United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 58

SEQ ID NO: 2440557 - DNA, 19 bp, Homo sapiens
gcccacgacactgcagccc

SEQ ID NO: 2440558 - DNA, 17 bp, Homo sapiens
gcccacgctcaccccct

SEQ ID NO: 2440559 - DNA, 22 bp, Homo sapiens
gcccacgtacccaggtctgggt

SEQ ID NO: 2440560 - DNA, 15 bp, Homo sapiens
gcccactccatctgg

SEQ ID NO: 2440561 - DNA, 15 bp, Homo sapiens
gcccactgtcctggg

SEQ ID NO: 2440562 - DNA, 18 bp, Homo sapiens
gcccactgtcctgggcct

SEQ ID NO: 2440563 - DNA, 23 bp, Homo sapiens
gcccactgtcctgggcctgcaga

SEQ ID NO: 2440564 - DNA, 19 bp, Homo sapiens
gcccacttacatttacaaa

SEQ ID NO: 2440565 - DNA, 23 bp, Homo sapiens
gcccagaataagttattgcagtt

SEQ ID NO: 2440566 - DNA, 13 bp, Homo sapiens
gcccagagcccag

SEQ ID NO: 2440567 - DNA, 18 bp, Homo sapiens
gcccagagcccagctcca

SEQ ID NO: 2440568 - DNA, 14 bp, Homo sapiens
gcccagccagcgtc

SEQ ID NO: 2440569 - DNA, 14 bp, Homo sapiens
gcccagcccaagtg

SEQ ID NO: 2440570 - DNA, 16 bp, Homo sapiens
gcccagccctaaacat

SEQ ID NO: 2440571 - DNA, 19 bp, Homo sapiens
gcccagctgggtcaggcag

SEQ ID NO: 2440572 - DNA, 20 bp, Homo sapiens
gcccaggaagtctcatctgg

SEQ ID NO: 2440573 - DNA, 11 bp, Homo sapiens
gcccaggagct

SEQ ID NO: 2440574 - DNA, 14 bp, Homo sapiens
gcccaggagctccc

SEQ ID NO: 2440575 - DNA, 11 bp, Homo sapiens
gcccaggccag

SEQ ID NO: 2440576 - DNA, 15 bp, Homo sapiens
gcccaggccaggact

SEQ ID NO: 2440577 - DNA, 21 bp, Homo sapiens
gcccaggccaggactctgcag

SEQ ID NO: 2440578 - DNA, 14 bp, Homo sapiens
gcccaggcctcacc

SEQ ID NO: 2440579 - DNA, 18 bp, Homo sapiens
gcccaggctcggcctgcc

SEQ ID NO: 2440580 - DNA, 14 bp, Homo sapiens
gcccagggcccaga

SEQ ID NO: 2440581 - DNA, 17 bp, Homo sapiens
gcccagggcccagagcc

SEQ ID NO: 2440582 - DNA, 21 bp, Homo sapiens
gcccagggcccagagcccagc

SEQ ID NO: 2440583 - DNA, 23 bp, Homo sapiens
gcccagggcccagagcccagctc

SEQ ID NO: 2440584 - DNA, 16 bp, Homo sapiens
gcccagggctcctgca

SEQ ID NO: 2440585 - DNA, 15 bp, Homo sapiens
gcccagggctgggag

SEQ ID NO: 2440586 - DNA, 21 bp, Homo sapiens
gcccagttggagactgtctgg

SEQ ID NO: 2440587 - DNA, 20 bp, Homo sapiens
gcccatatgctaccaccagc

SEQ ID NO: 2440588 - DNA, 12 bp, Homo sapiens
gcccatcagggt

SEQ ID NO: 2440589 - DNA, 21 bp, Homo sapiens
gcccatcagggtaggctggag

SEQ ID NO: 2440590 - DNA, 14 bp, Homo sapiens
gcccatccccttga

SEQ ID NO: 2440591 - DNA, 15 bp, Homo sapiens
gcccatcctgaccag

SEQ ID NO: 2440592 - DNA, 16 bp, Homo sapiens
gcccatcctgaccagc

SEQ ID NO: 2440593 - DNA, 20 bp, Homo sapiens
gcccatggacaggctggctc

SEQ ID NO: 2440594 - DNA, 21 bp, Homo sapiens
gcccatggacaggctggctcc

SEQ ID NO: 2440595 - DNA, 23 bp, Homo sapiens
gcccatggagattgacctggatg

SEQ ID NO: 2440596 - DNA, 15 bp, Homo sapiens
gccccaacccgtgga

SEQ ID NO: 2440597 - DNA, 19 bp, Homo sapiens
gccccaactccttccagct

SEQ ID NO: 2440598 - DNA, 15 bp, Homo sapiens
gccccaccccagggc

SEQ ID NO: 2440599 - DNA, 20 bp, Homo sapiens
gccccaccccagggcagcca

SEQ ID NO: 2440600 - DNA, 12 bp, Homo sapiens
gccccaccctgg

SEQ ID NO: 2440601 - DNA, 13 bp, Homo sapiens
gccccactcctct

SEQ ID NO: 2440602 - DNA, 14 bp, Homo sapiens
gccccacttgtcct

SEQ ID NO: 2440603 - DNA, 13 bp, Homo sapiens
gccccagcacagc

SEQ ID NO: 2440604 - DNA, 14 bp, Homo sapiens
gccccagcccagcc

SEQ ID NO: 2440605 - DNA, 22 bp, Homo sapiens
gccccagcccagccccactcct

SEQ ID NO: 2440606 - DNA, 16 bp, Homo sapiens
gccccaggaccagctc

SEQ ID NO: 2440607 - DNA, 18 bp, Homo sapiens
gccccaggaccagctcag

SEQ ID NO: 2440608 - DNA, 19 bp, Homo sapiens
gccccaggaccagctcagg

SEQ ID NO: 2440609 - DNA, 21 bp, Homo sapiens
gccccaggacctggctgccat

SEQ ID NO: 2440610 - DNA, 18 bp, Homo sapiens
gccccaggggaacactgg

SEQ ID NO: 2440611 - DNA, 22 bp, Homo sapiens
gccccagttcctgtggctccct

SEQ ID NO: 2440612 - DNA, 16 bp, Homo sapiens
gccccatgacctccag

SEQ ID NO: 2440613 - DNA, 17 bp, Homo sapiens
gccccatgacctccagc

SEQ ID NO: 2440614 - DNA, 12 bp, Homo sapiens
gccccattcctg

SEQ ID NO: 2440615 - DNA, 19 bp, Homo sapiens
gcccccaaggaggcagcct

SEQ ID NO: 2440616 - DNA, 14 bp, Homo sapiens
gcccccaccccatt

SEQ ID NO: 2440617 - DNA, 12 bp, Homo sapiens
gcccccaccctg

SEQ ID NO: 2440618 - DNA, 22 bp, Homo sapiens
gcccccaccgtgggcagggagc

SEQ ID NO: 2440619 - DNA, 13 bp, Homo sapiens
gcccccagagccc

SEQ ID NO: 2440620 - DNA, 18 bp, Homo sapiens
gcccccagagcccaggct

SEQ ID NO: 2440621 - DNA, 18 bp, Homo sapiens
gcccccagccccctcctg

SEQ ID NO: 2440622 - DNA, 22 bp, Homo sapiens
gcccccagcctgtcagatccag

SEQ ID NO: 2440623 - DNA, 18 bp, Homo sapiens
gcccccatctcatgcccc

SEQ ID NO: 2440624 - DNA, 17 bp, Homo sapiens
gcccccgccttggcctg

SEQ ID NO: 2440625 - DNA, 18 bp, Homo sapiens
gccccctccgccctgcca

SEQ ID NO: 2440626 - DNA, 20 bp, Homo sapiens
gccccctccgccctgccact

SEQ ID NO: 2440627 - DNA, 21 bp, Homo sapiens
gccccctcctctagctgtggg

SEQ ID NO: 2440628 - DNA, 18 bp, Homo sapiens
gccccctgaccactcaga

SEQ ID NO: 2440629 - DNA, 20 bp, Homo sapiens
gccccctgaccactcagaga

SEQ ID NO: 2440630 - DNA, 12 bp, Homo sapiens
gccccctgcaga

SEQ ID NO: 2440631 - DNA, 13 bp, Homo sapiens
gccccctgcagga

SEQ ID NO: 2440632 - DNA, 22 bp, Homo sapiens
gccccctgcaggaaggagctgc

SEQ ID NO: 2440633 - DNA, 13 bp, Homo sapiens
gccccgccctcat

SEQ ID NO: 2440634 - DNA, 13 bp, Homo sapiens
gccccgtgaggca

SEQ ID NO: 2440635 - DNA, 21 bp, Homo sapiens
gcccctagcgctatctccctg

SEQ ID NO: 2440636 - DNA, 22 bp, Homo sapiens
gagcaaccgtggcccttcctgg

SEQ ID NO: 2440637 - DNA, 20 bp, Homo sapiens
gagcacaaagaccctggctt

SEQ ID NO: 2440638 - DNA, 14 bp, Homo sapiens
gagcacctccacat

SEQ ID NO: 2440639 - DNA, 19 bp, Homo sapiens
gagcactgcacctgcctcc

SEQ ID NO: 2440640 - DNA, 12 bp, Homo sapiens
gagcactgccag

SEQ ID NO: 2440641 - DNA, 15 bp, Homo sapiens
gagcactgccaggag

SEQ ID NO: 2440642 - DNA, 19 bp, Homo sapiens
gagcactgccaggagggac

SEQ ID NO: 2440643 - DNA, 16 bp, Homo sapiens
gagcagaagcagcaac

SEQ ID NO: 2440644 - DNA, 15 bp, Homo sapiens
gagcagaggggctga

SEQ ID NO: 2440645 - DNA, 11 bp, Homo sapiens
gagcagcacct

SEQ ID NO: 2440646 - DNA, 15 bp, Homo sapiens
gagcagcacctcctc

SEQ ID NO: 2440647 - DNA, 21 bp, Homo sapiens
gagcagcacctcctcagcctg

SEQ ID NO: 2440648 - DNA, 21 bp, Homo sapiens
gagcagcaggaggggggaggg

SEQ ID NO: 2440649 - DNA, 15 bp, Homo sapiens
gagcagctgagcagg

SEQ ID NO: 2440650 - DNA, 16 bp, Homo sapiens
gagcagctgagcaggg

SEQ ID NO: 2440651 - DNA, 17 bp, Homo sapiens
gagcagctgagcagggc

SEQ ID NO: 2440652 - DNA, 18 bp, Homo sapiens
gagcagctgagcagggcc

SEQ ID NO: 2440653 - DNA, 19 bp, Homo sapiens
gagcagctgagcagggccg

SEQ ID NO: 2440654 - DNA, 15 bp, Homo sapiens
gagcaggactccagg

SEQ ID NO: 2440655 - DNA, 20 bp, Homo sapiens
gagcaggactccaggcccaa

SEQ ID NO: 2440656 - DNA, 20 bp, Homo sapiens
gagcaggactgatgtctcct

SEQ ID NO: 2440657 - DNA, 20 bp, Homo sapiens
gagcaggaggcctaggaggg

SEQ ID NO: 2440658 - DNA, 21 bp, Homo sapiens
gagcaggaggcctaggagggt

SEQ ID NO: 2440659 - DNA, 17 bp, Homo sapiens
gagcaggcagccagcat

SEQ ID NO: 2440660 - DNA, 19 bp, Homo sapiens
gagcaggcagccagcatct

SEQ ID NO: 2440661 - DNA, 16 bp, Homo sapiens
gagcagggccggggaa

SEQ ID NO: 2440662 - DNA, 16 bp, Homo sapiens
gagcagtcctgcctca

SEQ ID NO: 2440663 - DNA, 15 bp, Homo sapiens
gagcagtgcttttgg

SEQ ID NO: 2440664 - DNA, 22 bp, Homo sapiens
gagcataggtgatccatgtaac

SEQ ID NO: 2440665 - DNA, 17 bp, Homo sapiens
gagcatcatgcctctga

SEQ ID NO: 2440666 - DNA, 19 bp, Homo sapiens
gagcatcatgcctctgagg

SEQ ID NO: 2440667 - DNA, 21 bp, Homo sapiens
gagcatcatgcctctgaggcc

SEQ ID NO: 2440668 - DNA, 21 bp, Homo sapiens
gccacctctaacagcaccaaa

SEQ ID NO: 2440669 - DNA, 16 bp, Homo sapiens
gccacctggacccctg

SEQ ID NO: 2440670 - DNA, 18 bp, Homo sapiens
gccacctggacccctgca

SEQ ID NO: 2440671 - DNA, 14 bp, Homo sapiens
gccacgctccagct

SEQ ID NO: 2440672 - DNA, 21 bp, Homo sapiens
gccacgtgtttagacctagat

SEQ ID NO: 2440673 - DNA, 22 bp, Homo sapiens
gccactaaccttgcctggtaca

SEQ ID NO: 2440674 - DNA, 15 bp, Homo sapiens
gccactcactaggcc

SEQ ID NO: 2440675 - DNA, 13 bp, Homo sapiens
gccactcctctga

SEQ ID NO: 2440676 - DNA, 13 bp, Homo sapiens
gccactccttcct

SEQ ID NO: 2440677 - DNA, 22 bp, Homo sapiens
gcaaactgcatgcccagagacc

SEQ ID NO: 2440678 - DNA, 22 bp, Homo sapiens
gcaaactgggaacccctttccc

SEQ ID NO: 2440679 - DNA, 19 bp, Homo sapiens
gcaaagatctgtcctcagc

SEQ ID NO: 2440680 - DNA, 12 bp, Homo sapiens
gcaaagcacaga

SEQ ID NO: 2440681 - DNA, 19 bp, Homo sapiens
gcaaagcccccagagccca

SEQ ID NO: 2440682 - DNA, 21 bp, Homo sapiens
gcaaagcctgttcatggcaga

SEQ ID NO: 2440683 - DNA, 14 bp, Homo sapiens
gcaaatcatttgtt

SEQ ID NO: 2440684 - DNA, 18 bp, Homo sapiens
gcaaatcatttgtttaaa

SEQ ID NO: 2440685 - DNA, 12 bp, Homo sapiens
gcaaatcttgaa

SEQ ID NO: 2440686 - DNA, 19 bp, Homo sapiens
gcaaatgtcatgctgcctt

SEQ ID NO: 2440687 - DNA, 20 bp, Homo sapiens
gcaacaaggtcctctgtcag

SEQ ID NO: 2440688 - DNA, 18 bp, Homo sapiens
gcaacactggtctgctgt

SEQ ID NO: 2440689 - DNA, 14 bp, Homo sapiens
gcaacagatctgga

SEQ ID NO: 2440690 - DNA, 16 bp, Homo sapiens
gcaacagatctggaac

SEQ ID NO: 2440691 - DNA, 20 bp, Homo sapiens
gcaacagatctggaacctca

SEQ ID NO: 2440692 - DNA, 22 bp, Homo sapiens
gcaacagatctggaacctcagc

SEQ ID NO: 2440693 - DNA, 13 bp, Homo sapiens
gcaacatccaaaa

SEQ ID NO: 2440694 - DNA, 14 bp, Homo sapiens
gcacgtgtgttttt

SEQ ID NO: 2440695 - DNA, 18 bp, Homo sapiens
gcacgtgtgtttttctat

SEQ ID NO: 2440696 - DNA, 23 bp, Homo sapiens
gcacgtgtgtttttctattaaaa

SEQ ID NO: 2440697 - DNA, 20 bp, Homo sapiens
gcactaacgttgagcccctg

SEQ ID NO: 2440698 - DNA, 17 bp, Homo sapiens
gcactagccaaacctca

SEQ ID NO: 2440699 - DNA, 19 bp, Homo sapiens
gcactcaaccttaagacct

SEQ ID NO: 2440700 - DNA, 12 bp, Homo sapiens
gcactctagatt

SEQ ID NO: 2440701 - DNA, 19 bp, Homo sapiens
gcactgacggactcatgat

SEQ ID NO: 2440702 - DNA, 20 bp, Homo sapiens
gcactgactgggaccaggca

SEQ ID NO: 2440703 - DNA, 17 bp, Homo sapiens
gcactgatgttgtgttt

SEQ ID NO: 2440704 - DNA, 13 bp, Homo sapiens
gcactgccactgg

SEQ ID NO: 2440705 - DNA, 14 bp, Homo sapiens
gcactgccactggg

SEQ ID NO: 2440706 - DNA, 15 bp, Homo sapiens
gcactgccaggaggg

SEQ ID NO: 2440707 - DNA, 20 bp, Homo sapiens
gcactgggaggctccccttc

SEQ ID NO: 2440708 - DNA, 13 bp, Homo sapiens
gcactgtaaaatg

SEQ ID NO: 2440709 - DNA, 17 bp, Homo sapiens
gcactgtagttctaaga

SEQ ID NO: 2440710 - DNA, 15 bp, Homo sapiens
gcactgttccccctg

SEQ ID NO: 2440711 - DNA, 18 bp, Homo sapiens
gcacttcaaattcaaata

SEQ ID NO: 2440712 - DNA, 20 bp, Homo sapiens
gcacttcctctcgcggccct

SEQ ID NO: 2440713 - DNA, 23 bp, Homo sapiens
gcacttctttttctcgctgtcct

SEQ ID NO: 2440714 - DNA, 13 bp, Homo sapiens
gcacttggccctt

SEQ ID NO: 2440715 - DNA, 22 bp, Homo sapiens
gcacttgggggttcaggcccgg

SEQ ID NO: 2440716 - DNA, 16 bp, Homo sapiens
gcacttgtccagctga

SEQ ID NO: 2440717 - DNA, 19 bp, Homo sapiens
gcactttgctttaatataa

SEQ ID NO: 2440718 - DNA, 20 bp, Homo sapiens
gcactttgctttaatataaa

SEQ ID NO: 2440719 - DNA, 20 bp, Homo sapiens
gcactttggcttataattct

SEQ ID NO: 2440720 - DNA, 21 bp, Homo sapiens
gcactttggcttataattctt

SEQ ID NO: 2440721 - DNA, 17 bp, Homo sapiens
gcagaaaacccttgggc

SEQ ID NO: 2440722 - DNA, 17 bp, Homo sapiens
gcagaaaattctgtgcc

SEQ ID NO: 2440723 - DNA, 19 bp, Homo sapiens
gcagaaagtgcctttcagg

SEQ ID NO: 2440724 - DNA, 16 bp, Homo sapiens
gcagacagagccagga

SEQ ID NO: 2440725 - DNA, 18 bp, Homo sapiens
gcagacagagccaggaga

SEQ ID NO: 2440726 - DNA, 17 bp, Homo sapiens
gcagaccacattgcttt

SEQ ID NO: 2440727 - DNA, 20 bp, Homo sapiens
gcagaccacgcccgtcctgc

SEQ ID NO: 2440728 - DNA, 23 bp, Homo sapiens
gcagaccacgcccgtcctgcctg

SEQ ID NO: 2440729 - DNA, 15 bp, Homo sapiens
gcagaccctgccctt

SEQ ID NO: 2440730 - DNA, 18 bp, Homo sapiens
gcagacttcccagctagg

SEQ ID NO: 2440731 - DNA, 21 bp, Homo sapiens
gcagagaggtttgcagtccca

SEQ ID NO: 2440732 - DNA, 22 bp, Homo sapiens
gcagagaggtttgcagtcccaa

SEQ ID NO: 2440733 - DNA, 16 bp, Homo sapiens
gcagagcccaagggaa

SEQ ID NO: 2440734 - DNA, 14 bp, Homo sapiens
gcagagctggctct

SEQ ID NO: 2440735 - DNA, 18 bp, Homo sapiens
gcagaggcagtacctggg

SEQ ID NO: 2440736 - DNA, 15 bp, Homo sapiens
gcagaggccagaggc

SEQ ID NO: 2440737 - DNA, 20 bp, Homo sapiens
gcagagggctggaggcccag

SEQ ID NO: 2440738 - DNA, 13 bp, Homo sapiens
gcagaggggcaga

SEQ ID NO: 2440739 - DNA, 15 bp, Homo sapiens
gcagaggggcagagg

SEQ ID NO: 2440740 - DNA, 17 bp, Homo sapiens
gcagagttacagttctg

SEQ ID NO: 2440741 - DNA, 21 bp, Homo sapiens
gcagagttacagttctgtggt

SEQ ID NO: 2440742 - DNA, 13 bp, Homo sapiens
gcagatgtaggag

SEQ ID NO: 2440743 - DNA, 15 bp, Homo sapiens
gcagatgtaggaggg

SEQ ID NO: 2440744 - DNA, 19 bp, Homo sapiens
gcagattcagaaatgaggc

SEQ ID NO: 2440745 - DNA, 15 bp, Homo sapiens
gcagcaacttgtcct

SEQ ID NO: 2440746 - DNA, 14 bp, Homo sapiens
gcagcacctgccct

SEQ ID NO: 2440747 - DNA, 11 bp, Homo sapiens
gcagcagccag

SEQ ID NO: 2440748 - DNA, 12 bp, Homo sapiens
gcagcagccagc

SEQ ID NO: 2440749 - DNA, 21 bp, Homo sapiens
gcagcagccagccctgcctgg

SEQ ID NO: 2440750 - DNA, 22 bp, Homo sapiens
gcagcagcccccagctcccacc

SEQ ID NO: 2440751 - DNA, 20 bp, Homo sapiens
gcagcagcctcgcccctggc

SEQ ID NO: 2440752 - DNA, 23 bp, Homo sapiens
gcagcagcctcgcccctggcaga

SEQ ID NO: 2440753 - DNA, 19 bp, Homo sapiens
gcagcaggaggggggaggg

SEQ ID NO: 2440754 - DNA, 23 bp, Homo sapiens
gcagcatcggacaagacccccag

SEQ ID NO: 2440755 - DNA, 20 bp, Homo sapiens
gcagcatctctaccttctcc

SEQ ID NO: 2440756 - DNA, 18 bp, Homo sapiens
gcagccacacttctcagg

SEQ ID NO: 2440757 - DNA, 19 bp, Homo sapiens
gcagccacacttctcagga

SEQ ID NO: 2440758 - DNA, 20 bp, Homo sapiens
gcagccacacttctcaggac

SEQ ID NO: 2440759 - DNA, 16 bp, Homo sapiens
gcagccaccctgagga

SEQ ID NO: 2440760 - DNA, 20 bp, Homo sapiens
gcagccaccctgaggagtct

SEQ ID NO: 2440761 - DNA, 14 bp, Homo sapiens
gcagccagcatctg

SEQ ID NO: 2440762 - DNA, 19 bp, Homo sapiens
gcagccagccctgcctgga

SEQ ID NO: 2440763 - DNA, 14 bp, Homo sapiens
gcagccagggagag

SEQ ID NO: 2440764 - DNA, 17 bp, Homo sapiens
gcagccagggagagccc

SEQ ID NO: 2440765 - DNA, 18 bp, Homo sapiens
gcagccagggagagccca

SEQ ID NO: 2440766 - DNA, 16 bp, Homo sapiens
gcagccagtgccctga

SEQ ID NO: 2440767 - DNA, 19 bp, Homo sapiens
gcagccagtgccctgagcc

SEQ ID NO: 2440768 - DNA, 16 bp, Homo sapiens
gcagcccaggaagtct

SEQ ID NO: 2440769 - DNA, 19 bp, Homo sapiens
gcagcccccacccccaagg

SEQ ID NO: 2440770 - DNA, 19 bp, Homo sapiens
gcagcccccagctcccacc

SEQ ID NO: 2440771 - DNA, 19 bp, Homo sapiens
gcagccgaggtccctgctg

SEQ ID NO: 2440772 - DNA, 18 bp, Homo sapiens
gcagccggcacagggtct

SEQ ID NO: 2440773 - DNA, 21 bp, Homo sapiens
gcagcctcaggactgggagcc

SEQ ID NO: 2440774 - DNA, 21 bp, Homo sapiens
gcagcctcccatccagggccc

SEQ ID NO: 2440775 - DNA, 12 bp, Homo sapiens
gcagcctctccc

SEQ ID NO: 2440776 - DNA, 22 bp, Homo sapiens
gcagcctctggggggtggccag

SEQ ID NO: 2440777 - DNA, 18 bp, Homo sapiens
gcagcctttgcctccccg

SEQ ID NO: 2440778 - DNA, 18 bp, Homo sapiens
gcagcgaccgccccctcc

SEQ ID NO: 2440779 - DNA, 16 bp, Homo sapiens
gcagctcaagagatcc

SEQ ID NO: 2440780 - DNA, 18 bp, Homo sapiens
gcagctcaagagatccca

SEQ ID NO: 2440781 - DNA, 20 bp, Homo sapiens
gcagctcctctgtctcgagc

SEQ ID NO: 2440782 - DNA, 14 bp, Homo sapiens
gatagaaatgccaa

SEQ ID NO: 2440783 - DNA, 16 bp, Homo sapiens
gatagatgctggccca

SEQ ID NO: 2440784 - DNA, 17 bp, Homo sapiens
gatagccctgtcctggt

SEQ ID NO: 2440785 - DNA, 21 bp, Homo sapiens
gatagccctgtcctggtggta

SEQ ID NO: 2440786 - DNA, 19 bp, Homo sapiens
gataggaagaaagaagaca

SEQ ID NO: 2440787 - DNA, 13 bp, Homo sapiens
gataggccagccg

SEQ ID NO: 2440788 - DNA, 22 bp, Homo sapiens
gatagttttcatccataactga

SEQ ID NO: 2440789 - DNA, 17 bp, Homo sapiens
gatatactctagatgaa

SEQ ID NO: 2440790 - DNA, 23 bp, Homo sapiens
gatatcgacttgtttttgcacat

SEQ ID NO: 2440791 - DNA, 15 bp, Homo sapiens
gatatgaaagctgat

SEQ ID NO: 2440792 - DNA, 17 bp, Homo sapiens
gatatgcatatttgttt

SEQ ID NO: 2440793 - DNA, 12 bp, Homo sapiens
gatatgcttgta

SEQ ID NO: 2440794 - DNA, 17 bp, Homo sapiens
gatattaatgcccagac

SEQ ID NO: 2440795 - DNA, 22 bp, Homo sapiens
gatattcctattgtgcaatgta

SEQ ID NO: 2440796 - DNA, 22 bp, Homo sapiens
gatatttgtcatgctgggattt

SEQ ID NO: 2440797 - DNA, 15 bp, Homo sapiens
gatcaaagatgaaaa

SEQ ID NO: 2440798 - DNA, 13 bp, Homo sapiens
gatcaaggcctta

SEQ ID NO: 2440799 - DNA, 23 bp, Homo sapiens
gatcaaggccttattggaaagca

SEQ ID NO: 2440800 - DNA, 16 bp, Homo sapiens
gatcaattatagtttc

SEQ ID NO: 2440801 - DNA, 19 bp, Homo sapiens
gatcaattatagtttctga

SEQ ID NO: 2440802 - DNA, 21 bp, Homo sapiens
gatcaattatagtttctgagg

SEQ ID NO: 2440803 - DNA, 17 bp, Homo sapiens
gagctgaggccacactc

SEQ ID NO: 2440804 - DNA, 15 bp, Homo sapiens
gagctgcctggaccc

SEQ ID NO: 2440805 - DNA, 14 bp, Homo sapiens
gagctgggcctggt

SEQ ID NO: 2440806 - DNA, 15 bp, Homo sapiens
gagcttaaaatacaa

SEQ ID NO: 2440807 - DNA, 22 bp, Homo sapiens
gagcttaatctttgaaaggtta

SEQ ID NO: 2440808 - DNA, 15 bp, Homo sapiens
gagctttgactcagg

SEQ ID NO: 2440809 - DNA, 18 bp, Homo sapiens
gagctttgactcaggagc

SEQ ID NO: 2440810 - DNA, 19 bp, Homo sapiens
gaggaaggggccagaggct

SEQ ID NO: 2440811 - DNA, 17 bp, Homo sapiens
gaggaatactgaacatc

SEQ ID NO: 2440812 - DNA, 19 bp, Homo sapiens
gaggaatctgtgggtctgg

SEQ ID NO: 2440813 - DNA, 20 bp, Homo sapiens
gaggaatctgtgggtctggg

SEQ ID NO: 2440814 - DNA, 13 bp, Homo sapiens
gaggacacagaga

SEQ ID NO: 2440815 - DNA, 22 bp, Homo sapiens
gaggacagatgcctccttcctc

SEQ ID NO: 2440816 - DNA, 11 bp, Homo sapiens
gaggacccagg

SEQ ID NO: 2440817 - DNA, 12 bp, Homo sapiens
gaggacccagga

SEQ ID NO: 2440818 - DNA, 20 bp, Homo sapiens
gaggacccaggaaaggcagg

SEQ ID NO: 2440819 - DNA, 14 bp, Homo sapiens
gaggacccagggct

SEQ ID NO: 2440820 - DNA, 15 bp, Homo sapiens
gaggacccagggctc

SEQ ID NO: 2440821 - DNA, 14 bp, Homo sapiens
gaggacctgagcct

SEQ ID NO: 2440822 - DNA, 17 bp, Homo sapiens
gaggacctgagcctgcc

SEQ ID NO: 2440823 - DNA, 21 bp, Homo sapiens
gaggagcagcaggagggggga

SEQ ID NO: 2440824 - DNA, 18 bp, Homo sapiens
gaggagccaccagttctc

SEQ ID NO: 2440825 - DNA, 12 bp, Homo sapiens
gaggagcccagg

SEQ ID NO: 2440826 - DNA, 20 bp, Homo sapiens
gaggagcccaggccaggact

SEQ ID NO: 2440827 - DNA, 16 bp, Homo sapiens
gaggagcctgtcctgc

SEQ ID NO: 2440828 - DNA, 18 bp, Homo sapiens
gaggagcctgtcctgcct

SEQ ID NO: 2440829 - DNA, 14 bp, Homo sapiens
gaggaggagggagg

SEQ ID NO: 2440830 - DNA, 22 bp, Homo sapiens
gaggagggaggccgggcggtca

SEQ ID NO: 2440831 - DNA, 22 bp, Homo sapiens
gaggagtaacaatacaaatgga

SEQ ID NO: 2440832 - DNA, 14 bp, Homo sapiens
gagtattaaaatgt

SEQ ID NO: 2440833 - DNA, 15 bp, Homo sapiens
gagtccaagaatcca

SEQ ID NO: 2440834 - DNA, 19 bp, Homo sapiens
gagtccaaggtttaaagag

SEQ ID NO: 2440835 - DNA, 13 bp, Homo sapiens
gagtccactttgt

SEQ ID NO: 2440836 - DNA, 22 bp, Homo sapiens
gagtccactttgtttcgtgggg

SEQ ID NO: 2440837 - DNA, 16 bp, Homo sapiens
gagtcccctcacctcc

SEQ ID NO: 2440838 - DNA, 22 bp, Homo sapiens
gagtcgtggggtgtgctgggag

SEQ ID NO: 2440839 - DNA, 12 bp, Homo sapiens
gagtctaaagat

SEQ ID NO: 2440840 - DNA, 13 bp, Homo sapiens
gagtctaaagatg

SEQ ID NO: 2440841 - DNA, 11 bp, Homo sapiens
gagtctagatt

SEQ ID NO: 2440842 - DNA, 13 bp, Homo sapiens
gagtctagattca

SEQ ID NO: 2440843 - DNA, 13 bp, Homo sapiens
gagtctagattct

SEQ ID NO: 2440844 - DNA, 14 bp, Homo sapiens
gagtctagattctc

SEQ ID NO: 2440845 - DNA, 13 bp, Homo sapiens
gagtctctctggg

SEQ ID NO: 2440846 - DNA, 15 bp, Homo sapiens
gagtctgaggtcctg

SEQ ID NO: 2440847 - DNA, 16 bp, Homo sapiens
gagtctgaggtcctga

SEQ ID NO: 2440848 - DNA, 23 bp, Homo sapiens
gagtctgaggtcctgagcactgc

SEQ ID NO: 2440849 - DNA, 21 bp, Homo sapiens
gagtctgccagggcccctctc

SEQ ID NO: 2440850 - DNA, 18 bp, Homo sapiens
gagtctttggttctaagg

SEQ ID NO: 2440851 - DNA, 15 bp, Homo sapiens
gagtgaattccctca

SEQ ID NO: 2440852 - DNA, 18 bp, Homo sapiens
gagtgaattccctcactc

SEQ ID NO: 2440853 - DNA, 22 bp, Homo sapiens
gagtgagacccagccctcatcc

SEQ ID NO: 2440854 - DNA, 14 bp, Homo sapiens
gagtgagtggccct

SEQ ID NO: 2440855 - DNA, 18 bp, Homo sapiens
gagtgcagtcctgatcag

SEQ ID NO: 2440856 - DNA, 18 bp, Homo sapiens
gagtgcggaccaccctca

SEQ ID NO: 2440857 - DNA, 12 bp, Homo sapiens
gagtgctgtttt

SEQ ID NO: 2440858 - DNA, 15 bp, Homo sapiens
gagtgctgttttgtt

SEQ ID NO: 2440859 - DNA, 19 bp, Homo sapiens
gagtgcttgcttttcatgc

SEQ ID NO: 2440860 - DNA, 22 bp, Homo sapiens
gagtggccctttcggatccagg

SEQ ID NO: 2440861 - DNA, 14 bp, Homo sapiens
gagtgggtggggag

SEQ ID NO: 2440862 - DNA, 22 bp, Homo sapiens
gagtgtattttttaaaattgat

SEQ ID NO: 2440863 - DNA, 13 bp, Homo sapiens
gagtgtctttcca

SEQ ID NO: 2440864 - DNA, 15 bp, Homo sapiens
gagtgtctttccacg

SEQ ID NO: 2440865 - DNA, 21 bp, Homo sapiens
gagtgtctttccacggagcca

SEQ ID NO: 2440866 - DNA, 15 bp, Homo sapiens
gagtgtggactctgg

SEQ ID NO: 2440867 - DNA, 19 bp, Homo sapiens
gagtgttccccttccactg

SEQ ID NO: 2440868 - DNA, 13 bp, Homo sapiens
gagtgttccctat

SEQ ID NO: 2440869 - DNA, 12 bp, Homo sapiens
gagttaagacct

SEQ ID NO: 2440870 - DNA, 13 bp, Homo sapiens
gagttacagttct

SEQ ID NO: 2440871 - DNA, 15 bp, Homo sapiens
gagttacagttctgt

SEQ ID NO: 2440872 - DNA, 21 bp, Homo sapiens
gagttctttttgaagtattta

SEQ ID NO: 2440873 - DNA, 14 bp, Homo sapiens
gagttgatctggaa

SEQ ID NO: 2440874 - DNA, 17 bp, Homo sapiens
gagttgatctggaaccc

SEQ ID NO: 2440875 - DNA, 20 bp, Homo sapiens
gagttgatctggaacccaga

SEQ ID NO: 2440876 - DNA, 15 bp, Homo sapiens
gagtttcatgtacaa

SEQ ID NO: 2440877 - DNA, 18 bp, Homo sapiens
gagtttcatgtacaagat

SEQ ID NO: 2440878 - DNA, 12 bp, Homo sapiens
gagtttctaagg

SEQ ID NO: 2440879 - DNA, 19 bp, Homo sapiens
gagtttggagagagcagac

SEQ ID NO: 2440880 - DNA, 17 bp, Homo sapiens
gagtttgtcgctcatgt

SEQ ID NO: 2440881 - DNA, 13 bp, Homo sapiens
gagttttgtgttt

SEQ ID NO: 2440882 - DNA, 18 bp, Homo sapiens
gagttttgtgtttgttgt

SEQ ID NO: 2440883 - DNA, 22 bp, Homo sapiens
gagttttgtgtttgttgtagat

SEQ ID NO: 2440884 - DNA, 17 bp, Homo sapiens
gagttttgtttcctctg

SEQ ID NO: 2440885 - DNA, 16 bp, Homo sapiens
gagttttttgtaccaa

SEQ ID NO: 2440886 - DNA, 13 bp, Homo sapiens
gataaaagatggc

SEQ ID NO: 2440887 - DNA, 16 bp, Homo sapiens
gataaaagatggccat

SEQ ID NO: 2440888 - DNA, 15 bp, Homo sapiens
gataaacacaagatt

SEQ ID NO: 2440889 - DNA, 21 bp, Homo sapiens
gataaatattgagcagatcta

SEQ ID NO: 2440890 - DNA, 22 bp, Homo sapiens
gataagagtagaaactgcaggg

SEQ ID NO: 2440891 - DNA, 16 bp, Homo sapiens
gataagagttggctgg

SEQ ID NO: 2440892 - DNA, 15 bp, Homo sapiens
gataaggcctgtggg

SEQ ID NO: 2440893 - DNA, 17 bp, Homo sapiens
gataaggtaaaatgcca

SEQ ID NO: 2440894 - DNA, 12 bp, Homo sapiens
gataatagattc

SEQ ID NO: 2440895 - DNA, 13 bp, Homo sapiens
gataatagattct

SEQ ID NO: 2440896 - DNA, 12 bp, Homo sapiens
gataattttaaa

SEQ ID NO: 2440897 - DNA, 15 bp, Homo sapiens
gataccagcgaggag

SEQ ID NO: 2440898 - DNA, 13 bp, Homo sapiens
gataccagctgga

SEQ ID NO: 2440899 - DNA, 21 bp, Homo sapiens
gatacccccctctgtcttgtg

SEQ ID NO: 2440900 - DNA, 13 bp, Homo sapiens
gatactaaggacg

SEQ ID NO: 2440901 - DNA, 22 bp, Homo sapiens
gatactaataaactaataattg

SEQ ID NO: 2440902 - DNA, 17 bp, Homo sapiens
gatactgcgactttctg

SEQ ID NO: 2440903 - DNA, 18 bp, Homo sapiens
gatactgcgactttctgc

SEQ ID NO: 2440904 - DNA, 21 bp, Homo sapiens
gatactgcgactttctgcctg

SEQ ID NO: 2440905 - DNA, 14 bp, Homo sapiens
gatactgttgcacg

SEQ ID NO: 2440906 - DNA, 19 bp, Homo sapiens
gatactgttgcacgtgtgt

SEQ ID NO: 2440907 - DNA, 20 bp, Homo sapiens
gatacttcgacactgttctt

SEQ ID NO: 2440908 - DNA, 23 bp, Homo sapiens
gatacttcgacactgttcttagc

SEQ ID NO: 2440909 - DNA, 23 bp, Homo sapiens
gatacttggatttagtttcagta

SEQ ID NO: 2440910 - DNA, 13 bp, Homo sapiens
gatagaaatgcca

SEQ ID NO: 2440911 - DNA, 24 bp, Homo sapiens
gactggcatactatgtggatgtga

SEQ ID NO: 2440912 - DNA, 12 bp, Homo sapiens
gactggccaggg

SEQ ID NO: 2440913 - DNA, 15 bp, Homo sapiens
gactggccagggcca

SEQ ID NO: 2440914 - DNA, 17 bp, Homo sapiens
gactgggagcccccagc

SEQ ID NO: 2440915 - DNA, 23 bp, Homo sapiens
gactgggagcccccagcctgtca

SEQ ID NO: 2440916 - DNA, 15 bp, Homo sapiens
gactgggctgaggga

SEQ ID NO: 2440917 - DNA, 14 bp, Homo sapiens
gactggggcagggt

SEQ ID NO: 2440918 - DNA, 13 bp, Homo sapiens
gactgtaagttgg

SEQ ID NO: 2440919 - DNA, 14 bp, Homo sapiens
gactgtctggggag

SEQ ID NO: 2440920 - DNA, 15 bp, Homo sapiens
gactgtctggggagc

SEQ ID NO: 2440921 - DNA, 22 bp, Homo sapiens
gacttaagcatctggctctaat

SEQ ID NO: 2440922 - DNA, 12 bp, Homo sapiens
gacttactctaa

SEQ ID NO: 2440923 - DNA, 14 bp, Homo sapiens
gacttactctaaga

SEQ ID NO: 2440924 - DNA, 21 bp, Homo sapiens
gacttagaaaaccagctcagc

SEQ ID NO: 2440925 - DNA, 17 bp, Homo sapiens
gacttagggcaccaggg

SEQ ID NO: 2440926 - DNA, 13 bp, Homo sapiens
gacttcccagcta

SEQ ID NO: 2440927 - DNA, 18 bp, Homo sapiens
gacttcccagctaggaag

SEQ ID NO: 2440928 - DNA, 22 bp, Homo sapiens
gacttcctgtccagctccaacc

SEQ ID NO: 2440929 - DNA, 13 bp, Homo sapiens
gacttctgcctgg

SEQ ID NO: 2440930 - DNA, 14 bp, Homo sapiens
gacttctgcctgga

SEQ ID NO: 2440931 - DNA, 17 bp, Homo sapiens
gacttctgcctggagac

SEQ ID NO: 2440932 - DNA, 13 bp, Homo sapiens
gacttctggggta

SEQ ID NO: 2440933 - DNA, 13 bp, Homo sapiens
gacttgaaagaaa

SEQ ID NO: 2440934 - DNA, 12 bp, Homo sapiens
gacttggcctct

SEQ ID NO: 2440935 - DNA, 19 bp, Homo sapiens
gacttgtatattttaagaa

SEQ ID NO: 2440936 - DNA, 13 bp, Homo sapiens
gacttgtgtccca

SEQ ID NO: 2440937 - DNA, 23 bp, Homo sapiens
gacttgttggcgtaggctacaga

SEQ ID NO: 2440938 - DNA, 18 bp, Homo sapiens
gactttaacataagctat

SEQ ID NO: 2440939 - DNA, 11 bp, Homo sapiens
gactttcccca

SEQ ID NO: 2440940 - DNA, 21 bp, Homo sapiens
gactttccccaccagatgctg

SEQ ID NO: 2440941 - DNA, 18 bp, Homo sapiens
gactttcttttttgatat

SEQ ID NO: 2440942 - DNA, 11 bp, Homo sapiens
gactttgacaa

SEQ ID NO: 2440943 - DNA, 21 bp, Homo sapiens
gactttgcagccggcacaggg

SEQ ID NO: 2440944 - DNA, 12 bp, Homo sapiens
gactttgcttgc

SEQ ID NO: 2440945 - DNA, 14 bp, Homo sapiens
gactttgcttgctt

SEQ ID NO: 2440946 - DNA, 15 bp, Homo sapiens
gactttgcttgcttt

SEQ ID NO: 2440947 - DNA, 13 bp, Homo sapiens
gacttttctgtaa

SEQ ID NO: 2440948 - DNA, 14 bp, Homo sapiens
ctcttccatgctgt

SEQ ID NO: 2440949 - DNA, 16 bp, Homo sapiens
ctcttccatgctgtgc

SEQ ID NO: 2440950 - DNA, 16 bp, Homo sapiens
ctcttccccagacgcc

SEQ ID NO: 2440951 - DNA, 15 bp, Homo sapiens
ctcttcccccaagat

SEQ ID NO: 2440952 - DNA, 17 bp, Homo sapiens
ctcttccccctctccca

SEQ ID NO: 2440953 - DNA, 18 bp, Homo sapiens
ctcttcctactggtctct

SEQ ID NO: 2440954 - DNA, 16 bp, Homo sapiens
ctcttccttttatcag

SEQ ID NO: 2440955 - DNA, 14 bp, Homo sapiens
ctcttctactcact

SEQ ID NO: 2440956 - DNA, 13 bp, Homo sapiens
ctcttctctccag

SEQ ID NO: 2440957 - DNA, 21 bp, Homo sapiens
ctcttctggggcaggctgggc

SEQ ID NO: 2440958 - DNA, 15 bp, Homo sapiens
ctcttgagcagtggc

SEQ ID NO: 2440959 - DNA, 19 bp, Homo sapiens
ctcttgatacccccctctg

SEQ ID NO: 2440960 - DNA, 20 bp, Homo sapiens
ctcttgcacagtcactgctc

SEQ ID NO: 2440961 - DNA, 19 bp, Homo sapiens
ctcttggagaagtctcagc

SEQ ID NO: 2440962 - DNA, 12 bp, Homo sapiens
ctcttggctgga

SEQ ID NO: 2440963 - DNA, 14 bp, Homo sapiens
ctcttggctggacc

SEQ ID NO: 2440964 - DNA, 20 bp, Homo sapiens
ctcttggctggacccagcca

SEQ ID NO: 2440965 - DNA, 21 bp, Homo sapiens
ctcttgtaatccgaatctctt

SEQ ID NO: 2440966 - DNA, 16 bp, Homo sapiens
ctcttgttgagccgtg

SEQ ID NO: 2440967 - DNA, 21 bp, Homo sapiens
ctcttgttgagccgtgggcaa

SEQ ID NO: 2440968 - DNA, 21 bp, Homo sapiens
ctctttatgcttgcaaaaact

SEQ ID NO: 2440969 - DNA, 22 bp, Homo sapiens
ctctttcaagcagtcgtgcctg

SEQ ID NO: 2440970 - DNA, 11 bp, Homo sapiens
ctctttcagct

SEQ ID NO: 2440971 - DNA, 15 bp, Homo sapiens
ctctttcagctcctg

SEQ ID NO: 2440972 - DNA, 15 bp, Homo sapiens
ctctttccctggtcc

SEQ ID NO: 2440973 - DNA, 12 bp, Homo sapiens
ctctttctctgc

SEQ ID NO: 2440974 - DNA, 15 bp, Homo sapiens
ctctttctctgccag

SEQ ID NO: 2440975 - DNA, 16 bp, Homo sapiens
ctctttctctgccagt

SEQ ID NO: 2440976 - DNA, 13 bp, Homo sapiens
ctctttctgtata

SEQ ID NO: 2440977 - DNA, 10 bp, Homo sapiens
ctctttgaga

SEQ ID NO: 2440978 - DNA, 21 bp, Homo sapiens
ctctttggcgacctcctttca

SEQ ID NO: 2440979 - DNA, 18 bp, Homo sapiens
ctctttggctcccctgta

SEQ ID NO: 2440980 - DNA, 20 bp, Homo sapiens
ctctttgttttgtgtctctt

SEQ ID NO: 2440981 - DNA, 21 bp, Homo sapiens
ctcttttgctttattccagaa

SEQ ID NO: 2440982 - DNA, 15 bp, Homo sapiens
ctgaaaaaaaacctg

SEQ ID NO: 2440983 - DNA, 18 bp, Homo sapiens
ctgaaaatgtccttgtga

SEQ ID NO: 2440984 - DNA, 14 bp, Homo sapiens
ctgaaaccagtgtt

SEQ ID NO: 2440985 - DNA, 13 bp, Homo sapiens
ctgaaatgaagat

SEQ ID NO: 2440986 - DNA, 13 bp, Homo sapiens
ctgaaattccaaa

SEQ ID NO: 2440987 - DNA, 14 bp, Homo sapiens
ctgaaattccaaag

SEQ ID NO: 2440988 - DNA, 16 bp, Homo sapiens
ctgaaattccaaagtc

SEQ ID NO: 2440989 - DNA, 18 bp, Homo sapiens
ctgaaattccaaagtctc

SEQ ID NO: 2440990 - DNA, 18 bp, Homo sapiens
ctgaaattctcctggagg

SEQ ID NO: 2440991 - DNA, 18 bp, Homo sapiens
ctgaacaccattgaaggc

SEQ ID NO: 2440992 - DNA, 13 bp, Homo sapiens
ctgaacagctggt

SEQ ID NO: 2440993 - DNA, 14 bp, Homo sapiens
ctgaacagctggtg

SEQ ID NO: 2440994 - DNA, 12 bp, Homo sapiens
ctgaacagtgga

SEQ ID NO: 2440995 - DNA, 23 bp, Homo sapiens
ctgaacatctgagtcctggatga

SEQ ID NO: 2440996 - DNA, 14 bp, Homo sapiens
ctgaaccccagggc

SEQ ID NO: 2440997 - DNA, 23 bp, Homo sapiens
ctgaacctatttcttaaacactt

SEQ ID NO: 2440998 - DNA, 14 bp, Homo sapiens
ctgaagaaccagtc

SEQ ID NO: 2440999 - DNA, 15 bp, Homo sapiens
ctgaagcagcctctc

SEQ ID NO: 2441000 - DNA, 16 bp, Homo sapiens
ctgaagcagcctctcc

SEQ ID NO: 2441001 - DNA, 20 bp, Homo sapiens
ctgaagcaggttcccaagct

SEQ ID NO: 2441002 - DNA, 13 bp, Homo sapiens
ctgaaggagcccc

SEQ ID NO: 2441003 - DNA, 19 bp, Homo sapiens
ctgaaggcctgaggttact

SEQ ID NO: 2441004 - DNA, 16 bp, Homo sapiens
ctgaagggggcggcct

SEQ ID NO: 2441005 - DNA, 16 bp, Homo sapiens
ctgaagtgcttagtgt

SEQ ID NO: 2441006 - DNA, 15 bp, Homo sapiens
ctgaatagatatgaa

SEQ ID NO: 2441007 - DNA, 17 bp, Homo sapiens
ctgaatatacagcaggt

SEQ ID NO: 2441008 - DNA, 13 bp, Homo sapiens
ctgaatgcttcta

SEQ ID NO: 2441009 - DNA, 22 bp, Homo sapiens
ctgaatgtcattgaaaaactaa

SEQ ID NO: 2441010 - DNA, 15 bp, Homo sapiens
ctgaatgttgggact

SEQ ID NO: 2441011 - DNA, 19 bp, Homo sapiens
ctgaatgttgggactgcta

SEQ ID NO: 2441012 - DNA, 14 bp, Homo sapiens
ctgaatgtttttct

SEQ ID NO: 2441013 - DNA, 17 bp, Homo sapiens
ctgaatgtttttctaaa

SEQ ID NO: 2441014 - DNA, 20 bp, Homo sapiens
ctgaatgtttttctaaagga

SEQ ID NO: 2441015 - DNA, 23 bp, Homo sapiens
ctgaatgtttttctaaaggagtt

SEQ ID NO: 2441016 - DNA, 11 bp, Homo sapiens
ctgaattttta

SEQ ID NO: 2441017 - DNA, 21 bp, Homo sapiens
ctgaatttttaaacaagtatt

SEQ ID NO: 2441018 - DNA, 17 bp, Homo sapiens
ctgacacaccaggcgct

SEQ ID NO: 2441019 - DNA, 23 bp, Homo sapiens
ctgacacaccaggcgctaattca

SEQ ID NO: 2441020 - DNA, 19 bp, Homo sapiens
ctgacacactaaccaagct

SEQ ID NO: 2441021 - DNA, 19 bp, Homo sapiens
ctgacacctaactcttctt

SEQ ID NO: 2441022 - DNA, 13 bp, Homo sapiens
ctgacactgctgg

SEQ ID NO: 2441023 - DNA, 14 bp, Homo sapiens
ctgacactgctgga

SEQ ID NO: 2441024 - DNA, 17 bp, Homo sapiens
ctgacagcctcccaccc

SEQ ID NO: 2441025 - DNA, 20 bp, Homo sapiens
ctgacagcctcccaccccca

SEQ ID NO: 2441026 - DNA, 23 bp, Homo sapiens
ctgacatgaagctgttgtgtgag

SEQ ID NO: 2441027 - DNA, 19 bp, Homo sapiens
ctgacatgtggggccaggt

SEQ ID NO: 2441028 - DNA, 17 bp, Homo sapiens
ctgacattcacctgccc

SEQ ID NO: 2441029 - DNA, 21 bp, Homo sapiens
ctgacatttggagtgttcccc

SEQ ID NO: 2441030 - DNA, 15 bp, Homo sapiens
ctgaccaaacagcca

SEQ ID NO: 2441031 - DNA, 16 bp, Homo sapiens
ctgaccactcagagac

SEQ ID NO: 2441032 - DNA, 23 bp, Homo sapiens
ctgaccactcagagacatgcaga

SEQ ID NO: 2441033 - DNA, 12 bp, Homo sapiens
ctgaccagcagc

SEQ ID NO: 2441034 - DNA, 20 bp, Homo sapiens
ctgaccagccgtgagcatgt

SEQ ID NO: 2441035 - DNA, 15 bp, Homo sapiens
ctgaccatgctcatc

SEQ ID NO: 2441036 - DNA, 15 bp, Homo sapiens
ggagcggcagatggg

SEQ ID NO: 2441037 - DNA, 20 bp, Homo sapiens
ggagcggccggccagcccct

SEQ ID NO: 2441038 - DNA, 20 bp, Homo sapiens
ggagctaaggctctatgagt

SEQ ID NO: 2441039 - DNA, 19 bp, Homo sapiens
ggagctacctgtgtggaca

SEQ ID NO: 2441040 - DNA, 22 bp, Homo sapiens
ggagctacctgtgtggacagga

SEQ ID NO: 2441041 - DNA, 14 bp, Homo sapiens
ggagctgcctggac

SEQ ID NO: 2441042 - DNA, 20 bp, Homo sapiens
ggagcttcatggcagaaggc

SEQ ID NO: 2441043 - DNA, 19 bp, Homo sapiens
ggagctttgactcaggagc

SEQ ID NO: 2441044 - DNA, 20 bp, Homo sapiens
ggagctttgactcaggagcc

SEQ ID NO: 2441045 - DNA, 22 bp, Homo sapiens
ggagctttgactcaggagcctg

SEQ ID NO: 2441046 - DNA, 23 bp, Homo sapiens
ggaggaataagctcccagggcct

SEQ ID NO: 2441047 - DNA, 15 bp, Homo sapiens
ggaggacccagggct

SEQ ID NO: 2441048 - DNA, 18 bp, Homo sapiens
ggaggacccagggctctg

SEQ ID NO: 2441049 - DNA, 14 bp, Homo sapiens
ggaggacctgagcc

SEQ ID NO: 2441050 - DNA, 16 bp, Homo sapiens
ggaggacctgagcctg

SEQ ID NO: 2441051 - DNA, 19 bp, Homo sapiens
ggaggacctgagcctgccg

SEQ ID NO: 2441052 - DNA, 12 bp, Homo sapiens
ggaggagcccag

SEQ ID NO: 2441053 - DNA, 14 bp, Homo sapiens
ggaggagggaggcg

SEQ ID NO: 2441054 - DNA, 13 bp, Homo sapiens
ggaggcaggggct

SEQ ID NO: 2441055 - DNA, 20 bp, Homo sapiens
ggaggcccaggctgggaact

SEQ ID NO: 2441056 - DNA, 22 bp, Homo sapiens
ggaggcccaggctgggaactca

SEQ ID NO: 2441057 - DNA, 15 bp, Homo sapiens
ggaggccctgtgccc

SEQ ID NO: 2441058 - DNA, 20 bp, Homo sapiens
ggaggcctaggagggtcctc

SEQ ID NO: 2441059 - DNA, 20 bp, Homo sapiens
ggaggcggatgttgaagtga

SEQ ID NO: 2441060 - DNA, 21 bp, Homo sapiens
ggaggctcacccccttctcca

SEQ ID NO: 2441061 - DNA, 18 bp, Homo sapiens
ggaggctgctgctgctct

SEQ ID NO: 2441062 - DNA, 15 bp, Homo sapiens
ggagggaagggagcc

SEQ ID NO: 2441063 - DNA, 17 bp, Homo sapiens
ggagggaagggagccaa

SEQ ID NO: 2441064 - DNA, 22 bp, Homo sapiens
ggagggacaaaggagcctgtga

SEQ ID NO: 2441065 - DNA, 19 bp, Homo sapiens
ggagggaggctgggcgggt

SEQ ID NO: 2441066 - DNA, 17 bp, Homo sapiens
ggagggattctggttcc

SEQ ID NO: 2441067 - DNA, 14 bp, Homo sapiens
ggagggcagagctg

SEQ ID NO: 2441068 - DNA, 13 bp, Homo sapiens
ggagggctctgag

SEQ ID NO: 2441069 - DNA, 15 bp, Homo sapiens
ggagggctctgaggc

SEQ ID NO: 2441070 - DNA, 14 bp, Homo sapiens
ggagggggatccga

SEQ ID NO: 2441071 - DNA, 18 bp, Homo sapiens
ggaggggtaggggctggg

SEQ ID NO: 2441072 - DNA, 15 bp, Homo sapiens
ggaggggtgtggctc

SEQ ID NO: 2441073 - DNA, 15 bp, Homo sapiens
ggagggtaggcagga

SEQ ID NO: 2441074 - DNA, 18 bp, Homo sapiens
ggaggtcggtaggttcag

SEQ ID NO: 2441075 - DNA, 12 bp, Homo sapiens
ggaggttctaag

SEQ ID NO: 2441076 - DNA, 15 bp, Homo sapiens
ggaggttgggtgggc

SEQ ID NO: 2441077 - DNA, 22 bp, Homo sapiens
ggagtaacaatacaaatggatt

SEQ ID NO: 2441078 - DNA, 16 bp, Homo sapiens
ggagtagctgagctca

SEQ ID NO: 2441079 - DNA, 21 bp, Homo sapiens
ggagtcacacagtgttggagg

SEQ ID NO: 2441080 - DNA, 16 bp, Homo sapiens
ggagtccactttgttt

SEQ ID NO: 2441081 - DNA, 24 bp, Homo sapiens
ggagtcgtggggtgtgctgggagc

SEQ ID NO: 2441082 - DNA, 23 bp, Homo sapiens
ggagtctgaggtcctgagcactg

SEQ ID NO: 2441083 - DNA, 21 bp, Homo sapiens
ggagtctgccacccaggatcc

SEQ ID NO: 2441084 - DNA, 13 bp, Homo sapiens
ggagtctgccagg

SEQ ID NO: 2441085 - DNA, 22 bp, Homo sapiens
ggagtgcggaccaccctcactg

SEQ ID NO: 2441086 - DNA, 21 bp, Homo sapiens
ggagtgctgttttgttatata

SEQ ID NO: 2441087 - DNA, 17 bp, Homo sapiens
ggagtggcagcccagcc

SEQ ID NO: 2441088 - DNA, 17 bp, Homo sapiens
ggagtgtgtgtgagtgt

SEQ ID NO: 2441089 - DNA, 20 bp, Homo sapiens
ggagttgatcgcctttccca

SEQ ID NO: 2441090 - DNA, 14 bp, Homo sapiens
ggagttgatctgga

SEQ ID NO: 2441091 - DNA, 20 bp, Homo sapiens
ggagtttagggaacaatttg

SEQ ID NO: 2441092 - DNA, 21 bp, Homo sapiens
ggagtttatgttccattaaac

SEQ ID NO: 2441093 - DNA, 12 bp, Homo sapiens
ggagtttctaag

SEQ ID NO: 2441094 - DNA, 14 bp, Homo sapiens
ggagtttctaaggt

SEQ ID NO: 2441095 - DNA, 17 bp, Homo sapiens
ggagttttgtttcctct

SEQ ID NO: 2441096 - DNA, 18 bp, Homo sapiens
ggagtttttatgagaaac

SEQ ID NO: 2441097 - DNA, 12 bp, Homo sapiens
ggatagaggggt

SEQ ID NO: 2441098 - DNA, 19 bp, Homo sapiens
ggatagatgctggcccagg

SEQ ID NO: 2441099 - DNA, 21 bp, Homo sapiens
ggatagatgctggcccagggc

SEQ ID NO: 2441100 - DNA, 16 bp, Homo sapiens
ggatatgtaaaacatt

SEQ ID NO: 2441101 - DNA, 14 bp, Homo sapiens
ggatcacaagatgg

SEQ ID NO: 2441102 - DNA, 18 bp, Homo sapiens
ggatcacaagatggaatt

SEQ ID NO: 2441103 - DNA, 12 bp, Homo sapiens
ggatcagaatag

SEQ ID NO: 2441104 - DNA, 17 bp, Homo sapiens
ggatcagcgtggccttg

SEQ ID NO: 2441105 - DNA, 13 bp, Homo sapiens
ggatccctcatct

SEQ ID NO: 2441106 - DNA, 20 bp, Homo sapiens
ggatctactttccctctggg

SEQ ID NO: 2441107 - DNA, 21 bp, Homo sapiens
ggatctatttcatgtttttga

SEQ ID NO: 2441108 - DNA, 15 bp, Homo sapiens
ggatctcaccaggca

SEQ ID NO: 2441109 - DNA, 17 bp, Homo sapiens
ggatctcaccaggcagc

SEQ ID NO: 2441110 - DNA, 17 bp, Homo sapiens
ggatctcattggaccct

SEQ ID NO: 2441111 - DNA, 21 bp, Homo sapiens
ggatgagaatttgagtgctct

SEQ ID NO: 2441112 - DNA, 22 bp, Homo sapiens
ggatgagctcccacaagcctga

SEQ ID NO: 2441113 - DNA, 18 bp, Homo sapiens
ggatgcagaggcctgcag

SEQ ID NO: 2441114 - DNA, 23 bp, Homo sapiens
ggatgggggaactcagatccagg

SEQ ID NO: 2441115 - DNA, 15 bp, Homo sapiens
ggatgtccccagcag

SEQ ID NO: 2441116 - DNA, 18 bp, Homo sapiens
ggcagttcgcagccaccc

SEQ ID NO: 2441117 - DNA, 21 bp, Homo sapiens
ggcagttcgcagccaccctga

SEQ ID NO: 2441118 - DNA, 22 bp, Homo sapiens
ggcatacgagagcagaggtctc

SEQ ID NO: 2441119 - DNA, 13 bp, Homo sapiens
ggcatagctctgg

SEQ ID NO: 2441120 - DNA, 13 bp, Homo sapiens
ggcatccctgggc

SEQ ID NO: 2441121 - DNA, 16 bp, Homo sapiens
ggcatcctccagcccc

SEQ ID NO: 2441122 - DNA, 12 bp, Homo sapiens
ggcatctctggg

SEQ ID NO: 2441123 - DNA, 13 bp, Homo sapiens
ggcatctctgggc

SEQ ID NO: 2441124 - DNA, 11 bp, Homo sapiens
ggcatcttttg

SEQ ID NO: 2441125 - DNA, 14 bp, Homo sapiens
ggcatcttttgtat

SEQ ID NO: 2441126 - DNA, 16 bp, Homo sapiens
ggcatcttttgtatta

SEQ ID NO: 2441127 - DNA, 23 bp, Homo sapiens
ggcatgaggggttcctcccctcc

SEQ ID NO: 2441128 - DNA, 15 bp, Homo sapiens
ggcatggtctgccct

SEQ ID NO: 2441129 - DNA, 24 bp, Homo sapiens
ggcatgtcaacagcgttcctagag

SEQ ID NO: 2441130 - DNA, 17 bp, Homo sapiens
ggcattagaattattta

SEQ ID NO: 2441131 - DNA, 19 bp, Homo sapiens
ggcattctggacctctggg

SEQ ID NO: 2441132 - DNA, 20 bp, Homo sapiens
ggcattctggacctctgggt

SEQ ID NO: 2441133 - DNA, 12 bp, Homo sapiens
ggcatttcctgg

SEQ ID NO: 2441134 - DNA, 15 bp, Homo sapiens
ggcatttcctgggtg

SEQ ID NO: 2441135 - DNA, 20 bp, Homo sapiens
ggcatttgcagggtcctctt

SEQ ID NO: 2441136 - DNA, 21 bp, Homo sapiens
ggcatttgcagggtcctcttc

SEQ ID NO: 2441137 - DNA, 23 bp, Homo sapiens
ggcatttgtttctttctctgagg

SEQ ID NO: 2441138 - DNA, 21 bp, Homo sapiens
ggcatttttaccatcactgag

SEQ ID NO: 2441139 - DNA, 16 bp, Homo sapiens
ggccaaagagtctcca

SEQ ID NO: 2441140 - DNA, 21 bp, Homo sapiens
ggccaaaggggacctggaagg

SEQ ID NO: 2441141 - DNA, 20 bp, Homo sapiens
ggccaagctgaggtgcccag

SEQ ID NO: 2441142 - DNA, 17 bp, Homo sapiens
gctgatgtcaatttctg

SEQ ID NO: 2441143 - DNA, 12 bp, Homo sapiens
gctgcaaggtac

SEQ ID NO: 2441144 - DNA, 20 bp, Homo sapiens
gctgcactgatgctgcccct

SEQ ID NO: 2441145 - DNA, 21 bp, Homo sapiens
gctgcagcctcaggactggga

SEQ ID NO: 2441146 - DNA, 16 bp, Homo sapiens
gctgcagcctgcgcca

SEQ ID NO: 2441147 - DNA, 18 bp, Homo sapiens
gctgcagttcgactctgt

SEQ ID NO: 2441148 - DNA, 17 bp, Homo sapiens
gctgcatggcagggggc

SEQ ID NO: 2441149 - DNA, 15 bp, Homo sapiens
gctgccccggcccct

SEQ ID NO: 2441150 - DNA, 22 bp, Homo sapiens
gctgccccggcccctccccctg

SEQ ID NO: 2441151 - DNA, 15 bp, Homo sapiens
gctgcccctctcacc

SEQ ID NO: 2441152 - DNA, 16 bp, Homo sapiens
gctgcccctctcacca

SEQ ID NO: 2441153 - DNA, 21 bp, Homo sapiens
gctgccctacagcaccctgtg

SEQ ID NO: 2441154 - DNA, 23 bp, Homo sapiens
gctgccctcctgtgctcagccct

SEQ ID NO: 2441155 - DNA, 16 bp, Homo sapiens
gctgccgcgcagtgtg

SEQ ID NO: 2441156 - DNA, 19 bp, Homo sapiens
gctgccggtcgccctttgc

SEQ ID NO: 2441157 - DNA, 20 bp, Homo sapiens
gctgcctagattcagggaaa

SEQ ID NO: 2441158 - DNA, 21 bp, Homo sapiens
gctgcctctacctgacactcc

SEQ ID NO: 2441159 - DNA, 11 bp, Homo sapiens
gctgcctgagt

SEQ ID NO: 2441160 - DNA, 21 bp, Homo sapiens
gctgcctgagtcgtgacctgc

SEQ ID NO: 2441161 - DNA, 12 bp, Homo sapiens
gctgcctggacc

SEQ ID NO: 2441162 - DNA, 22 bp, Homo sapiens
gctgctaatattttcctcctga

SEQ ID NO: 2441163 - DNA, 19 bp, Homo sapiens
gctgctccctcagactggg

SEQ ID NO: 2441164 - DNA, 13 bp, Homo sapiens
gctgctgagaacc

SEQ ID NO: 2441165 - DNA, 22 bp, Homo sapiens
gctgctgagaacctggccttca

SEQ ID NO: 2441166 - DNA, 17 bp, Homo sapiens
gctgctgatcgccttcc

SEQ ID NO: 2441167 - DNA, 20 bp, Homo sapiens
gctgctgatcgccttcccca

SEQ ID NO: 2441168 - DNA, 13 bp, Homo sapiens
gctgctgctgggc

SEQ ID NO: 2441169 - DNA, 20 bp, Homo sapiens
gctgctgggctcagtgaagt

SEQ ID NO: 2441170 - DNA, 22 bp, Homo sapiens
gctgctgtccctcccccttgtc

SEQ ID NO: 2441171 - DNA, 17 bp, Homo sapiens
gctggaaaataatactg

SEQ ID NO: 2441172 - DNA, 14 bp, Homo sapiens
gctggacccagcca

SEQ ID NO: 2441173 - DNA, 20 bp, Homo sapiens
gctggaccctgaccagctcc

SEQ ID NO: 2441174 - DNA, 21 bp, Homo sapiens
gctggaccctgaccagctccc

SEQ ID NO: 2441175 - DNA, 22 bp, Homo sapiens
gctggaccctgaccagctcccc

SEQ ID NO: 2441176 - DNA, 20 bp, Homo sapiens
gctggagagcatagggtctg

SEQ ID NO: 2441177 - DNA, 15 bp, Homo sapiens
gctggaggagcccag

SEQ ID NO: 2441178 - DNA, 16 bp, Homo sapiens
gctggaggagcccagg

SEQ ID NO: 2441179 - DNA, 20 bp, Homo sapiens
gctggaggagcccaggccag

SEQ ID NO: 2441180 - DNA, 13 bp, Homo sapiens
gctggaggcccag

SEQ ID NO: 2441181 - DNA, 15 bp, Homo sapiens
gctggaggcccaggc

SEQ ID NO: 2441182 - DNA, 16 bp, Homo sapiens
gctggaggcccaggct

SEQ ID NO: 2441183 - DNA, 20 bp, Homo sapiens
gctggagtgcagtggcgcga

SEQ ID NO: 2441184 - DNA, 17 bp, Homo sapiens
gctggagttagggactg

SEQ ID NO: 2441185 - DNA, 20 bp, Homo sapiens
gctggatgagaatttgagtg

SEQ ID NO: 2441186 - DNA, 13 bp, Homo sapiens
gctggatgagctc

SEQ ID NO: 2441187 - DNA, 21 bp, Homo sapiens
gctggcaacacagaggcagcc

SEQ ID NO: 2441188 - DNA, 14 bp, Homo sapiens
gctggccagtccag

SEQ ID NO: 2441189 - DNA, 15 bp, Homo sapiens
gctggccagtccagg

SEQ ID NO: 2441190 - DNA, 16 bp, Homo sapiens
gctggccatggagaaa

SEQ ID NO: 2441191 - DNA, 20 bp, Homo sapiens
gctggccatggagaaagctg

SEQ ID NO: 2441192 - DNA, 18 bp, Homo sapiens
gctggcccagggcccaga

SEQ ID NO: 2441193 - DNA, 14 bp, Homo sapiens
gctggccgctgtgc

SEQ ID NO: 2441194 - DNA, 18 bp, Homo sapiens
gctggccgctgtgccagg

SEQ ID NO: 2441195 - DNA, 21 bp, Homo sapiens
gctggcctcccaaatgagcca

SEQ ID NO: 2441196 - DNA, 22 bp, Homo sapiens
gctggcctcccaaatgagccat

SEQ ID NO: 2441197 - DNA, 12 bp, Homo sapiens
gctggcctctgc

SEQ ID NO: 2441198 - DNA, 14 bp, Homo sapiens
gctggcctctgcga

SEQ ID NO: 2441199 - DNA, 15 bp, Homo sapiens
gctggcctctgcgag

SEQ ID NO: 2441200 - DNA, 16 bp, Homo sapiens
gctggcctctgcgagt

SEQ ID NO: 2441201 - DNA, 14 bp, Homo sapiens
gctggctccagatg

SEQ ID NO: 2441202 - DNA, 13 bp, Homo sapiens
gctggctctgagc

SEQ ID NO: 2441203 - DNA, 16 bp, Homo sapiens
gctggctctgagcgcc

SEQ ID NO: 2441204 - DNA, 17 bp, Homo sapiens
gctgggacgtggctcag

SEQ ID NO: 2441205 - DNA, 20 bp, Homo sapiens
gctgggacgtggctcagcca

SEQ ID NO: 2441206 - DNA, 16 bp, Homo sapiens
gctgggactcagcctt

SEQ ID NO: 2441207 - DNA, 22 bp, Homo sapiens
gctgggactcagccttcagaca

SEQ ID NO: 2441208 - DNA, 13 bp, Homo sapiens
gctgggagctcca

SEQ ID NO: 2441209 - DNA, 22 bp, Homo sapiens
gctgggagctccactctgcttc

SEQ ID NO: 2441210 - DNA, 19 bp, Homo sapiens
gctgggatctactttccct

SEQ ID NO: 2441211 - DNA, 20 bp, Homo sapiens
gctgggccatgtccaaagag

SEQ ID NO: 2441212 - DNA, 13 bp, Homo sapiens
gctgggcctggtc

SEQ ID NO: 2441213 - DNA, 13 bp, Homo sapiens
gctgggctctgca

SEQ ID NO: 2441214 - DNA, 15 bp, Homo sapiens
gctggggaagacagt

SEQ ID NO: 2441215 - DNA, 16 bp, Homo sapiens
gctggggaagacagtg

SEQ ID NO: 2441216 - DNA, 21 bp, Homo sapiens
gctggggaagacagtggcccc

SEQ ID NO: 2441217 - DNA, 23 bp, Homo sapiens
gctggggacctggtaccctcctg

SEQ ID NO: 2441218 - DNA, 16 bp, Homo sapiens
gctggggcctgggaca

SEQ ID NO: 2441219 - DNA, 20 bp, Homo sapiens
gctggggtgcagggatgtgg

SEQ ID NO: 2441220 - DNA, 15 bp, Homo sapiens
gctggtatctcagaa

SEQ ID NO: 2441221 - DNA, 16 bp, Homo sapiens
gctggtatctcagaaa

SEQ ID NO: 2441222 - DNA, 16 bp, Homo sapiens
gctggtccgtgggacg

SEQ ID NO: 2441223 - DNA, 19 bp, Homo sapiens
gctggtcctatggcctcat

SEQ ID NO: 2441224 - DNA, 21 bp, Homo sapiens
gctggtgtggtacagagaagc

SEQ ID NO: 2441225 - DNA, 22 bp, Homo sapiens
gctggtgttaacagaagggagg

SEQ ID NO: 2441226 - DNA, 12 bp, Homo sapiens
gctggttctgta

SEQ ID NO: 2441227 - DNA, 15 bp, Homo sapiens
gctggtttaatgttt

SEQ ID NO: 2441228 - DNA, 15 bp, Homo sapiens
gctgtaactgccagg

SEQ ID NO: 2441229 - DNA, 19 bp, Homo sapiens
gctgtaatgttaatattga

SEQ ID NO: 2441230 - DNA, 23 bp, Homo sapiens
gctgtacatctattttggattgt

SEQ ID NO: 2441231 - DNA, 18 bp, Homo sapiens
ggctacagagaagccttc

SEQ ID NO: 2441232 - DNA, 19 bp, Homo sapiens
ggctaccctgagctgaggc

SEQ ID NO: 2441233 - DNA, 13 bp, Homo sapiens
ggctactctgtgc

SEQ ID NO: 2441234 - DNA, 16 bp, Homo sapiens
ggctactctgtgccag

SEQ ID NO: 2441235 - DNA, 24 bp, Homo sapiens
ggctactctgtgccagagcctggg

SEQ ID NO: 2441236 - DNA, 13 bp, Homo sapiens
ggctaggccagca

SEQ ID NO: 2441237 - DNA, 15 bp, Homo sapiens
ggctaggccagcagg

SEQ ID NO: 2441238 - DNA, 16 bp, Homo sapiens
ggctaggccagcaggg

SEQ ID NO: 2441239 - DNA, 14 bp, Homo sapiens
ggctagggggagcc

SEQ ID NO: 2441240 - DNA, 18 bp, Homo sapiens
ggctatagatgtcttttc

SEQ ID NO: 2441241 - DNA, 21 bp, Homo sapiens
ggctattttgtttgcttcatg

SEQ ID NO: 2441242 - DNA, 18 bp, Homo sapiens
ggctcacacacctgtagc

SEQ ID NO: 2441243 - DNA, 17 bp, Homo sapiens
ggctcacccccttctcc

SEQ ID NO: 2441244 - DNA, 17 bp, Homo sapiens
ggctcacgcctgtaatc

SEQ ID NO: 2441245 - DNA, 22 bp, Homo sapiens
ggctcactcagcacttggccct

SEQ ID NO: 2441246 - DNA, 14 bp, Homo sapiens
ggctcactcagcca

SEQ ID NO: 2441247 - DNA, 18 bp, Homo sapiens
ggctcagtgaagttgctg

SEQ ID NO: 2441248 - DNA, 21 bp, Homo sapiens
ggctcagtgaagttgctgctt

SEQ ID NO: 2441249 - DNA, 16 bp, Homo sapiens
ggctccagagggcact

SEQ ID NO: 2441250 - DNA, 22 bp, Homo sapiens
ggctccagagggcactctgctt

SEQ ID NO: 2441251 - DNA, 18 bp, Homo sapiens
ggctccagatgcagggca

SEQ ID NO: 2441252 - DNA, 21 bp, Homo sapiens
ggctccagcccctcttggaga

SEQ ID NO: 2441253 - DNA, 22 bp, Homo sapiens
ggctccagcccctcttggagaa

SEQ ID NO: 2441254 - DNA, 21 bp, Homo sapiens
ggctccctgtaacctcttcag

SEQ ID NO: 2441255 - DNA, 9 bp, Homo sapiens
ggctcctgc

SEQ ID NO: 2441256 - DNA, 20 bp, Homo sapiens
ggctccttcccatcgctgtc

SEQ ID NO: 2441257 - DNA, 17 bp, Homo sapiens
ggctccttggttcttga

SEQ ID NO: 2441258 - DNA, 14 bp, Homo sapiens
ggctcggcctgccc

SEQ ID NO: 2441259 - DNA, 18 bp, Homo sapiens
ggctcggcctgcccccac

SEQ ID NO: 2441260 - DNA, 19 bp, Homo sapiens
ggctcgtggactgagtggg

SEQ ID NO: 2441261 - DNA, 15 bp, Homo sapiens
ggctctaacgcctga

SEQ ID NO: 2441262 - DNA, 17 bp, Homo sapiens
ggctctaacgcctgagc

SEQ ID NO: 2441263 - DNA, 21 bp, Homo sapiens
ggtgcaatgtgtgtatatgga

SEQ ID NO: 2441264 - DNA, 12 bp, Homo sapiens
ggtgcacaggag

SEQ ID NO: 2441265 - DNA, 13 bp, Homo sapiens
ggtgcacaggagg

SEQ ID NO: 2441266 - DNA, 14 bp, Homo sapiens
ggtgcacaggaggg

SEQ ID NO: 2441267 - DNA, 14 bp, Homo sapiens
ggtgcactgggagg

SEQ ID NO: 2441268 - DNA, 23 bp, Homo sapiens
ggtgccaaacaaaaaggttctca

SEQ ID NO: 2441269 - DNA, 23 bp, Homo sapiens
ggtgcccagaataagttattgca

SEQ ID NO: 2441270 - DNA, 15 bp, Homo sapiens
ggtgccccaggacca

SEQ ID NO: 2441271 - DNA, 13 bp, Homo sapiens
ggtgcctgtccca

SEQ ID NO: 2441272 - DNA, 12 bp, Homo sapiens
ggtgctctgtct

SEQ ID NO: 2441273 - DNA, 12 bp, Homo sapiens
ggtgctgggaga

SEQ ID NO: 2441274 - DNA, 19 bp, Homo sapiens
ggtgctgggagaggcagcc

SEQ ID NO: 2441275 - DNA, 21 bp, Homo sapiens
ggtggaaaggtgtgagactgg

SEQ ID NO: 2441276 - DNA, 19 bp, Homo sapiens
ggtggaagcttggggaaga

SEQ ID NO: 2441277 - DNA, 15 bp, Homo sapiens
ggtggactcgcctgt

SEQ ID NO: 2441278 - DNA, 13 bp, Homo sapiens
ggtggagggccac

SEQ ID NO: 2441279 - DNA, 23 bp, Homo sapiens
ggtggagggccacatgggaggct

SEQ ID NO: 2441280 - DNA, 14 bp, Homo sapiens
ggtggatggcccca

SEQ ID NO: 2441281 - DNA, 23 bp, Homo sapiens
ggtggcacaggagtgtcctcttc

SEQ ID NO: 2441282 - DNA, 17 bp, Homo sapiens
ggtggcacaggccccct

SEQ ID NO: 2441283 - DNA, 16 bp, Homo sapiens
ggtggccaggccggga

SEQ ID NO: 2441284 - DNA, 21 bp, Homo sapiens
ggtggccctctcccctgcccc

SEQ ID NO: 2441285 - DNA, 14 bp, Homo sapiens
ggtggctactctgt

SEQ ID NO: 2441286 - DNA, 16 bp, Homo sapiens
ggtggctactctgtgc

SEQ ID NO: 2441287 - DNA, 22 bp, Homo sapiens
ggtggctactctgtgccagagc

SEQ ID NO: 2441288 - DNA, 23 bp, Homo sapiens
ggtggcttttgcggttcaggaaa

SEQ ID NO: 2441289 - DNA, 12 bp, Homo sapiens
ggtggggcagct

SEQ ID NO: 2441290 - DNA, 13 bp, Homo sapiens
ggtggggcagctc

SEQ ID NO: 2441291 - DNA, 23 bp, Homo sapiens
ggtgggggtagggtttccctact

SEQ ID NO: 2441292 - DNA, 14 bp, Homo sapiens
ggtggggtcctgga

SEQ ID NO: 2441293 - DNA, 11 bp, Homo sapiens
ggtggggtgga

SEQ ID NO: 2441294 - DNA, 10 bp, Homo sapiens
ggtgggtcca

SEQ ID NO: 2441295 - DNA, 14 bp, Homo sapiens
ggtgggtccatggg

SEQ ID NO: 2441296 - DNA, 19 bp, Homo sapiens
ggtgggtgcctaggcctgg

SEQ ID NO: 2441297 - DNA, 16 bp, Homo sapiens
ggtggtaccctctgga

SEQ ID NO: 2441298 - DNA, 20 bp, Homo sapiens
ggtggtattttcaatagcca

SEQ ID NO: 2441299 - DNA, 14 bp, Homo sapiens
ggtggtccctgggt

SEQ ID NO: 2441300 - DNA, 22 bp, Homo sapiens
ggtggtctgttggcaggctggc

SEQ ID NO: 2441301 - DNA, 23 bp, Homo sapiens
ggtggtgtcagaccctggaggcc

SEQ ID NO: 2441302 - DNA, 15 bp, Homo sapiens
ggtgtagctacagag

SEQ ID NO: 2441303 - DNA, 18 bp, Homo sapiens
ggtgtagctacagagaaa

SEQ ID NO: 2441304 - DNA, 19 bp, Homo sapiens
ggtgtccccaacagcgccc

SEQ ID NO: 2441305 - DNA, 15 bp, Homo sapiens
ggtgtctcaggctgc

SEQ ID NO: 2441306 - DNA, 16 bp, Homo sapiens
ggtgtctcaggctgcc

SEQ ID NO: 2441307 - DNA, 20 bp, Homo sapiens
ggtgtctcaggctgcctgag

SEQ ID NO: 2441308 - DNA, 21 bp, Homo sapiens
ggtgtctcaggctgcctgagt

SEQ ID NO: 2441309 - DNA, 20 bp, Homo sapiens
ggtgtcttgggcagagctgg

SEQ ID NO: 2441310 - DNA, 12 bp, Homo sapiens
ggtgtgctggga

SEQ ID NO: 2441311 - DNA, 14 bp, Homo sapiens
ggtgtggtacagag

SEQ ID NO: 2441312 - DNA, 13 bp, Homo sapiens
ggtgttaacagaa

SEQ ID NO: 2441313 - DNA, 22 bp, Homo sapiens
ggtgttatttggaaccttgttt

SEQ ID NO: 2441314 - DNA, 21 bp, Homo sapiens
ggtgttgccaaatatgtcctg

SEQ ID NO: 2441315 - DNA, 23 bp, Homo sapiens
ggttatagacagtcgttcccagt

SEQ ID NO: 2441316 - DNA, 14 bp, Homo sapiens
ggttatctctgtgt

SEQ ID NO: 2441317 - DNA, 14 bp, Homo sapiens
ggttcaacttatta

SEQ ID NO: 2441318 - DNA, 14 bp, Homo sapiens
gtacatatgtgctg

SEQ ID NO: 2441319 - DNA, 18 bp, Homo sapiens
gtacatctattttggatt

SEQ ID NO: 2441320 - DNA, 17 bp, Homo sapiens
gtacatggtgctgggag

SEQ ID NO: 2441321 - DNA, 15 bp, Homo sapiens
gtacatttctcaggc

SEQ ID NO: 2441322 - DNA, 19 bp, Homo sapiens
gtacatttctcaggctagg

SEQ ID NO: 2441323 - DNA, 15 bp, Homo sapiens
gtacattttgtaaca

SEQ ID NO: 2441324 - DNA, 10 bp, Homo sapiens
gtaccagtta

SEQ ID NO: 2441325 - DNA, 20 bp, Homo sapiens
gtaccagttaatttttccaa

SEQ ID NO: 2441326 - DNA, 22 bp, Homo sapiens
gtaccagttaatttttccaact

SEQ ID NO: 2441327 - DNA, 23 bp, Homo sapiens
gtaccatttaatggggaggacaa

SEQ ID NO: 2441328 - DNA, 17 bp, Homo sapiens
gtaccctcctggctctt

SEQ ID NO: 2441329 - DNA, 16 bp, Homo sapiens
gtaccctctgaaatac

SEQ ID NO: 2441330 - DNA, 15 bp, Homo sapiens
gtaccctctggaggg

SEQ ID NO: 2441331 - DNA, 20 bp, Homo sapiens
gtaccgcgtctaccctggga

SEQ ID NO: 2441332 - DNA, 15 bp, Homo sapiens
gtacctgggcaagct

SEQ ID NO: 2441333 - DNA, 16 bp, Homo sapiens
gtacctgggcaagctg

SEQ ID NO: 2441334 - DNA, 23 bp, Homo sapiens
gtaccttttgaggagccccagct

SEQ ID NO: 2441335 - DNA, 17 bp, Homo sapiens
gtacggattttcagtta

SEQ ID NO: 2441336 - DNA, 13 bp, Homo sapiens
gtactaaagccaa

SEQ ID NO: 2441337 - DNA, 14 bp, Homo sapiens
gtactatttaactg

SEQ ID NO: 2441338 - DNA, 13 bp, Homo sapiens
gtactcaggagcc

SEQ ID NO: 2441339 - DNA, 19 bp, Homo sapiens
gtactccacatatttcagt

SEQ ID NO: 2441340 - DNA, 16 bp, Homo sapiens
gtactccctctcagga

SEQ ID NO: 2441341 - DNA, 20 bp, Homo sapiens
gtactgactttgcttgcttt

SEQ ID NO: 2441342 - DNA, 11 bp, Homo sapiens
gtactgcctgc

SEQ ID NO: 2441343 - DNA, 20 bp, Homo sapiens
gtactgggattacaggcgtg

SEQ ID NO: 2441344 - DNA, 14 bp, Homo sapiens
gtactgttctgtgt

SEQ ID NO: 2441345 - DNA, 17 bp, Homo sapiens
gtactgttctgtgtctt

SEQ ID NO: 2441346 - DNA, 18 bp, Homo sapiens
gtactgttctgtgtcttt

SEQ ID NO: 2441347 - DNA, 12 bp, Homo sapiens
gtacttgtagtt

SEQ ID NO: 2441348 - DNA, 15 bp, Homo sapiens
gtagaacactaattc

SEQ ID NO: 2441349 - DNA, 17 bp, Homo sapiens
gtagaattatctaattt

SEQ ID NO: 2441350 - DNA, 21 bp, Homo sapiens
gtagacggctcagtatagata

SEQ ID NO: 2441351 - DNA, 20 bp, Homo sapiens
gtagatgcatttgggtccag

SEQ ID NO: 2441352 - DNA, 18 bp, Homo sapiens
gtagattcaggtaataca

SEQ ID NO: 2441353 - DNA, 13 bp, Homo sapiens
gtagcacttactg

SEQ ID NO: 2441354 - DNA, 15 bp, Homo sapiens
gtagccacaccagga

SEQ ID NO: 2441355 - DNA, 16 bp, Homo sapiens
gtagccacaccaggat

SEQ ID NO: 2441356 - DNA, 15 bp, Homo sapiens
gtagccagcacacag

SEQ ID NO: 2441357 - DNA, 19 bp, Homo sapiens
gtagccagcacacagggca

SEQ ID NO: 2441358 - DNA, 21 bp, Homo sapiens
gtagccagccggggcgagtgg

SEQ ID NO: 2441359 - DNA, 15 bp, Homo sapiens
gtagctacagagaaa

SEQ ID NO: 2441360 - DNA, 21 bp, Homo sapiens
gtagctctttgtcagggagtg

SEQ ID NO: 2441361 - DNA, 18 bp, Homo sapiens
gtagctgtgacctgctga

SEQ ID NO: 2441362 - DNA, 19 bp, Homo sapiens
gtaggaccaagcatcttgg

SEQ ID NO: 2441363 - DNA, 18 bp, Homo sapiens
gtaggagcccagctctga

SEQ ID NO: 2441364 - DNA, 21 bp, Homo sapiens
gtaggagggactgtcgctgct

SEQ ID NO: 2441365 - DNA, 16 bp, Homo sapiens
gtaggagggtgggaag

SEQ ID NO: 2441366 - DNA, 17 bp, Homo sapiens
gtaggagggtgggaagg

SEQ ID NO: 2441367 - DNA, 18 bp, Homo sapiens
gtaggcaggattggggaa

SEQ ID NO: 2441368 - DNA, 20 bp, Homo sapiens
gtaggccaaggtgtcctaca

SEQ ID NO: 2441369 - DNA, 14 bp, Homo sapiens
gtaggctacagaga

SEQ ID NO: 2441370 - DNA, 16 bp, Homo sapiens
gtaggctacagagaag

SEQ ID NO: 2441371 - DNA, 19 bp, Homo sapiens
gtaggctacagagaagcct

SEQ ID NO: 2441372 - DNA, 19 bp, Homo sapiens
gttctaataatttctaatg

SEQ ID NO: 2441373 - DNA, 17 bp, Homo sapiens
gttctaggaaaataaaa

SEQ ID NO: 2441374 - DNA, 21 bp, Homo sapiens
gttctcaattccaacagttta

SEQ ID NO: 2441375 - DNA, 21 bp, Homo sapiens
gttctcacactggtctgctgt

SEQ ID NO: 2441376 - DNA, 23 bp, Homo sapiens
gttctcagaatcccttaacagtt

SEQ ID NO: 2441377 - DNA, 23 bp, Homo sapiens
gttctcatgataccacctttact

SEQ ID NO: 2441378 - DNA, 19 bp, Homo sapiens
gttctcatgggtggcactc

SEQ ID NO: 2441379 - DNA, 23 bp, Homo sapiens
gttctccaacatcacagcccagc

SEQ ID NO: 2441380 - DNA, 19 bp, Homo sapiens
gttctccgttagctcctgt

SEQ ID NO: 2441381 - DNA, 18 bp, Homo sapiens
gttctcctgctgctccct

SEQ ID NO: 2441382 - DNA, 15 bp, Homo sapiens
gttctctctttgcat

SEQ ID NO: 2441383 - DNA, 20 bp, Homo sapiens
gttctgagatggctcccagg

SEQ ID NO: 2441384 - DNA, 21 bp, Homo sapiens
gttctgagatggctcccaggg

SEQ ID NO: 2441385 - DNA, 13 bp, Homo sapiens
gttctgcctgcca

SEQ ID NO: 2441386 - DNA, 15 bp, Homo sapiens
gttctgcctgccagc

SEQ ID NO: 2441387 - DNA, 23 bp, Homo sapiens
gttctgcctgccagctgcactga

SEQ ID NO: 2441388 - DNA, 18 bp, Homo sapiens
gttctgctcatcattctc

SEQ ID NO: 2441389 - DNA, 23 bp, Homo sapiens
gttctgctcatcattctctgtct

SEQ ID NO: 2441390 - DNA, 12 bp, Homo sapiens
gttctgtcacca

SEQ ID NO: 2441391 - DNA, 22 bp, Homo sapiens
gttctgtgtctttcacagctcc

SEQ ID NO: 2441392 - DNA, 16 bp, Homo sapiens
gttctgttaactgaat

SEQ ID NO: 2441393 - DNA, 17 bp, Homo sapiens
gttctgttaactgaata

SEQ ID NO: 2441394 - DNA, 13 bp, Homo sapiens
gttctgtttcaag

SEQ ID NO: 2441395 - DNA, 24 bp, Homo sapiens
gtgggatgttcagcactgtccctt

SEQ ID NO: 2441396 - DNA, 17 bp, Homo sapiens
gtgggccaacaaagaac

SEQ ID NO: 2441397 - DNA, 14 bp, Homo sapiens
gtgggccccaccct

SEQ ID NO: 2441398 - DNA, 18 bp, Homo sapiens
gtgggcctgggctcctgg

SEQ ID NO: 2441399 - DNA, 15 bp, Homo sapiens
gtgggctccctgact

SEQ ID NO: 2441400 - DNA, 15 bp, Homo sapiens
gtgggctggccgctg

SEQ ID NO: 2441401 - DNA, 18 bp, Homo sapiens
gtggggcccaggcccgga

SEQ ID NO: 2441402 - DNA, 14 bp, Homo sapiens
gtggggcctgggag

SEQ ID NO: 2441403 - DNA, 12 bp, Homo sapiens
gtggggcttggg

SEQ ID NO: 2441404 - DNA, 19 bp, Homo sapiens
gtgggggtagggggctgga

SEQ ID NO: 2441405 - DNA, 13 bp, Homo sapiens
gtggggtggctgc

SEQ ID NO: 2441406 - DNA, 19 bp, Homo sapiens
gtggggtggctgcagcctc

SEQ ID NO: 2441407 - DNA, 16 bp, Homo sapiens
gtggggtggtgtcaga

SEQ ID NO: 2441408 - DNA, 19 bp, Homo sapiens
gtggggtgtgctgggagct

SEQ ID NO: 2441409 - DNA, 18 bp, Homo sapiens
gtgggtccatgggcagag

SEQ ID NO: 2441410 - DNA, 22 bp, Homo sapiens
gtgggtccatgggcagagccca

SEQ ID NO: 2441411 - DNA, 13 bp, Homo sapiens
gtgggtctgggag

SEQ ID NO: 2441412 - DNA, 16 bp, Homo sapiens
gtggtcacagcggagg

SEQ ID NO: 2441413 - DNA, 14 bp, Homo sapiens
gtggtcacagctgt

SEQ ID NO: 2441414 - DNA, 20 bp, Homo sapiens
gtggtccacaagcttctgtc

SEQ ID NO: 2441415 - DNA, 18 bp, Homo sapiens
gtggtggcctggtccctg

SEQ ID NO: 2441416 - DNA, 15 bp, Homo sapiens
gtggtggtccctggg

SEQ ID NO: 2441417 - DNA, 17 bp, Homo sapiens
gtggtttatatatttaa

SEQ ID NO: 2441418 - DNA, 19 bp, Homo sapiens
gtgtaactgcccaaagcag

SEQ ID NO: 2441419 - DNA, 20 bp, Homo sapiens
gtgtaactgcccaaagcagc

SEQ ID NO: 2441420 - DNA, 18 bp, Homo sapiens
gtgtaagaaatacagact

SEQ ID NO: 2441421 - DNA, 17 bp, Homo sapiens
gtgtaccatttgcctcc

SEQ ID NO: 2441422 - DNA, 17 bp, Homo sapiens
gtgtagccacaccagga

SEQ ID NO: 2441423 - DNA, 20 bp, Homo sapiens
gtgtagctacagagaaacca

SEQ ID NO: 2441424 - DNA, 22 bp, Homo sapiens
gtgtagctacagagaaaccagc

SEQ ID NO: 2441425 - DNA, 12 bp, Homo sapiens
gtgtagctgtga

SEQ ID NO: 2441426 - DNA, 17 bp, Homo sapiens
gtgtagttcatgtaaat

SEQ ID NO: 2441427 - DNA, 12 bp, Homo sapiens
gtgtataaaaat

SEQ ID NO: 2441428 - DNA, 18 bp, Homo sapiens
gtgtataaaaataaaaaa

SEQ ID NO: 2441429 - DNA, 10 bp, Homo sapiens
gtgtatttgc

SEQ ID NO: 2441430 - DNA, 19 bp, Homo sapiens
gtgtatttgctaattttta

SEQ ID NO: 2441431 - DNA, 14 bp, Homo sapiens
gtgtatttgctttt

SEQ ID NO: 2441432 - DNA, 19 bp, Homo sapiens
gtgtatttggaaataaagt

SEQ ID NO: 2441433 - DNA, 19 bp, Homo sapiens
gtgtcaactctttgttatt

SEQ ID NO: 2441434 - DNA, 14 bp, Homo sapiens
gtgtcacctgtgct

SEQ ID NO: 2441435 - DNA, 17 bp, Homo sapiens
gtgtcacggccaggcag

SEQ ID NO: 2441436 - DNA, 22 bp, Homo sapiens
gtgtcactcaaggcggtgcttg

SEQ ID NO: 2441437 - DNA, 22 bp, Homo sapiens
gtgtcaggcactgggcatgagg

SEQ ID NO: 2441438 - DNA, 18 bp, Homo sapiens
gtgtccaaaaccgccagc

SEQ ID NO: 2441439 - DNA, 23 bp, Homo sapiens
gtgtccaaaaccgccagctctgt

SEQ ID NO: 2441440 - DNA, 18 bp, Homo sapiens
gtgtccacgactgtctcc

SEQ ID NO: 2441441 - DNA, 18 bp, Homo sapiens
gtgtccatgcgctcaggg

SEQ ID NO: 2441442 - DNA, 19 bp, Homo sapiens
gtgtccatgcgctcagggc

SEQ ID NO: 2441443 - DNA, 22 bp, Homo sapiens
gtgtcccagaagatgactgagg

SEQ ID NO: 2441444 - DNA, 12 bp, Homo sapiens
gtgtccccaaca

SEQ ID NO: 2441445 - DNA, 18 bp, Homo sapiens
gtgtccccaacagcgccc

SEQ ID NO: 2441446 - DNA, 23 bp, Homo sapiens
gtgtcctgagccccagggagagg

SEQ ID NO: 2441447 - DNA, 14 bp, Homo sapiens
gtgtctaagattct

SEQ ID NO: 2441448 - DNA, 15 bp, Homo sapiens
gtgtctaagattcta

SEQ ID NO: 2441449 - DNA, 16 bp, Homo sapiens
gtgtctaagattctag

SEQ ID NO: 2441450 - DNA, 19 bp, Homo sapiens
gtgtctaagattctagatc

SEQ ID NO: 2441451 - DNA, 17 bp, Homo sapiens
gtgtctcaggctgcctg

SEQ ID NO: 2441452 - DNA, 17 bp, Homo sapiens
gtgtcttgggcagagct

SEQ ID NO: 2441453 - DNA, 19 bp, Homo sapiens
gtgtctttagatagccctg

SEQ ID NO: 2441454 - DNA, 14 bp, Homo sapiens
gtgtgaatgaacac

SEQ ID NO: 2441455 - DNA, 21 bp, Homo sapiens
gtgtgagaagtgaatgctggg

SEQ ID NO: 2441456 - DNA, 22 bp, Homo sapiens
gtgtgagaagtgaatgctggga

SEQ ID NO: 2441457 - DNA, 14 bp, Homo sapiens
gtgtgaggccaggg

SEQ ID NO: 2441458 - DNA, 17 bp, Homo sapiens
gtgtgaggccagggcag

SEQ ID NO: 2441459 - DNA, 14 bp, Homo sapiens
gtgtgcaaggcagc

SEQ ID NO: 2441460 - DNA, 13 bp, Homo sapiens
gtgtgcaggagcg

SEQ ID NO: 2441461 - DNA, 19 bp, Homo sapiens
gtgtgctgggagctccact

SEQ ID NO: 2441462 - DNA, 18 bp, Homo sapiens
gtgtggtacagagaagcc

SEQ ID NO: 2441463 - DNA, 18 bp, Homo sapiens
gtgtgtccaaaactgcct

SEQ ID NO: 2441464 - DNA, 19 bp, Homo sapiens
gtgtgtccacgactgtctc

SEQ ID NO: 2441465 - DNA, 14 bp, Homo sapiens
gtgtgtcttaatta

SEQ ID NO: 2441466 - DNA, 21 bp, Homo sapiens
gtgtgtcttaattattatttg

SEQ ID NO: 2441467 - DNA, 16 bp, Homo sapiens
gtgtgttaagctctgc

SEQ ID NO: 2441468 - DNA, 16 bp, Homo sapiens
gtgtgttgatactgtt

SEQ ID NO: 2441469 - DNA, 20 bp, Homo sapiens
gtgtgttgatactgttgcac

SEQ ID NO: 2441470 - DNA, 21 bp, Homo sapiens
gtgtgttgatactgttgcacg

SEQ ID NO: 2441471 - DNA, 16 bp, Homo sapiens
gtgtgttgtctcttga

SEQ ID NO: 2441472 - DNA, 19 bp, Homo sapiens
ggggccagatccagcctgg

SEQ ID NO: 2441473 - DNA, 21 bp, Homo sapiens
ggggcctccatgggccccagg

SEQ ID NO: 2441474 - DNA, 12 bp, Homo sapiens
ggggcctgccac

SEQ ID NO: 2441475 - DNA, 22 bp, Homo sapiens
ggggcctgccacctggacccct

SEQ ID NO: 2441476 - DNA, 22 bp, Homo sapiens
ggggcctggctggctgagggca

SEQ ID NO: 2441477 - DNA, 17 bp, Homo sapiens
ggggcctgtactgcctg

SEQ ID NO: 2441478 - DNA, 14 bp, Homo sapiens
ggggctaatttaac

SEQ ID NO: 2441479 - DNA, 19 bp, Homo sapiens
ggggctccctccgccccca

SEQ ID NO: 2441480 - DNA, 17 bp, Homo sapiens
ggggctctaacgcctga

SEQ ID NO: 2441481 - DNA, 20 bp, Homo sapiens
ggggctctaacgcctgagcc

SEQ ID NO: 2441482 - DNA, 23 bp, Homo sapiens
ggggctctaacgcctgagcccag

SEQ ID NO: 2441483 - DNA, 22 bp, Homo sapiens
ggggctgctgctgggctcagtg

SEQ ID NO: 2441484 - DNA, 19 bp, Homo sapiens
ggggctgcttcctcctgga

SEQ ID NO: 2441485 - DNA, 13 bp, Homo sapiens
ggggctggaggag

SEQ ID NO: 2441486 - DNA, 11 bp, Homo sapiens
gggggagaggg

SEQ ID NO: 2441487 - DNA, 21 bp, Homo sapiens
gggggcagcacaggagggcgg

SEQ ID NO: 2441488 - DNA, 13 bp, Homo sapiens
gggggtggccagg

SEQ ID NO: 2441489 - DNA, 19 bp, Homo sapiens
gggggttccgtgtccaccc

SEQ ID NO: 2441490 - DNA, 23 bp, Homo sapiens
ggggtcctcctccagggacagca

SEQ ID NO: 2441491 - DNA, 19 bp, Homo sapiens
ggggtcgtggagagctagg

SEQ ID NO: 2441492 - DNA, 16 bp, Homo sapiens
ggggtctggctggtgt

SEQ ID NO: 2441493 - DNA, 14 bp, Homo sapiens
ggggtgcacaggag

SEQ ID NO: 2441494 - DNA, 16 bp, Homo sapiens
ggggtgcccacaggcc

SEQ ID NO: 2441495 - DNA, 13 bp, Homo sapiens
ggggtggccaggc

SEQ ID NO: 2441496 - DNA, 14 bp, Homo sapiens
ggggtggtgtcaga

SEQ ID NO: 2441497 - DNA, 19 bp, Homo sapiens
ggggtgtggctccttccca

SEQ ID NO: 2441498 - DNA, 15 bp, Homo sapiens
gggtaaaatactttt

SEQ ID NO: 2441499 - DNA, 17 bp, Homo sapiens
gggtaatccctgctttt

SEQ ID NO: 2441500 - DNA, 19 bp, Homo sapiens
gggtaggagggtgggaagg

SEQ ID NO: 2441501 - DNA, 13 bp, Homo sapiens
gggtaggcaggat

SEQ ID NO: 2441502 - DNA, 15 bp, Homo sapiens
gggtagggtaaatca

SEQ ID NO: 2441503 - DNA, 22 bp, Homo sapiens
gggtagggtaaatcagtaagag

SEQ ID NO: 2441504 - DNA, 13 bp, Homo sapiens
gggtatggcgtaa

SEQ ID NO: 2441505 - DNA, 19 bp, Homo sapiens
gggtcagacgcctgaggaa

SEQ ID NO: 2441506 - DNA, 12 bp, Homo sapiens
gggtccatgggc

SEQ ID NO: 2441507 - DNA, 13 bp, Homo sapiens
gggtcccagcagc

SEQ ID NO: 2441508 - DNA, 16 bp, Homo sapiens
gggtccggcagcttct

SEQ ID NO: 2441509 - DNA, 16 bp, Homo sapiens
gggtcctcctccaggg

SEQ ID NO: 2441510 - DNA, 14 bp, Homo sapiens
gggtcctcctttct

SEQ ID NO: 2441511 - DNA, 19 bp, Homo sapiens
gggtcctctgagactccag

SEQ ID NO: 2441512 - DNA, 20 bp, Homo sapiens
gtcattttggtactttggtg

SEQ ID NO: 2441513 - DNA, 21 bp, Homo sapiens
gtccaaaaccgccagctctgt

SEQ ID NO: 2441514 - DNA, 22 bp, Homo sapiens
gtccaagaatccacatttctaa

SEQ ID NO: 2441515 - DNA, 23 bp, Homo sapiens
gtccaagaatccacatttctaaa

SEQ ID NO: 2441516 - DNA, 20 bp, Homo sapiens
gtccaagattccggatccta

SEQ ID NO: 2441517 - DNA, 22 bp, Homo sapiens
gtccaagattccggatcctaag

SEQ ID NO: 2441518 - DNA, 21 bp, Homo sapiens
gtccaaggtttaaagagtcta

SEQ ID NO: 2441519 - DNA, 17 bp, Homo sapiens
gtccaatcctatgtttt

SEQ ID NO: 2441520 - DNA, 18 bp, Homo sapiens
gtccaatgagctttctga

SEQ ID NO: 2441521 - DNA, 19 bp, Homo sapiens
gtccaatgagctttctgaa

SEQ ID NO: 2441522 - DNA, 20 bp, Homo sapiens
gtccacaaaataaccaatcc

SEQ ID NO: 2441523 - DNA, 16 bp, Homo sapiens
gtccacaagcttctgt

SEQ ID NO: 2441524 - DNA, 18 bp, Homo sapiens
gtccacgactgtctccat

SEQ ID NO: 2441525 - DNA, 14 bp, Homo sapiens
gtccagctccaacc

SEQ ID NO: 2441526 - DNA, 14 bp, Homo sapiens
gtccagctctggag

SEQ ID NO: 2441527 - DNA, 13 bp, Homo sapiens
gtccaggctgccg

SEQ ID NO: 2441528 - DNA, 16 bp, Homo sapiens
gtccaggctgccgtgg

SEQ ID NO: 2441529 - DNA, 15 bp, Homo sapiens
gtccagtccagtcct

SEQ ID NO: 2441530 - DNA, 17 bp, Homo sapiens
gtccagtccagtcctat

SEQ ID NO: 2441531 - DNA, 19 bp, Homo sapiens
gtccagtcctatctgggct

SEQ ID NO: 2441532 - DNA, 23 bp, Homo sapiens
gtccagtcctatctgggcttcct

SEQ ID NO: 2441533 - DNA, 14 bp, Homo sapiens
gtccatatcacaca

SEQ ID NO: 2441534 - DNA, 18 bp, Homo sapiens
gtccatatcacacacatt

SEQ ID NO: 2441535 - DNA, 13 bp, Homo sapiens
gtccatgggcaga

SEQ ID NO: 2441536 - DNA, 14 bp, Homo sapiens
gtccatgggcagag

SEQ ID NO: 2441537 - DNA, 16 bp, Homo sapiens
gtccattgtccaatcc

SEQ ID NO: 2441538 - DNA, 17 bp, Homo sapiens
gtcccacatccctgggc

SEQ ID NO: 2441539 - DNA, 19 bp, Homo sapiens
gtcccacatccctgggcct

SEQ ID NO: 2441540 - DNA, 20 bp, Homo sapiens
gtcccacatccctgggcctg

SEQ ID NO: 2441541 - DNA, 21 bp, Homo sapiens
gtcccacatccctgggcctgc

SEQ ID NO: 2441542 - DNA, 22 bp, Homo sapiens
gtcccacatccctgggcctgct

SEQ ID NO: 2441543 - DNA, 15 bp, Homo sapiens
gtcccacccccaccc

SEQ ID NO: 2441544 - DNA, 23 bp, Homo sapiens
gtcccacccccacccccagctca

SEQ ID NO: 2441545 - DNA, 21 bp, Homo sapiens
gtcccagaagatgactgaggg

SEQ ID NO: 2441546 - DNA, 11 bp, Homo sapiens
gtcccagcagc

SEQ ID NO: 2441547 - DNA, 14 bp, Homo sapiens
gtcccagcagctgc

SEQ ID NO: 2441548 - DNA, 17 bp, Homo sapiens
gtcccagcagctgccag

SEQ ID NO: 2441549 - DNA, 22 bp, Homo sapiens
gtcccagcagctgccaggagca

SEQ ID NO: 2441550 - DNA, 18 bp, Homo sapiens
gtcccaggttggctctgc

SEQ ID NO: 2441551 - DNA, 19 bp, Homo sapiens
gtcccaggttggctctgcc

SEQ ID NO: 2441552 - DNA, 15 bp, Homo sapiens
gtccccaacagcgcc

SEQ ID NO: 2441553 - DNA, 19 bp, Homo sapiens
gtccccaacagcgcccaaa

SEQ ID NO: 2441554 - DNA, 13 bp, Homo sapiens
gtccccagcctgg

SEQ ID NO: 2441555 - DNA, 20 bp, Homo sapiens
gtcccccactctaaagcaaa

SEQ ID NO: 2441556 - DNA, 11 bp, Homo sapiens
gtccccccacc

SEQ ID NO: 2441557 - DNA, 12 bp, Homo sapiens
gtccccccaccc

SEQ ID NO: 2441558 - DNA, 13 bp, Homo sapiens
gtccccctctgtc

SEQ ID NO: 2441559 - DNA, 19 bp, Homo sapiens
gtccccgagtgcctaggtt

SEQ ID NO: 2441560 - DNA, 15 bp, Homo sapiens
gtcccctccttccca

SEQ ID NO: 2441561 - DNA, 17 bp, Homo sapiens
gtcccctccttcccaag

SEQ ID NO: 2441562 - DNA, 17 bp, Homo sapiens
gtcccggggccagcact

SEQ ID NO: 2441563 - DNA, 22 bp, Homo sapiens
gtcccggggccagcacttccat

SEQ ID NO: 2441564 - DNA, 15 bp, Homo sapiens
gtcccggggctccac

SEQ ID NO: 2441565 - DNA, 22 bp, Homo sapiens
gtccctctcatttagcctgtcc

SEQ ID NO: 2441566 - DNA, 21 bp, Homo sapiens
gtccctgcacagtgacttctg

SEQ ID NO: 2441567 - DNA, 23 bp, Homo sapiens
gtccctgcacagtgacttctgag

SEQ ID NO: 2441568 - DNA, 22 bp, Homo sapiens
gtccctggggctagggggagcc

SEQ ID NO: 2441569 - DNA, 21 bp, Homo sapiens
gtcccttgcccccctggcctc

SEQ ID NO: 2441570 - DNA, 14 bp, Homo sapiens
gtcccttgcctcaa

SEQ ID NO: 2441571 - DNA, 20 bp, Homo sapiens
gtcccttgtatcccctgcag

SEQ ID NO: 2441572 - DNA, 15 bp, Homo sapiens
gtcctagcacagatg

SEQ ID NO: 2441573 - DNA, 15 bp, Homo sapiens
gtcctatctgggctt

SEQ ID NO: 2441574 - DNA, 18 bp, Homo sapiens
gtcctatctgggcttcct

SEQ ID NO: 2441575 - DNA, 19 bp, Homo sapiens
gtcctatctgggcttcctg

SEQ ID NO: 2441576 - DNA, 21 bp, Homo sapiens
gtcctatctgggcttcctgga

SEQ ID NO: 2441577 - DNA, 24 bp, Homo sapiens
gtcctatctgggcttcctggagca

SEQ ID NO: 2441578 - DNA, 14 bp, Homo sapiens
gtcctatggcctca

SEQ ID NO: 2441579 - DNA, 15 bp, Homo sapiens
gtcctatggcctcat

SEQ ID NO: 2441580 - DNA, 16 bp, Homo sapiens
gtcctatggcctcatg

SEQ ID NO: 2441581 - DNA, 13 bp, Homo sapiens
gtcctcctccagg

SEQ ID NO: 2441582 - DNA, 14 bp, Homo sapiens
gtcctcctccaggg

SEQ ID NO: 2441583 - DNA, 18 bp, Homo sapiens
gtcctcctccagggacag

SEQ ID NO: 2441584 - DNA, 20 bp, Homo sapiens
gtcctcctccagggacagca

SEQ ID NO: 2441585 - DNA, 13 bp, Homo sapiens
gtcctcctctgtg

SEQ ID NO: 2441586 - DNA, 17 bp, Homo sapiens
gtcctcctttctgaggg

SEQ ID NO: 2441587 - DNA, 14 bp, Homo sapiens
gtcctcgtttgtgt

SEQ ID NO: 2441588 - DNA, 19 bp, Homo sapiens
gtcctctgagactccagac

SEQ ID NO: 2441589 - DNA, 13 bp, Homo sapiens
gtcctcttctggg

SEQ ID NO: 2441590 - DNA, 14 bp, Homo sapiens
gtcctctttcagct

SEQ ID NO: 2441591 - DNA, 18 bp, Homo sapiens
gtcctctttcagctcctg

SEQ ID NO: 2441592 - DNA, 19 bp, Homo sapiens
gtcctctttcagctcctga

SEQ ID NO: 2441593 - DNA, 14 bp, Homo sapiens
gtcctgagcactgc

SEQ ID NO: 2441594 - DNA, 16 bp, Homo sapiens
gtcctgagcactgcca

SEQ ID NO: 2441595 - DNA, 20 bp, Homo sapiens
gtcctgagcactgccaggag

SEQ ID NO: 2441596 - DNA, 18 bp, Homo sapiens
gtcctgagccccagggag

SEQ ID NO: 2441597 - DNA, 13 bp, Homo sapiens
gtcctgagctcag

SEQ ID NO: 2441598 - DNA, 15 bp, Homo sapiens
gtcctgagctcagcg

SEQ ID NO: 2441599 - DNA, 19 bp, Homo sapiens
gtcctgagctcagcgtgga

SEQ ID NO: 2441600 - DNA, 17 bp, Homo sapiens
gtcctgatcagagccgt

SEQ ID NO: 2441601 - DNA, 15 bp, Homo sapiens
gtcctgcctgtggcg

SEQ ID NO: 2441602 - DNA, 22 bp, Homo sapiens
gtcctgcctgtggcgccgtctc

SEQ ID NO: 2441603 - DNA, 21 bp, Homo sapiens
gtcctggaagcgcgagggcct

SEQ ID NO: 2441604 - DNA, 22 bp, Homo sapiens
gtcctggcgcctggcagtccgt

SEQ ID NO: 2441605 - DNA, 23 bp, Homo sapiens
gtcctggtggtattttcaatagc

SEQ ID NO: 2441606 - DNA, 19 bp, Homo sapiens
gtcctgtcatcatcatggc

SEQ ID NO: 2441607 - DNA, 20 bp, Homo sapiens
gtcctgtcatcatcatggcc

SEQ ID NO: 2441608 - DNA, 21 bp, Homo sapiens
gtcctgtcatcatcatggcca

SEQ ID NO: 2441609 - DNA, 14 bp, Homo sapiens
gtccttagcctgga

SEQ ID NO: 2441610 - DNA, 19 bp, Homo sapiens
gtccttagcctggacctct

SEQ ID NO: 2441611 - DNA, 11 bp, Homo sapiens
gtcctttccct

SEQ ID NO: 2441612 - DNA, 20 bp, Homo sapiens
gtcctttcttccggcccctc

SEQ ID NO: 2441613 - DNA, 22 bp, Homo sapiens
gtccttttcataggtctgaaat

SEQ ID NO: 2441614 - DNA, 20 bp, Homo sapiens
gtcctttttcctctccacac

SEQ ID NO: 2441615 - DNA, 20 bp, Homo sapiens
gtcgcccaggctggagtgca

SEQ ID NO: 2441616 - DNA, 17 bp, Homo sapiens
tcgaggagtaacaatac

SEQ ID NO: 2441617 - DNA, 20 bp, Homo sapiens
tcgaggagtaacaatacaaa

SEQ ID NO: 2441618 - DNA, 19 bp, Homo sapiens
tcgatactgcgactttctg

SEQ ID NO: 2441619 - DNA, 15 bp, Homo sapiens
tcgatttctccagga

SEQ ID NO: 2441620 - DNA, 16 bp, Homo sapiens
tcgcaccattctgact

SEQ ID NO: 2441621 - DNA, 14 bp, Homo sapiens
tcgcagccaccctg

SEQ ID NO: 2441622 - DNA, 21 bp, Homo sapiens
tcgcagccaccctgaggagtc

SEQ ID NO: 2441623 - DNA, 19 bp, Homo sapiens
tcgcatggtcacacactga

SEQ ID NO: 2441624 - DNA, 19 bp, Homo sapiens
tcgcccaggctggagtgca

SEQ ID NO: 2441625 - DNA, 14 bp, Homo sapiens
tcgccccagcaggt

SEQ ID NO: 2441626 - DNA, 12 bp, Homo sapiens
tcgccttcccca

SEQ ID NO: 2441627 - DNA, 22 bp, Homo sapiens
tcgctagcagtggcaggcagag

SEQ ID NO: 2441628 - DNA, 16 bp, Homo sapiens
tcgctcctcaacccct

SEQ ID NO: 2441629 - DNA, 18 bp, Homo sapiens
tcgctcctcaacccctcc

SEQ ID NO: 2441630 - DNA, 22 bp, Homo sapiens
tcgctcctcaacccctcccctc

SEQ ID NO: 2441631 - DNA, 15 bp, Homo sapiens
tcgctcctgcagccc

SEQ ID NO: 2441632 - DNA, 13 bp, Homo sapiens
tcgctctttgaga

SEQ ID NO: 2441633 - DNA, 15 bp, Homo sapiens
tcgctctttgagaaa

SEQ ID NO: 2441634 - DNA, 16 bp, Homo sapiens
tcgctgcttcgtggga

SEQ ID NO: 2441635 - DNA, 20 bp, Homo sapiens
tcgctggactctcagtctct

SEQ ID NO: 2441636 - DNA, 17 bp, Homo sapiens
tcgctgtcctttctaga

SEQ ID NO: 2441637 - DNA, 19 bp, Homo sapiens
tcggaaaaataatcaaaag

SEQ ID NO: 2441638 - DNA, 14 bp, Homo sapiens
tcggattttttcca

SEQ ID NO: 2441639 - DNA, 16 bp, Homo sapiens
tcgggagacagcatca

SEQ ID NO: 2441640 - DNA, 12 bp, Homo sapiens
tcgggctgtgcc

SEQ ID NO: 2441641 - DNA, 13 bp, Homo sapiens
tcgggctgtgccc

SEQ ID NO: 2441642 - DNA, 16 bp, Homo sapiens
tcggggctgggaagtc

SEQ ID NO: 2441643 - DNA, 16 bp, Homo sapiens
tcggggtgcacaggag

SEQ ID NO: 2441644 - DNA, 13 bp, Homo sapiens
tcggtttctccaa

SEQ ID NO: 2441645 - DNA, 22 bp, Homo sapiens
tcgtatgatacttcgacactgt

SEQ ID NO: 2441646 - DNA, 19 bp, Homo sapiens
tcgtcctcgtttgtgttct

SEQ ID NO: 2441647 - DNA, 18 bp, Homo sapiens
tcgtctttcccatgggga

SEQ ID NO: 2441648 - DNA, 16 bp, Homo sapiens
tcgtgaaaacacattt

SEQ ID NO: 2441649 - DNA, 21 bp, Homo sapiens
tcgtgacctgctaggccagag

SEQ ID NO: 2441650 - DNA, 17 bp, Homo sapiens
tcgtggacacacacaga

SEQ ID NO: 2441651 - DNA, 18 bp, Homo sapiens
tcgtggacacacacagac

SEQ ID NO: 2441652 - DNA, 10 bp, Homo sapiens
tcgtggagag

SEQ ID NO: 2441653 - DNA, 18 bp, Homo sapiens
tcgtggagagctaggagc

SEQ ID NO: 2441654 - DNA, 18 bp, Homo sapiens
tcgtggggtgtgctggga

SEQ ID NO: 2441655 - DNA, 11 bp, Homo sapiens
tcgttctgtgg

SEQ ID NO: 2441656 - DNA, 15 bp, Homo sapiens
tcgtttgtgttctgt

SEQ ID NO: 2441657 - DNA, 11 bp, Homo sapiens
tctaaaactcc

SEQ ID NO: 2441658 - DNA, 19 bp, Homo sapiens
tctaaaatcttatagttct

SEQ ID NO: 2441659 - DNA, 14 bp, Homo sapiens
tctaaactggagac

SEQ ID NO: 2441660 - DNA, 15 bp, Homo sapiens
tctaaactggagact

SEQ ID NO: 2441661 - DNA, 19 bp, Homo sapiens
tctaaagatggagtttcta

SEQ ID NO: 2441662 - DNA, 20 bp, Homo sapiens
tctaaagatggagtttctaa

SEQ ID NO: 2441663 - DNA, 23 bp, Homo sapiens
tctaaagatggagtttctaaggt

SEQ ID NO: 2441664 - DNA, 13 bp, Homo sapiens
tctaaagattcta

SEQ ID NO: 2441665 - DNA, 15 bp, Homo sapiens
tctaaagattctata

SEQ ID NO: 2441666 - DNA, 12 bp, Homo sapiens
tctaaagctctg

SEQ ID NO: 2441667 - DNA, 17 bp, Homo sapiens
tctaaaggagtttatgt

SEQ ID NO: 2441668 - DNA, 18 bp, Homo sapiens
tctaaaggagtttatgtt

SEQ ID NO: 2441669 - DNA, 22 bp, Homo sapiens
tctaaaggtccacaggtctaga

SEQ ID NO: 2441670 - DNA, 14 bp, Homo sapiens
tctaaagttctaag

SEQ ID NO: 2441671 - DNA, 15 bp, Homo sapiens
tctaaagttctaaga

SEQ ID NO: 2441672 - DNA, 17 bp, Homo sapiens
tctaaagttctaagatt

SEQ ID NO: 2441673 - DNA, 18 bp, Homo sapiens
tctaaagttctaagattc

SEQ ID NO: 2441674 - DNA, 12 bp, Homo sapiens
tctaacagccct

SEQ ID NO: 2441675 - DNA, 19 bp, Homo sapiens
tctaaccctatactgtagt

SEQ ID NO: 2441676 - DNA, 13 bp, Homo sapiens
tctaacctcatct

SEQ ID NO: 2441677 - DNA, 18 bp, Homo sapiens
tctaacctcatcttcttc

SEQ ID NO: 2441678 - DNA, 23 bp, Homo sapiens
tctaacgcctgagcccagggagg

SEQ ID NO: 2441679 - DNA, 22 bp, Homo sapiens
tctaacggtctgttctgtttca

SEQ ID NO: 2441680 - DNA, 18 bp, Homo sapiens
tctaagaaacatttatat

SEQ ID NO: 2441681 - DNA, 24 bp, Homo sapiens
tctaagaaattgaatactttgaat

SEQ ID NO: 2441682 - DNA, 21 bp, Homo sapiens
tctaagactcaaatgttctaa

SEQ ID NO: 2441683 - DNA, 23 bp, Homo sapiens
tctaagacttactctaagatctt

SEQ ID NO: 2441684 - DNA, 12 bp, Homo sapiens
tctaagatgtga

SEQ ID NO: 2441685 - DNA, 13 bp, Homo sapiens
tctaagatgtgat

SEQ ID NO: 2441686 - DNA, 24 bp, Homo sapiens
tctaagatgtgatattctaagact

SEQ ID NO: 2441687 - DNA, 14 bp, Homo sapiens
tctaagattctaaa

SEQ ID NO: 2441688 - DNA, 15 bp, Homo sapiens
tctaagattctaaag

SEQ ID NO: 2441689 - DNA, 17 bp, Homo sapiens
tctaagattctaatgat

SEQ ID NO: 2441690 - DNA, 13 bp, Homo sapiens
tctaagattctag

SEQ ID NO: 2441691 - DNA, 17 bp, Homo sapiens
tctaagcataaaagatg

SEQ ID NO: 2441692 - DNA, 21 bp, Homo sapiens
tctaaggacctgaaattccaa

SEQ ID NO: 2441693 - DNA, 23 bp, Homo sapiens
tctaaggacctgaaattccaaag

SEQ ID NO: 2441694 - DNA, 20 bp, Homo sapiens
tctaaggcctaggattctaa

SEQ ID NO: 2441695 - DNA, 16 bp, Homo sapiens
tctcagtttgtgtgtc

SEQ ID NO: 2441696 - DNA, 18 bp, Homo sapiens
tctcagtttgtgtgtctt

SEQ ID NO: 2441697 - DNA, 12 bp, Homo sapiens
tctcatccacat

SEQ ID NO: 2441698 - DNA, 20 bp, Homo sapiens
tctcatgccagtaacaggct

SEQ ID NO: 2441699 - DNA, 17 bp, Homo sapiens
tctcatgggtggcactc

SEQ ID NO: 2441700 - DNA, 15 bp, Homo sapiens
tctcattaaaagaat

SEQ ID NO: 2441701 - DNA, 21 bp, Homo sapiens
tctcattggaaatttagcatt

SEQ ID NO: 2441702 - DNA, 22 bp, Homo sapiens
tctcatttagcctgtcctgtca

SEQ ID NO: 2441703 - DNA, 20 bp, Homo sapiens
tctcattttttaaaaaagct

SEQ ID NO: 2441704 - DNA, 17 bp, Homo sapiens
tctccaacatcacagcc

SEQ ID NO: 2441705 - DNA, 19 bp, Homo sapiens
tctccaagcagcttagagt

SEQ ID NO: 2441706 - DNA, 14 bp, Homo sapiens
tctccacagcaacc

SEQ ID NO: 2441707 - DNA, 14 bp, Homo sapiens
tctccactttcagc

SEQ ID NO: 2441708 - DNA, 17 bp, Homo sapiens
tctccactttcagctgt

SEQ ID NO: 2441709 - DNA, 18 bp, Homo sapiens
tctccagaaagccccacc

SEQ ID NO: 2441710 - DNA, 16 bp, Homo sapiens
tctccagcggccctgt

SEQ ID NO: 2441711 - DNA, 14 bp, Homo sapiens
tctccagctgacta

SEQ ID NO: 2441712 - DNA, 15 bp, Homo sapiens
tctccaggcaggtct

SEQ ID NO: 2441713 - DNA, 17 bp, Homo sapiens
tctccaggggctgcttc

SEQ ID NO: 2441714 - DNA, 18 bp, Homo sapiens
tctccaggggctgcttcc

SEQ ID NO: 2441715 - DNA, 15 bp, Homo sapiens
tctccattctgctcc

SEQ ID NO: 2441716 - DNA, 16 bp, Homo sapiens
tctccattctgctcct

SEQ ID NO: 2441717 - DNA, 13 bp, Homo sapiens
tctcccaccctct

SEQ ID NO: 2441718 - DNA, 15 bp, Homo sapiens
tctcccaccctcttc

SEQ ID NO: 2441719 - DNA, 16 bp, Homo sapiens
tctcccaccctcttcc

SEQ ID NO: 2441720 - DNA, 16 bp, Homo sapiens
tctcccagataatgtg

SEQ ID NO: 2441721 - DNA, 18 bp, Homo sapiens
tctcccagataatgtgaa

SEQ ID NO: 2441722 - DNA, 15 bp, Homo sapiens
tcagatggcagcttt

SEQ ID NO: 2441723 - DNA, 18 bp, Homo sapiens
tcagatggcagcttttaa

SEQ ID NO: 2441724 - DNA, 20 bp, Homo sapiens
tcagcaaagtggttccctct

SEQ ID NO: 2441725 - DNA, 19 bp, Homo sapiens
tcagcaagacttctctttg

SEQ ID NO: 2441726 - DNA, 19 bp, Homo sapiens
tcagcacaaggccatctgg

SEQ ID NO: 2441727 - DNA, 16 bp, Homo sapiens
tcagcacatctcaaca

SEQ ID NO: 2441728 - DNA, 20 bp, Homo sapiens
tcagcacatctcaacaggcc

SEQ ID NO: 2441729 - DNA, 18 bp, Homo sapiens
tcagcactgcctgctccc

SEQ ID NO: 2441730 - DNA, 15 bp, Homo sapiens
tcagcatgaatttgt

SEQ ID NO: 2441731 - DNA, 12 bp, Homo sapiens
tcagcatttgac

SEQ ID NO: 2441732 - DNA, 17 bp, Homo sapiens
tcagccaccctgagttg

SEQ ID NO: 2441733 - DNA, 12 bp, Homo sapiens
tcagccagcact

SEQ ID NO: 2441734 - DNA, 19 bp, Homo sapiens
tcagccccaccccagggca

SEQ ID NO: 2441735 - DNA, 17 bp, Homo sapiens
tcagcctgaaccccagg

SEQ ID NO: 2441736 - DNA, 15 bp, Homo sapiens
tcagcctggccagac

SEQ ID NO: 2441737 - DNA, 20 bp, Homo sapiens
tcagcctggccagacacagg

SEQ ID NO: 2441738 - DNA, 16 bp, Homo sapiens
tcagccttgccagaga

SEQ ID NO: 2441739 - DNA, 17 bp, Homo sapiens
tcagccttgccagagat

SEQ ID NO: 2441740 - DNA, 23 bp, Homo sapiens
tcagcgactccgttggccactcc

SEQ ID NO: 2441741 - DNA, 14 bp, Homo sapiens
tcagcgtggccttg

SEQ ID NO: 2441742 - DNA, 12 bp, Homo sapiens
tcagctcctgac

SEQ ID NO: 2441743 - DNA, 17 bp, Homo sapiens
tcagctcctgaccagtt

SEQ ID NO: 2441744 - DNA, 18 bp, Homo sapiens
tcagctcctgaccagttg

SEQ ID NO: 2441745 - DNA, 16 bp, Homo sapiens
tcagctccttcctgga

SEQ ID NO: 2441746 - DNA, 19 bp, Homo sapiens
tcagctctgggccattctc

SEQ ID NO: 2441747 - DNA, 21 bp, Homo sapiens
tcagctgcaaggtactctggt

SEQ ID NO: 2441748 - DNA, 20 bp, Homo sapiens
tcagctgcattccgcagccc

SEQ ID NO: 2441749 - DNA, 14 bp, Homo sapiens
tcagctgtcttttg

SEQ ID NO: 2441750 - DNA, 15 bp, Homo sapiens
tcagctgtcttttgg

SEQ ID NO: 2441751 - DNA, 16 bp, Homo sapiens
tcaggaaaaggcctgg

SEQ ID NO: 2441752 - DNA, 18 bp, Homo sapiens
tcaggaaaattgaatgca

SEQ ID NO: 2441753 - DNA, 21 bp, Homo sapiens
tcaggaaacgagactttccat

SEQ ID NO: 2441754 - DNA, 16 bp, Homo sapiens
tcaggaattcttggag

SEQ ID NO: 2441755 - DNA, 15 bp, Homo sapiens
tcaggacacaggcct

SEQ ID NO: 2441756 - DNA, 19 bp, Homo sapiens
tcaggacacaggcctgtgt

SEQ ID NO: 2441757 - DNA, 15 bp, Homo sapiens
tcaggactgggagcc

SEQ ID NO: 2441758 - DNA, 23 bp, Homo sapiens
tcaggactgggagcccccagcct

SEQ ID NO: 2441759 - DNA, 17 bp, Homo sapiens
tcaggacttgaaagaaa

SEQ ID NO: 2441760 - DNA, 14 bp, Homo sapiens
tcaggagcctgtga

SEQ ID NO: 2441761 - DNA, 19 bp, Homo sapiens
tcaggaggaatactgaaca

SEQ ID NO: 2441762 - DNA, 17 bp, Homo sapiens
tcaggaggcaggacctt

SEQ ID NO: 2441763 - DNA, 19 bp, Homo sapiens
tcaggatgagggaaaagaa

SEQ ID NO: 2441764 - DNA, 14 bp, Homo sapiens
tcaggcacacagct

SEQ ID NO: 2441765 - DNA, 13 bp, Homo sapiens
tcaggcagctcaa

SEQ ID NO: 2441766 - DNA, 20 bp, Homo sapiens
tcaggcattggatatttttt

SEQ ID NO: 2441767 - DNA, 14 bp, Homo sapiens
tcaggccagagcca

SEQ ID NO: 2441768 - DNA, 12 bp, Homo sapiens
tcaggcccaggc

SEQ ID NO: 2441769 - DNA, 16 bp, Homo sapiens
tcaggcccggcagggc

SEQ ID NO: 2441770 - DNA, 18 bp, Homo sapiens
tcaggcctttgagctcag

SEQ ID NO: 2441771 - DNA, 12 bp, Homo sapiens
tcaggctaggcc

SEQ ID NO: 2441772 - DNA, 20 bp, Homo sapiens
tcagggaaggaggagcctgt

SEQ ID NO: 2441773 - DNA, 21 bp, Homo sapiens
tcagggaaggaggagcctgtc

SEQ ID NO: 2441774 - DNA, 22 bp, Homo sapiens
tcagggaaggaggagcctgtcc

SEQ ID NO: 2441775 - DNA, 15 bp, Homo sapiens
tcagggaggccctgt

SEQ ID NO: 2441776 - DNA, 19 bp, Homo sapiens
tcagggagtgttccctatc

SEQ ID NO: 2441777 - DNA, 16 bp, Homo sapiens
tcagggcaaagccagg

SEQ ID NO: 2441778 - DNA, 22 bp, Homo sapiens
tcagggcaaagccaggtccctc

SEQ ID NO: 2441779 - DNA, 19 bp, Homo sapiens
tcagggcagcgccaggctg

SEQ ID NO: 2441780 - DNA, 14 bp, Homo sapiens
tcagggccatgctg

SEQ ID NO: 2441781 - DNA, 17 bp, Homo sapiens
tcagggccatgctgagg

SEQ ID NO: 2441782 - DNA, 15 bp, Homo sapiens
tcaggtatacctcac

SEQ ID NO: 2441783 - DNA, 21 bp, Homo sapiens
tcaggtgaaactccagatgcc

SEQ ID NO: 2441784 - DNA, 16 bp, Homo sapiens
tcaggtgaaaggaaat

SEQ ID NO: 2441785 - DNA, 17 bp, Homo sapiens
tcagtaaataactggaa

SEQ ID NO: 2441786 - DNA, 17 bp, Homo sapiens
tcagtaccctctcagct

SEQ ID NO: 2441787 - DNA, 19 bp, Homo sapiens
tcagtaccctctcagctcc

SEQ ID NO: 2441788 - DNA, 13 bp, Homo sapiens
tcagtatgaatta

SEQ ID NO: 2441789 - DNA, 17 bp, Homo sapiens
tcagtatgaattattca

SEQ ID NO: 2441790 - DNA, 15 bp, Homo sapiens
tcagtattatatgta

SEQ ID NO: 2441791 - DNA, 16 bp, Homo sapiens
tcagtattatatgtac

SEQ ID NO: 2441792 - DNA, 14 bp, Homo sapiens
tcagtcacagccac

SEQ ID NO: 2441793 - DNA, 15 bp, Homo sapiens
tcagtcacagccacc

SEQ ID NO: 2441794 - DNA, 20 bp, Homo sapiens
tcagtctctcttctctccag

SEQ ID NO: 2441795 - DNA, 13 bp, Homo sapiens
tcagtgaagacta

SEQ ID NO: 2441796 - DNA, 17 bp, Homo sapiens
tcagtgaagttgctgct

SEQ ID NO: 2441797 - DNA, 20 bp, Homo sapiens
tcagtgaagttgctgcttct

SEQ ID NO: 2441798 - DNA, 16 bp, Homo sapiens
tcagttctaggaaaat

SEQ ID NO: 2441799 - DNA, 17 bp, Homo sapiens
tcagttgattttctgga

SEQ ID NO: 2441800 - DNA, 13 bp, Homo sapiens
tcagttgtctctg

SEQ ID NO: 2441801 - DNA, 15 bp, Homo sapiens
tcagttgtgactaac

SEQ ID NO: 2441802 - DNA, 17 bp, Homo sapiens
tcagtttcacagaaaat

SEQ ID NO: 2441803 - DNA, 19 bp, Homo sapiens
tcagtttcacagaaaataa

SEQ ID NO: 2441804 - DNA, 14 bp, Homo sapiens
tcagtttcataaaa

SEQ ID NO: 2441805 - DNA, 19 bp, Homo sapiens
tcagtttcataaaaggaga

SEQ ID NO: 2441806 - DNA, 12 bp, Homo sapiens
tcagttttcatt

SEQ ID NO: 2441807 - DNA, 19 bp, Homo sapiens
tcataattgcattgacttt

SEQ ID NO: 2441808 - DNA, 23 bp, Homo sapiens
tcataattgcattgactttcccc

SEQ ID NO: 2441809 - DNA, 15 bp, Homo sapiens
tcatacagagaagtc

SEQ ID NO: 2441810 - DNA, 14 bp, Homo sapiens
tcatagcccagtag

SEQ ID NO: 2441811 - DNA, 16 bp, Homo sapiens
tcataggtctgaaatt

SEQ ID NO: 2441812 - DNA, 15 bp, Homo sapiens
tcatagtaacttctt

SEQ ID NO: 2441813 - DNA, 16 bp, Homo sapiens
tcatagtaacttctta

SEQ ID NO: 2441814 - DNA, 13 bp, Homo sapiens
tcatataaagtat

SEQ ID NO: 2441815 - DNA, 16 bp, Homo sapiens
tcatataattatatgt

SEQ ID NO: 2441816 - DNA, 22 bp, Homo sapiens
tcatatatatcacccagacata

SEQ ID NO: 2441817 - DNA, 13 bp, Homo sapiens
tcatcaagagaat

SEQ ID NO: 2441818 - DNA, 18 bp, Homo sapiens
tccaatgtctggagacca

SEQ ID NO: 2441819 - DNA, 23 bp, Homo sapiens
tccaatgtctggagaccaccagg

SEQ ID NO: 2441820 - DNA, 20 bp, Homo sapiens
tccaattagtttccttttta

SEQ ID NO: 2441821 - DNA, 20 bp, Homo sapiens
tccacaaaataaccaatcct

SEQ ID NO: 2441822 - DNA, 14 bp, Homo sapiens
tccacaaattatta

SEQ ID NO: 2441823 - DNA, 21 bp, Homo sapiens
tccacaaattattaatgaaaa

SEQ ID NO: 2441824 - DNA, 13 bp, Homo sapiens
tccacacatgaat

SEQ ID NO: 2441825 - DNA, 17 bp, Homo sapiens
tccacacatgaatctgc

SEQ ID NO: 2441826 - DNA, 14 bp, Homo sapiens
tccacactgcacaa

SEQ ID NO: 2441827 - DNA, 15 bp, Homo sapiens
tccacagaggacaca

SEQ ID NO: 2441828 - DNA, 15 bp, Homo sapiens
tccacagggtcccac

SEQ ID NO: 2441829 - DNA, 23 bp, Homo sapiens
gtttcagcactagccaaacctca

SEQ ID NO: 2441830 - DNA, 18 bp, Homo sapiens
gtttcatgtaatcctcaa

SEQ ID NO: 2441831 - DNA, 19 bp, Homo sapiens
gtttcatttagtcatgtga

SEQ ID NO: 2441832 - DNA, 21 bp, Homo sapiens
gtttcatttagtcatgtgacc

SEQ ID NO: 2441833 - DNA, 20 bp, Homo sapiens
gtttcctctgttcaaagctg

SEQ ID NO: 2441834 - DNA, 14 bp, Homo sapiens
gtttctaagattct

SEQ ID NO: 2441835 - DNA, 19 bp, Homo sapiens
gtttctaagattctaaagg

SEQ ID NO: 2441836 - DNA, 20 bp, Homo sapiens
gtttctaagattctaaaggt

SEQ ID NO: 2441837 - DNA, 21 bp, Homo sapiens
gtttctaagattctaaaggtc

SEQ ID NO: 2441838 - DNA, 23 bp, Homo sapiens
gtttctaggtaatttttacagaa

SEQ ID NO: 2441839 - DNA, 22 bp, Homo sapiens
gtttctgaggctttatgataat

SEQ ID NO: 2441840 - DNA, 17 bp, Homo sapiens
gtttctgtcgttaaaaa

SEQ ID NO: 2441841 - DNA, 22 bp, Homo sapiens
gtttctgtcgttaaaaacagat

SEQ ID NO: 2441842 - DNA, 12 bp, Homo sapiens
gtttctgttcca

SEQ ID NO: 2441843 - DNA, 13 bp, Homo sapiens
gtttctgttccaa

SEQ ID NO: 2441844 - DNA, 21 bp, Homo sapiens
gtttcttaaataagaaacttt

SEQ ID NO: 2441845 - DNA, 19 bp, Homo sapiens
gtttcttaagggcacacac

SEQ ID NO: 2441846 - DNA, 16 bp, Homo sapiens
gtttcttcctgccagc

SEQ ID NO: 2441847 - DNA, 12 bp, Homo sapiens
gtttctttcttt

SEQ ID NO: 2441848 - DNA, 23 bp, Homo sapiens
gtttctttctttctttattttga

SEQ ID NO: 2441849 - DNA, 16 bp, Homo sapiens
gtttgactagatgatg

SEQ ID NO: 2441850 - DNA, 15 bp, Homo sapiens
gtttgatgaggccct

SEQ ID NO: 2441851 - DNA, 13 bp, Homo sapiens
gtttgatttcaac

SEQ ID NO: 2441852 - DNA, 15 bp, Homo sapiens
gtttgatttcattaa

SEQ ID NO: 2441853 - DNA, 18 bp, Homo sapiens
gtttgccttctactttta

SEQ ID NO: 2441854 - DNA, 20 bp, Homo sapiens
gtttgcttcatgtgtcccag

SEQ ID NO: 2441855 - DNA, 21 bp, Homo sapiens
gtttgctttctgatcaaggcc

SEQ ID NO: 2441856 - DNA, 16 bp, Homo sapiens
gtttggaaggagcaga

SEQ ID NO: 2441857 - DNA, 21 bp, Homo sapiens
gtttggatatgtaaaacattt

SEQ ID NO: 2441858 - DNA, 21 bp, Homo sapiens
gtttggctggcttgtttgatt

SEQ ID NO: 2441859 - DNA, 18 bp, Homo sapiens
gtttggctttcagggagg

SEQ ID NO: 2441860 - DNA, 15 bp, Homo sapiens
gtttggggcaggagt

SEQ ID NO: 2441861 - DNA, 17 bp, Homo sapiens
gtttggggcaggagtag

SEQ ID NO: 2441862 - DNA, 21 bp, Homo sapiens
gtttggggcaggagtagctga

SEQ ID NO: 2441863 - DNA, 20 bp, Homo sapiens
gtttgggtaaaatactttta

SEQ ID NO: 2441864 - DNA, 17 bp, Homo sapiens
gtttgtgacagggcggg

SEQ ID NO: 2441865 - DNA, 22 bp, Homo sapiens
gtttgtgtatttacgctttgat

SEQ ID NO: 2441866 - DNA, 20 bp, Homo sapiens
gtttgtgtgttgtctcttga

SEQ ID NO: 2441867 - DNA, 15 bp, Homo sapiens
gtttgtgttctgttt

SEQ ID NO: 2441868 - DNA, 14 bp, Homo sapiens
gtttgtttttgcgt

SEQ ID NO: 2441869 - DNA, 23 bp, Homo sapiens
gttttaaacattaatagcagcct

SEQ ID NO: 2441870 - DNA, 12 bp, Homo sapiens
gttttacattgt

SEQ ID NO: 2441871 - DNA, 20 bp, Homo sapiens
gttttagattttctggttct

SEQ ID NO: 2441872 - DNA, 15 bp, Homo sapiens
gttttaggttctaaa

SEQ ID NO: 2441873 - DNA, 17 bp, Homo sapiens
gttttattcttggtttt

SEQ ID NO: 2441874 - DNA, 21 bp, Homo sapiens
gttttcatccataactgaaca

SEQ ID NO: 2441875 - DNA, 17 bp, Homo sapiens
gttttcatttggttcat

SEQ ID NO: 2441876 - DNA, 11 bp, Homo sapiens
gttttctaatt

SEQ ID NO: 2441877 - DNA, 12 bp, Homo sapiens
gttttctaattg

SEQ ID NO: 2441878 - DNA, 19 bp, Homo sapiens
gttttgaagctactgtgtg

SEQ ID NO: 2441879 - DNA, 15 bp, Homo sapiens
gttttgaaggcaaaa

SEQ ID NO: 2441880 - DNA, 17 bp, Homo sapiens
gttttgctacataatta

SEQ ID NO: 2441881 - DNA, 17 bp, Homo sapiens
gttttggacagtttacc

SEQ ID NO: 2441882 - DNA, 18 bp, Homo sapiens
gttttggacagtttacca

SEQ ID NO: 2441883 - DNA, 15 bp, Homo sapiens
gttttggagagtttg

SEQ ID NO: 2441884 - DNA, 20 bp, Homo sapiens
gttttggctgaaattctcct

SEQ ID NO: 2441885 - DNA, 23 bp, Homo sapiens
gttttggctgaaattctcctgga

SEQ ID NO: 2441886 - DNA, 12 bp, Homo sapiens
gttttgtattct

SEQ ID NO: 2441887 - DNA, 18 bp, Homo sapiens
gttttgtgtttgttgtag

SEQ ID NO: 2441888 - DNA, 17 bp, Homo sapiens
gttttgttatataattt

SEQ ID NO: 2441889 - DNA, 14 bp, Homo sapiens
gttttgttcaccat

SEQ ID NO: 2441890 - DNA, 14 bp, Homo sapiens
gttttgttgacatt

SEQ ID NO: 2441891 - DNA, 14 bp, Homo sapiens
gtttttaaactgta

SEQ ID NO: 2441892 - DNA, 18 bp, Homo sapiens
gtttttaaactgtacagt

SEQ ID NO: 2441893 - DNA, 19 bp, Homo sapiens
gtttttaataaaagaaaat

SEQ ID NO: 2441894 - DNA, 13 bp, Homo sapiens
gtttttaatgtat

SEQ ID NO: 2441895 - DNA, 18 bp, Homo sapiens
gtttttaatgtatagtaa

SEQ ID NO: 2441896 - DNA, 11 bp, Homo sapiens
gtttttctatt

SEQ ID NO: 2441897 - DNA, 13 bp, Homo sapiens
gtttttctattaa

SEQ ID NO: 2441898 - DNA, 18 bp, Homo sapiens
gtttttctattaaaagac

SEQ ID NO: 2441899 - DNA, 19 bp, Homo sapiens
gtttttctattaaaagact

SEQ ID NO: 2441900 - DNA, 20 bp, Homo sapiens
gtttttctattaaaagactc

SEQ ID NO: 2441901 - DNA, 14 bp, Homo sapiens
gtttttgagatatt

SEQ ID NO: 2441902 - DNA, 16 bp, Homo sapiens
gtttttgagatattaa

SEQ ID NO: 2441903 - DNA, 15 bp, Homo sapiens
gtttttgcacatgtt

SEQ ID NO: 2441904 - DNA, 18 bp, Homo sapiens
gtttttggtttttaaaac

SEQ ID NO: 2441905 - DNA, 16 bp, Homo sapiens
gttttttagttgaatt

SEQ ID NO: 2441906 - DNA, 23 bp, Homo sapiens
gttttttgccacagcttttgcaa

SEQ ID NO: 2441907 - DNA, 15 bp, Homo sapiens
gttttttttcagttg

SEQ ID NO: 2441908 - DNA, 17 bp, Homo sapiens
gttttttttttcttgtc

SEQ ID NO: 2441909 - DNA, 18 bp, Homo sapiens
gttttttttttcttgtct

SEQ ID NO: 2441910 - DNA, 17 bp, Homo sapiens
gttttttttttgtttgt

SEQ ID NO: 2441911 - DNA, 22 bp, Homo sapiens
taaaaaaaaaaaaaatgttctt

SEQ ID NO: 2441912 - DNA, 22 bp, Homo sapiens
taaaaaaataagaagaatgctt

SEQ ID NO: 2441913 - DNA, 11 bp, Homo sapiens
taaaaaacaac

SEQ ID NO: 2441914 - DNA, 17 bp, Homo sapiens
taaaaaactaaaaacta

SEQ ID NO: 2441915 - DNA, 13 bp, Homo sapiens
taaaaaagataaa

SEQ ID NO: 2441916 - DNA, 16 bp, Homo sapiens
taaaaaagataaacac

SEQ ID NO: 2441917 - DNA, 17 bp, Homo sapiens
taaaaaagataaacaca

SEQ ID NO: 2441918 - DNA, 17 bp, Homo sapiens
taaaaaagcttaaaact

SEQ ID NO: 2441919 - DNA, 19 bp, Homo sapiens
taaaaaagcttaaaacttt

SEQ ID NO: 2441920 - DNA, 19 bp, Homo sapiens
taaaaaatggttcagaatt

SEQ ID NO: 2441921 - DNA, 20 bp, Homo sapiens
taaaaagcttccatgattct

SEQ ID NO: 2441922 - DNA, 17 bp, Homo sapiens
taaaaagtgcttttgtg

SEQ ID NO: 2441923 - DNA, 16 bp, Homo sapiens
taaaaataaaaaagat

SEQ ID NO: 2441924 - DNA, 21 bp, Homo sapiens
taaaaataaaaaagatcccaa

SEQ ID NO: 2441925 - DNA, 12 bp, Homo sapiens
taaaacattaaa

SEQ ID NO: 2441926 - DNA, 16 bp, Homo sapiens
taaaacattaaaatat

SEQ ID NO: 2441927 - DNA, 20 bp, Homo sapiens
taaaacatttattttgacat

SEQ ID NO: 2441928 - DNA, 15 bp, Homo sapiens
taaaactttcctcgc

SEQ ID NO: 2441929 - DNA, 15 bp, Homo sapiens
taaaactttgctgcc

SEQ ID NO: 2441930 - DNA, 16 bp, Homo sapiens
taaaagactcatccgt

SEQ ID NO: 2441931 - DNA, 14 bp, Homo sapiens
taaaagataaatta

SEQ ID NO: 2441932 - DNA, 12 bp, Homo sapiens
taaaagcaaaaa

SEQ ID NO: 2441933 - DNA, 17 bp, Homo sapiens
taaaagcaaaaaagaaa

SEQ ID NO: 2441934 - DNA, 15 bp, Homo sapiens
tcctctagctgtggg

SEQ ID NO: 2441935 - DNA, 14 bp, Homo sapiens
tcctctccccagcc

SEQ ID NO: 2441936 - DNA, 18 bp, Homo sapiens
tcctctccccagcccaga

SEQ ID NO: 2441937 - DNA, 21 bp, Homo sapiens
tcctctccccagcccagagac

SEQ ID NO: 2441938 - DNA, 21 bp, Homo sapiens
tcctctgctgacctgctgacc

SEQ ID NO: 2441939 - DNA, 21 bp, Homo sapiens
tcctctgtcagtcacagccac

SEQ ID NO: 2441940 - DNA, 19 bp, Homo sapiens
tcctctgttcaaagctgcc

SEQ ID NO: 2441941 - DNA, 14 bp, Homo sapiens
tcctcttccccaga

SEQ ID NO: 2441942 - DNA, 17 bp, Homo sapiens
tcctcttcccccaagat

SEQ ID NO: 2441943 - DNA, 18 bp, Homo sapiens
tcctcttccctctctgca

SEQ ID NO: 2441944 - DNA, 20 bp, Homo sapiens
tcctcttctactcacttttc

SEQ ID NO: 2441945 - DNA, 18 bp, Homo sapiens
tcctctttcagctcctga

SEQ ID NO: 2441946 - DNA, 23 bp, Homo sapiens
tcctgaaaaggtttatgaaaaag

SEQ ID NO: 2441947 - DNA, 23 bp, Homo sapiens
tcctgaagaaccagtccccccac

SEQ ID NO: 2441948 - DNA, 22 bp, Homo sapiens
tcctgacacccttctcccactc

SEQ ID NO: 2441949 - DNA, 22 bp, Homo sapiens
tcctgaccagttgcagtcactc

SEQ ID NO: 2441950 - DNA, 15 bp, Homo sapiens
tcctgagaaagctca

SEQ ID NO: 2441951 - DNA, 12 bp, Homo sapiens
tcctgagcactg

SEQ ID NO: 2441952 - DNA, 14 bp, Homo sapiens
tccctaatgtgttt

SEQ ID NO: 2441953 - DNA, 18 bp, Homo sapiens
tccctactgaagcccttg

SEQ ID NO: 2441954 - DNA, 21 bp, Homo sapiens
tccctatcactgaagcttttt

SEQ ID NO: 2441955 - DNA, 14 bp, Homo sapiens
tccctcacaagtgg

SEQ ID NO: 2441956 - DNA, 20 bp, Homo sapiens
tccctcacctgtagcagcca

SEQ ID NO: 2441957 - DNA, 14 bp, Homo sapiens
tccctcaccttctg

SEQ ID NO: 2441958 - DNA, 12 bp, Homo sapiens
tccctcagactg

SEQ ID NO: 2441959 - DNA, 14 bp, Homo sapiens
tccctcagactggg

SEQ ID NO: 2441960 - DNA, 16 bp, Homo sapiens
tccctcagactggggc

SEQ ID NO: 2441961 - DNA, 23 bp, Homo sapiens
tccctccaagtggtccacaagct

SEQ ID NO: 2441962 - DNA, 23 bp, Homo sapiens
tccctcccagagcacctgctgtc

SEQ ID NO: 2441963 - DNA, 22 bp, Homo sapiens
tccctcccagaggagccaccag

SEQ ID NO: 2441964 - DNA, 12 bp, Homo sapiens
tccctccccccc

SEQ ID NO: 2441965 - DNA, 15 bp, Homo sapiens
tccctccccttctct

SEQ ID NO: 2441966 - DNA, 13 bp, Homo sapiens
tccctccccttgc

SEQ ID NO: 2441967 - DNA, 19 bp, Homo sapiens
tccctccgcccccaggtag

SEQ ID NO: 2441968 - DNA, 17 bp, Homo sapiens
tctggctggtgttaaca

SEQ ID NO: 2441969 - DNA, 13 bp, Homo sapiens
tctgggacctcag

SEQ ID NO: 2441970 - DNA, 16 bp, Homo sapiens
tctgggacctcagttt

SEQ ID NO: 2441971 - DNA, 16 bp, Homo sapiens
tctgggagtcacacag

SEQ ID NO: 2441972 - DNA, 18 bp, Homo sapiens
tctgggagtcacacagtg

SEQ ID NO: 2441973 - DNA, 18 bp, Homo sapiens
tctgggataagtaagttt

SEQ ID NO: 2441974 - DNA, 22 bp, Homo sapiens
tctgggccttggcctggagcac

SEQ ID NO: 2441975 - DNA, 12 bp, Homo sapiens
tctgggctctga

SEQ ID NO: 2441976 - DNA, 11 bp, Homo sapiens
tctgggctgga

SEQ ID NO: 2441977 - DNA, 19 bp, Homo sapiens
tctgggctggatgagctcc

SEQ ID NO: 2441978 - DNA, 17 bp, Homo sapiens
tctgggcttcctggagc

SEQ ID NO: 2441979 - DNA, 17 bp, Homo sapiens
tctggggagcaggcagc

SEQ ID NO: 2441980 - DNA, 21 bp, Homo sapiens
tctggggagcaggcagccagc

SEQ ID NO: 2441981 - DNA, 17 bp, Homo sapiens
tctggggcaggctgggc

SEQ ID NO: 2441982 - DNA, 18 bp, Homo sapiens
tctggggcaggctgggcc

SEQ ID NO: 2441983 - DNA, 20 bp, Homo sapiens
tctggggcaggctgggccat

SEQ ID NO: 2441984 - DNA, 15 bp, Homo sapiens
tctgggggctgcagt

SEQ ID NO: 2441985 - DNA, 17 bp, Homo sapiens
tctggggggtggccagg

SEQ ID NO: 2441986 - DNA, 20 bp, Homo sapiens
tctggggggtggccaggccg

SEQ ID NO: 2441987 - DNA, 21 bp, Homo sapiens
tctggggtatggcgtaagtac

SEQ ID NO: 2441988 - DNA, 19 bp, Homo sapiens
tctgggtgctactggggaa

SEQ ID NO: 2441989 - DNA, 13 bp, Homo sapiens
tctgggtggccct

SEQ ID NO: 2441990 - DNA, 19 bp, Homo sapiens
tctgggtggggcccaggcc

SEQ ID NO: 2441991 - DNA, 20 bp, Homo sapiens
tctggtaggaatagcatgtc

SEQ ID NO: 2441992 - DNA, 13 bp, Homo sapiens
tctggtccttttt

SEQ ID NO: 2441993 - DNA, 15 bp, Homo sapiens
tctggtcgctcctgc

SEQ ID NO: 2441994 - DNA, 17 bp, Homo sapiens
tctggtcgctcctgccc

SEQ ID NO: 2441995 - DNA, 13 bp, Homo sapiens
tctggtgcctcca

SEQ ID NO: 2441996 - DNA, 18 bp, Homo sapiens
tctggttctcaattccaa

SEQ ID NO: 2441997 - DNA, 19 bp, Homo sapiens
tctggttctcaattccaac

SEQ ID NO: 2441998 - DNA, 15 bp, Homo sapiens
tctggttgaactctg

SEQ ID NO: 2441999 - DNA, 18 bp, Homo sapiens
tctggttgtttctgttcc

SEQ ID NO: 2442000 - DNA, 22 bp, Homo sapiens
tccttgatttatcacacaaagc

SEQ ID NO: 2442001 - DNA, 17 bp, Homo sapiens
tccttgcttcctgtctt

SEQ ID NO: 2442002 - DNA, 13 bp, Homo sapiens
tccttgggccctt

SEQ ID NO: 2442003 - DNA, 14 bp, Homo sapiens
tccttgggcccttt

SEQ ID NO: 2442004 - DNA, 18 bp, Homo sapiens
tccttgtgggcctgggct

SEQ ID NO: 2442005 - DNA, 21 bp, Homo sapiens
tccttgttgtttcttgcctga

SEQ ID NO: 2442006 - DNA, 17 bp, Homo sapiens
tcctttctgagggcccg

SEQ ID NO: 2442007 - DNA, 12 bp, Homo sapiens
tcctttcttccg

SEQ ID NO: 2442008 - DNA, 12 bp, Homo sapiens
tcctttcttttc

SEQ ID NO: 2442009 - DNA, 13 bp, Homo sapiens
tcctttcttttcc

SEQ ID NO: 2442010 - DNA, 17 bp, Homo sapiens
tcctttgtgcttagtta

SEQ ID NO: 2442011 - DNA, 12 bp, Homo sapiens
tccttttaaaga

SEQ ID NO: 2442012 - DNA, 12 bp, Homo sapiens
tcctttttaata

SEQ ID NO: 2442013 - DNA, 19 bp, Homo sapiens
tcgaaagctctagaatctg

SEQ ID NO: 2442014 - DNA, 14 bp, Homo sapiens
tcgaatctctgtgc

SEQ ID NO: 2442015 - DNA, 12 bp, Homo sapiens
tcgaatgaaatt

SEQ ID NO: 2442016 - DNA, 17 bp, Homo sapiens
tcgaatgaaattaactg

SEQ ID NO: 2442017 - DNA, 19 bp, Homo sapiens
tcgagattatcgttttctt

SEQ ID NO: 2442018 - DNA, 17 bp, Homo sapiens
tcgagcagcattttatt

SEQ ID NO: 2442019 - DNA, 17 bp, Homo sapiens
tcgagcagtcctgcctc

SEQ ID NO: 2442020 - DNA, 14 bp, Homo sapiens
tcgagcgccctgca

SEQ ID NO: 2442021 - DNA, 18 bp, Homo sapiens
tcgagcgccctgcagacc

SEQ ID NO: 2442022 - DNA, 20 bp, Homo sapiens
tgaagcaaatgtcatgctgc

SEQ ID NO: 2442023 - DNA, 20 bp, Homo sapiens
tgaagcaggttcccaagctc

SEQ ID NO: 2442024 - DNA, 19 bp, Homo sapiens
tgaagccaattcagacagg

SEQ ID NO: 2442025 - DNA, 15 bp, Homo sapiens
tgaagccctcccagg

SEQ ID NO: 2442026 - DNA, 19 bp, Homo sapiens
tgaagctgttgtgtgaggt

SEQ ID NO: 2442027 - DNA, 12 bp, Homo sapiens
tgaaggaccctt

SEQ ID NO: 2442028 - DNA, 17 bp, Homo sapiens
tgaaggcaaaattgcaa

SEQ ID NO: 2442029 - DNA, 18 bp, Homo sapiens
tgaaggcaaaattgcaaa

SEQ ID NO: 2442030 - DNA, 15 bp, Homo sapiens
tgaagggccagagcc

SEQ ID NO: 2442031 - DNA, 18 bp, Homo sapiens
tgaagggccagagccagg

SEQ ID NO: 2442032 - DNA, 20 bp, Homo sapiens
tgaaggtaaataaaaagaaa

SEQ ID NO: 2442033 - DNA, 16 bp, Homo sapiens
tgaagtaaactttttg

SEQ ID NO: 2442034 - DNA, 22 bp, Homo sapiens
tgaagtaaactttttgttctgg

SEQ ID NO: 2442035 - DNA, 17 bp, Homo sapiens
tgaagtattttttcagt

SEQ ID NO: 2442036 - DNA, 17 bp, Homo sapiens
tgaagtgagcacagcct

SEQ ID NO: 2442037 - DNA, 14 bp, Homo sapiens
tgaagttttacatt

SEQ ID NO: 2442038 - DNA, 17 bp, Homo sapiens
tgaagttttacattgtt

SEQ ID NO: 2442039 - DNA, 18 bp, Homo sapiens
tgaataaaaactcaagga

SEQ ID NO: 2442040 - DNA, 14 bp, Homo sapiens
tgaataaatgtctt

SEQ ID NO: 2442041 - DNA, 18 bp, Homo sapiens
tgaataccactctgtaat

SEQ ID NO: 2442042 - DNA, 16 bp, Homo sapiens
tgaatactttgaatgt

SEQ ID NO: 2442043 - DNA, 18 bp, Homo sapiens
tgaatagccatatttgta

SEQ ID NO: 2442044 - DNA, 22 bp, Homo sapiens
tgaatagccatatttgtaaaat

SEQ ID NO: 2442045 - DNA, 17 bp, Homo sapiens
tgaatcaataatatatt

SEQ ID NO: 2442046 - DNA, 21 bp, Homo sapiens
tgaatcattgtatgtggtcat

SEQ ID NO: 2442047 - DNA, 17 bp, Homo sapiens
tgaatgaaaatgtccat

SEQ ID NO: 2442048 - DNA, 11 bp, Homo sapiens
tgaatgaacac

SEQ ID NO: 2442049 - DNA, 15 bp, Homo sapiens
tgaatgaacactctt

SEQ ID NO: 2442050 - DNA, 11 bp, Homo sapiens
tgaatgaagca

SEQ ID NO: 2442051 - DNA, 22 bp, Homo sapiens
tgaatgaagcaaatgtcatgct

SEQ ID NO: 2442052 - DNA, 16 bp, Homo sapiens
tgaatgatttttcttt

SEQ ID NO: 2442053 - DNA, 15 bp, Homo sapiens
tgaatgccactgcct

SEQ ID NO: 2442054 - DNA, 19 bp, Homo sapiens
tgaatgcctatggtggatc

SEQ ID NO: 2442055 - DNA, 15 bp, Homo sapiens
tgaatgctgggactc

SEQ ID NO: 2442056 - DNA, 21 bp, Homo sapiens
tgaatggctatgtttttaatg

SEQ ID NO: 2442057 - DNA, 19 bp, Homo sapiens
tgaatgtaaatttgtacta

SEQ ID NO: 2442058 - DNA, 13 bp, Homo sapiens
tgaatgtgaagcc

SEQ ID NO: 2442059 - DNA, 16 bp, Homo sapiens
tgaatgtgaagccttc

SEQ ID NO: 2442060 - DNA, 17 bp, Homo sapiens
tgaatgtgaagccttcc

SEQ ID NO: 2442061 - DNA, 19 bp, Homo sapiens
tgaatgtttacactctttg

SEQ ID NO: 2442062 - DNA, 13 bp, Homo sapiens
tgaatgtttttct

SEQ ID NO: 2442063 - DNA, 17 bp, Homo sapiens
tgaattaggctgtaact

SEQ ID NO: 2442064 - DNA, 14 bp, Homo sapiens
tgaattattacagt

SEQ ID NO: 2442065 - DNA, 13 bp, Homo sapiens
tgaattattcaat

SEQ ID NO: 2442066 - DNA, 15 bp, Homo sapiens
tgaattattcaattt

SEQ ID NO: 2442067 - DNA, 12 bp, Homo sapiens
tgaattccctca

SEQ ID NO: 2442068 - DNA, 14 bp, Homo sapiens
tgaattccctcact

SEQ ID NO: 2442069 - DNA, 13 bp, Homo sapiens
tgaatttcactgt

SEQ ID NO: 2442070 - DNA, 13 bp, Homo sapiens
tgaatttgtaatg

SEQ ID NO: 2442071 - DNA, 15 bp, Homo sapiens
tgaattttagctttt

SEQ ID NO: 2442072 - DNA, 15 bp, Homo sapiens
tgaattttttttaac

SEQ ID NO: 2442073 - DNA, 18 bp, Homo sapiens
tgaattttttttaacatt

SEQ ID NO: 2442074 - DNA, 19 bp, Homo sapiens
tgaattttttttaacattc

SEQ ID NO: 2442075 - DNA, 21 bp, Homo sapiens
tgaattttttttaacattcct

SEQ ID NO: 2442076 - DNA, 22 bp, Homo sapiens
tgaattttttttaacattcctc

SEQ ID NO: 2442077 - DNA, 22 bp, Homo sapiens
tgacaaagcagattcagaaatg

SEQ ID NO: 2442078 - DNA, 16 bp, Homo sapiens
tgacaaccactggtct

SEQ ID NO: 2442079 - DNA, 17 bp, Homo sapiens
tgacaaccactggtctg

SEQ ID NO: 2442080 - DNA, 15 bp, Homo sapiens
tgacaactggcaggc

SEQ ID NO: 2442081 - DNA, 12 bp, Homo sapiens
tgacaataaaac

SEQ ID NO: 2442082 - DNA, 14 bp, Homo sapiens
tgacaataaaacat

SEQ ID NO: 2442083 - DNA, 15 bp, Homo sapiens
tgacaatcatgtgtg

SEQ ID NO: 2442084 - DNA, 13 bp, Homo sapiens
tgacacaaacaca

SEQ ID NO: 2442085 - DNA, 17 bp, Homo sapiens
tgacacaaacacacaca

SEQ ID NO: 2442086 - DNA, 22 bp, Homo sapiens
tgacacaccaggcgctaattca

SEQ ID NO: 2442087 - DNA, 19 bp, Homo sapiens
tgacacagaaaatgttgag

SEQ ID NO: 2442088 - DNA, 20 bp, Homo sapiens
tgacacccttctcccactct

SEQ ID NO: 2442089 - DNA, 21 bp, Homo sapiens
tgacacccttctcccactctc

SEQ ID NO: 2442090 - DNA, 15 bp, Homo sapiens
tgacacctaactctt

SEQ ID NO: 2442091 - DNA, 17 bp, Homo sapiens
tgacacctcttttttcg

SEQ ID NO: 2442092 - DNA, 14 bp, Homo sapiens
tgacagacaggctc

SEQ ID NO: 2442093 - DNA, 15 bp, Homo sapiens
tgacagcctcagtga

SEQ ID NO: 2442094 - DNA, 11 bp, Homo sapiens
tgacagcctcc

SEQ ID NO: 2442095 - DNA, 21 bp, Homo sapiens
tgacagggcgggggtggcggc

SEQ ID NO: 2442096 - DNA, 21 bp, Homo sapiens
tgacagtattatacgctggca

SEQ ID NO: 2442097 - DNA, 16 bp, Homo sapiens
tgacataccccctccc

SEQ ID NO: 2442098 - DNA, 18 bp, Homo sapiens
tgacatcaggtttttccc

SEQ ID NO: 2442099 - DNA, 17 bp, Homo sapiens
tgacatgaattttagct

SEQ ID NO: 2442100 - DNA, 22 bp, Homo sapiens
tgacatgaattttagcttttgt

SEQ ID NO: 2442101 - DNA, 17 bp, Homo sapiens
tgacatgcatcatctca

SEQ ID NO: 2442102 - DNA, 18 bp, Homo sapiens
tgacattctgaatgcttc

SEQ ID NO: 2442103 - DNA, 23 bp, Homo sapiens
tgacatttgggagacatgtgaca

SEQ ID NO: 2442104 - DNA, 15 bp, Homo sapiens
tgaccaagatactta

SEQ ID NO: 2442105 - DNA, 14 bp, Homo sapiens
tgaccacagcacag

SEQ ID NO: 2442106 - DNA, 17 bp, Homo sapiens
tgaccacagcacagcca

SEQ ID NO: 2442107 - DNA, 14 bp, Homo sapiens
tgaccactcagaga

SEQ ID NO: 2442108 - DNA, 16 bp, Homo sapiens
tgaccactcagagaca

SEQ ID NO: 2442109 - DNA, 17 bp, Homo sapiens
tgaccagccgtgagcat

SEQ ID NO: 2442110 - DNA, 17 bp, Homo sapiens
tgaccagttgcagtcac

SEQ ID NO: 2442111 - DNA, 14 bp, Homo sapiens
tgacccacatgcca

SEQ ID NO: 2442112 - DNA, 18 bp, Homo sapiens
tgacccagtgcccccact

SEQ ID NO: 2442113 - DNA, 13 bp, Homo sapiens
tgaccccagagga

SEQ ID NO: 2442114 - DNA, 13 bp, Homo sapiens
tgaccccagggca

SEQ ID NO: 2442115 - DNA, 21 bp, Homo sapiens
tgaccccagggcacaggagct

SEQ ID NO: 2442116 - DNA, 18 bp, Homo sapiens
tgacccggcaccccctgc

SEQ ID NO: 2442117 - DNA, 20 bp, Homo sapiens
tgacccggcaccccctgcag

SEQ ID NO: 2442118 - DNA, 19 bp, Homo sapiens
tgaccctgcctctcccagg

SEQ ID NO: 2442119 - DNA, 19 bp, Homo sapiens
tgaccgcgactaatttcaa

SEQ ID NO: 2442120 - DNA, 23 bp, Homo sapiens
tgacctatacctgtgtttcttgc

SEQ ID NO: 2442121 - DNA, 18 bp, Homo sapiens
tgacctcgtactcaggag

SEQ ID NO: 2442122 - DNA, 15 bp, Homo sapiens
tgacctgctgacctg

SEQ ID NO: 2442123 - DNA, 13 bp, Homo sapiens
tgacctgctgagc

SEQ ID NO: 2442124 - DNA, 22 bp, Homo sapiens
tgacctgctgagctctgagagg

SEQ ID NO: 2442125 - DNA, 12 bp, Homo sapiens
tgacctggcccc

SEQ ID NO: 2442126 - DNA, 18 bp, Homo sapiens
tgaccttttatgtagtaa

SEQ ID NO: 2442127 - DNA, 15 bp, Homo sapiens
tctttcacagctcct

SEQ ID NO: 2442128 - DNA, 18 bp, Homo sapiens
tctttcacagctcctccc

SEQ ID NO: 2442129 - DNA, 20 bp, Homo sapiens
tctttcacagctcctcccac

SEQ ID NO: 2442130 - DNA, 13 bp, Homo sapiens
tctttcagctcct

SEQ ID NO: 2442131 - DNA, 21 bp, Homo sapiens
tctttcatttgctttggaagt

SEQ ID NO: 2442132 - DNA, 19 bp, Homo sapiens
tctttccacggagccactc

SEQ ID NO: 2442133 - DNA, 22 bp, Homo sapiens
tctttccacggagccactcctc

SEQ ID NO: 2442134 - DNA, 23 bp, Homo sapiens
tctttccacggagccactcctct

SEQ ID NO: 2442135 - DNA, 20 bp, Homo sapiens
tctttccattggatctcatt

SEQ ID NO: 2442136 - DNA, 14 bp, Homo sapiens
tctttccatttgca

SEQ ID NO: 2442137 - DNA, 16 bp, Homo sapiens
tctttccatttgcatt

SEQ ID NO: 2442138 - DNA, 17 bp, Homo sapiens
tctttctcactaaatct

SEQ ID NO: 2442139 - DNA, 12 bp, Homo sapiens
tctttctctgcc

SEQ ID NO: 2442140 - DNA, 10 bp, Homo sapiens
tctttctgta

SEQ ID NO: 2442141 - DNA, 13 bp, Homo sapiens
tctttgaataaat

SEQ ID NO: 2442142 - DNA, 16 bp, Homo sapiens
tctttgaataaatgtc

SEQ ID NO: 2442143 - DNA, 14 bp, Homo sapiens
tctttggctcccct

SEQ ID NO: 2442144 - DNA, 20 bp, Homo sapiens
tctttgggccagacatgcca

SEQ ID NO: 2442145 - DNA, 16 bp, Homo sapiens
tctttggggtgcccct

SEQ ID NO: 2442146 - DNA, 14 bp, Homo sapiens
tctttggttctaag

SEQ ID NO: 2442147 - DNA, 21 bp, Homo sapiens
tctttgtcagggagtgttccc

SEQ ID NO: 2442148 - DNA, 23 bp, Homo sapiens
tctttgttcatagcccagtagac

SEQ ID NO: 2442149 - DNA, 15 bp, Homo sapiens
tctttgtttctttct

SEQ ID NO: 2442150 - DNA, 13 bp, Homo sapiens
tcttttataattc

SEQ ID NO: 2442151 - DNA, 19 bp, Homo sapiens
tcttttcccatttatctaa

SEQ ID NO: 2442152 - DNA, 24 bp, Homo sapiens
tcttttccccctttgtgcacattt

SEQ ID NO: 2442153 - DNA, 12 bp, Homo sapiens
tcttttctttac

SEQ ID NO: 2442154 - DNA, 17 bp, Homo sapiens
tctttttgaagtattta

SEQ ID NO: 2442155 - DNA, 22 bp, Homo sapiens
tcttttttggccatctgctcct

SEQ ID NO: 2442156 - DNA, 15 bp, Homo sapiens
tctttttttcttgaa

SEQ ID NO: 2442157 - DNA, 18 bp, Homo sapiens
tctttttttgtatagtta

SEQ ID NO: 2442158 - DNA, 23 bp, Homo sapiens
tctttttttttttttaataaatt

SEQ ID NO: 2442159 - DNA, 22 bp, Homo sapiens
tgaaaaaaaacctgagatttat

SEQ ID NO: 2442160 - DNA, 22 bp, Homo sapiens
tgaaaaaatagagcctgaggga

SEQ ID NO: 2442161 - DNA, 18 bp, Homo sapiens
tgaaaaaatgtatatgca

SEQ ID NO: 2442162 - DNA, 19 bp, Homo sapiens
tgaaaaatgggcacttaaa

SEQ ID NO: 2442163 - DNA, 23 bp, Homo sapiens
tgaaaaattgctgactgtagctt

SEQ ID NO: 2442164 - DNA, 14 bp, Homo sapiens
tgaaaacacatttg

SEQ ID NO: 2442165 - DNA, 17 bp, Homo sapiens
tgaaaacacatttgctt

SEQ ID NO: 2442166 - DNA, 18 bp, Homo sapiens
tgaaaactctttgctgct

SEQ ID NO: 2442167 - DNA, 17 bp, Homo sapiens
tgaaaagctagaattga

SEQ ID NO: 2442168 - DNA, 20 bp, Homo sapiens
tgaaaatgtccaggaaagtg

SEQ ID NO: 2442169 - DNA, 14 bp, Homo sapiens
tgaaaatgtccttg

SEQ ID NO: 2442170 - DNA, 16 bp, Homo sapiens
tgaaaatgtccttgtg

SEQ ID NO: 2442171 - DNA, 19 bp, Homo sapiens
tgaaaatgtccttgtgatg

SEQ ID NO: 2442172 - DNA, 13 bp, Homo sapiens
tgaaaatgtcttg

SEQ ID NO: 2442173 - DNA, 16 bp, Homo sapiens
tgaaaatgtcttgtgt

SEQ ID NO: 2442174 - DNA, 14 bp, Homo sapiens
tgaaaattatttaa

SEQ ID NO: 2442175 - DNA, 14 bp, Homo sapiens
tgaaacaaagagtt

SEQ ID NO: 2442176 - DNA, 23 bp, Homo sapiens
tgaaacaaagagttcaagaaata

SEQ ID NO: 2442177 - DNA, 20 bp, Homo sapiens
tgaaagaatagaacacagtt

SEQ ID NO: 2442178 - DNA, 15 bp, Homo sapiens
tgaaagctactcata

SEQ ID NO: 2442179 - DNA, 16 bp, Homo sapiens
tgaaagctgatttttt

SEQ ID NO: 2442180 - DNA, 16 bp, Homo sapiens
tgaaaggaaattaagg

SEQ ID NO: 2442181 - DNA, 15 bp, Homo sapiens
tgaaaggaccctgtg

SEQ ID NO: 2442182 - DNA, 15 bp, Homo sapiens
tgaaagtctgtcctt

SEQ ID NO: 2442183 - DNA, 17 bp, Homo sapiens
tgaaagtctgtccttga

SEQ ID NO: 2442184 - DNA, 23 bp, Homo sapiens
tgaaagtctgtccttgaaggact

SEQ ID NO: 2442185 - DNA, 19 bp, Homo sapiens
tgaaagtgggcaaaagctt

SEQ ID NO: 2442186 - DNA, 13 bp, Homo sapiens
tgaaataagctat

SEQ ID NO: 2442187 - DNA, 16 bp, Homo sapiens
tgaaataagctatttg

SEQ ID NO: 2442188 - DNA, 22 bp, Homo sapiens
tgaaataagctatttgatgtaa

SEQ ID NO: 2442189 - DNA, 14 bp, Homo sapiens
tgaaataatgtgta

SEQ ID NO: 2442190 - DNA, 15 bp, Homo sapiens
tgaaatatcctgctt

SEQ ID NO: 2442191 - DNA, 20 bp, Homo sapiens
tgaaatgtaaggctgtgtaa

SEQ ID NO: 2442192 - DNA, 17 bp, Homo sapiens
tgaaattaacctctcac

SEQ ID NO: 2442193 - DNA, 22 bp, Homo sapiens
tgaaattaactgggtaatgaaa

SEQ ID NO: 2442194 - DNA, 23 bp, Homo sapiens
tgaaattaagaaggcaaaaatgt

SEQ ID NO: 2442195 - DNA, 13 bp, Homo sapiens
tgaaattatgtaa

SEQ ID NO: 2442196 - DNA, 15 bp, Homo sapiens
tgaaattatgtaaat

SEQ ID NO: 2442197 - DNA, 15 bp, Homo sapiens
tgaaattctcctgga

SEQ ID NO: 2442198 - DNA, 22 bp, Homo sapiens
tgaaattgaacctttgtgccct

SEQ ID NO: 2442199 - DNA, 16 bp, Homo sapiens
tgaacacgaagcttag

SEQ ID NO: 2442200 - DNA, 13 bp, Homo sapiens
tgaacagaacata

SEQ ID NO: 2442201 - DNA, 13 bp, Homo sapiens
tgaacagctggtg

SEQ ID NO: 2442202 - DNA, 18 bp, Homo sapiens
tgaacagctggtgtagct

SEQ ID NO: 2442203 - DNA, 19 bp, Homo sapiens
tgaacagctggtgtagcta

SEQ ID NO: 2442204 - DNA, 22 bp, Homo sapiens
tgaacaggaaactcctgtgacc

SEQ ID NO: 2442205 - DNA, 20 bp, Homo sapiens
tgaacatctgagtcctggat

SEQ ID NO: 2442206 - DNA, 13 bp, Homo sapiens
tgaacccttgctt

SEQ ID NO: 2442207 - DNA, 15 bp, Homo sapiens
tgaacccttgcttgc

SEQ ID NO: 2442208 - DNA, 15 bp, Homo sapiens
tgaacgttttctaat

SEQ ID NO: 2442209 - DNA, 23 bp, Homo sapiens
tgaacgttttctaattgcttatt

SEQ ID NO: 2442210 - DNA, 19 bp, Homo sapiens
tgaactaaagtgctgcact

SEQ ID NO: 2442211 - DNA, 20 bp, Homo sapiens
tgaactaccttggttccccc

SEQ ID NO: 2442212 - DNA, 15 bp, Homo sapiens
tgaactcttaatcaa

SEQ ID NO: 2442213 - DNA, 17 bp, Homo sapiens
tgaacttagattttaca

SEQ ID NO: 2442214 - DNA, 18 bp, Homo sapiens
tgaacttagattttacat

SEQ ID NO: 2442215 - DNA, 19 bp, Homo sapiens
tgaacttagattttacatg

SEQ ID NO: 2442216 - DNA, 21 bp, Homo sapiens
tgaacttgaaatatcctgctt

SEQ ID NO: 2442217 - DNA, 17 bp, Homo sapiens
tgaactttttattgatt

SEQ ID NO: 2442218 - DNA, 14 bp, Homo sapiens
tgaagaacatgtga

SEQ ID NO: 2442219 - DNA, 18 bp, Homo sapiens
tgaagaactgcaggccct

SEQ ID NO: 2442220 - DNA, 22 bp, Homo sapiens
tgaagaagctaaatcctttact

SEQ ID NO: 2442221 - DNA, 16 bp, Homo sapiens
tgaagaatacttctca

SEQ ID NO: 2442222 - DNA, 22 bp, Homo sapiens
tgaagaatgcacaagaatggat

SEQ ID NO: 2442223 - DNA, 12 bp, Homo sapiens
tgaagacataaa

SEQ ID NO: 2442224 - DNA, 16 bp, Homo sapiens
tgaagactatgaaaat

SEQ ID NO: 2442225 - DNA, 18 bp, Homo sapiens
tgaagactggaagctaat

SEQ ID NO: 2442226 - DNA, 17 bp, Homo sapiens
tgaagagccactgccat

SEQ ID NO: 2442227 - DNA, 23 bp, Homo sapiens
tgaagagtaatcaatctactcaa

SEQ ID NO: 2442228 - DNA, 15 bp, Homo sapiens
tgaagatctaaataa

SEQ ID NO: 2442229 - DNA, 20 bp, Homo sapiens
tgaagatctaaataaaatgc

SEQ ID NO: 2442230 - DNA, 22 bp, Homo sapiens
tgaagatctaaataaaatgcta

SEQ ID NO: 2442231 - DNA, 15 bp, Homo sapiens
tggcctcccctgcca

SEQ ID NO: 2442232 - DNA, 17 bp, Homo sapiens
tggcctcccctgccacc

SEQ ID NO: 2442233 - DNA, 22 bp, Homo sapiens
tggcctctctctagggtacatg

SEQ ID NO: 2442234 - DNA, 12 bp, Homo sapiens
tggcctctgctt

SEQ ID NO: 2442235 - DNA, 18 bp, Homo sapiens
tggcctgcaaactgggaa

SEQ ID NO: 2442236 - DNA, 12 bp, Homo sapiens
tggcctggagca

SEQ ID NO: 2442237 - DNA, 17 bp, Homo sapiens
tggcctggccagtgccc

SEQ ID NO: 2442238 - DNA, 15 bp, Homo sapiens
tggcctgtagagttg

SEQ ID NO: 2442239 - DNA, 18 bp, Homo sapiens
tggccttgaaaccacctt

SEQ ID NO: 2442240 - DNA, 14 bp, Homo sapiens
tggccttgttctgt

SEQ ID NO: 2442241 - DNA, 19 bp, Homo sapiens
tggccttgttctgtcacca

SEQ ID NO: 2442242 - DNA, 16 bp, Homo sapiens
tggcctttgcgctcct

SEQ ID NO: 2442243 - DNA, 19 bp, Homo sapiens
tggcctttgcgctcctggc

SEQ ID NO: 2442244 - DNA, 24 bp, Homo sapiens
tggcctttgcgctcctggcccagc

SEQ ID NO: 2442245 - DNA, 14 bp, Homo sapiens
tggcgatgccagcc

SEQ ID NO: 2442246 - DNA, 16 bp, Homo sapiens
tggcgatgccagccaa

SEQ ID NO: 2442247 - DNA, 18 bp, Homo sapiens
tggcggggggcccattgg

SEQ ID NO: 2442248 - DNA, 16 bp, Homo sapiens
tggcgtaagtacagag

SEQ ID NO: 2442249 - DNA, 17 bp, Homo sapiens
tggcgtaggctacagag

SEQ ID NO: 2442250 - DNA, 20 bp, Homo sapiens
tggcgtaggctacagagaag

SEQ ID NO: 2442251 - DNA, 14 bp, Homo sapiens
tggctaaccaagag

SEQ ID NO: 2442252 - DNA, 14 bp, Homo sapiens
tggctactctgtgc

SEQ ID NO: 2442253 - DNA, 15 bp, Homo sapiens
tggctactctgtgcc

SEQ ID NO: 2442254 - DNA, 17 bp, Homo sapiens
tggctactctgtgccag

SEQ ID NO: 2442255 - DNA, 23 bp, Homo sapiens
tggctactctgtgccagagcctg

SEQ ID NO: 2442256 - DNA, 24 bp, Homo sapiens
tggctactctgtgccagagcctgg

SEQ ID NO: 2442257 - DNA, 22 bp, Homo sapiens
tggctatagatgtcttttccca

SEQ ID NO: 2442258 - DNA, 18 bp, Homo sapiens
tggctatgtttttaatgt

SEQ ID NO: 2442259 - DNA, 15 bp, Homo sapiens
tggctatttaaaact

SEQ ID NO: 2442260 - DNA, 14 bp, Homo sapiens
tggctcccaggggc

SEQ ID NO: 2442261 - DNA, 21 bp, Homo sapiens
tggctcccaggggctccctcc

SEQ ID NO: 2442262 - DNA, 17 bp, Homo sapiens
tggctccttgtgccaga

SEQ ID NO: 2442263 - DNA, 18 bp, Homo sapiens
tggctccttgtgccagag

SEQ ID NO: 2442264 - DNA, 20 bp, Homo sapiens
tggctccttgtgccagagaa

SEQ ID NO: 2442265 - DNA, 19 bp, Homo sapiens
tggctcgaatctctgtgcc

SEQ ID NO: 2442266 - DNA, 20 bp, Homo sapiens
tggctcgaatctctgtgcct

SEQ ID NO: 2442267 - DNA, 14 bp, Homo sapiens
tggctctcctggcc

SEQ ID NO: 2442268 - DNA, 20 bp, Homo sapiens
tggctctgaggtgcctgtcc

SEQ ID NO: 2442269 - DNA, 21 bp, Homo sapiens
tggctctgaggtgcctgtccc

SEQ ID NO: 2442270 - DNA, 19 bp, Homo sapiens
tggctctgccagtcctgtc

SEQ ID NO: 2442271 - DNA, 21 bp, Homo sapiens
tggctcttgatacccccctct

SEQ ID NO: 2442272 - DNA, 20 bp, Homo sapiens
tggctgacttacatcatgtg

SEQ ID NO: 2442273 - DNA, 19 bp, Homo sapiens
tggctgcaggaatctttaa

SEQ ID NO: 2442274 - DNA, 14 bp, Homo sapiens
tggctgctgtggga

SEQ ID NO: 2442275 - DNA, 12 bp, Homo sapiens
tggctggctgag

SEQ ID NO: 2442276 - DNA, 15 bp, Homo sapiens
tggctgggacgtggc

SEQ ID NO: 2442277 - DNA, 13 bp, Homo sapiens
tggctggtccagg

SEQ ID NO: 2442278 - DNA, 15 bp, Homo sapiens
tggctggtccagggc

SEQ ID NO: 2442279 - DNA, 11 bp, Homo sapiens
tggctggtgtg

SEQ ID NO: 2442280 - DNA, 19 bp, Homo sapiens
tggctggtgtggtacagag

SEQ ID NO: 2442281 - DNA, 21 bp, Homo sapiens
tggctggtgtggtacagagaa

SEQ ID NO: 2442282 - DNA, 22 bp, Homo sapiens
tggctggtgtggtacagagaag

SEQ ID NO: 2442283 - DNA, 12 bp, Homo sapiens
tggctggtgtta

SEQ ID NO: 2442284 - DNA, 15 bp, Homo sapiens
tggctggtgttaaca

SEQ ID NO: 2442285 - DNA, 16 bp, Homo sapiens
tggctggtgttaacag

SEQ ID NO: 2442286 - DNA, 19 bp, Homo sapiens
tggctggtgttaacagaag

SEQ ID NO: 2442287 - DNA, 21 bp, Homo sapiens
tggctgtaaggctctagatca

SEQ ID NO: 2442288 - DNA, 14 bp, Homo sapiens
tggctgtttgagat

SEQ ID NO: 2442289 - DNA, 15 bp, Homo sapiens
tggcttacctggccc

SEQ ID NO: 2442290 - DNA, 18 bp, Homo sapiens
tggcttataattctttca

SEQ ID NO: 2442291 - DNA, 15 bp, Homo sapiens
tggcttcccatcccc

SEQ ID NO: 2442292 - DNA, 15 bp, Homo sapiens
tggcttctggccagg

SEQ ID NO: 2442293 - DNA, 16 bp, Homo sapiens
tggcttctggccagga

SEQ ID NO: 2442294 - DNA, 15 bp, Homo sapiens
tggcttgagaaatat

SEQ ID NO: 2442295 - DNA, 18 bp, Homo sapiens
tggcttgggactaaatgc

SEQ ID NO: 2442296 - DNA, 16 bp, Homo sapiens
tggcttgtttgatttc

SEQ ID NO: 2442297 - DNA, 16 bp, Homo sapiens
tggctttgatgataaa

SEQ ID NO: 2442298 - DNA, 21 bp, Homo sapiens
tggcttttattaatgcacttt

SEQ ID NO: 2442299 - DNA, 22 bp, Homo sapiens
tgggaaagcccctgcccctcct

SEQ ID NO: 2442300 - DNA, 22 bp, Homo sapiens
tgggaaccccttcatcctctga

SEQ ID NO: 2442301 - DNA, 18 bp, Homo sapiens
tgggaacccctttcccac

SEQ ID NO: 2442302 - DNA, 22 bp, Homo sapiens
tgggaagcccatcctgaccagc

SEQ ID NO: 2442303 - DNA, 23 bp, Homo sapiens
tgggaaggctacttcggggctgg

SEQ ID NO: 2442304 - DNA, 23 bp, Homo sapiens
tgggaagtcgtccttactcctgt

SEQ ID NO: 2442305 - DNA, 15 bp, Homo sapiens
tgggaagtgaagact

SEQ ID NO: 2442306 - DNA, 23 bp, Homo sapiens
tgggacggtgcccaagccagagg

SEQ ID NO: 2442307 - DNA, 20 bp, Homo sapiens
tgggacgtggctcagccagc

SEQ ID NO: 2442308 - DNA, 18 bp, Homo sapiens
tgggactgctaaataaaa

SEQ ID NO: 2442309 - DNA, 15 bp, Homo sapiens
tgggagacatgtgac

SEQ ID NO: 2442310 - DNA, 20 bp, Homo sapiens
tgggagaccggcctgccagg

SEQ ID NO: 2442311 - DNA, 21 bp, Homo sapiens
tgggagaccggcctgccagga

SEQ ID NO: 2442312 - DNA, 14 bp, Homo sapiens
tgggagagacttgt

SEQ ID NO: 2442313 - DNA, 14 bp, Homo sapiens
tgggagagggcgca

SEQ ID NO: 2442314 - DNA, 15 bp, Homo sapiens
tgggagagggcgcag

SEQ ID NO: 2442315 - DNA, 20 bp, Homo sapiens
tgggagagggcgcaggccgt

SEQ ID NO: 2442316 - DNA, 23 bp, Homo sapiens
tgggagattcaagggacccatga

SEQ ID NO: 2442317 - DNA, 18 bp, Homo sapiens
tgggagcaaactgcatgc

SEQ ID NO: 2442318 - DNA, 22 bp, Homo sapiens
tgggagcaaactgcatgcccag

SEQ ID NO: 2442319 - DNA, 17 bp, Homo sapiens
tgggagcccccagcctg

SEQ ID NO: 2442320 - DNA, 16 bp, Homo sapiens
tgggagctgaggccac

SEQ ID NO: 2442321 - DNA, 20 bp, Homo sapiens
tgggagctgaggccacactc

SEQ ID NO: 2442322 - DNA, 22 bp, Homo sapiens
tgggagctgaggccacactcag

SEQ ID NO: 2442323 - DNA, 20 bp, Homo sapiens
tgggaggctcacccccttct

SEQ ID NO: 2442324 - DNA, 15 bp, Homo sapiens
tgggaggctcccctt

SEQ ID NO: 2442325 - DNA, 23 bp, Homo sapiens
tgggagtcacacagtgttggagg

SEQ ID NO: 2442326 - DNA, 18 bp, Homo sapiens
tgggagtgttgagcatct

SEQ ID NO: 2442327 - DNA, 16 bp, Homo sapiens
tgggagttgtcattaa

SEQ ID NO: 2442328 - DNA, 16 bp, Homo sapiens
tgggatgttcagcact

SEQ ID NO: 2442329 - DNA, 20 bp, Homo sapiens
tgggatgttcagcactgtcc

SEQ ID NO: 2442330 - DNA, 15 bp, Homo sapiens
tgggattatgggtca

SEQ ID NO: 2442331 - DNA, 18 bp, Homo sapiens
tgggattatgggtcacag

SEQ ID NO: 2442332 - DNA, 21 bp, Homo sapiens
tgggattatgggtcacaggaa

SEQ ID NO: 2442333 - DNA, 22 bp, Homo sapiens
tgggattcaggaaaaggcctgg

SEQ ID NO: 2442334 - DNA, 23 bp, Homo sapiens
tgggattcaggaaaaggcctggg

SEQ ID NO: 2442335 - DNA, 17 bp, Homo sapiens
tggaatgcccttcactg

SEQ ID NO: 2442336 - DNA, 13 bp, Homo sapiens
tggaattctaaca

SEQ ID NO: 2442337 - DNA, 22 bp, Homo sapiens
tggaattcttagtcacaaaata

SEQ ID NO: 2442338 - DNA, 12 bp, Homo sapiens
tggaattgattt

SEQ ID NO: 2442339 - DNA, 16 bp, Homo sapiens
tggaattgatttgcat

SEQ ID NO: 2442340 - DNA, 17 bp, Homo sapiens
tggaattgatttgcatt

SEQ ID NO: 2442341 - DNA, 20 bp, Homo sapiens
tggaattgatttgcattgaa

SEQ ID NO: 2442342 - DNA, 22 bp, Homo sapiens
tggaattttgcaaagatttaat

SEQ ID NO: 2442343 - DNA, 16 bp, Homo sapiens
tggacactcagacctg

SEQ ID NO: 2442344 - DNA, 14 bp, Homo sapiens
tggacagccccacc

SEQ ID NO: 2442345 - DNA, 13 bp, Homo sapiens
tggacagctgtgc

SEQ ID NO: 2442346 - DNA, 23 bp, Homo sapiens
tggacaggactaacactcagaag

SEQ ID NO: 2442347 - DNA, 18 bp, Homo sapiens
tggacaggatgtgtttgc

SEQ ID NO: 2442348 - DNA, 23 bp, Homo sapiens
tggacagtttaccagttgccttt

SEQ ID NO: 2442349 - DNA, 20 bp, Homo sapiens
tggacatcctcctcccaccc

SEQ ID NO: 2442350 - DNA, 22 bp, Homo sapiens
tggacatgaagattctttccca

SEQ ID NO: 2442351 - DNA, 15 bp, Homo sapiens
tggacccccctttca

SEQ ID NO: 2442352 - DNA, 22 bp, Homo sapiens
tggacccccctttcacaggcag

SEQ ID NO: 2442353 - DNA, 21 bp, Homo sapiens
tggacccgttcatgggggagg

SEQ ID NO: 2442354 - DNA, 13 bp, Homo sapiens
tggacccttccat

SEQ ID NO: 2442355 - DNA, 17 bp, Homo sapiens
tggacctaaatggcctc

SEQ ID NO: 2442356 - DNA, 15 bp, Homo sapiens
tggacctctgacagc

SEQ ID NO: 2442357 - DNA, 16 bp, Homo sapiens
tggacctctgacagca

SEQ ID NO: 2442358 - DNA, 17 bp, Homo sapiens
tggacctctgacagcag

SEQ ID NO: 2442359 - DNA, 14 bp, Homo sapiens
tggacctgcctgca

SEQ ID NO: 2442360 - DNA, 24 bp, Homo sapiens
tggacgacacggtcggggcatctg

SEQ ID NO: 2442361 - DNA, 17 bp, Homo sapiens
tggactatctgtctggt

SEQ ID NO: 2442362 - DNA, 20 bp, Homo sapiens
tggactatctgtctggtggc

SEQ ID NO: 2442363 - DNA, 14 bp, Homo sapiens
tggactcagggcag

SEQ ID NO: 2442364 - DNA, 15 bp, Homo sapiens
tggactcagggcagc

SEQ ID NO: 2442365 - DNA, 16 bp, Homo sapiens
tggactcgcctgtaat

SEQ ID NO: 2442366 - DNA, 14 bp, Homo sapiens
tggactctaaagtc

SEQ ID NO: 2442367 - DNA, 20 bp, Homo sapiens
tggactgttttctctcggct

SEQ ID NO: 2442368 - DNA, 15 bp, Homo sapiens
tggacttctggggta

SEQ ID NO: 2442369 - DNA, 18 bp, Homo sapiens
tggactttcctgcaactc

SEQ ID NO: 2442370 - DNA, 13 bp, Homo sapiens
tggagaaagggcc

SEQ ID NO: 2442371 - DNA, 23 bp, Homo sapiens
tggagaagtctcagctaagctca

SEQ ID NO: 2442372 - DNA, 20 bp, Homo sapiens
tggagactgtgtgtgccctc

SEQ ID NO: 2442373 - DNA, 23 bp, Homo sapiens
tggagactgtgtgtgccctctgg

SEQ ID NO: 2442374 - DNA, 14 bp, Homo sapiens
tggagagccctggg

SEQ ID NO: 2442375 - DNA, 14 bp, Homo sapiens
tggagagctaggag

SEQ ID NO: 2442376 - DNA, 15 bp, Homo sapiens
tggagagctaggagc

SEQ ID NO: 2442377 - DNA, 22 bp, Homo sapiens
tggagagctaggagcaaagcct

SEQ ID NO: 2442378 - DNA, 16 bp, Homo sapiens
tggagatcctcctgca

SEQ ID NO: 2442379 - DNA, 21 bp, Homo sapiens
tggagatcctcctgcagacca

SEQ ID NO: 2442380 - DNA, 15 bp, Homo sapiens
tggagattgacctgg

SEQ ID NO: 2442381 - DNA, 20 bp, Homo sapiens
tggagcacaataaatggctg

SEQ ID NO: 2442382 - DNA, 12 bp, Homo sapiens
tggagcagaggg

SEQ ID NO: 2442383 - DNA, 16 bp, Homo sapiens
tggagcagaggggctg

SEQ ID NO: 2442384 - DNA, 17 bp, Homo sapiens
tggagcagaggggctga

SEQ ID NO: 2442385 - DNA, 17 bp, Homo sapiens
tggagcatttctcatca

SEQ ID NO: 2442386 - DNA, 12 bp, Homo sapiens
tggagccgaggc

SEQ ID NO: 2442387 - DNA, 14 bp, Homo sapiens
tggagctccagcct

SEQ ID NO: 2442388 - DNA, 20 bp, Homo sapiens
tggaggacctgagcctgccg

SEQ ID NO: 2442389 - DNA, 12 bp, Homo sapiens
tggaggagccca

SEQ ID NO: 2442390 - DNA, 13 bp, Homo sapiens
tggaggagcccag

SEQ ID NO: 2442391 - DNA, 19 bp, Homo sapiens
tggaggagcccaggccagg

SEQ ID NO: 2442392 - DNA, 14 bp, Homo sapiens
tggaggcaggggct

SEQ ID NO: 2442393 - DNA, 21 bp, Homo sapiens
tggaggccactgtttggaaat

SEQ ID NO: 2442394 - DNA, 12 bp, Homo sapiens
tggaggcccagg

SEQ ID NO: 2442395 - DNA, 17 bp, Homo sapiens
tggaggggtaggggctg

SEQ ID NO: 2442396 - DNA, 15 bp, Homo sapiens
ttcatgtgtcccaga

SEQ ID NO: 2442397 - DNA, 16 bp, Homo sapiens
ttcatgttagttacct

SEQ ID NO: 2442398 - DNA, 22 bp, Homo sapiens
ttcatgttagttaccttatagt

SEQ ID NO: 2442399 - DNA, 12 bp, Homo sapiens
ttcattaaataa

SEQ ID NO: 2442400 - DNA, 16 bp, Homo sapiens
ttcattaacaaaatgt

SEQ ID NO: 2442401 - DNA, 16 bp, Homo sapiens
ttcattaattctataa

SEQ ID NO: 2442402 - DNA, 15 bp, Homo sapiens
ttcattagtcatgtt

SEQ ID NO: 2442403 - DNA, 18 bp, Homo sapiens
ttcattctccctttcact

SEQ ID NO: 2442404 - DNA, 22 bp, Homo sapiens
ttcattgagttggttacttcat

SEQ ID NO: 2442405 - DNA, 19 bp, Homo sapiens
ttcatttagtcatgtgacc

SEQ ID NO: 2442406 - DNA, 17 bp, Homo sapiens
ttcatttatctataatt

SEQ ID NO: 2442407 - DNA, 13 bp, Homo sapiens
ttcatttcatcta

SEQ ID NO: 2442408 - DNA, 19 bp, Homo sapiens
ttcatttttttttcaatca

SEQ ID NO: 2442409 - DNA, 16 bp, Homo sapiens
ttccaaaatctcccat

SEQ ID NO: 2442410 - DNA, 16 bp, Homo sapiens
tgtgttttgaaagaat

SEQ ID NO: 2442411 - DNA, 19 bp, Homo sapiens
tgtgttttgctaaaggaaa

SEQ ID NO: 2442412 - DNA, 14 bp, Homo sapiens
tgtgtttttctatt

SEQ ID NO: 2442413 - DNA, 17 bp, Homo sapiens
tgtgtttttctattaaa

SEQ ID NO: 2442414 - DNA, 19 bp, Homo sapiens
tgtgtttttctattaaaag

SEQ ID NO: 2442415 - DNA, 14 bp, Homo sapiens
tgttaaaaatgtca

SEQ ID NO: 2442416 - DNA, 16 bp, Homo sapiens
tgttaaatacaggaaa

SEQ ID NO: 2442417 - DNA, 18 bp, Homo sapiens
tgttaaatacaggaaaca

SEQ ID NO: 2442418 - DNA, 16 bp, Homo sapiens
tgttaacattccaaga

SEQ ID NO: 2442419 - DNA, 21 bp, Homo sapiens
tgttaacattccaagactcta

SEQ ID NO: 2442420 - DNA, 14 bp, Homo sapiens
tgttaactgaatac

SEQ ID NO: 2442421 - DNA, 18 bp, Homo sapiens
tgttaactgaataccact

SEQ ID NO: 2442422 - DNA, 22 bp, Homo sapiens
tgttaactgaataccactctgt

SEQ ID NO: 2442423 - DNA, 14 bp, Homo sapiens
tgttaagctctgct

SEQ ID NO: 2442424 - DNA, 17 bp, Homo sapiens
tgttaagttatagtgaa

SEQ ID NO: 2442425 - DNA, 21 bp, Homo sapiens
tgttaagttatagtgaatact

SEQ ID NO: 2442426 - DNA, 15 bp, Homo sapiens
tgttaatttagaaaa

SEQ ID NO: 2442427 - DNA, 17 bp, Homo sapiens
tgttaatttagaaaact

SEQ ID NO: 2442428 - DNA, 22 bp, Homo sapiens
tgttaatttagaaaactttaaa

SEQ ID NO: 2442429 - DNA, 19 bp, Homo sapiens
tgttaccaaaaataaatat

SEQ ID NO: 2442430 - DNA, 16 bp, Homo sapiens
tgttacctgaaaacac

SEQ ID NO: 2442431 - DNA, 14 bp, Homo sapiens
tgttacctgtagat

SEQ ID NO: 2442432 - DNA, 16 bp, Homo sapiens
tgttacgtagcctaag

SEQ ID NO: 2442433 - DNA, 15 bp, Homo sapiens
tgttatataatcatt

SEQ ID NO: 2442434 - DNA, 16 bp, Homo sapiens
tgttatataatcatta

SEQ ID NO: 2442435 - DNA, 18 bp, Homo sapiens
tgttatatataaatatat

SEQ ID NO: 2442436 - DNA, 20 bp, Homo sapiens
tgttatcaaaactttctttt

SEQ ID NO: 2442437 - DNA, 19 bp, Homo sapiens
tgttatcaccgtgggctcc

SEQ ID NO: 2442438 - DNA, 15 bp, Homo sapiens
tgttatcttctcaag

SEQ ID NO: 2442439 - DNA, 23 bp, Homo sapiens
tgttattatctgggcttatatct

SEQ ID NO: 2442440 - DNA, 17 bp, Homo sapiens
tgttatttgtaatagat

SEQ ID NO: 2442441 - DNA, 19 bp, Homo sapiens
tgttcaactaggatcagaa

SEQ ID NO: 2442442 - DNA, 15 bp, Homo sapiens
tgttcaatattttct

SEQ ID NO: 2442443 - DNA, 13 bp, Homo sapiens
tgttcagcactgt

SEQ ID NO: 2442444 - DNA, 14 bp, Homo sapiens
tgttcatagcccag

SEQ ID NO: 2442445 - DNA, 19 bp, Homo sapiens
tgttcatagcccagtagac

SEQ ID NO: 2442446 - DNA, 23 bp, Homo sapiens
tgttcatagcccagtagaccttg

SEQ ID NO: 2442447 - DNA, 10 bp, Homo sapiens
tgttccaaat

SEQ ID NO: 2442448 - DNA, 17 bp, Homo sapiens
tgttccaaattcagttt

SEQ ID NO: 2442449 - DNA, 22 bp, Homo sapiens
tgttcccaagagcatcatgcct

SEQ ID NO: 2442450 - DNA, 13 bp, Homo sapiens
tgttccccactgg

SEQ ID NO: 2442451 - DNA, 17 bp, Homo sapiens
tgttccccactggagca

SEQ ID NO: 2442452 - DNA, 13 bp, Homo sapiens
tgttccccagaga

SEQ ID NO: 2442453 - DNA, 14 bp, Homo sapiens
tgttccccagagaa

SEQ ID NO: 2442454 - DNA, 15 bp, Homo sapiens
tgttccccctgtgca

SEQ ID NO: 2442455 - DNA, 16 bp, Homo sapiens
tgttccccctgtgcag

SEQ ID NO: 2442456 - DNA, 21 bp, Homo sapiens
tgttccccttccactgagggc

SEQ ID NO: 2442457 - DNA, 13 bp, Homo sapiens
tgttcctgctgct

SEQ ID NO: 2442458 - DNA, 16 bp, Homo sapiens
tgttcctgctgctgtc

SEQ ID NO: 2442459 - DNA, 18 bp, Homo sapiens
tgttccttccctgtgcct

SEQ ID NO: 2442460 - DNA, 23 bp, Homo sapiens
tgttcgcatggtcacacactgat

SEQ ID NO: 2442461 - DNA, 22 bp, Homo sapiens
tgttcgggccaaggacctgaga

SEQ ID NO: 2442462 - DNA, 14 bp, Homo sapiens
tgttctaagatgtg

SEQ ID NO: 2442463 - DNA, 22 bp, Homo sapiens
tgttctaagatgtgatattcta

SEQ ID NO: 2442464 - DNA, 14 bp, Homo sapiens
tgttctaaggctct

SEQ ID NO: 2442465 - DNA, 16 bp, Homo sapiens
tgttctaaggctctga

SEQ ID NO: 2442466 - DNA, 12 bp, Homo sapiens
tgttctaagttt

SEQ ID NO: 2442467 - DNA, 19 bp, Homo sapiens
tgttctaagtttctaagat

SEQ ID NO: 2442468 - DNA, 21 bp, Homo sapiens
tgttctagttttttacttttg

SEQ ID NO: 2442469 - DNA, 22 bp, Homo sapiens
tgttctcacactggtctgctgt

SEQ ID NO: 2442470 - DNA, 13 bp, Homo sapiens
tgttctcctgctg

SEQ ID NO: 2442471 - DNA, 21 bp, Homo sapiens
tgttctcctgctgctccctca

SEQ ID NO: 2442472 - DNA, 13 bp, Homo sapiens
tgttctgtcacca

SEQ ID NO: 2442473 - DNA, 16 bp, Homo sapiens
tgttctgtcccttgcc

SEQ ID NO: 2442474 - DNA, 18 bp, Homo sapiens
tgttctgtcccttgcccc

SEQ ID NO: 2442475 - DNA, 16 bp, Homo sapiens
tgttctgttaactgaa

SEQ ID NO: 2442476 - DNA, 18 bp, Homo sapiens
tgttctgttaactgaata

SEQ ID NO: 2442477 - DNA, 23 bp, Homo sapiens
tgttcttgaatttaataatctgt

SEQ ID NO: 2442478 - DNA, 14 bp, Homo sapiens
tgttcttgtattta

SEQ ID NO: 2442479 - DNA, 22 bp, Homo sapiens
tgttctttggaaagtacactct

SEQ ID NO: 2442480 - DNA, 18 bp, Homo sapiens
tgttgaatactttttaca

SEQ ID NO: 2442481 - DNA, 17 bp, Homo sapiens
tgttgagcatcacagaa

SEQ ID NO: 2442482 - DNA, 16 bp, Homo sapiens
tgttgagccttttccc

SEQ ID NO: 2442483 - DNA, 14 bp, Homo sapiens
tgttgatactgttg

SEQ ID NO: 2442484 - DNA, 17 bp, Homo sapiens
tgttgatactgttgcac

SEQ ID NO: 2442485 - DNA, 16 bp, Homo sapiens
tgttgattaaagatga

SEQ ID NO: 2442486 - DNA, 14 bp, Homo sapiens
tgttgcacgtgtgt

SEQ ID NO: 2442487 - DNA, 21 bp, Homo sapiens
tgttgcacgtgtgtttttcta

SEQ ID NO: 2442488 - DNA, 21 bp, Homo sapiens
tgttggacacctttaggttct

SEQ ID NO: 2442489 - DNA, 18 bp, Homo sapiens
tgttggcaggctggccag

SEQ ID NO: 2442490 - DNA, 23 bp, Homo sapiens
tgttggccaggctggtctaaaac

SEQ ID NO: 2442491 - DNA, 21 bp, Homo sapiens
ttagctaaacggattccaaag

SEQ ID NO: 2442492 - DNA, 13 bp, Homo sapiens
ttagctcaatgag

SEQ ID NO: 2442493 - DNA, 13 bp, Homo sapiens
ttagctcctgtgg

SEQ ID NO: 2442494 - DNA, 23 bp, Homo sapiens
ttaggaaatgtttttaataaaag

SEQ ID NO: 2442495 - DNA, 13 bp, Homo sapiens
ttaggagaagcca

SEQ ID NO: 2442496 - DNA, 21 bp, Homo sapiens
ttaggagagaaggtaggggtt

SEQ ID NO: 2442497 - DNA, 15 bp, Homo sapiens
ttaggcagactcttt

SEQ ID NO: 2442498 - DNA, 16 bp, Homo sapiens
ttaggctatttgtaaa

SEQ ID NO: 2442499 - DNA, 22 bp, Homo sapiens
ttaggctatttgtaaatctgcc

SEQ ID NO: 2442500 - DNA, 17 bp, Homo sapiens
ttagggcaccaggggtt

SEQ ID NO: 2442501 - DNA, 23 bp, Homo sapiens
ttagtaacatgtgttaagtattt

SEQ ID NO: 2442502 - DNA, 23 bp, Homo sapiens
ttagtattgttgtccttttcata

SEQ ID NO: 2442503 - DNA, 19 bp, Homo sapiens
ttagtgccacttaatgtat

SEQ ID NO: 2442504 - DNA, 13 bp, Homo sapiens
ttagttaccttat

SEQ ID NO: 2442505 - DNA, 22 bp, Homo sapiens
ttagttaccttatagttactgt

SEQ ID NO: 2442506 - DNA, 15 bp, Homo sapiens
ttagttccactgaga

SEQ ID NO: 2442507 - DNA, 17 bp, Homo sapiens
ttagtttacaatcagcc

SEQ ID NO: 2442508 - DNA, 16 bp, Homo sapiens
tgggattgagtctgtg

SEQ ID NO: 2442509 - DNA, 15 bp, Homo sapiens
tgggcaattgtctga

SEQ ID NO: 2442510 - DNA, 18 bp, Homo sapiens
tgggcacccccagcctgg

SEQ ID NO: 2442511 - DNA, 20 bp, Homo sapiens
tgggcacccccagcctgggc

SEQ ID NO: 2442512 - DNA, 21 bp, Homo sapiens
tgggcacccccagcctgggcc

SEQ ID NO: 2442513 - DNA, 13 bp, Homo sapiens
tgggcagagccca

SEQ ID NO: 2442514 - DNA, 16 bp, Homo sapiens
tgggcagagctggctc

SEQ ID NO: 2442515 - DNA, 13 bp, Homo sapiens
tgggcagggagcg

SEQ ID NO: 2442516 - DNA, 16 bp, Homo sapiens
tgggcagttttttgaa

SEQ ID NO: 2442517 - DNA, 13 bp, Homo sapiens
tgggcatcttttg

SEQ ID NO: 2442518 - DNA, 18 bp, Homo sapiens
tgggcatcttttgtatta

SEQ ID NO: 2442519 - DNA, 22 bp, Homo sapiens
tgggcatgaggggttcctcccc

SEQ ID NO: 2442520 - DNA, 23 bp, Homo sapiens
tgggcatgaggggttcctcccct

SEQ ID NO: 2442521 - DNA, 19 bp, Homo sapiens
tgggcatggtgttctcctg

SEQ ID NO: 2442522 - DNA, 20 bp, Homo sapiens
tgggccattctccacagcaa

SEQ ID NO: 2442523 - DNA, 20 bp, Homo sapiens
tgggcccacacctccttccc

SEQ ID NO: 2442524 - DNA, 16 bp, Homo sapiens
tgggccctctctgctc

SEQ ID NO: 2442525 - DNA, 16 bp, Homo sapiens
tgggccctggggcctg

SEQ ID NO: 2442526 - DNA, 13 bp, Homo sapiens
tgggccctttgag

SEQ ID NO: 2442527 - DNA, 15 bp, Homo sapiens
tgggcctaggctgca

SEQ ID NO: 2442528 - DNA, 17 bp, Homo sapiens
tgggcctatggagagcc

SEQ ID NO: 2442529 - DNA, 18 bp, Homo sapiens
tgggcctatggagagccc

SEQ ID NO: 2442530 - DNA, 19 bp, Homo sapiens
tgggcctatggagagccct

SEQ ID NO: 2442531 - DNA, 21 bp, Homo sapiens
tgggcctatggagagccctgg

SEQ ID NO: 2442532 - DNA, 14 bp, Homo sapiens
tgggcctgctccag

SEQ ID NO: 2442533 - DNA, 18 bp, Homo sapiens
tgggcctgctccagacct

SEQ ID NO: 2442534 - DNA, 20 bp, Homo sapiens
tgggcctgctccagacctga

SEQ ID NO: 2442535 - DNA, 13 bp, Homo sapiens
tgggcctgctgct

SEQ ID NO: 2442536 - DNA, 15 bp, Homo sapiens
tgggcctgctgctga

SEQ ID NO: 2442537 - DNA, 16 bp, Homo sapiens
tgggcctgctgctgag

SEQ ID NO: 2442538 - DNA, 17 bp, Homo sapiens
tgggcctgggctcctgg

SEQ ID NO: 2442539 - DNA, 15 bp, Homo sapiens
tgggccttggcctgg

SEQ ID NO: 2442540 - DNA, 15 bp, Homo sapiens
tgggccttgggctcc

SEQ ID NO: 2442541 - DNA, 16 bp, Homo sapiens
tgggccttgggctccg

SEQ ID NO: 2442542 - DNA, 14 bp, Homo sapiens
tgggctcagtgaag

SEQ ID NO: 2442543 - DNA, 19 bp, Homo sapiens
tgggctcagtgaagttgct

SEQ ID NO: 2442544 - DNA, 18 bp, Homo sapiens
tgtccccctctgtccagg

SEQ ID NO: 2442545 - DNA, 21 bp, Homo sapiens
tgtccccctttagatctctga

SEQ ID NO: 2442546 - DNA, 13 bp, Homo sapiens
tgtccctaggtgt

SEQ ID NO: 2442547 - DNA, 21 bp, Homo sapiens
tgtccctcactgttgaatttt

SEQ ID NO: 2442548 - DNA, 18 bp, Homo sapiens
tgtcccttgcccccctgg

SEQ ID NO: 2442549 - DNA, 14 bp, Homo sapiens
tgtcctacagaaaa

SEQ ID NO: 2442550 - DNA, 16 bp, Homo sapiens
tgtcctacagaaaaac

SEQ ID NO: 2442551 - DNA, 18 bp, Homo sapiens
tgtcctacagaaaaacct

SEQ ID NO: 2442552 - DNA, 15 bp, Homo sapiens
tgtcctagcacagat

SEQ ID NO: 2442553 - DNA, 20 bp, Homo sapiens
tgtcctatctccagcggccc

SEQ ID NO: 2442554 - DNA, 13 bp, Homo sapiens
tgtcctcagcctt

SEQ ID NO: 2442555 - DNA, 16 bp, Homo sapiens
tgtcctcagccttgcc

SEQ ID NO: 2442556 - DNA, 22 bp, Homo sapiens
tgtcctcagccttgccagagat

SEQ ID NO: 2442557 - DNA, 17 bp, Homo sapiens
tgtcctcccgagctcct

SEQ ID NO: 2442558 - DNA, 23 bp, Homo sapiens
tgtcctcccgagctcctcttcca

SEQ ID NO: 2442559 - DNA, 13 bp, Homo sapiens
tgtcctcttccct

SEQ ID NO: 2442560 - DNA, 17 bp, Homo sapiens
tgtcctctttcagctcc

SEQ ID NO: 2442561 - DNA, 21 bp, Homo sapiens
tgtcctgagccccagggagag

SEQ ID NO: 2442562 - DNA, 14 bp, Homo sapiens
tgtcctgagctcag

SEQ ID NO: 2442563 - DNA, 17 bp, Homo sapiens
tgtcctgagctcagcgt

SEQ ID NO: 2442564 - DNA, 19 bp, Homo sapiens
tgtcctgcccccaaggagg

SEQ ID NO: 2442565 - DNA, 17 bp, Homo sapiens
tgtcctgcctattatct

SEQ ID NO: 2442566 - DNA, 12 bp, Homo sapiens
tgtcctgcctgt

SEQ ID NO: 2442567 - DNA, 17 bp, Homo sapiens
tgtcctgggcctgcaga

SEQ ID NO: 2442568 - DNA, 17 bp, Homo sapiens
tgtcctggtggtatttt

SEQ ID NO: 2442569 - DNA, 18 bp, Homo sapiens
tgtcctggtggtattttc

SEQ ID NO: 2442570 - DNA, 20 bp, Homo sapiens
tgtcctggtggtattttcaa

SEQ ID NO: 2442571 - DNA, 19 bp, Homo sapiens
tgtcctgtcatcatcatgg

SEQ ID NO: 2442572 - DNA, 16 bp, Homo sapiens
tgtccttagcctggac

SEQ ID NO: 2442573 - DNA, 23 bp, Homo sapiens
tgtccttagcctggacctctgac

SEQ ID NO: 2442574 - DNA, 13 bp, Homo sapiens
tgtcctttccctt

SEQ ID NO: 2442575 - DNA, 23 bp, Homo sapiens
tgtcctttcccttcagtaccctc

SEQ ID NO: 2442576 - DNA, 18 bp, Homo sapiens
tgtcctttctagagcact

SEQ ID NO: 2442577 - DNA, 15 bp, Homo sapiens
tgtcctttttcctct

SEQ ID NO: 2442578 - DNA, 17 bp, Homo sapiens
tgtcctttttcctctcc

SEQ ID NO: 2442579 - DNA, 18 bp, Homo sapiens
tgtcctttttcctctcca

SEQ ID NO: 2442580 - DNA, 21 bp, Homo sapiens
tgtcctttttcctctccacac

SEQ ID NO: 2442581 - DNA, 14 bp, Homo sapiens
tgtcgctcatgtgt

SEQ ID NO: 2442582 - DNA, 22 bp, Homo sapiens
tgtcgctcatgtgtgcaacagg

SEQ ID NO: 2442583 - DNA, 13 bp, Homo sapiens
tgtctaagattct

SEQ ID NO: 2442584 - DNA, 16 bp, Homo sapiens
tgtctaagattctaga

SEQ ID NO: 2442585 - DNA, 12 bp, Homo sapiens
tgtctataaagc

SEQ ID NO: 2442586 - DNA, 13 bp, Homo sapiens
tgtctcagcctcc

SEQ ID NO: 2442587 - DNA, 16 bp, Homo sapiens
tgtctcaggctgcctg

SEQ ID NO: 2442588 - DNA, 17 bp, Homo sapiens
tgtctcaggctgcctga

SEQ ID NO: 2442589 - DNA, 19 bp, Homo sapiens
tgtctcaggctgcctgagt

SEQ ID NO: 2442590 - DNA, 13 bp, Homo sapiens
tgtctcctaagca

SEQ ID NO: 2442591 - DNA, 15 bp, Homo sapiens
tgtctcgaactattt

SEQ ID NO: 2442592 - DNA, 15 bp, Homo sapiens
tgtctcttatggatg

SEQ ID NO: 2442593 - DNA, 14 bp, Homo sapiens
tgtctcttgagttt

SEQ ID NO: 2442594 - DNA, 17 bp, Homo sapiens
tgtctcttgagtttgtc

SEQ ID NO: 2442595 - DNA, 21 bp, Homo sapiens
tgtctcttgcctgccactgtg

SEQ ID NO: 2442596 - DNA, 16 bp, Homo sapiens
tgtctcttttctcttt

SEQ ID NO: 2442597 - DNA, 13 bp, Homo sapiens
tgtctgaacttgc

SEQ ID NO: 2442598 - DNA, 14 bp, Homo sapiens
tgtctggcaaggac

SEQ ID NO: 2442599 - DNA, 16 bp, Homo sapiens
tgtctggcaatgccac

SEQ ID NO: 2442600 - DNA, 22 bp, Homo sapiens
tgtctggcaatgccacagccct

SEQ ID NO: 2442601 - DNA, 14 bp, Homo sapiens
tgtctggggcagaa

SEQ ID NO: 2442602 - DNA, 15 bp, Homo sapiens
tgtctgggtgctact

SEQ ID NO: 2442603 - DNA, 21 bp, Homo sapiens
tgtctgggtgctactggggaa

SEQ ID NO: 2442604 - DNA, 13 bp, Homo sapiens
tgtctggtggccc

SEQ ID NO: 2442605 - DNA, 23 bp, Homo sapiens
tgtctggttctcaattccaacag

SEQ ID NO: 2442606 - DNA, 20 bp, Homo sapiens
tgtctgtgacttttgtgaaa

SEQ ID NO: 2442607 - DNA, 15 bp, Homo sapiens
tgtctgtggattttt

SEQ ID NO: 2442608 - DNA, 19 bp, Homo sapiens
tgtctgtggcaaaagttta

SEQ ID NO: 2442609 - DNA, 18 bp, Homo sapiens
tgtcttaattttctttca

SEQ ID NO: 2442610 - DNA, 12 bp, Homo sapiens
tgtcttctccct

SEQ ID NO: 2442611 - DNA, 13 bp, Homo sapiens
tgtcttctccctg

SEQ ID NO: 2442612 - DNA, 16 bp, Homo sapiens
tgtcttgagctctatt

SEQ ID NO: 2442613 - DNA, 19 bp, Homo sapiens
tgtcttgagctctattatg

SEQ ID NO: 2442614 - DNA, 22 bp, Homo sapiens
tgtcttgatgcatgcactgttc

SEQ ID NO: 2442615 - DNA, 13 bp, Homo sapiens
tgtcttggaacat

SEQ ID NO: 2442616 - DNA, 16 bp, Homo sapiens
tgtcttgggcagagct

SEQ ID NO: 2442617 - DNA, 21 bp, Homo sapiens
tgtcttgggcagagctggctc

SEQ ID NO: 2442618 - DNA, 22 bp, Homo sapiens
tgtcttgggcagagctggctct

SEQ ID NO: 2442619 - DNA, 14 bp, Homo sapiens
tgtctttttttgta

SEQ ID NO: 2442620 - DNA, 21 bp, Homo sapiens
tggcagcctcccatccagggc

SEQ ID NO: 2442621 - DNA, 22 bp, Homo sapiens
tggcagcctcccatccagggcc

SEQ ID NO: 2442622 - DNA, 12 bp, Homo sapiens
tggcagccttgt

SEQ ID NO: 2442623 - DNA, 21 bp, Homo sapiens
tggcagctctggacagcccca

SEQ ID NO: 2442624 - DNA, 15 bp, Homo sapiens
tggcaggaaggcttg

SEQ ID NO: 2442625 - DNA, 17 bp, Homo sapiens
tggcaggaaggcttgtt

SEQ ID NO: 2442626 - DNA, 18 bp, Homo sapiens
tggcaggcagaggcccag

SEQ ID NO: 2442627 - DNA, 13 bp, Homo sapiens
tggcaggctggcc

SEQ ID NO: 2442628 - DNA, 15 bp, Homo sapiens
tggcaggctggccag

SEQ ID NO: 2442629 - DNA, 18 bp, Homo sapiens
tggcaggctggccagtcc

SEQ ID NO: 2442630 - DNA, 15 bp, Homo sapiens
tggcaggggacagga

SEQ ID NO: 2442631 - DNA, 19 bp, Homo sapiens
tggcagggggctgctgctg

SEQ ID NO: 2442632 - DNA, 23 bp, Homo sapiens
tggcagggggctgctgctgggct

SEQ ID NO: 2442633 - DNA, 20 bp, Homo sapiens
tggcagtttatatttaactc

SEQ ID NO: 2442634 - DNA, 14 bp, Homo sapiens
tggcatagctctgg

SEQ ID NO: 2442635 - DNA, 15 bp, Homo sapiens
tggcatagctctggg

SEQ ID NO: 2442636 - DNA, 13 bp, Homo sapiens
tggcatccctggg

SEQ ID NO: 2442637 - DNA, 14 bp, Homo sapiens
tggcatccctgggc

SEQ ID NO: 2442638 - DNA, 19 bp, Homo sapiens
tggcatggaaatttaaagc

SEQ ID NO: 2442639 - DNA, 16 bp, Homo sapiens
tggccaagaagcagtg

SEQ ID NO: 2442640 - DNA, 14 bp, Homo sapiens
tggccaagctgagg

SEQ ID NO: 2442641 - DNA, 17 bp, Homo sapiens
tggccaagctgaggtgc

SEQ ID NO: 2442642 - DNA, 13 bp, Homo sapiens
tggccacagccag

SEQ ID NO: 2442643 - DNA, 11 bp, Homo sapiens
tggccaccagt

SEQ ID NO: 2442644 - DNA, 13 bp, Homo sapiens
tggccagcagcac

SEQ ID NO: 2442645 - DNA, 22 bp, Homo sapiens
tggccagccccttagacagagg

SEQ ID NO: 2442646 - DNA, 21 bp, Homo sapiens
tggccaggaagctttggtgag

SEQ ID NO: 2442647 - DNA, 13 bp, Homo sapiens
tggccaggccggg

SEQ ID NO: 2442648 - DNA, 17 bp, Homo sapiens
tggccagtccaggctgc

SEQ ID NO: 2442649 - DNA, 23 bp, Homo sapiens
tggccagtccaggctgccgtggg

SEQ ID NO: 2442650 - DNA, 14 bp, Homo sapiens
tggccagtgccctg

SEQ ID NO: 2442651 - DNA, 19 bp, Homo sapiens
tggccagtgtttaaaactt

SEQ ID NO: 2442652 - DNA, 16 bp, Homo sapiens
tggccatactgtgtcc

SEQ ID NO: 2442653 - DNA, 18 bp, Homo sapiens
tggccatatttacctcag

SEQ ID NO: 2442654 - DNA, 23 bp, Homo sapiens
tggccatatttacctcagcctgg

SEQ ID NO: 2442655 - DNA, 24 bp, Homo sapiens
tggccatatttacctcagcctggg

SEQ ID NO: 2442656 - DNA, 14 bp, Homo sapiens
tggccatctgctcc

SEQ ID NO: 2442657 - DNA, 22 bp, Homo sapiens
tggccatggagaaagctgactt

SEQ ID NO: 2442658 - DNA, 13 bp, Homo sapiens
tggccatggcctg

SEQ ID NO: 2442659 - DNA, 22 bp, Homo sapiens
tggcccagccaaaccctgtctg

SEQ ID NO: 2442660 - DNA, 11 bp, Homo sapiens
tggcccagcct

SEQ ID NO: 2442661 - DNA, 22 bp, Homo sapiens
tggcccagggcccagagcccag

SEQ ID NO: 2442662 - DNA, 22 bp, Homo sapiens
tggcccatcagggtaggctgga

SEQ ID NO: 2442663 - DNA, 15 bp, Homo sapiens
tggccccaccctggg

SEQ ID NO: 2442664 - DNA, 18 bp, Homo sapiens
tggccccaccctgggccc

SEQ ID NO: 2442665 - DNA, 14 bp, Homo sapiens
tggccccagcacag

SEQ ID NO: 2442666 - DNA, 19 bp, Homo sapiens
tggccccagcacagcttga

SEQ ID NO: 2442667 - DNA, 15 bp, Homo sapiens
tggccccaggacctg

SEQ ID NO: 2442668 - DNA, 10 bp, Homo sapiens
tggcccctct

SEQ ID NO: 2442669 - DNA, 15 bp, Homo sapiens
tggcccctctccctt

SEQ ID NO: 2442670 - DNA, 18 bp, Homo sapiens
tggcccctctgacctgca

SEQ ID NO: 2442671 - DNA, 16 bp, Homo sapiens
tggccctctcccctgc

SEQ ID NO: 2442672 - DNA, 13 bp, Homo sapiens
tggcccttcctgg

SEQ ID NO: 2442673 - DNA, 21 bp, Homo sapiens
tggcccttcctggacagctgt

SEQ ID NO: 2442674 - DNA, 17 bp, Homo sapiens
tggccgccccctgcccc

SEQ ID NO: 2442675 - DNA, 23 bp, Homo sapiens
tggccgccccctgccccccagcc

SEQ ID NO: 2442676 - DNA, 17 bp, Homo sapiens
tggccgctgagtggcag

SEQ ID NO: 2442677 - DNA, 19 bp, Homo sapiens
tggccgctgagtggcaggg

SEQ ID NO: 2442678 - DNA, 14 bp, Homo sapiens
tggccgctgtgcca

SEQ ID NO: 2442679 - DNA, 17 bp, Homo sapiens
tggccgctgtgccaggc

SEQ ID NO: 2442680 - DNA, 21 bp, Homo sapiens
tggccgtgaatgggtgcccac

SEQ ID NO: 2442681 - DNA, 21 bp, Homo sapiens
tggcctaagaggctgccctcc

SEQ ID NO: 2442682 - DNA, 15 bp, Homo sapiens
tggcctcacccaccc

SEQ ID NO: 2442683 - DNA, 19 bp, Homo sapiens
tggcctcagctcccacaag

SEQ ID NO: 2442684 - DNA, 13 bp, Homo sapiens
aaatacatgacat

SEQ ID NO: 2442685 - DNA, 15 bp, Homo sapiens
aaatagaaaatggtc

SEQ ID NO: 2442686 - DNA, 21 bp, Homo sapiens
aaatagataagagtagaaact

SEQ ID NO: 2442687 - DNA, 18 bp, Homo sapiens
aaatagcgttcttgtaat

SEQ ID NO: 2442688 - DNA, 19 bp, Homo sapiens
aaatagcgttcttgtaatt

SEQ ID NO: 2442689 - DNA, 21 bp, Homo sapiens
aaatagcgttcttgtaatttt

SEQ ID NO: 2442690 - DNA, 22 bp, Homo sapiens
aaatagttaagacatgatttcc

SEQ ID NO: 2442691 - DNA, 12 bp, Homo sapiens
aaatataaagac

SEQ ID NO: 2442692 - DNA, 12 bp, Homo sapiens
aaatatatatta

SEQ ID NO: 2442693 - DNA, 12 bp, Homo sapiens
aaatatattatt

SEQ ID NO: 2442694 - DNA, 16 bp, Homo sapiens
aaatatattattactt

SEQ ID NO: 2442695 - DNA, 22 bp, Homo sapiens
aaatatatttaagataattata

SEQ ID NO: 2442696 - DNA, 20 bp, Homo sapiens
aaatatccctcctgttggga

SEQ ID NO: 2442697 - DNA, 16 bp, Homo sapiens
aaatatgcctttttga

SEQ ID NO: 2442698 - DNA, 18 bp, Homo sapiens
aaatatgtacatttctca

SEQ ID NO: 2442699 - DNA, 20 bp, Homo sapiens
aaatatgtacatttctcagg

SEQ ID NO: 2442700 - DNA, 18 bp, Homo sapiens
aaatattccctagaaact

SEQ ID NO: 2442701 - DNA, 17 bp, Homo sapiens
aaatattttaaagaatt

SEQ ID NO: 2442702 - DNA, 19 bp, Homo sapiens
aaatattttaaagaattgt

SEQ ID NO: 2442703 - DNA, 11 bp, Homo sapiens
tttagctctga

SEQ ID NO: 2442704 - DNA, 15 bp, Homo sapiens
tttaggtaagaagtt

SEQ ID NO: 2442705 - DNA, 12 bp, Homo sapiens
tttaggttctaa

SEQ ID NO: 2442706 - DNA, 13 bp, Homo sapiens
tttaggttctaaa

SEQ ID NO: 2442707 - DNA, 14 bp, Homo sapiens
tttaggttctaaag

SEQ ID NO: 2442708 - DNA, 23 bp, Homo sapiens
tttaggttctaaagttctaagat

SEQ ID NO: 2442709 - DNA, 23 bp, Homo sapiens
tttaggttctttgctgcattctg

SEQ ID NO: 2442710 - DNA, 13 bp, Homo sapiens
tttagtaaaccaa

SEQ ID NO: 2442711 - DNA, 22 bp, Homo sapiens
tttagtagcagtgattgtctta

SEQ ID NO: 2442712 - DNA, 11 bp, Homo sapiens
tttagttgaat

SEQ ID NO: 2442713 - DNA, 12 bp, Homo sapiens
tttagtttttca

SEQ ID NO: 2442714 - DNA, 22 bp, Homo sapiens
tttataaaagtgttcattgttt

SEQ ID NO: 2442715 - DNA, 15 bp, Homo sapiens
tttataagaaagcct

SEQ ID NO: 2442716 - DNA, 14 bp, Homo sapiens
tttataagcatcat

SEQ ID NO: 2442717 - DNA, 17 bp, Homo sapiens
tttataagcatcattat

SEQ ID NO: 2442718 - DNA, 12 bp, Homo sapiens
tttatacagctg

SEQ ID NO: 2442719 - DNA, 14 bp, Homo sapiens
tttatacagctgta

SEQ ID NO: 2442720 - DNA, 18 bp, Homo sapiens
tttatacagctgtattgt

SEQ ID NO: 2442721 - DNA, 20 bp, Homo sapiens
tttatatatatatataaaga

SEQ ID NO: 2442722 - DNA, 15 bp, Homo sapiens
tttatatattatatg

SEQ ID NO: 2442723 - DNA, 15 bp, Homo sapiens
tttatatcacatgtt

SEQ ID NO: 2442724 - DNA, 14 bp, Homo sapiens
tttatcattcaagt

SEQ ID NO: 2442725 - DNA, 15 bp, Homo sapiens
tttatcattcaagtg

SEQ ID NO: 2442726 - DNA, 18 bp, Homo sapiens
tttatcccaaagttgttg

SEQ ID NO: 2442727 - DNA, 16 bp, Homo sapiens
tttatcgcagaccttt

SEQ ID NO: 2442728 - DNA, 14 bp, Homo sapiens
tttatgaatgggtg

SEQ ID NO: 2442729 - DNA, 17 bp, Homo sapiens
tttatgataatagattc

SEQ ID NO: 2442730 - DNA, 22 bp, Homo sapiens
ttgttaatttttcctatattgc

SEQ ID NO: 2442731 - DNA, 13 bp, Homo sapiens
ttgttatataatc

SEQ ID NO: 2442732 - DNA, 16 bp, Homo sapiens
ttgttatcagtcaata

SEQ ID NO: 2442733 - DNA, 22 bp, Homo sapiens
ttgttatcagtcaatattttta

SEQ ID NO: 2442734 - DNA, 15 bp, Homo sapiens
ttgttctgttaactg

SEQ ID NO: 2442735 - DNA, 17 bp, Homo sapiens
ttgttctgttaactgaa

SEQ ID NO: 2442736 - DNA, 14 bp, Homo sapiens
ttgttcttgtattt

SEQ ID NO: 2442737 - DNA, 16 bp, Homo sapiens
ttgttgaaaaagtttg

SEQ ID NO: 2442738 - DNA, 12 bp, Homo sapiens
ttgttgacatta

SEQ ID NO: 2442739 - DNA, 15 bp, Homo sapiens
ttgttgacattctga

SEQ ID NO: 2442740 - DNA, 16 bp, Homo sapiens
ttgttgacattctgaa

SEQ ID NO: 2442741 - DNA, 15 bp, Homo sapiens
ttgttggtgcacagc

SEQ ID NO: 2442742 - DNA, 20 bp, Homo sapiens
ttgttggttggttttcttct

SEQ ID NO: 2442743 - DNA, 23 bp, Homo sapiens
ttgttgtagattgattgtattgt

SEQ ID NO: 2442744 - DNA, 17 bp, Homo sapiens
ttgtttacatgcttatt

SEQ ID NO: 2442745 - DNA, 21 bp, Homo sapiens
ttgtttcaatgaggtgtccaa

SEQ ID NO: 2442746 - DNA, 14 bp, Homo sapiens
ttgtttctccccca

SEQ ID NO: 2442747 - DNA, 15 bp, Homo sapiens
ttgtttcttaaataa

SEQ ID NO: 2442748 - DNA, 16 bp, Homo sapiens
ttgtttctttctctga

SEQ ID NO: 2442749 - DNA, 20 bp, Homo sapiens
ttgtttctttctctgaggac

SEQ ID NO: 2442750 - DNA, 14 bp, Homo sapiens
ttgttttggatgcc

SEQ ID NO: 2442751 - DNA, 19 bp, Homo sapiens
ttgttttgtgtctcttatg

SEQ ID NO: 2442752 - DNA, 14 bp, Homo sapiens
ttgtttttaaactg

SEQ ID NO: 2442753 - DNA, 13 bp, Homo sapiens
tttggacagttta

SEQ ID NO: 2442754 - DNA, 19 bp, Homo sapiens
tttggacctaaatggcctc

SEQ ID NO: 2442755 - DNA, 17 bp, Homo sapiens
tttggaggtttattacg

SEQ ID NO: 2442756 - DNA, 14 bp, Homo sapiens
tttggattgtatat

SEQ ID NO: 2442757 - DNA, 16 bp, Homo sapiens
tttggcaattttgtgg

SEQ ID NO: 2442758 - DNA, 23 bp, Homo sapiens
tttggcatccctgggccttgggc

SEQ ID NO: 2442759 - DNA, 17 bp, Homo sapiens
tttggccatctgctcct

SEQ ID NO: 2442760 - DNA, 22 bp, Homo sapiens
tttggctgaaattctcctggag

SEQ ID NO: 2442761 - DNA, 16 bp, Homo sapiens
tttgggagacatgtga

SEQ ID NO: 2442762 - DNA, 15 bp, Homo sapiens
tttgggagtttttat

SEQ ID NO: 2442763 - DNA, 21 bp, Homo sapiens
tttggggtataggtctcatct

SEQ ID NO: 2442764 - DNA, 13 bp, Homo sapiens
tttgggtccagga

SEQ ID NO: 2442765 - DNA, 14 bp, Homo sapiens
tttgggtccaggag

SEQ ID NO: 2442766 - DNA, 16 bp, Homo sapiens
tttgggttctgcctgc

SEQ ID NO: 2442767 - DNA, 16 bp, Homo sapiens
tttgggtttttttcct

SEQ ID NO: 2442768 - DNA, 17 bp, Homo sapiens
tttggtccgtcataacc

SEQ ID NO: 2442769 - DNA, 22 bp, Homo sapiens
tttggtcgaggagtaacaatac

SEQ ID NO: 2442770 - DNA, 14 bp, Homo sapiens
tttggtgagaacct

SEQ ID NO: 2442771 - DNA, 18 bp, Homo sapiens
tttggtgattacatttta

SEQ ID NO: 2442772 - DNA, 12 bp, Homo sapiens
tttggtgtatgg

SEQ ID NO: 2442773 - DNA, 14 bp, Homo sapiens
tttgtaaaatgaca

SEQ ID NO: 2442774 - DNA, 15 bp, Homo sapiens
tttgtaaatctgcca

SEQ ID NO: 2442775 - DNA, 18 bp, Homo sapiens
tttgtacatttgggagtt

SEQ ID NO: 2442776 - DNA, 15 bp, Homo sapiens
tttgtagggtttcta

SEQ ID NO: 2442777 - DNA, 14 bp, Homo sapiens
tttgtatcttgatg

SEQ ID NO: 2442778 - DNA, 14 bp, Homo sapiens
tttgtattctctga

SEQ ID NO: 2442779 - DNA, 18 bp, Homo sapiens
tttgtgaatagaactctg

SEQ ID NO: 2442780 - DNA, 15 bp, Homo sapiens
tttgtgaattaggct

SEQ ID NO: 2442781 - DNA, 13 bp, Homo sapiens
tttgtgcattctg

SEQ ID NO: 2442782 - DNA, 12 bp, Homo sapiens
tttgtgccctat

SEQ ID NO: 2442783 - DNA, 22 bp, Homo sapiens
tttgtgctgaatgttgggactg

SEQ ID NO: 2442784 - DNA, 18 bp, Homo sapiens
tttgtgggggactgtaag

SEQ ID NO: 2442785 - DNA, 15 bp, Homo sapiens
tttttaaactgtaca

SEQ ID NO: 2442786 - DNA, 17 bp, Homo sapiens
tttttaaactgtacagt

SEQ ID NO: 2442787 - DNA, 13 bp, Homo sapiens
tttttaagaattg

SEQ ID NO: 2442788 - DNA, 20 bp, Homo sapiens
tttttaagctctgagctgtc

SEQ ID NO: 2442789 - DNA, 14 bp, Homo sapiens
tttttaataattta

SEQ ID NO: 2442790 - DNA, 18 bp, Homo sapiens
tttttaatgtatagtaaa

SEQ ID NO: 2442791 - DNA, 23 bp, Homo sapiens
tttttaatttacaaaaatataaa

SEQ ID NO: 2442792 - DNA, 22 bp, Homo sapiens
tttttacaaatgttaaaatgtg

SEQ ID NO: 2442793 - DNA, 23 bp, Homo sapiens
tttttacaaatgttaaaatgtgt

SEQ ID NO: 2442794 - DNA, 20 bp, Homo sapiens
tttttaggaagcaagcttaa

SEQ ID NO: 2442795 - DNA, 12 bp, Homo sapiens
tttttagttgaa

SEQ ID NO: 2442796 - DNA, 15 bp, Homo sapiens
tttttagttgaattt

SEQ ID NO: 2442797 - DNA, 15 bp, Homo sapiens
tttttatatatgtgt

SEQ ID NO: 2442798 - DNA, 17 bp, Homo sapiens
tttttattagtattgtt

SEQ ID NO: 2442799 - DNA, 15 bp, Homo sapiens
tttttatttcttcct

SEQ ID NO: 2442800 - DNA, 16 bp, Homo sapiens
tttttcatcttcagtt

SEQ ID NO: 2442801 - DNA, 23 bp, Homo sapiens
tttttccaactactaatagaata

SEQ ID NO: 2442802 - DNA, 21 bp, Homo sapiens
tttttccccagacttgttggc

SEQ ID NO: 2442803 - DNA, 14 bp, Homo sapiens
tttttctaaaggag

SEQ ID NO: 2442804 - DNA, 18 bp, Homo sapiens
tttttctattaaaagact

SEQ ID NO: 2442805 - DNA, 19 bp, Homo sapiens
tttttctattaaaagactc

SEQ ID NO: 2442806 - DNA, 16 bp, Homo sapiens
tttttctctcaacacc

SEQ ID NO: 2442807 - DNA, 14 bp, Homo sapiens
tttttctgtaccag

SEQ ID NO: 2442808 - DNA, 12 bp, Homo sapiens
tttttcttgtct

SEQ ID NO: 2442809 - DNA, 17 bp, Homo sapiens
tttttcttgtctataaa

SEQ ID NO: 2442810 - DNA, 22 bp, Homo sapiens
tttttcttgtctataaagcatt

SEQ ID NO: 2442811 - DNA, 15 bp, Homo sapiens
tttttgataaagcct

SEQ ID NO: 2442812 - DNA, 20 bp, Homo sapiens
tttttgcacatgtttcctct

SEQ ID NO: 2442813 - DNA, 9 bp, Homo sapiens
tttttgcag

SEQ ID NO: 2442814 - DNA, 19 bp, Homo sapiens
tttttggaagtgaaaactt

SEQ ID NO: 2442815 - DNA, 21 bp, Homo sapiens
tttttggggggttttcttgcc

SEQ ID NO: 2442816 - DNA, 14 bp, Homo sapiens
tttttgtaccattt

SEQ ID NO: 2442817 - DNA, 18 bp, Homo sapiens
tttttgtataaaatagac

SEQ ID NO: 2442818 - DNA, 20 bp, Homo sapiens
tttttgttctggtccttttt

SEQ ID NO: 2442819 - DNA, 15 bp, Homo sapiens
tttttgtttgtttgt

SEQ ID NO: 2442820 - DNA, 19 bp, Homo sapiens
ttttttaatccgccaatat

SEQ ID NO: 2442821 - DNA, 15 bp, Homo sapiens
ttttttatatatgtg

SEQ ID NO: 2442822 - DNA, 16 bp, Homo sapiens
ttttttatgctaatca

SEQ ID NO: 2442823 - DNA, 10 bp, Homo sapiens
ttttttcctt

SEQ ID NO: 2442824 - DNA, 12 bp, Homo sapiens
ttttttgtatag

SEQ ID NO: 2442825 - DNA, 16 bp, Homo sapiens
ttttttgtttgtttgt

SEQ ID NO: 2442826 - DNA, 12 bp, Homo sapiens
tttttttcagtt

SEQ ID NO: 2442827 - DNA, 10 bp, Homo sapiens
tttttttcct

SEQ ID NO: 2442828 - DNA, 13 bp, Homo sapiens
tttttttgtttgt

SEQ ID NO: 2442829 - DNA, 16 bp, Homo sapiens
ccaccatttggcatcc

SEQ ID NO: 2442830 - DNA, 18 bp, Homo sapiens
ccaccatttggcatccct

SEQ ID NO: 2442831 - DNA, 11 bp, Homo sapiens
ccacccagagg

SEQ ID NO: 2442832 - DNA, 17 bp, Homo sapiens
ccaccccaatcctccca

SEQ ID NO: 2442833 - DNA, 19 bp, Homo sapiens
ccaccccagggcagccagg

SEQ ID NO: 2442834 - DNA, 15 bp, Homo sapiens
ccacccccaccccca

SEQ ID NO: 2442835 - DNA, 16 bp, Homo sapiens
ccacccccagctcaat

SEQ ID NO: 2442836 - DNA, 14 bp, Homo sapiens
ccacccccggcagc

SEQ ID NO: 2442837 - DNA, 21 bp, Homo sapiens
ccaccctcactggctctcctg

SEQ ID NO: 2442838 - DNA, 19 bp, Homo sapiens
ccaccctcggggatgtgtc

SEQ ID NO: 2442839 - DNA, 13 bp, Homo sapiens
ccaccctgagccg

SEQ ID NO: 2442840 - DNA, 21 bp, Homo sapiens
ccaccctgaggagtctgaggt

SEQ ID NO: 2442841 - DNA, 21 bp, Homo sapiens
ccaccctggccgagtccaagc

SEQ ID NO: 2442842 - DNA, 13 bp, Homo sapiens
ccaccctgggccc

SEQ ID NO: 2442843 - DNA, 17 bp, Homo sapiens
ccaccctgggccctggg

SEQ ID NO: 2442844 - DNA, 20 bp, Homo sapiens
ccaccctgggccctgggctg

SEQ ID NO: 2442845 - DNA, 22 bp, Homo sapiens
ccaccctgggccctgggctgga

SEQ ID NO: 2442846 - DNA, 15 bp, Homo sapiens
ccaccctgttcctgc

SEQ ID NO: 2442847 - DNA, 15 bp, Homo sapiens
ccagcaaagccccca

SEQ ID NO: 2442848 - DNA, 21 bp, Homo sapiens
ccagcaaagcccccagagccc

SEQ ID NO: 2442849 - DNA, 23 bp, Homo sapiens
ccagcaaagcccccagagcccag

SEQ ID NO: 2442850 - DNA, 20 bp, Homo sapiens
ccagcacagcttagatttca

SEQ ID NO: 2442851 - DNA, 19 bp, Homo sapiens
ccagcaccggaccagcctg

SEQ ID NO: 2442852 - DNA, 21 bp, Homo sapiens
ccagcaccggaccagcctggc

SEQ ID NO: 2442853 - DNA, 20 bp, Homo sapiens
ccagcactcgctagcagtgg

SEQ ID NO: 2442854 - DNA, 15 bp, Homo sapiens
ccagcactgcttgag

SEQ ID NO: 2442855 - DNA, 19 bp, Homo sapiens
ccagcactgcttgaggaaa

SEQ ID NO: 2442856 - DNA, 20 bp, Homo sapiens
ccagcacttgtccagctgag

SEQ ID NO: 2442857 - DNA, 21 bp, Homo sapiens
ccagcagacagagccaggaga

SEQ ID NO: 2442858 - DNA, 22 bp, Homo sapiens
ccagcagctttagaatcccagc

SEQ ID NO: 2442859 - DNA, 13 bp, Homo sapiens
ccagcatctgggc

SEQ ID NO: 2442860 - DNA, 20 bp, Homo sapiens
ccagcattccagcccctctg

SEQ ID NO: 2442861 - DNA, 22 bp, Homo sapiens
ccagcattccagcccctctggt

SEQ ID NO: 2442862 - DNA, 14 bp, Homo sapiens
ccagcattcccagg

SEQ ID NO: 2442863 - DNA, 17 bp, Homo sapiens
ccagcattcccaggtag

SEQ ID NO: 2442864 - DNA, 21 bp, Homo sapiens
ccagcattcccaggtaggcca

SEQ ID NO: 2442865 - DNA, 22 bp, Homo sapiens
ccagccaacttttgcatgtttt

SEQ ID NO: 2442866 - DNA, 20 bp, Homo sapiens
ccagccaagctctgcagtcc

SEQ ID NO: 2442867 - DNA, 22 bp, Homo sapiens
ccagccaggcccagccgacccc

SEQ ID NO: 2442868 - DNA, 15 bp, Homo sapiens
ccagccagggctcaa

SEQ ID NO: 2442869 - DNA, 19 bp, Homo sapiens
ccagcccaagtgaggcagc

SEQ ID NO: 2442870 - DNA, 20 bp, Homo sapiens
ccagcccaagtgaggcagcc

SEQ ID NO: 2442871 - DNA, 12 bp, Homo sapiens
ccagcccagaga

SEQ ID NO: 2442872 - DNA, 22 bp, Homo sapiens
ccagcccagagacatacttgaa

SEQ ID NO: 2442873 - DNA, 23 bp, Homo sapiens
ccagcccagagacatacttgaag

SEQ ID NO: 2442874 - DNA, 14 bp, Homo sapiens
ccagcccatggaga

SEQ ID NO: 2442875 - DNA, 19 bp, Homo sapiens
ccagccccactcctctgct

SEQ ID NO: 2442876 - DNA, 15 bp, Homo sapiens
ccagccccagccagg

SEQ ID NO: 2442877 - DNA, 18 bp, Homo sapiens
ccagccccctcctggtgc

SEQ ID NO: 2442878 - DNA, 14 bp, Homo sapiens
ccagccccctgacc

SEQ ID NO: 2442879 - DNA, 19 bp, Homo sapiens
ccagccccctgaccactca

SEQ ID NO: 2442880 - DNA, 14 bp, Homo sapiens
ccagcccctctggt

SEQ ID NO: 2442881 - DNA, 18 bp, Homo sapiens
ccagcccctcttggagaa

SEQ ID NO: 2442882 - DNA, 21 bp, Homo sapiens
ccagcccctcttggagaagtc

SEQ ID NO: 2442883 - DNA, 19 bp, Homo sapiens
ccagcccctgtagaactca

SEQ ID NO: 2442884 - DNA, 21 bp, Homo sapiens
ccagccctgcctggaggacct

SEQ ID NO: 2442885 - DNA, 15 bp, Homo sapiens
ccagccgaccccctc

SEQ ID NO: 2442886 - DNA, 19 bp, Homo sapiens
ccagccgccggctgtgcag

SEQ ID NO: 2442887 - DNA, 19 bp, Homo sapiens
ccagccgcgcatcagactg

SEQ ID NO: 2442888 - DNA, 15 bp, Homo sapiens
ccagcctccctgaag

SEQ ID NO: 2442889 - DNA, 21 bp, Homo sapiens
ccagcctccctgaagcctttg

SEQ ID NO: 2442890 - DNA, 23 bp, Homo sapiens
ccagcctcgcccatccccttgag

SEQ ID NO: 2442891 - DNA, 15 bp, Homo sapiens
ccagcctctggcatt

SEQ ID NO: 2442892 - DNA, 16 bp, Homo sapiens
ccagcctggcctcctg

SEQ ID NO: 2442893 - DNA, 22 bp, Homo sapiens
ccagcctggcctcctgcctcta

SEQ ID NO: 2442894 - DNA, 12 bp, Homo sapiens
ccagcctgggcc

SEQ ID NO: 2442895 - DNA, 17 bp, Homo sapiens
ccagcctgggcctatgg

SEQ ID NO: 2442896 - DNA, 13 bp, Homo sapiens
ccagcgagcgccc

SEQ ID NO: 2442897 - DNA, 15 bp, Homo sapiens
ccagcggccctgtca

SEQ ID NO: 2442898 - DNA, 19 bp, Homo sapiens
ccagcgtcctcctctgtga

SEQ ID NO: 2442899 - DNA, 18 bp, Homo sapiens
ccagcgtcggtctgtgcc

SEQ ID NO: 2442900 - DNA, 13 bp, Homo sapiens
ccagctaagaacc

SEQ ID NO: 2442901 - DNA, 16 bp, Homo sapiens
ccagctaaggggtggg

SEQ ID NO: 2442902 - DNA, 16 bp, Homo sapiens
ccagctaccctttttc

SEQ ID NO: 2442903 - DNA, 20 bp, Homo sapiens
ccagctagtgacccacatgc

SEQ ID NO: 2442904 - DNA, 17 bp, Homo sapiens
ccagctcaatggactgg

SEQ ID NO: 2442905 - DNA, 22 bp, Homo sapiens
ccagctcaatggactggaaggg

SEQ ID NO: 2442906 - DNA, 11 bp, Homo sapiens
ccagctcagca

SEQ ID NO: 2442907 - DNA, 12 bp, Homo sapiens
ccagctcagcac

SEQ ID NO: 2442908 - DNA, 14 bp, Homo sapiens
ccagctccaacctg

SEQ ID NO: 2442909 - DNA, 19 bp, Homo sapiens
ccagctcccacctcccctt

SEQ ID NO: 2442910 - DNA, 22 bp, Homo sapiens
ccagctcccacctccccttggg

SEQ ID NO: 2442911 - DNA, 12 bp, Homo sapiens
ccagctcccagg

SEQ ID NO: 2442912 - DNA, 16 bp, Homo sapiens
ccagctccccctccct

SEQ ID NO: 2442913 - DNA, 14 bp, Homo sapiens
ccagctcctttggg

SEQ ID NO: 2442914 - DNA, 20 bp, Homo sapiens
ccagctctgaaaccagtgtt

SEQ ID NO: 2442915 - DNA, 19 bp, Homo sapiens
ccagctctggaggggaggg

SEQ ID NO: 2442916 - DNA, 17 bp, Homo sapiens
ccagctctgttcttcct

SEQ ID NO: 2442917 - DNA, 23 bp, Homo sapiens
ccagctgactaaactttttttct

SEQ ID NO: 2442918 - DNA, 22 bp, Homo sapiens
ccagctgctccgaggacccagg

SEQ ID NO: 2442919 - DNA, 15 bp, Homo sapiens
ccagctggaggcagg

SEQ ID NO: 2442920 - DNA, 16 bp, Homo sapiens
ccagctgggctctgca

SEQ ID NO: 2442921 - DNA, 17 bp, Homo sapiens
ccagctgggtcaggcag

SEQ ID NO: 2442922 - DNA, 18 bp, Homo sapiens
ccagctgtccccccactc

SEQ ID NO: 2442923 - DNA, 13 bp, Homo sapiens
ccagctgtggttt

SEQ ID NO: 2442924 - DNA, 13 bp, Homo sapiens
ccagctgtgtcca

SEQ ID NO: 2442925 - DNA, 20 bp, Homo sapiens
ccagcttatagtcatatata

SEQ ID NO: 2442926 - DNA, 14 bp, Homo sapiens
ccagcttcaggtga

SEQ ID NO: 2442927 - DNA, 21 bp, Homo sapiens
ccagcttgtttacatgcttat

SEQ ID NO: 2442928 - DNA, 23 bp, Homo sapiens
ccaggaaactctgcattctagta

SEQ ID NO: 2442929 - DNA, 19 bp, Homo sapiens
ccaggaacagcaaatgcaa

SEQ ID NO: 2442930 - DNA, 10 bp, Homo sapiens
ccaggaagcc

SEQ ID NO: 2442931 - DNA, 11 bp, Homo sapiens
ccaggaagccg

SEQ ID NO: 2442932 - DNA, 22 bp, Homo sapiens
ccaggaagccgtcctggcgcct

SEQ ID NO: 2442933 - DNA, 14 bp, Homo sapiens
tcccatccagggcc

SEQ ID NO: 2442934 - DNA, 14 bp, Homo sapiens
tcccatccccagcg

SEQ ID NO: 2442935 - DNA, 14 bp, Homo sapiens
tcccatcctgtgtg

SEQ ID NO: 2442936 - DNA, 15 bp, Homo sapiens
tcccatcctgtgtgt

SEQ ID NO: 2442937 - DNA, 16 bp, Homo sapiens
tcccatgatccctgtg

SEQ ID NO: 2442938 - DNA, 15 bp, Homo sapiens
tcccattcctgaaga

SEQ ID NO: 2442939 - DNA, 16 bp, Homo sapiens
tcccatttatcgcaga

SEQ ID NO: 2442940 - DNA, 16 bp, Homo sapiens
tccccaacagcgccca

SEQ ID NO: 2442941 - DNA, 17 bp, Homo sapiens
tccccaacagcgcccaa

SEQ ID NO: 2442942 - DNA, 20 bp, Homo sapiens
tccccaacagcgcccaaagg

SEQ ID NO: 2442943 - DNA, 16 bp, Homo sapiens
tccccaacccccaact

SEQ ID NO: 2442944 - DNA, 15 bp, Homo sapiens
tccccaccagatgct

SEQ ID NO: 2442945 - DNA, 20 bp, Homo sapiens
tccccaccagatgctgaaaa

SEQ ID NO: 2442946 - DNA, 21 bp, Homo sapiens
tccccacccaccaaccctcag

SEQ ID NO: 2442947 - DNA, 16 bp, Homo sapiens
tccccacgagggctgg

SEQ ID NO: 2442948 - DNA, 20 bp, Homo sapiens
tccccacgagggctggctgg

SEQ ID NO: 2442949 - DNA, 17 bp, Homo sapiens
tccccactctgctctga

SEQ ID NO: 2442950 - DNA, 19 bp, Homo sapiens
tccccactgtatctaggca

SEQ ID NO: 2442951 - DNA, 19 bp, Homo sapiens
tccccacttgcagccctgt

SEQ ID NO: 2442952 - DNA, 21 bp, Homo sapiens
tccccacttgtccgctgggtg

SEQ ID NO: 2442953 - DNA, 23 bp, Homo sapiens
tccccagagaaaggggagcccac

SEQ ID NO: 2442954 - DNA, 13 bp, Homo sapiens
tccccagcccaga

SEQ ID NO: 2442955 - DNA, 15 bp, Homo sapiens
tccccagcccagaga

SEQ ID NO: 2442956 - DNA, 16 bp, Homo sapiens
tccccagcccagagac

SEQ ID NO: 2442957 - DNA, 16 bp, Homo sapiens
tccccagctcccagga

SEQ ID NO: 2442958 - DNA, 17 bp, Homo sapiens
tccccagctcccaggac

SEQ ID NO: 2442959 - DNA, 19 bp, Homo sapiens
tccccagggaagcagcagc

SEQ ID NO: 2442960 - DNA, 23 bp, Homo sapiens
tccccagggaagcagcagcctcg

SEQ ID NO: 2442961 - DNA, 15 bp, Homo sapiens
tccccaggtccagct

SEQ ID NO: 2442962 - DNA, 17 bp, Homo sapiens
tccccaggtccagctct

SEQ ID NO: 2442963 - DNA, 23 bp, Homo sapiens
tccccatactcctatgatctgag

SEQ ID NO: 2442964 - DNA, 14 bp, Homo sapiens
tccccatcttctaa

SEQ ID NO: 2442965 - DNA, 13 bp, Homo sapiens
tcccccccatgca

SEQ ID NO: 2442966 - DNA, 17 bp, Homo sapiens
tcccccggcacctccct

SEQ ID NO: 2442967 - DNA, 12 bp, Homo sapiens
tccccctctgtc

SEQ ID NO: 2442968 - DNA, 17 bp, Homo sapiens
tccccgactggggcagg

SEQ ID NO: 2442969 - DNA, 23 bp, Homo sapiens
tccccgataccatgctgtaagga

SEQ ID NO: 2442970 - DNA, 20 bp, Homo sapiens
tcccctaagcagaccactga

SEQ ID NO: 2442971 - DNA, 16 bp, Homo sapiens
tcccctccatccctgg

SEQ ID NO: 2442972 - DNA, 15 bp, Homo sapiens
tcccctctccttcct

SEQ ID NO: 2442973 - DNA, 14 bp, Homo sapiens
tcccctctgctgct

SEQ ID NO: 2442974 - DNA, 13 bp, Homo sapiens
tcccctgcactgt

SEQ ID NO: 2442975 - DNA, 16 bp, Homo sapiens
tcccctgcactgtaaa

SEQ ID NO: 2442976 - DNA, 17 bp, Homo sapiens
tcccctgcactgtaaaa

SEQ ID NO: 2442977 - DNA, 18 bp, Homo sapiens
tcccctgcactgtaaaat

SEQ ID NO: 2442978 - DNA, 22 bp, Homo sapiens
tcccctgcactgtaaaatgtgg

SEQ ID NO: 2442979 - DNA, 15 bp, Homo sapiens
tcccctgccagggca

SEQ ID NO: 2442980 - DNA, 14 bp, Homo sapiens
tcccctgcccatgc

SEQ ID NO: 2442981 - DNA, 15 bp, Homo sapiens
tcccctgcccatgct

SEQ ID NO: 2442982 - DNA, 16 bp, Homo sapiens
tcccctgccccctgca

SEQ ID NO: 2442983 - DNA, 17 bp, Homo sapiens
tcccctgccccctgcag

SEQ ID NO: 2442984 - DNA, 18 bp, Homo sapiens
tcccctgccccctgcagg

SEQ ID NO: 2442985 - DNA, 19 bp, Homo sapiens
tcccctgccccctgcagga

SEQ ID NO: 2442986 - DNA, 23 bp, Homo sapiens
tcccctgccccctgcaggaagga

SEQ ID NO: 2442987 - DNA, 18 bp, Homo sapiens
tcccctgcctgccctggt

SEQ ID NO: 2442988 - DNA, 23 bp, Homo sapiens
tccccttatcctccctgtaactt

SEQ ID NO: 2442989 - DNA, 16 bp, Homo sapiens
tccccttgcctgtgcc

SEQ ID NO: 2442990 - DNA, 15 bp, Homo sapiens
tcccgattgtaactc

SEQ ID NO: 2442991 - DNA, 20 bp, Homo sapiens
tcccgcagtgggagcaaact

SEQ ID NO: 2442992 - DNA, 18 bp, Homo sapiens
tcccggaggttgggtggg

SEQ ID NO: 2442993 - DNA, 21 bp, Homo sapiens
tcccggggccagcacttccat

SEQ ID NO: 2442994 - DNA, 14 bp, Homo sapiens
tcccggggctccac

SEQ ID NO: 2442995 - DNA, 15 bp, Homo sapiens
tcccgtgttctcctt

SEQ ID NO: 2442996 - DNA, 16 bp, Homo sapiens
tccctaatctatggtc

SEQ ID NO: 2442997 - DNA, 23 bp, Homo sapiens
tccctaatctatggtcgggagac

SEQ ID NO: 2442998 - DNA, 16 bp, Homo sapiens
tccctaccctctagag

SEQ ID NO: 2442999 - DNA, 19 bp, Homo sapiens
tccctaccttgaaagaaga

SEQ ID NO: 2443000 - DNA, 15 bp, Homo sapiens
tccctactgaagccc

SEQ ID NO: 2443001 - DNA, 21 bp, Homo sapiens
tccctactgaagcccttgtga

SEQ ID NO: 2443002 - DNA, 18 bp, Homo sapiens
tccctagaaacttccaaa

SEQ ID NO: 2443003 - DNA, 16 bp, Homo sapiens
tccctatccaatcaat

SEQ ID NO: 2443004 - DNA, 14 bp, Homo sapiens
tccctatggaaaga

SEQ ID NO: 2443005 - DNA, 19 bp, Homo sapiens
tatcttggacaaatcacat

SEQ ID NO: 2443006 - DNA, 18 bp, Homo sapiens
tatgaattattcaattta

SEQ ID NO: 2443007 - DNA, 23 bp, Homo sapiens
tatgacttgggcacccccagcct

SEQ ID NO: 2443008 - DNA, 16 bp, Homo sapiens
tatgagtctagatgtt

SEQ ID NO: 2443009 - DNA, 23 bp, Homo sapiens
tatgatacttcgacactgttctt

SEQ ID NO: 2443010 - DNA, 14 bp, Homo sapiens
tatgatctgtctgt

SEQ ID NO: 2443011 - DNA, 18 bp, Homo sapiens
tatgatgttaaaaaaata

SEQ ID NO: 2443012 - DNA, 19 bp, Homo sapiens
tatgcacttataattttcc

SEQ ID NO: 2443013 - DNA, 15 bp, Homo sapiens
tatgcatatttgttt

SEQ ID NO: 2443014 - DNA, 18 bp, Homo sapiens
tatgcatggtgccccagg

SEQ ID NO: 2443015 - DNA, 20 bp, Homo sapiens
tatgcatggtgccccaggac

SEQ ID NO: 2443016 - DNA, 14 bp, Homo sapiens
tatgcattatatca

SEQ ID NO: 2443017 - DNA, 19 bp, Homo sapiens
tatgccattggggtagttg

SEQ ID NO: 2443018 - DNA, 14 bp, Homo sapiens
tatgcctttagtca

SEQ ID NO: 2443019 - DNA, 14 bp, Homo sapiens
tatgctaccaccag

SEQ ID NO: 2443020 - DNA, 15 bp, Homo sapiens
tatgctaccaccagc

SEQ ID NO: 2443021 - DNA, 17 bp, Homo sapiens
tatgctaccaccagctg

SEQ ID NO: 2443022 - DNA, 17 bp, Homo sapiens
tatgctcttaattgcca

SEQ ID NO: 2443023 - DNA, 16 bp, Homo sapiens
tatgcttaaaataagc

SEQ ID NO: 2443024 - DNA, 18 bp, Homo sapiens
tatgcttgtaactaaaat

SEQ ID NO: 2443025 - DNA, 15 bp, Homo sapiens
tatggaaatatatat

SEQ ID NO: 2443026 - DNA, 11 bp, Homo sapiens
tatggaattga

SEQ ID NO: 2443027 - DNA, 15 bp, Homo sapiens
tatggaattttgcaa

SEQ ID NO: 2443028 - DNA, 13 bp, Homo sapiens
tatggactatctg

SEQ ID NO: 2443029 - DNA, 16 bp, Homo sapiens
tatggagagccctggg

SEQ ID NO: 2443030 - DNA, 22 bp, Homo sapiens
tatggagtcatttttacaatgt

SEQ ID NO: 2443031 - DNA, 13 bp, Homo sapiens
tatggcctgtgtc

SEQ ID NO: 2443032 - DNA, 17 bp, Homo sapiens
tatggcgtaagtacaga

SEQ ID NO: 2443033 - DNA, 13 bp, Homo sapiens
tatgggtcacagg

SEQ ID NO: 2443034 - DNA, 15 bp, Homo sapiens
tatgggtcacaggaa

SEQ ID NO: 2443035 - DNA, 23 bp, Homo sapiens
tatggtgctctgtctacttgctc

SEQ ID NO: 2443036 - DNA, 17 bp, Homo sapiens
tatggtggatccaaact

SEQ ID NO: 2443037 - DNA, 20 bp, Homo sapiens
tatgtaaatggtatgtcatt

SEQ ID NO: 2443038 - DNA, 11 bp, Homo sapiens
tatgtaacatg

SEQ ID NO: 2443039 - DNA, 18 bp, Homo sapiens
tatgtacatttctcaggc

SEQ ID NO: 2443040 - DNA, 18 bp, Homo sapiens
tatgtaccctctgaaata

SEQ ID NO: 2443041 - DNA, 20 bp, Homo sapiens
tatgtagtaattgacatgtg

SEQ ID NO: 2443042 - DNA, 22 bp, Homo sapiens
tatgtatgggtagggtaaatca

SEQ ID NO: 2443043 - DNA, 19 bp, Homo sapiens
tatgtattatttacattta

SEQ ID NO: 2443044 - DNA, 20 bp, Homo sapiens
tatgtattgtgcaatgtgta

SEQ ID NO: 2443045 - DNA, 21 bp, Homo sapiens
tatgtattgtgcaatgtgtat

SEQ ID NO: 2443046 - DNA, 13 bp, Homo sapiens
tatgtctggttct

SEQ ID NO: 2443047 - DNA, 22 bp, Homo sapiens
tatgtctggttctcaattccaa

SEQ ID NO: 2443048 - DNA, 16 bp, Homo sapiens
tatgtggttttagatt

SEQ ID NO: 2443049 - DNA, 19 bp, Homo sapiens
tatgtggttttagattttc

SEQ ID NO: 2443050 - DNA, 19 bp, Homo sapiens
tatgttatatataaatata

SEQ ID NO: 2443051 - DNA, 16 bp, Homo sapiens
tatgttccattaaacg

SEQ ID NO: 2443052 - DNA, 20 bp, Homo sapiens
tatgttccattaaacgattt

SEQ ID NO: 2443053 - DNA, 13 bp, Homo sapiens
tatgtttttaatg

SEQ ID NO: 2443054 - DNA, 12 bp, Homo sapiens
tattaaaagact

SEQ ID NO: 2443055 - DNA, 16 bp, Homo sapiens
tattaaaatgtatgca

SEQ ID NO: 2443056 - DNA, 18 bp, Homo sapiens
tattaaagaaaaaaatgt

SEQ ID NO: 2443057 - DNA, 14 bp, Homo sapiens
tattaaagtgctaa

SEQ ID NO: 2443058 - DNA, 22 bp, Homo sapiens
tattaaagtgctaaggttctaa

SEQ ID NO: 2443059 - DNA, 22 bp, Homo sapiens
tattaaattttttaaaaagcaa

SEQ ID NO: 2443060 - DNA, 19 bp, Homo sapiens
tattaaattttttgttgac

SEQ ID NO: 2443061 - DNA, 18 bp, Homo sapiens
tattaactttaatgtttt

SEQ ID NO: 2443062 - DNA, 21 bp, Homo sapiens
tattaagaaaggaagcattgt

SEQ ID NO: 2443063 - DNA, 23 bp, Homo sapiens
tattaagaaaggaagcattgtaa

SEQ ID NO: 2443064 - DNA, 17 bp, Homo sapiens
tattaatgcactttcta

SEQ ID NO: 2443065 - DNA, 17 bp, Homo sapiens
tattaatttatgcagaa

SEQ ID NO: 2443066 - DNA, 21 bp, Homo sapiens
tattaattttagtttttcatt

SEQ ID NO: 2443067 - DNA, 16 bp, Homo sapiens
tattacagtgtttatc

SEQ ID NO: 2443068 - DNA, 18 bp, Homo sapiens
tattacttgtaaatataa

SEQ ID NO: 2443069 - DNA, 23 bp, Homo sapiens
tattagaatcaaacattttgaaa

SEQ ID NO: 2443070 - DNA, 15 bp, Homo sapiens
tattagtattgttgt

SEQ ID NO: 2443071 - DNA, 16 bp, Homo sapiens
tattagtgctttgcca

SEQ ID NO: 2443072 - DNA, 14 bp, Homo sapiens
tattagttttgatt

SEQ ID NO: 2443073 - DNA, 19 bp, Homo sapiens
tattataatcttataattg

SEQ ID NO: 2443074 - DNA, 17 bp, Homo sapiens
tattatacttgtaatta

SEQ ID NO: 2443075 - DNA, 18 bp, Homo sapiens
tattatacttgtaattat

SEQ ID NO: 2443076 - DNA, 12 bp, Homo sapiens
tattatatggaa

SEQ ID NO: 2443077 - DNA, 13 bp, Homo sapiens
tattatatggaaa

SEQ ID NO: 2443078 - DNA, 17 bp, Homo sapiens
tattatatgtaccctct

SEQ ID NO: 2443079 - DNA, 20 bp, Homo sapiens
tattatgaatgtgaagcctt

SEQ ID NO: 2443080 - DNA, 17 bp, Homo sapiens
tattattacttgtaaat

SEQ ID NO: 2443081 - DNA, 15 bp, Homo sapiens
tattattataatctt

SEQ ID NO: 2443082 - DNA, 13 bp, Homo sapiens
tattcagacagat

SEQ ID NO: 2443083 - DNA, 20 bp, Homo sapiens
tattccagaatgctgtacat

SEQ ID NO: 2443084 - DNA, 15 bp, Homo sapiens
tattccatgactgct

SEQ ID NO: 2443085 - DNA, 21 bp, Homo sapiens
tattccctagaaacttccaaa

SEQ ID NO: 2443086 - DNA, 22 bp, Homo sapiens
tattcctgacctccgccatcca

SEQ ID NO: 2443087 - DNA, 20 bp, Homo sapiens
tattcgccacacagtatttt

SEQ ID NO: 2443088 - DNA, 21 bp, Homo sapiens
tattctaagacttactctaag

SEQ ID NO: 2443089 - DNA, 22 bp, Homo sapiens
tattctaagacttactctaaga

SEQ ID NO: 2443090 - DNA, 19 bp, Homo sapiens
tattctctgagctgtgcag

SEQ ID NO: 2443091 - DNA, 19 bp, Homo sapiens
tattctgggggctgcagtt

SEQ ID NO: 2443092 - DNA, 22 bp, Homo sapiens
tattcttctcttccttttatca

SEQ ID NO: 2443093 - DNA, 14 bp, Homo sapiens
tattcttggttttc

SEQ ID NO: 2443094 - DNA, 13 bp, Homo sapiens
tattgacacagaa

SEQ ID NO: 2443095 - DNA, 22 bp, Homo sapiens
tattgactaacaggccaaagag

SEQ ID NO: 2443096 - DNA, 14 bp, Homo sapiens
tattgacttgtata

SEQ ID NO: 2443097 - DNA, 19 bp, Homo sapiens
tattgataagatcttttat

SEQ ID NO: 2443098 - DNA, 13 bp, Homo sapiens
tattgcacattgt

SEQ ID NO: 2443099 - DNA, 11 bp, Homo sapiens
tattgcagttt

SEQ ID NO: 2443100 - DNA, 13 bp, Homo sapiens
tattgcagtttat

SEQ ID NO: 2443101 - DNA, 14 bp, Homo sapiens
tattgctagagctc

SEQ ID NO: 2443102 - DNA, 15 bp, Homo sapiens
tattggaacttgcga

SEQ ID NO: 2443103 - DNA, 15 bp, Homo sapiens
tattgtaaaacaggt

SEQ ID NO: 2443104 - DNA, 17 bp, Homo sapiens
tattgtgcaatgtaaat

SEQ ID NO: 2443105 - DNA, 19 bp, Homo sapiens
tattgtgcaatgtaaatat

SEQ ID NO: 2443106 - DNA, 14 bp, Homo sapiens
tattgtgcaatgtg

SEQ ID NO: 2443107 - DNA, 23 bp, Homo sapiens
tattgtgcaatgtgtataaacaa

SEQ ID NO: 2443108 - DNA, 12 bp, Homo sapiens
tattgtttcaat

SEQ ID NO: 2443109 - DNA, 22 bp, Homo sapiens
tcagaactcaaatggggccaga

SEQ ID NO: 2443110 - DNA, 13 bp, Homo sapiens
tcagaagaaaaag

SEQ ID NO: 2443111 - DNA, 15 bp, Homo sapiens
tcagaagcctggggg

SEQ ID NO: 2443112 - DNA, 21 bp, Homo sapiens
tcagaatagccacatttggaa

SEQ ID NO: 2443113 - DNA, 22 bp, Homo sapiens
tcagaatagccacatttggaat

SEQ ID NO: 2443114 - DNA, 22 bp, Homo sapiens
tcagaattagagcatgggaggt

SEQ ID NO: 2443115 - DNA, 19 bp, Homo sapiens
tcagacatctgaggtttta

SEQ ID NO: 2443116 - DNA, 17 bp, Homo sapiens
tcagactaagccagcac

SEQ ID NO: 2443117 - DNA, 19 bp, Homo sapiens
tcagactcccattcctgaa

SEQ ID NO: 2443118 - DNA, 22 bp, Homo sapiens
tcagactcccattcctgaagaa

SEQ ID NO: 2443119 - DNA, 18 bp, Homo sapiens
tcagactgacagtttaca

SEQ ID NO: 2443120 - DNA, 15 bp, Homo sapiens
tcagagacatgcaga

SEQ ID NO: 2443121 - DNA, 20 bp, Homo sapiens
tcagagaccagggctccagc

SEQ ID NO: 2443122 - DNA, 22 bp, Homo sapiens
tcagagccatgtcttctccctg

SEQ ID NO: 2443123 - DNA, 22 bp, Homo sapiens
tcagaggccctcgctgccagct

SEQ ID NO: 2443124 - DNA, 16 bp, Homo sapiens
tcagaggcgcactgtg

SEQ ID NO: 2443125 - DNA, 21 bp, Homo sapiens
tcagagtgacatccaggagga

SEQ ID NO: 2443126 - DNA, 16 bp, Homo sapiens
tcagagttctttttga

SEQ ID NO: 2443127 - DNA, 15 bp, Homo sapiens
tcagatccagggaca

SEQ ID NO: 2443128 - DNA, 14 bp, Homo sapiens
tcagatcctcctca

SEQ ID NO: 2443129 - DNA, 16 bp, Homo sapiens
tcagatgctccaagat

SEQ ID NO: 2443130 - DNA, 18 bp, Homo sapiens
tcagatgctccaagattc

SEQ ID NO: 2443131 - DNA, 20 bp, Homo sapiens
tcagatggaaaattcatttt

SEQ ID NO: 2443132 - DNA, 14 bp, Homo sapiens
tcagattccttccc

SEQ ID NO: 2443133 - DNA, 14 bp, Homo sapiens
tcagcacatctcaa

SEQ ID NO: 2443134 - DNA, 16 bp, Homo sapiens
tcagcacttggccctt

SEQ ID NO: 2443135 - DNA, 13 bp, Homo sapiens
tcagcatgaattt

SEQ ID NO: 2443136 - DNA, 18 bp, Homo sapiens
tcagcatgaatttgtaat

SEQ ID NO: 2443137 - DNA, 19 bp, Homo sapiens
tcagcatgaatttgtaatg

SEQ ID NO: 2443138 - DNA, 15 bp, Homo sapiens
tcagcatgcaataca

SEQ ID NO: 2443139 - DNA, 16 bp, Homo sapiens
tcagccaccctgagtt

SEQ ID NO: 2443140 - DNA, 21 bp, Homo sapiens
tcagccagcctcgcccatccc

SEQ ID NO: 2443141 - DNA, 15 bp, Homo sapiens
tcagccccaccccag

SEQ ID NO: 2443142 - DNA, 13 bp, Homo sapiens
tcagccctgagga

SEQ ID NO: 2443143 - DNA, 20 bp, Homo sapiens
tcagcctcccaagtagctgg

SEQ ID NO: 2443144 - DNA, 19 bp, Homo sapiens
tcagcctgaaccccagggc

SEQ ID NO: 2443145 - DNA, 12 bp, Homo sapiens
tcagcctggcca

SEQ ID NO: 2443146 - DNA, 19 bp, Homo sapiens
tcagcctgggcgctggtcc

SEQ ID NO: 2443147 - DNA, 15 bp, Homo sapiens
tcagccttgccagag

SEQ ID NO: 2443148 - DNA, 19 bp, Homo sapiens
tcagcgactccgttggcca

SEQ ID NO: 2443149 - DNA, 20 bp, Homo sapiens
tcagcgactccgttggccac

SEQ ID NO: 2443150 - DNA, 17 bp, Homo sapiens
tcagcgtggccttgttc

SEQ ID NO: 2443151 - DNA, 14 bp, Homo sapiens
tcagctaagctcac

SEQ ID NO: 2443152 - DNA, 15 bp, Homo sapiens
tcagctcatccatgc

SEQ ID NO: 2443153 - DNA, 14 bp, Homo sapiens
tcagctccaggtgg

SEQ ID NO: 2443154 - DNA, 13 bp, Homo sapiens
tcagctcccacaa

SEQ ID NO: 2443155 - DNA, 16 bp, Homo sapiens
tcagctcccacaagcc

SEQ ID NO: 2443156 - DNA, 12 bp, Homo sapiens
tcagctgccagt

SEQ ID NO: 2443157 - DNA, 13 bp, Homo sapiens
tcagctgtctttt

SEQ ID NO: 2443158 - DNA, 19 bp, Homo sapiens
tcagctgtcttttggagga

SEQ ID NO: 2443159 - DNA, 14 bp, Homo sapiens
tcaggaaaaggcct

SEQ ID NO: 2443160 - DNA, 15 bp, Homo sapiens
tcaggaaaaggcctg

SEQ ID NO: 2443161 - DNA, 17 bp, Homo sapiens
tcaggaaaaggcctggg

SEQ ID NO: 2443162 - DNA, 19 bp, Homo sapiens
tcaggaaaaggcctggggt

SEQ ID NO: 2443163 - DNA, 22 bp, Homo sapiens
tcaggaaacgagactttccatt

SEQ ID NO: 2443164 - DNA, 22 bp, Homo sapiens
tcaggaaaggaatcatttctat

SEQ ID NO: 2443165 - DNA, 18 bp, Homo sapiens
tcaggaattcttggagaa

SEQ ID NO: 2443166 - DNA, 20 bp, Homo sapiens
tcaggaccaaagctttcatg

SEQ ID NO: 2443167 - DNA, 15 bp, Homo sapiens
tcaggacccagagga

SEQ ID NO: 2443168 - DNA, 19 bp, Homo sapiens
tcaggacccagaggaaggg

SEQ ID NO: 2443169 - DNA, 12 bp, Homo sapiens
tcaggactggga

SEQ ID NO: 2443170 - DNA, 21 bp, Homo sapiens
tcaggactgggagcccccagc

SEQ ID NO: 2443171 - DNA, 16 bp, Homo sapiens
tcaggacttgaaagaa

SEQ ID NO: 2443172 - DNA, 20 bp, Homo sapiens
tcaggatccaagctaagcac

SEQ ID NO: 2443173 - DNA, 22 bp, Homo sapiens
tcaggatccaagctaagcactg

SEQ ID NO: 2443174 - DNA, 13 bp, Homo sapiens
tcaggattgcgag

SEQ ID NO: 2443175 - DNA, 18 bp, Homo sapiens
tcaggattgcgagagatg

SEQ ID NO: 2443176 - DNA, 20 bp, Homo sapiens
tcaggattgcgagagatgtg

SEQ ID NO: 2443177 - DNA, 13 bp, Homo sapiens
tcaggcacacagc

SEQ ID NO: 2443178 - DNA, 16 bp, Homo sapiens
tcaggcaggggcctcc

SEQ ID NO: 2443179 - DNA, 21 bp, Homo sapiens
tcaggcaggggcctccatggg

SEQ ID NO: 2443180 - DNA, 15 bp, Homo sapiens
tcaggcccaggcact

SEQ ID NO: 2443181 - DNA, 21 bp, Homo sapiens
tcaggcccggcagggcgggca

SEQ ID NO: 2443182 - DNA, 18 bp, Homo sapiens
tcaggctaggccagcagg

SEQ ID NO: 2443183 - DNA, 15 bp, Homo sapiens
tcaggctgcctgagt

SEQ ID NO: 2443184 - DNA, 21 bp, Homo sapiens
tcagggcaaagccaggtccct

SEQ ID NO: 2443185 - DNA, 15 bp, Homo sapiens
tcagggcagcgccag

SEQ ID NO: 2443186 - DNA, 14 bp, Homo sapiens
tcagggctcctggg

SEQ ID NO: 2443187 - DNA, 17 bp, Homo sapiens
tcagggggcgcctgtgg

SEQ ID NO: 2443188 - DNA, 20 bp, Homo sapiens
tcaggggtctgagctccagc

SEQ ID NO: 2443189 - DNA, 15 bp, Homo sapiens
tcaggtaatacaaac

SEQ ID NO: 2443190 - DNA, 16 bp, Homo sapiens
tcaggtaatacaaact

SEQ ID NO: 2443191 - DNA, 23 bp, Homo sapiens
tcaggtcacataaaactttgtat

SEQ ID NO: 2443192 - DNA, 14 bp, Homo sapiens
tcagtattatatgt

SEQ ID NO: 2443193 - DNA, 13 bp, Homo sapiens
tcagtatttaact

SEQ ID NO: 2443194 - DNA, 16 bp, Homo sapiens
tcagtcaatattttta

SEQ ID NO: 2443195 - DNA, 13 bp, Homo sapiens
tcagtcacagcca

SEQ ID NO: 2443196 - DNA, 19 bp, Homo sapiens
tcagtctcagaatgtcatt

SEQ ID NO: 2443197 - DNA, 15 bp, Homo sapiens
tcagtctctgagcag

SEQ ID NO: 2443198 - DNA, 18 bp, Homo sapiens
tcagtgaccctggctcct

SEQ ID NO: 2443199 - DNA, 16 bp, Homo sapiens
tcagtgctgtgctgtg

SEQ ID NO: 2443200 - DNA, 22 bp, Homo sapiens
tcagtgctgtgctgtgctatgg

SEQ ID NO: 2443201 - DNA, 14 bp, Homo sapiens
tcagtggggcagtc

SEQ ID NO: 2443202 - DNA, 18 bp, Homo sapiens
tcagtgtaccatttgcct

SEQ ID NO: 2443203 - DNA, 19 bp, Homo sapiens
tcagtgtaccatttgcctc

SEQ ID NO: 2443204 - DNA, 22 bp, Homo sapiens
tcagtgtaccgcgtctaccctg

SEQ ID NO: 2443205 - DNA, 13 bp, Homo sapiens
tcagttaagaaat

SEQ ID NO: 2443206 - DNA, 13 bp, Homo sapiens
tcagttctaggaa

SEQ ID NO: 2443207 - DNA, 15 bp, Homo sapiens
tcagttctaggaaaa

SEQ ID NO: 2443208 - DNA, 15 bp, Homo sapiens
tcagtttgtgtgtct

SEQ ID NO: 2443209 - DNA, 16 bp, Homo sapiens
tcagttttatcatttt

SEQ ID NO: 2443210 - DNA, 19 bp, Homo sapiens
tcagttttatcattttcaa

SEQ ID NO: 2443211 - DNA, 20 bp, Homo sapiens
tcataagtatttcaaattgg

SEQ ID NO: 2443212 - DNA, 19 bp, Homo sapiens
tcataatgggggtaaagtt

SEQ ID NO: 2443213 - DNA, 18 bp, Homo sapiens
tccatccacctttcccaa

SEQ ID NO: 2443214 - DNA, 15 bp, Homo sapiens
tccatccatggccag

SEQ ID NO: 2443215 - DNA, 21 bp, Homo sapiens
tccatctggtagaagggaaag

SEQ ID NO: 2443216 - DNA, 22 bp, Homo sapiens
tccatctggtagaagggaaagc

SEQ ID NO: 2443217 - DNA, 20 bp, Homo sapiens
tccatgactgcttgccctaa

SEQ ID NO: 2443218 - DNA, 20 bp, Homo sapiens
tccatgctgtgcgcccaggg

SEQ ID NO: 2443219 - DNA, 14 bp, Homo sapiens
tccatggccagcag

SEQ ID NO: 2443220 - DNA, 17 bp, Homo sapiens
tccatggccagcagcac

SEQ ID NO: 2443221 - DNA, 18 bp, Homo sapiens
tccatgggagaaaataga

SEQ ID NO: 2443222 - DNA, 15 bp, Homo sapiens
tccatgggcagagcc

SEQ ID NO: 2443223 - DNA, 12 bp, Homo sapiens
tccatgtaactg

SEQ ID NO: 2443224 - DNA, 19 bp, Homo sapiens
tccattaaacgatttttaa

SEQ ID NO: 2443225 - DNA, 14 bp, Homo sapiens
tccattctcctgag

SEQ ID NO: 2443226 - DNA, 20 bp, Homo sapiens
tccattctgctccttcccca

SEQ ID NO: 2443227 - DNA, 23 bp, Homo sapiens
tccatttaatggggtgcacctgt

SEQ ID NO: 2443228 - DNA, 20 bp, Homo sapiens
tcccaaaatgttgaaatatg

SEQ ID NO: 2443229 - DNA, 20 bp, Homo sapiens
tcccaaaccacgcctcttga

SEQ ID NO: 2443230 - DNA, 22 bp, Homo sapiens
tcccaaacgccctttcctcctc

SEQ ID NO: 2443231 - DNA, 20 bp, Homo sapiens
tcccaaagtgctgagattac

SEQ ID NO: 2443232 - DNA, 21 bp, Homo sapiens
tcccaaagtgctgggattaca

SEQ ID NO: 2443233 - DNA, 14 bp, Homo sapiens
tcccaaatgagcca

SEQ ID NO: 2443234 - DNA, 17 bp, Homo sapiens
tcccaaatttgattgat

SEQ ID NO: 2443235 - DNA, 19 bp, Homo sapiens
tcccaaatttgattgattt

SEQ ID NO: 2443236 - DNA, 20 bp, Homo sapiens
tcccaaatttgattgatttg

SEQ ID NO: 2443237 - DNA, 13 bp, Homo sapiens
tcccaagagctac

SEQ ID NO: 2443238 - DNA, 16 bp, Homo sapiens
tcccaagctcagaggc

SEQ ID NO: 2443239 - DNA, 15 bp, Homo sapiens
tcccaagggctgccg

SEQ ID NO: 2443240 - DNA, 16 bp, Homo sapiens
tcccaaggggcctgag

SEQ ID NO: 2443241 - DNA, 19 bp, Homo sapiens
tcccaaggggcctgagcag

SEQ ID NO: 2443242 - DNA, 16 bp, Homo sapiens
tcccaagtagaatctc

SEQ ID NO: 2443243 - DNA, 21 bp, Homo sapiens
tcccaagtagctgggattaca

SEQ ID NO: 2443244 - DNA, 15 bp, Homo sapiens
tcccaattcacatct

SEQ ID NO: 2443245 - DNA, 14 bp, Homo sapiens
tcccacaagcctga

SEQ ID NO: 2443246 - DNA, 15 bp, Homo sapiens
tcccacaagcctgag

SEQ ID NO: 2443247 - DNA, 16 bp, Homo sapiens
tcccacaagcctgagg

SEQ ID NO: 2443248 - DNA, 21 bp, Homo sapiens
tcccacagtcccatctgcttc

SEQ ID NO: 2443249 - DNA, 15 bp, Homo sapiens
tcccacatccctggg

SEQ ID NO: 2443250 - DNA, 18 bp, Homo sapiens
tcccacatccctgggcct

SEQ ID NO: 2443251 - DNA, 20 bp, Homo sapiens
tcccacatccctgggcctgc

SEQ ID NO: 2443252 - DNA, 21 bp, Homo sapiens
tcccacatccctgggcctgct

SEQ ID NO: 2443253 - DNA, 22 bp, Homo sapiens
tcccacatccctgggcctgctg

SEQ ID NO: 2443254 - DNA, 16 bp, Homo sapiens
tcccacatgggcccag

SEQ ID NO: 2443255 - DNA, 22 bp, Homo sapiens
tcccacatgggcccaggcctca

SEQ ID NO: 2443256 - DNA, 19 bp, Homo sapiens
tcccacattaaagaagacc

SEQ ID NO: 2443257 - DNA, 19 bp, Homo sapiens
tcccaccccaacctgctct

SEQ ID NO: 2443258 - DNA, 23 bp, Homo sapiens
tcccaccccaacctgctctcctc

SEQ ID NO: 2443259 - DNA, 20 bp, Homo sapiens
tcccacccccatctctccct

SEQ ID NO: 2443260 - DNA, 15 bp, Homo sapiens
tcccaccctcttcct

SEQ ID NO: 2443261 - DNA, 18 bp, Homo sapiens
tcccacctccccttgggc

SEQ ID NO: 2443262 - DNA, 19 bp, Homo sapiens
tcccacctgacacaccagg

SEQ ID NO: 2443263 - DNA, 23 bp, Homo sapiens
tcccacctgacacaccaggcgct

SEQ ID NO: 2443264 - DNA, 14 bp, Homo sapiens
tcccactccaagcc

SEQ ID NO: 2443265 - DNA, 12 bp, Homo sapiens
tcccagagcagg

SEQ ID NO: 2443266 - DNA, 16 bp, Homo sapiens
tcccagaggagccacc

SEQ ID NO: 2443267 - DNA, 23 bp, Homo sapiens
tcccagaggagccaccagttctc

SEQ ID NO: 2443268 - DNA, 23 bp, Homo sapiens
tcccagaggggcctgccacctgg

SEQ ID NO: 2443269 - DNA, 18 bp, Homo sapiens
tcccagccccctgaccac

SEQ ID NO: 2443270 - DNA, 16 bp, Homo sapiens
tcccagctaggaagag

SEQ ID NO: 2443271 - DNA, 11 bp, Homo sapiens
tcccaggaccc

SEQ ID NO: 2443272 - DNA, 16 bp, Homo sapiens
tcccaggaccctgaag

SEQ ID NO: 2443273 - DNA, 19 bp, Homo sapiens
tcccaggaccctgaagggg

SEQ ID NO: 2443274 - DNA, 12 bp, Homo sapiens
tcccaggcccac

SEQ ID NO: 2443275 - DNA, 20 bp, Homo sapiens
tcccaggcccactgtgcctc

SEQ ID NO: 2443276 - DNA, 21 bp, Homo sapiens
tcccaggccccatgacctcca

SEQ ID NO: 2443277 - DNA, 22 bp, Homo sapiens
tcccaggccccatgacctccag

SEQ ID NO: 2443278 - DNA, 20 bp, Homo sapiens
tcccagggttttaactttgt

SEQ ID NO: 2443279 - DNA, 15 bp, Homo sapiens
tcccaggtgttaaca

SEQ ID NO: 2443280 - DNA, 15 bp, Homo sapiens
tcccaggttggctct

SEQ ID NO: 2443281 - DNA, 23 bp, Homo sapiens
tcccagtccacctgaggaactgt

SEQ ID NO: 2443282 - DNA, 21 bp, Homo sapiens
tcccagttggagctccagcct

SEQ ID NO: 2443283 - DNA, 22 bp, Homo sapiens
tcccagttggagctccagcctg

SEQ ID NO: 2443284 - DNA, 13 bp, Homo sapiens
tcccatccagggc

SEQ ID NO: 2443285 - DNA, 22 bp, Homo sapiens
tcccatcgtctcggccttcaca

SEQ ID NO: 2443286 - DNA, 13 bp, Homo sapiens
tcccatctaggga

SEQ ID NO: 2443287 - DNA, 14 bp, Homo sapiens
tcccatggggaggg

SEQ ID NO: 2443288 - DNA, 13 bp, Homo sapiens
tcccattcctgaa

SEQ ID NO: 2443289 - DNA, 14 bp, Homo sapiens
tcccattcctgaag

SEQ ID NO: 2443290 - DNA, 17 bp, Homo sapiens
tcccatttatctaaata

SEQ ID NO: 2443291 - DNA, 22 bp, Homo sapiens
tccccaagtacaaccacaccca

SEQ ID NO: 2443292 - DNA, 17 bp, Homo sapiens
tccccaccagatgctga

SEQ ID NO: 2443293 - DNA, 13 bp, Homo sapiens
tccccacccacca

SEQ ID NO: 2443294 - DNA, 22 bp, Homo sapiens
tccccacccaccaaccctcagg

SEQ ID NO: 2443295 - DNA, 16 bp, Homo sapiens
tccccactgacagcct

SEQ ID NO: 2443296 - DNA, 12 bp, Homo sapiens
tccccactggag

SEQ ID NO: 2443297 - DNA, 13 bp, Homo sapiens
tccccactggagc

SEQ ID NO: 2443298 - DNA, 14 bp, Homo sapiens
tccccactggagca

SEQ ID NO: 2443299 - DNA, 17 bp, Homo sapiens
tccccagacttgttggc

SEQ ID NO: 2443300 - DNA, 14 bp, Homo sapiens
tccccagcccagag

SEQ ID NO: 2443301 - DNA, 23 bp, Homo sapiens
tccccagcgattccctctcccag

SEQ ID NO: 2443302 - DNA, 22 bp, Homo sapiens
tccccatcgttgcccccatttc

SEQ ID NO: 2443303 - DNA, 10 bp, Homo sapiens
tcccccaaga

SEQ ID NO: 2443304 - DNA, 19 bp, Homo sapiens
tcccccatgttctgtccct

SEQ ID NO: 2443305 - DNA, 22 bp, Homo sapiens
tccccccacaagtgccctccag

SEQ ID NO: 2443306 - DNA, 18 bp, Homo sapiens
tccccccactccctcaca

SEQ ID NO: 2443307 - DNA, 15 bp, Homo sapiens
tccccccatcttgct

SEQ ID NO: 2443308 - DNA, 22 bp, Homo sapiens
tccccccatcttgcttccctaa

SEQ ID NO: 2443309 - DNA, 17 bp, Homo sapiens
tcccccccatgcactgt

SEQ ID NO: 2443310 - DNA, 18 bp, Homo sapiens
tcccccccatgcactgtg

SEQ ID NO: 2443311 - DNA, 22 bp, Homo sapiens
tccccctatttattgactttga

SEQ ID NO: 2443312 - DNA, 19 bp, Homo sapiens
tcccctccaaaatgtgcct

SEQ ID NO: 2443313 - DNA, 20 bp, Homo sapiens
tcccctccatccctggcccc

SEQ ID NO: 2443314 - DNA, 14 bp, Homo sapiens
tcccctccccaact

SEQ ID NO: 2443315 - DNA, 14 bp, Homo sapiens
tcccctccttctcc

SEQ ID NO: 2443316 - DNA, 23 bp, Homo sapiens
tccctgcatggcatcctccagcc

SEQ ID NO: 2443317 - DNA, 16 bp, Homo sapiens
tccctgcctcctgccg

SEQ ID NO: 2443318 - DNA, 20 bp, Homo sapiens
tccctggatgacattaaaga

SEQ ID NO: 2443319 - DNA, 16 bp, Homo sapiens
tccctgggcctgctgc

SEQ ID NO: 2443320 - DNA, 19 bp, Homo sapiens
tccctgggcctgctgctga

SEQ ID NO: 2443321 - DNA, 16 bp, Homo sapiens
tccctgggccttgggc

SEQ ID NO: 2443322 - DNA, 12 bp, Homo sapiens
tccctggtccct

SEQ ID NO: 2443323 - DNA, 11 bp, Homo sapiens
tccctggtgct

SEQ ID NO: 2443324 - DNA, 15 bp, Homo sapiens
tccctggtgcttatg

SEQ ID NO: 2443325 - DNA, 19 bp, Homo sapiens
tccctgtaacctcttcaga

SEQ ID NO: 2443326 - DNA, 15 bp, Homo sapiens
tccctgtaacttgat

SEQ ID NO: 2443327 - DNA, 14 bp, Homo sapiens
tccctgtgcctcct

SEQ ID NO: 2443328 - DNA, 14 bp, Homo sapiens
tccctgtggtctac

SEQ ID NO: 2443329 - DNA, 21 bp, Homo sapiens
tccctgtggtctacccgtgtc

SEQ ID NO: 2443330 - DNA, 15 bp, Homo sapiens
tccctgttccccaga

SEQ ID NO: 2443331 - DNA, 18 bp, Homo sapiens
tccctgttccccagagaa

SEQ ID NO: 2443332 - DNA, 20 bp, Homo sapiens
tcccttaacagttgtattta

SEQ ID NO: 2443333 - DNA, 17 bp, Homo sapiens
tcccttaatatcctaaa

SEQ ID NO: 2443334 - DNA, 19 bp, Homo sapiens
tcccttcagtaccctctca

SEQ ID NO: 2443335 - DNA, 10 bp, Homo sapiens
tcccttcata

SEQ ID NO: 2443336 - DNA, 14 bp, Homo sapiens
tcccttgcccccct

SEQ ID NO: 2443337 - DNA, 12 bp, Homo sapiens
tcccttgggctc

SEQ ID NO: 2443338 - DNA, 21 bp, Homo sapiens
tcccttgggctctgatgaaaa

SEQ ID NO: 2443339 - DNA, 16 bp, Homo sapiens
tcccttgtatcccctg

SEQ ID NO: 2443340 - DNA, 19 bp, Homo sapiens
tcccttgtatcccctgcag

SEQ ID NO: 2443341 - DNA, 21 bp, Homo sapiens
tcccttgtatcccctgcaggc

SEQ ID NO: 2443342 - DNA, 13 bp, Homo sapiens
tcccttttctgtt

SEQ ID NO: 2443343 - DNA, 12 bp, Homo sapiens
tccgactgcttt

SEQ ID NO: 2443344 - DNA, 15 bp, Homo sapiens
tccgcccccaggtag

SEQ ID NO: 2443345 - DNA, 16 bp, Homo sapiens
tccgcccccaggtagg

SEQ ID NO: 2443346 - DNA, 13 bp, Homo sapiens
tccgccctgccac

SEQ ID NO: 2443347 - DNA, 16 bp, Homo sapiens
tccgcctggcctggcc

SEQ ID NO: 2443348 - DNA, 13 bp, Homo sapiens
tccggcatggaca

SEQ ID NO: 2443349 - DNA, 21 bp, Homo sapiens
tccgggacctggtgctgcctc

SEQ ID NO: 2443350 - DNA, 16 bp, Homo sapiens
tccggtgttctaagat

SEQ ID NO: 2443351 - DNA, 17 bp, Homo sapiens
tccgtgggacggtgccc

SEQ ID NO: 2443352 - DNA, 23 bp, Homo sapiens
tccgtgggacggtgcccaagcca

SEQ ID NO: 2443353 - DNA, 13 bp, Homo sapiens
tccgttggccact

SEQ ID NO: 2443354 - DNA, 21 bp, Homo sapiens
tcctaaatattatgagatgct

SEQ ID NO: 2443355 - DNA, 17 bp, Homo sapiens
tcctaagagtgctgggc

SEQ ID NO: 2443356 - DNA, 21 bp, Homo sapiens
tcctaagcaactaggccttca

SEQ ID NO: 2443357 - DNA, 16 bp, Homo sapiens
tcctaagcatctaagt

SEQ ID NO: 2443358 - DNA, 17 bp, Homo sapiens
tcctaagcatctaagtt

SEQ ID NO: 2443359 - DNA, 14 bp, Homo sapiens
tcctaagcctaaaa

SEQ ID NO: 2443360 - DNA, 20 bp, Homo sapiens
tcctaagggtcgaaagctct

SEQ ID NO: 2443361 - DNA, 23 bp, Homo sapiens
tcctaagggtcgaaagctctaga

SEQ ID NO: 2443362 - DNA, 18 bp, Homo sapiens
tcctaataaagttctgta

SEQ ID NO: 2443363 - DNA, 15 bp, Homo sapiens
tcctaatactgtcat

SEQ ID NO: 2443364 - DNA, 19 bp, Homo sapiens
tcctacagaaaaaccttgg

SEQ ID NO: 2443365 - DNA, 13 bp, Homo sapiens
tcctaccgtcttt

SEQ ID NO: 2443366 - DNA, 19 bp, Homo sapiens
tcctactggtctctctatg

SEQ ID NO: 2443367 - DNA, 23 bp, Homo sapiens
tcctagatcctaagggtcgaaag

SEQ ID NO: 2443368 - DNA, 18 bp, Homo sapiens
tcctagctgtcctttttc

SEQ ID NO: 2443369 - DNA, 17 bp, Homo sapiens
tcctagctgtgtgaata

SEQ ID NO: 2443370 - DNA, 23 bp, Homo sapiens
tcctaggcattctggacctctgg

SEQ ID NO: 2443371 - DNA, 15 bp, Homo sapiens
tcctagttctagaaa

SEQ ID NO: 2443372 - DNA, 16 bp, Homo sapiens
tcctagttctagaaaa

SEQ ID NO: 2443373 - DNA, 22 bp, Homo sapiens
tcctagttctagaaaaacaggc

SEQ ID NO: 2443374 - DNA, 18 bp, Homo sapiens
tcctatacgcagcgtgct

SEQ ID NO: 2443375 - DNA, 23 bp, Homo sapiens
tcctatctccagcggccctgtca

SEQ ID NO: 2443376 - DNA, 16 bp, Homo sapiens
tcctatctgggcttcc

SEQ ID NO: 2443377 - DNA, 19 bp, Homo sapiens
tcctatctgggcttcctgg

SEQ ID NO: 2443378 - DNA, 11 bp, Homo sapiens
tcctatgtttg

SEQ ID NO: 2443379 - DNA, 18 bp, Homo sapiens
tcctatgtttttgttcaa

SEQ ID NO: 2443380 - DNA, 19 bp, Homo sapiens
tcctatgtttttgttcaaa

SEQ ID NO: 2443381 - DNA, 21 bp, Homo sapiens
tcctattgtgcaatgtaaata

SEQ ID NO: 2443382 - DNA, 22 bp, Homo sapiens
tcctcaacccctcccctccatc

SEQ ID NO: 2443383 - DNA, 17 bp, Homo sapiens
tcctcaagaaataaaag

SEQ ID NO: 2443384 - DNA, 16 bp, Homo sapiens
tcctcagactctaaga

SEQ ID NO: 2443385 - DNA, 15 bp, Homo sapiens
tcctcagccagcctc

SEQ ID NO: 2443386 - DNA, 12 bp, Homo sapiens
tcctcagcctga

SEQ ID NO: 2443387 - DNA, 21 bp, Homo sapiens
tcctcagcctgaaccccaggg

SEQ ID NO: 2443388 - DNA, 21 bp, Homo sapiens
tcctcagccttgccagagatc

SEQ ID NO: 2443389 - DNA, 17 bp, Homo sapiens
tcctcatccaccccatc

SEQ ID NO: 2443390 - DNA, 18 bp, Homo sapiens
tcctcatccaccccatcc

SEQ ID NO: 2443391 - DNA, 22 bp, Homo sapiens
tcctcatcccgtgttctccttt

SEQ ID NO: 2443392 - DNA, 17 bp, Homo sapiens
tcctcatgaatgtaaat

SEQ ID NO: 2443393 - DNA, 20 bp, Homo sapiens
tcctcatgaatgtaaatttg

SEQ ID NO: 2443394 - DNA, 17 bp, Homo sapiens
tcctccaacaccaagca

SEQ ID NO: 2443395 - DNA, 12 bp, Homo sapiens
tcctccagcccc

SEQ ID NO: 2443396 - DNA, 20 bp, Homo sapiens
tcctcccacccggctgcaga

SEQ ID NO: 2443397 - DNA, 11 bp, Homo sapiens
tcctcccaggg

SEQ ID NO: 2443398 - DNA, 16 bp, Homo sapiens
cccaaatttgattgat

SEQ ID NO: 2443399 - DNA, 19 bp, Homo sapiens
cccaaatttgattgatttg

SEQ ID NO: 2443400 - DNA, 13 bp, Homo sapiens
cccaacacaaaga

SEQ ID NO: 2443401 - DNA, 18 bp, Homo sapiens
cccaacccgtggaggctg

SEQ ID NO: 2443402 - DNA, 20 bp, Homo sapiens
cccaacccgtggaggctgct

SEQ ID NO: 2443403 - DNA, 21 bp, Homo sapiens
cccaacccgtggaggctgctc

SEQ ID NO: 2443404 - DNA, 16 bp, Homo sapiens
cccaacctgctctcct

SEQ ID NO: 2443405 - DNA, 12 bp, Homo sapiens
cccaactgacca

SEQ ID NO: 2443406 - DNA, 22 bp, Homo sapiens
cccaagagcatcatgcctctga

SEQ ID NO: 2443407 - DNA, 20 bp, Homo sapiens
cccaagatgggcatcttttg

SEQ ID NO: 2443408 - DNA, 17 bp, Homo sapiens
cccaagcggtgtctctc

SEQ ID NO: 2443409 - DNA, 16 bp, Homo sapiens
cccaaggaggcagcct

SEQ ID NO: 2443410 - DNA, 16 bp, Homo sapiens
cccaagggaggctgct

SEQ ID NO: 2443411 - DNA, 18 bp, Homo sapiens
cccaagggaggctgctgc

SEQ ID NO: 2443412 - DNA, 22 bp, Homo sapiens
cccacaagcctctgcccaggca

SEQ ID NO: 2443413 - DNA, 12 bp, Homo sapiens
cccacaccctgg

SEQ ID NO: 2443414 - DNA, 20 bp, Homo sapiens
cccacaggaagcctgcagtc

SEQ ID NO: 2443415 - DNA, 23 bp, Homo sapiens
cccacaggaagcctgcagtcctg

SEQ ID NO: 2443416 - DNA, 20 bp, Homo sapiens
cccacaggacatttctctaa

SEQ ID NO: 2443417 - DNA, 21 bp, Homo sapiens
cccacagtgtcaggcactggg

SEQ ID NO: 2443418 - DNA, 16 bp, Homo sapiens
cccacatccctgggcc

SEQ ID NO: 2443419 - DNA, 20 bp, Homo sapiens
cccacatccctgggcctgct

SEQ ID NO: 2443420 - DNA, 14 bp, Homo sapiens
cccacattaaagaa

SEQ ID NO: 2443421 - DNA, 16 bp, Homo sapiens
cccaccaaccctcagg

SEQ ID NO: 2443422 - DNA, 13 bp, Homo sapiens
cccaccagggtcc

SEQ ID NO: 2443423 - DNA, 16 bp, Homo sapiens
cccacccacttctgca

SEQ ID NO: 2443424 - DNA, 21 bp, Homo sapiens
cccacccaggccaggcatgtg

SEQ ID NO: 2443425 - DNA, 19 bp, Homo sapiens
cccaccccaacctgctctc

SEQ ID NO: 2443426 - DNA, 22 bp, Homo sapiens
cccaccccaacctgctctcctc

SEQ ID NO: 2443427 - DNA, 15 bp, Homo sapiens
cccacccctgcacag

SEQ ID NO: 2443428 - DNA, 13 bp, Homo sapiens
cccaccctggcct

SEQ ID NO: 2443429 - DNA, 18 bp, Homo sapiens
cccaccctggtgggccaa

SEQ ID NO: 2443430 - DNA, 19 bp, Homo sapiens
cccaccctgttcctgctgc

SEQ ID NO: 2443431 - DNA, 18 bp, Homo sapiens
cccaccgggccactcctt

SEQ ID NO: 2443432 - DNA, 19 bp, Homo sapiens
cccaccgggccactccttc

SEQ ID NO: 2443433 - DNA, 22 bp, Homo sapiens
cccaccgggccactccttcctg

SEQ ID NO: 2443434 - DNA, 23 bp, Homo sapiens
cccaccgggccactccttcctgc

SEQ ID NO: 2443435 - DNA, 19 bp, Homo sapiens
cccaccgtgggcagggagc

SEQ ID NO: 2443436 - DNA, 18 bp, Homo sapiens
cccacctgacacaccagg

SEQ ID NO: 2443437 - DNA, 14 bp, Homo sapiens
cccacgccttatcc

SEQ ID NO: 2443438 - DNA, 16 bp, Homo sapiens
cccacgctcaccccct

SEQ ID NO: 2443439 - DNA, 15 bp, Homo sapiens
cccactagctcttgt

SEQ ID NO: 2443440 - DNA, 18 bp, Homo sapiens
cccactccatctggtaga

SEQ ID NO: 2443441 - DNA, 12 bp, Homo sapiens
cccactcccaca

SEQ ID NO: 2443442 - DNA, 17 bp, Homo sapiens
cccactctgctctgatg

SEQ ID NO: 2443443 - DNA, 18 bp, Homo sapiens
cccactctgctctgatgc

SEQ ID NO: 2443444 - DNA, 13 bp, Homo sapiens
cccactggagcag

SEQ ID NO: 2443445 - DNA, 15 bp, Homo sapiens
cccactgtcctgggc

SEQ ID NO: 2443446 - DNA, 16 bp, Homo sapiens
cccactgtcctgggcc

SEQ ID NO: 2443447 - DNA, 22 bp, Homo sapiens
cccactgtgcctcagagaccag

SEQ ID NO: 2443448 - DNA, 14 bp, Homo sapiens
cccacttctgcact

SEQ ID NO: 2443449 - DNA, 16 bp, Homo sapiens
cccacttctgcacttg

SEQ ID NO: 2443450 - DNA, 14 bp, Homo sapiens
cccacttgcctctt

SEQ ID NO: 2443451 - DNA, 18 bp, Homo sapiens
cccacttgtccttagcct

SEQ ID NO: 2443452 - DNA, 22 bp, Homo sapiens
cccagaataagttattgcagtt

SEQ ID NO: 2443453 - DNA, 16 bp, Homo sapiens
cccagacataaaggaa

SEQ ID NO: 2443454 - DNA, 16 bp, Homo sapiens
cccagactcagacatt

SEQ ID NO: 2443455 - DNA, 22 bp, Homo sapiens
cccagagacatacttgaagggc

SEQ ID NO: 2443456 - DNA, 23 bp, Homo sapiens
cccagagacatacttgaagggcc

SEQ ID NO: 2443457 - DNA, 19 bp, Homo sapiens
cccagaggggcctgccacc

SEQ ID NO: 2443458 - DNA, 21 bp, Homo sapiens
cccagaggggcctgccacctg

SEQ ID NO: 2443459 - DNA, 15 bp, Homo sapiens
cccagagggtctggg

SEQ ID NO: 2443460 - DNA, 22 bp, Homo sapiens
cccagagggtctgggggcacaa

SEQ ID NO: 2443461 - DNA, 17 bp, Homo sapiens
cccagcaaagcccccag

SEQ ID NO: 2443462 - DNA, 23 bp, Homo sapiens
cccagcaaagcccccagagccca

SEQ ID NO: 2443463 - DNA, 19 bp, Homo sapiens
cccagcacatgtgctgccc

SEQ ID NO: 2443464 - DNA, 15 bp, Homo sapiens
cccagcagctgccag

SEQ ID NO: 2443465 - DNA, 18 bp, Homo sapiens
cccagcattccagcccct

SEQ ID NO: 2443466 - DNA, 20 bp, Homo sapiens
cccagcattccagcccctct

SEQ ID NO: 2443467 - DNA, 14 bp, Homo sapiens
cccagccaggccca

SEQ ID NO: 2443468 - DNA, 13 bp, Homo sapiens
cccagcccacccc

SEQ ID NO: 2443469 - DNA, 18 bp, Homo sapiens
cccagcccagggctcctg

SEQ ID NO: 2443470 - DNA, 15 bp, Homo sapiens
cccagcccatggaga

SEQ ID NO: 2443471 - DNA, 15 bp, Homo sapiens
cccagccccagccag

SEQ ID NO: 2443472 - DNA, 19 bp, Homo sapiens
cccagccctcatcccgagc

SEQ ID NO: 2443473 - DNA, 17 bp, Homo sapiens
cccagcctccctgaagc

SEQ ID NO: 2443474 - DNA, 11 bp, Homo sapiens
cccagcctggg

SEQ ID NO: 2443475 - DNA, 15 bp, Homo sapiens
cccagcctgggccta

SEQ ID NO: 2443476 - DNA, 16 bp, Homo sapiens
cccagcctgggcctat

SEQ ID NO: 2443477 - DNA, 10 bp, Homo sapiens
cccagcctgt

SEQ ID NO: 2443478 - DNA, 19 bp, Homo sapiens
cccagcctgtcagatccag

SEQ ID NO: 2443479 - DNA, 15 bp, Homo sapiens
cccagcggacacacg

SEQ ID NO: 2443480 - DNA, 16 bp, Homo sapiens
cccagctaagaacctg

SEQ ID NO: 2443481 - DNA, 18 bp, Homo sapiens
cccagctaagaacctgga

SEQ ID NO: 2443482 - DNA, 20 bp, Homo sapiens
cccagctaagaacctggaac

SEQ ID NO: 2443483 - DNA, 22 bp, Homo sapiens
cccagctaagaacctggaactt

SEQ ID NO: 2443484 - DNA, 16 bp, Homo sapiens
cccagctcccacctcc

SEQ ID NO: 2443485 - DNA, 17 bp, Homo sapiens
cccagctgggtcaggca

SEQ ID NO: 2443486 - DNA, 22 bp, Homo sapiens
cccagctgtgcttatggtacca

SEQ ID NO: 2443487 - DNA, 19 bp, Homo sapiens
cccaggaaaggcaggattg

SEQ ID NO: 2443488 - DNA, 16 bp, Homo sapiens
cccaggaaaggcccag

SEQ ID NO: 2443489 - DNA, 15 bp, Homo sapiens
cccaggaccagaagc

SEQ ID NO: 2443490 - DNA, 12 bp, Homo sapiens
cccaggaccagc

SEQ ID NO: 2443491 - DNA, 11 bp, Homo sapiens
cccaggaccct

SEQ ID NO: 2443492 - DNA, 12 bp, Homo sapiens
cccaggaccctg

SEQ ID NO: 2443493 - DNA, 23 bp, Homo sapiens
cccaggaccctgaaggggccatg

SEQ ID NO: 2443494 - DNA, 13 bp, Homo sapiens
cccaggagctccc

SEQ ID NO: 2443495 - DNA, 18 bp, Homo sapiens
cccaggcaaggctgtgga

SEQ ID NO: 2443496 - DNA, 17 bp, Homo sapiens
cccaggcactgggctcc

SEQ ID NO: 2443497 - DNA, 21 bp, Homo sapiens
cccaggcattgccaagggctt

SEQ ID NO: 2443498 - DNA, 22 bp, Homo sapiens
cccaggccaggactctgcagcc

SEQ ID NO: 2443499 - DNA, 18 bp, Homo sapiens
cccaggcccactgtgcct

SEQ ID NO: 2443500 - DNA, 14 bp, Homo sapiens
cccaggccccatga

SEQ ID NO: 2443501 - DNA, 20 bp, Homo sapiens
cccaggccccatgacctcca

SEQ ID NO: 2443502 - DNA, 19 bp, Homo sapiens
ccccatctctccctcccct

SEQ ID NO: 2443503 - DNA, 15 bp, Homo sapiens
ccccatgacctccag

SEQ ID NO: 2443504 - DNA, 20 bp, Homo sapiens
ccccatggtgctaggaagag

SEQ ID NO: 2443505 - DNA, 23 bp, Homo sapiens
ccccattcctgggaaatattccc

SEQ ID NO: 2443506 - DNA, 18 bp, Homo sapiens
cccccaagggaggctgct

SEQ ID NO: 2443507 - DNA, 22 bp, Homo sapiens
cccccacttgcctcttccttga

SEQ ID NO: 2443508 - DNA, 12 bp, Homo sapiens
cccccagatatc

SEQ ID NO: 2443509 - DNA, 11 bp, Homo sapiens
cccccagcact

SEQ ID NO: 2443510 - DNA, 13 bp, Homo sapiens
cccccagcccagg

SEQ ID NO: 2443511 - DNA, 11 bp, Homo sapiens
cccccagcctg

SEQ ID NO: 2443512 - DNA, 15 bp, Homo sapiens
cccccagcctgggcc

SEQ ID NO: 2443513 - DNA, 13 bp, Homo sapiens
cccccagcctgtc

SEQ ID NO: 2443514 - DNA, 15 bp, Homo sapiens
cccccagctccggcc

SEQ ID NO: 2443515 - DNA, 18 bp, Homo sapiens
cccccatgcactgtgaag

SEQ ID NO: 2443516 - DNA, 14 bp, Homo sapiens
cccccggcagcagc

SEQ ID NO: 2443517 - DNA, 13 bp, Homo sapiens
ccccctcccccac

SEQ ID NO: 2443518 - DNA, 12 bp, Homo sapiens
ccccctccctcc

SEQ ID NO: 2443519 - DNA, 13 bp, Homo sapiens
ccccctccctgga

SEQ ID NO: 2443520 - DNA, 14 bp, Homo sapiens
ccccctccctggat

SEQ ID NO: 2443521 - DNA, 14 bp, Homo sapiens
ccccctctccctgc

SEQ ID NO: 2443522 - DNA, 18 bp, Homo sapiens
ccccctctccctgcatgg

SEQ ID NO: 2443523 - DNA, 12 bp, Homo sapiens
ccccctctgtcc

SEQ ID NO: 2443524 - DNA, 11 bp, Homo sapiens
ccccctgcagc

SEQ ID NO: 2443525 - DNA, 21 bp, Homo sapiens
ccccctgccccccagcctctg

SEQ ID NO: 2443526 - DNA, 22 bp, Homo sapiens
ccccctgccccccagcctctgg

SEQ ID NO: 2443527 - DNA, 14 bp, Homo sapiens
ccccctgctgccat

SEQ ID NO: 2443528 - DNA, 12 bp, Homo sapiens
ccccctgtacac

SEQ ID NO: 2443529 - DNA, 20 bp, Homo sapiens
ccccctgtacacaactcact

SEQ ID NO: 2443530 - DNA, 23 bp, Homo sapiens
ccccctgtctctcagggccaggc

SEQ ID NO: 2443531 - DNA, 21 bp, Homo sapiens
ccccctgtgcagccgctgagc

SEQ ID NO: 2443532 - DNA, 17 bp, Homo sapiens
ccccctttcacaggcag

SEQ ID NO: 2443533 - DNA, 12 bp, Homo sapiens
ccccctttcctg

SEQ ID NO: 2443534 - DNA, 18 bp, Homo sapiens
ccccggcagcagccccca

SEQ ID NO: 2443535 - DNA, 14 bp, Homo sapiens
cccctagagtccca

SEQ ID NO: 2443536 - DNA, 18 bp, Homo sapiens
cccctcaaatcgtccagc

SEQ ID NO: 2443537 - DNA, 16 bp, Homo sapiens
cccctcaccctgcctt

SEQ ID NO: 2443538 - DNA, 16 bp, Homo sapiens
cccctccaaaatgtgc

SEQ ID NO: 2443539 - DNA, 21 bp, Homo sapiens
cccctccaaaatgtgcctatt

SEQ ID NO: 2443540 - DNA, 19 bp, Homo sapiens
cccctccgccctgccactc

SEQ ID NO: 2443541 - DNA, 21 bp, Homo sapiens
cccctcctctagctgtggggg

SEQ ID NO: 2443542 - DNA, 12 bp, Homo sapiens
cccctccttctc

SEQ ID NO: 2443543 - DNA, 13 bp, Homo sapiens
cccctctcagccc

SEQ ID NO: 2443544 - DNA, 14 bp, Homo sapiens
cccctctcagccct

SEQ ID NO: 2443545 - DNA, 18 bp, Homo sapiens
cccctctccctgcatggc

SEQ ID NO: 2443546 - DNA, 12 bp, Homo sapiens
cccctctccctt

SEQ ID NO: 2443547 - DNA, 15 bp, Homo sapiens
cccctctcccttggg

SEQ ID NO: 2443548 - DNA, 15 bp, Homo sapiens
cccctctgacctgca

SEQ ID NO: 2443549 - DNA, 19 bp, Homo sapiens
cccctctggtcgctcctgc

SEQ ID NO: 2443550 - DNA, 12 bp, Homo sapiens
cccctctgtctt

SEQ ID NO: 2443551 - DNA, 18 bp, Homo sapiens
cccctgaccactcagaga

SEQ ID NO: 2443552 - DNA, 22 bp, Homo sapiens
cccctgcagcttgtagccagcc

SEQ ID NO: 2443553 - DNA, 14 bp, Homo sapiens
cccctgcaggaagg

SEQ ID NO: 2443554 - DNA, 15 bp, Homo sapiens
cccctgcaggaagga

SEQ ID NO: 2443555 - DNA, 18 bp, Homo sapiens
cccctgcaggaaggagct

SEQ ID NO: 2443556 - DNA, 20 bp, Homo sapiens
cccctgcaggaaggagctgc

SEQ ID NO: 2443557 - DNA, 21 bp, Homo sapiens
cccctgcattggaactggagg

SEQ ID NO: 2443558 - DNA, 14 bp, Homo sapiens
cccctgccagggca

SEQ ID NO: 2443559 - DNA, 11 bp, Homo sapiens
cccctgccccc

SEQ ID NO: 2443560 - DNA, 15 bp, Homo sapiens
cccctgccccctgca

SEQ ID NO: 2443561 - DNA, 19 bp, Homo sapiens
cccctggcctcccccactt

SEQ ID NO: 2443562 - DNA, 13 bp, Homo sapiens
cccctggggtggc

SEQ ID NO: 2443563 - DNA, 16 bp, Homo sapiens
cccctgtacacaactc

SEQ ID NO: 2443564 - DNA, 20 bp, Homo sapiens
cccctgtgcagccgctgagc

SEQ ID NO: 2443565 - DNA, 14 bp, Homo sapiens
cccctgttcatgcc

SEQ ID NO: 2443566 - DNA, 24 bp, Homo sapiens
ccccttagacagaggccctcaagt

SEQ ID NO: 2443567 - DNA, 14 bp, Homo sapiens
ccccttatcctccc

SEQ ID NO: 2443568 - DNA, 16 bp, Homo sapiens
ccccttcatcctctga

SEQ ID NO: 2443569 - DNA, 16 bp, Homo sapiens
ccccttccgccactgg

SEQ ID NO: 2443570 - DNA, 17 bp, Homo sapiens
ccccttccgccactggg

SEQ ID NO: 2443571 - DNA, 18 bp, Homo sapiens
ccccttctcccctgcact

SEQ ID NO: 2443572 - DNA, 20 bp, Homo sapiens
ccccttctgctcagctctgg

SEQ ID NO: 2443573 - DNA, 19 bp, Homo sapiens
ccccttgaggtctcagccc

SEQ ID NO: 2443574 - DNA, 11 bp, Homo sapiens
ccccttgcctg

SEQ ID NO: 2443575 - DNA, 18 bp, Homo sapiens
ccccttgggcccacacct

SEQ ID NO: 2443576 - DNA, 19 bp, Homo sapiens
ccccttgggcccacacctc

SEQ ID NO: 2443577 - DNA, 21 bp, Homo sapiens
cccgagaacatggcctaaggg

SEQ ID NO: 2443578 - DNA, 15 bp, Homo sapiens
cccgagcagctgagc

SEQ ID NO: 2443579 - DNA, 17 bp, Homo sapiens
cccgagctcctcttcca

SEQ ID NO: 2443580 - DNA, 14 bp, Homo sapiens
cccgattgtaactc

SEQ ID NO: 2443581 - DNA, 12 bp, Homo sapiens
cccgcacacctg

SEQ ID NO: 2443582 - DNA, 16 bp, Homo sapiens
cccgcagacaccttgg

SEQ ID NO: 2443583 - DNA, 17 bp, Homo sapiens
cccgcgatgtggaactg

SEQ ID NO: 2443584 - DNA, 23 bp, Homo sapiens
cccgcgatgtggaactgctgcca

SEQ ID NO: 2443585 - DNA, 21 bp, Homo sapiens
cccgctctacatcttctgcct

SEQ ID NO: 2443586 - DNA, 15 bp, Homo sapiens
cccggcaccccctgc

SEQ ID NO: 2443587 - DNA, 19 bp, Homo sapiens
cccggcacctcccttgggc

SEQ ID NO: 2443588 - DNA, 17 bp, Homo sapiens
cccggctaatttttgta

SEQ ID NO: 2443589 - DNA, 16 bp, Homo sapiens
cccggggccagcactt

SEQ ID NO: 2443590 - DNA, 23 bp, Homo sapiens
cccggggtgagggggggctccct

SEQ ID NO: 2443591 - DNA, 17 bp, Homo sapiens
cccgtctggcccaccag

SEQ ID NO: 2443592 - DNA, 15 bp, Homo sapiens
cccgtgccaagtcca

SEQ ID NO: 2443593 - DNA, 21 bp, Homo sapiens
cccgtgccaagtccaggtcct

SEQ ID NO: 2443594 - DNA, 13 bp, Homo sapiens
cccgtggaggctg

SEQ ID NO: 2443595 - DNA, 17 bp, Homo sapiens
cccgtggaggctgctcg

SEQ ID NO: 2443596 - DNA, 14 bp, Homo sapiens
ccctaagagagcac

SEQ ID NO: 2443597 - DNA, 20 bp, Homo sapiens
ccctaagcagaaagtgcctt

SEQ ID NO: 2443598 - DNA, 15 bp, Homo sapiens
ccctaatctatggtc

SEQ ID NO: 2443599 - DNA, 13 bp, Homo sapiens
ccctaccctctag

SEQ ID NO: 2443600 - DNA, 15 bp, Homo sapiens
ccctaccctctagag

SEQ ID NO: 2443601 - DNA, 14 bp, Homo sapiens
ccctagagtcccag

SEQ ID NO: 2443602 - DNA, 14 bp, Homo sapiens
ccctagccttgctt

SEQ ID NO: 2443603 - DNA, 19 bp, Homo sapiens
ccctagcgctatctccctg

SEQ ID NO: 2443604 - DNA, 15 bp, Homo sapiens
ccctaggtgttttgt

SEQ ID NO: 2443605 - DNA, 16 bp, Homo sapiens
ccctaggtgttttgtt

SEQ ID NO: 2443606 - DNA, 19 bp, Homo sapiens
ccctagttctacctcaggc

SEQ ID NO: 2443607 - DNA, 13 bp, Homo sapiens
cctaaagcctcaa

SEQ ID NO: 2443608 - DNA, 19 bp, Homo sapiens
cctaaagcctcaaaacaaa

SEQ ID NO: 2443609 - DNA, 18 bp, Homo sapiens
cctaacctcgggcctgct

SEQ ID NO: 2443610 - DNA, 12 bp, Homo sapiens
cctaagaggctg

SEQ ID NO: 2443611 - DNA, 14 bp, Homo sapiens
cctaagaggctgcc

SEQ ID NO: 2443612 - DNA, 20 bp, Homo sapiens
cctaagcagaaagtgccttt

SEQ ID NO: 2443613 - DNA, 21 bp, Homo sapiens
cctaataaagttctgtactca

SEQ ID NO: 2443614 - DNA, 14 bp, Homo sapiens
cctaatccaggcag

SEQ ID NO: 2443615 - DNA, 18 bp, Homo sapiens
cctaatccaggcagatcc

SEQ ID NO: 2443616 - DNA, 18 bp, Homo sapiens
cctacactcacctgcact

SEQ ID NO: 2443617 - DNA, 13 bp, Homo sapiens
cctacagaaaaac

SEQ ID NO: 2443618 - DNA, 19 bp, Homo sapiens
cctacagaaaaaccttggg

SEQ ID NO: 2443619 - DNA, 16 bp, Homo sapiens
cctacagggggtctgg

SEQ ID NO: 2443620 - DNA, 18 bp, Homo sapiens
cctacagggggtctggct

SEQ ID NO: 2443621 - DNA, 15 bp, Homo sapiens
cctacagttttaact

SEQ ID NO: 2443622 - DNA, 22 bp, Homo sapiens
cctacagttttaactgtggata

SEQ ID NO: 2443623 - DNA, 13 bp, Homo sapiens
cctaccctctaga

SEQ ID NO: 2443624 - DNA, 13 bp, Homo sapiens
cctactgcccagg

SEQ ID NO: 2443625 - DNA, 16 bp, Homo sapiens
cctactgcccaggcac

SEQ ID NO: 2443626 - DNA, 20 bp, Homo sapiens
cctactgcccaggcactgca

SEQ ID NO: 2443627 - DNA, 18 bp, Homo sapiens
cctagaaacaacactgta

SEQ ID NO: 2443628 - DNA, 20 bp, Homo sapiens
cctagaaacaacactgtagt

SEQ ID NO: 2443629 - DNA, 23 bp, Homo sapiens
cctagaccagcagacagagccag

SEQ ID NO: 2443630 - DNA, 19 bp, Homo sapiens
cctagactgtaaacctctc

SEQ ID NO: 2443631 - DNA, 12 bp, Homo sapiens
cctagagtccca

SEQ ID NO: 2443632 - DNA, 16 bp, Homo sapiens
cctagattcagggaaa

SEQ ID NO: 2443633 - DNA, 16 bp, Homo sapiens
cctagatttaatataa

SEQ ID NO: 2443634 - DNA, 12 bp, Homo sapiens
cctagcagcacc

SEQ ID NO: 2443635 - DNA, 22 bp, Homo sapiens
cctagcattgcacttggcctca

SEQ ID NO: 2443636 - DNA, 10 bp, Homo sapiens
cctagccttg

SEQ ID NO: 2443637 - DNA, 14 bp, Homo sapiens
cctagccttgcttg

SEQ ID NO: 2443638 - DNA, 17 bp, Homo sapiens
cctagcgggatggggct

SEQ ID NO: 2443639 - DNA, 19 bp, Homo sapiens
cctagctgaatgtttttct

SEQ ID NO: 2443640 - DNA, 21 bp, Homo sapiens
cctagctgaatgtttttctaa

SEQ ID NO: 2443641 - DNA, 18 bp, Homo sapiens
cctagctgtcctttttcc

SEQ ID NO: 2443642 - DNA, 22 bp, Homo sapiens
cctagctgtgtgaatacctgct

SEQ ID NO: 2443643 - DNA, 15 bp, Homo sapiens
cctaggaagcctcag

SEQ ID NO: 2443644 - DNA, 16 bp, Homo sapiens
cctaggcattctggac

SEQ ID NO: 2443645 - DNA, 23 bp, Homo sapiens
cctaggcctgggcagtggatggc

SEQ ID NO: 2443646 - DNA, 22 bp, Homo sapiens
cctagtgaaggcttctctctgt

SEQ ID NO: 2443647 - DNA, 17 bp, Homo sapiens
cctagttctagaaaaac

SEQ ID NO: 2443648 - DNA, 13 bp, Homo sapiens
cctagttcttcat

SEQ ID NO: 2443649 - DNA, 18 bp, Homo sapiens
cctatacctgtgtttctt

SEQ ID NO: 2443650 - DNA, 22 bp, Homo sapiens
cctatactgcttggagctgagc

SEQ ID NO: 2443651 - DNA, 20 bp, Homo sapiens
cctatcacccaacgctccaa

SEQ ID NO: 2443652 - DNA, 16 bp, Homo sapiens
cctatcacctatttcc

SEQ ID NO: 2443653 - DNA, 17 bp, Homo sapiens
cctatcacctatttcca

SEQ ID NO: 2443654 - DNA, 12 bp, Homo sapiens
cctatctgggct

SEQ ID NO: 2443655 - DNA, 16 bp, Homo sapiens
cctatgacttgggcac

SEQ ID NO: 2443656 - DNA, 11 bp, Homo sapiens
cctatgcatgg

SEQ ID NO: 2443657 - DNA, 18 bp, Homo sapiens
cctatgcatggtttcagc

SEQ ID NO: 2443658 - DNA, 15 bp, Homo sapiens
cctatggagagccct

SEQ ID NO: 2443659 - DNA, 16 bp, Homo sapiens
cctattgctagagctc

SEQ ID NO: 2443660 - DNA, 22 bp, Homo sapiens
cctattgctagagctcctccct

SEQ ID NO: 2443661 - DNA, 21 bp, Homo sapiens
cctcaaagcaagcattcagaa

SEQ ID NO: 2443662 - DNA, 21 bp, Homo sapiens
cctcaaataaaaagtgctttt

SEQ ID NO: 2443663 - DNA, 15 bp, Homo sapiens
cctcaaatcgtccag

SEQ ID NO: 2443664 - DNA, 14 bp, Homo sapiens
cctcaacccctccc

SEQ ID NO: 2443665 - DNA, 23 bp, Homo sapiens
cctcaacccctcccctccatccc

SEQ ID NO: 2443666 - DNA, 12 bp, Homo sapiens
cctcaacctccc

SEQ ID NO: 2443667 - DNA, 16 bp, Homo sapiens
cctcaagaaataaaag

SEQ ID NO: 2443668 - DNA, 23 bp, Homo sapiens
cctcaaggttttaggttctaaag

SEQ ID NO: 2443669 - DNA, 15 bp, Homo sapiens
cctcaagtctttctc

SEQ ID NO: 2443670 - DNA, 19 bp, Homo sapiens
cctcaagtctttctctttc

SEQ ID NO: 2443671 - DNA, 23 bp, Homo sapiens
cctcaatgccagtaacgcgtctt

SEQ ID NO: 2443672 - DNA, 13 bp, Homo sapiens
cctcacacaccct

SEQ ID NO: 2443673 - DNA, 22 bp, Homo sapiens
cctcaccctgccttatcttgca

SEQ ID NO: 2443674 - DNA, 15 bp, Homo sapiens
cctcacctgtagcag

SEQ ID NO: 2443675 - DNA, 15 bp, Homo sapiens
cctcaccttctgagt

SEQ ID NO: 2443676 - DNA, 16 bp, Homo sapiens
cctcaccttggcacca

SEQ ID NO: 2443677 - DNA, 15 bp, Homo sapiens
cctcagactctaaga

SEQ ID NO: 2443678 - DNA, 15 bp, Homo sapiens
cctcagactggggca

SEQ ID NO: 2443679 - DNA, 14 bp, Homo sapiens
cctcagagaccagg

SEQ ID NO: 2443680 - DNA, 17 bp, Homo sapiens
cctcagagaccagggct

SEQ ID NO: 2443681 - DNA, 15 bp, Homo sapiens
cctcagatggcagct

SEQ ID NO: 2443682 - DNA, 17 bp, Homo sapiens
cctcagatggcagcttt

SEQ ID NO: 2443683 - DNA, 21 bp, Homo sapiens
cctcagatggcagcttttaaa

SEQ ID NO: 2443684 - DNA, 12 bp, Homo sapiens
cctcagccagcc

SEQ ID NO: 2443685 - DNA, 14 bp, Homo sapiens
cctcagccagcctc

SEQ ID NO: 2443686 - DNA, 22 bp, Homo sapiens
cctcagcctcccaagtagctgg

SEQ ID NO: 2443687 - DNA, 12 bp, Homo sapiens
cctcagcctctc

SEQ ID NO: 2443688 - DNA, 12 bp, Homo sapiens
cctcagcctggc

SEQ ID NO: 2443689 - DNA, 13 bp, Homo sapiens
cctcagcctggcc

SEQ ID NO: 2443690 - DNA, 21 bp, Homo sapiens
cctcagccttgccagagatcc

SEQ ID NO: 2443691 - DNA, 13 bp, Homo sapiens
cctcaggactggg

SEQ ID NO: 2443692 - DNA, 19 bp, Homo sapiens
cctcaggaggcaggacctt

SEQ ID NO: 2443693 - DNA, 20 bp, Homo sapiens
cctcaggcacacagctactc

SEQ ID NO: 2443694 - DNA, 14 bp, Homo sapiens
cctcagggcaaagc

SEQ ID NO: 2443695 - DNA, 15 bp, Homo sapiens
cctcagggcaaagcc

SEQ ID NO: 2443696 - DNA, 17 bp, Homo sapiens
cctcagggcaaagccag

SEQ ID NO: 2443697 - DNA, 21 bp, Homo sapiens
cctcagggcaaagccaggtcc

SEQ ID NO: 2443698 - DNA, 15 bp, Homo sapiens
cctcagtagtccctg

SEQ ID NO: 2443699 - DNA, 14 bp, Homo sapiens
cctcatcccgagca

SEQ ID NO: 2443700 - DNA, 17 bp, Homo sapiens
cctcatgaatgtaaatt

SEQ ID NO: 2443701 - DNA, 20 bp, Homo sapiens
cctcatgaatgtaaatttgt

SEQ ID NO: 2443702 - DNA, 21 bp, Homo sapiens
cctcatgtacataccctggcc

SEQ ID NO: 2443703 - DNA, 18 bp, Homo sapiens
cctcatgtggctggaaga

SEQ ID NO: 2443704 - DNA, 23 bp, Homo sapiens
cctcattatttatgtccaggtgt

SEQ ID NO: 2443705 - DNA, 21 bp, Homo sapiens
cctccacgttctgctcatcat

SEQ ID NO: 2443706 - DNA, 12 bp, Homo sapiens
cctccagcccct

SEQ ID NO: 2443707 - DNA, 13 bp, Homo sapiens
cctccagcccctg

SEQ ID NO: 2443708 - DNA, 12 bp, Homo sapiens
cctccagctgtt

SEQ ID NO: 2443709 - DNA, 15 bp, Homo sapiens
cctccagggacagca

SEQ ID NO: 2443710 - DNA, 12 bp, Homo sapiens
cctccatccctg

SEQ ID NO: 2443711 - DNA, 17 bp, Homo sapiens
cctccatccctggcccc

SEQ ID NO: 2443712 - DNA, 12 bp, Homo sapiens
aaaaaaaataca

SEQ ID NO: 2443713 - DNA, 11 bp, Homo sapiens
aaaaaagatga

SEQ ID NO: 2443714 - DNA, 20 bp, Homo sapiens
aaaaaagttgcagctgtttt

SEQ ID NO: 2443715 - DNA, 12 bp, Homo sapiens
aaaaaatggttc

SEQ ID NO: 2443716 - DNA, 18 bp, Homo sapiens
aaaaacagatttggaaag

SEQ ID NO: 2443717 - DNA, 21 bp, Homo sapiens
aaaaacaggtatatactttga

SEQ ID NO: 2443718 - DNA, 17 bp, Homo sapiens
aaaaactaaaaactaga

SEQ ID NO: 2443719 - DNA, 20 bp, Homo sapiens
aaaaactttggaaccagact

SEQ ID NO: 2443720 - DNA, 14 bp, Homo sapiens
aaaaagaagtgctg

SEQ ID NO: 2443721 - DNA, 13 bp, Homo sapiens
aaaaagataaaca

SEQ ID NO: 2443722 - DNA, 11 bp, Homo sapiens
aaaaagatccc

SEQ ID NO: 2443723 - DNA, 17 bp, Homo sapiens
aaaaagccagtttgggt

SEQ ID NO: 2443724 - DNA, 23 bp, Homo sapiens
aaaaagccagtttgggtaaaata

SEQ ID NO: 2443725 - DNA, 17 bp, Homo sapiens
aaaaagctaataccagt

SEQ ID NO: 2443726 - DNA, 15 bp, Homo sapiens
aaaaagcttaaaact

SEQ ID NO: 2443727 - DNA, 13 bp, Homo sapiens
aaaaaggtttaca

SEQ ID NO: 2443728 - DNA, 14 bp, Homo sapiens
aaaaagtgaaataa

SEQ ID NO: 2443729 - DNA, 17 bp, Homo sapiens
aaaaagtgaaataatgt

SEQ ID NO: 2443730 - DNA, 22 bp, Homo sapiens
aaaaagtgggttttttagttga

SEQ ID NO: 2443731 - DNA, 22 bp, Homo sapiens
aaaaagttgcagctgttttgtt

SEQ ID NO: 2443732 - DNA, 18 bp, Homo sapiens
aaaaataaatatatctac

SEQ ID NO: 2443733 - DNA, 18 bp, Homo sapiens
aaaaataatcaaaagcta

SEQ ID NO: 2443734 - DNA, 17 bp, Homo sapiens
aaaaataatttttatat

SEQ ID NO: 2443735 - DNA, 16 bp, Homo sapiens
aaaaatgtattttatg

SEQ ID NO: 2443736 - DNA, 17 bp, Homo sapiens
aaaaatgtattttatgt

SEQ ID NO: 2443737 - DNA, 12 bp, Homo sapiens
aaaaattaaaat

SEQ ID NO: 2443738 - DNA, 20 bp, Homo sapiens
aaaaattcagcaaagtggtt

SEQ ID NO: 2443739 - DNA, 15 bp, Homo sapiens
aaaaattgctgactg

SEQ ID NO: 2443740 - DNA, 21 bp, Homo sapiens
aaaaattgctgactgtagctt

SEQ ID NO: 2443741 - DNA, 22 bp, Homo sapiens
aaaacaactatggatcagaata

SEQ ID NO: 2443742 - DNA, 13 bp, Homo sapiens
aaaacacacaggt

SEQ ID NO: 2443743 - DNA, 13 bp, Homo sapiens
aaaacactgtgca

SEQ ID NO: 2443744 - DNA, 22 bp, Homo sapiens
aaaacaggtagaattatctaat

SEQ ID NO: 2443745 - DNA, 19 bp, Homo sapiens
aaaacaggtatatactttg

SEQ ID NO: 2443746 - DNA, 19 bp, Homo sapiens
aaaacagtggatcacaaag

SEQ ID NO: 2443747 - DNA, 13 bp, Homo sapiens
aaaacatttattt

SEQ ID NO: 2443748 - DNA, 16 bp, Homo sapiens
aaaacatttattttga

SEQ ID NO: 2443749 - DNA, 19 bp, Homo sapiens
aaaacccttgggccagaag

SEQ ID NO: 2443750 - DNA, 15 bp, Homo sapiens
aaaacctgagattta

SEQ ID NO: 2443751 - DNA, 13 bp, Homo sapiens
aaaactaaaaact

SEQ ID NO: 2443752 - DNA, 22 bp, Homo sapiens
aaaactagaggtgagaaattta

SEQ ID NO: 2443753 - DNA, 16 bp, Homo sapiens
aaaactccaccttccc

SEQ ID NO: 2443754 - DNA, 18 bp, Homo sapiens
aaaactctacttaatcca

SEQ ID NO: 2443755 - DNA, 12 bp, Homo sapiens
aaaactctttga

SEQ ID NO: 2443756 - DNA, 11 bp, Homo sapiens
aaaactgctcc

SEQ ID NO: 2443757 - DNA, 19 bp, Homo sapiens
aaaactgtttttgaacctg

SEQ ID NO: 2443758 - DNA, 21 bp, Homo sapiens
aaaacttcagtttcacagaaa

SEQ ID NO: 2443759 - DNA, 16 bp, Homo sapiens
aaaactttcctcgcct

SEQ ID NO: 2443760 - DNA, 11 bp, Homo sapiens
aaaactttgga

SEQ ID NO: 2443761 - DNA, 17 bp, Homo sapiens
aaaactttggaaccaga

SEQ ID NO: 2443762 - DNA, 22 bp, Homo sapiens
aaaagaaaatctttataaatgt

SEQ ID NO: 2443763 - DNA, 11 bp, Homo sapiens
aaaagaaaatt

SEQ ID NO: 2443764 - DNA, 19 bp, Homo sapiens
aaatgaggccatggactct

SEQ ID NO: 2443765 - DNA, 12 bp, Homo sapiens
aaatgagtaaca

SEQ ID NO: 2443766 - DNA, 15 bp, Homo sapiens
aaatgattcttagtg

SEQ ID NO: 2443767 - DNA, 18 bp, Homo sapiens
aaatgccaaattaaaaaa

SEQ ID NO: 2443768 - DNA, 22 bp, Homo sapiens
aaatgccatgatgcctctgtct

SEQ ID NO: 2443769 - DNA, 16 bp, Homo sapiens
aaatgcggggtggggg

SEQ ID NO: 2443770 - DNA, 22 bp, Homo sapiens
aaatgcggttataaaaaatggt

SEQ ID NO: 2443771 - DNA, 16 bp, Homo sapiens
aaatgctaggttctac

SEQ ID NO: 2443772 - DNA, 19 bp, Homo sapiens
aaatgcttagaaattcagc

SEQ ID NO: 2443773 - DNA, 20 bp, Homo sapiens
aaatgctttttatttctgca

SEQ ID NO: 2443774 - DNA, 11 bp, Homo sapiens
aaatggcctca

SEQ ID NO: 2443775 - DNA, 18 bp, Homo sapiens
aaatggtactgtacagct

SEQ ID NO: 2443776 - DNA, 22 bp, Homo sapiens
aaatggtccaattagtttcctt

SEQ ID NO: 2443777 - DNA, 14 bp, Homo sapiens
aaatggttcagaat

SEQ ID NO: 2443778 - DNA, 15 bp, Homo sapiens
aaatggttcagaatt

SEQ ID NO: 2443779 - DNA, 21 bp, Homo sapiens
aaatgtaagattatagattct

SEQ ID NO: 2443780 - DNA, 17 bp, Homo sapiens
aaatgtaaggctgtgta

SEQ ID NO: 2443781 - DNA, 14 bp, Homo sapiens
aaatgtatatgcac

SEQ ID NO: 2443782 - DNA, 15 bp, Homo sapiens
aaatgtatatgcact

SEQ ID NO: 2443783 - DNA, 14 bp, Homo sapiens
aaatgtatgcatgt

SEQ ID NO: 2443784 - DNA, 16 bp, Homo sapiens
aaatgtattttatgtt

SEQ ID NO: 2443785 - DNA, 21 bp, Homo sapiens
aaatgtattttatgttatata

SEQ ID NO: 2443786 - DNA, 15 bp, Homo sapiens
aaatgtcactttttg

SEQ ID NO: 2443787 - DNA, 22 bp, Homo sapiens
aaatgtcactttttgaggcaaa

SEQ ID NO: 2443788 - DNA, 18 bp, Homo sapiens
aaatgtcatgctgcctta

SEQ ID NO: 2443789 - DNA, 15 bp, Homo sapiens
aaatgtccttgtgat

SEQ ID NO: 2443790 - DNA, 21 bp, Homo sapiens
aaatgtgatgaatactgtatt

SEQ ID NO: 2443791 - DNA, 20 bp, Homo sapiens
aaatgtgatgttctaaggct

SEQ ID NO: 2443792 - DNA, 14 bp, Homo sapiens
aaatgttaaaatgt

SEQ ID NO: 2443793 - DNA, 20 bp, Homo sapiens
aaatgttattttttaattat

SEQ ID NO: 2443794 - DNA, 21 bp, Homo sapiens
aaatgttattttttaattatt

SEQ ID NO: 2443795 - DNA, 13 bp, Homo sapiens
aaatgttcacttt

SEQ ID NO: 2443796 - DNA, 21 bp, Homo sapiens
aaatgtttttaataaaagaaa

SEQ ID NO: 2443797 - DNA, 14 bp, Homo sapiens
aaatgtttttggtc

SEQ ID NO: 2443798 - DNA, 16 bp, Homo sapiens
aaattaaaaaagataa

SEQ ID NO: 2443799 - DNA, 19 bp, Homo sapiens
aaattaaacttatttacaa

SEQ ID NO: 2443800 - DNA, 21 bp, Homo sapiens
aaattaactgggtaatgaaac

SEQ ID NO: 2443801 - DNA, 13 bp, Homo sapiens
aaattactgttta

SEQ ID NO: 2443802 - DNA, 23 bp, Homo sapiens
aaattactgtttattaaagtaca

SEQ ID NO: 2443803 - DNA, 20 bp, Homo sapiens
aaattagactgtgattcaga

SEQ ID NO: 2443804 - DNA, 14 bp, Homo sapiens
aaattcacaaactt

SEQ ID NO: 2443805 - DNA, 18 bp, Homo sapiens
aaattcacaaacttttat

SEQ ID NO: 2443806 - DNA, 21 bp, Homo sapiens
aaattcacatgatgcacttca

SEQ ID NO: 2443807 - DNA, 12 bp, Homo sapiens
aaattcagcaaa

SEQ ID NO: 2443808 - DNA, 13 bp, Homo sapiens
aaattcagtttca

SEQ ID NO: 2443809 - DNA, 19 bp, Homo sapiens
aaattcattttttaaattc

SEQ ID NO: 2443810 - DNA, 14 bp, Homo sapiens
aaattccaaagtct

SEQ ID NO: 2443811 - DNA, 17 bp, Homo sapiens
aaattcccgttttgtca

SEQ ID NO: 2443812 - DNA, 22 bp, Homo sapiens
aaattctgtgccttgttttttg

SEQ ID NO: 2443813 - DNA, 15 bp, Homo sapiens
aaattgaacctttgt

SEQ ID NO: 2443814 - DNA, 17 bp, Homo sapiens
aaattgaatactttgaa

SEQ ID NO: 2443815 - DNA, 13 bp, Homo sapiens
aaattgaatgcaa

SEQ ID NO: 2443816 - DNA, 15 bp, Homo sapiens
aaattgaatgcaaac

SEQ ID NO: 2443817 - DNA, 11 bp, Homo sapiens
aaattgatttt

SEQ ID NO: 2443818 - DNA, 18 bp, Homo sapiens
aaattgatttttctcttc

SEQ ID NO: 2443819 - DNA, 20 bp, Homo sapiens
aaattgatttttctcttcat

SEQ ID NO: 2443820 - DNA, 19 bp, Homo sapiens
aaattgctgactgtagctt

SEQ ID NO: 2443821 - DNA, 14 bp, Homo sapiens
aaatttaaactata

SEQ ID NO: 2443822 - DNA, 13 bp, Homo sapiens
aaatttaaagcag

SEQ ID NO: 2443823 - DNA, 18 bp, Homo sapiens
aaatttaaagcaggttct

SEQ ID NO: 2443824 - DNA, 22 bp, Homo sapiens
aaatttagcattgtagtgcttt

SEQ ID NO: 2443825 - DNA, 15 bp, Homo sapiens
aaatttgattgattt

SEQ ID NO: 2443826 - DNA, 17 bp, Homo sapiens
aaatttgcattaaatta

SEQ ID NO: 2443827 - DNA, 17 bp, Homo sapiens
aaatttgtactatttaa

SEQ ID NO: 2443828 - DNA, 14 bp, Homo sapiens
aaatttgttgcata

SEQ ID NO: 2443829 - DNA, 11 bp, Homo sapiens
aaattttttgt

SEQ ID NO: 2443830 - DNA, 14 bp, Homo sapiens
aaattttttgttga

SEQ ID NO: 2443831 - DNA, 18 bp, Homo sapiens
aaattttttgttgacatt

SEQ ID NO: 2443832 - DNA, 13 bp, Homo sapiens
aacaaaaattgtc

SEQ ID NO: 2443833 - DNA, 23 bp, Homo sapiens
aacaaagagttcaagaaataagt

SEQ ID NO: 2443834 - DNA, 21 bp, Homo sapiens
aacaaagatgccacattcaaa

SEQ ID NO: 2443835 - DNA, 23 bp, Homo sapiens
aacaaatgccaaattaaaaaaga

SEQ ID NO: 2443836 - DNA, 20 bp, Homo sapiens
aacaacatgtttccagcatt

SEQ ID NO: 2443837 - DNA, 14 bp, Homo sapiens
aacaacctgcccaa

SEQ ID NO: 2443838 - DNA, 12 bp, Homo sapiens
aacaagaaaaat

SEQ ID NO: 2443839 - DNA, 12 bp, Homo sapiens
aacaagtatttg

SEQ ID NO: 2443840 - DNA, 23 bp, Homo sapiens
aacaagtatttgttaatttagaa

SEQ ID NO: 2443841 - DNA, 18 bp, Homo sapiens
aacaatgaaaactctttg

SEQ ID NO: 2443842 - DNA, 22 bp, Homo sapiens
aacaatgaataaaaactcaagg

SEQ ID NO: 2443843 - DNA, 22 bp, Homo sapiens
aacaattctaaaatgattgtag

SEQ ID NO: 2443844 - DNA, 23 bp, Homo sapiens
aacaattgaagtaaactttttgt

SEQ ID NO: 2443845 - DNA, 18 bp, Homo sapiens
aacaattgtgtagccttt

SEQ ID NO: 2443846 - DNA, 23 bp, Homo sapiens
aacaattgtgtagcctttttgta

SEQ ID NO: 2443847 - DNA, 18 bp, Homo sapiens
aacaatttggcaattttg

SEQ ID NO: 2443848 - DNA, 13 bp, Homo sapiens
aacacaaactgta

SEQ ID NO: 2443849 - DNA, 15 bp, Homo sapiens
aacacaaactgtaaa

SEQ ID NO: 2443850 - DNA, 19 bp, Homo sapiens
aacacaaactgtaaataaa

SEQ ID NO: 2443851 - DNA, 20 bp, Homo sapiens
aacacaagattggtgttttt

SEQ ID NO: 2443852 - DNA, 23 bp, Homo sapiens
aacacaagattggtgtttttttc

SEQ ID NO: 2443853 - DNA, 17 bp, Homo sapiens
aacacactaccgaatgt

SEQ ID NO: 2443854 - DNA, 19 bp, Homo sapiens
aacaccaagcacagcagcc

SEQ ID NO: 2443855 - DNA, 18 bp, Homo sapiens
aacaccatgattccttta

SEQ ID NO: 2443856 - DNA, 15 bp, Homo sapiens
aacaccattgaaggc

SEQ ID NO: 2443857 - DNA, 17 bp, Homo sapiens
aacaccattgaaggctt

SEQ ID NO: 2443858 - DNA, 17 bp, Homo sapiens
aacacccatttttcctt

SEQ ID NO: 2443859 - DNA, 14 bp, Homo sapiens
aacacgcacctgcc

SEQ ID NO: 2443860 - DNA, 18 bp, Homo sapiens
aacactaactatgcatgg

SEQ ID NO: 2443861 - DNA, 13 bp, Homo sapiens
aacactaatatat

SEQ ID NO: 2443862 - DNA, 22 bp, Homo sapiens
aacactaatatatttaaaaata

SEQ ID NO: 2443863 - DNA, 15 bp, Homo sapiens
aacactaattcataa

SEQ ID NO: 2443864 - DNA, 18 bp, Homo sapiens
aacactagacaagccaga

SEQ ID NO: 2443865 - DNA, 19 bp, Homo sapiens
aacactagacaagccagaa

SEQ ID NO: 2443866 - DNA, 17 bp, Homo sapiens
aacactcagtggcccat

SEQ ID NO: 2443867 - DNA, 19 bp, Homo sapiens
aacactgtagtaaataatg

SEQ ID NO: 2443868 - DNA, 20 bp, Homo sapiens
aagccaggaatttcccagga

SEQ ID NO: 2443869 - DNA, 22 bp, Homo sapiens
aagccaggaatttcccaggacc

SEQ ID NO: 2443870 - DNA, 23 bp, Homo sapiens
aagccaggaatttcccaggaccc

SEQ ID NO: 2443871 - DNA, 13 bp, Homo sapiens
aagccatgctgga

SEQ ID NO: 2443872 - DNA, 23 bp, Homo sapiens
aagcccagcactgcttgaggaaa

SEQ ID NO: 2443873 - DNA, 22 bp, Homo sapiens
aagcccagtgcactgaaagtca

SEQ ID NO: 2443874 - DNA, 14 bp, Homo sapiens
aagcccatcctgac

SEQ ID NO: 2443875 - DNA, 16 bp, Homo sapiens
aagcccccagagccca

SEQ ID NO: 2443876 - DNA, 17 bp, Homo sapiens
aagcccccagagcccag

SEQ ID NO: 2443877 - DNA, 16 bp, Homo sapiens
aagcccccagctaaga

SEQ ID NO: 2443878 - DNA, 18 bp, Homo sapiens
aagcccggctcctggtca

SEQ ID NO: 2443879 - DNA, 15 bp, Homo sapiens
aagcctctgcccagg

SEQ ID NO: 2443880 - DNA, 16 bp, Homo sapiens
aagcctgagggaaagg

SEQ ID NO: 2443881 - DNA, 24 bp, Homo sapiens
aagcctgagggaaaggccagcact

SEQ ID NO: 2443882 - DNA, 15 bp, Homo sapiens
aagcctgggggcctg

SEQ ID NO: 2443883 - DNA, 18 bp, Homo sapiens
aagcctgggggcctggct

SEQ ID NO: 2443884 - DNA, 18 bp, Homo sapiens
aagccttaatttgcacag

SEQ ID NO: 2443885 - DNA, 19 bp, Homo sapiens
aagccttaatttgcacagt

SEQ ID NO: 2443886 - DNA, 16 bp, Homo sapiens
aagccttcaagctctg

SEQ ID NO: 2443887 - DNA, 12 bp, Homo sapiens
aagccttcccct

SEQ ID NO: 2443888 - DNA, 20 bp, Homo sapiens
aagccttccccttatcctcc

SEQ ID NO: 2443889 - DNA, 15 bp, Homo sapiens
aagcgaaaaaatcag

SEQ ID NO: 2443890 - DNA, 19 bp, Homo sapiens
aagcgattctcttgcctca

SEQ ID NO: 2443891 - DNA, 20 bp, Homo sapiens
aagctaacagggaaggcagg

SEQ ID NO: 2443892 - DNA, 22 bp, Homo sapiens
aagctactgtgtgtgtgaatga

SEQ ID NO: 2443893 - DNA, 23 bp, Homo sapiens
aagctactgtgtgtgtgaatgaa

SEQ ID NO: 2443894 - DNA, 21 bp, Homo sapiens
aagctaggtgctatttgtcat

SEQ ID NO: 2443895 - DNA, 19 bp, Homo sapiens
aagctagtcttttgctttt

SEQ ID NO: 2443896 - DNA, 16 bp, Homo sapiens
aagctatttgatgtaa

SEQ ID NO: 2443897 - DNA, 22 bp, Homo sapiens
aagctcaaaggtttggaaggag

SEQ ID NO: 2443898 - DNA, 17 bp, Homo sapiens
aagctcacgtcctgaga

SEQ ID NO: 2443899 - DNA, 18 bp, Homo sapiens
aagctcacgtcctgagaa

SEQ ID NO: 2443900 - DNA, 22 bp, Homo sapiens
aagctcagaggcgcactgtgac

SEQ ID NO: 2443901 - DNA, 15 bp, Homo sapiens
aagctcagctgcatt

SEQ ID NO: 2443902 - DNA, 15 bp, Homo sapiens
aagctcccagggcct

SEQ ID NO: 2443903 - DNA, 18 bp, Homo sapiens
aagctcctctccccagcc

SEQ ID NO: 2443904 - DNA, 19 bp, Homo sapiens
aagctcttggagctgtgag

SEQ ID NO: 2443905 - DNA, 14 bp, Homo sapiens
aagctgacttggct

SEQ ID NO: 2443906 - DNA, 17 bp, Homo sapiens
aagctgacttggctggt

SEQ ID NO: 2443907 - DNA, 19 bp, Homo sapiens
aagctgacttggctggtgt

SEQ ID NO: 2443908 - DNA, 13 bp, Homo sapiens
aagctgaggtgcc

SEQ ID NO: 2443909 - DNA, 18 bp, Homo sapiens
aagctgagtattaaaatg

SEQ ID NO: 2443910 - DNA, 19 bp, Homo sapiens
aagctgagtattaaaatgt

SEQ ID NO: 2443911 - DNA, 13 bp, Homo sapiens
aagctgagtttcc

SEQ ID NO: 2443912 - DNA, 14 bp, Homo sapiens
aagctgagtttcct

SEQ ID NO: 2443913 - DNA, 22 bp, Homo sapiens
aagctgagtttcctatgggaac

SEQ ID NO: 2443914 - DNA, 16 bp, Homo sapiens
aagcttccatgattct

SEQ ID NO: 2443915 - DNA, 23 bp, Homo sapiens
aagctttcatgtaaactgtgcac

SEQ ID NO: 2443916 - DNA, 12 bp, Homo sapiens
aagctttcctgc

SEQ ID NO: 2443917 - DNA, 21 bp, Homo sapiens
aagctttcctgccccaggcct

SEQ ID NO: 2443918 - DNA, 22 bp, Homo sapiens
aagctttcctgccccaggcctg

SEQ ID NO: 2443919 - DNA, 16 bp, Homo sapiens
aaggaaccaacaatct

SEQ ID NO: 2443920 - DNA, 18 bp, Homo sapiens
aaggaaggtggatggccc

SEQ ID NO: 2443921 - DNA, 18 bp, Homo sapiens
aaggacctgaaattccaa

SEQ ID NO: 2443922 - DNA, 15 bp, Homo sapiens
aaggactaatagaaa

SEQ ID NO: 2443923 - DNA, 22 bp, Homo sapiens
aaggactcctcctttttccatg

SEQ ID NO: 2443924 - DNA, 21 bp, Homo sapiens
aaggacttcctgtccagctcc

SEQ ID NO: 2443925 - DNA, 14 bp, Homo sapiens
aaggactttgtaca

SEQ ID NO: 2443926 - DNA, 20 bp, Homo sapiens
aaggagaggcaacatccaaa

SEQ ID NO: 2443927 - DNA, 19 bp, Homo sapiens
aaggagccccattcctggg

SEQ ID NO: 2443928 - DNA, 12 bp, Homo sapiens
aaggagcctgtg

SEQ ID NO: 2443929 - DNA, 22 bp, Homo sapiens
aaggagcctgtgaacccaggac

SEQ ID NO: 2443930 - DNA, 16 bp, Homo sapiens
aaggagctgcctggac

SEQ ID NO: 2443931 - DNA, 19 bp, Homo sapiens
aaggagtgtagcaactaca

SEQ ID NO: 2443932 - DNA, 17 bp, Homo sapiens
aaggagtttatgttcca

SEQ ID NO: 2443933 - DNA, 16 bp, Homo sapiens
aaggatccggaaagaa

SEQ ID NO: 2443934 - DNA, 20 bp, Homo sapiens
aaggattctgctggcctctg

SEQ ID NO: 2443935 - DNA, 22 bp, Homo sapiens
aaggattctgctggcctctgcg

SEQ ID NO: 2443936 - DNA, 21 bp, Homo sapiens
aaggcaaaaatagtttggata

SEQ ID NO: 2443937 - DNA, 19 bp, Homo sapiens
aaggcaaaattgcaaatct

SEQ ID NO: 2443938 - DNA, 20 bp, Homo sapiens
aaggcaaagcacgaaatgtt

SEQ ID NO: 2443939 - DNA, 18 bp, Homo sapiens
aaggcaagcacttgtggg

SEQ ID NO: 2443940 - DNA, 15 bp, Homo sapiens
aaggcactctagatt

SEQ ID NO: 2443941 - DNA, 16 bp, Homo sapiens
aaggcactctagattc

SEQ ID NO: 2443942 - DNA, 15 bp, Homo sapiens
aaggcagaggcctgg

SEQ ID NO: 2443943 - DNA, 23 bp, Homo sapiens
aaggcagccgtgggccccaccct

SEQ ID NO: 2443944 - DNA, 14 bp, Homo sapiens
aaggcaggcagggc

SEQ ID NO: 2443945 - DNA, 16 bp, Homo sapiens
aaggcaggcagggctc

SEQ ID NO: 2443946 - DNA, 17 bp, Homo sapiens
aaggcaggcagggctct

SEQ ID NO: 2443947 - DNA, 18 bp, Homo sapiens
aaggcaggcagggctctc

SEQ ID NO: 2443948 - DNA, 21 bp, Homo sapiens
aaggcaggcagggctctcctg

SEQ ID NO: 2443949 - DNA, 22 bp, Homo sapiens
aaggcaggcagggctctcctgg

SEQ ID NO: 2443950 - DNA, 23 bp, Homo sapiens
aaggcagttaccattaaaccatc

SEQ ID NO: 2443951 - DNA, 19 bp, Homo sapiens
aaggcagtttgcaaaaaat

SEQ ID NO: 2443952 - DNA, 15 bp, Homo sapiens
aaggcagttttctaa

SEQ ID NO: 2443953 - DNA, 17 bp, Homo sapiens
aaggcatctgacatgca

SEQ ID NO: 2443954 - DNA, 14 bp, Homo sapiens
aaggccataaaaca

SEQ ID NO: 2443955 - DNA, 18 bp, Homo sapiens
aaggcccgagcagctgag

SEQ ID NO: 2443956 - DNA, 19 bp, Homo sapiens
aaggcccgagcagctgagc

SEQ ID NO: 2443957 - DNA, 15 bp, Homo sapiens
aaggcctggggtgac

SEQ ID NO: 2443958 - DNA, 16 bp, Homo sapiens
aaggctctatgagtct

SEQ ID NO: 2443959 - DNA, 12 bp, Homo sapiens
aaggctctgaga

SEQ ID NO: 2443960 - DNA, 14 bp, Homo sapiens
aaggctctgagagt

SEQ ID NO: 2443961 - DNA, 17 bp, Homo sapiens
aaggctctgagagtcta

SEQ ID NO: 2443962 - DNA, 16 bp, Homo sapiens
aaggctgtgtaagatt

SEQ ID NO: 2443963 - DNA, 15 bp, Homo sapiens
aaggcttaaacccat

SEQ ID NO: 2443964 - DNA, 17 bp, Homo sapiens
aaggcttctctctgtgg

SEQ ID NO: 2443965 - DNA, 14 bp, Homo sapiens
aaggcttgggattt

SEQ ID NO: 2443966 - DNA, 16 bp, Homo sapiens
aagggaaaagtctctt

SEQ ID NO: 2443967 - DNA, 15 bp, Homo sapiens
aagggaacctgtgtc

SEQ ID NO: 2443968 - DNA, 11 bp, Homo sapiens
aagggagccaa

SEQ ID NO: 2443969 - DNA, 12 bp, Homo sapiens
aagggagccaag

SEQ ID NO: 2443970 - DNA, 19 bp, Homo sapiens
aagggagccaagggatgga

SEQ ID NO: 2443971 - DNA, 17 bp, Homo sapiens
aagggagggctctgagg

SEQ ID NO: 2443972 - DNA, 19 bp, Homo sapiens
aatgctttttatttctgca

SEQ ID NO: 2443973 - DNA, 21 bp, Homo sapiens
aatggaatgtgatgttcatgg

SEQ ID NO: 2443974 - DNA, 23 bp, Homo sapiens
aatggactggaaggggaagggac

SEQ ID NO: 2443975 - DNA, 13 bp, Homo sapiens
aatggatcacaag

SEQ ID NO: 2443976 - DNA, 13 bp, Homo sapiens
aatggatttttct

SEQ ID NO: 2443977 - DNA, 17 bp, Homo sapiens
aatggatttttctttaa

SEQ ID NO: 2443978 - DNA, 20 bp, Homo sapiens
aatggatttttctttaactg

SEQ ID NO: 2443979 - DNA, 13 bp, Homo sapiens
aatggcagcaggg

SEQ ID NO: 2443980 - DNA, 17 bp, Homo sapiens
aatggcagttatatttt

SEQ ID NO: 2443981 - DNA, 22 bp, Homo sapiens
aatggcctcatgtggctggaag

SEQ ID NO: 2443982 - DNA, 14 bp, Homo sapiens
aatggccttcatat

SEQ ID NO: 2443983 - DNA, 16 bp, Homo sapiens
aatggctatgttttta

SEQ ID NO: 2443984 - DNA, 16 bp, Homo sapiens
aatggctgataatttt

SEQ ID NO: 2443985 - DNA, 21 bp, Homo sapiens
aatggctgcacctttttgcat

SEQ ID NO: 2443986 - DNA, 16 bp, Homo sapiens
aatgggctcaaccaga

SEQ ID NO: 2443987 - DNA, 14 bp, Homo sapiens
aatggggccagatc

SEQ ID NO: 2443988 - DNA, 17 bp, Homo sapiens
aatggtaggcatttcct

SEQ ID NO: 2443989 - DNA, 20 bp, Homo sapiens
aatggtccaattagtttcct

SEQ ID NO: 2443990 - DNA, 19 bp, Homo sapiens
aatggtccaggagaaggcc

SEQ ID NO: 2443991 - DNA, 15 bp, Homo sapiens
aatggtgtagaacac

SEQ ID NO: 2443992 - DNA, 19 bp, Homo sapiens
aatggtgtagaacactaat

SEQ ID NO: 2443993 - DNA, 17 bp, Homo sapiens
aatgtaaatattttaaa

SEQ ID NO: 2443994 - DNA, 15 bp, Homo sapiens
aatgtaaggctgtgt

SEQ ID NO: 2443995 - DNA, 17 bp, Homo sapiens
aatgtaattatttatgt

SEQ ID NO: 2443996 - DNA, 15 bp, Homo sapiens
aatgtacattaatta

SEQ ID NO: 2443997 - DNA, 16 bp, Homo sapiens
aatgtagataagtgtt

SEQ ID NO: 2443998 - DNA, 13 bp, Homo sapiens
aatgtatgcatgt

SEQ ID NO: 2443999 - DNA, 13 bp, Homo sapiens
aatgtatgtctgg

SEQ ID NO: 2444000 - DNA, 13 bp, Homo sapiens
aatgtattttatg

SEQ ID NO: 2444001 - DNA, 15 bp, Homo sapiens
aatgtattttatgtt

SEQ ID NO: 2444002 - DNA, 19 bp, Homo sapiens
aatgtcactttttgaggca

SEQ ID NO: 2444003 - DNA, 15 bp, Homo sapiens
aatgtcatgctgcct

SEQ ID NO: 2444004 - DNA, 19 bp, Homo sapiens
aatgtcatgctgccttatt

SEQ ID NO: 2444005 - DNA, 14 bp, Homo sapiens
aatgtcattgaaaa

SEQ ID NO: 2444006 - DNA, 19 bp, Homo sapiens
aatgtcattgaaaaactaa

SEQ ID NO: 2444007 - DNA, 14 bp, Homo sapiens
aatgtcattttggt

SEQ ID NO: 2444008 - DNA, 17 bp, Homo sapiens
aatgtcttgagctctat

SEQ ID NO: 2444009 - DNA, 19 bp, Homo sapiens
aatgtcttgagctctatta

SEQ ID NO: 2444010 - DNA, 17 bp, Homo sapiens
aatgtctttaatgcaat

SEQ ID NO: 2444011 - DNA, 14 bp, Homo sapiens
aatgtgaagccttc

SEQ ID NO: 2444012 - DNA, 20 bp, Homo sapiens
aatgtgatgaatactgtatt

SEQ ID NO: 2444013 - DNA, 14 bp, Homo sapiens
aatgtgatgttcta

SEQ ID NO: 2444014 - DNA, 16 bp, Homo sapiens
aatgtgatgttctaag

SEQ ID NO: 2444015 - DNA, 19 bp, Homo sapiens
aatgtgatgttctaaggct

SEQ ID NO: 2444016 - DNA, 15 bp, Homo sapiens
aatgtgcaatagaag

SEQ ID NO: 2444017 - DNA, 12 bp, Homo sapiens
aatgtgcctatt

SEQ ID NO: 2444018 - DNA, 22 bp, Homo sapiens
aatgtggcaaggaaaaacaggt

SEQ ID NO: 2444019 - DNA, 14 bp, Homo sapiens
aatgtgggattatg

SEQ ID NO: 2444020 - DNA, 16 bp, Homo sapiens
aatgtgtagttcatgt

SEQ ID NO: 2444021 - DNA, 15 bp, Homo sapiens
aatgtgtataaacaa

SEQ ID NO: 2444022 - DNA, 11 bp, Homo sapiens
aatgtgtcttt

SEQ ID NO: 2444023 - DNA, 12 bp, Homo sapiens
aatgtgtcttta

SEQ ID NO: 2444024 - DNA, 16 bp, Homo sapiens
aatgtgtgtatatgga

SEQ ID NO: 2444025 - DNA, 17 bp, Homo sapiens
aatgttctaagtttcta

SEQ ID NO: 2444026 - DNA, 22 bp, Homo sapiens
aatgttctaagtttctaagatt

SEQ ID NO: 2444027 - DNA, 17 bp, Homo sapiens
aatgttctcagatttct

SEQ ID NO: 2444028 - DNA, 10 bp, Homo sapiens
aatgttcttt

SEQ ID NO: 2444029 - DNA, 14 bp, Homo sapiens
aatgttctttggaa

SEQ ID NO: 2444030 - DNA, 17 bp, Homo sapiens
aatgttctttggaaagt

SEQ ID NO: 2444031 - DNA, 20 bp, Homo sapiens
aatgttctttggaaagtaca

SEQ ID NO: 2444032 - DNA, 21 bp, Homo sapiens
aatgttctttggaaagtacac

SEQ ID NO: 2444033 - DNA, 22 bp, Homo sapiens
aatgttctttggaaagtacact

SEQ ID NO: 2444034 - DNA, 17 bp, Homo sapiens
aatgttgctgaaaaatg

SEQ ID NO: 2444035 - DNA, 20 bp, Homo sapiens
aatgttggacacctttaggt

SEQ ID NO: 2444036 - DNA, 21 bp, Homo sapiens
aatgttggacacctttaggtt

SEQ ID NO: 2444037 - DNA, 21 bp, Homo sapiens
aatgttgggactgctaaataa

SEQ ID NO: 2444038 - DNA, 22 bp, Homo sapiens
aatgttgggactgctaaataaa

SEQ ID NO: 2444039 - DNA, 15 bp, Homo sapiens
aatgttgttatttaa

SEQ ID NO: 2444040 - DNA, 23 bp, Homo sapiens
aatgtttcttctaggttctaaaa

SEQ ID NO: 2444041 - DNA, 15 bp, Homo sapiens
aatgtttttctaaag

SEQ ID NO: 2444042 - DNA, 23 bp, Homo sapiens
aatgttttttgccacagcttttg

SEQ ID NO: 2444043 - DNA, 17 bp, Homo sapiens
aattaaaaaagataaac

SEQ ID NO: 2444044 - DNA, 14 bp, Homo sapiens
aattaaacttttaa

SEQ ID NO: 2444045 - DNA, 21 bp, Homo sapiens
aattaactgggtaatgaaaca

SEQ ID NO: 2444046 - DNA, 22 bp, Homo sapiens
aattaactgggtaatgaaacaa

SEQ ID NO: 2444047 - DNA, 16 bp, Homo sapiens
aattaagaaggcaaaa

SEQ ID NO: 2444048 - DNA, 16 bp, Homo sapiens
aattaaggcataagaa

SEQ ID NO: 2444049 - DNA, 18 bp, Homo sapiens
aattacaaaaaaaaattt

SEQ ID NO: 2444050 - DNA, 14 bp, Homo sapiens
aattacctactctg

SEQ ID NO: 2444051 - DNA, 21 bp, Homo sapiens
aattaccttgagccagtaatt

SEQ ID NO: 2444052 - DNA, 14 bp, Homo sapiens
aattactcaggttt

SEQ ID NO: 2444053 - DNA, 22 bp, Homo sapiens
aattactttggggctaatttaa

SEQ ID NO: 2444054 - DNA, 17 bp, Homo sapiens
aattagacactttggaa

SEQ ID NO: 2444055 - DNA, 20 bp, Homo sapiens
aattaggcccccatcatcct

SEQ ID NO: 2444056 - DNA, 16 bp, Homo sapiens
aattaggctgtaacta

SEQ ID NO: 2444057 - DNA, 17 bp, Homo sapiens
aattaggctgtaactac

SEQ ID NO: 2444058 - DNA, 18 bp, Homo sapiens
aattaggctgtaactact

SEQ ID NO: 2444059 - DNA, 23 bp, Homo sapiens
aattaggctgtaactactttata

SEQ ID NO: 2444060 - DNA, 17 bp, Homo sapiens
aattagtgccacttaat

SEQ ID NO: 2444061 - DNA, 22 bp, Homo sapiens
aattatagtgatgtaatcttga

SEQ ID NO: 2444062 - DNA, 21 bp, Homo sapiens
aattatagtttctgaggcttt

SEQ ID NO: 2444063 - DNA, 17 bp, Homo sapiens
aattatgccttttttga

SEQ ID NO: 2444064 - DNA, 19 bp, Homo sapiens
aattatgccttttttgatc

SEQ ID NO: 2444065 - DNA, 12 bp, Homo sapiens
aattatgtaaat

SEQ ID NO: 2444066 - DNA, 22 bp, Homo sapiens
aattattaatgaaaataagaat

SEQ ID NO: 2444067 - DNA, 13 bp, Homo sapiens
aattattattctt

SEQ ID NO: 2444068 - DNA, 16 bp, Homo sapiens
aattattatttatata

SEQ ID NO: 2444069 - DNA, 21 bp, Homo sapiens
aattattatttatatatgtat

SEQ ID NO: 2444070 - DNA, 22 bp, Homo sapiens
aattattatttatatatgtatt

SEQ ID NO: 2444071 - DNA, 18 bp, Homo sapiens
aattattatttgtgtttt

SEQ ID NO: 2444072 - DNA, 11 bp, Homo sapiens
aattattttgt

SEQ ID NO: 2444073 - DNA, 16 bp, Homo sapiens
aattattttttttctt

SEQ ID NO: 2444074 - DNA, 23 bp, Homo sapiens
aattcaaggaatttcttaacttc

SEQ ID NO: 2444075 - DNA, 17 bp, Homo sapiens
aattcaatttggattta

SEQ ID NO: 2444076 - DNA, 22 bp, Homo sapiens
accaaatcaaaatctctccact

SEQ ID NO: 2444077 - DNA, 15 bp, Homo sapiens
accaaatctggaagc

SEQ ID NO: 2444078 - DNA, 20 bp, Homo sapiens
accaaatgtgctttgagaag

SEQ ID NO: 2444079 - DNA, 14 bp, Homo sapiens
accaacataaaaat

SEQ ID NO: 2444080 - DNA, 21 bp, Homo sapiens
accaacttttctattaaaagt

SEQ ID NO: 2444081 - DNA, 20 bp, Homo sapiens
accaagatacttaagtgctg

SEQ ID NO: 2444082 - DNA, 21 bp, Homo sapiens
accaagatacttaagtgctgc

SEQ ID NO: 2444083 - DNA, 19 bp, Homo sapiens
accaagattggcctgaggc

SEQ ID NO: 2444084 - DNA, 20 bp, Homo sapiens
accaagccaagggaacctgt

SEQ ID NO: 2444085 - DNA, 18 bp, Homo sapiens
accaagctgagtttccta

SEQ ID NO: 2444086 - DNA, 19 bp, Homo sapiens
accaagctgagtttcctat

SEQ ID NO: 2444087 - DNA, 14 bp, Homo sapiens
accaatgaaaaaat

SEQ ID NO: 2444088 - DNA, 17 bp, Homo sapiens
accaatgaaaaaatgta

SEQ ID NO: 2444089 - DNA, 14 bp, Homo sapiens
accaattattttca

SEQ ID NO: 2444090 - DNA, 16 bp, Homo sapiens
accaattattttcatc

SEQ ID NO: 2444091 - DNA, 14 bp, Homo sapiens
accacaaactgtaa

SEQ ID NO: 2444092 - DNA, 17 bp, Homo sapiens
accacaacatgaggcca

SEQ ID NO: 2444093 - DNA, 13 bp, Homo sapiens
accacaccctgta

SEQ ID NO: 2444094 - DNA, 17 bp, Homo sapiens
accacaccctgtactgt

SEQ ID NO: 2444095 - DNA, 16 bp, Homo sapiens
accacagcacagccaa

SEQ ID NO: 2444096 - DNA, 13 bp, Homo sapiens
accacattgcttt

SEQ ID NO: 2444097 - DNA, 19 bp, Homo sapiens
accaccaactactacctgt

SEQ ID NO: 2444098 - DNA, 17 bp, Homo sapiens
accaccagctgtgtcca

SEQ ID NO: 2444099 - DNA, 22 bp, Homo sapiens
accaccagggcatctctgggct

SEQ ID NO: 2444100 - DNA, 22 bp, Homo sapiens
accaccccgcctgccctcatgg

SEQ ID NO: 2444101 - DNA, 13 bp, Homo sapiens
accaccctgagcc

SEQ ID NO: 2444102 - DNA, 14 bp, Homo sapiens
accaccctgagccg

SEQ ID NO: 2444103 - DNA, 17 bp, Homo sapiens
accacctctccagaggc

SEQ ID NO: 2444104 - DNA, 14 bp, Homo sapiens
accacctttactgt

SEQ ID NO: 2444105 - DNA, 18 bp, Homo sapiens
accacgcccgtcctgcct

SEQ ID NO: 2444106 - DNA, 19 bp, Homo sapiens
accacgcccgtcctgcctg

SEQ ID NO: 2444107 - DNA, 20 bp, Homo sapiens
accacgcccgtcctgcctgt

SEQ ID NO: 2444108 - DNA, 22 bp, Homo sapiens
accacgcctcttgaccaggctg

SEQ ID NO: 2444109 - DNA, 12 bp, Homo sapiens
accactctggca

SEQ ID NO: 2444110 - DNA, 20 bp, Homo sapiens
accactctggcagccacact

SEQ ID NO: 2444111 - DNA, 15 bp, Homo sapiens
accactgaaaaaata

SEQ ID NO: 2444112 - DNA, 16 bp, Homo sapiens
accactggtctgtagg

SEQ ID NO: 2444113 - DNA, 15 bp, Homo sapiens
accactttcttattt

SEQ ID NO: 2444114 - DNA, 17 bp, Homo sapiens
accagaaaagcccaagt

SEQ ID NO: 2444115 - DNA, 21 bp, Homo sapiens
accagaaccaattattttcat

SEQ ID NO: 2444116 - DNA, 14 bp, Homo sapiens
accagacacccagg

SEQ ID NO: 2444117 - DNA, 14 bp, Homo sapiens
accagataactttt

SEQ ID NO: 2444118 - DNA, 11 bp, Homo sapiens
accagatgctg

SEQ ID NO: 2444119 - DNA, 14 bp, Homo sapiens
accagatgctgaaa

SEQ ID NO: 2444120 - DNA, 21 bp, Homo sapiens
accagccattggctatttaaa

SEQ ID NO: 2444121 - DNA, 13 bp, Homo sapiens
accagcctggccc

SEQ ID NO: 2444122 - DNA, 15 bp, Homo sapiens
accagctcaggacag

SEQ ID NO: 2444123 - DNA, 22 bp, Homo sapiens
accagctgctccgaggacccag

SEQ ID NO: 2444124 - DNA, 16 bp, Homo sapiens
accagcttagatttta

SEQ ID NO: 2444125 - DNA, 20 bp, Homo sapiens
accagcttccttcagagagc

SEQ ID NO: 2444126 - DNA, 12 bp, Homo sapiens
accaggaagccg

SEQ ID NO: 2444127 - DNA, 14 bp, Homo sapiens
accaggatagagac

SEQ ID NO: 2444128 - DNA, 19 bp, Homo sapiens
accaggatagagactggaa

SEQ ID NO: 2444129 - DNA, 17 bp, Homo sapiens
accaggcaccaaaagaa

SEQ ID NO: 2444130 - DNA, 19 bp, Homo sapiens
accaggcaccaaaagaagt

SEQ ID NO: 2444131 - DNA, 17 bp, Homo sapiens
accaggcagcctctggg

SEQ ID NO: 2444132 - DNA, 20 bp, Homo sapiens
accaggcagcctctgggggg

SEQ ID NO: 2444133 - DNA, 17 bp, Homo sapiens
accaggctgcctccctt

SEQ ID NO: 2444134 - DNA, 20 bp, Homo sapiens
accagggcatctctgggctg

SEQ ID NO: 2444135 - DNA, 21 bp, Homo sapiens
accagggcatctctgggctgg

SEQ ID NO: 2444136 - DNA, 16 bp, Homo sapiens
accagggccagcctct

SEQ ID NO: 2444137 - DNA, 17 bp, Homo sapiens
accagggccagcctcta

SEQ ID NO: 2444138 - DNA, 16 bp, Homo sapiens
accagggctccagccc

SEQ ID NO: 2444139 - DNA, 16 bp, Homo sapiens
accaggggtttctcgc

SEQ ID NO: 2444140 - DNA, 17 bp, Homo sapiens
accaggggtttctcgca

SEQ ID NO: 2444141 - DNA, 20 bp, Homo sapiens
accagggttgaccccagagg

SEQ ID NO: 2444142 - DNA, 20 bp, Homo sapiens
accagtatcgctcatagatc

SEQ ID NO: 2444143 - DNA, 18 bp, Homo sapiens
accagtatttagaagcca

SEQ ID NO: 2444144 - DNA, 15 bp, Homo sapiens
accagtccccccacc

SEQ ID NO: 2444145 - DNA, 22 bp, Homo sapiens
accagtgttagggaagggcctg

SEQ ID NO: 2444146 - DNA, 14 bp, Homo sapiens
accagttaattttt

SEQ ID NO: 2444147 - DNA, 13 bp, Homo sapiens
accagttgccttt

SEQ ID NO: 2444148 - DNA, 18 bp, Homo sapiens
accagtttgtccatcttg

SEQ ID NO: 2444149 - DNA, 13 bp, Homo sapiens
accataatgttac

SEQ ID NO: 2444150 - DNA, 22 bp, Homo sapiens
accatagcacaggctaattttt

SEQ ID NO: 2444151 - DNA, 17 bp, Homo sapiens
accatcaagttgtgcca

SEQ ID NO: 2444152 - DNA, 13 bp, Homo sapiens
accatcactgagt

SEQ ID NO: 2444153 - DNA, 15 bp, Homo sapiens
accatccaccaggcc

SEQ ID NO: 2444154 - DNA, 13 bp, Homo sapiens
accatctccctgg

SEQ ID NO: 2444155 - DNA, 17 bp, Homo sapiens
accatctccctggtgct

SEQ ID NO: 2444156 - DNA, 14 bp, Homo sapiens
accatgattccttt

SEQ ID NO: 2444157 - DNA, 18 bp, Homo sapiens
accatgattcctttaaca

SEQ ID NO: 2444158 - DNA, 20 bp, Homo sapiens
accatgcccggctaattttt

SEQ ID NO: 2444159 - DNA, 19 bp, Homo sapiens
accatgctcatctgctggt

SEQ ID NO: 2444160 - DNA, 16 bp, Homo sapiens
accatggagtggcagc

SEQ ID NO: 2444161 - DNA, 21 bp, Homo sapiens
accatggagtggcagcccagc

SEQ ID NO: 2444162 - DNA, 23 bp, Homo sapiens
accatggagtggcagcccagcca

SEQ ID NO: 2444163 - DNA, 15 bp, Homo sapiens
accatggccagccaa

SEQ ID NO: 2444164 - DNA, 17 bp, Homo sapiens
accatgtacatgaagaa

SEQ ID NO: 2444165 - DNA, 22 bp, Homo sapiens
accatgtcaagggttcaagatt

SEQ ID NO: 2444166 - DNA, 12 bp, Homo sapiens
accatgtcattt

SEQ ID NO: 2444167 - DNA, 18 bp, Homo sapiens
accatgtcatttcagaag

SEQ ID NO: 2444168 - DNA, 16 bp, Homo sapiens
accattataatgaatt

SEQ ID NO: 2444169 - DNA, 17 bp, Homo sapiens
accattataatgaattt

SEQ ID NO: 2444170 - DNA, 13 bp, Homo sapiens
accattctgactc

SEQ ID NO: 2444171 - DNA, 21 bp, Homo sapiens
accattctgactcggtttctc

SEQ ID NO: 2444172 - DNA, 24 bp, Homo sapiens
accattctgactcggtttctccaa

SEQ ID NO: 2444173 - DNA, 16 bp, Homo sapiens
accattgaaggcttaa

SEQ ID NO: 2444174 - DNA, 19 bp, Homo sapiens
accatttcctcagactcta

SEQ ID NO: 2444175 - DNA, 19 bp, Homo sapiens
accatttggcatccctggg

SEQ ID NO: 2444176 - DNA, 15 bp, Homo sapiens
accattttaaagtta

SEQ ID NO: 2444177 - DNA, 13 bp, Homo sapiens
accattttctggt

SEQ ID NO: 2444178 - DNA, 13 bp, Homo sapiens
acccaacgctcca

SEQ ID NO: 2444179 - DNA, 23 bp, Homo sapiens
acccaaggggatttttatgtctg

SEQ ID NO: 2444180 - DNA, 22 bp, Homo sapiens
actattaggtgcaatttcaagg

SEQ ID NO: 2444181 - DNA, 19 bp, Homo sapiens
actattcttgatgtaaaat

SEQ ID NO: 2444182 - DNA, 20 bp, Homo sapiens
actattcttgatgtaaaatc

SEQ ID NO: 2444183 - DNA, 11 bp, Homo sapiens
actatttaaag

SEQ ID NO: 2444184 - DNA, 12 bp, Homo sapiens
actatttaactg

SEQ ID NO: 2444185 - DNA, 14 bp, Homo sapiens
actatttaactgac

SEQ ID NO: 2444186 - DNA, 22 bp, Homo sapiens
actattttcagatgtgaaccat

SEQ ID NO: 2444187 - DNA, 22 bp, Homo sapiens
actcaaagcatgggattattag

SEQ ID NO: 2444188 - DNA, 17 bp, Homo sapiens
actcaaagggtggaata

SEQ ID NO: 2444189 - DNA, 20 bp, Homo sapiens
actcaaatggggccagatcc

SEQ ID NO: 2444190 - DNA, 20 bp, Homo sapiens
actcaaatgtgagtgttttt

SEQ ID NO: 2444191 - DNA, 16 bp, Homo sapiens
actcaaatgttctaag

SEQ ID NO: 2444192 - DNA, 14 bp, Homo sapiens
actcacacaggcat

SEQ ID NO: 2444193 - DNA, 20 bp, Homo sapiens
actcacacaggcatttcctg

SEQ ID NO: 2444194 - DNA, 23 bp, Homo sapiens
actcacacaggcatttcctgggt

SEQ ID NO: 2444195 - DNA, 15 bp, Homo sapiens
actcactaggccccc

SEQ ID NO: 2444196 - DNA, 17 bp, Homo sapiens
actcacttttcccactc

SEQ ID NO: 2444197 - DNA, 18 bp, Homo sapiens
actcacttttcccactcc

SEQ ID NO: 2444198 - DNA, 13 bp, Homo sapiens
actcagaagcctg

SEQ ID NO: 2444199 - DNA, 22 bp, Homo sapiens
actcagaagcctgggggcctgg

SEQ ID NO: 2444200 - DNA, 23 bp, Homo sapiens
actcagaagcctgggggcctggc

SEQ ID NO: 2444201 - DNA, 18 bp, Homo sapiens
actcagacattggcacct

SEQ ID NO: 2444202 - DNA, 20 bp, Homo sapiens
actcagagacatgcagagat

SEQ ID NO: 2444203 - DNA, 12 bp, Homo sapiens
actcagatccag

SEQ ID NO: 2444204 - DNA, 16 bp, Homo sapiens
actcagatccagggac

SEQ ID NO: 2444205 - DNA, 19 bp, Homo sapiens
actcagatccagggacaga

SEQ ID NO: 2444206 - DNA, 16 bp, Homo sapiens
actcagatcctcctca

SEQ ID NO: 2444207 - DNA, 15 bp, Homo sapiens
actcagcacaaggcc

SEQ ID NO: 2444208 - DNA, 17 bp, Homo sapiens
actcagccaccctgagt

SEQ ID NO: 2444209 - DNA, 23 bp, Homo sapiens
actcagccttcagacagagagga

SEQ ID NO: 2444210 - DNA, 16 bp, Homo sapiens
actcaggagcctgtga

SEQ ID NO: 2444211 - DNA, 20 bp, Homo sapiens
actcagggcagcgccaggct

SEQ ID NO: 2444212 - DNA, 22 bp, Homo sapiens
actcagggcagcgccaggctga

SEQ ID NO: 2444213 - DNA, 23 bp, Homo sapiens
actcaggtttgagaaaaaggaaa

SEQ ID NO: 2444214 - DNA, 17 bp, Homo sapiens
actcatataattatatg

SEQ ID NO: 2444215 - DNA, 23 bp, Homo sapiens
actcatataattatatgttgtaa

SEQ ID NO: 2444216 - DNA, 19 bp, Homo sapiens
actccaaacagacccctgt

SEQ ID NO: 2444217 - DNA, 22 bp, Homo sapiens
actccaaacagacccctgttca

SEQ ID NO: 2444218 - DNA, 17 bp, Homo sapiens
actccaagcccagccca

SEQ ID NO: 2444219 - DNA, 18 bp, Homo sapiens
actccaagcccagcccat

SEQ ID NO: 2444220 - DNA, 12 bp, Homo sapiens
actccacactgc

SEQ ID NO: 2444221 - DNA, 14 bp, Homo sapiens
actccacactgcac

SEQ ID NO: 2444222 - DNA, 16 bp, Homo sapiens
actccacactgcacaa

SEQ ID NO: 2444223 - DNA, 17 bp, Homo sapiens
actccacactgcacaat

SEQ ID NO: 2444224 - DNA, 13 bp, Homo sapiens
actccaccttccc

SEQ ID NO: 2444225 - DNA, 14 bp, Homo sapiens
actccaggcccaag

SEQ ID NO: 2444226 - DNA, 17 bp, Homo sapiens
actccaggcccaaggct

SEQ ID NO: 2444227 - DNA, 21 bp, Homo sapiens
actccaggcccaaggctcccg

SEQ ID NO: 2444228 - DNA, 20 bp, Homo sapiens
actccagttaaaaaaaattt

SEQ ID NO: 2444229 - DNA, 14 bp, Homo sapiens
actcccacctgaca

SEQ ID NO: 2444230 - DNA, 13 bp, Homo sapiens
actcccattcctg

SEQ ID NO: 2444231 - DNA, 16 bp, Homo sapiens
actccccgaagtcttt

SEQ ID NO: 2444232 - DNA, 13 bp, Homo sapiens
actccctctcagg

SEQ ID NO: 2444233 - DNA, 16 bp, Homo sapiens
actcctatgatctgag

SEQ ID NO: 2444234 - DNA, 21 bp, Homo sapiens
actcctcccagggttttaact

SEQ ID NO: 2444235 - DNA, 21 bp, Homo sapiens
actcctctgctgacctgctga

SEQ ID NO: 2444236 - DNA, 15 bp, Homo sapiens
actcctgacctcagg

SEQ ID NO: 2444237 - DNA, 16 bp, Homo sapiens
actcctgacctcaggc

SEQ ID NO: 2444238 - DNA, 19 bp, Homo sapiens
actcctgtgggagcctcgc

SEQ ID NO: 2444239 - DNA, 20 bp, Homo sapiens
actcctgtgggagcctcgca

SEQ ID NO: 2444240 - DNA, 12 bp, Homo sapiens
actccttccagc

SEQ ID NO: 2444241 - DNA, 14 bp, Homo sapiens
actcgctagcagtg

SEQ ID NO: 2444242 - DNA, 22 bp, Homo sapiens
actcggcctcccaaagtgctgg

SEQ ID NO: 2444243 - DNA, 16 bp, Homo sapiens
actcggtttctccaaa

SEQ ID NO: 2444244 - DNA, 13 bp, Homo sapiens
actctaagaaaga

SEQ ID NO: 2444245 - DNA, 20 bp, Homo sapiens
actctaagatcttagattct

SEQ ID NO: 2444246 - DNA, 19 bp, Homo sapiens
actctagagtccaaggttt

SEQ ID NO: 2444247 - DNA, 13 bp, Homo sapiens
actctagattcca

SEQ ID NO: 2444248 - DNA, 13 bp, Homo sapiens
actctagtcaatg

SEQ ID NO: 2444249 - DNA, 15 bp, Homo sapiens
actctagtcaatgac

SEQ ID NO: 2444250 - DNA, 19 bp, Homo sapiens
actctagtcaatgacatga

SEQ ID NO: 2444251 - DNA, 23 bp, Homo sapiens
actctagtcaatgacatgaattt

SEQ ID NO: 2444252 - DNA, 16 bp, Homo sapiens
actctcagtctctgag

SEQ ID NO: 2444253 - DNA, 22 bp, Homo sapiens
actctccccacgagggctggct

SEQ ID NO: 2444254 - DNA, 20 bp, Homo sapiens
actctcttattgcctcactt

SEQ ID NO: 2444255 - DNA, 12 bp, Homo sapiens
actctgcagcct

SEQ ID NO: 2444256 - DNA, 13 bp, Homo sapiens
actctgcagcctc

SEQ ID NO: 2444257 - DNA, 14 bp, Homo sapiens
actctgcagcctca

SEQ ID NO: 2444258 - DNA, 14 bp, Homo sapiens
actctgctgtttga

SEQ ID NO: 2444259 - DNA, 21 bp, Homo sapiens
actctgcttctctgacttctg

SEQ ID NO: 2444260 - DNA, 13 bp, Homo sapiens
actctggcagcca

SEQ ID NO: 2444261 - DNA, 17 bp, Homo sapiens
actctggtgcctccaga

SEQ ID NO: 2444262 - DNA, 17 bp, Homo sapiens
actctggtgttctattg

SEQ ID NO: 2444263 - DNA, 12 bp, Homo sapiens
actctgtaattg

SEQ ID NO: 2444264 - DNA, 15 bp, Homo sapiens
actctgtaattgcaa

SEQ ID NO: 2444265 - DNA, 12 bp, Homo sapiens
actctgtcctga

SEQ ID NO: 2444266 - DNA, 22 bp, Homo sapiens
actctgtcctgaaggcctgagg

SEQ ID NO: 2444267 - DNA, 23 bp, Homo sapiens
actctgtcctgaaggcctgaggt

SEQ ID NO: 2444268 - DNA, 15 bp, Homo sapiens
actctgtcttgtgtt

SEQ ID NO: 2444269 - DNA, 11 bp, Homo sapiens
actctgtgcca

SEQ ID NO: 2444270 - DNA, 19 bp, Homo sapiens
actctgtgccagagcctgg

SEQ ID NO: 2444271 - DNA, 17 bp, Homo sapiens
actctgtgctggccagc

SEQ ID NO: 2444272 - DNA, 20 bp, Homo sapiens
actctgttgcaagtgcaata

SEQ ID NO: 2444273 - DNA, 15 bp, Homo sapiens
actcttcactcttca

SEQ ID NO: 2444274 - DNA, 16 bp, Homo sapiens
actcttcactcttcaa

SEQ ID NO: 2444275 - DNA, 14 bp, Homo sapiens
actcttccctctct

SEQ ID NO: 2444276 - DNA, 18 bp, Homo sapiens
actcttgcctgtttccca

SEQ ID NO: 2444277 - DNA, 18 bp, Homo sapiens
actctttatgcttgcaaa

SEQ ID NO: 2444278 - DNA, 11 bp, Homo sapiens
actctttcaaa

SEQ ID NO: 2444279 - DNA, 13 bp, Homo sapiens
actctttcaaaac

SEQ ID NO: 2444280 - DNA, 21 bp, Homo sapiens
actctttctgtatatactttt

SEQ ID NO: 2444281 - DNA, 13 bp, Homo sapiens
actctttgagaaa

SEQ ID NO: 2444282 - DNA, 14 bp, Homo sapiens
actctttggtcgtt

SEQ ID NO: 2444283 - DNA, 19 bp, Homo sapiens
actctttggtcgttttttt

SEQ ID NO: 2444284 - DNA, 17 bp, Homo sapiens
agaagcctgatgctgac

SEQ ID NO: 2444285 - DNA, 11 bp, Homo sapiens
agaagcctgca

SEQ ID NO: 2444286 - DNA, 19 bp, Homo sapiens
agaagccttcaagctctga

SEQ ID NO: 2444287 - DNA, 23 bp, Homo sapiens
agaagccttcaagctctgaggga

SEQ ID NO: 2444288 - DNA, 15 bp, Homo sapiens
agaagggagggcaga

SEQ ID NO: 2444289 - DNA, 19 bp, Homo sapiens
agaagggagggcagagctg

SEQ ID NO: 2444290 - DNA, 16 bp, Homo sapiens
agaagtaccagactag

SEQ ID NO: 2444291 - DNA, 18 bp, Homo sapiens
agaagtcacagggcagta

SEQ ID NO: 2444292 - DNA, 19 bp, Homo sapiens
agaagtcacagggcagtac

SEQ ID NO: 2444293 - DNA, 21 bp, Homo sapiens
agaagtgtgccttctctctcc

SEQ ID NO: 2444294 - DNA, 15 bp, Homo sapiens
agaagttagtttgta

SEQ ID NO: 2444295 - DNA, 16 bp, Homo sapiens
agaagtttagatttta

SEQ ID NO: 2444296 - DNA, 18 bp, Homo sapiens
agaagtttagattttaat

SEQ ID NO: 2444297 - DNA, 13 bp, Homo sapiens
agaataaaggcag

SEQ ID NO: 2444298 - DNA, 14 bp, Homo sapiens
agaataaaggcagt

SEQ ID NO: 2444299 - DNA, 21 bp, Homo sapiens
agaataaaggcagttttctaa

SEQ ID NO: 2444300 - DNA, 12 bp, Homo sapiens
agaataagttat

SEQ ID NO: 2444301 - DNA, 14 bp, Homo sapiens
agaataagttattg

SEQ ID NO: 2444302 - DNA, 21 bp, Homo sapiens
agaataagttattgcagttta

SEQ ID NO: 2444303 - DNA, 16 bp, Homo sapiens
agaatatcacagaaaa

SEQ ID NO: 2444304 - DNA, 13 bp, Homo sapiens
agaatatgaaaca

SEQ ID NO: 2444305 - DNA, 14 bp, Homo sapiens
agaatcaaacattt

SEQ ID NO: 2444306 - DNA, 21 bp, Homo sapiens
agaatcaacatttctcaataa

SEQ ID NO: 2444307 - DNA, 15 bp, Homo sapiens
agaatcatttagcat

SEQ ID NO: 2444308 - DNA, 18 bp, Homo sapiens
agaatcccaaatttgatt

SEQ ID NO: 2444309 - DNA, 22 bp, Homo sapiens
agaatcccttaacagttgtatt

SEQ ID NO: 2444310 - DNA, 14 bp, Homo sapiens
agaatctttagaga

SEQ ID NO: 2444311 - DNA, 23 bp, Homo sapiens
agaatctttagagaagtatacat

SEQ ID NO: 2444312 - DNA, 16 bp, Homo sapiens
agaatgcacaagaatg

SEQ ID NO: 2444313 - DNA, 17 bp, Homo sapiens
agaatgcacaagaatgg

SEQ ID NO: 2444314 - DNA, 15 bp, Homo sapiens
agaatgctgtacatc

SEQ ID NO: 2444315 - DNA, 19 bp, Homo sapiens
agaatggatcacaagatgg

SEQ ID NO: 2444316 - DNA, 14 bp, Homo sapiens
agaatgtatcccca

SEQ ID NO: 2444317 - DNA, 20 bp, Homo sapiens
agaattaaacttttaattca

SEQ ID NO: 2444318 - DNA, 20 bp, Homo sapiens
agaattactgtaactgatta

SEQ ID NO: 2444319 - DNA, 19 bp, Homo sapiens
agaattgtgtcagactgtt

SEQ ID NO: 2444320 - DNA, 23 bp, Homo sapiens
agaattgttgggggtttttttgg

SEQ ID NO: 2444321 - DNA, 18 bp, Homo sapiens
agaattttatactttccc

SEQ ID NO: 2444322 - DNA, 20 bp, Homo sapiens
agaattttatactttcccta

SEQ ID NO: 2444323 - DNA, 21 bp, Homo sapiens
agaattttatactttccctac

SEQ ID NO: 2444324 - DNA, 22 bp, Homo sapiens
agaattttatactttccctacc

SEQ ID NO: 2444325 - DNA, 15 bp, Homo sapiens
agacaaactttgcat

SEQ ID NO: 2444326 - DNA, 15 bp, Homo sapiens
agacaagccagaact

SEQ ID NO: 2444327 - DNA, 13 bp, Homo sapiens
agacacacttgtc

SEQ ID NO: 2444328 - DNA, 12 bp, Homo sapiens
agacacaggccc

SEQ ID NO: 2444329 - DNA, 19 bp, Homo sapiens
agacacatgaaggtaaata

SEQ ID NO: 2444330 - DNA, 21 bp, Homo sapiens
agacacatgaaggtaaataaa

SEQ ID NO: 2444331 - DNA, 18 bp, Homo sapiens
agacaccaaagttctaat

SEQ ID NO: 2444332 - DNA, 14 bp, Homo sapiens
agacacccaggact

SEQ ID NO: 2444333 - DNA, 19 bp, Homo sapiens
agacagaaccacagggcta

SEQ ID NO: 2444334 - DNA, 17 bp, Homo sapiens
agacagaagaaacaagg

SEQ ID NO: 2444335 - DNA, 20 bp, Homo sapiens
agacagagaggactgtaggg

SEQ ID NO: 2444336 - DNA, 16 bp, Homo sapiens
agacagaggccctcaa

SEQ ID NO: 2444337 - DNA, 17 bp, Homo sapiens
agacagctccaccctgg

SEQ ID NO: 2444338 - DNA, 15 bp, Homo sapiens
agacaggctggaaga

SEQ ID NO: 2444339 - DNA, 23 bp, Homo sapiens
agacagggtttcaccatgttgcc

SEQ ID NO: 2444340 - DNA, 21 bp, Homo sapiens
agacataaaggaaaagacaca

SEQ ID NO: 2444341 - DNA, 19 bp, Homo sapiens
agacatacttgaagggcca

SEQ ID NO: 2444342 - DNA, 20 bp, Homo sapiens
agacatacttgaagggccag

SEQ ID NO: 2444343 - DNA, 16 bp, Homo sapiens
agacatcagcccttgg

SEQ ID NO: 2444344 - DNA, 19 bp, Homo sapiens
agacatctgaggttttatt

SEQ ID NO: 2444345 - DNA, 19 bp, Homo sapiens
agacatggaggttctaagg

SEQ ID NO: 2444346 - DNA, 13 bp, Homo sapiens
agacatgtgacat

SEQ ID NO: 2444347 - DNA, 21 bp, Homo sapiens
agaccaagatggcccatcctg

SEQ ID NO: 2444348 - DNA, 20 bp, Homo sapiens
agaccacgcccgtcctgcct

SEQ ID NO: 2444349 - DNA, 24 bp, Homo sapiens
agaccacgcccgtcctgcctgtgg

SEQ ID NO: 2444350 - DNA, 14 bp, Homo sapiens
agaccactgccata

SEQ ID NO: 2444351 - DNA, 16 bp, Homo sapiens
agaccagggctccagc

SEQ ID NO: 2444352 - DNA, 19 bp, Homo sapiens
agacccagccctcatcccg

SEQ ID NO: 2444353 - DNA, 22 bp, Homo sapiens
agacccattccttcccagaggg

SEQ ID NO: 2444354 - DNA, 12 bp, Homo sapiens
agaccctggagg

SEQ ID NO: 2444355 - DNA, 19 bp, Homo sapiens
agacccttttgggtttctg

SEQ ID NO: 2444356 - DNA, 19 bp, Homo sapiens
agaccggcctgccaggagg

SEQ ID NO: 2444357 - DNA, 11 bp, Homo sapiens
agacctacagg

SEQ ID NO: 2444358 - DNA, 21 bp, Homo sapiens
agacctacagggggtctggct

SEQ ID NO: 2444359 - DNA, 15 bp, Homo sapiens
agacctactgttcta

SEQ ID NO: 2444360 - DNA, 17 bp, Homo sapiens
agacctactgttctaaa

SEQ ID NO: 2444361 - DNA, 20 bp, Homo sapiens
agacctactgttctaaagct

SEQ ID NO: 2444362 - DNA, 15 bp, Homo sapiens
agacctcagaagtaa

SEQ ID NO: 2444363 - DNA, 15 bp, Homo sapiens
agacctgaattcttt

SEQ ID NO: 2444364 - DNA, 23 bp, Homo sapiens
agacctgatcctggaggcccagt

SEQ ID NO: 2444365 - DNA, 14 bp, Homo sapiens
agacctggcagctc

SEQ ID NO: 2444366 - DNA, 13 bp, Homo sapiens
agacctgtaatca

SEQ ID NO: 2444367 - DNA, 22 bp, Homo sapiens
agaccttgttacttctgaggta

SEQ ID NO: 2444368 - DNA, 23 bp, Homo sapiens
agacgcactttggcttataattc

SEQ ID NO: 2444369 - DNA, 13 bp, Homo sapiens
agacgcctggctg

SEQ ID NO: 2444370 - DNA, 18 bp, Homo sapiens
agacgcctttctcctcca

SEQ ID NO: 2444371 - DNA, 15 bp, Homo sapiens
agacgctgctgtcac

SEQ ID NO: 2444372 - DNA, 16 bp, Homo sapiens
agacgttttataagca

SEQ ID NO: 2444373 - DNA, 13 bp, Homo sapiens
agactaagccagc

SEQ ID NO: 2444374 - DNA, 16 bp, Homo sapiens
agactaagccagcacc

SEQ ID NO: 2444375 - DNA, 19 bp, Homo sapiens
agactagatgtagtatttt

SEQ ID NO: 2444376 - DNA, 20 bp, Homo sapiens
agactatcttactatttcac

SEQ ID NO: 2444377 - DNA, 14 bp, Homo sapiens
agactatttttaga

SEQ ID NO: 2444378 - DNA, 17 bp, Homo sapiens
agactcccattcctgaa

SEQ ID NO: 2444379 - DNA, 19 bp, Homo sapiens
agactcccattcctgaaga

SEQ ID NO: 2444380 - DNA, 23 bp, Homo sapiens
agactcccattcctgaagaacca

SEQ ID NO: 2444381 - DNA, 21 bp, Homo sapiens
agactccttcaacaattctaa

SEQ ID NO: 2444382 - DNA, 12 bp, Homo sapiens
agactctaagaa

SEQ ID NO: 2444383 - DNA, 16 bp, Homo sapiens
agactctaagaaagaa

SEQ ID NO: 2444384 - DNA, 20 bp, Homo sapiens
agactctagagtccaaggtt

SEQ ID NO: 2444385 - DNA, 21 bp, Homo sapiens
agactctagagtccaaggttt

SEQ ID NO: 2444386 - DNA, 18 bp, Homo sapiens
agactcttgcctgtttcc

SEQ ID NO: 2444387 - DNA, 22 bp, Homo sapiens
agactcttgcctgtttcccagg

SEQ ID NO: 2444388 - DNA, 23 bp, Homo sapiens
agcaggaaatgaaaatgtcttgt

SEQ ID NO: 2444389 - DNA, 19 bp, Homo sapiens
agcaggactgatgtctcct

SEQ ID NO: 2444390 - DNA, 22 bp, Homo sapiens
agcaggactgatgtctcctaag

SEQ ID NO: 2444391 - DNA, 16 bp, Homo sapiens
agcaggcagccagcat

SEQ ID NO: 2444392 - DNA, 23 bp, Homo sapiens
agcagggccggggaactggccaa

SEQ ID NO: 2444393 - DNA, 23 bp, Homo sapiens
agcagggctaccctgagctgagg

SEQ ID NO: 2444394 - DNA, 16 bp, Homo sapiens
agcaggttcccaagct

SEQ ID NO: 2444395 - DNA, 15 bp, Homo sapiens
agcagtccccttccc

SEQ ID NO: 2444396 - DNA, 18 bp, Homo sapiens
agcagtccccttccctcc

SEQ ID NO: 2444397 - DNA, 19 bp, Homo sapiens
agcagtcctgcctcagcct

SEQ ID NO: 2444398 - DNA, 15 bp, Homo sapiens
agcagtccttggcct

SEQ ID NO: 2444399 - DNA, 14 bp, Homo sapiens
agcagtcgtgcctg

SEQ ID NO: 2444400 - DNA, 21 bp, Homo sapiens
agcagtcgtgcctgtgtccat

SEQ ID NO: 2444401 - DNA, 21 bp, Homo sapiens
agcagtgaatgattcagtgtt

SEQ ID NO: 2444402 - DNA, 22 bp, Homo sapiens
agcagtgaatgattcagtgtta

SEQ ID NO: 2444403 - DNA, 12 bp, Homo sapiens
agcagtggcctt

SEQ ID NO: 2444404 - DNA, 11 bp, Homo sapiens
agcagtggctg

SEQ ID NO: 2444405 - DNA, 17 bp, Homo sapiens
agcagtggctggtccag

SEQ ID NO: 2444406 - DNA, 18 bp, Homo sapiens
agcagtggctggtccagg

SEQ ID NO: 2444407 - DNA, 17 bp, Homo sapiens
agcagttctgcagagga

SEQ ID NO: 2444408 - DNA, 20 bp, Homo sapiens
agcataggtgatccatgtaa

SEQ ID NO: 2444409 - DNA, 15 bp, Homo sapiens
agcatcatgcctctg

SEQ ID NO: 2444410 - DNA, 16 bp, Homo sapiens
agcatcatgcctctga

SEQ ID NO: 2444411 - DNA, 22 bp, Homo sapiens
agcatcatgcctctgaggccag

SEQ ID NO: 2444412 - DNA, 19 bp, Homo sapiens
agcatcattatttatgtat

SEQ ID NO: 2444413 - DNA, 21 bp, Homo sapiens
agcatccgcaggtgctggtcc

SEQ ID NO: 2444414 - DNA, 22 bp, Homo sapiens
agcatctaagttataagactct

SEQ ID NO: 2444415 - DNA, 17 bp, Homo sapiens
agcatctctaccttctc

SEQ ID NO: 2444416 - DNA, 23 bp, Homo sapiens
agcatctctaccttctccccagc

SEQ ID NO: 2444417 - DNA, 22 bp, Homo sapiens
agcatctgggccttggcctgga

SEQ ID NO: 2444418 - DNA, 15 bp, Homo sapiens
agcatgcatctgttt

SEQ ID NO: 2444419 - DNA, 15 bp, Homo sapiens
agcatggctatttta

SEQ ID NO: 2444420 - DNA, 18 bp, Homo sapiens
agcatggctattttatat

SEQ ID NO: 2444421 - DNA, 21 bp, Homo sapiens
agcatggtcccacatccctgg

SEQ ID NO: 2444422 - DNA, 22 bp, Homo sapiens
agcatggtcccacatccctggg

SEQ ID NO: 2444423 - DNA, 23 bp, Homo sapiens
agcatggtcccacatccctgggc

SEQ ID NO: 2444424 - DNA, 20 bp, Homo sapiens
agcatgtacggattttcagt

SEQ ID NO: 2444425 - DNA, 21 bp, Homo sapiens
agcatgtacggattttcagtt

SEQ ID NO: 2444426 - DNA, 18 bp, Homo sapiens
agcatgtttagactttaa

SEQ ID NO: 2444427 - DNA, 18 bp, Homo sapiens
agcattcacaacttgttt

SEQ ID NO: 2444428 - DNA, 15 bp, Homo sapiens
agcattcagaagaaa

SEQ ID NO: 2444429 - DNA, 12 bp, Homo sapiens
agcattcccagg

SEQ ID NO: 2444430 - DNA, 19 bp, Homo sapiens
agcattcccaggtaggcca

SEQ ID NO: 2444431 - DNA, 15 bp, Homo sapiens
agcattgaatggcta

SEQ ID NO: 2444432 - DNA, 12 bp, Homo sapiens
agcattgcactt

SEQ ID NO: 2444433 - DNA, 17 bp, Homo sapiens
agcattgtaaaagcatt

SEQ ID NO: 2444434 - DNA, 15 bp, Homo sapiens
agcattgtaaaataa

SEQ ID NO: 2444435 - DNA, 15 bp, Homo sapiens
agcattgtagtgctt

SEQ ID NO: 2444436 - DNA, 21 bp, Homo sapiens
agcatttaacccccctgtaca

SEQ ID NO: 2444437 - DNA, 22 bp, Homo sapiens
agcatttaacccccctgtacac

SEQ ID NO: 2444438 - DNA, 14 bp, Homo sapiens
agcatttctcatca

SEQ ID NO: 2444439 - DNA, 17 bp, Homo sapiens
agcattttgtaagttga

SEQ ID NO: 2444440 - DNA, 18 bp, Homo sapiens
agccaaaaatagctaaat

SEQ ID NO: 2444441 - DNA, 22 bp, Homo sapiens
agccaaaaatagctaaatacct

SEQ ID NO: 2444442 - DNA, 17 bp, Homo sapiens
agccaaaatgtaggctt

SEQ ID NO: 2444443 - DNA, 14 bp, Homo sapiens
agccaaaccctgtc

SEQ ID NO: 2444444 - DNA, 15 bp, Homo sapiens
agccaaacctcacca

SEQ ID NO: 2444445 - DNA, 16 bp, Homo sapiens
agccaactagcccctg

SEQ ID NO: 2444446 - DNA, 16 bp, Homo sapiens
agccaagctctgcagt

SEQ ID NO: 2444447 - DNA, 19 bp, Homo sapiens
agccaagggaacctgtgtc

SEQ ID NO: 2444448 - DNA, 20 bp, Homo sapiens
agccaagggaacctgtgtcc

SEQ ID NO: 2444449 - DNA, 11 bp, Homo sapiens
agccaagggat

SEQ ID NO: 2444450 - DNA, 22 bp, Homo sapiens
agccaagggatggacatcttgt

SEQ ID NO: 2444451 - DNA, 23 bp, Homo sapiens
agccaagggcaacagatcagtaa

SEQ ID NO: 2444452 - DNA, 19 bp, Homo sapiens
agccacacttctcaggaca

SEQ ID NO: 2444453 - DNA, 20 bp, Homo sapiens
agccacacttctcaggacac

SEQ ID NO: 2444454 - DNA, 22 bp, Homo sapiens
agccacatttggaatacttttt

SEQ ID NO: 2444455 - DNA, 23 bp, Homo sapiens
agccacatttggaatactttttg

SEQ ID NO: 2444456 - DNA, 14 bp, Homo sapiens
agccaccagttctc

SEQ ID NO: 2444457 - DNA, 13 bp, Homo sapiens
agccacccctgag

SEQ ID NO: 2444458 - DNA, 13 bp, Homo sapiens
agccaccctgagg

SEQ ID NO: 2444459 - DNA, 19 bp, Homo sapiens
agccaccctgaggagtctg

SEQ ID NO: 2444460 - DNA, 14 bp, Homo sapiens
agccaccctgagtt

SEQ ID NO: 2444461 - DNA, 18 bp, Homo sapiens
agccacgggtgccagaag

SEQ ID NO: 2444462 - DNA, 12 bp, Homo sapiens
agccactcctct

SEQ ID NO: 2444463 - DNA, 21 bp, Homo sapiens
agccactcctctgactcaggg

SEQ ID NO: 2444464 - DNA, 22 bp, Homo sapiens
agccactcctctgactcagggc

SEQ ID NO: 2444465 - DNA, 22 bp, Homo sapiens
agccacttgcctgtgctacaat

SEQ ID NO: 2444466 - DNA, 15 bp, Homo sapiens
agccagcacacaggg

SEQ ID NO: 2444467 - DNA, 20 bp, Homo sapiens
agccagcaccggaccagcct

SEQ ID NO: 2444468 - DNA, 24 bp, Homo sapiens
agccagcaccggaccagcctggcc

SEQ ID NO: 2444469 - DNA, 20 bp, Homo sapiens
agccagcacttgtccagctg

SEQ ID NO: 2444470 - DNA, 21 bp, Homo sapiens
agccagcacttgtccagctga

SEQ ID NO: 2444471 - DNA, 22 bp, Homo sapiens
agccagcacttgtccagctgag

SEQ ID NO: 2444472 - DNA, 14 bp, Homo sapiens
agccagcatcggaa

SEQ ID NO: 2444473 - DNA, 18 bp, Homo sapiens
agccagccctgcctggag

SEQ ID NO: 2444474 - DNA, 19 bp, Homo sapiens
agccagcgtcctcctctgt

SEQ ID NO: 2444475 - DNA, 21 bp, Homo sapiens
agccagcttgtttacatgctt

SEQ ID NO: 2444476 - DNA, 23 bp, Homo sapiens
agccaggaatttcccaggaccct

SEQ ID NO: 2444477 - DNA, 13 bp, Homo sapiens
agccaggagaagc

SEQ ID NO: 2444478 - DNA, 15 bp, Homo sapiens
agccagggagagccc

SEQ ID NO: 2444479 - DNA, 13 bp, Homo sapiens
agccagggctcaa

SEQ ID NO: 2444480 - DNA, 12 bp, Homo sapiens
agccaggtccct

SEQ ID NO: 2444481 - DNA, 13 bp, Homo sapiens
agccatcaaaatg

SEQ ID NO: 2444482 - DNA, 16 bp, Homo sapiens
agccatcaaaatgctt

SEQ ID NO: 2444483 - DNA, 18 bp, Homo sapiens
agccatcaaaatgctttt

SEQ ID NO: 2444484 - DNA, 16 bp, Homo sapiens
agccatcacctcagat

SEQ ID NO: 2444485 - DNA, 23 bp, Homo sapiens
agccatgagttccagaaagtaaa

SEQ ID NO: 2444486 - DNA, 23 bp, Homo sapiens
agcccaagttcatgcagctgtgg

SEQ ID NO: 2444487 - DNA, 19 bp, Homo sapiens
agcccactgtcctgggcct

SEQ ID NO: 2444488 - DNA, 22 bp, Homo sapiens
agcccactgtcctgggcctgca

SEQ ID NO: 2444489 - DNA, 12 bp, Homo sapiens
agcccagagaca

SEQ ID NO: 2444490 - DNA, 15 bp, Homo sapiens
agcccagagggtctg

SEQ ID NO: 2444491 - DNA, 15 bp, Homo sapiens
agctgaggcagcagt

SEQ ID NO: 2444492 - DNA, 13 bp, Homo sapiens
agctgaggccaca

SEQ ID NO: 2444493 - DNA, 21 bp, Homo sapiens
agctgaggccacactcagcac

SEQ ID NO: 2444494 - DNA, 12 bp, Homo sapiens
agctgaggtgcc

SEQ ID NO: 2444495 - DNA, 16 bp, Homo sapiens
agctgaggtgcccagg

SEQ ID NO: 2444496 - DNA, 19 bp, Homo sapiens
agctgagtattaaaatgta

SEQ ID NO: 2444497 - DNA, 23 bp, Homo sapiens
agctgcaaggtactctggtgagt

SEQ ID NO: 2444498 - DNA, 19 bp, Homo sapiens
agctgcactgatgctgccc

SEQ ID NO: 2444499 - DNA, 22 bp, Homo sapiens
agctgcactgatgctgcccctc

SEQ ID NO: 2444500 - DNA, 15 bp, Homo sapiens
agctgcattccgcag

SEQ ID NO: 2444501 - DNA, 18 bp, Homo sapiens
agctgcattccgcagccc

SEQ ID NO: 2444502 - DNA, 17 bp, Homo sapiens
agctgccccggcccctc

SEQ ID NO: 2444503 - DNA, 21 bp, Homo sapiens
agctgcctagattcagggaaa

SEQ ID NO: 2444504 - DNA, 20 bp, Homo sapiens
agctgcctcccctctccttc

SEQ ID NO: 2444505 - DNA, 14 bp, Homo sapiens
agctgcctggaccc

SEQ ID NO: 2444506 - DNA, 23 bp, Homo sapiens
agctggaggcaggggcttcctgg

SEQ ID NO: 2444507 - DNA, 13 bp, Homo sapiens
agctgggcctggt

SEQ ID NO: 2444508 - DNA, 17 bp, Homo sapiens
agctgggctaagtaaat

SEQ ID NO: 2444509 - DNA, 22 bp, Homo sapiens
agctggggctttgatgttcctt

SEQ ID NO: 2444510 - DNA, 13 bp, Homo sapiens
agctggtgcggct

SEQ ID NO: 2444511 - DNA, 19 bp, Homo sapiens
agctggtgcggctggccat

SEQ ID NO: 2444512 - DNA, 21 bp, Homo sapiens
agctgtatagctgcttccagt

SEQ ID NO: 2444513 - DNA, 16 bp, Homo sapiens
agctgtcaaggctcag

SEQ ID NO: 2444514 - DNA, 14 bp, Homo sapiens
agctgtccccccac

SEQ ID NO: 2444515 - DNA, 22 bp, Homo sapiens
agctgtccccccactccctcac

SEQ ID NO: 2444516 - DNA, 23 bp, Homo sapiens
agctgtccccccactccctcaca

SEQ ID NO: 2444517 - DNA, 14 bp, Homo sapiens
agctgtcctttttc

SEQ ID NO: 2444518 - DNA, 16 bp, Homo sapiens
agctgtcctttttcct

SEQ ID NO: 2444519 - DNA, 20 bp, Homo sapiens
agctgtcctttttcctctcc

SEQ ID NO: 2444520 - DNA, 16 bp, Homo sapiens
agctgtcttttggagg

SEQ ID NO: 2444521 - DNA, 17 bp, Homo sapiens
agctgtcttttggagga

SEQ ID NO: 2444522 - DNA, 15 bp, Homo sapiens
agctgtgacctgctg

SEQ ID NO: 2444523 - DNA, 16 bp, Homo sapiens
agctgtgacctgctga

SEQ ID NO: 2444524 - DNA, 17 bp, Homo sapiens
agctgtgacctgctgag

SEQ ID NO: 2444525 - DNA, 22 bp, Homo sapiens
agctgtgacctgctgagctctg

SEQ ID NO: 2444526 - DNA, 10 bp, Homo sapiens
agctgtgcag

SEQ ID NO: 2444527 - DNA, 19 bp, Homo sapiens
agctgtgcaggtggggaga

SEQ ID NO: 2444528 - DNA, 22 bp, Homo sapiens
agctgtgcttatggtaccagat

SEQ ID NO: 2444529 - DNA, 18 bp, Homo sapiens
agctgtggcagagttaca

SEQ ID NO: 2444530 - DNA, 22 bp, Homo sapiens
agctgtggttttcttttgccat

SEQ ID NO: 2444531 - DNA, 21 bp, Homo sapiens
agctgtgtccaaaaccgccag

SEQ ID NO: 2444532 - DNA, 22 bp, Homo sapiens
agctgtttactagggatccctc

SEQ ID NO: 2444533 - DNA, 23 bp, Homo sapiens
agctgttttgttgacattctgaa

SEQ ID NO: 2444534 - DNA, 22 bp, Homo sapiens
agcttaaaactttgaagttagc

SEQ ID NO: 2444535 - DNA, 13 bp, Homo sapiens
agcttaaaataca

SEQ ID NO: 2444536 - DNA, 22 bp, Homo sapiens
agcttagagttggccatattta

SEQ ID NO: 2444537 - DNA, 15 bp, Homo sapiens
agcttagatttcata

SEQ ID NO: 2444538 - DNA, 16 bp, Homo sapiens
agcttagatttcatag

SEQ ID NO: 2444539 - DNA, 16 bp, Homo sapiens
agcttatgaaaagaat

SEQ ID NO: 2444540 - DNA, 21 bp, Homo sapiens
agcttccttcagagagcagtg

SEQ ID NO: 2444541 - DNA, 12 bp, Homo sapiens
agcttctgagac

SEQ ID NO: 2444542 - DNA, 13 bp, Homo sapiens
agcttctgagacg

SEQ ID NO: 2444543 - DNA, 14 bp, Homo sapiens
agcttctgtcctgc

SEQ ID NO: 2444544 - DNA, 22 bp, Homo sapiens
agcttgatgttggatctcaaga

SEQ ID NO: 2444545 - DNA, 14 bp, Homo sapiens
agcttggggaagac

SEQ ID NO: 2444546 - DNA, 16 bp, Homo sapiens
agcttgtctcttgcct

SEQ ID NO: 2444547 - DNA, 21 bp, Homo sapiens
agcttgtctcttgcctgccac

SEQ ID NO: 2444548 - DNA, 22 bp, Homo sapiens
agcttgtctcttgcctgccact

SEQ ID NO: 2444549 - DNA, 18 bp, Homo sapiens
agcttgtttacatgctta

SEQ ID NO: 2444550 - DNA, 18 bp, Homo sapiens
agctttaacttaaatagt

SEQ ID NO: 2444551 - DNA, 21 bp, Homo sapiens
agctttaatgatatgcttgta

SEQ ID NO: 2444552 - DNA, 18 bp, Homo sapiens
agctttagaaacagtgca

SEQ ID NO: 2444553 - DNA, 18 bp, Homo sapiens
agctttagaatcccagcc

SEQ ID NO: 2444554 - DNA, 15 bp, Homo sapiens
agctttccccagccc

SEQ ID NO: 2444555 - DNA, 21 bp, Homo sapiens
agctttcctgccccaggcctg

SEQ ID NO: 2444556 - DNA, 21 bp, Homo sapiens
agctttctgaacagctggtgt

SEQ ID NO: 2444557 - DNA, 16 bp, Homo sapiens
agctttgactcaggag

SEQ ID NO: 2444558 - DNA, 13 bp, Homo sapiens
agcttttgtctac

SEQ ID NO: 2444559 - DNA, 21 bp, Homo sapiens
agcttttgtgggggactgtaa

SEQ ID NO: 2444560 - DNA, 24 bp, Homo sapiens
agcttttgtgggggactgtaagtt

SEQ ID NO: 2444561 - DNA, 13 bp, Homo sapiens
aggaaaaggcctg

SEQ ID NO: 2444562 - DNA, 17 bp, Homo sapiens
aggaaaaggcctggggt

SEQ ID NO: 2444563 - DNA, 14 bp, Homo sapiens
aggaaaattgaatg

SEQ ID NO: 2444564 - DNA, 19 bp, Homo sapiens
aggaaacaaccatgtcatt

SEQ ID NO: 2444565 - DNA, 20 bp, Homo sapiens
aggaaacgagactttccatt

SEQ ID NO: 2444566 - DNA, 22 bp, Homo sapiens
aggaaactcctgtgaccacaac

SEQ ID NO: 2444567 - DNA, 14 bp, Homo sapiens
aggaaatcccttca

SEQ ID NO: 2444568 - DNA, 14 bp, Homo sapiens
aggaaatctcaccc

SEQ ID NO: 2444569 - DNA, 20 bp, Homo sapiens
aggaaatgtttttaataaaa

SEQ ID NO: 2444570 - DNA, 22 bp, Homo sapiens
aggaaatgtttttaataaaaga

SEQ ID NO: 2444571 - DNA, 20 bp, Homo sapiens
aggaagaggggaagcagaaa

SEQ ID NO: 2444572 - DNA, 15 bp, Homo sapiens
aggaagcaagcttaa

SEQ ID NO: 2444573 - DNA, 15 bp, Homo sapiens
aggaagcattgtaaa

SEQ ID NO: 2444574 - DNA, 16 bp, Homo sapiens
aggaagcattgtaaaa

SEQ ID NO: 2444575 - DNA, 19 bp, Homo sapiens
aggaagcattgtaaaataa

SEQ ID NO: 2444576 - DNA, 14 bp, Homo sapiens
aggaagcctcagat

SEQ ID NO: 2444577 - DNA, 20 bp, Homo sapiens
aggaagcctcagattccttc

SEQ ID NO: 2444578 - DNA, 19 bp, Homo sapiens
aggaagcctgcagtcctgg

SEQ ID NO: 2444579 - DNA, 14 bp, Homo sapiens
aggaaggagctgcc

SEQ ID NO: 2444580 - DNA, 16 bp, Homo sapiens
aggaaggagctgcctg

SEQ ID NO: 2444581 - DNA, 21 bp, Homo sapiens
aggaaggcttgttgtgctttt

SEQ ID NO: 2444582 - DNA, 22 bp, Homo sapiens
aggaaggcttgttgtgctttta

SEQ ID NO: 2444583 - DNA, 16 bp, Homo sapiens
aggaaggggccagagg

SEQ ID NO: 2444584 - DNA, 16 bp, Homo sapiens
aggaagtctcatctgg

SEQ ID NO: 2444585 - DNA, 19 bp, Homo sapiens
aggaagtctcatctgggga

SEQ ID NO: 2444586 - DNA, 18 bp, Homo sapiens
aggaatagcatgtcacta

SEQ ID NO: 2444587 - DNA, 15 bp, Homo sapiens
aggaatattttccaa

SEQ ID NO: 2444588 - DNA, 17 bp, Homo sapiens
aggaatttcccaggacc

SEQ ID NO: 2444589 - DNA, 19 bp, Homo sapiens
aggaatttcccaggaccct

SEQ ID NO: 2444590 - DNA, 20 bp, Homo sapiens
aggaatttcccaggaccctg

SEQ ID NO: 2444591 - DNA, 21 bp, Homo sapiens
aggaatttcccaggaccctga

SEQ ID NO: 2444592 - DNA, 13 bp, Homo sapiens
aggaatttcttaa

SEQ ID NO: 2444593 - DNA, 19 bp, Homo sapiens
aggaatttcttaacttctt

SEQ ID NO: 2444594 - DNA, 16 bp, Homo sapiens
aggcctgtttggcctc

SEQ ID NO: 2444595 - DNA, 18 bp, Homo sapiens
aggcctgtttggcctctc

SEQ ID NO: 2444596 - DNA, 23 bp, Homo sapiens
aggcgatccacctgtctcagcct

SEQ ID NO: 2444597 - DNA, 18 bp, Homo sapiens
aggcggggcttgccttct

SEQ ID NO: 2444598 - DNA, 18 bp, Homo sapiens
aggcgtgagccaccatgc

SEQ ID NO: 2444599 - DNA, 18 bp, Homo sapiens
aggcgtgagccacctcgc

SEQ ID NO: 2444600 - DNA, 23 bp, Homo sapiens
aggctaatttttttgtattttag

SEQ ID NO: 2444601 - DNA, 16 bp, Homo sapiens
aggctacagagaagcc

SEQ ID NO: 2444602 - DNA, 17 bp, Homo sapiens
aggctacagagaagcct

SEQ ID NO: 2444603 - DNA, 18 bp, Homo sapiens
aggctacagagaagcctt

SEQ ID NO: 2444604 - DNA, 20 bp, Homo sapiens
aggctacttcggggctggga

SEQ ID NO: 2444605 - DNA, 23 bp, Homo sapiens
aggctcaaacaatgacaaagcag

SEQ ID NO: 2444606 - DNA, 23 bp, Homo sapiens
aggctcacccccttctccatcca

SEQ ID NO: 2444607 - DNA, 14 bp, Homo sapiens
aggctcaggcaggg

SEQ ID NO: 2444608 - DNA, 10 bp, Homo sapiens
aggctcaggt

SEQ ID NO: 2444609 - DNA, 15 bp, Homo sapiens
aggctcccagggaca

SEQ ID NO: 2444610 - DNA, 13 bp, Homo sapiens
aggctccccttct

SEQ ID NO: 2444611 - DNA, 22 bp, Homo sapiens
aggctcctgttttgcacagcca

SEQ ID NO: 2444612 - DNA, 20 bp, Homo sapiens
aggctctatgagtctagatg

SEQ ID NO: 2444613 - DNA, 16 bp, Homo sapiens
aggctctgagagtcta

SEQ ID NO: 2444614 - DNA, 21 bp, Homo sapiens
aggctctgagagtctagattc

SEQ ID NO: 2444615 - DNA, 18 bp, Homo sapiens
aggctgaccacagcacag

SEQ ID NO: 2444616 - DNA, 15 bp, Homo sapiens
aggctgaggcctgga

SEQ ID NO: 2444617 - DNA, 16 bp, Homo sapiens
aggctgaggctggcac

SEQ ID NO: 2444618 - DNA, 18 bp, Homo sapiens
aggctgaggctggcacag

SEQ ID NO: 2444619 - DNA, 22 bp, Homo sapiens
aggctgcattgaaaagagctga

SEQ ID NO: 2444620 - DNA, 22 bp, Homo sapiens
aggctgccctcctgtgctcagc

SEQ ID NO: 2444621 - DNA, 13 bp, Homo sapiens
aggctgcctgagt

SEQ ID NO: 2444622 - DNA, 17 bp, Homo sapiens
aggctgctcggggtgca

SEQ ID NO: 2444623 - DNA, 20 bp, Homo sapiens
aggctggagtggagtggcgt

SEQ ID NO: 2444624 - DNA, 18 bp, Homo sapiens
aggctggcacaggacatg

SEQ ID NO: 2444625 - DNA, 18 bp, Homo sapiens
aggctggccagtccaggc

SEQ ID NO: 2444626 - DNA, 10 bp, Homo sapiens
aggctgggcc

SEQ ID NO: 2444627 - DNA, 18 bp, Homo sapiens
aggctgggccatgtccaa

SEQ ID NO: 2444628 - DNA, 20 bp, Homo sapiens
aggctgggccatgtccaaag

SEQ ID NO: 2444629 - DNA, 17 bp, Homo sapiens
aggctggtcctatggcc

SEQ ID NO: 2444630 - DNA, 15 bp, Homo sapiens
aggctgtcctgtaca

SEQ ID NO: 2444631 - DNA, 16 bp, Homo sapiens
aggctgtcctgtacat

SEQ ID NO: 2444632 - DNA, 21 bp, Homo sapiens
aggctgtcctgtacattgtgg

SEQ ID NO: 2444633 - DNA, 16 bp, Homo sapiens
aggctgtctgttgtat

SEQ ID NO: 2444634 - DNA, 19 bp, Homo sapiens
aggctgtggtgagggaaga

SEQ ID NO: 2444635 - DNA, 20 bp, Homo sapiens
aggctgttaaatacaggaaa

SEQ ID NO: 2444636 - DNA, 23 bp, Homo sapiens
aggctgttaaatacaggaaacag

SEQ ID NO: 2444637 - DNA, 14 bp, Homo sapiens
aggcttaaacccat

SEQ ID NO: 2444638 - DNA, 19 bp, Homo sapiens
aggcttctgctggggcctg

SEQ ID NO: 2444639 - DNA, 21 bp, Homo sapiens
aggcttctgctggggcctggg

SEQ ID NO: 2444640 - DNA, 17 bp, Homo sapiens
aggcttggggctggaga

SEQ ID NO: 2444641 - DNA, 15 bp, Homo sapiens
aggcttgttgtgctt

SEQ ID NO: 2444642 - DNA, 18 bp, Homo sapiens
agggaaaattatttgcat

SEQ ID NO: 2444643 - DNA, 22 bp, Homo sapiens
agggaaagcccatatgctacca

SEQ ID NO: 2444644 - DNA, 21 bp, Homo sapiens
agggaacaatttggcaatttt

SEQ ID NO: 2444645 - DNA, 17 bp, Homo sapiens
agggaaccactttctta

SEQ ID NO: 2444646 - DNA, 17 bp, Homo sapiens
agggaagcagcagcctc

SEQ ID NO: 2444647 - DNA, 14 bp, Homo sapiens
agggaagctcttgg

SEQ ID NO: 2444648 - DNA, 12 bp, Homo sapiens
agggaaggcagg

SEQ ID NO: 2444649 - DNA, 14 bp, Homo sapiens
agggaaggcaggca

SEQ ID NO: 2444650 - DNA, 20 bp, Homo sapiens
agggaaggcaggcagggctc

SEQ ID NO: 2444651 - DNA, 19 bp, Homo sapiens
agggaaggctggactaggc

SEQ ID NO: 2444652 - DNA, 12 bp, Homo sapiens
agggaagggagc

SEQ ID NO: 2444653 - DNA, 15 bp, Homo sapiens
agggaagggagccaa

SEQ ID NO: 2444654 - DNA, 19 bp, Homo sapiens
agggaagggagccaaggga

SEQ ID NO: 2444655 - DNA, 20 bp, Homo sapiens
agggaagggagccaagggat

SEQ ID NO: 2444656 - DNA, 17 bp, Homo sapiens
agggacagaggccccag

SEQ ID NO: 2444657 - DNA, 22 bp, Homo sapiens
agggacagaggccccagcctcc

SEQ ID NO: 2444658 - DNA, 13 bp, Homo sapiens
agggacccagcta

SEQ ID NO: 2444659 - DNA, 23 bp, Homo sapiens
agggacgcctgggggtgccagga

SEQ ID NO: 2444660 - DNA, 16 bp, Homo sapiens
agggactgaccagcag

SEQ ID NO: 2444661 - DNA, 16 bp, Homo sapiens
agggactgtcgctgct

SEQ ID NO: 2444662 - DNA, 22 bp, Homo sapiens
agggactgtcgctgcttcgtgg

SEQ ID NO: 2444663 - DNA, 13 bp, Homo sapiens
agggagaagctcc

SEQ ID NO: 2444664 - DNA, 13 bp, Homo sapiens
agggagagcccag

SEQ ID NO: 2444665 - DNA, 21 bp, Homo sapiens
agggagccaagggatggacat

SEQ ID NO: 2444666 - DNA, 16 bp, Homo sapiens
agggagccatgtttca

SEQ ID NO: 2444667 - DNA, 15 bp, Homo sapiens
agggagccatttgag

SEQ ID NO: 2444668 - DNA, 14 bp, Homo sapiens
agggaggccgaagc

SEQ ID NO: 2444669 - DNA, 13 bp, Homo sapiens
agggaggccgggc

SEQ ID NO: 2444670 - DNA, 14 bp, Homo sapiens
agggaggctggtcc

SEQ ID NO: 2444671 - DNA, 12 bp, Homo sapiens
agggagggcaga

SEQ ID NO: 2444672 - DNA, 16 bp, Homo sapiens
agggagggcagagctg

SEQ ID NO: 2444673 - DNA, 18 bp, Homo sapiens
agggagggcagagctggt

SEQ ID NO: 2444674 - DNA, 19 bp, Homo sapiens
agggagggcagagctggtg

SEQ ID NO: 2444675 - DNA, 21 bp, Homo sapiens
agggagggcagagctggtgcg

SEQ ID NO: 2444676 - DNA, 15 bp, Homo sapiens
agggagggctctgag

SEQ ID NO: 2444677 - DNA, 16 bp, Homo sapiens
agggagggctctgagg

SEQ ID NO: 2444678 - DNA, 13 bp, Homo sapiens
agggaggggctgt

SEQ ID NO: 2444679 - DNA, 14 bp, Homo sapiens
agggagtctgccag

SEQ ID NO: 2444680 - DNA, 17 bp, Homo sapiens
agggagtgttccctatc

SEQ ID NO: 2444681 - DNA, 15 bp, Homo sapiens
agggatccctcatct

SEQ ID NO: 2444682 - DNA, 21 bp, Homo sapiens
agggatgtgggttccacagac

SEQ ID NO: 2444683 - DNA, 18 bp, Homo sapiens
agggattaacctctgcac

SEQ ID NO: 2444684 - DNA, 13 bp, Homo sapiens
agggcaaagccag

SEQ ID NO: 2444685 - DNA, 15 bp, Homo sapiens
agggcaaagccaggt

SEQ ID NO: 2444686 - DNA, 13 bp, Homo sapiens
agggcacaggagc

SEQ ID NO: 2444687 - DNA, 20 bp, Homo sapiens
agggcacaggagctacctgt

SEQ ID NO: 2444688 - DNA, 23 bp, Homo sapiens
agggcacaggagctacctgtgtg

SEQ ID NO: 2444689 - DNA, 19 bp, Homo sapiens
agggcaccaggggtttctc

SEQ ID NO: 2444690 - DNA, 21 bp, Homo sapiens
agggcaccctagttctacctc

SEQ ID NO: 2444691 - DNA, 20 bp, Homo sapiens
agggcagaccacattgcttt

SEQ ID NO: 2444692 - DNA, 19 bp, Homo sapiens
agggcagagtgagacccag

SEQ ID NO: 2444693 - DNA, 18 bp, Homo sapiens
agggcagcagccagccct

SEQ ID NO: 2444694 - DNA, 13 bp, Homo sapiens
agggcagccaggg

SEQ ID NO: 2444695 - DNA, 21 bp, Homo sapiens
agggcagccagggagagccca

SEQ ID NO: 2444696 - DNA, 22 bp, Homo sapiens
agggcagccagggagagcccag

SEQ ID NO: 2444697 - DNA, 20 bp, Homo sapiens
agggcagtcgatagagctgt

SEQ ID NO: 2444698 - DNA, 14 bp, Homo sapiens
aggggtgtcttggg

SEQ ID NO: 2444699 - DNA, 15 bp, Homo sapiens
aggggtgtggctcct

SEQ ID NO: 2444700 - DNA, 14 bp, Homo sapiens
aggggttcctcccc

SEQ ID NO: 2444701 - DNA, 21 bp, Homo sapiens
aggggttcctcccctccagct

SEQ ID NO: 2444702 - DNA, 21 bp, Homo sapiens
aggggttgctccgcctggcct

SEQ ID NO: 2444703 - DNA, 14 bp, Homo sapiens
agggtaaacaatat

SEQ ID NO: 2444704 - DNA, 23 bp, Homo sapiens
agggtaaatcagtaagaggtgtt

SEQ ID NO: 2444705 - DNA, 20 bp, Homo sapiens
agggtaggagggtgggaagg

SEQ ID NO: 2444706 - DNA, 15 bp, Homo sapiens
agggtaggcaggatt

SEQ ID NO: 2444707 - DNA, 21 bp, Homo sapiens
agggtatattttcctatatta

SEQ ID NO: 2444708 - DNA, 16 bp, Homo sapiens
agggtatgaagagtgt

SEQ ID NO: 2444709 - DNA, 20 bp, Homo sapiens
agggtcaacatcttttacat

SEQ ID NO: 2444710 - DNA, 19 bp, Homo sapiens
agggtccccgagtgcctag

SEQ ID NO: 2444711 - DNA, 20 bp, Homo sapiens
agggtccccgagtgcctagg

SEQ ID NO: 2444712 - DNA, 12 bp, Homo sapiens
agggtccctctg

SEQ ID NO: 2444713 - DNA, 17 bp, Homo sapiens
agggtccttttgacact

SEQ ID NO: 2444714 - DNA, 23 bp, Homo sapiens
agggtctgggggcacaagactga

SEQ ID NO: 2444715 - DNA, 19 bp, Homo sapiens
agggtctgtaggttgcaca

SEQ ID NO: 2444716 - DNA, 21 bp, Homo sapiens
agggtctgtaggttgcacact

SEQ ID NO: 2444717 - DNA, 22 bp, Homo sapiens
agggtctgtaggttgcacactt

SEQ ID NO: 2444718 - DNA, 17 bp, Homo sapiens
agggtgaaggaggtcag

SEQ ID NO: 2444719 - DNA, 20 bp, Homo sapiens
agggtgagttggcttacctg

SEQ ID NO: 2444720 - DNA, 23 bp, Homo sapiens
agggtgggcttgtggggcctggg

SEQ ID NO: 2444721 - DNA, 16 bp, Homo sapiens
agggttgaccccagag

SEQ ID NO: 2444722 - DNA, 18 bp, Homo sapiens
agggttgaccccagagga

SEQ ID NO: 2444723 - DNA, 21 bp, Homo sapiens
agggtttccctactgaagccc

SEQ ID NO: 2444724 - DNA, 16 bp, Homo sapiens
agggttttaactttgt

SEQ ID NO: 2444725 - DNA, 21 bp, Homo sapiens
aggtaatccaagatattttaa

SEQ ID NO: 2444726 - DNA, 16 bp, Homo sapiens
aggtacaagaagcatt

SEQ ID NO: 2444727 - DNA, 19 bp, Homo sapiens
agtactccacactgcacaa

SEQ ID NO: 2444728 - DNA, 13 bp, Homo sapiens
agtacttgtagtt

SEQ ID NO: 2444729 - DNA, 14 bp, Homo sapiens
agtacttgtagttc

SEQ ID NO: 2444730 - DNA, 15 bp, Homo sapiens
agtactttgtgcatt

SEQ ID NO: 2444731 - DNA, 21 bp, Homo sapiens
agtagaatctcagttgatttt

SEQ ID NO: 2444732 - DNA, 20 bp, Homo sapiens
agtagaccttgttacttctg

SEQ ID NO: 2444733 - DNA, 15 bp, Homo sapiens
agtagattttccaaa

SEQ ID NO: 2444734 - DNA, 14 bp, Homo sapiens
agtagctgagctca

SEQ ID NO: 2444735 - DNA, 23 bp, Homo sapiens
agtagctgagctcacaaggcagc

SEQ ID NO: 2444736 - DNA, 13 bp, Homo sapiens
agtaggagcccag

SEQ ID NO: 2444737 - DNA, 12 bp, Homo sapiens
agtagtcctgtg

SEQ ID NO: 2444738 - DNA, 17 bp, Homo sapiens
agtatgaattattcaat

SEQ ID NO: 2444739 - DNA, 16 bp, Homo sapiens
agtatggcctgtgtca

SEQ ID NO: 2444740 - DNA, 22 bp, Homo sapiens
agtatgttctaacctttacatg

SEQ ID NO: 2444741 - DNA, 13 bp, Homo sapiens
agtattaaaatgt

SEQ ID NO: 2444742 - DNA, 15 bp, Homo sapiens
agtattaaaatgtat

SEQ ID NO: 2444743 - DNA, 12 bp, Homo sapiens
agtattatatgt

SEQ ID NO: 2444744 - DNA, 13 bp, Homo sapiens
agtattatatgta

SEQ ID NO: 2444745 - DNA, 19 bp, Homo sapiens
agtattcaacaatttcaat

SEQ ID NO: 2444746 - DNA, 22 bp, Homo sapiens
agtattgctcacccagtgccct

SEQ ID NO: 2444747 - DNA, 15 bp, Homo sapiens
agtattgttgtcctt

SEQ ID NO: 2444748 - DNA, 16 bp, Homo sapiens
agtattgttgtccttt

SEQ ID NO: 2444749 - DNA, 19 bp, Homo sapiens
agtattgttgtccttttca

SEQ ID NO: 2444750 - DNA, 22 bp, Homo sapiens
agtattgttgtccttttcatag

SEQ ID NO: 2444751 - DNA, 24 bp, Homo sapiens
agtattgttgtccttttcataggt

SEQ ID NO: 2444752 - DNA, 20 bp, Homo sapiens
agtatttcaaattggagctt

SEQ ID NO: 2444753 - DNA, 13 bp, Homo sapiens
agtatttgttaat

SEQ ID NO: 2444754 - DNA, 14 bp, Homo sapiens
agtatttgttaatt

SEQ ID NO: 2444755 - DNA, 18 bp, Homo sapiens
agtattttagtgaacttg

SEQ ID NO: 2444756 - DNA, 13 bp, Homo sapiens
agtatttttgccg

SEQ ID NO: 2444757 - DNA, 19 bp, Homo sapiens
agtattttttgtataattg

SEQ ID NO: 2444758 - DNA, 20 bp, Homo sapiens
agtattttttgtataattgg

SEQ ID NO: 2444759 - DNA, 22 bp, Homo sapiens
agtattttttgtataattggat

SEQ ID NO: 2444760 - DNA, 14 bp, Homo sapiens
agtcaaataactcc

SEQ ID NO: 2444761 - DNA, 22 bp, Homo sapiens
agtcaaatggtaggcatttcct

SEQ ID NO: 2444762 - DNA, 23 bp, Homo sapiens
agtcaaatggtaggcatttccta

SEQ ID NO: 2444763 - DNA, 16 bp, Homo sapiens
agtcaacagtaaacca

SEQ ID NO: 2444764 - DNA, 15 bp, Homo sapiens
agtcaacctgcctga

SEQ ID NO: 2444765 - DNA, 14 bp, Homo sapiens
agtcaacctgggca

SEQ ID NO: 2444766 - DNA, 10 bp, Homo sapiens
agtcaataca

SEQ ID NO: 2444767 - DNA, 17 bp, Homo sapiens
agtcaatatttttagat

SEQ ID NO: 2444768 - DNA, 12 bp, Homo sapiens
agtcaatcaagt

SEQ ID NO: 2444769 - DNA, 14 bp, Homo sapiens
agtcacagggcagt

SEQ ID NO: 2444770 - DNA, 17 bp, Homo sapiens
agtcacagggcagtacc

SEQ ID NO: 2444771 - DNA, 20 bp, Homo sapiens
agtcactcgataataaagta

SEQ ID NO: 2444772 - DNA, 17 bp, Homo sapiens
agtcactcttatgctgt

SEQ ID NO: 2444773 - DNA, 23 bp, Homo sapiens
agtcagatggaaaattcattttt

SEQ ID NO: 2444774 - DNA, 12 bp, Homo sapiens
agtcatgtgacc

SEQ ID NO: 2444775 - DNA, 21 bp, Homo sapiens
agtcatttttacaatgtaatt

SEQ ID NO: 2444776 - DNA, 14 bp, Homo sapiens
agtccaagaatcca

SEQ ID NO: 2444777 - DNA, 15 bp, Homo sapiens
agtccaggtcctggt

SEQ ID NO: 2444778 - DNA, 17 bp, Homo sapiens
agtccagtccagtccta

SEQ ID NO: 2444779 - DNA, 17 bp, Homo sapiens
agtccagtcctatctgg

SEQ ID NO: 2444780 - DNA, 21 bp, Homo sapiens
agtccagtcctatctgggctt

SEQ ID NO: 2444781 - DNA, 20 bp, Homo sapiens
agtcccaagcggtgtctctc

SEQ ID NO: 2444782 - DNA, 19 bp, Homo sapiens
agtcccaggttggctctgc

SEQ ID NO: 2444783 - DNA, 17 bp, Homo sapiens
agtcccatctgcttcag

SEQ ID NO: 2444784 - DNA, 18 bp, Homo sapiens
agtccccattgaggcttg

SEQ ID NO: 2444785 - DNA, 21 bp, Homo sapiens
agtccctgcacagtgacttct

SEQ ID NO: 2444786 - DNA, 13 bp, Homo sapiens
agtccgtgggacg

SEQ ID NO: 2444787 - DNA, 23 bp, Homo sapiens
agtccgtgggacgggatggttct

SEQ ID NO: 2444788 - DNA, 20 bp, Homo sapiens
agtcctgatcagagccgtgg

SEQ ID NO: 2444789 - DNA, 16 bp, Homo sapiens
agtcctgcctcagcct

SEQ ID NO: 2444790 - DNA, 19 bp, Homo sapiens
agtcctggatgatactaat

SEQ ID NO: 2444791 - DNA, 19 bp, Homo sapiens
agtcctgtgaatgccactg

SEQ ID NO: 2444792 - DNA, 21 bp, Homo sapiens
agtcctgtgaatgccactgcc

SEQ ID NO: 2444793 - DNA, 24 bp, Homo sapiens
agtccttaaaatgtaagattatag

SEQ ID NO: 2444794 - DNA, 14 bp, Homo sapiens
agtccttggcctgc

SEQ ID NO: 2444795 - DNA, 12 bp, Homo sapiens
agtcgtgcctgt

SEQ ID NO: 2444796 - DNA, 17 bp, Homo sapiens
agtcgtggggtgtgctg

SEQ ID NO: 2444797 - DNA, 20 bp, Homo sapiens
agtcgtggggtgtgctggga

SEQ ID NO: 2444798 - DNA, 21 bp, Homo sapiens
agtctaaagctggtttaatgt

SEQ ID NO: 2444799 - DNA, 23 bp, Homo sapiens
agtctagatgtttattcttctag

SEQ ID NO: 2444800 - DNA, 20 bp, Homo sapiens
agtctagattcaaaggttct

SEQ ID NO: 2444801 - DNA, 21 bp, Homo sapiens
agtctagattcaaaggttcta

SEQ ID NO: 2444802 - DNA, 20 bp, Homo sapiens
agtctagattctctggctgt

SEQ ID NO: 2444803 - DNA, 11 bp, Homo sapiens
agtctcagcta

SEQ ID NO: 2444804 - DNA, 18 bp, Homo sapiens
agtctcagctaagctcac

SEQ ID NO: 2444805 - DNA, 23 bp, Homo sapiens
agtctctcttctctccagctgac

SEQ ID NO: 2444806 - DNA, 14 bp, Homo sapiens
agtctgaggtcctg

SEQ ID NO: 2444807 - DNA, 17 bp, Homo sapiens
agtctgaggtcctgagc

SEQ ID NO: 2444808 - DNA, 18 bp, Homo sapiens
agtctgaggtcctgagca

SEQ ID NO: 2444809 - DNA, 22 bp, Homo sapiens
agtctgaggtcctgagcactgc

SEQ ID NO: 2444810 - DNA, 20 bp, Homo sapiens
agtctggataacttccacag

SEQ ID NO: 2444811 - DNA, 21 bp, Homo sapiens
agtctggataacttccacagg

SEQ ID NO: 2444812 - DNA, 23 bp, Homo sapiens
agtctggataacttccacagggt

SEQ ID NO: 2444813 - DNA, 20 bp, Homo sapiens
agtctgtgccacgtgtttgt

SEQ ID NO: 2444814 - DNA, 16 bp, Homo sapiens
agtctgttgattaaag

SEQ ID NO: 2444815 - DNA, 15 bp, Homo sapiens
agtcttccatttgca

SEQ ID NO: 2444816 - DNA, 16 bp, Homo sapiens
agtcttccatttgcaa

SEQ ID NO: 2444817 - DNA, 14 bp, Homo sapiens
agtctttctctttc

SEQ ID NO: 2444818 - DNA, 17 bp, Homo sapiens
agtctttctctttccct

SEQ ID NO: 2444819 - DNA, 20 bp, Homo sapiens
agtctttctctttccctggt

SEQ ID NO: 2444820 - DNA, 23 bp, Homo sapiens
agtctttctctttccctggtccc

SEQ ID NO: 2444821 - DNA, 12 bp, Homo sapiens
agtcttttgctt

SEQ ID NO: 2444822 - DNA, 13 bp, Homo sapiens
agtcttttgcttt

SEQ ID NO: 2444823 - DNA, 22 bp, Homo sapiens
agtcttttgcttttgcccattt

SEQ ID NO: 2444824 - DNA, 17 bp, Homo sapiens
agtcttttgttcgcatg

SEQ ID NO: 2444825 - DNA, 22 bp, Homo sapiens
agtcttttgttcgcatggtcac

SEQ ID NO: 2444826 - DNA, 15 bp, Homo sapiens
agtgaaaactttgta

SEQ ID NO: 2444827 - DNA, 13 bp, Homo sapiens
agtgaaataatgt

SEQ ID NO: 2444828 - DNA, 12 bp, Homo sapiens
agtgaagaatac

SEQ ID NO: 2444829 - DNA, 14 bp, Homo sapiens
agtgaagaatactt

SEQ ID NO: 2444830 - DNA, 14 bp, Homo sapiens
agtgaagacagaag

SEQ ID NO: 2444831 - DNA, 15 bp, Homo sapiens
agttctaagattcta

SEQ ID NO: 2444832 - DNA, 18 bp, Homo sapiens
agttctaagattctaatg

SEQ ID NO: 2444833 - DNA, 18 bp, Homo sapiens
agttctaataatttctaa

SEQ ID NO: 2444834 - DNA, 19 bp, Homo sapiens
agttctaataatttctaat

SEQ ID NO: 2444835 - DNA, 21 bp, Homo sapiens
agttctaataatttctaatgt

SEQ ID NO: 2444836 - DNA, 22 bp, Homo sapiens
agttctacctcaggcagctcaa

SEQ ID NO: 2444837 - DNA, 12 bp, Homo sapiens
agttctagaaaa

SEQ ID NO: 2444838 - DNA, 14 bp, Homo sapiens
agttctagaaaaac

SEQ ID NO: 2444839 - DNA, 22 bp, Homo sapiens
agttctagacatggaggttcta

SEQ ID NO: 2444840 - DNA, 15 bp, Homo sapiens
agttctaggaaaata

SEQ ID NO: 2444841 - DNA, 10 bp, Homo sapiens
agttctaggc

SEQ ID NO: 2444842 - DNA, 22 bp, Homo sapiens
agttctaggcactgtagttcta

SEQ ID NO: 2444843 - DNA, 13 bp, Homo sapiens
agttctccctgta

SEQ ID NO: 2444844 - DNA, 14 bp, Homo sapiens
agttctgctccaga

SEQ ID NO: 2444845 - DNA, 18 bp, Homo sapiens
agttctgctccagacagg

SEQ ID NO: 2444846 - DNA, 22 bp, Homo sapiens
agttctgtggtttcatgttagt

SEQ ID NO: 2444847 - DNA, 18 bp, Homo sapiens
agttctttgggccagaca

SEQ ID NO: 2444848 - DNA, 10 bp, Homo sapiens
agttgaattt

SEQ ID NO: 2444849 - DNA, 18 bp, Homo sapiens
agttgagatagttttcat

SEQ ID NO: 2444850 - DNA, 15 bp, Homo sapiens
agttgatctggaacc

SEQ ID NO: 2444851 - DNA, 20 bp, Homo sapiens
agttgatctggaacccagac

SEQ ID NO: 2444852 - DNA, 13 bp, Homo sapiens
agttgattagaaa

SEQ ID NO: 2444853 - DNA, 15 bp, Homo sapiens
agttgcactcaggtg

SEQ ID NO: 2444854 - DNA, 21 bp, Homo sapiens
agttgcagctgttttgttgac

SEQ ID NO: 2444855 - DNA, 17 bp, Homo sapiens
agttgcagtcactctag

SEQ ID NO: 2444856 - DNA, 15 bp, Homo sapiens
agttgcatgtagtaa

SEQ ID NO: 2444857 - DNA, 18 bp, Homo sapiens
agttgcatgtagtaacac

SEQ ID NO: 2444858 - DNA, 19 bp, Homo sapiens
agttgcatgtagtaacact

SEQ ID NO: 2444859 - DNA, 12 bp, Homo sapiens
agttgctgagag

SEQ ID NO: 2444860 - DNA, 21 bp, Homo sapiens
agttgctgcttctcccaggca

SEQ ID NO: 2444861 - DNA, 17 bp, Homo sapiens
agttggagtcactctta

SEQ ID NO: 2444862 - DNA, 22 bp, Homo sapiens
agttggccatatttacctcagc

SEQ ID NO: 2444863 - DNA, 23 bp, Homo sapiens
agttggccatatttacctcagcc

SEQ ID NO: 2444864 - DNA, 16 bp, Homo sapiens
agttggggacacatgt

SEQ ID NO: 2444865 - DNA, 21 bp, Homo sapiens
agttggggtctggcagcctcc

SEQ ID NO: 2444866 - DNA, 20 bp, Homo sapiens
agttggtaacttttgtgaat

SEQ ID NO: 2444867 - DNA, 22 bp, Homo sapiens
agttgtatttaacagaaattgt

SEQ ID NO: 2444868 - DNA, 19 bp, Homo sapiens
agttgtcaagtctctgctg

SEQ ID NO: 2444869 - DNA, 13 bp, Homo sapiens
agttgtctctgat

SEQ ID NO: 2444870 - DNA, 17 bp, Homo sapiens
agttgtctctgatgcag

SEQ ID NO: 2444871 - DNA, 14 bp, Homo sapiens
agttgtgtttcaac

SEQ ID NO: 2444872 - DNA, 21 bp, Homo sapiens
agttgttcgggccaaggacct

SEQ ID NO: 2444873 - DNA, 12 bp, Homo sapiens
agtttaatgaag

SEQ ID NO: 2444874 - DNA, 20 bp, Homo sapiens
agtttaccagttgcctttta

SEQ ID NO: 2444875 - DNA, 14 bp, Homo sapiens
agtttaccttgtat

SEQ ID NO: 2444876 - DNA, 16 bp, Homo sapiens
agtttaggataaaata

SEQ ID NO: 2444877 - DNA, 18 bp, Homo sapiens
agtttagggaacaatttg

SEQ ID NO: 2444878 - DNA, 24 bp, Homo sapiens
agtttagggaacaatttggcaatt

SEQ ID NO: 2444879 - DNA, 16 bp, Homo sapiens
agtttatcattcaagt

SEQ ID NO: 2444880 - DNA, 18 bp, Homo sapiens
agtttcatgtacaagatg

SEQ ID NO: 2444881 - DNA, 18 bp, Homo sapiens
agtttctaaactggagac

SEQ ID NO: 2444882 - DNA, 19 bp, Homo sapiens
agtttctaaactggagact

SEQ ID NO: 2444883 - DNA, 18 bp, Homo sapiens
agtttctaagattctaaa

SEQ ID NO: 2444884 - DNA, 19 bp, Homo sapiens
agtttctaagattctaaag

SEQ ID NO: 2444885 - DNA, 12 bp, Homo sapiens
agtttctaaggt

SEQ ID NO: 2444886 - DNA, 23 bp, Homo sapiens
agtttctaaggtccggtgttcta

SEQ ID NO: 2444887 - DNA, 12 bp, Homo sapiens
agtttgaaataa

SEQ ID NO: 2444888 - DNA, 13 bp, Homo sapiens
agtttgaaataag

SEQ ID NO: 2444889 - DNA, 18 bp, Homo sapiens
agtttgaaataagctatt

SEQ ID NO: 2444890 - DNA, 17 bp, Homo sapiens
agtttgatgaggccctc

SEQ ID NO: 2444891 - DNA, 18 bp, Homo sapiens
agtttgattattcagtgt

SEQ ID NO: 2444892 - DNA, 16 bp, Homo sapiens
agtttggatatgtaaa

SEQ ID NO: 2444893 - DNA, 22 bp, Homo sapiens
agtttggatatgtaaaacattt

SEQ ID NO: 2444894 - DNA, 13 bp, Homo sapiens
agtttgggtaaaa

SEQ ID NO: 2444895 - DNA, 17 bp, Homo sapiens
agtttgtcgctcatgtg

SEQ ID NO: 2444896 - DNA, 14 bp, Homo sapiens
agtttgtgtgtctt

SEQ ID NO: 2444897 - DNA, 21 bp, Homo sapiens
agtttgtgtgttgtctcttga

SEQ ID NO: 2444898 - DNA, 18 bp, Homo sapiens
agttttaactgtggatat

SEQ ID NO: 2444899 - DNA, 12 bp, Homo sapiens
agttttatatat

SEQ ID NO: 2444900 - DNA, 16 bp, Homo sapiens
agttttatatattata

SEQ ID NO: 2444901 - DNA, 21 bp, Homo sapiens
agttttcatccataactgaac

SEQ ID NO: 2444902 - DNA, 16 bp, Homo sapiens
agttttcctatgcttt

SEQ ID NO: 2444903 - DNA, 16 bp, Homo sapiens
agttttgtgtttgttg

SEQ ID NO: 2444904 - DNA, 21 bp, Homo sapiens
agttttgtgtttgttgtagat

SEQ ID NO: 2444905 - DNA, 16 bp, Homo sapiens
agtttttatgagaaac

SEQ ID NO: 2444906 - DNA, 18 bp, Homo sapiens
agtttttatgagaaactt

SEQ ID NO: 2444907 - DNA, 9 bp, Homo sapiens
agtttttca

SEQ ID NO: 2444908 - DNA, 22 bp, Homo sapiens
agtttttcattaaataaatttg

SEQ ID NO: 2444909 - DNA, 12 bp, Homo sapiens
agttttttcatc

SEQ ID NO: 2444910 - DNA, 15 bp, Homo sapiens
agttttttgtaccaa

SEQ ID NO: 2444911 - DNA, 18 bp, Homo sapiens
agttttttttttcttgtc

SEQ ID NO: 2444912 - DNA, 22 bp, Homo sapiens
agttttttttttcttgtctata

SEQ ID NO: 2444913 - DNA, 13 bp, Homo sapiens
ataaaacattaat

SEQ ID NO: 2444914 - DNA, 12 bp, Homo sapiens
ataaaagaaaat

SEQ ID NO: 2444915 - DNA, 20 bp, Homo sapiens
ataaaaggaagccaaagagt

SEQ ID NO: 2444916 - DNA, 21 bp, Homo sapiens
ataaacccagttgccatctgc

SEQ ID NO: 2444917 - DNA, 16 bp, Homo sapiens
ataaactttaatataa

SEQ ID NO: 2444918 - DNA, 19 bp, Homo sapiens
ataaagaaaagatgcactt

SEQ ID NO: 2444919 - DNA, 24 bp, Homo sapiens
ataaagacgttttataagcatcat

SEQ ID NO: 2444920 - DNA, 18 bp, Homo sapiens
ataaagattttttaataa

SEQ ID NO: 2444921 - DNA, 22 bp, Homo sapiens
ataaagcctcaaggttttaggt

SEQ ID NO: 2444922 - DNA, 18 bp, Homo sapiens
ataaaggaaaagacacat

SEQ ID NO: 2444923 - DNA, 19 bp, Homo sapiens
ataaagtgtaacaattgtg

SEQ ID NO: 2444924 - DNA, 15 bp, Homo sapiens
ataaagttctgtact

SEQ ID NO: 2444925 - DNA, 17 bp, Homo sapiens
ataaagttgataaagat

SEQ ID NO: 2444926 - DNA, 14 bp, Homo sapiens
ataaagttttatat

SEQ ID NO: 2444927 - DNA, 21 bp, Homo sapiens
ataaagttttatatattatat

SEQ ID NO: 2444928 - DNA, 15 bp, Homo sapiens
ataaatctgacccag

SEQ ID NO: 2444929 - DNA, 18 bp, Homo sapiens
ataaatgtaccagagaga

SEQ ID NO: 2444930 - DNA, 13 bp, Homo sapiens
ataaattgctcaa

SEQ ID NO: 2444931 - DNA, 20 bp, Homo sapiens
ataaatttgacttttctgta

SEQ ID NO: 2444932 - DNA, 21 bp, Homo sapiens
ataacaaatgccaaattaaaa

SEQ ID NO: 2444933 - DNA, 12 bp, Homo sapiens
ataacccacttt

SEQ ID NO: 2444934 - DNA, 17 bp, Homo sapiens
ataacgtttaagccaaa

SEQ ID NO: 2444935 - DNA, 21 bp, Homo sapiens
atacttttttttctttaaaaa

SEQ ID NO: 2444936 - DNA, 22 bp, Homo sapiens
atagaaataaaggatgtgattg

SEQ ID NO: 2444937 - DNA, 12 bp, Homo sapiens
atagaaatgcca

SEQ ID NO: 2444938 - DNA, 18 bp, Homo sapiens
atagaagtataaagaatt

SEQ ID NO: 2444939 - DNA, 18 bp, Homo sapiens
atagacagaagaaacaag

SEQ ID NO: 2444940 - DNA, 19 bp, Homo sapiens
atagagccgggtgtcccca

SEQ ID NO: 2444941 - DNA, 20 bp, Homo sapiens
atagagccgggtgtccccaa

SEQ ID NO: 2444942 - DNA, 13 bp, Homo sapiens
atagagctgtatt

SEQ ID NO: 2444943 - DNA, 21 bp, Homo sapiens
atagataccctacgctgtcca

SEQ ID NO: 2444944 - DNA, 13 bp, Homo sapiens
atagatgtctttt

SEQ ID NO: 2444945 - DNA, 12 bp, Homo sapiens
atagatgtttga

SEQ ID NO: 2444946 - DNA, 18 bp, Homo sapiens
atagattctaaagattct

SEQ ID NO: 2444947 - DNA, 19 bp, Homo sapiens
atagattctcttgtataag

SEQ ID NO: 2444948 - DNA, 20 bp, Homo sapiens
atagattgtccttttgcaaa

SEQ ID NO: 2444949 - DNA, 15 bp, Homo sapiens
atagcaaaagaagaa

SEQ ID NO: 2444950 - DNA, 19 bp, Homo sapiens
atagcaaaagaagaagttt

SEQ ID NO: 2444951 - DNA, 15 bp, Homo sapiens
atagcaatacttgga

SEQ ID NO: 2444952 - DNA, 15 bp, Homo sapiens
atagcattgtaaaag

SEQ ID NO: 2444953 - DNA, 16 bp, Homo sapiens
atagccaaaaatagct

SEQ ID NO: 2444954 - DNA, 13 bp, Homo sapiens
atagccactaacc

SEQ ID NO: 2444955 - DNA, 15 bp, Homo sapiens
atagccactaacctt

SEQ ID NO: 2444956 - DNA, 20 bp, Homo sapiens
atagccactaaccttgcctg

SEQ ID NO: 2444957 - DNA, 20 bp, Homo sapiens
atagccatatttgtaaaatg

SEQ ID NO: 2444958 - DNA, 15 bp, Homo sapiens
atagccctgtcctgg

SEQ ID NO: 2444959 - DNA, 14 bp, Homo sapiens
atagcgttcttgta

SEQ ID NO: 2444960 - DNA, 15 bp, Homo sapiens
atagcgttcttgtaa

SEQ ID NO: 2444961 - DNA, 17 bp, Homo sapiens
atagctgcttccagtgt

SEQ ID NO: 2444962 - DNA, 19 bp, Homo sapiens
ataggcggggcttgccttc

SEQ ID NO: 2444963 - DNA, 15 bp, Homo sapiens
atagggtatttgacc

SEQ ID NO: 2444964 - DNA, 20 bp, Homo sapiens
atagggtttgtgacagggcg

SEQ ID NO: 2444965 - DNA, 16 bp, Homo sapiens
atagtctttggagaaa

SEQ ID NO: 2444966 - DNA, 18 bp, Homo sapiens
atagtctttttcagttcc

SEQ ID NO: 2444967 - DNA, 21 bp, Homo sapiens
atagttcagaatttagtgtat

SEQ ID NO: 2444968 - DNA, 15 bp, Homo sapiens
atagttcctgctaaa

SEQ ID NO: 2444969 - DNA, 14 bp, Homo sapiens
atagttctagacat

SEQ ID NO: 2444970 - DNA, 23 bp, Homo sapiens
atagttctagacatggaggttct

SEQ ID NO: 2444971 - DNA, 13 bp, Homo sapiens
atagtttctgagg

SEQ ID NO: 2444972 - DNA, 23 bp, Homo sapiens
atagtttggatatgtaaaacatt

SEQ ID NO: 2444973 - DNA, 14 bp, Homo sapiens
atataaaatatgaa

SEQ ID NO: 2444974 - DNA, 20 bp, Homo sapiens
atataaagacgttttataag

SEQ ID NO: 2444975 - DNA, 22 bp, Homo sapiens
atataaagacgttttataagca

SEQ ID NO: 2444976 - DNA, 22 bp, Homo sapiens
atataaagttttatatattata

SEQ ID NO: 2444977 - DNA, 12 bp, Homo sapiens
atataaatgcaa

SEQ ID NO: 2444978 - DNA, 14 bp, Homo sapiens
atataaatgcaaat

SEQ ID NO: 2444979 - DNA, 17 bp, Homo sapiens
atataaatgcaaataac

SEQ ID NO: 2444980 - DNA, 18 bp, Homo sapiens
atataagtgtacatatgt

SEQ ID NO: 2444981 - DNA, 21 bp, Homo sapiens
atataataaatgtacattaat

SEQ ID NO: 2444982 - DNA, 21 bp, Homo sapiens
atataatgttgttatttaaag

SEQ ID NO: 2444983 - DNA, 18 bp, Homo sapiens
atataattgttttatctg

SEQ ID NO: 2444984 - DNA, 20 bp, Homo sapiens
atatactttgaaaggagatg

SEQ ID NO: 2444985 - DNA, 11 bp, Homo sapiens
atatacttttt

SEQ ID NO: 2444986 - DNA, 20 bp, Homo sapiens
atatagaagtataaagaatt

SEQ ID NO: 2444987 - DNA, 11 bp, Homo sapiens
atatataaata

SEQ ID NO: 2444988 - DNA, 18 bp, Homo sapiens
atatataaatatattatt

SEQ ID NO: 2444989 - DNA, 15 bp, Homo sapiens
atatataagtgtaca

SEQ ID NO: 2444990 - DNA, 15 bp, Homo sapiens
atatatatataaaga

SEQ ID NO: 2444991 - DNA, 12 bp, Homo sapiens
atatatattata

SEQ ID NO: 2444992 - DNA, 16 bp, Homo sapiens
atatatattatctttt

SEQ ID NO: 2444993 - DNA, 12 bp, Homo sapiens
atatatgtattt

SEQ ID NO: 2444994 - DNA, 14 bp, Homo sapiens
atatattatacttg

SEQ ID NO: 2444995 - DNA, 14 bp, Homo sapiens
atatattatctttt

SEQ ID NO: 2444996 - DNA, 15 bp, Homo sapiens
atatattatcttttc

SEQ ID NO: 2444997 - DNA, 18 bp, Homo sapiens
atatattattacttgtaa

SEQ ID NO: 2444998 - DNA, 18 bp, Homo sapiens
atatatttaaaagtgtca

SEQ ID NO: 2444999 - DNA, 16 bp, Homo sapiens
atatattttgtttaca

SEQ ID NO: 2445000 - DNA, 14 bp, Homo sapiens
atatcacacacatt

SEQ ID NO: 2445001 - DNA, 21 bp, Homo sapiens
atatcataatgggggtaaagt

SEQ ID NO: 2445002 - DNA, 16 bp, Homo sapiens
atatcatccacacatg

SEQ ID NO: 2445003 - DNA, 16 bp, Homo sapiens
atatccctacatgtat

SEQ ID NO: 2445004 - DNA, 17 bp, Homo sapiens
atatccctacatgtatt

SEQ ID NO: 2445005 - DNA, 15 bp, Homo sapiens
atatcctaaacatca

SEQ ID NO: 2445006 - DNA, 13 bp, Homo sapiens
atatctcctgaaa

SEQ ID NO: 2445007 - DNA, 22 bp, Homo sapiens
atatctcctgaaaaggtttatg

SEQ ID NO: 2445008 - DNA, 19 bp, Homo sapiens
atatcttggacaaatcaca

SEQ ID NO: 2445009 - DNA, 20 bp, Homo sapiens
atatcttggacaaatcacat

SEQ ID NO: 2445010 - DNA, 15 bp, Homo sapiens
atatgatgttaaaaa

SEQ ID NO: 2445011 - DNA, 15 bp, Homo sapiens
atatgcacaatagca

SEQ ID NO: 2445012 - DNA, 13 bp, Homo sapiens
atatgcacttata

SEQ ID NO: 2445013 - DNA, 21 bp, Homo sapiens
atatgctaccaccagctgtgt

SEQ ID NO: 2445014 - DNA, 19 bp, Homo sapiens
atatgcttaaaataagcag

SEQ ID NO: 2445015 - DNA, 14 bp, Homo sapiens
atatgtaaaacatt

SEQ ID NO: 2445016 - DNA, 22 bp, Homo sapiens
atatgtaaatggtatgtcattc

SEQ ID NO: 2445017 - DNA, 17 bp, Homo sapiens
atatgtatgggtagggt

SEQ ID NO: 2445018 - DNA, 23 bp, Homo sapiens
atatgtatgggtagggtaaatca

SEQ ID NO: 2445019 - DNA, 11 bp, Homo sapiens
atatgtcctgg

SEQ ID NO: 2445020 - DNA, 15 bp, Homo sapiens
atatgttgaatactt

SEQ ID NO: 2445021 - DNA, 16 bp, Homo sapiens
atatgttgaatacttt

SEQ ID NO: 2445022 - DNA, 19 bp, Homo sapiens
atattaaccagatatatat

SEQ ID NO: 2445023 - DNA, 16 bp, Homo sapiens
atattaatgcccagac

SEQ ID NO: 2445024 - DNA, 15 bp, Homo sapiens
atattacactacaca

SEQ ID NO: 2445025 - DNA, 12 bp, Homo sapiens
atattatatgga

SEQ ID NO: 2445026 - DNA, 20 bp, Homo sapiens
atattatatggaaatatata

SEQ ID NO: 2445027 - DNA, 15 bp, Homo sapiens
atattatgagatgct

SEQ ID NO: 2445028 - DNA, 12 bp, Homo sapiens
atattattactt

SEQ ID NO: 2445029 - DNA, 23 bp, Homo sapiens
atattattataatcttataattg

SEQ ID NO: 2445030 - DNA, 17 bp, Homo sapiens
atattccctagaaactt

SEQ ID NO: 2445031 - DNA, 13 bp, Homo sapiens
atattctaagact

SEQ ID NO: 2445032 - DNA, 15 bp, Homo sapiens
atattgacttgtata

SEQ ID NO: 2445033 - DNA, 17 bp, Homo sapiens
atattgagtcaaatggt

SEQ ID NO: 2445034 - DNA, 12 bp, Homo sapiens
atattggaactt

SEQ ID NO: 2445035 - DNA, 19 bp, Homo sapiens
atattggacaaagaacctt

SEQ ID NO: 2445036 - DNA, 19 bp, Homo sapiens
atattgtgggtgttaattt

SEQ ID NO: 2445037 - DNA, 17 bp, Homo sapiens
atattgtgtttgtgtat

SEQ ID NO: 2445038 - DNA, 21 bp, Homo sapiens
atattgtgtttgtgtatttac

SEQ ID NO: 2445039 - DNA, 20 bp, Homo sapiens
atattgttgcattgcttttt

SEQ ID NO: 2445040 - DNA, 20 bp, Homo sapiens
atccccaacatgcactgatg

SEQ ID NO: 2445041 - DNA, 20 bp, Homo sapiens
atccccttctcccctgcact

SEQ ID NO: 2445042 - DNA, 21 bp, Homo sapiens
atccccttctcccctgcactg

SEQ ID NO: 2445043 - DNA, 22 bp, Homo sapiens
atccccttctcccctgcactgt

SEQ ID NO: 2445044 - DNA, 14 bp, Homo sapiens
atcccgagcacctc

SEQ ID NO: 2445045 - DNA, 16 bp, Homo sapiens
atcccgtgttctcctt

SEQ ID NO: 2445046 - DNA, 12 bp, Homo sapiens
atccctacatgt

SEQ ID NO: 2445047 - DNA, 13 bp, Homo sapiens
atccctacatgta

SEQ ID NO: 2445048 - DNA, 18 bp, Homo sapiens
atccctacatgtattgca

SEQ ID NO: 2445049 - DNA, 14 bp, Homo sapiens
atccctcacctgta

SEQ ID NO: 2445050 - DNA, 18 bp, Homo sapiens
atccctcaccttctgagt

SEQ ID NO: 2445051 - DNA, 21 bp, Homo sapiens
atccctcccccccatgcactg

SEQ ID NO: 2445052 - DNA, 15 bp, Homo sapiens
atccctcctgttggg

SEQ ID NO: 2445053 - DNA, 22 bp, Homo sapiens
atccctctacagagcttccctg

SEQ ID NO: 2445054 - DNA, 14 bp, Homo sapiens
atccctctcctccc

SEQ ID NO: 2445055 - DNA, 15 bp, Homo sapiens
atccctgaggactga

SEQ ID NO: 2445056 - DNA, 18 bp, Homo sapiens
atccctgaggactgattt

SEQ ID NO: 2445057 - DNA, 12 bp, Homo sapiens
atccctggcccc

SEQ ID NO: 2445058 - DNA, 15 bp, Homo sapiens
atccctgggcctgct

SEQ ID NO: 2445059 - DNA, 18 bp, Homo sapiens
atccctgggcctgctgct

SEQ ID NO: 2445060 - DNA, 21 bp, Homo sapiens
atccctgggcctgctgctgag

SEQ ID NO: 2445061 - DNA, 22 bp, Homo sapiens
atccctgggcctgctgctgaga

SEQ ID NO: 2445062 - DNA, 20 bp, Homo sapiens
atcccttaatatcctaaaca

SEQ ID NO: 2445063 - DNA, 21 bp, Homo sapiens
atcccttaatatcctaaacat

SEQ ID NO: 2445064 - DNA, 14 bp, Homo sapiens
atccgccaatatta

SEQ ID NO: 2445065 - DNA, 13 bp, Homo sapiens
atccggaaagaag

SEQ ID NO: 2445066 - DNA, 17 bp, Homo sapiens
atcctaagcatctaagt

SEQ ID NO: 2445067 - DNA, 18 bp, Homo sapiens
atcctaagcatctaagtt

SEQ ID NO: 2445068 - DNA, 23 bp, Homo sapiens
atcctaagggtcgaaagctctag

SEQ ID NO: 2445069 - DNA, 22 bp, Homo sapiens
atcctatgcatggtttcagcac

SEQ ID NO: 2445070 - DNA, 18 bp, Homo sapiens
atcctcaaagaaagtgta

SEQ ID NO: 2445071 - DNA, 19 bp, Homo sapiens
atcctcaaagaaagtgtat

SEQ ID NO: 2445072 - DNA, 12 bp, Homo sapiens
atcctcaatcca

SEQ ID NO: 2445073 - DNA, 16 bp, Homo sapiens
atcctccctgtaactt

SEQ ID NO: 2445074 - DNA, 15 bp, Homo sapiens
atcctcccttcctcc

SEQ ID NO: 2445075 - DNA, 11 bp, Homo sapiens
atcctcctccc

SEQ ID NO: 2445076 - DNA, 14 bp, Homo sapiens
atcctcctcccacc

SEQ ID NO: 2445077 - DNA, 15 bp, Homo sapiens
atcctctcttcctct

SEQ ID NO: 2445078 - DNA, 17 bp, Homo sapiens
atcctctggagccagcc

SEQ ID NO: 2445079 - DNA, 15 bp, Homo sapiens
atcctctttttccaa

SEQ ID NO: 2445080 - DNA, 16 bp, Homo sapiens
atcctgcgggtggggc

SEQ ID NO: 2445081 - DNA, 16 bp, Homo sapiens
atcctggaggcccagt

SEQ ID NO: 2445082 - DNA, 20 bp, Homo sapiens
atcctggaggcccagttcac

SEQ ID NO: 2445083 - DNA, 17 bp, Homo sapiens
atcctgtggtcactgac

SEQ ID NO: 2445084 - DNA, 21 bp, Homo sapiens
atcctgtgtggagagggaatg

SEQ ID NO: 2445085 - DNA, 11 bp, Homo sapiens
atcctgtgtgt

SEQ ID NO: 2445086 - DNA, 18 bp, Homo sapiens
atccttagatctggcatg

SEQ ID NO: 2445087 - DNA, 15 bp, Homo sapiens
atcgaaccgttttga

SEQ ID NO: 2445088 - DNA, 18 bp, Homo sapiens
atcgaatctactaattcc

SEQ ID NO: 2445089 - DNA, 20 bp, Homo sapiens
atcgaatctactaattccac

SEQ ID NO: 2445090 - DNA, 13 bp, Homo sapiens
atcgaatgaaatt

SEQ ID NO: 2445091 - DNA, 12 bp, Homo sapiens
atcgcctttccc

SEQ ID NO: 2445092 - DNA, 13 bp, Homo sapiens
atcggaaaaataa

SEQ ID NO: 2445093 - DNA, 17 bp, Homo sapiens
atcgttttcttaaagtg

SEQ ID NO: 2445094 - DNA, 19 bp, Homo sapiens
atctaaaaatagacttaaa

SEQ ID NO: 2445095 - DNA, 23 bp, Homo sapiens
atctaaaaatagacttaaatctc

SEQ ID NO: 2445096 - DNA, 16 bp, Homo sapiens
atctaaataaaatgct

SEQ ID NO: 2445097 - DNA, 13 bp, Homo sapiens
atctaagtgatat

SEQ ID NO: 2445098 - DNA, 15 bp, Homo sapiens
atctaagtgatataa

SEQ ID NO: 2445099 - DNA, 13 bp, Homo sapiens
atctaatttataa

SEQ ID NO: 2445100 - DNA, 22 bp, Homo sapiens
atctaccccagactagatgtag

SEQ ID NO: 2445101 - DNA, 15 bp, Homo sapiens
atctacctagattta

SEQ ID NO: 2445102 - DNA, 19 bp, Homo sapiens
atctactaattccacacct

SEQ ID NO: 2445103 - DNA, 20 bp, Homo sapiens
atctacttctgtaattgtgt

SEQ ID NO: 2445104 - DNA, 18 bp, Homo sapiens
atctaggcaacatagtat

SEQ ID NO: 2445105 - DNA, 22 bp, Homo sapiens
atctagttatttacaggaactt

SEQ ID NO: 2445106 - DNA, 16 bp, Homo sapiens
atctataatttaccta

SEQ ID NO: 2445107 - DNA, 19 bp, Homo sapiens
atctatttcatgtttttga

SEQ ID NO: 2445108 - DNA, 14 bp, Homo sapiens
atctattttggatt

SEQ ID NO: 2445109 - DNA, 15 bp, Homo sapiens
atctatttttggagg

SEQ ID NO: 2445110 - DNA, 15 bp, Homo sapiens
atctcaacaggcctc

SEQ ID NO: 2445111 - DNA, 22 bp, Homo sapiens
atctcaccaggcagcctctggg

SEQ ID NO: 2445112 - DNA, 19 bp, Homo sapiens
atctcagaaagtgcctgac

SEQ ID NO: 2445113 - DNA, 17 bp, Homo sapiens
atctcaggccagagcca

SEQ ID NO: 2445114 - DNA, 22 bp, Homo sapiens
atctcagtatgaattattcaat

SEQ ID NO: 2445115 - DNA, 20 bp, Homo sapiens
atctcagtgaagaatacttc

SEQ ID NO: 2445116 - DNA, 19 bp, Homo sapiens
atctcatctcagtgaagaa

SEQ ID NO: 2445117 - DNA, 23 bp, Homo sapiens
atctcatgcccctggctgggacg

SEQ ID NO: 2445118 - DNA, 14 bp, Homo sapiens
atctcattggaccc

SEQ ID NO: 2445119 - DNA, 15 bp, Homo sapiens
atctccaagcagctt

SEQ ID NO: 2445120 - DNA, 17 bp, Homo sapiens
atctccaagcagcttag

SEQ ID NO: 2445121 - DNA, 18 bp, Homo sapiens
atctcccacctagcagca

SEQ ID NO: 2445122 - DNA, 19 bp, Homo sapiens
atctcccagataatgtgaa

SEQ ID NO: 2445123 - DNA, 20 bp, Homo sapiens
atctcccagataatgtgaaa

SEQ ID NO: 2445124 - DNA, 18 bp, Homo sapiens
atctcccattttggaatt

SEQ ID NO: 2445125 - DNA, 19 bp, Homo sapiens
atctccctgcctcctgccg

SEQ ID NO: 2445126 - DNA, 18 bp, Homo sapiens
atctccctggtgcttatg

SEQ ID NO: 2445127 - DNA, 16 bp, Homo sapiens
atctcctgccttcctc

SEQ ID NO: 2445128 - DNA, 23 bp, Homo sapiens
atctctccctcccctgccatttt

SEQ ID NO: 2445129 - DNA, 15 bp, Homo sapiens
atctctgtgccttcg

SEQ ID NO: 2445130 - DNA, 16 bp, Homo sapiens
atctcttattttacaa

SEQ ID NO: 2445131 - DNA, 18 bp, Homo sapiens
atctgaatttttaaacaa

SEQ ID NO: 2445132 - DNA, 13 bp, Homo sapiens
atctgacccagtg

SEQ ID NO: 2445133 - DNA, 21 bp, Homo sapiens
atctgacccagtgcccccact

SEQ ID NO: 2445134 - DNA, 16 bp, Homo sapiens
atctgagtcagagcca

SEQ ID NO: 2445135 - DNA, 17 bp, Homo sapiens
atctgagtcctggatga

SEQ ID NO: 2445136 - DNA, 18 bp, Homo sapiens
atctgatcagaacaaatg

SEQ ID NO: 2445137 - DNA, 19 bp, Homo sapiens
atctgatcagaacaaatgt

SEQ ID NO: 2445138 - DNA, 19 bp, Homo sapiens
atctgcattttcaccccac

SEQ ID NO: 2445139 - DNA, 22 bp, Homo sapiens
atctgcattttcaccccaccct

SEQ ID NO: 2445140 - DNA, 16 bp, Homo sapiens
atctgccaagggccga

SEQ ID NO: 2445141 - DNA, 21 bp, Homo sapiens
atctgcgtgacaataaaacat

SEQ ID NO: 2445142 - DNA, 11 bp, Homo sapiens
atctggaaccc

SEQ ID NO: 2445143 - DNA, 14 bp, Homo sapiens
atctggaacccaga

SEQ ID NO: 2445144 - DNA, 20 bp, Homo sapiens
atgataaagagacagtgata

SEQ ID NO: 2445145 - DNA, 12 bp, Homo sapiens
atgataatgaac

SEQ ID NO: 2445146 - DNA, 17 bp, Homo sapiens
atgatacagcagagcta

SEQ ID NO: 2445147 - DNA, 20 bp, Homo sapiens
atgatcaattatagtttctg

SEQ ID NO: 2445148 - DNA, 22 bp, Homo sapiens
atgatgcctctgtcttctggac

SEQ ID NO: 2445149 - DNA, 22 bp, Homo sapiens
atgatgcttctataattttgcc

SEQ ID NO: 2445150 - DNA, 15 bp, Homo sapiens
atgatggatgccaat

SEQ ID NO: 2445151 - DNA, 19 bp, Homo sapiens
atgatggatgccaatatta

SEQ ID NO: 2445152 - DNA, 22 bp, Homo sapiens
atgatgttaaaaaaataagaag

SEQ ID NO: 2445153 - DNA, 19 bp, Homo sapiens
atgattactggcctttttc

SEQ ID NO: 2445154 - DNA, 22 bp, Homo sapiens
atgattagaaattacctgtgga

SEQ ID NO: 2445155 - DNA, 23 bp, Homo sapiens
atgattctatttatatgtacatg

SEQ ID NO: 2445156 - DNA, 14 bp, Homo sapiens
atgatttcatttca

SEQ ID NO: 2445157 - DNA, 19 bp, Homo sapiens
atgatttttctttacaaaa

SEQ ID NO: 2445158 - DNA, 17 bp, Homo sapiens
atgcaaaaactctttga

SEQ ID NO: 2445159 - DNA, 23 bp, Homo sapiens
atgcaaaaactctttgagagggt

SEQ ID NO: 2445160 - DNA, 12 bp, Homo sapiens
atgcaaactctt

SEQ ID NO: 2445161 - DNA, 21 bp, Homo sapiens
atgcaatatactggaaagctt

SEQ ID NO: 2445162 - DNA, 16 bp, Homo sapiens
atgcacaagaatggat

SEQ ID NO: 2445163 - DNA, 18 bp, Homo sapiens
atgcacagtatttgtaat

SEQ ID NO: 2445164 - DNA, 21 bp, Homo sapiens
atgcaccaccaagccaaggga

SEQ ID NO: 2445165 - DNA, 23 bp, Homo sapiens
atgcacctaaagaaaaacaaact

SEQ ID NO: 2445166 - DNA, 18 bp, Homo sapiens
atgcactgtgaaggaccc

SEQ ID NO: 2445167 - DNA, 19 bp, Homo sapiens
atgcactgtgaaggaccct

SEQ ID NO: 2445168 - DNA, 20 bp, Homo sapiens
atgcactgtgaaggaccctt

SEQ ID NO: 2445169 - DNA, 18 bp, Homo sapiens
atgcactttgctttaata

SEQ ID NO: 2445170 - DNA, 20 bp, Homo sapiens
atgcactttgctttaatata

SEQ ID NO: 2445171 - DNA, 23 bp, Homo sapiens
atgcactttgctttaatataaat

SEQ ID NO: 2445172 - DNA, 21 bp, Homo sapiens
atgcagaatgttgattacagt

SEQ ID NO: 2445173 - DNA, 13 bp, Homo sapiens
atgcagaggcctg

SEQ ID NO: 2445174 - DNA, 21 bp, Homo sapiens
atgcagaggcctgcagggcct

SEQ ID NO: 2445175 - DNA, 13 bp, Homo sapiens
atgcagctcaaga

SEQ ID NO: 2445176 - DNA, 15 bp, Homo sapiens
atgcagctgtggcag

SEQ ID NO: 2445177 - DNA, 16 bp, Homo sapiens
atgcagttgtctctgt

SEQ ID NO: 2445178 - DNA, 15 bp, Homo sapiens
atgcatcagaaaggg

SEQ ID NO: 2445179 - DNA, 17 bp, Homo sapiens
atgcatgcactgttccc

SEQ ID NO: 2445180 - DNA, 17 bp, Homo sapiens
atgcatggtgccccagg

SEQ ID NO: 2445181 - DNA, 22 bp, Homo sapiens
atgcatggtgccccaggaccag

SEQ ID NO: 2445182 - DNA, 16 bp, Homo sapiens
atgcatggtttcagca

SEQ ID NO: 2445183 - DNA, 18 bp, Homo sapiens
atgcatggtttcagcact

SEQ ID NO: 2445184 - DNA, 14 bp, Homo sapiens
atgcattcttctct

SEQ ID NO: 2445185 - DNA, 19 bp, Homo sapiens
atgcatttgggtccaggag

SEQ ID NO: 2445186 - DNA, 22 bp, Homo sapiens
atgccaaattaaaaaagataaa

SEQ ID NO: 2445187 - DNA, 13 bp, Homo sapiens
atgccacagccct

SEQ ID NO: 2445188 - DNA, 14 bp, Homo sapiens
atgccacagccctg

SEQ ID NO: 2445189 - DNA, 17 bp, Homo sapiens
atgccagccaagctctg

SEQ ID NO: 2445190 - DNA, 16 bp, Homo sapiens
atgccagctacttcct

SEQ ID NO: 2445191 - DNA, 16 bp, Homo sapiens
atgcccagagacccag

SEQ ID NO: 2445192 - DNA, 23 bp, Homo sapiens
atgccctgctctgaacacgaagc

SEQ ID NO: 2445193 - DNA, 21 bp, Homo sapiens
atgcctatggtggatccaaac

SEQ ID NO: 2445194 - DNA, 15 bp, Homo sapiens
atgcctcagaagtgc

SEQ ID NO: 2445195 - DNA, 16 bp, Homo sapiens
atgcctcagaagtgca

SEQ ID NO: 2445196 - DNA, 23 bp, Homo sapiens
atgcctcagaagtgcatctggag

SEQ ID NO: 2445197 - DNA, 13 bp, Homo sapiens
atgcctctgaggc

SEQ ID NO: 2445198 - DNA, 17 bp, Homo sapiens
atgcctctgaggccagc

SEQ ID NO: 2445199 - DNA, 19 bp, Homo sapiens
atgcctctgaggccagcct

SEQ ID NO: 2445200 - DNA, 21 bp, Homo sapiens
atgcctctgaggccagcctgg

SEQ ID NO: 2445201 - DNA, 23 bp, Homo sapiens
atgcgctcagggccatgctgagg

SEQ ID NO: 2445202 - DNA, 14 bp, Homo sapiens
atgcggtagccagc

SEQ ID NO: 2445203 - DNA, 15 bp, Homo sapiens
atgcggtagccagca

SEQ ID NO: 2445204 - DNA, 19 bp, Homo sapiens
atgcggttaattttgaagt

SEQ ID NO: 2445205 - DNA, 17 bp, Homo sapiens
atgctaacatctaaaaa

SEQ ID NO: 2445206 - DNA, 16 bp, Homo sapiens
atgctaagagaagtag

SEQ ID NO: 2445207 - DNA, 17 bp, Homo sapiens
atgctaagagaagtaga

SEQ ID NO: 2445208 - DNA, 22 bp, Homo sapiens
atgctaagagaagtagaaatca

SEQ ID NO: 2445209 - DNA, 16 bp, Homo sapiens
atgctaccaccagctg

SEQ ID NO: 2445210 - DNA, 22 bp, Homo sapiens
atgctaccaccagctgtgtcca

SEQ ID NO: 2445211 - DNA, 15 bp, Homo sapiens
atgctccaagattct

SEQ ID NO: 2445212 - DNA, 16 bp, Homo sapiens
atgctccaagattcta

SEQ ID NO: 2445213 - DNA, 17 bp, Homo sapiens
atgctccaagattctag

SEQ ID NO: 2445214 - DNA, 16 bp, Homo sapiens
atgctcctcttcccca

SEQ ID NO: 2445215 - DNA, 19 bp, Homo sapiens
atgctcctcttccccagac

SEQ ID NO: 2445216 - DNA, 16 bp, Homo sapiens
atgctccttgggccct

SEQ ID NO: 2445217 - DNA, 15 bp, Homo sapiens
atgctcttaattgcc

SEQ ID NO: 2445218 - DNA, 19 bp, Homo sapiens
atgctcttaattgccacct

SEQ ID NO: 2445219 - DNA, 23 bp, Homo sapiens
atgctgaatatacagcaggtgct

SEQ ID NO: 2445220 - DNA, 14 bp, Homo sapiens
atgctgctggggaa

SEQ ID NO: 2445221 - DNA, 16 bp, Homo sapiens
atgctgctggggaaga

SEQ ID NO: 2445222 - DNA, 18 bp, Homo sapiens
atgctgctggggaagaca

SEQ ID NO: 2445223 - DNA, 12 bp, Homo sapiens
atgctggcccag

SEQ ID NO: 2445224 - DNA, 18 bp, Homo sapiens
atgctggcccagggccca

SEQ ID NO: 2445225 - DNA, 21 bp, Homo sapiens
atgctggcccagggcccagag

SEQ ID NO: 2445226 - DNA, 22 bp, Homo sapiens
atgctggctatagatgtctttt

SEQ ID NO: 2445227 - DNA, 10 bp, Homo sapiens
atgctgggac

SEQ ID NO: 2445228 - DNA, 16 bp, Homo sapiens
atgctgggactcagcc

SEQ ID NO: 2445229 - DNA, 12 bp, Homo sapiens
atgctgtacatc

SEQ ID NO: 2445230 - DNA, 13 bp, Homo sapiens
atgctgtacccag

SEQ ID NO: 2445231 - DNA, 16 bp, Homo sapiens
atgctgtacccagttt

SEQ ID NO: 2445232 - DNA, 18 bp, Homo sapiens
atgctgtgcgcccagggc

SEQ ID NO: 2445233 - DNA, 20 bp, Homo sapiens
atgctgtgcgcccagggctg

SEQ ID NO: 2445234 - DNA, 21 bp, Homo sapiens
atgctgtggcatgggtgaaga

SEQ ID NO: 2445235 - DNA, 13 bp, Homo sapiens
atgcttattccat

SEQ ID NO: 2445236 - DNA, 19 bp, Homo sapiens
atgcttctaagtaaataca

SEQ ID NO: 2445237 - DNA, 22 bp, Homo sapiens
atgcttctaagtaaatacaatt

SEQ ID NO: 2445238 - DNA, 16 bp, Homo sapiens
atgcttgcaaaaacta

SEQ ID NO: 2445239 - DNA, 16 bp, Homo sapiens
atggaaatatatatta

SEQ ID NO: 2445240 - DNA, 19 bp, Homo sapiens
atggaattgatttgcattg

SEQ ID NO: 2445241 - DNA, 15 bp, Homo sapiens
atggacaatggaccg

SEQ ID NO: 2445242 - DNA, 21 bp, Homo sapiens
atggactatctgtctggtggc

SEQ ID NO: 2445243 - DNA, 22 bp, Homo sapiens
atggactatctgtctggtggcc

SEQ ID NO: 2445244 - DNA, 14 bp, Homo sapiens
atggagaaagctga

SEQ ID NO: 2445245 - DNA, 14 bp, Homo sapiens
atggagctgggcta

SEQ ID NO: 2445246 - DNA, 13 bp, Homo sapiens
atggaggttctaa

SEQ ID NO: 2445247 - DNA, 14 bp, Homo sapiens
atgtctgtggattt

SEQ ID NO: 2445248 - DNA, 16 bp, Homo sapiens
atgtcttgagctctat

SEQ ID NO: 2445249 - DNA, 21 bp, Homo sapiens
atgtcttgagctctattatga

SEQ ID NO: 2445250 - DNA, 17 bp, Homo sapiens
atgtcttttcccattta

SEQ ID NO: 2445251 - DNA, 21 bp, Homo sapiens
atgtgaaaatggtccaggaga

SEQ ID NO: 2445252 - DNA, 20 bp, Homo sapiens
atgtgaaatttacatcattt

SEQ ID NO: 2445253 - DNA, 21 bp, Homo sapiens
atgtgaagccaattcagacag

SEQ ID NO: 2445254 - DNA, 13 bp, Homo sapiens
atgtgaagccttc

SEQ ID NO: 2445255 - DNA, 17 bp, Homo sapiens
atgtgaagccttcccct

SEQ ID NO: 2445256 - DNA, 14 bp, Homo sapiens
atgtgacagtggcg

SEQ ID NO: 2445257 - DNA, 14 bp, Homo sapiens
atgtgacatttata

SEQ ID NO: 2445258 - DNA, 17 bp, Homo sapiens
atgtgagaggtttgact

SEQ ID NO: 2445259 - DNA, 17 bp, Homo sapiens
atgtgataaggaaatca

SEQ ID NO: 2445260 - DNA, 13 bp, Homo sapiens
atgtgatatataa

SEQ ID NO: 2445261 - DNA, 16 bp, Homo sapiens
atgtgatatataagtg

SEQ ID NO: 2445262 - DNA, 14 bp, Homo sapiens
atgtgatattctaa

SEQ ID NO: 2445263 - DNA, 18 bp, Homo sapiens
atgtgatattctaagact

SEQ ID NO: 2445264 - DNA, 20 bp, Homo sapiens
atgtgatcatgtgtggaagt

SEQ ID NO: 2445265 - DNA, 17 bp, Homo sapiens
atgtgatgaatactgta

SEQ ID NO: 2445266 - DNA, 20 bp, Homo sapiens
atgtgatgttctaaggctct

SEQ ID NO: 2445267 - DNA, 14 bp, Homo sapiens
atgtgattgtggaa

SEQ ID NO: 2445268 - DNA, 18 bp, Homo sapiens
atgtgcaatagaaggtga

SEQ ID NO: 2445269 - DNA, 20 bp, Homo sapiens
atgtgccagggcaatgatga

SEQ ID NO: 2445270 - DNA, 19 bp, Homo sapiens
atgtgcctattgctagagc

SEQ ID NO: 2445271 - DNA, 15 bp, Homo sapiens
atgtggaactgctgc

SEQ ID NO: 2445272 - DNA, 16 bp, Homo sapiens
atgtggaactgctgcc

SEQ ID NO: 2445273 - DNA, 19 bp, Homo sapiens
atgtggaactgctgccact

SEQ ID NO: 2445274 - DNA, 18 bp, Homo sapiens
atgtggcaaggaaaaaca

SEQ ID NO: 2445275 - DNA, 13 bp, Homo sapiens
atgtggcaggggt

SEQ ID NO: 2445276 - DNA, 18 bp, Homo sapiens
atgtgggattatgggtca

SEQ ID NO: 2445277 - DNA, 18 bp, Homo sapiens
atgtggtggcacaggccc

SEQ ID NO: 2445278 - DNA, 22 bp, Homo sapiens
atgtggtggcacaggccccctt

SEQ ID NO: 2445279 - DNA, 21 bp, Homo sapiens
atgtgtaaacaattttatata

SEQ ID NO: 2445280 - DNA, 23 bp, Homo sapiens
atgtgtataaaaataaaaaagat

SEQ ID NO: 2445281 - DNA, 15 bp, Homo sapiens
atgtgtataaacaag

SEQ ID NO: 2445282 - DNA, 11 bp, Homo sapiens
atgtgtcccag

SEQ ID NO: 2445283 - DNA, 13 bp, Homo sapiens
atgtgtctttaga

SEQ ID NO: 2445284 - DNA, 22 bp, Homo sapiens
atgtgtgcaacagggtatggac

SEQ ID NO: 2445285 - DNA, 15 bp, Homo sapiens
atgtgtgttgatact

SEQ ID NO: 2445286 - DNA, 20 bp, Homo sapiens
atgtgtgttgatactgttgc

SEQ ID NO: 2445287 - DNA, 23 bp, Homo sapiens
atgtgtgttgatactgttgcacg

SEQ ID NO: 2445288 - DNA, 18 bp, Homo sapiens
atgtgtttcacagtttga

SEQ ID NO: 2445289 - DNA, 20 bp, Homo sapiens
atgtgtttcacagtttgaaa

SEQ ID NO: 2445290 - DNA, 21 bp, Homo sapiens
atgtgtttcacagtttgaaat

SEQ ID NO: 2445291 - DNA, 12 bp, Homo sapiens
atgttagccagg

SEQ ID NO: 2445292 - DNA, 21 bp, Homo sapiens
atgttagttaccttatagtta

SEQ ID NO: 2445293 - DNA, 15 bp, Homo sapiens
atgttatatataaat

SEQ ID NO: 2445294 - DNA, 18 bp, Homo sapiens
atgttatatataaatata

SEQ ID NO: 2445295 - DNA, 17 bp, Homo sapiens
atgttatcttctcaagt

SEQ ID NO: 2445296 - DNA, 19 bp, Homo sapiens
atgttattttttaattatt

SEQ ID NO: 2445297 - DNA, 20 bp, Homo sapiens
atgttattttttaattatta

SEQ ID NO: 2445298 - DNA, 16 bp, Homo sapiens
atgttcagcactgtcc

SEQ ID NO: 2445299 - DNA, 13 bp, Homo sapiens
atgttctaaggct

SEQ ID NO: 2445300 - DNA, 15 bp, Homo sapiens
atgttctaaggctct

SEQ ID NO: 2445301 - DNA, 16 bp, Homo sapiens
atgttctaaggctctg

SEQ ID NO: 2445302 - DNA, 22 bp, Homo sapiens
atgttctaaggctctgagagtc

SEQ ID NO: 2445303 - DNA, 12 bp, Homo sapiens
atgttctaagtt

SEQ ID NO: 2445304 - DNA, 16 bp, Homo sapiens
atgttctaagtttcta

SEQ ID NO: 2445305 - DNA, 19 bp, Homo sapiens
atgttctttggaaagtaca

SEQ ID NO: 2445306 - DNA, 22 bp, Homo sapiens
atgttgaaatatgatgttaaaa

SEQ ID NO: 2445307 - DNA, 18 bp, Homo sapiens
atgttgattacagtgcag

SEQ ID NO: 2445308 - DNA, 16 bp, Homo sapiens
atgttgtctaagaaat

SEQ ID NO: 2445309 - DNA, 17 bp, Homo sapiens
atgttgtctaagaaatt

SEQ ID NO: 2445310 - DNA, 12 bp, Homo sapiens
atgttgttattt

SEQ ID NO: 2445311 - DNA, 15 bp, Homo sapiens
atgttgttatttaaa

SEQ ID NO: 2445312 - DNA, 14 bp, Homo sapiens
atgtttaaaacatc

SEQ ID NO: 2445313 - DNA, 21 bp, Homo sapiens
atgtttacactctttgtaaga

SEQ ID NO: 2445314 - DNA, 22 bp, Homo sapiens
atgtttacactctttgtaagag

SEQ ID NO: 2445315 - DNA, 18 bp, Homo sapiens
atgtttattcttctagag

SEQ ID NO: 2445316 - DNA, 14 bp, Homo sapiens
atgtttatttcagg

SEQ ID NO: 2445317 - DNA, 12 bp, Homo sapiens
atgtttccagca

SEQ ID NO: 2445318 - DNA, 13 bp, Homo sapiens
atgtttccagcat

SEQ ID NO: 2445319 - DNA, 18 bp, Homo sapiens
atgtttccagcattccca

SEQ ID NO: 2445320 - DNA, 13 bp, Homo sapiens
atgtttggtaaga

SEQ ID NO: 2445321 - DNA, 20 bp, Homo sapiens
atgttttcgaaaatcaaatg

SEQ ID NO: 2445322 - DNA, 23 bp, Homo sapiens
atgttttcgaaaatcaaatggta

SEQ ID NO: 2445323 - DNA, 16 bp, Homo sapiens
atgtttttaatgtata

SEQ ID NO: 2445324 - DNA, 16 bp, Homo sapiens
atgtttttctaaagga

SEQ ID NO: 2445325 - DNA, 18 bp, Homo sapiens
atgttttttgccacagct

SEQ ID NO: 2445326 - DNA, 18 bp, Homo sapiens
attaaaaaagataaacac

SEQ ID NO: 2445327 - DNA, 18 bp, Homo sapiens
attaaaatataatctcta

SEQ ID NO: 2445328 - DNA, 14 bp, Homo sapiens
attaaaatcctcaa

SEQ ID NO: 2445329 - DNA, 17 bp, Homo sapiens
attaaaatgtatgcatg

SEQ ID NO: 2445330 - DNA, 18 bp, Homo sapiens
attaaaccatctccctgg

SEQ ID NO: 2445331 - DNA, 22 bp, Homo sapiens
attaaacgatttttaaaatgta

SEQ ID NO: 2445332 - DNA, 19 bp, Homo sapiens
attaaacttttaattcatt

SEQ ID NO: 2445333 - DNA, 17 bp, Homo sapiens
attaaagaaaaaaatgt

SEQ ID NO: 2445334 - DNA, 15 bp, Homo sapiens
attaaagaatatgaa

SEQ ID NO: 2445335 - DNA, 17 bp, Homo sapiens
attaaagtgctaaggtt

SEQ ID NO: 2445336 - DNA, 19 bp, Homo sapiens
attaaataagattctaacg

SEQ ID NO: 2445337 - DNA, 13 bp, Homo sapiens
attaaattacaga

SEQ ID NO: 2445338 - DNA, 13 bp, Homo sapiens
attaaattcacaa

SEQ ID NO: 2445339 - DNA, 19 bp, Homo sapiens
attaacaattaggcagact

SEQ ID NO: 2445340 - DNA, 21 bp, Homo sapiens
attaacccactagctcttgtt

SEQ ID NO: 2445341 - DNA, 13 bp, Homo sapiens
attaacctagaga

SEQ ID NO: 2445342 - DNA, 13 bp, Homo sapiens
attaacctctcac

SEQ ID NO: 2445343 - DNA, 15 bp, Homo sapiens
attaacgatgtccaa

SEQ ID NO: 2445344 - DNA, 13 bp, Homo sapiens
attaactttaatg

SEQ ID NO: 2445345 - DNA, 20 bp, Homo sapiens
attaagccacttaaaatgtt

SEQ ID NO: 2445346 - DNA, 17 bp, Homo sapiens
attaatatatattatct

SEQ ID NO: 2445347 - DNA, 16 bp, Homo sapiens
attaatctgcctccct

SEQ ID NO: 2445348 - DNA, 21 bp, Homo sapiens
attaatcttagtgtatgatta

SEQ ID NO: 2445349 - DNA, 17 bp, Homo sapiens
attaatgaaaataagaa

SEQ ID NO: 2445350 - DNA, 11 bp, Homo sapiens
attaatgcact

SEQ ID NO: 2445351 - DNA, 15 bp, Homo sapiens
attaatgcactttct

SEQ ID NO: 2445352 - DNA, 16 bp, Homo sapiens
attaatgcactttcta

SEQ ID NO: 2445353 - DNA, 14 bp, Homo sapiens
attaatgcccagac

SEQ ID NO: 2445354 - DNA, 18 bp, Homo sapiens
attaattcctgtttgtct

SEQ ID NO: 2445355 - DNA, 13 bp, Homo sapiens
attaattctataa

SEQ ID NO: 2445356 - DNA, 14 bp, Homo sapiens
attacaaatcagaa

SEQ ID NO: 2445357 - DNA, 16 bp, Homo sapiens
attacaaatcagaagt

SEQ ID NO: 2445358 - DNA, 21 bp, Homo sapiens
attacaaatcagaagtcatct

SEQ ID NO: 2445359 - DNA, 19 bp, Homo sapiens
attacacttggtaattgta

SEQ ID NO: 2445360 - DNA, 22 bp, Homo sapiens
attacaggcgtgagccacctcg

SEQ ID NO: 2445361 - DNA, 22 bp, Homo sapiens
attacagtgtttatcctttcat

SEQ ID NO: 2445362 - DNA, 12 bp, Homo sapiens
attacctcctga

SEQ ID NO: 2445363 - DNA, 15 bp, Homo sapiens
attacctgtggatat

SEQ ID NO: 2445364 - DNA, 21 bp, Homo sapiens
attacgtatgtctggttctca

SEQ ID NO: 2445365 - DNA, 13 bp, Homo sapiens
attactcaggttt

SEQ ID NO: 2445366 - DNA, 21 bp, Homo sapiens
attactggcctttttcattta

SEQ ID NO: 2445367 - DNA, 17 bp, Homo sapiens
attacttgtaaatataa

SEQ ID NO: 2445368 - DNA, 21 bp, Homo sapiens
attacttgtaaatataaagac

SEQ ID NO: 2445369 - DNA, 14 bp, Homo sapiens
attactttgtgaat

SEQ ID NO: 2445370 - DNA, 17 bp, Homo sapiens
attagacagaacaccta

SEQ ID NO: 2445371 - DNA, 14 bp, Homo sapiens
attagactgtgatt

SEQ ID NO: 2445372 - DNA, 14 bp, Homo sapiens
attaggcagactct

SEQ ID NO: 2445373 - DNA, 21 bp, Homo sapiens
attaggcagactctttatgct

SEQ ID NO: 2445374 - DNA, 13 bp, Homo sapiens
attaggccagcaa

SEQ ID NO: 2445375 - DNA, 15 bp, Homo sapiens
attagggccctgtgt

SEQ ID NO: 2445376 - DNA, 17 bp, Homo sapiens
attagtaacatgtgtta

SEQ ID NO: 2445377 - DNA, 23 bp, Homo sapiens
attagtattgttgtccttttcat

SEQ ID NO: 2445378 - DNA, 18 bp, Homo sapiens
attagtttcctttttaat

SEQ ID NO: 2445379 - DNA, 13 bp, Homo sapiens
attagttttgatt

SEQ ID NO: 2445380 - DNA, 15 bp, Homo sapiens
attataaatgacaac

SEQ ID NO: 2445381 - DNA, 17 bp, Homo sapiens
attataactggaaagaa

SEQ ID NO: 2445382 - DNA, 12 bp, Homo sapiens
attataactgta

SEQ ID NO: 2445383 - DNA, 13 bp, Homo sapiens
attataatgaatt

SEQ ID NO: 2445384 - DNA, 18 bp, Homo sapiens
attataccaaaatgttgc

SEQ ID NO: 2445385 - DNA, 14 bp, Homo sapiens
attatacgctggca

SEQ ID NO: 2445386 - DNA, 14 bp, Homo sapiens
attatacttgtaat

SEQ ID NO: 2445387 - DNA, 18 bp, Homo sapiens
attatagattctaaagat

SEQ ID NO: 2445388 - DNA, 19 bp, Homo sapiens
attatagattctaaagatt

SEQ ID NO: 2445389 - DNA, 15 bp, Homo sapiens
attatataactgtat

SEQ ID NO: 2445390 - DNA, 16 bp, Homo sapiens
attatatggaaatata

SEQ ID NO: 2445391 - DNA, 18 bp, Homo sapiens
attatatggaaatatata

SEQ ID NO: 2445392 - DNA, 20 bp, Homo sapiens
attatatggaaatatatatt

SEQ ID NO: 2445393 - DNA, 22 bp, Homo sapiens
attatatgtaccctctgaaata

SEQ ID NO: 2445394 - DNA, 20 bp, Homo sapiens
attatcaggcaaatttgcat

SEQ ID NO: 2445395 - DNA, 21 bp, Homo sapiens
attatcaggcaaatttgcatt

SEQ ID NO: 2445396 - DNA, 13 bp, Homo sapiens
attatctaattta

SEQ ID NO: 2445397 - DNA, 23 bp, Homo sapiens
attatcttttcatacattttcta

SEQ ID NO: 2445398 - DNA, 19 bp, Homo sapiens
attatgccttttttgatca

SEQ ID NO: 2445399 - DNA, 22 bp, Homo sapiens
attatggagtcatttttacaat

SEQ ID NO: 2445400 - DNA, 15 bp, Homo sapiens
attatgggtcacagg

SEQ ID NO: 2445401 - DNA, 12 bp, Homo sapiens
attatgtagctc

SEQ ID NO: 2445402 - DNA, 19 bp, Homo sapiens
attatgtagctctttgtca

SEQ ID NO: 2445403 - DNA, 14 bp, Homo sapiens
attatgtggtttta

SEQ ID NO: 2445404 - DNA, 15 bp, Homo sapiens
attatgtgtgttttg

SEQ ID NO: 2445405 - DNA, 14 bp, Homo sapiens
attattacttttgc

SEQ ID NO: 2445406 - DNA, 23 bp, Homo sapiens
attattagaatcaaacattttga

SEQ ID NO: 2445407 - DNA, 14 bp, Homo sapiens
attattcagtgtca

SEQ ID NO: 2445408 - DNA, 20 bp, Homo sapiens
attattggaatataattgtt

SEQ ID NO: 2445409 - DNA, 12 bp, Homo sapiens
attatttaaaca

SEQ ID NO: 2445410 - DNA, 14 bp, Homo sapiens
attatttatgtatg

SEQ ID NO: 2445411 - DNA, 19 bp, Homo sapiens
attatttatgtatggtgca

SEQ ID NO: 2445412 - DNA, 16 bp, Homo sapiens
attcaaaagttccaag

SEQ ID NO: 2445413 - DNA, 17 bp, Homo sapiens
attcaaaagttccaaga

SEQ ID NO: 2445414 - DNA, 18 bp, Homo sapiens
attcaaaatagggtatat

SEQ ID NO: 2445415 - DNA, 15 bp, Homo sapiens
attcaaaggttctag

SEQ ID NO: 2445416 - DNA, 17 bp, Homo sapiens
attcaaaggttctaggt

SEQ ID NO: 2445417 - DNA, 18 bp, Homo sapiens
attcaaaggttctaggtt

SEQ ID NO: 2445418 - DNA, 19 bp, Homo sapiens
attcaaggaatttcttaac

SEQ ID NO: 2445419 - DNA, 21 bp, Homo sapiens
attcaagtgtaaaatattttg

SEQ ID NO: 2445420 - DNA, 17 bp, Homo sapiens
attcacatctaacctca

SEQ ID NO: 2445421 - DNA, 19 bp, Homo sapiens
attcacctgccccaactct

SEQ ID NO: 2445422 - DNA, 21 bp, Homo sapiens
attcactctgagtgttttatg

SEQ ID NO: 2445423 - DNA, 22 bp, Homo sapiens
attcagaaaatgttctgtttgc

SEQ ID NO: 2445424 - DNA, 18 bp, Homo sapiens
attcagaagaaaaagaag

SEQ ID NO: 2445425 - DNA, 13 bp, Homo sapiens
attcagacagatg

SEQ ID NO: 2445426 - DNA, 18 bp, Homo sapiens
attcaggaaaaggcctgg

SEQ ID NO: 2445427 - DNA, 20 bp, Homo sapiens
attcagggaaagtgggacag

SEQ ID NO: 2445428 - DNA, 12 bp, Homo sapiens
attcaggttttt

SEQ ID NO: 2445429 - DNA, 16 bp, Homo sapiens
attcaggtttttcctt

SEQ ID NO: 2445430 - DNA, 23 bp, Homo sapiens
attcaggtttttcctttttttgt

SEQ ID NO: 2445431 - DNA, 16 bp, Homo sapiens
attcatagtaacttct

SEQ ID NO: 2445432 - DNA, 18 bp, Homo sapiens
attcatagtaacttctta

SEQ ID NO: 2445433 - DNA, 17 bp, Homo sapiens
attcatccaagttaaat

SEQ ID NO: 2445434 - DNA, 13 bp, Homo sapiens
attcatgactatg

SEQ ID NO: 2445435 - DNA, 17 bp, Homo sapiens
attccaaagaacagcct

SEQ ID NO: 2445436 - DNA, 17 bp, Homo sapiens
attccaacagtttaatg

SEQ ID NO: 2445437 - DNA, 19 bp, Homo sapiens
attccaactcgtatagcat

SEQ ID NO: 2445438 - DNA, 18 bp, Homo sapiens
attccaagactctagagt

SEQ ID NO: 2445439 - DNA, 13 bp, Homo sapiens
attccatgactgc

SEQ ID NO: 2445440 - DNA, 16 bp, Homo sapiens
attccatgtgcccagt

SEQ ID NO: 2445441 - DNA, 17 bp, Homo sapiens
attccattggtccaaga

SEQ ID NO: 2445442 - DNA, 23 bp, Homo sapiens
attccattggtccaagattccgg

SEQ ID NO: 2445443 - DNA, 19 bp, Homo sapiens
attcccaggtaggccaagg

SEQ ID NO: 2445444 - DNA, 23 bp, Homo sapiens
attcccgttttgtcactttttct

SEQ ID NO: 2445445 - DNA, 18 bp, Homo sapiens
attccctctcccaggccc

SEQ ID NO: 2445446 - DNA, 13 bp, Homo sapiens
attccggatccta

SEQ ID NO: 2445447 - DNA, 16 bp, Homo sapiens
attccggatcctaagc

SEQ ID NO: 2445448 - DNA, 21 bp, Homo sapiens
attcctatacgcagcgtgctt

SEQ ID NO: 2445449 - DNA, 22 bp, Homo sapiens
attcctattgtgcaatgtaaat

SEQ ID NO: 2445450 - DNA, 16 bp, Homo sapiens
attcctcatgaatgta

SEQ ID NO: 2445451 - DNA, 23 bp, Homo sapiens
attcctcatgaatgtaaatttgt

SEQ ID NO: 2445452 - DNA, 15 bp, Homo sapiens
attcctgaagaacca

SEQ ID NO: 2445453 - DNA, 19 bp, Homo sapiens
attcctgaagaaccagtcc

SEQ ID NO: 2445454 - DNA, 17 bp, Homo sapiens
attcctgggaaatattc

SEQ ID NO: 2445455 - DNA, 22 bp, Homo sapiens
atttgcataacaattcctctac

SEQ ID NO: 2445456 - DNA, 18 bp, Homo sapiens
atttgcattaaattcaca

SEQ ID NO: 2445457 - DNA, 23 bp, Homo sapiens
atttgcattaaattcacaaactt

SEQ ID NO: 2445458 - DNA, 21 bp, Homo sapiens
atttgcattgaacacaaactg

SEQ ID NO: 2445459 - DNA, 19 bp, Homo sapiens
atttgctaatttttattaa

SEQ ID NO: 2445460 - DNA, 15 bp, Homo sapiens
atttggaaataaagt

SEQ ID NO: 2445461 - DNA, 16 bp, Homo sapiens
atttggaaccttgttt

SEQ ID NO: 2445462 - DNA, 23 bp, Homo sapiens
atttggagggaagctcttggagc

SEQ ID NO: 2445463 - DNA, 21 bp, Homo sapiens
atttggagtgttccccttcca

SEQ ID NO: 2445464 - DNA, 17 bp, Homo sapiens
atttggcatccctgggc

SEQ ID NO: 2445465 - DNA, 21 bp, Homo sapiens
atttgggcctgctccagacct

SEQ ID NO: 2445466 - DNA, 21 bp, Homo sapiens
atttggggtataggtctcatc

SEQ ID NO: 2445467 - DNA, 23 bp, Homo sapiens
atttggggtataggtctcatctc

SEQ ID NO: 2445468 - DNA, 17 bp, Homo sapiens
atttgggtccaggagga

SEQ ID NO: 2445469 - DNA, 16 bp, Homo sapiens
atttgtaaatctgcca

SEQ ID NO: 2445470 - DNA, 19 bp, Homo sapiens
atttgtaatgtcttgagct

SEQ ID NO: 2445471 - DNA, 23 bp, Homo sapiens
atttgtaatgtcttgagctctat

SEQ ID NO: 2445472 - DNA, 22 bp, Homo sapiens
atttgtaattaaaagcaaatca

SEQ ID NO: 2445473 - DNA, 17 bp, Homo sapiens
atttgtactatttaact

SEQ ID NO: 2445474 - DNA, 20 bp, Homo sapiens
atttgtcagtatttttgccg

SEQ ID NO: 2445475 - DNA, 18 bp, Homo sapiens
atttgttaatagttcctg

SEQ ID NO: 2445476 - DNA, 14 bp, Homo sapiens
atttgttcccaaga

SEQ ID NO: 2445477 - DNA, 13 bp, Homo sapiens
atttgttcttgta

SEQ ID NO: 2445478 - DNA, 19 bp, Homo sapiens
atttgtttatgtaatttca

SEQ ID NO: 2445479 - DNA, 20 bp, Homo sapiens
atttgtttctttctctgagg

SEQ ID NO: 2445480 - DNA, 16 bp, Homo sapiens
atttgttttggatata

SEQ ID NO: 2445481 - DNA, 18 bp, Homo sapiens
attttaaaatagcgttct

SEQ ID NO: 2445482 - DNA, 13 bp, Homo sapiens
attttaaaatcag

SEQ ID NO: 2445483 - DNA, 17 bp, Homo sapiens
attttaaagaattgtgt

SEQ ID NO: 2445484 - DNA, 18 bp, Homo sapiens
attttaaagttagtatct

SEQ ID NO: 2445485 - DNA, 21 bp, Homo sapiens
attttaaagttagtatctttt

SEQ ID NO: 2445486 - DNA, 13 bp, Homo sapiens
attttaattctct

SEQ ID NO: 2445487 - DNA, 15 bp, Homo sapiens
attttatattacact

SEQ ID NO: 2445488 - DNA, 20 bp, Homo sapiens
attttatccctcacctgtag

SEQ ID NO: 2445489 - DNA, 14 bp, Homo sapiens
attttatgttatat

SEQ ID NO: 2445490 - DNA, 15 bp, Homo sapiens
attttattatgaaga

SEQ ID NO: 2445491 - DNA, 15 bp, Homo sapiens
attttcaaagactta

SEQ ID NO: 2445492 - DNA, 17 bp, Homo sapiens
attttcaaagacttaag

SEQ ID NO: 2445493 - DNA, 16 bp, Homo sapiens
attttcaatagccact

SEQ ID NO: 2445494 - DNA, 17 bp, Homo sapiens
attttccaaatgtaata

SEQ ID NO: 2445495 - DNA, 21 bp, Homo sapiens
attttcctaataaagttctgt

SEQ ID NO: 2445496 - DNA, 20 bp, Homo sapiens
attttcctatattacggttt

SEQ ID NO: 2445497 - DNA, 16 bp, Homo sapiens
attttcctgtcctctt

SEQ ID NO: 2445498 - DNA, 19 bp, Homo sapiens
attttcctgtcctctttca

SEQ ID NO: 2445499 - DNA, 21 bp, Homo sapiens
attttcctgtcctctttcagc

SEQ ID NO: 2445500 - DNA, 23 bp, Homo sapiens
attttcctgtcctctttcagctc

SEQ ID NO: 2445501 - DNA, 15 bp, Homo sapiens
attttctgctacttt

SEQ ID NO: 2445502 - DNA, 19 bp, Homo sapiens
attttctggtaggaatagc

SEQ ID NO: 2445503 - DNA, 14 bp, Homo sapiens
attttctggttcta

SEQ ID NO: 2445504 - DNA, 19 bp, Homo sapiens
attttgaaagtctgtcctt

SEQ ID NO: 2445505 - DNA, 13 bp, Homo sapiens
attttgaagtgct

SEQ ID NO: 2445506 - DNA, 11 bp, Homo sapiens
attttgaatca

SEQ ID NO: 2445507 - DNA, 12 bp, Homo sapiens
attttgaatcaa

SEQ ID NO: 2445508 - DNA, 13 bp, Homo sapiens
attttgaatcaat

SEQ ID NO: 2445509 - DNA, 13 bp, Homo sapiens
attttgcaaagat

SEQ ID NO: 2445510 - DNA, 21 bp, Homo sapiens
attttgcaaagatttaatctg

SEQ ID NO: 2445511 - DNA, 18 bp, Homo sapiens
attttgcaaggtgcattt

SEQ ID NO: 2445512 - DNA, 12 bp, Homo sapiens
attttggaattt

SEQ ID NO: 2445513 - DNA, 12 bp, Homo sapiens
attttgtaagtt

SEQ ID NO: 2445514 - DNA, 14 bp, Homo sapiens
attttgtaataata

SEQ ID NO: 2445515 - DNA, 22 bp, Homo sapiens
attttgtaataataaagaatag

SEQ ID NO: 2445516 - DNA, 18 bp, Homo sapiens
attttgtgtaagaaatac

SEQ ID NO: 2445517 - DNA, 20 bp, Homo sapiens
attttgtgtaagaaatacag

SEQ ID NO: 2445518 - DNA, 18 bp, Homo sapiens
attttgtttttccttcca

SEQ ID NO: 2445519 - DNA, 15 bp, Homo sapiens
atttttaaacaagta

SEQ ID NO: 2445520 - DNA, 18 bp, Homo sapiens
atttttacaatgtaatta

SEQ ID NO: 2445521 - DNA, 16 bp, Homo sapiens
atttttacagaattgc

SEQ ID NO: 2445522 - DNA, 16 bp, Homo sapiens
atttttataaatactg

SEQ ID NO: 2445523 - DNA, 17 bp, Homo sapiens
atttttatttcttccta

SEQ ID NO: 2445524 - DNA, 19 bp, Homo sapiens
atttttctaactacaaagg

SEQ ID NO: 2445525 - DNA, 15 bp, Homo sapiens
atttttctttaactg

SEQ ID NO: 2445526 - DNA, 15 bp, Homo sapiens
atttttctttacaaa

SEQ ID NO: 2445527 - DNA, 21 bp, Homo sapiens
atttttgatactaagcattga

SEQ ID NO: 2445528 - DNA, 19 bp, Homo sapiens
atttttggaggtttattac

SEQ ID NO: 2445529 - DNA, 21 bp, Homo sapiens
atttttggggggagtaaagaa

SEQ ID NO: 2445530 - DNA, 18 bp, Homo sapiens
atttttggtcattgtaat

SEQ ID NO: 2445531 - DNA, 15 bp, Homo sapiens
attttttaaaaagca

SEQ ID NO: 2445532 - DNA, 17 bp, Homo sapiens
attttttataaaataca

SEQ ID NO: 2445533 - DNA, 15 bp, Homo sapiens
attttttcagtatta

SEQ ID NO: 2445534 - DNA, 12 bp, Homo sapiens
attttttccaaa

SEQ ID NO: 2445535 - DNA, 13 bp, Homo sapiens
attttttccaaaa

SEQ ID NO: 2445536 - DNA, 14 bp, Homo sapiens
attttttccaaaat

SEQ ID NO: 2445537 - DNA, 23 bp, Homo sapiens
attttttccaaaatctcccattt

SEQ ID NO: 2445538 - DNA, 16 bp, Homo sapiens
attttttgttgacatt

SEQ ID NO: 2445539 - DNA, 17 bp, Homo sapiens
attttttgttgacatta

SEQ ID NO: 2445540 - DNA, 18 bp, Homo sapiens
atttttttaatttacaaa

SEQ ID NO: 2445541 - DNA, 16 bp, Homo sapiens
attttttttattagta

SEQ ID NO: 2445542 - DNA, 21 bp, Homo sapiens
atttttttttaagctctgagc

SEQ ID NO: 2445543 - DNA, 16 bp, Homo sapiens
atttttttttcaatca

SEQ ID NO: 2445544 - DNA, 19 bp, Homo sapiens
atttttttttcaatcaact

SEQ ID NO: 2445545 - DNA, 21 bp, Homo sapiens
caaaaaaaaattttaaagacc

SEQ ID NO: 2445546 - DNA, 22 bp, Homo sapiens
caaaaaaaaattttaaagaccc

SEQ ID NO: 2445547 - DNA, 14 bp, Homo sapiens
caaaaaagaaaacc

SEQ ID NO: 2445548 - DNA, 14 bp, Homo sapiens
caaaaactatttgg

SEQ ID NO: 2445549 - DNA, 22 bp, Homo sapiens
caaaaatttctgtaaaacaggt

SEQ ID NO: 2445550 - DNA, 15 bp, Homo sapiens
caaaacaaaggccta

SEQ ID NO: 2445551 - DNA, 16 bp, Homo sapiens
caaaacaaaggcctaa

SEQ ID NO: 2445552 - DNA, 22 bp, Homo sapiens
caaaacaaaggcctaattctat

SEQ ID NO: 2445553 - DNA, 12 bp, Homo sapiens
caaaaccgccag

SEQ ID NO: 2445554 - DNA, 20 bp, Homo sapiens
caaaaccgccagctctgttc

SEQ ID NO: 2445555 - DNA, 15 bp, Homo sapiens
caaaactgcatttca

SEQ ID NO: 2445556 - DNA, 13 bp, Homo sapiens
caaaagaagcccc

SEQ ID NO: 2445557 - DNA, 16 bp, Homo sapiens
caaaagaagcccccag

SEQ ID NO: 2445558 - DNA, 18 bp, Homo sapiens
caaaagaagtaaaagcaa

SEQ ID NO: 2445559 - DNA, 15 bp, Homo sapiens
caaggcagaggcctg

SEQ ID NO: 2445560 - DNA, 14 bp, Homo sapiens
caaggcagcaaggc

SEQ ID NO: 2445561 - DNA, 15 bp, Homo sapiens
caaggcagcaaggcc

SEQ ID NO: 2445562 - DNA, 19 bp, Homo sapiens
caaggcagcaaggcccgag

SEQ ID NO: 2445563 - DNA, 14 bp, Homo sapiens
caaggccatctggg

SEQ ID NO: 2445564 - DNA, 13 bp, Homo sapiens
caaggcccgagca

SEQ ID NO: 2445565 - DNA, 17 bp, Homo sapiens
caaggcccgagcagctg

SEQ ID NO: 2445566 - DNA, 18 bp, Homo sapiens
caaggcccgagcagctga

SEQ ID NO: 2445567 - DNA, 21 bp, Homo sapiens
caaggcccgagcagctgagca

SEQ ID NO: 2445568 - DNA, 15 bp, Homo sapiens
caaggctgtggacca

SEQ ID NO: 2445569 - DNA, 17 bp, Homo sapiens
caagggaggctgctgct

SEQ ID NO: 2445570 - DNA, 14 bp, Homo sapiens
caaggggcctgagc

SEQ ID NO: 2445571 - DNA, 15 bp, Homo sapiens
caagggtcaggcctt

SEQ ID NO: 2445572 - DNA, 16 bp, Homo sapiens
caaggtactctggtga

SEQ ID NO: 2445573 - DNA, 17 bp, Homo sapiens
caaggtgtcctacagaa

SEQ ID NO: 2445574 - DNA, 21 bp, Homo sapiens
caaggtgtcctacagaaaaac

SEQ ID NO: 2445575 - DNA, 17 bp, Homo sapiens
caaggtttaaagagtct

SEQ ID NO: 2445576 - DNA, 13 bp, Homo sapiens
caaggttttaggt

SEQ ID NO: 2445577 - DNA, 23 bp, Homo sapiens
caaggttttaggttctaaagttc

SEQ ID NO: 2445578 - DNA, 19 bp, Homo sapiens
caaggttttataaggctga

SEQ ID NO: 2445579 - DNA, 15 bp, Homo sapiens
caagtaatacaaact

SEQ ID NO: 2445580 - DNA, 24 bp, Homo sapiens
caagtacaaccacacccacactca

SEQ ID NO: 2445581 - DNA, 13 bp, Homo sapiens
caagtagaatctc

SEQ ID NO: 2445582 - DNA, 16 bp, Homo sapiens
caagtagaatctcagt

SEQ ID NO: 2445583 - DNA, 22 bp, Homo sapiens
caagtagataggaagaaagaag

SEQ ID NO: 2445584 - DNA, 19 bp, Homo sapiens
caagtatttgttaatttag

SEQ ID NO: 2445585 - DNA, 16 bp, Homo sapiens
caagtatttttaatta

SEQ ID NO: 2445586 - DNA, 15 bp, Homo sapiens
caagtccaggtcctg

SEQ ID NO: 2445587 - DNA, 17 bp, Homo sapiens
caagtccaggtcctggt

SEQ ID NO: 2445588 - DNA, 18 bp, Homo sapiens
caagtctctgctggccca

SEQ ID NO: 2445589 - DNA, 19 bp, Homo sapiens
caagtctctgctggcccag

SEQ ID NO: 2445590 - DNA, 20 bp, Homo sapiens
caagtctgtttactgcaagg

SEQ ID NO: 2445591 - DNA, 19 bp, Homo sapiens
caagtctttctctttccct

SEQ ID NO: 2445592 - DNA, 21 bp, Homo sapiens
caagtgacctatacctgtgtt

SEQ ID NO: 2445593 - DNA, 14 bp, Homo sapiens
caagtgaggcagcc

SEQ ID NO: 2445594 - DNA, 18 bp, Homo sapiens
caagtgagtctctctggg

SEQ ID NO: 2445595 - DNA, 14 bp, Homo sapiens
caagtgctgaacag

SEQ ID NO: 2445596 - DNA, 16 bp, Homo sapiens
caagtgctgaacagtg

SEQ ID NO: 2445597 - DNA, 20 bp, Homo sapiens
caagtgctgaacagtggagg

SEQ ID NO: 2445598 - DNA, 15 bp, Homo sapiens
caagtggactcaggg

SEQ ID NO: 2445599 - DNA, 18 bp, Homo sapiens
caagtggactcagggcag

SEQ ID NO: 2445600 - DNA, 17 bp, Homo sapiens
caagtgggtacccccag

SEQ ID NO: 2445601 - DNA, 19 bp, Homo sapiens
caagtgggtacccccagga

SEQ ID NO: 2445602 - DNA, 15 bp, Homo sapiens
caagtgtaaaatatt

SEQ ID NO: 2445603 - DNA, 12 bp, Homo sapiens
caagttaaatgt

SEQ ID NO: 2445604 - DNA, 21 bp, Homo sapiens
caagttattaatttcttcaca

SEQ ID NO: 2445605 - DNA, 19 bp, Homo sapiens
caagttcccagttggagct

SEQ ID NO: 2445606 - DNA, 21 bp, Homo sapiens
caagttcctctaacttggctc

SEQ ID NO: 2445607 - DNA, 12 bp, Homo sapiens
caagttctaaga

SEQ ID NO: 2445608 - DNA, 21 bp, Homo sapiens
caagttctaagattctaatga

SEQ ID NO: 2445609 - DNA, 19 bp, Homo sapiens
caagttgaggacttcttgc

SEQ ID NO: 2445610 - DNA, 13 bp, Homo sapiens
caagttggagtca

SEQ ID NO: 2445611 - DNA, 15 bp, Homo sapiens
caagttggagtcact

SEQ ID NO: 2445612 - DNA, 18 bp, Homo sapiens
caagttgtgccaaattat

SEQ ID NO: 2445613 - DNA, 20 bp, Homo sapiens
caagtttatcagtaaataac

SEQ ID NO: 2445614 - DNA, 14 bp, Homo sapiens
caataaaacattaa

SEQ ID NO: 2445615 - DNA, 15 bp, Homo sapiens
caataaaacattaat

SEQ ID NO: 2445616 - DNA, 17 bp, Homo sapiens
caataaatctgacccag

SEQ ID NO: 2445617 - DNA, 15 bp, Homo sapiens
caataaatggctgta

SEQ ID NO: 2445618 - DNA, 23 bp, Homo sapiens
caataacgtttaagccaaaacaa

SEQ ID NO: 2445619 - DNA, 18 bp, Homo sapiens
caataactcctcccaggg

SEQ ID NO: 2445620 - DNA, 20 bp, Homo sapiens
caataatatattttctgttt

SEQ ID NO: 2445621 - DNA, 13 bp, Homo sapiens
caatacaaatgga

SEQ ID NO: 2445622 - DNA, 14 bp, Homo sapiens
caatacaaatggat

SEQ ID NO: 2445623 - DNA, 15 bp, Homo sapiens
caatacagatatatt

SEQ ID NO: 2445624 - DNA, 18 bp, Homo sapiens
caatagccactaaccttg

SEQ ID NO: 2445625 - DNA, 20 bp, Homo sapiens
caatatactggaaagctttt

SEQ ID NO: 2445626 - DNA, 15 bp, Homo sapiens
caatattaaatctgc

SEQ ID NO: 2445627 - DNA, 17 bp, Homo sapiens
caatattttcttttccc

SEQ ID NO: 2445628 - DNA, 19 bp, Homo sapiens
caatcaatcttgcatgtaa

SEQ ID NO: 2445629 - DNA, 18 bp, Homo sapiens
caatcagctccttcctgg

SEQ ID NO: 2445630 - DNA, 17 bp, Homo sapiens
caatcattttaattatt

SEQ ID NO: 2445631 - DNA, 20 bp, Homo sapiens
caatcctatgcatggtttca

SEQ ID NO: 2445632 - DNA, 22 bp, Homo sapiens
caatcctatgcatggtttcagc

SEQ ID NO: 2445633 - DNA, 14 bp, Homo sapiens
caatctgtcagttc

SEQ ID NO: 2445634 - DNA, 21 bp, Homo sapiens
caatcttcctgtttaaaaaac

SEQ ID NO: 2445635 - DNA, 13 bp, Homo sapiens
caatcttgcatgt

SEQ ID NO: 2445636 - DNA, 17 bp, Homo sapiens
caatcttgcatgtaacg

SEQ ID NO: 2445637 - DNA, 15 bp, Homo sapiens
caatctttaaaccaa

SEQ ID NO: 2445638 - DNA, 15 bp, Homo sapiens
caatgacatgaattt

SEQ ID NO: 2445639 - DNA, 20 bp, Homo sapiens
caatgacatgaattttagct

SEQ ID NO: 2445640 - DNA, 12 bp, Homo sapiens
caatgagcatgt

SEQ ID NO: 2445641 - DNA, 14 bp, Homo sapiens
caatgagcatgttt

SEQ ID NO: 2445642 - DNA, 13 bp, Homo sapiens
caatgagctttct

SEQ ID NO: 2445643 - DNA, 21 bp, Homo sapiens
caatgagctttctgaacagct

SEQ ID NO: 2445644 - DNA, 22 bp, Homo sapiens
caatgagctttctgaacagctg

SEQ ID NO: 2445645 - DNA, 18 bp, Homo sapiens
caatgcagttgtctctgt

SEQ ID NO: 2445646 - DNA, 16 bp, Homo sapiens
caatgccacagccctg

SEQ ID NO: 2445647 - DNA, 14 bp, Homo sapiens
caatggaccggaga

SEQ ID NO: 2445648 - DNA, 22 bp, Homo sapiens
caatggaccggagagtgggggt

SEQ ID NO: 2445649 - DNA, 19 bp, Homo sapiens
caatgggagctgaggccac

SEQ ID NO: 2445650 - DNA, 23 bp, Homo sapiens
caatgggtttttccctgtacagt

SEQ ID NO: 2445651 - DNA, 19 bp, Homo sapiens
caatgtaaatattttaaag

SEQ ID NO: 2445652 - DNA, 12 bp, Homo sapiens
caatgtaattat

SEQ ID NO: 2445653 - DNA, 17 bp, Homo sapiens
caatgtacccaccgggc

SEQ ID NO: 2445654 - DNA, 13 bp, Homo sapiens
caatgtctggaga

SEQ ID NO: 2445655 - DNA, 15 bp, Homo sapiens
caatgtctggagacc

SEQ ID NO: 2445656 - DNA, 20 bp, Homo sapiens
caatgtctggagaccaccag

SEQ ID NO: 2445657 - DNA, 11 bp, Homo sapiens
caatgtcttga

SEQ ID NO: 2445658 - DNA, 15 bp, Homo sapiens
caatgtgtataaaca

SEQ ID NO: 2445659 - DNA, 17 bp, Homo sapiens
caatgtgtataaacaag

SEQ ID NO: 2445660 - DNA, 20 bp, Homo sapiens
caatgtgtataaacaagaaa

SEQ ID NO: 2445661 - DNA, 21 bp, Homo sapiens
caatgtgtataaacaagaaaa

SEQ ID NO: 2445662 - DNA, 15 bp, Homo sapiens
caatgtgtgtatatg

SEQ ID NO: 2445663 - DNA, 17 bp, Homo sapiens
caattagtttccttttt

SEQ ID NO: 2445664 - DNA, 15 bp, Homo sapiens
caattatagtttctg

SEQ ID NO: 2445665 - DNA, 18 bp, Homo sapiens
caattatagtttctgagg

SEQ ID NO: 2445666 - DNA, 13 bp, Homo sapiens
caattcaaaagtt

SEQ ID NO: 2445667 - DNA, 15 bp, Homo sapiens
caattcaaaagttcc

SEQ ID NO: 2445668 - DNA, 20 bp, Homo sapiens
caattcacatctaacctcat

SEQ ID NO: 2445669 - DNA, 13 bp, Homo sapiens
caattcagacagg

SEQ ID NO: 2445670 - DNA, 15 bp, Homo sapiens
caattcagacaggca

SEQ ID NO: 2445671 - DNA, 19 bp, Homo sapiens
caattccaacagtttaatg

SEQ ID NO: 2445672 - DNA, 11 bp, Homo sapiens
caattcccctc

SEQ ID NO: 2445673 - DNA, 13 bp, Homo sapiens
caattcccctctg

SEQ ID NO: 2445674 - DNA, 18 bp, Homo sapiens
caattgaagtaaactttt

SEQ ID NO: 2445675 - DNA, 14 bp, Homo sapiens
caattgacaacagt

SEQ ID NO: 2445676 - DNA, 22 bp, Homo sapiens
caattgacaacagttacataat

SEQ ID NO: 2445677 - DNA, 15 bp, Homo sapiens
caattggcaccgaag

SEQ ID NO: 2445678 - DNA, 19 bp, Homo sapiens
caattggcaccgaagccca

SEQ ID NO: 2445679 - DNA, 16 bp, Homo sapiens
caattgtgtagccttt

SEQ ID NO: 2445680 - DNA, 20 bp, Homo sapiens
caattgtgtagcctttttgt

SEQ ID NO: 2445681 - DNA, 23 bp, Homo sapiens
caatttatttgaatgatttttct

SEQ ID NO: 2445682 - DNA, 19 bp, Homo sapiens
caatttcaaggttctaacc

SEQ ID NO: 2445683 - DNA, 14 bp, Homo sapiens
caatttcagactcc

SEQ ID NO: 2445684 - DNA, 22 bp, Homo sapiens
caatttcggattttttccaaaa

SEQ ID NO: 2445685 - DNA, 22 bp, Homo sapiens
caatttctgtgttgccaagctc

SEQ ID NO: 2445686 - DNA, 23 bp, Homo sapiens
caattttttttattagtattgtt

SEQ ID NO: 2445687 - DNA, 22 bp, Homo sapiens
cacaaaatatattttgtttaca

SEQ ID NO: 2445688 - DNA, 12 bp, Homo sapiens
cacaaactgtaa

SEQ ID NO: 2445689 - DNA, 14 bp, Homo sapiens
cacaaactgtaaat

SEQ ID NO: 2445690 - DNA, 16 bp, Homo sapiens
cacaaagaccctggct

SEQ ID NO: 2445691 - DNA, 17 bp, Homo sapiens
cacaaagaccctggctt

SEQ ID NO: 2445692 - DNA, 13 bp, Homo sapiens
cacaaattagtta

SEQ ID NO: 2445693 - DNA, 14 bp, Homo sapiens
cacaaattagttat

SEQ ID NO: 2445694 - DNA, 23 bp, Homo sapiens
cacaacagcctgacaacatttct

SEQ ID NO: 2445695 - DNA, 20 bp, Homo sapiens
cacaacttgtttttggtttt

SEQ ID NO: 2445696 - DNA, 23 bp, Homo sapiens
cacaagaatggatcacaagatgg

SEQ ID NO: 2445697 - DNA, 13 bp, Homo sapiens
cacaagcctgagg

SEQ ID NO: 2445698 - DNA, 18 bp, Homo sapiens
cacaaggatagatgctgg

SEQ ID NO: 2445699 - DNA, 14 bp, Homo sapiens
cacaaggcagcaag

SEQ ID NO: 2445700 - DNA, 17 bp, Homo sapiens
cacaaggcagcaaggcc

SEQ ID NO: 2445701 - DNA, 21 bp, Homo sapiens
cacaagtgccctccaggcttt

SEQ ID NO: 2445702 - DNA, 18 bp, Homo sapiens
cacaagtgggtaccccca

SEQ ID NO: 2445703 - DNA, 21 bp, Homo sapiens
cacaagtgggtacccccagga

SEQ ID NO: 2445704 - DNA, 19 bp, Homo sapiens
cacacaaggatagatgctg

SEQ ID NO: 2445705 - DNA, 22 bp, Homo sapiens
cacacacattgctgtgaacagg

SEQ ID NO: 2445706 - DNA, 12 bp, Homo sapiens
cacacagctgcc

SEQ ID NO: 2445707 - DNA, 13 bp, Homo sapiens
cacacagctgccg

SEQ ID NO: 2445708 - DNA, 16 bp, Homo sapiens
cacacaggcatttcct

SEQ ID NO: 2445709 - DNA, 13 bp, Homo sapiens
cacaccagagaac

SEQ ID NO: 2445710 - DNA, 14 bp, Homo sapiens
cacaccaggataga

SEQ ID NO: 2445711 - DNA, 18 bp, Homo sapiens
cacaccaggcgctaattc

SEQ ID NO: 2445712 - DNA, 15 bp, Homo sapiens
cacaccagggccagc

SEQ ID NO: 2445713 - DNA, 19 bp, Homo sapiens
cacaccagggccagcctct

SEQ ID NO: 2445714 - DNA, 22 bp, Homo sapiens
cacacctccttccctctctgga

SEQ ID NO: 2445715 - DNA, 12 bp, Homo sapiens
cacactgcacaa

SEQ ID NO: 2445716 - DNA, 18 bp, Homo sapiens
cacacttcaaactacttt

SEQ ID NO: 2445717 - DNA, 17 bp, Homo sapiens
cacactttggtaccaga

SEQ ID NO: 2445718 - DNA, 14 bp, Homo sapiens
cacagaaaataagg

SEQ ID NO: 2445719 - DNA, 14 bp, Homo sapiens
cacagactattttt

SEQ ID NO: 2445720 - DNA, 14 bp, Homo sapiens
cacagatggccagc

SEQ ID NO: 2445721 - DNA, 23 bp, Homo sapiens
cacagcacaaattagttatatat

SEQ ID NO: 2445722 - DNA, 12 bp, Homo sapiens
cacagcacagcc

SEQ ID NO: 2445723 - DNA, 12 bp, Homo sapiens
cacagcagcctg

SEQ ID NO: 2445724 - DNA, 20 bp, Homo sapiens
cacagcatggaggaggaggg

SEQ ID NO: 2445725 - DNA, 22 bp, Homo sapiens
cacagcatggaggaggagggag

SEQ ID NO: 2445726 - DNA, 16 bp, Homo sapiens
cacagccagcacctgg

SEQ ID NO: 2445727 - DNA, 17 bp, Homo sapiens
cacagccagcacctggc

SEQ ID NO: 2445728 - DNA, 13 bp, Homo sapiens
cacagccctgtca

SEQ ID NO: 2445729 - DNA, 22 bp, Homo sapiens
cacagccctgtcagcatgaatt

SEQ ID NO: 2445730 - DNA, 23 bp, Homo sapiens
cacagccctgtcagcatgaattt

SEQ ID NO: 2445731 - DNA, 20 bp, Homo sapiens
cacagcctcccctgccaggg

SEQ ID NO: 2445732 - DNA, 21 bp, Homo sapiens
cacagcggaggtgtggagccg

SEQ ID NO: 2445733 - DNA, 14 bp, Homo sapiens
cacagctgagaggc

SEQ ID NO: 2445734 - DNA, 20 bp, Homo sapiens
cacagcttgacctgaggctg

SEQ ID NO: 2445735 - DNA, 18 bp, Homo sapiens
cacagcttgtctcttgcc

SEQ ID NO: 2445736 - DNA, 23 bp, Homo sapiens
cacagcttgtctcttgcctgcca

SEQ ID NO: 2445737 - DNA, 20 bp, Homo sapiens
cacaggacatgcggtagcca

SEQ ID NO: 2445738 - DNA, 17 bp, Homo sapiens
cacaggacatttctcta

SEQ ID NO: 2445739 - DNA, 14 bp, Homo sapiens
cacaggagctacct

SEQ ID NO: 2445740 - DNA, 15 bp, Homo sapiens
cacaggagctacctg

SEQ ID NO: 2445741 - DNA, 18 bp, Homo sapiens
cacaggagctacctgtgt

SEQ ID NO: 2445742 - DNA, 20 bp, Homo sapiens
cacaggagctacctgtgtgg

SEQ ID NO: 2445743 - DNA, 23 bp, Homo sapiens
cacaggagggggtcgtggagagc

SEQ ID NO: 2445744 - DNA, 10 bp, Homo sapiens
cacaggcagc

SEQ ID NO: 2445745 - DNA, 20 bp, Homo sapiens
cacaggcagccagtgccctg

SEQ ID NO: 2445746 - DNA, 16 bp, Homo sapiens
cacaggcatttcctgg

SEQ ID NO: 2445747 - DNA, 17 bp, Homo sapiens
cacaggcatttcctggg

SEQ ID NO: 2445748 - DNA, 23 bp, Homo sapiens
cacaggcatttcctgggtggcta

SEQ ID NO: 2445749 - DNA, 21 bp, Homo sapiens
cacaggcccccttgagtgggg

SEQ ID NO: 2445750 - DNA, 22 bp, Homo sapiens
cacaggcccccttgagtggggt

SEQ ID NO: 2445751 - DNA, 18 bp, Homo sapiens
cacaggcctgtgtagctg

SEQ ID NO: 2445752 - DNA, 23 bp, Homo sapiens
cacaggcctgtgtagctgtgacc

SEQ ID NO: 2445753 - DNA, 15 bp, Homo sapiens
cacaggctcaggcag

SEQ ID NO: 2445754 - DNA, 19 bp, Homo sapiens
cacaggctcaggcaggggc

SEQ ID NO: 2445755 - DNA, 17 bp, Homo sapiens
cacaggcttctgagcag

SEQ ID NO: 2445756 - DNA, 18 bp, Homo sapiens
cacagggcagtacctgag

SEQ ID NO: 2445757 - DNA, 21 bp, Homo sapiens
cacagggcggtaccttgtgcc

SEQ ID NO: 2445758 - DNA, 15 bp, Homo sapiens
cacagggtctgctct

SEQ ID NO: 2445759 - DNA, 16 bp, Homo sapiens
cacagggtctgctctt

SEQ ID NO: 2445760 - DNA, 19 bp, Homo sapiens
cacagggtctgctctttct

SEQ ID NO: 2445761 - DNA, 14 bp, Homo sapiens
cacaggtctagact

SEQ ID NO: 2445762 - DNA, 19 bp, Homo sapiens
cacaggttcatgccaccat

SEQ ID NO: 2445763 - DNA, 16 bp, Homo sapiens
cacagtagtcttgatg

SEQ ID NO: 2445764 - DNA, 15 bp, Homo sapiens
cacagtattgctcac

SEQ ID NO: 2445765 - DNA, 16 bp, Homo sapiens
cacagtgtatgaaggg

SEQ ID NO: 2445766 - DNA, 12 bp, Homo sapiens
cacagtgtgtga

SEQ ID NO: 2445767 - DNA, 22 bp, Homo sapiens
cactgagttttccatggcagga

SEQ ID NO: 2445768 - DNA, 20 bp, Homo sapiens
cactgatatatcatgagtga

SEQ ID NO: 2445769 - DNA, 19 bp, Homo sapiens
cactgatgttgtgttttta

SEQ ID NO: 2445770 - DNA, 19 bp, Homo sapiens
cactgcaacctccacctcc

SEQ ID NO: 2445771 - DNA, 23 bp, Homo sapiens
cactgcacaataactcctcccag

SEQ ID NO: 2445772 - DNA, 19 bp, Homo sapiens
cactgcacctgcctccagc

SEQ ID NO: 2445773 - DNA, 21 bp, Homo sapiens
cactgcactcaaccttaagac

SEQ ID NO: 2445774 - DNA, 13 bp, Homo sapiens
cactgccaggagg

SEQ ID NO: 2445775 - DNA, 15 bp, Homo sapiens
cactgccaggaggga

SEQ ID NO: 2445776 - DNA, 22 bp, Homo sapiens
cactgccaggagggacaaagga

SEQ ID NO: 2445777 - DNA, 17 bp, Homo sapiens
cactgcccatggacagg

SEQ ID NO: 2445778 - DNA, 17 bp, Homo sapiens
cactgccccctgctgcc

SEQ ID NO: 2445779 - DNA, 18 bp, Homo sapiens
cactgccttcgcttcttg

SEQ ID NO: 2445780 - DNA, 19 bp, Homo sapiens
cactgccttcgcttcttgc

SEQ ID NO: 2445781 - DNA, 15 bp, Homo sapiens
cactgctctaacagc

SEQ ID NO: 2445782 - DNA, 20 bp, Homo sapiens
cactgcttgaggaaaacaag

SEQ ID NO: 2445783 - DNA, 21 bp, Homo sapiens
cactgcttttccctttgtgag

SEQ ID NO: 2445784 - DNA, 13 bp, Homo sapiens
cactggagcacaa

SEQ ID NO: 2445785 - DNA, 24 bp, Homo sapiens
cactggcccctcaaatcgtccagc

SEQ ID NO: 2445786 - DNA, 14 bp, Homo sapiens
cactggctctcctg

SEQ ID NO: 2445787 - DNA, 21 bp, Homo sapiens
cactggctctcctggccctgg

SEQ ID NO: 2445788 - DNA, 21 bp, Homo sapiens
cactggggagcccgtctcagt

SEQ ID NO: 2445789 - DNA, 16 bp, Homo sapiens
cactggggctcagagc

SEQ ID NO: 2445790 - DNA, 19 bp, Homo sapiens
cactggggctcagagccgg

SEQ ID NO: 2445791 - DNA, 20 bp, Homo sapiens
cactggggctcagagccggg

SEQ ID NO: 2445792 - DNA, 23 bp, Homo sapiens
cactggtcacggatttgtgtctg

SEQ ID NO: 2445793 - DNA, 15 bp, Homo sapiens
cactggtctgctgtc

SEQ ID NO: 2445794 - DNA, 23 bp, Homo sapiens
cactggtggggataggccagccg

SEQ ID NO: 2445795 - DNA, 12 bp, Homo sapiens
cactgtaaaatg

SEQ ID NO: 2445796 - DNA, 14 bp, Homo sapiens
cactgtagttctaa

SEQ ID NO: 2445797 - DNA, 14 bp, Homo sapiens
cactgtatccaggt

SEQ ID NO: 2445798 - DNA, 15 bp, Homo sapiens
cactgtatgagtgga

SEQ ID NO: 2445799 - DNA, 18 bp, Homo sapiens
cactgtcccttgcctcaa

SEQ ID NO: 2445800 - DNA, 18 bp, Homo sapiens
cactgtcctgggcctgca

SEQ ID NO: 2445801 - DNA, 19 bp, Homo sapiens
cactgtctttaattctgta

SEQ ID NO: 2445802 - DNA, 22 bp, Homo sapiens
cactgtgcacatctgtgtcttg

SEQ ID NO: 2445803 - DNA, 17 bp, Homo sapiens
cactgtgttccttccgc

SEQ ID NO: 2445804 - DNA, 15 bp, Homo sapiens
cactgttatcaaaac

SEQ ID NO: 2445805 - DNA, 16 bp, Homo sapiens
cactgttcttagctca

SEQ ID NO: 2445806 - DNA, 13 bp, Homo sapiens
cactgttgaattt

SEQ ID NO: 2445807 - DNA, 14 bp, Homo sapiens
cacttacatttaca

SEQ ID NO: 2445808 - DNA, 15 bp, Homo sapiens
cacttactggtagga

SEQ ID NO: 2445809 - DNA, 12 bp, Homo sapiens
cacttcaaacta

SEQ ID NO: 2445810 - DNA, 13 bp, Homo sapiens
cacttccatggga

SEQ ID NO: 2445811 - DNA, 17 bp, Homo sapiens
cacttctgacagcctca

SEQ ID NO: 2445812 - DNA, 16 bp, Homo sapiens
cacttgccaaaatcca

SEQ ID NO: 2445813 - DNA, 17 bp, Homo sapiens
cacttgcctcttccttg

SEQ ID NO: 2445814 - DNA, 21 bp, Homo sapiens
cacttgcctcttccttgaaga

SEQ ID NO: 2445815 - DNA, 20 bp, Homo sapiens
cacttggggcaccttgctcc

SEQ ID NO: 2445816 - DNA, 15 bp, Homo sapiens
cacttggtaattgta

SEQ ID NO: 2445817 - DNA, 14 bp, Homo sapiens
cacttgtacaatta

SEQ ID NO: 2445818 - DNA, 19 bp, Homo sapiens
cacttgtacaattaattat

SEQ ID NO: 2445819 - DNA, 16 bp, Homo sapiens
cacttgtcaggagtgt

SEQ ID NO: 2445820 - DNA, 15 bp, Homo sapiens
cacttgtccagctga

SEQ ID NO: 2445821 - DNA, 19 bp, Homo sapiens
cacttgtccttagcctgga

SEQ ID NO: 2445822 - DNA, 22 bp, Homo sapiens
cactttacacaatagaattata

SEQ ID NO: 2445823 - DNA, 11 bp, Homo sapiens
cactttcagct

SEQ ID NO: 2445824 - DNA, 19 bp, Homo sapiens
cactttgcactgatatatc

SEQ ID NO: 2445825 - DNA, 17 bp, Homo sapiens
cactttgctttaatata

SEQ ID NO: 2445826 - DNA, 18 bp, Homo sapiens
cactttgctttaatataa

SEQ ID NO: 2445827 - DNA, 19 bp, Homo sapiens
cactttgctttaatataaa

SEQ ID NO: 2445828 - DNA, 23 bp, Homo sapiens
cactttggcttataattctttca

SEQ ID NO: 2445829 - DNA, 22 bp, Homo sapiens
cactttggtaccagataacttt

SEQ ID NO: 2445830 - DNA, 20 bp, Homo sapiens
cactttgtcgcccaggctgg

SEQ ID NO: 2445831 - DNA, 21 bp, Homo sapiens
cactttgtttcgtggggaggt

SEQ ID NO: 2445832 - DNA, 12 bp, Homo sapiens
cacttttcccac

SEQ ID NO: 2445833 - DNA, 15 bp, Homo sapiens
cacttttcccactcc

SEQ ID NO: 2445834 - DNA, 19 bp, Homo sapiens
cacttttcccactccaagc

SEQ ID NO: 2445835 - DNA, 23 bp, Homo sapiens
cagaaaacccttgggccagaagt

SEQ ID NO: 2445836 - DNA, 23 bp, Homo sapiens
cagaaaatgttgagaatcccaaa

SEQ ID NO: 2445837 - DNA, 14 bp, Homo sapiens
cagaaaattctgtg

SEQ ID NO: 2445838 - DNA, 23 bp, Homo sapiens
cagaaaattctgtgccttgtttt

SEQ ID NO: 2445839 - DNA, 22 bp, Homo sapiens
cagaaagcctgggtgacatttg

SEQ ID NO: 2445840 - DNA, 16 bp, Homo sapiens
cagaaaggaaaaacaa

SEQ ID NO: 2445841 - DNA, 15 bp, Homo sapiens
cagaaagggagggct

SEQ ID NO: 2445842 - DNA, 17 bp, Homo sapiens
cagaaagggagggctct

SEQ ID NO: 2445843 - DNA, 19 bp, Homo sapiens
cagaaagggagggctctga

SEQ ID NO: 2445844 - DNA, 23 bp, Homo sapiens
cagaaagggagggctctgaggcg

SEQ ID NO: 2445845 - DNA, 19 bp, Homo sapiens
cagaaagtgcctgacacac

SEQ ID NO: 2445846 - DNA, 17 bp, Homo sapiens
cagaaagtgcctttcag

SEQ ID NO: 2445847 - DNA, 18 bp, Homo sapiens
cagaaagtgcctttcagg

SEQ ID NO: 2445848 - DNA, 23 bp, Homo sapiens
cagaaagtgcctttcaggatcta

SEQ ID NO: 2445849 - DNA, 14 bp, Homo sapiens
cagaaatactactg

SEQ ID NO: 2445850 - DNA, 20 bp, Homo sapiens
cagaaatgaggccatggact

SEQ ID NO: 2445851 - DNA, 23 bp, Homo sapiens
cagaaatgaggccatggactctg

SEQ ID NO: 2445852 - DNA, 16 bp, Homo sapiens
cagaaattcaatttgg

SEQ ID NO: 2445853 - DNA, 14 bp, Homo sapiens
cagaaattgtatat

SEQ ID NO: 2445854 - DNA, 16 bp, Homo sapiens
cagaaattgtatattg

SEQ ID NO: 2445855 - DNA, 17 bp, Homo sapiens
cagaaatttaattcaga

SEQ ID NO: 2445856 - DNA, 19 bp, Homo sapiens
cagaacatagacagaagaa

SEQ ID NO: 2445857 - DNA, 20 bp, Homo sapiens
cagaaccacagggctatttt

SEQ ID NO: 2445858 - DNA, 15 bp, Homo sapiens
cagaactagaatttg

SEQ ID NO: 2445859 - DNA, 21 bp, Homo sapiens
cagaactcaaatggggccaga

SEQ ID NO: 2445860 - DNA, 22 bp, Homo sapiens
cagaactcaaatggggccagat

SEQ ID NO: 2445861 - DNA, 16 bp, Homo sapiens
cagaactctttcaaaa

SEQ ID NO: 2445862 - DNA, 16 bp, Homo sapiens
cagaacttcagaaaga

SEQ ID NO: 2445863 - DNA, 17 bp, Homo sapiens
cagaacttcagaaagac

SEQ ID NO: 2445864 - DNA, 24 bp, Homo sapiens
cagaagcctgggggcctggctggc

SEQ ID NO: 2445865 - DNA, 17 bp, Homo sapiens
cagaagctcccccagca

SEQ ID NO: 2445866 - DNA, 19 bp, Homo sapiens
cagaagctcccccagcaaa

SEQ ID NO: 2445867 - DNA, 21 bp, Homo sapiens
cagaagctcccccagcaaagc

SEQ ID NO: 2445868 - DNA, 23 bp, Homo sapiens
cagaagctcccccagcaaagccc

SEQ ID NO: 2445869 - DNA, 18 bp, Homo sapiens
cagaaggcaaacccatca

SEQ ID NO: 2445870 - DNA, 19 bp, Homo sapiens
cagccacacttctcaggac

SEQ ID NO: 2445871 - DNA, 15 bp, Homo sapiens
cagccaccctgagga

SEQ ID NO: 2445872 - DNA, 22 bp, Homo sapiens
cagccaccctgaggagtctgag

SEQ ID NO: 2445873 - DNA, 14 bp, Homo sapiens
cagccaccctgagt

SEQ ID NO: 2445874 - DNA, 17 bp, Homo sapiens
cagccaccgtttcttcc

SEQ ID NO: 2445875 - DNA, 12 bp, Homo sapiens
cagccagcacct

SEQ ID NO: 2445876 - DNA, 13 bp, Homo sapiens
cagccagcatctg

SEQ ID NO: 2445877 - DNA, 17 bp, Homo sapiens
cagccagcatctgggcc

SEQ ID NO: 2445878 - DNA, 16 bp, Homo sapiens
cagccagccctgcctg

SEQ ID NO: 2445879 - DNA, 14 bp, Homo sapiens
cagccagcctcgcc

SEQ ID NO: 2445880 - DNA, 19 bp, Homo sapiens
cagccagcctcgcccatcc

SEQ ID NO: 2445881 - DNA, 15 bp, Homo sapiens
cagccaggcccagcc

SEQ ID NO: 2445882 - DNA, 22 bp, Homo sapiens
cagccagggagagcccaggagc

SEQ ID NO: 2445883 - DNA, 19 bp, Homo sapiens
cagccattggctatttaaa

SEQ ID NO: 2445884 - DNA, 15 bp, Homo sapiens
cagcccagccagcgt

SEQ ID NO: 2445885 - DNA, 20 bp, Homo sapiens
cagcccaggaagtctcatct

SEQ ID NO: 2445886 - DNA, 23 bp, Homo sapiens
cagcccaggaagtctcatctggg

SEQ ID NO: 2445887 - DNA, 22 bp, Homo sapiens
cagcccatggagattgacctgg

SEQ ID NO: 2445888 - DNA, 16 bp, Homo sapiens
cagccccacaccaggg

SEQ ID NO: 2445889 - DNA, 14 bp, Homo sapiens
cagccccaccccag

SEQ ID NO: 2445890 - DNA, 17 bp, Homo sapiens
cagccccaccctggcct

SEQ ID NO: 2445891 - DNA, 21 bp, Homo sapiens
cagccccactcctctgctgac

SEQ ID NO: 2445892 - DNA, 17 bp, Homo sapiens
cagccccctaagagagc

SEQ ID NO: 2445893 - DNA, 12 bp, Homo sapiens
cagccccctcac

SEQ ID NO: 2445894 - DNA, 16 bp, Homo sapiens
cagccccctgaccact

SEQ ID NO: 2445895 - DNA, 18 bp, Homo sapiens
cagcccctctggtcgctc

SEQ ID NO: 2445896 - DNA, 22 bp, Homo sapiens
cagcccctctggtcgctcctgc

SEQ ID NO: 2445897 - DNA, 17 bp, Homo sapiens
cagccccttagacagag

SEQ ID NO: 2445898 - DNA, 18 bp, Homo sapiens
cagccccttagacagagg

SEQ ID NO: 2445899 - DNA, 16 bp, Homo sapiens
cagcccgcacacctgc

SEQ ID NO: 2445900 - DNA, 14 bp, Homo sapiens
cagccctaaacatc

SEQ ID NO: 2445901 - DNA, 16 bp, Homo sapiens
cagccctcacacaccc

SEQ ID NO: 2445902 - DNA, 13 bp, Homo sapiens
cagccctcatccc

SEQ ID NO: 2445903 - DNA, 18 bp, Homo sapiens
cagccctcctctgcactc

SEQ ID NO: 2445904 - DNA, 20 bp, Homo sapiens
cagccctgcctggaggacct

SEQ ID NO: 2445905 - DNA, 13 bp, Homo sapiens
cagccctgtcagc

SEQ ID NO: 2445906 - DNA, 18 bp, Homo sapiens
cagccctgtcagcatgaa

SEQ ID NO: 2445907 - DNA, 23 bp, Homo sapiens
cagcccttatgcggttaattttg

SEQ ID NO: 2445908 - DNA, 20 bp, Homo sapiens
cagcccttgggggtcctcct

SEQ ID NO: 2445909 - DNA, 16 bp, Homo sapiens
cagccgagcaggaggc

SEQ ID NO: 2445910 - DNA, 19 bp, Homo sapiens
cagccgagcaggaggccta

SEQ ID NO: 2445911 - DNA, 17 bp, Homo sapiens
cagccgaggtccctgct

SEQ ID NO: 2445912 - DNA, 19 bp, Homo sapiens
cagccgaggtccctgctgc

SEQ ID NO: 2445913 - DNA, 20 bp, Homo sapiens
cagccgaggtccctgctgcc

SEQ ID NO: 2445914 - DNA, 17 bp, Homo sapiens
cagccgccggctgtgca

SEQ ID NO: 2445915 - DNA, 19 bp, Homo sapiens
cagccgccggctgtgcagt

SEQ ID NO: 2445916 - DNA, 19 bp, Homo sapiens
cagccgctgagcgaggaga

SEQ ID NO: 2445917 - DNA, 12 bp, Homo sapiens
cagccgcttggc

SEQ ID NO: 2445918 - DNA, 21 bp, Homo sapiens
cagccgcttggcgatgccagc

SEQ ID NO: 2445919 - DNA, 15 bp, Homo sapiens
cagccggcacagggt

SEQ ID NO: 2445920 - DNA, 17 bp, Homo sapiens
cagccgtgagcatgttt

SEQ ID NO: 2445921 - DNA, 12 bp, Homo sapiens
cagcctcagaga

SEQ ID NO: 2445922 - DNA, 16 bp, Homo sapiens
cagcctcaggactggg

SEQ ID NO: 2445923 - DNA, 18 bp, Homo sapiens
cagcctcaggactgggag

SEQ ID NO: 2445924 - DNA, 23 bp, Homo sapiens
cagcctcaggactgggagccccc

SEQ ID NO: 2445925 - DNA, 16 bp, Homo sapiens
cagcctcccatccagg

SEQ ID NO: 2445926 - DNA, 20 bp, Homo sapiens
cagcctcccatccagggccc

SEQ ID NO: 2445927 - DNA, 16 bp, Homo sapiens
cagcctcccctgccag

SEQ ID NO: 2445928 - DNA, 17 bp, Homo sapiens
cagcctcccctgccagg

SEQ ID NO: 2445929 - DNA, 12 bp, Homo sapiens
cagcctccctga

SEQ ID NO: 2445930 - DNA, 17 bp, Homo sapiens
cagcctccctgaagcct

SEQ ID NO: 2445931 - DNA, 13 bp, Homo sapiens
cagcctctggggg

SEQ ID NO: 2445932 - DNA, 22 bp, Homo sapiens
cagcctctggggggtggccagg

SEQ ID NO: 2445933 - DNA, 16 bp, Homo sapiens
cagcctgagcaactct

SEQ ID NO: 2445934 - DNA, 20 bp, Homo sapiens
cagcctgagcaactcttgat

SEQ ID NO: 2445935 - DNA, 17 bp, Homo sapiens
cagcctggaccactcct

SEQ ID NO: 2445936 - DNA, 12 bp, Homo sapiens
cagcctggccca

SEQ ID NO: 2445937 - DNA, 18 bp, Homo sapiens
cagcctggcctcctgcct

SEQ ID NO: 2445938 - DNA, 20 bp, Homo sapiens
cagcctggcctcctgcctct

SEQ ID NO: 2445939 - DNA, 18 bp, Homo sapiens
cagcctgggcctatggag

SEQ ID NO: 2445940 - DNA, 23 bp, Homo sapiens
cagcctgggcctatggagagccc

SEQ ID NO: 2445941 - DNA, 16 bp, Homo sapiens
cagcctgggcgctggt

SEQ ID NO: 2445942 - DNA, 20 bp, Homo sapiens
cagcctgggcgctggtcctt

SEQ ID NO: 2445943 - DNA, 23 bp, Homo sapiens
cagcctgggcgctggtcctttct

SEQ ID NO: 2445944 - DNA, 17 bp, Homo sapiens
cagcctggggctggcct

SEQ ID NO: 2445945 - DNA, 15 bp, Homo sapiens
cagcctggggtctgg

SEQ ID NO: 2445946 - DNA, 22 bp, Homo sapiens
cagcctgtcagatccaggagct

SEQ ID NO: 2445947 - DNA, 14 bp, Homo sapiens
cagccttgccagag

SEQ ID NO: 2445948 - DNA, 22 bp, Homo sapiens
cagcctttgttccccactggag

SEQ ID NO: 2445949 - DNA, 18 bp, Homo sapiens
cagcgaccttcctcatcc

SEQ ID NO: 2445950 - DNA, 22 bp, Homo sapiens
cagcgactccgttggccactcc

SEQ ID NO: 2445951 - DNA, 13 bp, Homo sapiens
cagcgagcctgct

SEQ ID NO: 2445952 - DNA, 20 bp, Homo sapiens
cagcgagcgcccagctcctg

SEQ ID NO: 2445953 - DNA, 21 bp, Homo sapiens
cagcgagcgcccagctcctga

SEQ ID NO: 2445954 - DNA, 23 bp, Homo sapiens
cagcgattccctctcccaggccc

SEQ ID NO: 2445955 - DNA, 19 bp, Homo sapiens
cagcgccaggctgaccaca

SEQ ID NO: 2445956 - DNA, 20 bp, Homo sapiens
cagcgccaggctgaccacag

SEQ ID NO: 2445957 - DNA, 22 bp, Homo sapiens
cagcgccaggctgaccacagca

SEQ ID NO: 2445958 - DNA, 22 bp, Homo sapiens
cagcggtgggacctagggaggc

SEQ ID NO: 2445959 - DNA, 18 bp, Homo sapiens
cagcgtggccttgttctg

SEQ ID NO: 2445960 - DNA, 13 bp, Homo sapiens
cagctaagaacct

SEQ ID NO: 2445961 - DNA, 13 bp, Homo sapiens
cagctaagctcac

SEQ ID NO: 2445962 - DNA, 21 bp, Homo sapiens
cagctaataactgatctcgtt

SEQ ID NO: 2445963 - DNA, 22 bp, Homo sapiens
cagctaattctactcacagtgc

SEQ ID NO: 2445964 - DNA, 13 bp, Homo sapiens
cagctactctccc

SEQ ID NO: 2445965 - DNA, 15 bp, Homo sapiens
cagctacttcctcct

SEQ ID NO: 2445966 - DNA, 20 bp, Homo sapiens
cagctaggaagagcaggact

SEQ ID NO: 2445967 - DNA, 18 bp, Homo sapiens
cagctagtgacccacatg

SEQ ID NO: 2445968 - DNA, 22 bp, Homo sapiens
cagctcaagagatcccaagtag

SEQ ID NO: 2445969 - DNA, 16 bp, Homo sapiens
cagctcaatggactgg

SEQ ID NO: 2445970 - DNA, 20 bp, Homo sapiens
cagctcaatggactggaagg

SEQ ID NO: 2445971 - DNA, 14 bp, Homo sapiens
cagctcagcactgc

SEQ ID NO: 2445972 - DNA, 20 bp, Homo sapiens
cagctcagcactgcctgctc

SEQ ID NO: 2445973 - DNA, 13 bp, Homo sapiens
cagctcaggacag

SEQ ID NO: 2445974 - DNA, 22 bp, Homo sapiens
cagctcatccatgcctcagaag

SEQ ID NO: 2445975 - DNA, 14 bp, Homo sapiens
cagctccaacctgc

SEQ ID NO: 2445976 - DNA, 16 bp, Homo sapiens
cagctccagttggagt

SEQ ID NO: 2445977 - DNA, 15 bp, Homo sapiens
cagctcccacctccc

SEQ ID NO: 2445978 - DNA, 24 bp, Homo sapiens
cagctcccaggaccacaggctcag

SEQ ID NO: 2445979 - DNA, 14 bp, Homo sapiens
cagctcctcccaca

SEQ ID NO: 2445980 - DNA, 12 bp, Homo sapiens
cagctcctctgt

SEQ ID NO: 2445981 - DNA, 22 bp, Homo sapiens
cagctcctgaccagttgcagtc

SEQ ID NO: 2445982 - DNA, 15 bp, Homo sapiens
cagctcctgtaacat

SEQ ID NO: 2445983 - DNA, 13 bp, Homo sapiens
cagctccttcctg

SEQ ID NO: 2445984 - DNA, 18 bp, Homo sapiens
cagctctgaaaccagtgt

SEQ ID NO: 2445985 - DNA, 19 bp, Homo sapiens
cagctctgaaaccagtgtt

SEQ ID NO: 2445986 - DNA, 18 bp, Homo sapiens
cagctctggaggggaggg

SEQ ID NO: 2445987 - DNA, 20 bp, Homo sapiens
cagctctgttcttcctcagc

SEQ ID NO: 2445988 - DNA, 22 bp, Homo sapiens
cagctctgttcttcctcagcca

SEQ ID NO: 2445989 - DNA, 15 bp, Homo sapiens
cagctgagcagggcc

SEQ ID NO: 2445990 - DNA, 19 bp, Homo sapiens
cagctgcaaggtactctgg

SEQ ID NO: 2445991 - DNA, 20 bp, Homo sapiens
cagctgcaaggtactctggt

SEQ ID NO: 2445992 - DNA, 15 bp, Homo sapiens
cagctgccagtgtcc

SEQ ID NO: 2445993 - DNA, 16 bp, Homo sapiens
cagctggaccctgacc

SEQ ID NO: 2445994 - DNA, 17 bp, Homo sapiens
cagctggaccctgacca

SEQ ID NO: 2445995 - DNA, 18 bp, Homo sapiens
cagctggaccctgaccag

SEQ ID NO: 2445996 - DNA, 13 bp, Homo sapiens
cagctggaggcag

SEQ ID NO: 2445997 - DNA, 23 bp, Homo sapiens
cagctggaggcaggggcttcctg

SEQ ID NO: 2445998 - DNA, 17 bp, Homo sapiens
cagctgggctctgcaat

SEQ ID NO: 2445999 - DNA, 19 bp, Homo sapiens
cagctggggtgcagggatg

SEQ ID NO: 2446000 - DNA, 23 bp, Homo sapiens
cagctggggtgcagggatgtggg

SEQ ID NO: 2446001 - DNA, 14 bp, Homo sapiens
cagctgggtcaggc

SEQ ID NO: 2446002 - DNA, 15 bp, Homo sapiens
cagctgggtcaggca

SEQ ID NO: 2446003 - DNA, 14 bp, Homo sapiens
cagctggtgtagct

SEQ ID NO: 2446004 - DNA, 15 bp, Homo sapiens
cagctggtgtagcta

SEQ ID NO: 2446005 - DNA, 14 bp, Homo sapiens
cagctgtcccccca

SEQ ID NO: 2446006 - DNA, 17 bp, Homo sapiens
cagctgtccccccactc

SEQ ID NO: 2446007 - DNA, 19 bp, Homo sapiens
cagctgtccccccactccc

SEQ ID NO: 2446008 - DNA, 16 bp, Homo sapiens
cagctgtcttttggag

SEQ ID NO: 2446009 - DNA, 12 bp, Homo sapiens
cagctgtgcctc

SEQ ID NO: 2446010 - DNA, 13 bp, Homo sapiens
cagctgtgcctcg

SEQ ID NO: 2446011 - DNA, 14 bp, Homo sapiens
cagctgtgcctcgc

SEQ ID NO: 2446012 - DNA, 16 bp, Homo sapiens
cagctgtggcagagtt

SEQ ID NO: 2446013 - DNA, 17 bp, Homo sapiens
cagctgtggcagagtta

SEQ ID NO: 2446014 - DNA, 23 bp, Homo sapiens
cagctgtggcagagttacagttc

SEQ ID NO: 2446015 - DNA, 22 bp, Homo sapiens
cagctgttttgttgacattctg

SEQ ID NO: 2446016 - DNA, 23 bp, Homo sapiens
cagctgttttgttgacattctga

SEQ ID NO: 2446017 - DNA, 16 bp, Homo sapiens
cagcttatacgaaata

SEQ ID NO: 2446018 - DNA, 19 bp, Homo sapiens
cagcttatacgaaataatt

SEQ ID NO: 2446019 - DNA, 13 bp, Homo sapiens
cagcttcagtgat

SEQ ID NO: 2446020 - DNA, 13 bp, Homo sapiens
cagcttccttcag

SEQ ID NO: 2446021 - DNA, 15 bp, Homo sapiens
cagcttccttcagag

SEQ ID NO: 2446022 - DNA, 16 bp, Homo sapiens
cagcttccttcagaga

SEQ ID NO: 2446023 - DNA, 15 bp, Homo sapiens
cagcttgacctgagg

SEQ ID NO: 2446024 - DNA, 19 bp, Homo sapiens
cagcttgacctgaggctgt

SEQ ID NO: 2446025 - DNA, 22 bp, Homo sapiens
cagcttgacctgaggctgtggt

SEQ ID NO: 2446026 - DNA, 23 bp, Homo sapiens
cagcttgacctgaggctgtggtc

SEQ ID NO: 2446027 - DNA, 22 bp, Homo sapiens
cagcttgtctcttgcctgccac

SEQ ID NO: 2446028 - DNA, 14 bp, Homo sapiens
cagcttgtttacat

SEQ ID NO: 2446029 - DNA, 18 bp, Homo sapiens
cagcttgtttacatgctt

SEQ ID NO: 2446030 - DNA, 13 bp, Homo sapiens
cagcttttcaaac

SEQ ID NO: 2446031 - DNA, 12 bp, Homo sapiens
cagcttttgcaa

SEQ ID NO: 2446032 - DNA, 13 bp, Homo sapiens
caggaaaaggcct

SEQ ID NO: 2446033 - DNA, 15 bp, Homo sapiens
caggaaaaggcctgg

SEQ ID NO: 2446034 - DNA, 18 bp, Homo sapiens
caggaaaggcccagccac

SEQ ID NO: 2446035 - DNA, 16 bp, Homo sapiens
caggaaagtggccaag

SEQ ID NO: 2446036 - DNA, 15 bp, Homo sapiens
caggaagccgtcctg

SEQ ID NO: 2446037 - DNA, 13 bp, Homo sapiens
caggaagcctgca

SEQ ID NO: 2446038 - DNA, 18 bp, Homo sapiens
caggaaggagctgcctgg

SEQ ID NO: 2446039 - DNA, 20 bp, Homo sapiens
caggaaggagctgcctggac

SEQ ID NO: 2446040 - DNA, 12 bp, Homo sapiens
caggacacaggc

SEQ ID NO: 2446041 - DNA, 13 bp, Homo sapiens
caggacacaggcc

SEQ ID NO: 2446042 - DNA, 21 bp, Homo sapiens
caggacatgcggtagccagca

SEQ ID NO: 2446043 - DNA, 22 bp, Homo sapiens
caggacatgcggtagccagcac

SEQ ID NO: 2446044 - DNA, 14 bp, Homo sapiens
caggaccacaggct

SEQ ID NO: 2446045 - DNA, 13 bp, Homo sapiens
caggaccagaagc

SEQ ID NO: 2446046 - DNA, 15 bp, Homo sapiens
caggaccagaagctc

SEQ ID NO: 2446047 - DNA, 14 bp, Homo sapiens
caggaccagctcag

SEQ ID NO: 2446048 - DNA, 19 bp, Homo sapiens
caggaccagctcaggacag

SEQ ID NO: 2446049 - DNA, 21 bp, Homo sapiens
caggaccagtcaacctgggca

SEQ ID NO: 2446050 - DNA, 18 bp, Homo sapiens
caggaccagtcccagagc

SEQ ID NO: 2446051 - DNA, 16 bp, Homo sapiens
caggacccagaggaag

SEQ ID NO: 2446052 - DNA, 13 bp, Homo sapiens
caggaccctggac

SEQ ID NO: 2446053 - DNA, 20 bp, Homo sapiens
caggaccttcgggctgtgcc

SEQ ID NO: 2446054 - DNA, 22 bp, Homo sapiens
caggaccttcgggctgtgcccg

SEQ ID NO: 2446055 - DNA, 20 bp, Homo sapiens
caggactaacactcagaagc

SEQ ID NO: 2446056 - DNA, 22 bp, Homo sapiens
caggactaacactcagaagcct

SEQ ID NO: 2446057 - DNA, 16 bp, Homo sapiens
caggactccaggccca

SEQ ID NO: 2446058 - DNA, 18 bp, Homo sapiens
caggactccaggcccaag

SEQ ID NO: 2446059 - DNA, 11 bp, Homo sapiens
caggactctgc

SEQ ID NO: 2446060 - DNA, 14 bp, Homo sapiens
caggactctgcagc

SEQ ID NO: 2446061 - DNA, 17 bp, Homo sapiens
caggactgatgtctcct

SEQ ID NO: 2446062 - DNA, 21 bp, Homo sapiens
caggactgggagcccccagcc

SEQ ID NO: 2446063 - DNA, 16 bp, Homo sapiens
caggacttgaaagaaa

SEQ ID NO: 2446064 - DNA, 14 bp, Homo sapiens
caggagaagaaaga

SEQ ID NO: 2446065 - DNA, 20 bp, Homo sapiens
caggagaagaaagaggtgac

SEQ ID NO: 2446066 - DNA, 15 bp, Homo sapiens
caggagaagctcagc

SEQ ID NO: 2446067 - DNA, 19 bp, Homo sapiens
caggagaagctcagctgca

SEQ ID NO: 2446068 - DNA, 20 bp, Homo sapiens
caggagaagctcagctgcat

SEQ ID NO: 2446069 - DNA, 22 bp, Homo sapiens
caggagaaggccaattcctata

SEQ ID NO: 2446070 - DNA, 17 bp, Homo sapiens
caggagctacctgtgtg

SEQ ID NO: 2446071 - DNA, 23 bp, Homo sapiens
caggagctacctgtgtggacagg

SEQ ID NO: 2446072 - DNA, 21 bp, Homo sapiens
caggagctccagtgtcctgag

SEQ ID NO: 2446073 - DNA, 16 bp, Homo sapiens
caggagctcccctccc

SEQ ID NO: 2446074 - DNA, 18 bp, Homo sapiens
caggagctcccctcccca

SEQ ID NO: 2446075 - DNA, 18 bp, Homo sapiens
caggaggacccagggctc

SEQ ID NO: 2446076 - DNA, 20 bp, Homo sapiens
caggaggacccagggctctg

SEQ ID NO: 2446077 - DNA, 18 bp, Homo sapiens
cagggaaggcaggcaggg

SEQ ID NO: 2446078 - DNA, 21 bp, Homo sapiens
cagggaaggcaggcagggctc

SEQ ID NO: 2446079 - DNA, 23 bp, Homo sapiens
cagggaaggcaggcagggctctc

SEQ ID NO: 2446080 - DNA, 22 bp, Homo sapiens
cagggacacctgggagaaatct

SEQ ID NO: 2446081 - DNA, 18 bp, Homo sapiens
cagggacagaggccccag

SEQ ID NO: 2446082 - DNA, 14 bp, Homo sapiens
cagggacagcaact

SEQ ID NO: 2446083 - DNA, 16 bp, Homo sapiens
cagggaccacaccctg

SEQ ID NO: 2446084 - DNA, 12 bp, Homo sapiens
cagggactcagg

SEQ ID NO: 2446085 - DNA, 12 bp, Homo sapiens
cagggagaagct

SEQ ID NO: 2446086 - DNA, 13 bp, Homo sapiens
cagggagagccca

SEQ ID NO: 2446087 - DNA, 17 bp, Homo sapiens
cagggagagggggctgg

SEQ ID NO: 2446088 - DNA, 17 bp, Homo sapiens
cagggagcggccggcca

SEQ ID NO: 2446089 - DNA, 12 bp, Homo sapiens
cagggaggccga

SEQ ID NO: 2446090 - DNA, 23 bp, Homo sapiens
cagggaggccgaagctaacaggg

SEQ ID NO: 2446091 - DNA, 12 bp, Homo sapiens
cagggagtgttc

SEQ ID NO: 2446092 - DNA, 19 bp, Homo sapiens
cagggataaggcctgtggg

SEQ ID NO: 2446093 - DNA, 18 bp, Homo sapiens
cagggattaacctctgca

SEQ ID NO: 2446094 - DNA, 12 bp, Homo sapiens
cagggcaaagcc

SEQ ID NO: 2446095 - DNA, 13 bp, Homo sapiens
cagggcaaagcca

SEQ ID NO: 2446096 - DNA, 14 bp, Homo sapiens
cagggcaaagccag

SEQ ID NO: 2446097 - DNA, 23 bp, Homo sapiens
cagggcaaagccaggtccctctc

SEQ ID NO: 2446098 - DNA, 12 bp, Homo sapiens
cagggcacagga

SEQ ID NO: 2446099 - DNA, 16 bp, Homo sapiens
cagggcacaggagcta

SEQ ID NO: 2446100 - DNA, 20 bp, Homo sapiens
cagggcacaggagctacctg

SEQ ID NO: 2446101 - DNA, 21 bp, Homo sapiens
cagggcacaggagctacctgt

SEQ ID NO: 2446102 - DNA, 22 bp, Homo sapiens
cagggcacaggagctacctgtg

SEQ ID NO: 2446103 - DNA, 13 bp, Homo sapiens
cagggcagagtga

SEQ ID NO: 2446104 - DNA, 14 bp, Homo sapiens
cagggcagccaggg

SEQ ID NO: 2446105 - DNA, 15 bp, Homo sapiens
cagggcagccaggga

SEQ ID NO: 2446106 - DNA, 17 bp, Homo sapiens
cagggcagccagggaga

SEQ ID NO: 2446107 - DNA, 20 bp, Homo sapiens
cagggcagccagggagagcc

SEQ ID NO: 2446108 - DNA, 13 bp, Homo sapiens
cagggcagcgcca

SEQ ID NO: 2446109 - DNA, 15 bp, Homo sapiens
cagggcagtacctga

SEQ ID NO: 2446110 - DNA, 18 bp, Homo sapiens
cagggcatctctgggctg

SEQ ID NO: 2446111 - DNA, 20 bp, Homo sapiens
cagggcatctctgggctgga

SEQ ID NO: 2446112 - DNA, 22 bp, Homo sapiens
cagggccacgctccagctgccc

SEQ ID NO: 2446113 - DNA, 15 bp, Homo sapiens
cagggccagcctcta

SEQ ID NO: 2446114 - DNA, 18 bp, Homo sapiens
cagggccatgctgaggcc

SEQ ID NO: 2446115 - DNA, 19 bp, Homo sapiens
cagggcccagagcccagct

SEQ ID NO: 2446116 - DNA, 21 bp, Homo sapiens
cagggcccctcaccctgcctt

SEQ ID NO: 2446117 - DNA, 22 bp, Homo sapiens
cagggcccctctccccagggaa

SEQ ID NO: 2446118 - DNA, 12 bp, Homo sapiens
cagggccgggga

SEQ ID NO: 2446119 - DNA, 24 bp, Homo sapiens
cagggccggggaactggccaagct

SEQ ID NO: 2446120 - DNA, 21 bp, Homo sapiens
cagggcgggcagagggctgga

SEQ ID NO: 2446121 - DNA, 22 bp, Homo sapiens
cagggcgggcagagggctggag

SEQ ID NO: 2446122 - DNA, 14 bp, Homo sapiens
cagggctaccctga

SEQ ID NO: 2446123 - DNA, 18 bp, Homo sapiens
cagggctaccctgagctg

SEQ ID NO: 2446124 - DNA, 19 bp, Homo sapiens
cagggctaccctgagctga

SEQ ID NO: 2446125 - DNA, 11 bp, Homo sapiens
cagggctcctg

SEQ ID NO: 2446126 - DNA, 12 bp, Homo sapiens
cagggctcctgc

SEQ ID NO: 2446127 - DNA, 14 bp, Homo sapiens
cagggctcctgcac

SEQ ID NO: 2446128 - DNA, 21 bp, Homo sapiens
cagggctccttgtgggcctgg

SEQ ID NO: 2446129 - DNA, 17 bp, Homo sapiens
cagggctctcctggctt

SEQ ID NO: 2446130 - DNA, 19 bp, Homo sapiens
cagggctctcctggcttcc

SEQ ID NO: 2446131 - DNA, 16 bp, Homo sapiens
cagggctgggaggaag

SEQ ID NO: 2446132 - DNA, 18 bp, Homo sapiens
cagggctgtaactgccag

SEQ ID NO: 2446133 - DNA, 21 bp, Homo sapiens
cagggctgtaactgccaggct

SEQ ID NO: 2446134 - DNA, 21 bp, Homo sapiens
caggggaacactggggacttg

SEQ ID NO: 2446135 - DNA, 22 bp, Homo sapiens
caggggacaggagtccactttg

SEQ ID NO: 2446136 - DNA, 20 bp, Homo sapiens
caggggagcagaggggcaga

SEQ ID NO: 2446137 - DNA, 22 bp, Homo sapiens
caggggagcagaggggcagagg

SEQ ID NO: 2446138 - DNA, 18 bp, Homo sapiens
caggggcagccccaggcc

SEQ ID NO: 2446139 - DNA, 22 bp, Homo sapiens
caggggcccgcgatgtggaact

SEQ ID NO: 2446140 - DNA, 15 bp, Homo sapiens
caggggcctggagat

SEQ ID NO: 2446141 - DNA, 14 bp, Homo sapiens
caggggctccctcc

SEQ ID NO: 2446142 - DNA, 18 bp, Homo sapiens
caggggctccctccgccc

SEQ ID NO: 2446143 - DNA, 13 bp, Homo sapiens
caggggctgcttc

SEQ ID NO: 2446144 - DNA, 19 bp, Homo sapiens
caggggctgcttcctcctg

SEQ ID NO: 2446145 - DNA, 22 bp, Homo sapiens
caggggctgcttcctcctggaa

SEQ ID NO: 2446146 - DNA, 15 bp, Homo sapiens
caggggcttcctggt

SEQ ID NO: 2446147 - DNA, 17 bp, Homo sapiens
caggggcttcctggtgc

SEQ ID NO: 2446148 - DNA, 20 bp, Homo sapiens
caggggcttcctggtgctgg

SEQ ID NO: 2446149 - DNA, 22 bp, Homo sapiens
cagggggagctgggcctggtct

SEQ ID NO: 2446150 - DNA, 13 bp, Homo sapiens
cagggggctgctg

SEQ ID NO: 2446151 - DNA, 18 bp, Homo sapiens
cagggggctgctgctggg

SEQ ID NO: 2446152 - DNA, 21 bp, Homo sapiens
cagggggctgctgctgggctc

SEQ ID NO: 2446153 - DNA, 23 bp, Homo sapiens
cagggggctgctgctgggctcag

SEQ ID NO: 2446154 - DNA, 13 bp, Homo sapiens
cagggggtctggc

SEQ ID NO: 2446155 - DNA, 17 bp, Homo sapiens
cagggggtctggctggt

SEQ ID NO: 2446156 - DNA, 21 bp, Homo sapiens
caggggtctgagctccagctc

SEQ ID NO: 2446157 - DNA, 13 bp, Homo sapiens
cagggtcccacag

SEQ ID NO: 2446158 - DNA, 17 bp, Homo sapiens
cagggtcccacagccac

SEQ ID NO: 2446159 - DNA, 19 bp, Homo sapiens
cagggtcccacagccacgt

SEQ ID NO: 2446160 - DNA, 21 bp, Homo sapiens
cagggtccccgagtgcctagg

SEQ ID NO: 2446161 - DNA, 13 bp, Homo sapiens
cagggtccctctg

SEQ ID NO: 2446162 - DNA, 20 bp, Homo sapiens
cagggtcctcttctgggcct

SEQ ID NO: 2446163 - DNA, 14 bp, Homo sapiens
cagggtcctgggag

SEQ ID NO: 2446164 - DNA, 19 bp, Homo sapiens
cagggtccttttgacactg

SEQ ID NO: 2446165 - DNA, 17 bp, Homo sapiens
cagggtctgctctttct

SEQ ID NO: 2446166 - DNA, 20 bp, Homo sapiens
cagggtgcagtatcatgccc

SEQ ID NO: 2446167 - DNA, 16 bp, Homo sapiens
cagggtgggcttgtgg

SEQ ID NO: 2446168 - DNA, 23 bp, Homo sapiens
cagggttttgccccaagtcctca

SEQ ID NO: 2446169 - DNA, 15 bp, Homo sapiens
caggtaatacaaact

SEQ ID NO: 2446170 - DNA, 20 bp, Homo sapiens
caggtagaattatctaattt

SEQ ID NO: 2446171 - DNA, 21 bp, Homo sapiens
caggtagggggtccctccaag

SEQ ID NO: 2446172 - DNA, 15 bp, Homo sapiens
caggtcagccactgt

SEQ ID NO: 2446173 - DNA, 17 bp, Homo sapiens
caggtccaatgagcttt

SEQ ID NO: 2446174 - DNA, 18 bp, Homo sapiens
caggtccaatgagctttc

SEQ ID NO: 2446175 - DNA, 14 bp, Homo sapiens
caggtccagctctg

SEQ ID NO: 2446176 - DNA, 14 bp, Homo sapiens
caggtccctctcat

SEQ ID NO: 2446177 - DNA, 18 bp, Homo sapiens
caggtcctggtggggcag

SEQ ID NO: 2446178 - DNA, 20 bp, Homo sapiens
caggtcctggtggggcagct

SEQ ID NO: 2446179 - DNA, 12 bp, Homo sapiens
caggtctagact

SEQ ID NO: 2446180 - DNA, 19 bp, Homo sapiens
caggtgactgtctggggag

SEQ ID NO: 2446181 - DNA, 15 bp, Homo sapiens
cagtgttttctggga

SEQ ID NO: 2446182 - DNA, 15 bp, Homo sapiens
cagttaaaaaaaatt

SEQ ID NO: 2446183 - DNA, 16 bp, Homo sapiens
cagttaaaaaaaattt

SEQ ID NO: 2446184 - DNA, 16 bp, Homo sapiens
cagttaatttttccaa

SEQ ID NO: 2446185 - DNA, 23 bp, Homo sapiens
cagttaccattaaaccatctccc

SEQ ID NO: 2446186 - DNA, 17 bp, Homo sapiens
cagttcattagaaatat

SEQ ID NO: 2446187 - DNA, 19 bp, Homo sapiens
cagttcccacattaaagaa

SEQ ID NO: 2446188 - DNA, 15 bp, Homo sapiens
cagttcgcagccacc

SEQ ID NO: 2446189 - DNA, 19 bp, Homo sapiens
cagttcgcagccaccctga

SEQ ID NO: 2446190 - DNA, 18 bp, Homo sapiens
cagttctaacctcctaag

SEQ ID NO: 2446191 - DNA, 11 bp, Homo sapiens
cagttctagga

SEQ ID NO: 2446192 - DNA, 12 bp, Homo sapiens
cagttctaggaa

SEQ ID NO: 2446193 - DNA, 16 bp, Homo sapiens
cagttctttgggccag

SEQ ID NO: 2446194 - DNA, 18 bp, Homo sapiens
cagttctttgggccagac

SEQ ID NO: 2446195 - DNA, 20 bp, Homo sapiens
cagttctttgggccagacat

SEQ ID NO: 2446196 - DNA, 16 bp, Homo sapiens
cagttgattttctgga

SEQ ID NO: 2446197 - DNA, 17 bp, Homo sapiens
cagttgattttctggat

SEQ ID NO: 2446198 - DNA, 19 bp, Homo sapiens
cagttgcagtcactctagt

SEQ ID NO: 2446199 - DNA, 21 bp, Homo sapiens
cagttgcatgtagtaacacta

SEQ ID NO: 2446200 - DNA, 22 bp, Homo sapiens
cagttgccttttatcccaaagt

SEQ ID NO: 2446201 - DNA, 22 bp, Homo sapiens
cagttggagctccagcctgaca

SEQ ID NO: 2446202 - DNA, 14 bp, Homo sapiens
cagttgtatttaac

SEQ ID NO: 2446203 - DNA, 18 bp, Homo sapiens
cagttgtatttaacagaa

SEQ ID NO: 2446204 - DNA, 21 bp, Homo sapiens
cagttgtatttaacagaaatt

SEQ ID NO: 2446205 - DNA, 20 bp, Homo sapiens
cagttgtcccgattgtaact

SEQ ID NO: 2446206 - DNA, 22 bp, Homo sapiens
cagttgtctctgatgcagctta

SEQ ID NO: 2446207 - DNA, 12 bp, Homo sapiens
cagttgttcttt

SEQ ID NO: 2446208 - DNA, 15 bp, Homo sapiens
cagttgttcttttta

SEQ ID NO: 2446209 - DNA, 19 bp, Homo sapiens
cagttgttctttttagaaa

SEQ ID NO: 2446210 - DNA, 15 bp, Homo sapiens
cagtttaaaagcacg

SEQ ID NO: 2446211 - DNA, 13 bp, Homo sapiens
cagtttaatgaag

SEQ ID NO: 2446212 - DNA, 23 bp, Homo sapiens
cagtttacagacgctgctgtcac

SEQ ID NO: 2446213 - DNA, 18 bp, Homo sapiens
cagtttaccagttgcctt

SEQ ID NO: 2446214 - DNA, 15 bp, Homo sapiens
cagtttatcattcaa

SEQ ID NO: 2446215 - DNA, 16 bp, Homo sapiens
cagtttatcattcaag

SEQ ID NO: 2446216 - DNA, 17 bp, Homo sapiens
cagtttcacagaaaata

SEQ ID NO: 2446217 - DNA, 23 bp, Homo sapiens
cagtttcataaaaggagaaccag

SEQ ID NO: 2446218 - DNA, 13 bp, Homo sapiens
cagtttgaaataa

SEQ ID NO: 2446219 - DNA, 11 bp, Homo sapiens
cagtttgcaaa

SEQ ID NO: 2446220 - DNA, 15 bp, Homo sapiens
cagtttgcaaaaaat

SEQ ID NO: 2446221 - DNA, 20 bp, Homo sapiens
cagtttgggtaaaatacttt

SEQ ID NO: 2446222 - DNA, 23 bp, Homo sapiens
cagtttgtgtgtcttaattatta

SEQ ID NO: 2446223 - DNA, 22 bp, Homo sapiens
cagttttaactgtggatattgt

SEQ ID NO: 2446224 - DNA, 23 bp, Homo sapiens
cagttttaactgtggatattgtt

SEQ ID NO: 2446225 - DNA, 13 bp, Homo sapiens
cagtttttattaa

SEQ ID NO: 2446226 - DNA, 16 bp, Homo sapiens
cagttttttatgctaa

SEQ ID NO: 2446227 - DNA, 18 bp, Homo sapiens
cagttttttttttcttgt

SEQ ID NO: 2446228 - DNA, 20 bp, Homo sapiens
cagttttttttttcttgtct

SEQ ID NO: 2446229 - DNA, 12 bp, Homo sapiens
cataaaacaggt

SEQ ID NO: 2446230 - DNA, 13 bp, Homo sapiens
cataaaggaaaag

SEQ ID NO: 2446231 - DNA, 21 bp, Homo sapiens
cataaagttgataaagatttt

SEQ ID NO: 2446232 - DNA, 16 bp, Homo sapiens
cataaatccttgatga

SEQ ID NO: 2446233 - DNA, 17 bp, Homo sapiens
cataacaattcctctac

SEQ ID NO: 2446234 - DNA, 19 bp, Homo sapiens
cataagaaaactaagaaat

SEQ ID NO: 2446235 - DNA, 20 bp, Homo sapiens
cataagctatttttctaact

SEQ ID NO: 2446236 - DNA, 16 bp, Homo sapiens
cataatcactctaatt

SEQ ID NO: 2446237 - DNA, 12 bp, Homo sapiens
cataattgcatt

SEQ ID NO: 2446238 - DNA, 18 bp, Homo sapiens
cataattgcattgacttt

SEQ ID NO: 2446239 - DNA, 21 bp, Homo sapiens
cataattgtgattagacagaa

SEQ ID NO: 2446240 - DNA, 13 bp, Homo sapiens
catacagagaagt

SEQ ID NO: 2446241 - DNA, 13 bp, Homo sapiens
cataccccctccc

SEQ ID NO: 2446242 - DNA, 20 bp, Homo sapiens
cataccccttacaaatgaaa

SEQ ID NO: 2446243 - DNA, 17 bp, Homo sapiens
catacgctcagctcatc

SEQ ID NO: 2446244 - DNA, 15 bp, Homo sapiens
catacgtgcacaggg

SEQ ID NO: 2446245 - DNA, 16 bp, Homo sapiens
catacgtgcacagggt

SEQ ID NO: 2446246 - DNA, 22 bp, Homo sapiens
catactcatttttcatgataat

SEQ ID NO: 2446247 - DNA, 13 bp, Homo sapiens
catactggcctgg

SEQ ID NO: 2446248 - DNA, 20 bp, Homo sapiens
catacttgaacgttttctaa

SEQ ID NO: 2446249 - DNA, 21 bp, Homo sapiens
catacttgaagggccagagcc

SEQ ID NO: 2446250 - DNA, 21 bp, Homo sapiens
catagagccgggtgtccccaa

SEQ ID NO: 2446251 - DNA, 15 bp, Homo sapiens
catagccaggaaact

SEQ ID NO: 2446252 - DNA, 20 bp, Homo sapiens
cataggagtttggaggaagt

SEQ ID NO: 2446253 - DNA, 21 bp, Homo sapiens
cataggtgatccatgtaactg

SEQ ID NO: 2446254 - DNA, 21 bp, Homo sapiens
catagtaacttcttatggaat

SEQ ID NO: 2446255 - DNA, 24 bp, Homo sapiens
catagtaacttcttatggaattga

SEQ ID NO: 2446256 - DNA, 16 bp, Homo sapiens
catagtaccaatcatt

SEQ ID NO: 2446257 - DNA, 22 bp, Homo sapiens
catagtaccaatcattttaatt

SEQ ID NO: 2446258 - DNA, 13 bp, Homo sapiens
catagttcagaat

SEQ ID NO: 2446259 - DNA, 15 bp, Homo sapiens
catataatgttgtta

SEQ ID NO: 2446260 - DNA, 14 bp, Homo sapiens
catatatatactat

SEQ ID NO: 2446261 - DNA, 14 bp, Homo sapiens
catatcacacacat

SEQ ID NO: 2446262 - DNA, 16 bp, Homo sapiens
catatcacacacattg

SEQ ID NO: 2446263 - DNA, 18 bp, Homo sapiens
catatcacacacattgct

SEQ ID NO: 2446264 - DNA, 14 bp, Homo sapiens
catatcatccacac

SEQ ID NO: 2446265 - DNA, 14 bp, Homo sapiens
catatgatttacat

SEQ ID NO: 2446266 - DNA, 16 bp, Homo sapiens
catatgctaccaccag

SEQ ID NO: 2446267 - DNA, 20 bp, Homo sapiens
catatgctaccaccagctgt

SEQ ID NO: 2446268 - DNA, 21 bp, Homo sapiens
catatgctaccaccagctgtg

SEQ ID NO: 2446269 - DNA, 22 bp, Homo sapiens
catatgctaccaccagctgtgt

SEQ ID NO: 2446270 - DNA, 23 bp, Homo sapiens
catatgctaccaccagctgtgtc

SEQ ID NO: 2446271 - DNA, 15 bp, Homo sapiens
catatgtaccatgta

SEQ ID NO: 2446272 - DNA, 21 bp, Homo sapiens
catatgtaccatgtacatgaa

SEQ ID NO: 2446273 - DNA, 18 bp, Homo sapiens
catatgttgaatactttt

SEQ ID NO: 2446274 - DNA, 14 bp, Homo sapiens
catatgtttggtaa

SEQ ID NO: 2446275 - DNA, 17 bp, Homo sapiens
catattgtaaaacaggt

SEQ ID NO: 2446276 - DNA, 17 bp, Homo sapiens
catatttacctcagcct

SEQ ID NO: 2446277 - DNA, 18 bp, Homo sapiens
catatttgtaaaatgaca

SEQ ID NO: 2446278 - DNA, 17 bp, Homo sapiens
catattttaaacagagg

SEQ ID NO: 2446279 - DNA, 15 bp, Homo sapiens
catcaaaaaaggcag

SEQ ID NO: 2446280 - DNA, 13 bp, Homo sapiens
catcaaaatgctt

SEQ ID NO: 2446281 - DNA, 11 bp, Homo sapiens
catcaaagagg

SEQ ID NO: 2446282 - DNA, 23 bp, Homo sapiens
catcaaagaggctgaggctggca

SEQ ID NO: 2446283 - DNA, 15 bp, Homo sapiens
catcaacaaaaattg

SEQ ID NO: 2446284 - DNA, 16 bp, Homo sapiens
catcaagactttgcta

SEQ ID NO: 2446285 - DNA, 14 bp, Homo sapiens
catgactgcttgcc

SEQ ID NO: 2446286 - DNA, 16 bp, Homo sapiens
catgactgcttgccct

SEQ ID NO: 2446287 - DNA, 18 bp, Homo sapiens
catgactgcttgccctaa

SEQ ID NO: 2446288 - DNA, 18 bp, Homo sapiens
catgagaaatacaaaaat

SEQ ID NO: 2446289 - DNA, 17 bp, Homo sapiens
catgagaccactgttat

SEQ ID NO: 2446290 - DNA, 22 bp, Homo sapiens
catgagatgatacatccaaagc

SEQ ID NO: 2446291 - DNA, 21 bp, Homo sapiens
catgaggagattctgcctttg

SEQ ID NO: 2446292 - DNA, 18 bp, Homo sapiens
catgaggccactggagac

SEQ ID NO: 2446293 - DNA, 15 bp, Homo sapiens
catgaggggttcctc

SEQ ID NO: 2446294 - DNA, 19 bp, Homo sapiens
catgagttccagaaagtaa

SEQ ID NO: 2446295 - DNA, 22 bp, Homo sapiens
catgataccacctttactgtgc

SEQ ID NO: 2446296 - DNA, 21 bp, Homo sapiens
catgatccctgtgttgtctct

SEQ ID NO: 2446297 - DNA, 20 bp, Homo sapiens
catgatgcctctgtcttctg

SEQ ID NO: 2446298 - DNA, 19 bp, Homo sapiens
catgatggcaacagatctg

SEQ ID NO: 2446299 - DNA, 22 bp, Homo sapiens
catgattcctttaacaacatgt

SEQ ID NO: 2446300 - DNA, 17 bp, Homo sapiens
catgatttccttgaatg

SEQ ID NO: 2446301 - DNA, 14 bp, Homo sapiens
catgcaaactcttt

SEQ ID NO: 2446302 - DNA, 14 bp, Homo sapiens
catgcactgtgaag

SEQ ID NO: 2446303 - DNA, 17 bp, Homo sapiens
catgcactgtgaaggac

SEQ ID NO: 2446304 - DNA, 22 bp, Homo sapiens
catgcactgtgaaggacccttg

SEQ ID NO: 2446305 - DNA, 14 bp, Homo sapiens
catgcatcatctca

SEQ ID NO: 2446306 - DNA, 15 bp, Homo sapiens
catgcatctgtttat

SEQ ID NO: 2446307 - DNA, 16 bp, Homo sapiens
catgccaggctaattt

SEQ ID NO: 2446308 - DNA, 18 bp, Homo sapiens
catgcccagagacccagc

SEQ ID NO: 2446309 - DNA, 19 bp, Homo sapiens
catgcccagagacccagcg

SEQ ID NO: 2446310 - DNA, 15 bp, Homo sapiens
catgcccctggctgg

SEQ ID NO: 2446311 - DNA, 21 bp, Homo sapiens
catgcccggctaatttttgta

SEQ ID NO: 2446312 - DNA, 15 bp, Homo sapiens
catgcctctgaggcc

SEQ ID NO: 2446313 - DNA, 18 bp, Homo sapiens
catgcctctgaggccagc

SEQ ID NO: 2446314 - DNA, 19 bp, Homo sapiens
catgcctctgaggccagcc

SEQ ID NO: 2446315 - DNA, 22 bp, Homo sapiens
catgcctctgaggccagcctgg

SEQ ID NO: 2446316 - DNA, 21 bp, Homo sapiens
catgcgatgacacttgtacaa

SEQ ID NO: 2446317 - DNA, 22 bp, Homo sapiens
catgcgatgacacttgtacaat

SEQ ID NO: 2446318 - DNA, 23 bp, Homo sapiens
catgcgccccctccgccctgcca

SEQ ID NO: 2446319 - DNA, 22 bp, Homo sapiens
catgcgctcagggccatgctga

SEQ ID NO: 2446320 - DNA, 23 bp, Homo sapiens
catgcgctcagggccatgctgag

SEQ ID NO: 2446321 - DNA, 14 bp, Homo sapiens
catgcggtagccag

SEQ ID NO: 2446322 - DNA, 15 bp, Homo sapiens
catgcggtagccagc

SEQ ID NO: 2446323 - DNA, 13 bp, Homo sapiens
catgctaagagaa

SEQ ID NO: 2446324 - DNA, 19 bp, Homo sapiens
catgctaagagaagtagaa

SEQ ID NO: 2446325 - DNA, 16 bp, Homo sapiens
catgctcatctgctgg

SEQ ID NO: 2446326 - DNA, 22 bp, Homo sapiens
catgctccagattagagcctgt

SEQ ID NO: 2446327 - DNA, 14 bp, Homo sapiens
catgctcctcttcc

SEQ ID NO: 2446328 - DNA, 16 bp, Homo sapiens
catgctcctcttcccc

SEQ ID NO: 2446329 - DNA, 16 bp, Homo sapiens
catgctggagggaggc

SEQ ID NO: 2446330 - DNA, 13 bp, Homo sapiens
catgctgggattt

SEQ ID NO: 2446331 - DNA, 14 bp, Homo sapiens
catgctgggatttc

SEQ ID NO: 2446332 - DNA, 19 bp, Homo sapiens
catgctgggatttccaact

SEQ ID NO: 2446333 - DNA, 16 bp, Homo sapiens
catgcttattccatga

SEQ ID NO: 2446334 - DNA, 16 bp, Homo sapiens
catgcttcacaatgtt

SEQ ID NO: 2446335 - DNA, 16 bp, Homo sapiens
catggaaatttaaagc

SEQ ID NO: 2446336 - DNA, 18 bp, Homo sapiens
catggaaatttaaagcag

SEQ ID NO: 2446337 - DNA, 15 bp, Homo sapiens
catggacaatggacc

SEQ ID NO: 2446338 - DNA, 15 bp, Homo sapiens
catggacaggctggc

SEQ ID NO: 2446339 - DNA, 18 bp, Homo sapiens
catggacaggctggctcc

SEQ ID NO: 2446340 - DNA, 16 bp, Homo sapiens
catggactctgtcctg

SEQ ID NO: 2446341 - DNA, 21 bp, Homo sapiens
catggagaaagctgacttggc

SEQ ID NO: 2446342 - DNA, 18 bp, Homo sapiens
catggagggagggagtgg

SEQ ID NO: 2446343 - DNA, 22 bp, Homo sapiens
catggagggagggagtggtttg

SEQ ID NO: 2446344 - DNA, 18 bp, Homo sapiens
catggaggttctaaggcc

SEQ ID NO: 2446345 - DNA, 14 bp, Homo sapiens
catggagtggcagc

SEQ ID NO: 2446346 - DNA, 21 bp, Homo sapiens
catggagtggcagcccagcca

SEQ ID NO: 2446347 - DNA, 14 bp, Homo sapiens
catggcagggggct

SEQ ID NO: 2446348 - DNA, 15 bp, Homo sapiens
catggcatccaagac

SEQ ID NO: 2446349 - DNA, 20 bp, Homo sapiens
catggccagcagcacctgcc

SEQ ID NO: 2446350 - DNA, 20 bp, Homo sapiens
catggccagctggaggcagg

SEQ ID NO: 2446351 - DNA, 21 bp, Homo sapiens
catggccagctggaggcaggg

SEQ ID NO: 2446352 - DNA, 16 bp, Homo sapiens
catggcccctctgacc

SEQ ID NO: 2446353 - DNA, 17 bp, Homo sapiens
catggccctgagcgagt

SEQ ID NO: 2446354 - DNA, 14 bp, Homo sapiens
catggctattttat

SEQ ID NO: 2446355 - DNA, 15 bp, Homo sapiens
catggctattttata

SEQ ID NO: 2446356 - DNA, 22 bp, Homo sapiens
catggctcagatcggccacagg

SEQ ID NO: 2446357 - DNA, 16 bp, Homo sapiens
catgggattattagaa

SEQ ID NO: 2446358 - DNA, 20 bp, Homo sapiens
catgggcccaggcctcacca

SEQ ID NO: 2446359 - DNA, 20 bp, Homo sapiens
catgggccccaggggaacac

SEQ ID NO: 2446360 - DNA, 12 bp, Homo sapiens
catggggaggag

SEQ ID NO: 2446361 - DNA, 13 bp, Homo sapiens
catgggggagggg

SEQ ID NO: 2446362 - DNA, 17 bp, Homo sapiens
catgggggagggggcag

SEQ ID NO: 2446363 - DNA, 20 bp, Homo sapiens
catgggtatagttcatgtct

SEQ ID NO: 2446364 - DNA, 15 bp, Homo sapiens
catggtcacacactg

SEQ ID NO: 2446365 - DNA, 17 bp, Homo sapiens
catggtcccacatccct

SEQ ID NO: 2446366 - DNA, 18 bp, Homo sapiens
catggtcccacatccctg

SEQ ID NO: 2446367 - DNA, 19 bp, Homo sapiens
catggtcccacatccctgg

SEQ ID NO: 2446368 - DNA, 22 bp, Homo sapiens
catggtcccacatccctgggcc

SEQ ID NO: 2446369 - DNA, 13 bp, Homo sapiens
catggtctgccct

SEQ ID NO: 2446370 - DNA, 19 bp, Homo sapiens
catggtgccccaggaccag

SEQ ID NO: 2446371 - DNA, 16 bp, Homo sapiens
catggtgttctcctgc

SEQ ID NO: 2446372 - DNA, 17 bp, Homo sapiens
catggtgttctcctgct

SEQ ID NO: 2446373 - DNA, 16 bp, Homo sapiens
catggttaagagtcca

SEQ ID NO: 2446374 - DNA, 18 bp, Homo sapiens
catggttaccatgtcttt

SEQ ID NO: 2446375 - DNA, 19 bp, Homo sapiens
catgtaacgcaagttccca

SEQ ID NO: 2446376 - DNA, 19 bp, Homo sapiens
catgtaactgcctagaaac

SEQ ID NO: 2446377 - DNA, 21 bp, Homo sapiens
catgtaactgcctagaaacaa

SEQ ID NO: 2446378 - DNA, 16 bp, Homo sapiens
catgtagtaacactaa

SEQ ID NO: 2446379 - DNA, 17 bp, Homo sapiens
catgtagtaacactaat

SEQ ID NO: 2446380 - DNA, 18 bp, Homo sapiens
catgtcatttcagaagtt

SEQ ID NO: 2446381 - DNA, 12 bp, Homo sapiens
catgtccaaaga

SEQ ID NO: 2446382 - DNA, 15 bp, Homo sapiens
catgtccaaagaggc

SEQ ID NO: 2446383 - DNA, 17 bp, Homo sapiens
catgtccaaagaggctg

SEQ ID NO: 2446384 - DNA, 19 bp, Homo sapiens
catgtccaaagaggctgcc

SEQ ID NO: 2446385 - DNA, 20 bp, Homo sapiens
catgtccaaagaggctgccc

SEQ ID NO: 2446386 - DNA, 16 bp, Homo sapiens
catgtgacatttatat

SEQ ID NO: 2446387 - DNA, 24 bp, Homo sapiens
catgtgccagggcaatgatgaatg

SEQ ID NO: 2446388 - DNA, 15 bp, Homo sapiens
catgtggctggaaga

SEQ ID NO: 2446389 - DNA, 14 bp, Homo sapiens
catttgctttggaa

SEQ ID NO: 2446390 - DNA, 15 bp, Homo sapiens
catttgctttggaag

SEQ ID NO: 2446391 - DNA, 15 bp, Homo sapiens
catttggaatacttt

SEQ ID NO: 2446392 - DNA, 21 bp, Homo sapiens
catttggatcctgtgtggaga

SEQ ID NO: 2446393 - DNA, 20 bp, Homo sapiens
catttggcatccctgggcct

SEQ ID NO: 2446394 - DNA, 20 bp, Homo sapiens
catttgggagacatgtgaca

SEQ ID NO: 2446395 - DNA, 16 bp, Homo sapiens
catttggttcattaat

SEQ ID NO: 2446396 - DNA, 21 bp, Homo sapiens
catttggttcattaattctat

SEQ ID NO: 2446397 - DNA, 19 bp, Homo sapiens
catttgtttatgtaatttc

SEQ ID NO: 2446398 - DNA, 17 bp, Homo sapiens
cattttaattattattc

SEQ ID NO: 2446399 - DNA, 16 bp, Homo sapiens
cattttcaccccaccc

SEQ ID NO: 2446400 - DNA, 10 bp, Homo sapiens
cattttctgg

SEQ ID NO: 2446401 - DNA, 22 bp, Homo sapiens
cattttctggccagtgtttaaa

SEQ ID NO: 2446402 - DNA, 21 bp, Homo sapiens
cattttgaaagtctgtccttg

SEQ ID NO: 2446403 - DNA, 15 bp, Homo sapiens
cattttgaatcacat

SEQ ID NO: 2446404 - DNA, 12 bp, Homo sapiens
cattttgtaata

SEQ ID NO: 2446405 - DNA, 20 bp, Homo sapiens
catttttacaatgtaattat

SEQ ID NO: 2446406 - DNA, 18 bp, Homo sapiens
catttttaccatcactga

SEQ ID NO: 2446407 - DNA, 15 bp, Homo sapiens
cattttttaggaaat

SEQ ID NO: 2446408 - DNA, 21 bp, Homo sapiens
catttttttttcaatcaactt

SEQ ID NO: 2446409 - DNA, 16 bp, Homo sapiens
ccaaaaagtgaaataa

SEQ ID NO: 2446410 - DNA, 12 bp, Homo sapiens
ccaaaaatagct

SEQ ID NO: 2446411 - DNA, 12 bp, Homo sapiens
ccaaaactgctc

SEQ ID NO: 2446412 - DNA, 15 bp, Homo sapiens
ccaaacaccttccag

SEQ ID NO: 2446413 - DNA, 19 bp, Homo sapiens
ccaaacaccttccagctcc

SEQ ID NO: 2446414 - DNA, 20 bp, Homo sapiens
ccaaacaccttccagctcct

SEQ ID NO: 2446415 - DNA, 22 bp, Homo sapiens
ccaaagaggctgcccctctcac

SEQ ID NO: 2446416 - DNA, 16 bp, Homo sapiens
ccaaagctttcctgcc

SEQ ID NO: 2446417 - DNA, 18 bp, Homo sapiens
ccaaaggacgcactgagc

SEQ ID NO: 2446418 - DNA, 14 bp, Homo sapiens
ccaaaggctccctg

SEQ ID NO: 2446419 - DNA, 18 bp, Homo sapiens
ccaaaggggacctggaag

SEQ ID NO: 2446420 - DNA, 19 bp, Homo sapiens
ccaaagtcataattgcatt

SEQ ID NO: 2446421 - DNA, 19 bp, Homo sapiens
ccaaatactaatgaaaaca

SEQ ID NO: 2446422 - DNA, 16 bp, Homo sapiens
ccaaatcaaaatctct

SEQ ID NO: 2446423 - DNA, 21 bp, Homo sapiens
ccaaatccttagatctggcat

SEQ ID NO: 2446424 - DNA, 14 bp, Homo sapiens
ccaaatctggaagc

SEQ ID NO: 2446425 - DNA, 13 bp, Homo sapiens
ccaaattaaaaaa

SEQ ID NO: 2446426 - DNA, 11 bp, Homo sapiens
ccaaatttaaa

SEQ ID NO: 2446427 - DNA, 16 bp, Homo sapiens
ccaacaccaagcacag

SEQ ID NO: 2446428 - DNA, 16 bp, Homo sapiens
ccaacacgcacctgcc

SEQ ID NO: 2446429 - DNA, 20 bp, Homo sapiens
ccaacacgcacctgcctcag

SEQ ID NO: 2446430 - DNA, 16 bp, Homo sapiens
ccaacagcgcccaaag

SEQ ID NO: 2446431 - DNA, 18 bp, Homo sapiens
ccaacagctggaccctga

SEQ ID NO: 2446432 - DNA, 17 bp, Homo sapiens
ccaacatgcactgatgt

SEQ ID NO: 2446433 - DNA, 21 bp, Homo sapiens
ccaacatgcactgatgttgtg

SEQ ID NO: 2446434 - DNA, 17 bp, Homo sapiens
ccaaccatttcctcaga

SEQ ID NO: 2446435 - DNA, 19 bp, Homo sapiens
ccaacccccgacttcatcc

SEQ ID NO: 2446436 - DNA, 17 bp, Homo sapiens
ccaacccgtggaggctg

SEQ ID NO: 2446437 - DNA, 20 bp, Homo sapiens
ccaacccgtggaggctgctc

SEQ ID NO: 2446438 - DNA, 12 bp, Homo sapiens
ccaaccctcagg

SEQ ID NO: 2446439 - DNA, 14 bp, Homo sapiens
ccaaccctcagggc

SEQ ID NO: 2446440 - DNA, 15 bp, Homo sapiens
ccaaccctcagggca

SEQ ID NO: 2446441 - DNA, 17 bp, Homo sapiens
ccaacctgctctcctct

SEQ ID NO: 2446442 - DNA, 22 bp, Homo sapiens
ccaactactgtgttatgcaaaa

SEQ ID NO: 2446443 - DNA, 17 bp, Homo sapiens
ccaactagcccctgggg

SEQ ID NO: 2446444 - DNA, 22 bp, Homo sapiens
ccaactccgtgtggtaagcaac

SEQ ID NO: 2446445 - DNA, 19 bp, Homo sapiens
ccaactcctagttctagaa

SEQ ID NO: 2446446 - DNA, 16 bp, Homo sapiens
ccaactccttccagct

SEQ ID NO: 2446447 - DNA, 15 bp, Homo sapiens
ccaactgaccacctt

SEQ ID NO: 2446448 - DNA, 18 bp, Homo sapiens
ccaagaagcagtggcctt

SEQ ID NO: 2446449 - DNA, 21 bp, Homo sapiens
ccaagaatccacatttctaaa

SEQ ID NO: 2446450 - DNA, 11 bp, Homo sapiens
ccaagaatctt

SEQ ID NO: 2446451 - DNA, 17 bp, Homo sapiens
ccaagagcatcatgcct

SEQ ID NO: 2446452 - DNA, 23 bp, Homo sapiens
ccaagagcatcatgcctctgagg

SEQ ID NO: 2446453 - DNA, 15 bp, Homo sapiens
ccaagagtctaaaga

SEQ ID NO: 2446454 - DNA, 16 bp, Homo sapiens
ccaagagtctaaagat

SEQ ID NO: 2446455 - DNA, 18 bp, Homo sapiens
ccaagatggcccatcctg

SEQ ID NO: 2446456 - DNA, 22 bp, Homo sapiens
ccaagatgggcatcttttgtat

SEQ ID NO: 2446457 - DNA, 16 bp, Homo sapiens
ccaagattctagatga

SEQ ID NO: 2446458 - DNA, 17 bp, Homo sapiens
ccaagattctagatgat

SEQ ID NO: 2446459 - DNA, 17 bp, Homo sapiens
ccaagcacagcagcctg

SEQ ID NO: 2446460 - DNA, 22 bp, Homo sapiens
ccaagcacctccaaccaaataa

SEQ ID NO: 2446461 - DNA, 18 bp, Homo sapiens
ccaagcaggaaatgaaaa

SEQ ID NO: 2446462 - DNA, 13 bp, Homo sapiens
ccaagcatcttgg

SEQ ID NO: 2446463 - DNA, 18 bp, Homo sapiens
ccaagccaagggaacctg

SEQ ID NO: 2446464 - DNA, 16 bp, Homo sapiens
ccaagccagaggctgg

SEQ ID NO: 2446465 - DNA, 17 bp, Homo sapiens
ccaagccagaggctggg

SEQ ID NO: 2446466 - DNA, 12 bp, Homo sapiens
ccaagctgaggt

SEQ ID NO: 2446467 - DNA, 21 bp, Homo sapiens
ccaagctgaggtgcccaggag

SEQ ID NO: 2446468 - DNA, 15 bp, Homo sapiens
ccaagctgagtttcc

SEQ ID NO: 2446469 - DNA, 16 bp, Homo sapiens
ccaagctgagtttcct

SEQ ID NO: 2446470 - DNA, 14 bp, Homo sapiens
ccaaggaggcagcc

SEQ ID NO: 2446471 - DNA, 21 bp, Homo sapiens
ccaaggcagaggcctgggctg

SEQ ID NO: 2446472 - DNA, 13 bp, Homo sapiens
ccaaggccaggtt

SEQ ID NO: 2446473 - DNA, 16 bp, Homo sapiens
ccaagggaacctgtgt

SEQ ID NO: 2446474 - DNA, 13 bp, Homo sapiens
ccaagggaggctg

SEQ ID NO: 2446475 - DNA, 19 bp, Homo sapiens
ccaagggcataaattattg

SEQ ID NO: 2446476 - DNA, 14 bp, Homo sapiens
ccaaggggcctgag

SEQ ID NO: 2446477 - DNA, 16 bp, Homo sapiens
ccaaggggcctgagca

SEQ ID NO: 2446478 - DNA, 16 bp, Homo sapiens
ccaaggtaccatccta

SEQ ID NO: 2446479 - DNA, 13 bp, Homo sapiens
ccaaggtgtccta

SEQ ID NO: 2446480 - DNA, 22 bp, Homo sapiens
ccaaggtgtcctacagaaaaac

SEQ ID NO: 2446481 - DNA, 19 bp, Homo sapiens
ccaaggtttaaagagtcta

SEQ ID NO: 2446482 - DNA, 17 bp, Homo sapiens
ccaagtccaggtcctgg

SEQ ID NO: 2446483 - DNA, 22 bp, Homo sapiens
ccaagtgacctatacctgtgtt

SEQ ID NO: 2446484 - DNA, 16 bp, Homo sapiens
ccaagttaaatgtaga

SEQ ID NO: 2446485 - DNA, 13 bp, Homo sapiens
ccaagttcctcta

SEQ ID NO: 2446486 - DNA, 18 bp, Homo sapiens
ccaatattaaatctgctg

SEQ ID NO: 2446487 - DNA, 13 bp, Homo sapiens
ccaatcctatgtt

SEQ ID NO: 2446488 - DNA, 16 bp, Homo sapiens
ccaatcctcccagaaa

SEQ ID NO: 2446489 - DNA, 14 bp, Homo sapiens
ccaatgagctttct

SEQ ID NO: 2446490 - DNA, 22 bp, Homo sapiens
ccaatgagctttctgaacagct

SEQ ID NO: 2446491 - DNA, 15 bp, Homo sapiens
ccaatgtctggagac

SEQ ID NO: 2446492 - DNA, 14 bp, Homo sapiens
ccaattagtttcct

SEQ ID NO: 2446493 - DNA, 16 bp, Homo sapiens
ccaattagtttccttt

SEQ ID NO: 2446494 - DNA, 14 bp, Homo sapiens
ccactctgcttctc

SEQ ID NO: 2446495 - DNA, 16 bp, Homo sapiens
ccactctggcagccac

SEQ ID NO: 2446496 - DNA, 17 bp, Homo sapiens
ccactctggcagccaca

SEQ ID NO: 2446497 - DNA, 11 bp, Homo sapiens
ccactctgtaa

SEQ ID NO: 2446498 - DNA, 17 bp, Homo sapiens
ccactgaaaaaatatat

SEQ ID NO: 2446499 - DNA, 19 bp, Homo sapiens
ccactgaaaaaatatatgt

SEQ ID NO: 2446500 - DNA, 17 bp, Homo sapiens
ccactgacagcctccca

SEQ ID NO: 2446501 - DNA, 19 bp, Homo sapiens
ccactgacagcctcccacc

SEQ ID NO: 2446502 - DNA, 18 bp, Homo sapiens
ccactgagaggacagaga

SEQ ID NO: 2446503 - DNA, 13 bp, Homo sapiens
ccactgagggcag

SEQ ID NO: 2446504 - DNA, 12 bp, Homo sapiens
ccactgccttcg

SEQ ID NO: 2446505 - DNA, 18 bp, Homo sapiens
ccactggagcagaagggg

SEQ ID NO: 2446506 - DNA, 14 bp, Homo sapiens
ccactggggctcag

SEQ ID NO: 2446507 - DNA, 16 bp, Homo sapiens
ccactgtgttccttcc

SEQ ID NO: 2446508 - DNA, 13 bp, Homo sapiens
ccacttaaaatgt

SEQ ID NO: 2446509 - DNA, 17 bp, Homo sapiens
ccacttaatgtatgtta

SEQ ID NO: 2446510 - DNA, 21 bp, Homo sapiens
ccacttacatttacaaactga

SEQ ID NO: 2446511 - DNA, 16 bp, Homo sapiens
ccacttatagcctctg

SEQ ID NO: 2446512 - DNA, 20 bp, Homo sapiens
ccacttcttgttccccactg

SEQ ID NO: 2446513 - DNA, 16 bp, Homo sapiens
ccacttgcctcttcct

SEQ ID NO: 2446514 - DNA, 18 bp, Homo sapiens
ccacttgtccttagcctg

SEQ ID NO: 2446515 - DNA, 20 bp, Homo sapiens
ccactttaaaatatctacat

SEQ ID NO: 2446516 - DNA, 15 bp, Homo sapiens
ccactttcagctgtc

SEQ ID NO: 2446517 - DNA, 15 bp, Homo sapiens
ccagaaagtaaaggt

SEQ ID NO: 2446518 - DNA, 15 bp, Homo sapiens
ccagaagctccccca

SEQ ID NO: 2446519 - DNA, 17 bp, Homo sapiens
ccagaagctcccccagc

SEQ ID NO: 2446520 - DNA, 20 bp, Homo sapiens
ccagaagtaccagactagat

SEQ ID NO: 2446521 - DNA, 15 bp, Homo sapiens
ccagaataagttatt

SEQ ID NO: 2446522 - DNA, 22 bp, Homo sapiens
ccagaataagttattgcagttt

SEQ ID NO: 2446523 - DNA, 14 bp, Homo sapiens
ccagacacaggccc

SEQ ID NO: 2446524 - DNA, 13 bp, Homo sapiens
ccagacacccagg

SEQ ID NO: 2446525 - DNA, 14 bp, Homo sapiens
ccagacacccagga

SEQ ID NO: 2446526 - DNA, 15 bp, Homo sapiens
ccagacacccaggac

SEQ ID NO: 2446527 - DNA, 16 bp, Homo sapiens
ccagacataaaggaaa

SEQ ID NO: 2446528 - DNA, 16 bp, Homo sapiens
ccagacctgatcctgg

SEQ ID NO: 2446529 - DNA, 17 bp, Homo sapiens
ccagacctgatcctgga

SEQ ID NO: 2446530 - DNA, 19 bp, Homo sapiens
ccagacctgatcctggagg

SEQ ID NO: 2446531 - DNA, 24 bp, Homo sapiens
ccagacctgatcctggaggcccag

SEQ ID NO: 2446532 - DNA, 21 bp, Homo sapiens
ccagacctgttagcagacagg

SEQ ID NO: 2446533 - DNA, 22 bp, Homo sapiens
ccagactagatgtagtattttt

SEQ ID NO: 2446534 - DNA, 13 bp, Homo sapiens
ccagactcttgcc

SEQ ID NO: 2446535 - DNA, 20 bp, Homo sapiens
ccagagaaaggggagcccac

SEQ ID NO: 2446536 - DNA, 22 bp, Homo sapiens
ccagagacatacttgaagggcc

SEQ ID NO: 2446537 - DNA, 13 bp, Homo sapiens
ccagagacccagc

SEQ ID NO: 2446538 - DNA, 16 bp, Homo sapiens
ccagagacccagcgga

SEQ ID NO: 2446539 - DNA, 17 bp, Homo sapiens
ccagagcacctgctgtc

SEQ ID NO: 2446540 - DNA, 18 bp, Homo sapiens
ccagagcacctgctgtct

SEQ ID NO: 2446541 - DNA, 19 bp, Homo sapiens
ccagagcacctgctgtctg

SEQ ID NO: 2446542 - DNA, 13 bp, Homo sapiens
ccagagccaaggg

SEQ ID NO: 2446543 - DNA, 23 bp, Homo sapiens
ccagagccaggggggtgaggagc

SEQ ID NO: 2446544 - DNA, 11 bp, Homo sapiens
ccagagcccac

SEQ ID NO: 2446545 - DNA, 20 bp, Homo sapiens
ccagagcccactccatctgg

SEQ ID NO: 2446546 - DNA, 13 bp, Homo sapiens
ccagagcccagct

SEQ ID NO: 2446547 - DNA, 16 bp, Homo sapiens
ccagagcctggggctc

SEQ ID NO: 2446548 - DNA, 17 bp, Homo sapiens
ccagaggaaggggccag

SEQ ID NO: 2446549 - DNA, 21 bp, Homo sapiens
ccagaggattgctgccccatc

SEQ ID NO: 2446550 - DNA, 21 bp, Homo sapiens
ccagaggcccccagcccaggg

SEQ ID NO: 2446551 - DNA, 12 bp, Homo sapiens
ccagaggctggg

SEQ ID NO: 2446552 - DNA, 20 bp, Homo sapiens
ccagaggggcctgccacctg

SEQ ID NO: 2446553 - DNA, 17 bp, Homo sapiens
ccagatagtgtagctga

SEQ ID NO: 2446554 - DNA, 18 bp, Homo sapiens
ccagatatcatctaccta

SEQ ID NO: 2446555 - DNA, 13 bp, Homo sapiens
ccagatccagcct

SEQ ID NO: 2446556 - DNA, 15 bp, Homo sapiens
ccagatccagcctgg

SEQ ID NO: 2446557 - DNA, 14 bp, Homo sapiens
ccagatgcagggca

SEQ ID NO: 2446558 - DNA, 18 bp, Homo sapiens
ccagatgcccctttctgg

SEQ ID NO: 2446559 - DNA, 14 bp, Homo sapiens
ccagatgctgaaaa

SEQ ID NO: 2446560 - DNA, 17 bp, Homo sapiens
ccagattagagcctgta

SEQ ID NO: 2446561 - DNA, 19 bp, Homo sapiens
ccagattgacgacaagtgc

SEQ ID NO: 2446562 - DNA, 23 bp, Homo sapiens
ccagatttggggtataggtctca

SEQ ID NO: 2446563 - DNA, 15 bp, Homo sapiens
ccagcacctggcatc

SEQ ID NO: 2446564 - DNA, 18 bp, Homo sapiens
ccagcactgcttgaggaa

SEQ ID NO: 2446565 - DNA, 16 bp, Homo sapiens
ccagcacttgtccagc

SEQ ID NO: 2446566 - DNA, 18 bp, Homo sapiens
ccagcagacagagccagg

SEQ ID NO: 2446567 - DNA, 19 bp, Homo sapiens
ccagcagacagagccagga

SEQ ID NO: 2446568 - DNA, 20 bp, Homo sapiens
ccagcagacagagccaggag

SEQ ID NO: 2446569 - DNA, 10 bp, Homo sapiens
ccagcagctg

SEQ ID NO: 2446570 - DNA, 20 bp, Homo sapiens
ccagcagctgccaggagcac

SEQ ID NO: 2446571 - DNA, 15 bp, Homo sapiens
ccagcatctgggcct

SEQ ID NO: 2446572 - DNA, 14 bp, Homo sapiens
ccagcattccagcc

SEQ ID NO: 2446573 - DNA, 21 bp, Homo sapiens
ccagcattccagcccctctgg

SEQ ID NO: 2446574 - DNA, 17 bp, Homo sapiens
ccagccaaaccctgtct

SEQ ID NO: 2446575 - DNA, 21 bp, Homo sapiens
ccagccaggcccagccgaccc

SEQ ID NO: 2446576 - DNA, 19 bp, Homo sapiens
ccagccagggctcaatctc

SEQ ID NO: 2446577 - DNA, 18 bp, Homo sapiens
ccagccatcaaaatgctt

SEQ ID NO: 2446578 - DNA, 18 bp, Homo sapiens
ccagcccacccccggcag

SEQ ID NO: 2446579 - DNA, 11 bp, Homo sapiens
ccagcccagag

SEQ ID NO: 2446580 - DNA, 14 bp, Homo sapiens
ccagcccagagaca

SEQ ID NO: 2446581 - DNA, 13 bp, Homo sapiens
ccagcccagggct

SEQ ID NO: 2446582 - DNA, 21 bp, Homo sapiens
ccagcccagggctcctgcact

SEQ ID NO: 2446583 - DNA, 16 bp, Homo sapiens
ccagccccagccaggg

SEQ ID NO: 2446584 - DNA, 22 bp, Homo sapiens
ccagccccctcctggtgccacc

SEQ ID NO: 2446585 - DNA, 23 bp, Homo sapiens
ccagccccctgaccactcagaga

SEQ ID NO: 2446586 - DNA, 15 bp, Homo sapiens
ccagcccctctggtc

SEQ ID NO: 2446587 - DNA, 17 bp, Homo sapiens
ccagcccctctggtcgc

SEQ ID NO: 2446588 - DNA, 13 bp, Homo sapiens
ccagcccctcttg

SEQ ID NO: 2446589 - DNA, 18 bp, Homo sapiens
ccagccccttagacagag

SEQ ID NO: 2446590 - DNA, 19 bp, Homo sapiens
ccagccccttagacagagg

SEQ ID NO: 2446591 - DNA, 13 bp, Homo sapiens
ccagccctgcctg

SEQ ID NO: 2446592 - DNA, 16 bp, Homo sapiens
ccagccctgcctggag

SEQ ID NO: 2446593 - DNA, 22 bp, Homo sapiens
ccagccctgcctggaggacctg

SEQ ID NO: 2446594 - DNA, 17 bp, Homo sapiens
ccagccgaccccctctc

SEQ ID NO: 2446595 - DNA, 20 bp, Homo sapiens
ccagccgaccccctctccct

SEQ ID NO: 2446596 - DNA, 22 bp, Homo sapiens
ccagccgaccccctctccctgc

SEQ ID NO: 2446597 - DNA, 23 bp, Homo sapiens
ccagccgaccccctctccctgca

SEQ ID NO: 2446598 - DNA, 20 bp, Homo sapiens
ccagggcagccagggagagc

SEQ ID NO: 2446599 - DNA, 13 bp, Homo sapiens
ccagggcatctct

SEQ ID NO: 2446600 - DNA, 16 bp, Homo sapiens
ccagggccacgctcca

SEQ ID NO: 2446601 - DNA, 19 bp, Homo sapiens
ccagggccacgctccagct

SEQ ID NO: 2446602 - DNA, 21 bp, Homo sapiens
ccagggcccagagcccagctc

SEQ ID NO: 2446603 - DNA, 23 bp, Homo sapiens
ccagggcccagagcccagctcca

SEQ ID NO: 2446604 - DNA, 19 bp, Homo sapiens
ccagggctagtgacttgtg

SEQ ID NO: 2446605 - DNA, 17 bp, Homo sapiens
ccagggctccagcccct

SEQ ID NO: 2446606 - DNA, 20 bp, Homo sapiens
ccagggctcctgcacttact

SEQ ID NO: 2446607 - DNA, 20 bp, Homo sapiens
ccagggctgtaactgccagg

SEQ ID NO: 2446608 - DNA, 23 bp, Homo sapiens
ccaggggcagccccaggccaaag

SEQ ID NO: 2446609 - DNA, 23 bp, Homo sapiens
ccaggggctgcttcctcctggaa

SEQ ID NO: 2446610 - DNA, 19 bp, Homo sapiens
ccaggggggtgaggagctg

SEQ ID NO: 2446611 - DNA, 20 bp, Homo sapiens
ccaggggggtgaggagctgg

SEQ ID NO: 2446612 - DNA, 17 bp, Homo sapiens
ccagggtccctctgtgt

SEQ ID NO: 2446613 - DNA, 16 bp, Homo sapiens
ccagggtcctgggagg

SEQ ID NO: 2446614 - DNA, 14 bp, Homo sapiens
ccagggtgtgtgct

SEQ ID NO: 2446615 - DNA, 13 bp, Homo sapiens
ccagggttttaac

SEQ ID NO: 2446616 - DNA, 16 bp, Homo sapiens
ccagggttttaacttt

SEQ ID NO: 2446617 - DNA, 16 bp, Homo sapiens
ccaggtacttgagaaa

SEQ ID NO: 2446618 - DNA, 14 bp, Homo sapiens
ccaggtaggccaag

SEQ ID NO: 2446619 - DNA, 17 bp, Homo sapiens
ccaggtccaatgagctt

SEQ ID NO: 2446620 - DNA, 17 bp, Homo sapiens
ccaggtccagctctgga

SEQ ID NO: 2446621 - DNA, 13 bp, Homo sapiens
ccaggtccctctc

SEQ ID NO: 2446622 - DNA, 16 bp, Homo sapiens
ccaggtccctctcatt

SEQ ID NO: 2446623 - DNA, 23 bp, Homo sapiens
ccaggtccctctcatttagcctg

SEQ ID NO: 2446624 - DNA, 14 bp, Homo sapiens
ccaggtcctggtgg

SEQ ID NO: 2446625 - DNA, 20 bp, Homo sapiens
ccaggtgttaacattccaag

SEQ ID NO: 2446626 - DNA, 20 bp, Homo sapiens
ccaggttggctctgccagtc

SEQ ID NO: 2446627 - DNA, 14 bp, Homo sapiens
ccagtattttaaaa

SEQ ID NO: 2446628 - DNA, 14 bp, Homo sapiens
ccagtccagtccta

SEQ ID NO: 2446629 - DNA, 19 bp, Homo sapiens
ccagtcctatctgggcttc

SEQ ID NO: 2446630 - DNA, 19 bp, Homo sapiens
ccagtgacagacaggctct

SEQ ID NO: 2446631 - DNA, 21 bp, Homo sapiens
ccagtgacagacaggctctta

SEQ ID NO: 2446632 - DNA, 18 bp, Homo sapiens
ccagtgcccccactgacc

SEQ ID NO: 2446633 - DNA, 23 bp, Homo sapiens
ccagtgccctctcccctcagcct

SEQ ID NO: 2446634 - DNA, 15 bp, Homo sapiens
ccagtgccctgagcc

SEQ ID NO: 2446635 - DNA, 16 bp, Homo sapiens
ccagtgccctgagcca

SEQ ID NO: 2446636 - DNA, 18 bp, Homo sapiens
ccagtgccctgagccagg

SEQ ID NO: 2446637 - DNA, 21 bp, Homo sapiens
ccagtgccctgagccagggtc

SEQ ID NO: 2446638 - DNA, 16 bp, Homo sapiens
ccagtgccctgatccc

SEQ ID NO: 2446639 - DNA, 23 bp, Homo sapiens
ccagtgtcctgagctcagcgtgg

SEQ ID NO: 2446640 - DNA, 19 bp, Homo sapiens
ccagttaatcttgctttct

SEQ ID NO: 2446641 - DNA, 12 bp, Homo sapiens
ccagttgcagtc

SEQ ID NO: 2446642 - DNA, 19 bp, Homo sapiens
ccagttggagctccagcct

SEQ ID NO: 2446643 - DNA, 22 bp, Homo sapiens
ccagttggagctccagcctgac

SEQ ID NO: 2446644 - DNA, 21 bp, Homo sapiens
ccagttgtcccgattgtaact

SEQ ID NO: 2446645 - DNA, 21 bp, Homo sapiens
ccagttgttagattaagaaat

SEQ ID NO: 2446646 - DNA, 16 bp, Homo sapiens
ccagtttccttgggag

SEQ ID NO: 2446647 - DNA, 19 bp, Homo sapiens
ccagtttctaaactggaga

SEQ ID NO: 2446648 - DNA, 20 bp, Homo sapiens
ccagtttctaaactggagac

SEQ ID NO: 2446649 - DNA, 15 bp, Homo sapiens
ccatagtcttaactg

SEQ ID NO: 2446650 - DNA, 21 bp, Homo sapiens
ccatagtggatcactcaccat

SEQ ID NO: 2446651 - DNA, 19 bp, Homo sapiens
ccatatgctaccaccagct

SEQ ID NO: 2446652 - DNA, 21 bp, Homo sapiens
ccatatgctaccaccagctgt

SEQ ID NO: 2446653 - DNA, 22 bp, Homo sapiens
ccatatgctaccaccagctgtg

SEQ ID NO: 2446654 - DNA, 22 bp, Homo sapiens
ccatattaaattttttgttgac

SEQ ID NO: 2446655 - DNA, 14 bp, Homo sapiens
ccatattgtaaaac

SEQ ID NO: 2446656 - DNA, 16 bp, Homo sapiens
ccatatttacctcagc

SEQ ID NO: 2446657 - DNA, 19 bp, Homo sapiens
ccatatttacctcagcctg

SEQ ID NO: 2446658 - DNA, 21 bp, Homo sapiens
ccatatttacctcagcctggg

SEQ ID NO: 2446659 - DNA, 12 bp, Homo sapiens
ccatatttgtaa

SEQ ID NO: 2446660 - DNA, 13 bp, Homo sapiens
ccatatttgtaaa

SEQ ID NO: 2446661 - DNA, 22 bp, Homo sapiens
ccatatttgtaaaatgacaatc

SEQ ID NO: 2446662 - DNA, 19 bp, Homo sapiens
ccatcaaaatgctttttat

SEQ ID NO: 2446663 - DNA, 12 bp, Homo sapiens
ccatcagtgctc

SEQ ID NO: 2446664 - DNA, 14 bp, Homo sapiens
ccatcatcctctgg

SEQ ID NO: 2446665 - DNA, 17 bp, Homo sapiens
ccatccacatgggagcc

SEQ ID NO: 2446666 - DNA, 13 bp, Homo sapiens
ccatccatggcca

SEQ ID NO: 2446667 - DNA, 16 bp, Homo sapiens
ccatccatggccagca

SEQ ID NO: 2446668 - DNA, 16 bp, Homo sapiens
ccatcccacaccctgg

SEQ ID NO: 2446669 - DNA, 13 bp, Homo sapiens
ccatccctggccc

SEQ ID NO: 2446670 - DNA, 16 bp, Homo sapiens
ccatccctggccccct

SEQ ID NO: 2446671 - DNA, 23 bp, Homo sapiens
ccatccctggccccctccctgga

SEQ ID NO: 2446672 - DNA, 17 bp, Homo sapiens
ccatcctaggctgacac

SEQ ID NO: 2446673 - DNA, 12 bp, Homo sapiens
ccatcctgacca

SEQ ID NO: 2446674 - DNA, 11 bp, Homo sapiens
ccatctcaggc

SEQ ID NO: 2446675 - DNA, 20 bp, Homo sapiens
ccatctcatgcccctggctg

SEQ ID NO: 2446676 - DNA, 16 bp, Homo sapiens
ccatctccctggtgct

SEQ ID NO: 2446677 - DNA, 11 bp, Homo sapiens
ccatctgctcc

SEQ ID NO: 2446678 - DNA, 14 bp, Homo sapiens
ccatctgctcctgg

SEQ ID NO: 2446679 - DNA, 16 bp, Homo sapiens
ccatctgggctcctcc

SEQ ID NO: 2446680 - DNA, 21 bp, Homo sapiens
ccatcttgcttccctaatcta

SEQ ID NO: 2446681 - DNA, 15 bp, Homo sapiens
ccatgaaccaagacc

SEQ ID NO: 2446682 - DNA, 20 bp, Homo sapiens
ccatgaccctgcctctccca

SEQ ID NO: 2446683 - DNA, 14 bp, Homo sapiens
ccatgacctccagc

SEQ ID NO: 2446684 - DNA, 21 bp, Homo sapiens
ccatgacctccagctttcctg

SEQ ID NO: 2446685 - DNA, 21 bp, Homo sapiens
ccatgactgcttgccctaagc

SEQ ID NO: 2446686 - DNA, 19 bp, Homo sapiens
ccatgagttccagaaagta

SEQ ID NO: 2446687 - DNA, 22 bp, Homo sapiens
ccatgagttggggtctggcagc

SEQ ID NO: 2446688 - DNA, 14 bp, Homo sapiens
ccatgatgcctctg

SEQ ID NO: 2446689 - DNA, 15 bp, Homo sapiens
ccatgatggcaacag

SEQ ID NO: 2446690 - DNA, 23 bp, Homo sapiens
ccatgattctatttatatgtaca

SEQ ID NO: 2446691 - DNA, 13 bp, Homo sapiens
ccatgcactgtga

SEQ ID NO: 2446692 - DNA, 16 bp, Homo sapiens
ccatgcactgtgaagg

SEQ ID NO: 2446693 - DNA, 17 bp, Homo sapiens
ccatgcactgtgaagga

SEQ ID NO: 2446694 - DNA, 20 bp, Homo sapiens
ccatgcactgtgaaggaccc

SEQ ID NO: 2446695 - DNA, 14 bp, Homo sapiens
ccatgcgccccctc

SEQ ID NO: 2446696 - DNA, 13 bp, Homo sapiens
ccatgcgctcagg

SEQ ID NO: 2446697 - DNA, 15 bp, Homo sapiens
ccatgcgctcagggc

SEQ ID NO: 2446698 - DNA, 16 bp, Homo sapiens
ccatgctcatctgctg

SEQ ID NO: 2446699 - DNA, 19 bp, Homo sapiens
ccatgctcctcttccccag

SEQ ID NO: 2446700 - DNA, 20 bp, Homo sapiens
ccatgctcctcttccccaga

SEQ ID NO: 2446701 - DNA, 15 bp, Homo sapiens
ccatgctgaggcctg

SEQ ID NO: 2446702 - DNA, 19 bp, Homo sapiens
cccagaataagttattgca

SEQ ID NO: 2446703 - DNA, 22 bp, Homo sapiens
cccagacctgttagcagacagg

SEQ ID NO: 2446704 - DNA, 13 bp, Homo sapiens
cccagactcagac

SEQ ID NO: 2446705 - DNA, 20 bp, Homo sapiens
cccagactcagacattggca

SEQ ID NO: 2446706 - DNA, 10 bp, Homo sapiens
cccagacttg

SEQ ID NO: 2446707 - DNA, 18 bp, Homo sapiens
cccagagacatacttgaa

SEQ ID NO: 2446708 - DNA, 14 bp, Homo sapiens
cccagagcacctgc

SEQ ID NO: 2446709 - DNA, 17 bp, Homo sapiens
cccagagcacctgctgt

SEQ ID NO: 2446710 - DNA, 12 bp, Homo sapiens
cccagagcccag

SEQ ID NO: 2446711 - DNA, 16 bp, Homo sapiens
cccagagcccaggctc

SEQ ID NO: 2446712 - DNA, 20 bp, Homo sapiens
cccagaggagccaccagttc

SEQ ID NO: 2446713 - DNA, 18 bp, Homo sapiens
cccagaggggcctgccac

SEQ ID NO: 2446714 - DNA, 22 bp, Homo sapiens
cccagcattccagcccctctgg

SEQ ID NO: 2446715 - DNA, 15 bp, Homo sapiens
cccagccaggcccag

SEQ ID NO: 2446716 - DNA, 16 bp, Homo sapiens
cccagccaggcccagc

SEQ ID NO: 2446717 - DNA, 11 bp, Homo sapiens
cccagcccaga

SEQ ID NO: 2446718 - DNA, 13 bp, Homo sapiens
cccagcccagaga

SEQ ID NO: 2446719 - DNA, 22 bp, Homo sapiens
cccagccccactcctctgctga

SEQ ID NO: 2446720 - DNA, 19 bp, Homo sapiens
cccagccgaccccctctcc

SEQ ID NO: 2446721 - DNA, 22 bp, Homo sapiens
cccagccgaccccctctccctg

SEQ ID NO: 2446722 - DNA, 23 bp, Homo sapiens
cccagccgcttggcgatgccagc

SEQ ID NO: 2446723 - DNA, 18 bp, Homo sapiens
cccagcctccctgaagcc

SEQ ID NO: 2446724 - DNA, 10 bp, Homo sapiens
cccagcctgg

SEQ ID NO: 2446725 - DNA, 12 bp, Homo sapiens
cccagcctgggc

SEQ ID NO: 2446726 - DNA, 13 bp, Homo sapiens
cccagcctgggcc

SEQ ID NO: 2446727 - DNA, 14 bp, Homo sapiens
cccagcctgggcct

SEQ ID NO: 2446728 - DNA, 18 bp, Homo sapiens
cccagcctgggcctatgg

SEQ ID NO: 2446729 - DNA, 19 bp, Homo sapiens
cccagcctgggcctatgga

SEQ ID NO: 2446730 - DNA, 11 bp, Homo sapiens
cccagcctgtc

SEQ ID NO: 2446731 - DNA, 12 bp, Homo sapiens
cccagcctgtca

SEQ ID NO: 2446732 - DNA, 17 bp, Homo sapiens
cccagctaagaacctgg

SEQ ID NO: 2446733 - DNA, 19 bp, Homo sapiens
cccagctaagaacctggaa

SEQ ID NO: 2446734 - DNA, 18 bp, Homo sapiens
cccagctaggaagagcag

SEQ ID NO: 2446735 - DNA, 22 bp, Homo sapiens
cccagctaggaagagcaggact

SEQ ID NO: 2446736 - DNA, 12 bp, Homo sapiens
cccagctctgaa

SEQ ID NO: 2446737 - DNA, 14 bp, Homo sapiens
cccagctctgaaac

SEQ ID NO: 2446738 - DNA, 22 bp, Homo sapiens
cccagctctgaaaccagtgtta

SEQ ID NO: 2446739 - DNA, 19 bp, Homo sapiens
cccagctgggtcaggcagg

SEQ ID NO: 2446740 - DNA, 16 bp, Homo sapiens
cccaggacaagcatgg

SEQ ID NO: 2446741 - DNA, 21 bp, Homo sapiens
cccaggacaagcatggtccca

SEQ ID NO: 2446742 - DNA, 16 bp, Homo sapiens
cccaggaccacaggct

SEQ ID NO: 2446743 - DNA, 23 bp, Homo sapiens
cccaggaccacaggctcaggcag

SEQ ID NO: 2446744 - DNA, 15 bp, Homo sapiens
cccaggaccagctca

SEQ ID NO: 2446745 - DNA, 16 bp, Homo sapiens
cccaggaccagctcag

SEQ ID NO: 2446746 - DNA, 20 bp, Homo sapiens
cccaggaccctggacccagc

SEQ ID NO: 2446747 - DNA, 15 bp, Homo sapiens
cccaggatccccaag

SEQ ID NO: 2446748 - DNA, 13 bp, Homo sapiens
cccaggcaaggct

SEQ ID NO: 2446749 - DNA, 12 bp, Homo sapiens
cccaggcactgc

SEQ ID NO: 2446750 - DNA, 13 bp, Homo sapiens
cccaggccaggac

SEQ ID NO: 2446751 - DNA, 17 bp, Homo sapiens
cccaggccaggactctg

SEQ ID NO: 2446752 - DNA, 18 bp, Homo sapiens
cccaggccaggactctgc

SEQ ID NO: 2446753 - DNA, 23 bp, Homo sapiens
cccaggccaggactctgcagcct

SEQ ID NO: 2446754 - DNA, 22 bp, Homo sapiens
cccaggccccatgacctccagc

SEQ ID NO: 2446755 - DNA, 20 bp, Homo sapiens
cccaggcccggatgcagagg

SEQ ID NO: 2446756 - DNA, 22 bp, Homo sapiens
cccaggctcgtggactgagtgg

SEQ ID NO: 2446757 - DNA, 22 bp, Homo sapiens
cccaggctgccgtcccctagag

SEQ ID NO: 2446758 - DNA, 19 bp, Homo sapiens
cccaggctggagtgcagtg

SEQ ID NO: 2446759 - DNA, 20 bp, Homo sapiens
cccagggaagcagcagcctc

SEQ ID NO: 2446760 - DNA, 18 bp, Homo sapiens
cccagggacacctgggag

SEQ ID NO: 2446761 - DNA, 14 bp, Homo sapiens
cccagggcacagga

SEQ ID NO: 2446762 - DNA, 17 bp, Homo sapiens
cccagggcacaggagct

SEQ ID NO: 2446763 - DNA, 20 bp, Homo sapiens
cccagggcccagagcccagc

SEQ ID NO: 2446764 - DNA, 15 bp, Homo sapiens
cccagggctcctgca

SEQ ID NO: 2446765 - DNA, 17 bp, Homo sapiens
cccagggctgggaggaa

SEQ ID NO: 2446766 - DNA, 20 bp, Homo sapiens
cccagggctgggaggaagga

SEQ ID NO: 2446767 - DNA, 19 bp, Homo sapiens
cccaggggaacactgggga

SEQ ID NO: 2446768 - DNA, 16 bp, Homo sapiens
cccaggggctccctcc

SEQ ID NO: 2446769 - DNA, 15 bp, Homo sapiens
cccagggtcctggga

SEQ ID NO: 2446770 - DNA, 17 bp, Homo sapiens
cccaggtaggggcccct

SEQ ID NO: 2446771 - DNA, 20 bp, Homo sapiens
cccaggtaggggcccctctc

SEQ ID NO: 2446772 - DNA, 18 bp, Homo sapiens
cccaggtccagctctgga

SEQ ID NO: 2446773 - DNA, 21 bp, Homo sapiens
cccaggtctgggtggggccca

SEQ ID NO: 2446774 - DNA, 19 bp, Homo sapiens
cccaggtgttaacattcca

SEQ ID NO: 2446775 - DNA, 21 bp, Homo sapiens
cccaggtgttaacattccaag

SEQ ID NO: 2446776 - DNA, 22 bp, Homo sapiens
cccaggtgttaacattccaaga

SEQ ID NO: 2446777 - DNA, 15 bp, Homo sapiens
cccaggttggctctg

SEQ ID NO: 2446778 - DNA, 20 bp, Homo sapiens
cccaggttggctctgccagt

SEQ ID NO: 2446779 - DNA, 19 bp, Homo sapiens
cccagttgcactcaggtga

SEQ ID NO: 2446780 - DNA, 21 bp, Homo sapiens
cccagttggagctccagcctg

SEQ ID NO: 2446781 - DNA, 21 bp, Homo sapiens
cccatcacctactcacacagg

SEQ ID NO: 2446782 - DNA, 22 bp, Homo sapiens
cccatcagtgctccctcacatg

SEQ ID NO: 2446783 - DNA, 23 bp, Homo sapiens
cccatcagtgctccctcacatgt

SEQ ID NO: 2446784 - DNA, 14 bp, Homo sapiens
cccatcatcctctg

SEQ ID NO: 2446785 - DNA, 13 bp, Homo sapiens
cccatccagggcc

SEQ ID NO: 2446786 - DNA, 15 bp, Homo sapiens
cccatccctccccag

SEQ ID NO: 2446787 - DNA, 14 bp, Homo sapiens
cccatccctgtggt

SEQ ID NO: 2446788 - DNA, 22 bp, Homo sapiens
cccatcgtctcggccttcacaa

SEQ ID NO: 2446789 - DNA, 16 bp, Homo sapiens
cccatctcaggccaga

SEQ ID NO: 2446790 - DNA, 21 bp, Homo sapiens
cccatctcatgcccctggctg

SEQ ID NO: 2446791 - DNA, 17 bp, Homo sapiens
cccatctgtctgccaac

SEQ ID NO: 2446792 - DNA, 16 bp, Homo sapiens
cccatgcactgtgaag

SEQ ID NO: 2446793 - DNA, 14 bp, Homo sapiens
cccatggccctgag

SEQ ID NO: 2446794 - DNA, 12 bp, Homo sapiens
cccattcccgca

SEQ ID NO: 2446795 - DNA, 15 bp, Homo sapiens
cccattcccgcagtg

SEQ ID NO: 2446796 - DNA, 18 bp, Homo sapiens
cccattcctgaagaacca

SEQ ID NO: 2446797 - DNA, 14 bp, Homo sapiens
cccattcctgggaa

SEQ ID NO: 2446798 - DNA, 18 bp, Homo sapiens
cccattccttcccagagg

SEQ ID NO: 2446799 - DNA, 18 bp, Homo sapiens
ccccaaacaccttccagc

SEQ ID NO: 2446800 - DNA, 18 bp, Homo sapiens
ccccaaagctttcctgcc

SEQ ID NO: 2446801 - DNA, 14 bp, Homo sapiens
ccccaacagctgga

SEQ ID NO: 2446802 - DNA, 22 bp, Homo sapiens
ccccaacagctggaccctgacc

SEQ ID NO: 2446803 - DNA, 15 bp, Homo sapiens
ccccaacctgctctc

SEQ ID NO: 2446804 - DNA, 16 bp, Homo sapiens
ccccaacctgctctcc

SEQ ID NO: 2446805 - DNA, 21 bp, Homo sapiens
ccccaacctgctctcctcttc

SEQ ID NO: 2446806 - DNA, 20 bp, Homo sapiens
ccccaccccagggcagccag

SEQ ID NO: 2446807 - DNA, 13 bp, Homo sapiens
ccccacccccagc

SEQ ID NO: 2446808 - DNA, 14 bp, Homo sapiens
ccccaccctggcct

SEQ ID NO: 2446809 - DNA, 12 bp, Homo sapiens
ccccaccctggg

SEQ ID NO: 2446810 - DNA, 14 bp, Homo sapiens
ccccaccctgggcc

SEQ ID NO: 2446811 - DNA, 20 bp, Homo sapiens
ccccaccctggtgggccaac

SEQ ID NO: 2446812 - DNA, 19 bp, Homo sapiens
ccccaccctgttcctgctg

SEQ ID NO: 2446813 - DNA, 15 bp, Homo sapiens
ccccactctgctctg

SEQ ID NO: 2446814 - DNA, 16 bp, Homo sapiens
ccccactctgctctga

SEQ ID NO: 2446815 - DNA, 12 bp, Homo sapiens
ccccactggagc

SEQ ID NO: 2446816 - DNA, 14 bp, Homo sapiens
ccccacttgcctct

SEQ ID NO: 2446817 - DNA, 15 bp, Homo sapiens
ccccacttgcctctt

SEQ ID NO: 2446818 - DNA, 15 bp, Homo sapiens
ccccagactagatgt

SEQ ID NO: 2446819 - DNA, 13 bp, Homo sapiens
ccccagagcccag

SEQ ID NO: 2446820 - DNA, 14 bp, Homo sapiens
ccccagagcccagg

SEQ ID NO: 2446821 - DNA, 16 bp, Homo sapiens
ccccagcccagagaca

SEQ ID NO: 2446822 - DNA, 15 bp, Homo sapiens
ccccagcccagggct

SEQ ID NO: 2446823 - DNA, 16 bp, Homo sapiens
ccccagccccctaaga

SEQ ID NO: 2446824 - DNA, 15 bp, Homo sapiens
ccccagcctctggca

SEQ ID NO: 2446825 - DNA, 16 bp, Homo sapiens
ccccagcctctggcat

SEQ ID NO: 2446826 - DNA, 10 bp, Homo sapiens
ccccagcctg

SEQ ID NO: 2446827 - DNA, 11 bp, Homo sapiens
ccccagctacc

SEQ ID NO: 2446828 - DNA, 22 bp, Homo sapiens
ccccagctaccctttttctcca

SEQ ID NO: 2446829 - DNA, 13 bp, Homo sapiens
ccccagctcccag

SEQ ID NO: 2446830 - DNA, 14 bp, Homo sapiens
ccccagctcccagg

SEQ ID NO: 2446831 - DNA, 11 bp, Homo sapiens
ccccaggacca

SEQ ID NO: 2446832 - DNA, 13 bp, Homo sapiens
ccccaggaccagc

SEQ ID NO: 2446833 - DNA, 15 bp, Homo sapiens
ccccaggaccagctc

SEQ ID NO: 2446834 - DNA, 20 bp, Homo sapiens
ccccaggacctggctgccat

SEQ ID NO: 2446835 - DNA, 21 bp, Homo sapiens
ccccaggcctgaaagaggctg

SEQ ID NO: 2446836 - DNA, 23 bp, Homo sapiens
ccccaggcctgaaagaggctgag

SEQ ID NO: 2446837 - DNA, 18 bp, Homo sapiens
ccccaggctcgtggactg

SEQ ID NO: 2446838 - DNA, 16 bp, Homo sapiens
ccccagggaagcagca

SEQ ID NO: 2446839 - DNA, 12 bp, Homo sapiens
ccccagggagag

SEQ ID NO: 2446840 - DNA, 12 bp, Homo sapiens
ccccagggcaca

SEQ ID NO: 2446841 - DNA, 14 bp, Homo sapiens
ccccagggcacagg

SEQ ID NO: 2446842 - DNA, 21 bp, Homo sapiens
ccccaggtccagctctggagg

SEQ ID NO: 2446843 - DNA, 22 bp, Homo sapiens
ccccaggtccagctctggaggg

SEQ ID NO: 2446844 - DNA, 21 bp, Homo sapiens
ccccagttcctgtggctccct

SEQ ID NO: 2446845 - DNA, 13 bp, Homo sapiens
ccccatcagtgct

SEQ ID NO: 2446846 - DNA, 14 bp, Homo sapiens
ccccatcagtgctc

SEQ ID NO: 2446847 - DNA, 16 bp, Homo sapiens
ccccatcatcctctgg

SEQ ID NO: 2446848 - DNA, 13 bp, Homo sapiens
ccccatctcaggc

SEQ ID NO: 2446849 - DNA, 12 bp, Homo sapiens
ccccatcttgct

SEQ ID NO: 2446850 - DNA, 14 bp, Homo sapiens
ccccatcttgcttc

SEQ ID NO: 2446851 - DNA, 19 bp, Homo sapiens
ccccatgcactgtgaagga

SEQ ID NO: 2446852 - DNA, 13 bp, Homo sapiens
ccccatggccctg

SEQ ID NO: 2446853 - DNA, 16 bp, Homo sapiens
ccccatggccctgagc

SEQ ID NO: 2446854 - DNA, 14 bp, Homo sapiens
ccccatgtgtcctg

SEQ ID NO: 2446855 - DNA, 23 bp, Homo sapiens
ccccatgtgtcctggttcccgtt

SEQ ID NO: 2446856 - DNA, 13 bp, Homo sapiens
ccccattcccgca

SEQ ID NO: 2446857 - DNA, 20 bp, Homo sapiens
cccccaagggaggctgctgc

SEQ ID NO: 2446858 - DNA, 13 bp, Homo sapiens
cccccaatccatg

SEQ ID NO: 2446859 - DNA, 17 bp, Homo sapiens
cccccacccccagctca

SEQ ID NO: 2446860 - DNA, 14 bp, Homo sapiens
cccccaccctgttc

SEQ ID NO: 2446861 - DNA, 18 bp, Homo sapiens
cccccaccctgttcctgc

SEQ ID NO: 2446862 - DNA, 20 bp, Homo sapiens
cccccagcaaagcccccaga

SEQ ID NO: 2446863 - DNA, 14 bp, Homo sapiens
cccccagcccaggg

SEQ ID NO: 2446864 - DNA, 21 bp, Homo sapiens
cccccagcccagggctcctgc

SEQ ID NO: 2446865 - DNA, 14 bp, Homo sapiens
cccccagcctgggc

SEQ ID NO: 2446866 - DNA, 16 bp, Homo sapiens
cccccagcctgggcct

SEQ ID NO: 2446867 - DNA, 15 bp, Homo sapiens
cccccagctcccacc

SEQ ID NO: 2446868 - DNA, 18 bp, Homo sapiens
cccccagggtcctgggag

SEQ ID NO: 2446869 - DNA, 19 bp, Homo sapiens
ccccccaagggaggctgct

SEQ ID NO: 2446870 - DNA, 21 bp, Homo sapiens
ccccccaagggaggctgctgc

SEQ ID NO: 2446871 - DNA, 12 bp, Homo sapiens
cccccctctgtc

SEQ ID NO: 2446872 - DNA, 19 bp, Homo sapiens
ccccctctccctgcatggc

SEQ ID NO: 2446873 - DNA, 14 bp, Homo sapiens
ccccctgcagcttg

SEQ ID NO: 2446874 - DNA, 12 bp, Homo sapiens
ccccctgcagga

SEQ ID NO: 2446875 - DNA, 17 bp, Homo sapiens
ccccctggtcccctcct

SEQ ID NO: 2446876 - DNA, 14 bp, Homo sapiens
cccccttgagtggg

SEQ ID NO: 2446877 - DNA, 18 bp, Homo sapiens
ccccctttcacaggcagc

SEQ ID NO: 2446878 - DNA, 16 bp, Homo sapiens
ccccgacttcatccca

SEQ ID NO: 2446879 - DNA, 14 bp, Homo sapiens
ccccgcagacacct

SEQ ID NO: 2446880 - DNA, 17 bp, Homo sapiens
cccctaagagagcacct

SEQ ID NO: 2446881 - DNA, 13 bp, Homo sapiens
cccctcaccctgc

SEQ ID NO: 2446882 - DNA, 13 bp, Homo sapiens
cccctcacctcct

SEQ ID NO: 2446883 - DNA, 14 bp, Homo sapiens
cccctcacctcctc

SEQ ID NO: 2446884 - DNA, 13 bp, Homo sapiens
cccctcccctcca

SEQ ID NO: 2446885 - DNA, 17 bp, Homo sapiens
cccctccgccctgccac

SEQ ID NO: 2446886 - DNA, 17 bp, Homo sapiens
cccctcctctagctgtg

SEQ ID NO: 2446887 - DNA, 17 bp, Homo sapiens
cccctctcccagttgtc

SEQ ID NO: 2446888 - DNA, 19 bp, Homo sapiens
cccctctccttcctgtgtg

SEQ ID NO: 2446889 - DNA, 15 bp, Homo sapiens
cccctctccttctta

SEQ ID NO: 2446890 - DNA, 12 bp, Homo sapiens
cccctctggtcg

SEQ ID NO: 2446891 - DNA, 20 bp, Homo sapiens
cccctctggtcgctcctgcc

SEQ ID NO: 2446892 - DNA, 22 bp, Homo sapiens
cccctcttggagaagtctcagc

SEQ ID NO: 2446893 - DNA, 20 bp, Homo sapiens
cccctgaccactcagagaca

SEQ ID NO: 2446894 - DNA, 20 bp, Homo sapiens
cccctgacctgtgagcccag

SEQ ID NO: 2446895 - DNA, 14 bp, Homo sapiens
cccctgcactgtaa

SEQ ID NO: 2446896 - DNA, 17 bp, Homo sapiens
cccctgcactgtaaaat

SEQ ID NO: 2446897 - DNA, 18 bp, Homo sapiens
cccctgcactgtaaaatg

SEQ ID NO: 2446898 - DNA, 19 bp, Homo sapiens
cccctgcaggaaggagctg

SEQ ID NO: 2446899 - DNA, 16 bp, Homo sapiens
cccctgccccctgcag

SEQ ID NO: 2446900 - DNA, 18 bp, Homo sapiens
cccctgccccctgcagga

SEQ ID NO: 2446901 - DNA, 13 bp, Homo sapiens
cccctgcccctcc

SEQ ID NO: 2446902 - DNA, 15 bp, Homo sapiens
cccctgcctgccctg

SEQ ID NO: 2446903 - DNA, 22 bp, Homo sapiens
cccctgctttgggcttgggcct

SEQ ID NO: 2446904 - DNA, 15 bp, Homo sapiens
cccctggagggggaa

SEQ ID NO: 2446905 - DNA, 22 bp, Homo sapiens
cccctggctgggacgtggctca

SEQ ID NO: 2446906 - DNA, 12 bp, Homo sapiens
aaaagttataac

SEQ ID NO: 2446907 - DNA, 14 bp, Homo sapiens
aaaagttgcagctg

SEQ ID NO: 2446908 - DNA, 21 bp, Homo sapiens
aaaagttgcagctgttttgtt

SEQ ID NO: 2446909 - DNA, 22 bp, Homo sapiens
aaaagttgctatttgaactttt

SEQ ID NO: 2446910 - DNA, 16 bp, Homo sapiens
aaaataaaaaagatcc

SEQ ID NO: 2446911 - DNA, 21 bp, Homo sapiens
aaaataaagaaaagatgcact

SEQ ID NO: 2446912 - DNA, 16 bp, Homo sapiens
aaaataagaatagaaa

SEQ ID NO: 2446913 - DNA, 16 bp, Homo sapiens
aaaataagtcaacagt

SEQ ID NO: 2446914 - DNA, 18 bp, Homo sapiens
aaaataagtcaacagtaa

SEQ ID NO: 2446915 - DNA, 23 bp, Homo sapiens
aaaataatactgctgagatacat

SEQ ID NO: 2446916 - DNA, 23 bp, Homo sapiens
aaaataatcaaaagctatttaaa

SEQ ID NO: 2446917 - DNA, 16 bp, Homo sapiens
aaaataatttttatat

SEQ ID NO: 2446918 - DNA, 17 bp, Homo sapiens
aaaatagcaaaagaaga

SEQ ID NO: 2446919 - DNA, 22 bp, Homo sapiens
aaaatagggactatctatctta

SEQ ID NO: 2446920 - DNA, 20 bp, Homo sapiens
aaaatagggtatattttcct

SEQ ID NO: 2446921 - DNA, 23 bp, Homo sapiens
aaaatagttaagacatgatttcc

SEQ ID NO: 2446922 - DNA, 22 bp, Homo sapiens
aaaatagtttggatatgtaaaa

SEQ ID NO: 2446923 - DNA, 18 bp, Homo sapiens
aaaatcagctattttgtg

SEQ ID NO: 2446924 - DNA, 15 bp, Homo sapiens
aaaatcatcagaaag

SEQ ID NO: 2446925 - DNA, 20 bp, Homo sapiens
aaaatctctccactttcagc

SEQ ID NO: 2446926 - DNA, 21 bp, Homo sapiens
aaaatctctccactttcagct

SEQ ID NO: 2446927 - DNA, 18 bp, Homo sapiens
aaaatcttatagttctag

SEQ ID NO: 2446928 - DNA, 15 bp, Homo sapiens
aaaatcttgatcagt

SEQ ID NO: 2446929 - DNA, 19 bp, Homo sapiens
aaaatcttgtcatgtgtat

SEQ ID NO: 2446930 - DNA, 14 bp, Homo sapiens
aaaatgaaagctac

SEQ ID NO: 2446931 - DNA, 19 bp, Homo sapiens
aaaatgaaagctactcata

SEQ ID NO: 2446932 - DNA, 17 bp, Homo sapiens
aaaatgacaatcatgtg

SEQ ID NO: 2446933 - DNA, 18 bp, Homo sapiens
aaaatgcggttataaaaa

SEQ ID NO: 2446934 - DNA, 13 bp, Homo sapiens
aaaatgcttttta

SEQ ID NO: 2446935 - DNA, 22 bp, Homo sapiens
aaaatggtccaattagtttcct

SEQ ID NO: 2446936 - DNA, 19 bp, Homo sapiens
aaaatgtaaaggagtcaaa

SEQ ID NO: 2446937 - DNA, 15 bp, Homo sapiens
aaaatgtatgcatgt

SEQ ID NO: 2446938 - DNA, 15 bp, Homo sapiens
aaaatgtatgtctgg

SEQ ID NO: 2446939 - DNA, 18 bp, Homo sapiens
aaaatgtattttatgtta

SEQ ID NO: 2446940 - DNA, 20 bp, Homo sapiens
aaaatgtgatgttctaaggc

SEQ ID NO: 2446941 - DNA, 21 bp, Homo sapiens
aaaatgtgggattatgggtca

SEQ ID NO: 2446942 - DNA, 22 bp, Homo sapiens
aaaatgtgggattatgggtcac

SEQ ID NO: 2446943 - DNA, 18 bp, Homo sapiens
aaaatgttatcttctcaa

SEQ ID NO: 2446944 - DNA, 15 bp, Homo sapiens
aaaatgttctttgga

SEQ ID NO: 2446945 - DNA, 17 bp, Homo sapiens
aaaatgttgaaatatga

SEQ ID NO: 2446946 - DNA, 22 bp, Homo sapiens
aaaatgtttttggtcttttata

SEQ ID NO: 2446947 - DNA, 14 bp, Homo sapiens
aaaattactgttta

SEQ ID NO: 2446948 - DNA, 13 bp, Homo sapiens
aaaattatttaaa

SEQ ID NO: 2446949 - DNA, 13 bp, Homo sapiens
aaaattcagcaaa

SEQ ID NO: 2446950 - DNA, 14 bp, Homo sapiens
aaaattcagcaaag

SEQ ID NO: 2446951 - DNA, 13 bp, Homo sapiens
aaaattcattttt

SEQ ID NO: 2446952 - DNA, 13 bp, Homo sapiens
aaaattccactca

SEQ ID NO: 2446953 - DNA, 12 bp, Homo sapiens
aaaattgatttt

SEQ ID NO: 2446954 - DNA, 13 bp, Homo sapiens
aaaattgtgatca

SEQ ID NO: 2446955 - DNA, 16 bp, Homo sapiens
aaaatttgttcttgta

SEQ ID NO: 2446956 - DNA, 20 bp, Homo sapiens
aaaatttgttcttgtattta

SEQ ID NO: 2446957 - DNA, 18 bp, Homo sapiens
aaacaaagagttcaagaa

SEQ ID NO: 2446958 - DNA, 16 bp, Homo sapiens
aaacaacaatttctac

SEQ ID NO: 2446959 - DNA, 15 bp, Homo sapiens
aaacaaccatgtcat

SEQ ID NO: 2446960 - DNA, 17 bp, Homo sapiens
aaacaagaaaaataaag

SEQ ID NO: 2446961 - DNA, 12 bp, Homo sapiens
aaacaagtattt

SEQ ID NO: 2446962 - DNA, 15 bp, Homo sapiens
aaacaccaacataaa

SEQ ID NO: 2446963 - DNA, 19 bp, Homo sapiens
aaacaccaacataaaaatg

SEQ ID NO: 2446964 - DNA, 13 bp, Homo sapiens
aaacactgtgcac

SEQ ID NO: 2446965 - DNA, 15 bp, Homo sapiens
aaacacttgcaacct

SEQ ID NO: 2446966 - DNA, 20 bp, Homo sapiens
aaacagccaccgtttcttcc

SEQ ID NO: 2446967 - DNA, 18 bp, Homo sapiens
aaacagttggtaactttt

SEQ ID NO: 2446968 - DNA, 21 bp, Homo sapiens
aaacatgaccctaaatcttga

SEQ ID NO: 2446969 - DNA, 12 bp, Homo sapiens
aaacatgtttcc

SEQ ID NO: 2446970 - DNA, 20 bp, Homo sapiens
aaacattaatagcagccttt

SEQ ID NO: 2446971 - DNA, 22 bp, Homo sapiens
aaacattaatagcagcctttct

SEQ ID NO: 2446972 - DNA, 18 bp, Homo sapiens
aaacatttattttgacat

SEQ ID NO: 2446973 - DNA, 20 bp, Homo sapiens
aaacatttattttgacataa

SEQ ID NO: 2446974 - DNA, 16 bp, Homo sapiens
aaacattttctggcca

SEQ ID NO: 2446975 - DNA, 18 bp, Homo sapiens
aaaccactgaaaaaatat

SEQ ID NO: 2446976 - DNA, 13 bp, Homo sapiens
aaaccagctcagc

SEQ ID NO: 2446977 - DNA, 16 bp, Homo sapiens
aaaccagcttccttca

SEQ ID NO: 2446978 - DNA, 17 bp, Homo sapiens
aaaccagcttccttcag

SEQ ID NO: 2446979 - DNA, 18 bp, Homo sapiens
aaaccagcttccttcaga

SEQ ID NO: 2446980 - DNA, 19 bp, Homo sapiens
aaaccagtgttagggaagg

SEQ ID NO: 2446981 - DNA, 15 bp, Homo sapiens
aaacccaatccaaat

SEQ ID NO: 2446982 - DNA, 15 bp, Homo sapiens
aaaccctagccttgc

SEQ ID NO: 2446983 - DNA, 16 bp, Homo sapiens
aaaccctagccttgct

SEQ ID NO: 2446984 - DNA, 18 bp, Homo sapiens
aaaccctagccttgcttg

SEQ ID NO: 2446985 - DNA, 16 bp, Homo sapiens
aaaccgctaaaagaaa

SEQ ID NO: 2446986 - DNA, 18 bp, Homo sapiens
aaaccgctaaaagaaact

SEQ ID NO: 2446987 - DNA, 14 bp, Homo sapiens
aaacctcaccaact

SEQ ID NO: 2446988 - DNA, 23 bp, Homo sapiens
aaacctgagatttattaaagaaa

SEQ ID NO: 2446989 - DNA, 17 bp, Homo sapiens
aaacctttcttcaccaa

SEQ ID NO: 2446990 - DNA, 17 bp, Homo sapiens
aaacgagactttccatt

SEQ ID NO: 2446991 - DNA, 20 bp, Homo sapiens
aaacgatttttaaaatgtac

SEQ ID NO: 2446992 - DNA, 15 bp, Homo sapiens
aaactaataattgca

SEQ ID NO: 2446993 - DNA, 15 bp, Homo sapiens
aaactccagatgcca

SEQ ID NO: 2446994 - DNA, 22 bp, Homo sapiens
aaactccagatgccacaatgga

SEQ ID NO: 2446995 - DNA, 21 bp, Homo sapiens
aaactctttggtcgttttttt

SEQ ID NO: 2446996 - DNA, 21 bp, Homo sapiens
aaactgaagcagcctctcccc

SEQ ID NO: 2446997 - DNA, 17 bp, Homo sapiens
aaactgcatgaaaaatc

SEQ ID NO: 2446998 - DNA, 16 bp, Homo sapiens
aaactgcatgcccaga

SEQ ID NO: 2446999 - DNA, 10 bp, Homo sapiens
aaactggaga

SEQ ID NO: 2447000 - DNA, 18 bp, Homo sapiens
aaactgggaacccctttc

SEQ ID NO: 2447001 - DNA, 17 bp, Homo sapiens
aaactgtaatacaatga

SEQ ID NO: 2447002 - DNA, 13 bp, Homo sapiens
aaactgtacagtg

SEQ ID NO: 2447003 - DNA, 16 bp, Homo sapiens
aaactgtacagtgtct

SEQ ID NO: 2447004 - DNA, 12 bp, Homo sapiens
aaactgtgcacc

SEQ ID NO: 2447005 - DNA, 18 bp, Homo sapiens
aaactgtttttgaacctg

SEQ ID NO: 2447006 - DNA, 17 bp, Homo sapiens
aaacttggatacttgga

SEQ ID NO: 2447007 - DNA, 16 bp, Homo sapiens
aaacttgtaatttttt

SEQ ID NO: 2447008 - DNA, 13 bp, Homo sapiens
aaactttaatata

SEQ ID NO: 2447009 - DNA, 15 bp, Homo sapiens
aaactttatcactta

SEQ ID NO: 2447010 - DNA, 17 bp, Homo sapiens
aacagtgaagacagaag

SEQ ID NO: 2447011 - DNA, 14 bp, Homo sapiens
aacagtggatcaca

SEQ ID NO: 2447012 - DNA, 16 bp, Homo sapiens
aacagtgtgcaaggca

SEQ ID NO: 2447013 - DNA, 18 bp, Homo sapiens
aacagtgtgcaaggcagc

SEQ ID NO: 2447014 - DNA, 17 bp, Homo sapiens
aacagttggtaactttt

SEQ ID NO: 2447015 - DNA, 21 bp, Homo sapiens
aacagttggtaacttttgtga

SEQ ID NO: 2447016 - DNA, 18 bp, Homo sapiens
aacagtttaatgaagatc

SEQ ID NO: 2447017 - DNA, 20 bp, Homo sapiens
aacagtttaatgaagatcta

SEQ ID NO: 2447018 - DNA, 18 bp, Homo sapiens
aacagttttcctatgctt

SEQ ID NO: 2447019 - DNA, 20 bp, Homo sapiens
aacagttttcctatgctttg

SEQ ID NO: 2447020 - DNA, 14 bp, Homo sapiens
aacataaaaatgat

SEQ ID NO: 2447021 - DNA, 22 bp, Homo sapiens
aacatataatgttgttatttaa

SEQ ID NO: 2447022 - DNA, 19 bp, Homo sapiens
aacatgcactgatgttgtg

SEQ ID NO: 2447023 - DNA, 17 bp, Homo sapiens
aacatgtgaaaagaata

SEQ ID NO: 2447024 - DNA, 15 bp, Homo sapiens
aacatgtttccagca

SEQ ID NO: 2447025 - DNA, 18 bp, Homo sapiens
aacatgtttccagcattc

SEQ ID NO: 2447026 - DNA, 19 bp, Homo sapiens
aacatgtttccagcattcc

SEQ ID NO: 2447027 - DNA, 21 bp, Homo sapiens
aacatgtttccagcattccca

SEQ ID NO: 2447028 - DNA, 22 bp, Homo sapiens
aacatgtttccagcattcccag

SEQ ID NO: 2447029 - DNA, 20 bp, Homo sapiens
aacattcctcatgaatgtaa

SEQ ID NO: 2447030 - DNA, 21 bp, Homo sapiens
aacattcctcatgaatgtaaa

SEQ ID NO: 2447031 - DNA, 22 bp, Homo sapiens
aacattcctcatgaatgtaaat

SEQ ID NO: 2447032 - DNA, 16 bp, Homo sapiens
aacattgtagcctcaa

SEQ ID NO: 2447033 - DNA, 22 bp, Homo sapiens
aacatttctatagccaaaaata

SEQ ID NO: 2447034 - DNA, 14 bp, Homo sapiens
aacatttgctgttt

SEQ ID NO: 2447035 - DNA, 12 bp, Homo sapiens
aacattttctgg

SEQ ID NO: 2447036 - DNA, 19 bp, Homo sapiens
aaccaatcctatgcatggt

SEQ ID NO: 2447037 - DNA, 15 bp, Homo sapiens
aaccacgcctcttga

SEQ ID NO: 2447038 - DNA, 16 bp, Homo sapiens
aaccactgaaaaaata

SEQ ID NO: 2447039 - DNA, 19 bp, Homo sapiens
aaccactgaaaaaatatat

SEQ ID NO: 2447040 - DNA, 12 bp, Homo sapiens
aaccactgcttc

SEQ ID NO: 2447041 - DNA, 13 bp, Homo sapiens
aaccactgcttcc

SEQ ID NO: 2447042 - DNA, 14 bp, Homo sapiens
aaccagactcttgc

SEQ ID NO: 2447043 - DNA, 18 bp, Homo sapiens
aaccagggaagctgtccc

SEQ ID NO: 2447044 - DNA, 22 bp, Homo sapiens
aaccaggtccaatgagctttct

SEQ ID NO: 2447045 - DNA, 19 bp, Homo sapiens
aaccatctccctggtgctt

SEQ ID NO: 2447046 - DNA, 16 bp, Homo sapiens
aaccattcgacctata

SEQ ID NO: 2447047 - DNA, 15 bp, Homo sapiens
aaccatttcctcaga

SEQ ID NO: 2447048 - DNA, 22 bp, Homo sapiens
aacccagacctgttagcagaca

SEQ ID NO: 2447049 - DNA, 15 bp, Homo sapiens
aacccagactcagac

SEQ ID NO: 2447050 - DNA, 16 bp, Homo sapiens
aacccagactcagaca

SEQ ID NO: 2447051 - DNA, 17 bp, Homo sapiens
aacccctgtaggcctca

SEQ ID NO: 2447052 - DNA, 18 bp, Homo sapiens
aacccctttcccacccca

SEQ ID NO: 2447053 - DNA, 15 bp, Homo sapiens
aacccgtctggccca

SEQ ID NO: 2447054 - DNA, 18 bp, Homo sapiens
aacccgtggaggctgctc

SEQ ID NO: 2447055 - DNA, 13 bp, Homo sapiens
aaccctagccttg

SEQ ID NO: 2447056 - DNA, 16 bp, Homo sapiens
aaccctagccttgctt

SEQ ID NO: 2447057 - DNA, 18 bp, Homo sapiens
aaccctagccttgcttgt

SEQ ID NO: 2447058 - DNA, 18 bp, Homo sapiens
aaccctctgttccttccc

SEQ ID NO: 2447059 - DNA, 20 bp, Homo sapiens
aacccttgggccagaagtac

SEQ ID NO: 2447060 - DNA, 22 bp, Homo sapiens
aaccgccagctctgttcttcct

SEQ ID NO: 2447061 - DNA, 11 bp, Homo sapiens
aaccgtggccc

SEQ ID NO: 2447062 - DNA, 21 bp, Homo sapiens
aaccgtggcccttcctggaca

SEQ ID NO: 2447063 - DNA, 18 bp, Homo sapiens
aaccgttttgaagctact

SEQ ID NO: 2447064 - DNA, 17 bp, Homo sapiens
aacctaaaactctttcg

SEQ ID NO: 2447065 - DNA, 22 bp, Homo sapiens
aacctatttcttaaacacttgc

SEQ ID NO: 2447066 - DNA, 17 bp, Homo sapiens
aacctcaccaactccta

SEQ ID NO: 2447067 - DNA, 12 bp, Homo sapiens
aacctcagcctg

SEQ ID NO: 2447068 - DNA, 20 bp, Homo sapiens
aacctcatcctccttcttca

SEQ ID NO: 2447069 - DNA, 15 bp, Homo sapiens
aacctgagatttatt

SEQ ID NO: 2447070 - DNA, 14 bp, Homo sapiens
aacctgctctcctc

SEQ ID NO: 2447071 - DNA, 16 bp, Homo sapiens
aacctgctctcctctt

SEQ ID NO: 2447072 - DNA, 20 bp, Homo sapiens
aacctgggttgcagacagga

SEQ ID NO: 2447073 - DNA, 19 bp, Homo sapiens
aacctttacatgaggactc

SEQ ID NO: 2447074 - DNA, 16 bp, Homo sapiens
aacctttgtgccctat

SEQ ID NO: 2447075 - DNA, 19 bp, Homo sapiens
aacgatttttaaaatgtac

SEQ ID NO: 2447076 - DNA, 19 bp, Homo sapiens
aacgcaagttcccagttgg

SEQ ID NO: 2447077 - DNA, 22 bp, Homo sapiens
aacgcaagttcccagttggagc

SEQ ID NO: 2447078 - DNA, 12 bp, Homo sapiens
aacgcctgagcc

SEQ ID NO: 2447079 - DNA, 18 bp, Homo sapiens
aacgcctgagcccaggga

SEQ ID NO: 2447080 - DNA, 16 bp, Homo sapiens
aacgctccaaagtcat

SEQ ID NO: 2447081 - DNA, 20 bp, Homo sapiens
aacgctccaaagtcataatt

SEQ ID NO: 2447082 - DNA, 15 bp, Homo sapiens
aacggattccaaaga

SEQ ID NO: 2447083 - DNA, 20 bp, Homo sapiens
aacgtgctctttgttttgtg

SEQ ID NO: 2447084 - DNA, 15 bp, Homo sapiens
aactaaaataatttt

SEQ ID NO: 2447085 - DNA, 11 bp, Homo sapiens
aactaacatgt

SEQ ID NO: 2447086 - DNA, 23 bp, Homo sapiens
aactaagaaatatgcacaatagc

SEQ ID NO: 2447087 - DNA, 16 bp, Homo sapiens
aactacaaaggtttaa

SEQ ID NO: 2447088 - DNA, 17 bp, Homo sapiens
aactacaaaggtttaaa

SEQ ID NO: 2447089 - DNA, 20 bp, Homo sapiens
aactacaaccaatggaatgt

SEQ ID NO: 2447090 - DNA, 13 bp, Homo sapiens
aactacagtggct

SEQ ID NO: 2447091 - DNA, 13 bp, Homo sapiens
aactacatgagaa

SEQ ID NO: 2447092 - DNA, 17 bp, Homo sapiens
aactactttataactaa

SEQ ID NO: 2447093 - DNA, 19 bp, Homo sapiens
aactactttgctgctaata

SEQ ID NO: 2447094 - DNA, 15 bp, Homo sapiens
aactagaatttgatt

SEQ ID NO: 2447095 - DNA, 17 bp, Homo sapiens
aactagacaccaaagtt

SEQ ID NO: 2447096 - DNA, 22 bp, Homo sapiens
aactagaggtgagaaatttaaa

SEQ ID NO: 2447097 - DNA, 15 bp, Homo sapiens
aactagcattgtaaa

SEQ ID NO: 2447098 - DNA, 23 bp, Homo sapiens
aactaggagctttgactcaggag

SEQ ID NO: 2447099 - DNA, 14 bp, Homo sapiens
aactaggatcagaa

SEQ ID NO: 2447100 - DNA, 17 bp, Homo sapiens
aactatgcatggtgccc

SEQ ID NO: 2447101 - DNA, 23 bp, Homo sapiens
aactatgcatggtgccccaggac

SEQ ID NO: 2447102 - DNA, 16 bp, Homo sapiens
aactcactccttttaa

SEQ ID NO: 2447103 - DNA, 17 bp, Homo sapiens
aactcactccttttaaa

SEQ ID NO: 2447104 - DNA, 20 bp, Homo sapiens
aactcactccttttaaagaa

SEQ ID NO: 2447105 - DNA, 14 bp, Homo sapiens
aactcactttcctc

SEQ ID NO: 2447106 - DNA, 14 bp, Homo sapiens
aactcagatccagg

SEQ ID NO: 2447107 - DNA, 22 bp, Homo sapiens
aactcagatccagggacagagg

SEQ ID NO: 2447108 - DNA, 15 bp, Homo sapiens
aactccaccttccca

SEQ ID NO: 2447109 - DNA, 16 bp, Homo sapiens
aactcctcattgtaaa

SEQ ID NO: 2447110 - DNA, 21 bp, Homo sapiens
aactcctgtgaccacaacatg

SEQ ID NO: 2447111 - DNA, 15 bp, Homo sapiens
aactcgaatctgtgt

SEQ ID NO: 2447112 - DNA, 22 bp, Homo sapiens
aactctatattgttcagcatgc

SEQ ID NO: 2447113 - DNA, 12 bp, Homo sapiens
aactctggtggc

SEQ ID NO: 2447114 - DNA, 23 bp, Homo sapiens
aagactggcttttattaatgcac

SEQ ID NO: 2447115 - DNA, 15 bp, Homo sapiens
aagacttactctaag

SEQ ID NO: 2447116 - DNA, 20 bp, Homo sapiens
aagacttactctaagatctt

SEQ ID NO: 2447117 - DNA, 13 bp, Homo sapiens
aagagaagtagaa

SEQ ID NO: 2447118 - DNA, 21 bp, Homo sapiens
aagagaagttgtaaagtatgt

SEQ ID NO: 2447119 - DNA, 16 bp, Homo sapiens
aagagataactgtaaa

SEQ ID NO: 2447120 - DNA, 22 bp, Homo sapiens
aagagcaggactccaggcccaa

SEQ ID NO: 2447121 - DNA, 15 bp, Homo sapiens
aagagcatcatgcct

SEQ ID NO: 2447122 - DNA, 14 bp, Homo sapiens
aagagccactgcca

SEQ ID NO: 2447123 - DNA, 23 bp, Homo sapiens
aagaggagcccccaccctgttcc

SEQ ID NO: 2447124 - DNA, 22 bp, Homo sapiens
aagaggaggggaagaggcctgt

SEQ ID NO: 2447125 - DNA, 21 bp, Homo sapiens
aagaggctgcccctctcacca

SEQ ID NO: 2447126 - DNA, 17 bp, Homo sapiens
aagagggacgcctgggg

SEQ ID NO: 2447127 - DNA, 16 bp, Homo sapiens
aagaggtgaccccagg

SEQ ID NO: 2447128 - DNA, 18 bp, Homo sapiens
aagaggtgaccccagggc

SEQ ID NO: 2447129 - DNA, 24 bp, Homo sapiens
aagaggtgaccccagggcacagga

SEQ ID NO: 2447130 - DNA, 13 bp, Homo sapiens
aagagtaatcaat

SEQ ID NO: 2447131 - DNA, 24 bp, Homo sapiens
aagagtctaaagatggagtttcta

SEQ ID NO: 2447132 - DNA, 23 bp, Homo sapiens
aagagtgatagtcttttgctttt

SEQ ID NO: 2447133 - DNA, 14 bp, Homo sapiens
aagagttcaagaaa

SEQ ID NO: 2447134 - DNA, 16 bp, Homo sapiens
aagagttcaagaaata

SEQ ID NO: 2447135 - DNA, 20 bp, Homo sapiens
aagagtttgatgaggccctc

SEQ ID NO: 2447136 - DNA, 22 bp, Homo sapiens
aagagtttgatgaggccctcca

SEQ ID NO: 2447137 - DNA, 22 bp, Homo sapiens
aagatacagaactctttcaaaa

SEQ ID NO: 2447138 - DNA, 20 bp, Homo sapiens
aagatactaaggacgttgtt

SEQ ID NO: 2447139 - DNA, 14 bp, Homo sapiens
aagatacttaagtg

SEQ ID NO: 2447140 - DNA, 22 bp, Homo sapiens
aagatcctagatcctaagggtc

SEQ ID NO: 2447141 - DNA, 21 bp, Homo sapiens
aagatctgttttgaaggcaaa

SEQ ID NO: 2447142 - DNA, 22 bp, Homo sapiens
aagatctgttttgaaggcaaaa

SEQ ID NO: 2447143 - DNA, 14 bp, Homo sapiens
aagatcttagattc

SEQ ID NO: 2447144 - DNA, 16 bp, Homo sapiens
aagatcttagattctc

SEQ ID NO: 2447145 - DNA, 15 bp, Homo sapiens
aagatcttttatttt

SEQ ID NO: 2447146 - DNA, 23 bp, Homo sapiens
aagatgaaggagaggcaacatcc

SEQ ID NO: 2447147 - DNA, 18 bp, Homo sapiens
aagatgcactttgcttta

SEQ ID NO: 2447148 - DNA, 23 bp, Homo sapiens
aagatgcactttgctttaatata

SEQ ID NO: 2447149 - DNA, 15 bp, Homo sapiens
aagatggagtttcta

SEQ ID NO: 2447150 - DNA, 16 bp, Homo sapiens
aagatgttatggtgtt

SEQ ID NO: 2447151 - DNA, 20 bp, Homo sapiens
aagatgttctggataccatt

SEQ ID NO: 2447152 - DNA, 20 bp, Homo sapiens
aagattacaaatcagaagtc

SEQ ID NO: 2447153 - DNA, 21 bp, Homo sapiens
aagattacaaatcagaagtca

SEQ ID NO: 2447154 - DNA, 16 bp, Homo sapiens
aagattatagattcta

SEQ ID NO: 2447155 - DNA, 17 bp, Homo sapiens
aagattatagattctaa

SEQ ID NO: 2447156 - DNA, 12 bp, Homo sapiens
aagattctaaag

SEQ ID NO: 2447157 - DNA, 13 bp, Homo sapiens
aagattctagatc

SEQ ID NO: 2447158 - DNA, 17 bp, Homo sapiens
aagattctatagttcta

SEQ ID NO: 2447159 - DNA, 17 bp, Homo sapiens
aagattggtgttttttt

SEQ ID NO: 2447160 - DNA, 14 bp, Homo sapiens
aagatttgttttta

SEQ ID NO: 2447161 - DNA, 19 bp, Homo sapiens
aagatttgtttttaaactg

SEQ ID NO: 2447162 - DNA, 23 bp, Homo sapiens
aagatttgtttttaaactgtaca

SEQ ID NO: 2447163 - DNA, 16 bp, Homo sapiens
aagattttttaataat

SEQ ID NO: 2447164 - DNA, 23 bp, Homo sapiens
aagattttttttttttctctcaa

SEQ ID NO: 2447165 - DNA, 12 bp, Homo sapiens
aagcaaagcaca

SEQ ID NO: 2447166 - DNA, 16 bp, Homo sapiens
aagcaaatcatttgtt

SEQ ID NO: 2447167 - DNA, 19 bp, Homo sapiens
aagcaaatcatttgtttaa

SEQ ID NO: 2447168 - DNA, 17 bp, Homo sapiens
aagcaaatcgaatgaaa

SEQ ID NO: 2447169 - DNA, 16 bp, Homo sapiens
aagcaaatgtcatgct

SEQ ID NO: 2447170 - DNA, 14 bp, Homo sapiens
aagcaacatggctt

SEQ ID NO: 2447171 - DNA, 22 bp, Homo sapiens
aagcaacctcagtaatttagaa

SEQ ID NO: 2447172 - DNA, 19 bp, Homo sapiens
aagcaactaggccttcagt

SEQ ID NO: 2447173 - DNA, 19 bp, Homo sapiens
aagcaagttcgtctgttgt

SEQ ID NO: 2447174 - DNA, 16 bp, Homo sapiens
aagcacatctgcattt

SEQ ID NO: 2447175 - DNA, 17 bp, Homo sapiens
aagcagaaagtgccttt

SEQ ID NO: 2447176 - DNA, 18 bp, Homo sapiens
aagcagaaagtgcctttc

SEQ ID NO: 2447177 - DNA, 20 bp, Homo sapiens
aagcagaaagtgcctttcag

SEQ ID NO: 2447178 - DNA, 14 bp, Homo sapiens
aagcagacagctcc

SEQ ID NO: 2447179 - DNA, 14 bp, Homo sapiens
aagcagcagcctcg

SEQ ID NO: 2447180 - DNA, 17 bp, Homo sapiens
aagcagcctctccccag

SEQ ID NO: 2447181 - DNA, 22 bp, Homo sapiens
aagcagcctctccccaggtcca

SEQ ID NO: 2447182 - DNA, 15 bp, Homo sapiens
aagcagcttagagtt

SEQ ID NO: 2447183 - DNA, 14 bp, Homo sapiens
aagcaggtggatct

SEQ ID NO: 2447184 - DNA, 22 bp, Homo sapiens
aagcaggtggatctatttcatg

SEQ ID NO: 2447185 - DNA, 19 bp, Homo sapiens
aagcatcattatttatgta

SEQ ID NO: 2447186 - DNA, 23 bp, Homo sapiens
aagcatcattatttatgtattgt

SEQ ID NO: 2447187 - DNA, 13 bp, Homo sapiens
aagcatctggctc

SEQ ID NO: 2447188 - DNA, 19 bp, Homo sapiens
aagcatctggctctaattc

SEQ ID NO: 2447189 - DNA, 14 bp, Homo sapiens
aagcatcttgcatt

SEQ ID NO: 2447190 - DNA, 20 bp, Homo sapiens
aagcatcttgggggggtggc

SEQ ID NO: 2447191 - DNA, 13 bp, Homo sapiens
aagcattcacaac

SEQ ID NO: 2447192 - DNA, 15 bp, Homo sapiens
aagcattcagaagaa

SEQ ID NO: 2447193 - DNA, 18 bp, Homo sapiens
aagcattctcattggaaa

SEQ ID NO: 2447194 - DNA, 23 bp, Homo sapiens
aagcattctcattggaaatttag

SEQ ID NO: 2447195 - DNA, 16 bp, Homo sapiens
aagcattgaatggcta

SEQ ID NO: 2447196 - DNA, 19 bp, Homo sapiens
aagcattttgtaagttgaa

SEQ ID NO: 2447197 - DNA, 18 bp, Homo sapiens
aagccaaaacaatgttta

SEQ ID NO: 2447198 - DNA, 17 bp, Homo sapiens
aagccaattcagacagg

SEQ ID NO: 2447199 - DNA, 15 bp, Homo sapiens
aagccagaggctggg

SEQ ID NO: 2447200 - DNA, 17 bp, Homo sapiens
aagccagcaccggacca

SEQ ID NO: 2447201 - DNA, 22 bp, Homo sapiens
aagccagcaccggaccagcctg

SEQ ID NO: 2447202 - DNA, 17 bp, Homo sapiens
aagccaggtccctctca

SEQ ID NO: 2447203 - DNA, 23 bp, Homo sapiens
aagccatcacctcagatggcagc

SEQ ID NO: 2447204 - DNA, 22 bp, Homo sapiens
aagccatgagttccagaaagta

SEQ ID NO: 2447205 - DNA, 23 bp, Homo sapiens
aagccatgagttccagaaagtaa

SEQ ID NO: 2447206 - DNA, 15 bp, Homo sapiens
aagccatgctggaaa

SEQ ID NO: 2447207 - DNA, 21 bp, Homo sapiens
aagccatgctggaaaataata

SEQ ID NO: 2447208 - DNA, 16 bp, Homo sapiens
aagcccagagggtctg

SEQ ID NO: 2447209 - DNA, 20 bp, Homo sapiens
aagcccagcactgcttgagg

SEQ ID NO: 2447210 - DNA, 22 bp, Homo sapiens
aagcccatatgctaccaccagc

SEQ ID NO: 2447211 - DNA, 20 bp, Homo sapiens
aagcccatcctgaccagctg

SEQ ID NO: 2447212 - DNA, 16 bp, Homo sapiens
aagccccacccaggcc

SEQ ID NO: 2447213 - DNA, 18 bp, Homo sapiens
aagccccacccaggccag

SEQ ID NO: 2447214 - DNA, 22 bp, Homo sapiens
aagccccacccaggccaggcat

SEQ ID NO: 2447215 - DNA, 13 bp, Homo sapiens
aagcccccagagc

SEQ ID NO: 2447216 - DNA, 14 bp, Homo sapiens
aagcccccagagcc

SEQ ID NO: 2447217 - DNA, 13 bp, Homo sapiens
aatattgtccatt

SEQ ID NO: 2447218 - DNA, 13 bp, Homo sapiens
aatattttaaaga

SEQ ID NO: 2447219 - DNA, 13 bp, Homo sapiens
aatattttgaatc

SEQ ID NO: 2447220 - DNA, 16 bp, Homo sapiens
aatattttgaatcaat

SEQ ID NO: 2447221 - DNA, 15 bp, Homo sapiens
aatcaaaatctctcc

SEQ ID NO: 2447222 - DNA, 19 bp, Homo sapiens
aatcaaaatctctccactt

SEQ ID NO: 2447223 - DNA, 16 bp, Homo sapiens
aatcaaacattttctg

SEQ ID NO: 2447224 - DNA, 23 bp, Homo sapiens
aatcaaacattttgaaagtctgt

SEQ ID NO: 2447225 - DNA, 20 bp, Homo sapiens
aatcaaatttgtagggtttc

SEQ ID NO: 2447226 - DNA, 13 bp, Homo sapiens
aatcaacttgctt

SEQ ID NO: 2447227 - DNA, 15 bp, Homo sapiens
aatcaacttgcttat

SEQ ID NO: 2447228 - DNA, 17 bp, Homo sapiens
aatcaacttgcttatca

SEQ ID NO: 2447229 - DNA, 12 bp, Homo sapiens
aatcagaactca

SEQ ID NO: 2447230 - DNA, 23 bp, Homo sapiens
aatcagaactcaaatggggccag

SEQ ID NO: 2447231 - DNA, 16 bp, Homo sapiens
aatcagagaaggaaca

SEQ ID NO: 2447232 - DNA, 16 bp, Homo sapiens
aatcagctattttgtg

SEQ ID NO: 2447233 - DNA, 20 bp, Homo sapiens
aatcagctccttcctggaga

SEQ ID NO: 2447234 - DNA, 20 bp, Homo sapiens
aatcaggaatattttccaaa

SEQ ID NO: 2447235 - DNA, 16 bp, Homo sapiens
aatcaggtggcttttg

SEQ ID NO: 2447236 - DNA, 14 bp, Homo sapiens
aatcagtaagaggt

SEQ ID NO: 2447237 - DNA, 24 bp, Homo sapiens
aatcagtctcagaatgtcattttg

SEQ ID NO: 2447238 - DNA, 17 bp, Homo sapiens
aatcagttcattagaaa

SEQ ID NO: 2447239 - DNA, 20 bp, Homo sapiens
aatcatagctggttcacact

SEQ ID NO: 2447240 - DNA, 12 bp, Homo sapiens
aatcatcaagta

SEQ ID NO: 2447241 - DNA, 12 bp, Homo sapiens
aatcatgtgtgt

SEQ ID NO: 2447242 - DNA, 15 bp, Homo sapiens
aatcatgtgtgttaa

SEQ ID NO: 2447243 - DNA, 16 bp, Homo sapiens
aatcattttaattatt

SEQ ID NO: 2447244 - DNA, 20 bp, Homo sapiens
aatcattttaattattattc

SEQ ID NO: 2447245 - DNA, 20 bp, Homo sapiens
aatccaaatggcgtctggaa

SEQ ID NO: 2447246 - DNA, 21 bp, Homo sapiens
aatccaggcagatccaggact

SEQ ID NO: 2447247 - DNA, 19 bp, Homo sapiens
aatcccagccccctgacca

SEQ ID NO: 2447248 - DNA, 15 bp, Homo sapiens
aatccccttctcccc

SEQ ID NO: 2447249 - DNA, 17 bp, Homo sapiens
aatccccttctcccctg

SEQ ID NO: 2447250 - DNA, 23 bp, Homo sapiens
aatccccttctcccctgcactgt

SEQ ID NO: 2447251 - DNA, 13 bp, Homo sapiens
aatccctgctttt

SEQ ID NO: 2447252 - DNA, 14 bp, Homo sapiens
aatccctgcttttt

SEQ ID NO: 2447253 - DNA, 22 bp, Homo sapiens
aatccctgctttttgtgttttt

SEQ ID NO: 2447254 - DNA, 17 bp, Homo sapiens
aatcctacctcaaaatt

SEQ ID NO: 2447255 - DNA, 15 bp, Homo sapiens
aatcctatgcatggt

SEQ ID NO: 2447256 - DNA, 18 bp, Homo sapiens
aatcctatgcatggtttc

SEQ ID NO: 2447257 - DNA, 20 bp, Homo sapiens
aatccttagatctggcatgt

SEQ ID NO: 2447258 - DNA, 17 bp, Homo sapiens
aatccttgatgattgac

SEQ ID NO: 2447259 - DNA, 15 bp, Homo sapiens
aatctactaattcca

SEQ ID NO: 2447260 - DNA, 17 bp, Homo sapiens
aatctactaattccaca

SEQ ID NO: 2447261 - DNA, 17 bp, Homo sapiens
aatctactcaaagcatg

SEQ ID NO: 2447262 - DNA, 21 bp, Homo sapiens
aatctatggtcgggagacagc

SEQ ID NO: 2447263 - DNA, 17 bp, Homo sapiens
aatctcatctcagtgaa

SEQ ID NO: 2447264 - DNA, 17 bp, Homo sapiens
aatctcattgcttacaa

SEQ ID NO: 2447265 - DNA, 16 bp, Homo sapiens
aatctcccattttgga

SEQ ID NO: 2447266 - DNA, 23 bp, Homo sapiens
aatctctccactttcagctgtct

SEQ ID NO: 2447267 - DNA, 13 bp, Homo sapiens
aatctctgggggc

SEQ ID NO: 2447268 - DNA, 13 bp, Homo sapiens
aatctctgtgcct

SEQ ID NO: 2447269 - DNA, 12 bp, Homo sapiens
aatctgacccag

SEQ ID NO: 2447270 - DNA, 15 bp, Homo sapiens
aatctgcaattcaaa

SEQ ID NO: 2447271 - DNA, 19 bp, Homo sapiens
aatctgcaattcaaaagtt

SEQ ID NO: 2447272 - DNA, 17 bp, Homo sapiens
aatctgcattattggaa

SEQ ID NO: 2447273 - DNA, 19 bp, Homo sapiens
aatctgctaccaaaacagt

SEQ ID NO: 2447274 - DNA, 22 bp, Homo sapiens
aatctgtcacgtagaacttgga

SEQ ID NO: 2447275 - DNA, 17 bp, Homo sapiens
aatctgtgggtctggga

SEQ ID NO: 2447276 - DNA, 19 bp, Homo sapiens
aatctgtgggtctgggagt

SEQ ID NO: 2447277 - DNA, 23 bp, Homo sapiens
aatctgtgtgaaactttcattcc

SEQ ID NO: 2447278 - DNA, 23 bp, Homo sapiens
aatcttagtgtatgattactggc

SEQ ID NO: 2447279 - DNA, 14 bp, Homo sapiens
aatcttataattgt

SEQ ID NO: 2447280 - DNA, 15 bp, Homo sapiens
aatcttatagttcta

SEQ ID NO: 2447281 - DNA, 19 bp, Homo sapiens
aatcttatagttctaggca

SEQ ID NO: 2447282 - DNA, 14 bp, Homo sapiens
aatcttcctgttta

SEQ ID NO: 2447283 - DNA, 14 bp, Homo sapiens
aatcttgaaattaa

SEQ ID NO: 2447284 - DNA, 22 bp, Homo sapiens
aatcttgactacagtcaggaaa

SEQ ID NO: 2447285 - DNA, 23 bp, Homo sapiens
aatcttgatcagttaagaaattt

SEQ ID NO: 2447286 - DNA, 13 bp, Homo sapiens
aatcttggtttgc

SEQ ID NO: 2447287 - DNA, 16 bp, Homo sapiens
aatcttgtcatgtgta

SEQ ID NO: 2447288 - DNA, 21 bp, Homo sapiens
aatctttaaaagatgctttta

SEQ ID NO: 2447289 - DNA, 16 bp, Homo sapiens
aatctttataaatgta

SEQ ID NO: 2447290 - DNA, 21 bp, Homo sapiens
aatctttgaaaggttagagaa

SEQ ID NO: 2447291 - DNA, 19 bp, Homo sapiens
aatgaaaaattccactcaa

SEQ ID NO: 2447292 - DNA, 16 bp, Homo sapiens
aatgaaaacagaatgt

SEQ ID NO: 2447293 - DNA, 15 bp, Homo sapiens
aatgaaaatgtccat

SEQ ID NO: 2447294 - DNA, 23 bp, Homo sapiens
aatgaaacaaagagttcaagaaa

SEQ ID NO: 2447295 - DNA, 21 bp, Homo sapiens
aatgaaataatgtacatctgg

SEQ ID NO: 2447296 - DNA, 14 bp, Homo sapiens
aatgaaattaactg

SEQ ID NO: 2447297 - DNA, 12 bp, Homo sapiens
aatgaacaagag

SEQ ID NO: 2447298 - DNA, 13 bp, Homo sapiens
aatgaacaagaga

SEQ ID NO: 2447299 - DNA, 14 bp, Homo sapiens
aatgaacaagagaa

SEQ ID NO: 2447300 - DNA, 21 bp, Homo sapiens
aatgaacactcttttgcttta

SEQ ID NO: 2447301 - DNA, 22 bp, Homo sapiens
aatgaacagaacatagacagaa

SEQ ID NO: 2447302 - DNA, 23 bp, Homo sapiens
aatgaagcaaatgtcatgctgcc

SEQ ID NO: 2447303 - DNA, 23 bp, Homo sapiens
aatgaatgtttacactctttgta

SEQ ID NO: 2447304 - DNA, 16 bp, Homo sapiens
aatgacaatcatgtgt

SEQ ID NO: 2447305 - DNA, 14 bp, Homo sapiens
aatgacactcatat

SEQ ID NO: 2447306 - DNA, 19 bp, Homo sapiens
aatgacactcatataatta

SEQ ID NO: 2447307 - DNA, 23 bp, Homo sapiens
aatgagctttctgaacagctggt

SEQ ID NO: 2447308 - DNA, 18 bp, Homo sapiens
aatgatatgcttgtaact

SEQ ID NO: 2447309 - DNA, 19 bp, Homo sapiens
aatgatatgcttgtaacta

SEQ ID NO: 2447310 - DNA, 19 bp, Homo sapiens
aatgatcctgtattcagac

SEQ ID NO: 2447311 - DNA, 21 bp, Homo sapiens
aatgatcctgtattcagacag

SEQ ID NO: 2447312 - DNA, 21 bp, Homo sapiens
aatgatgatcaattatagttt

SEQ ID NO: 2447313 - DNA, 14 bp, Homo sapiens
aatgattcagtgtt

SEQ ID NO: 2447314 - DNA, 22 bp, Homo sapiens
aatgattcagtgttaaatgtga

SEQ ID NO: 2447315 - DNA, 17 bp, Homo sapiens
aatgcacaagaatggat

SEQ ID NO: 2447316 - DNA, 15 bp, Homo sapiens
aatgcacctaaagaa

SEQ ID NO: 2447317 - DNA, 16 bp, Homo sapiens
aatgcacctaaagaaa

SEQ ID NO: 2447318 - DNA, 13 bp, Homo sapiens
aatgcactttcta

SEQ ID NO: 2447319 - DNA, 22 bp, Homo sapiens
aatgcactttctatcctctgta

SEQ ID NO: 2447320 - DNA, 15 bp, Homo sapiens
aatgcagttgtctct

SEQ ID NO: 2447321 - DNA, 21 bp, Homo sapiens
aattcactgtactatcaggtt

SEQ ID NO: 2447322 - DNA, 23 bp, Homo sapiens
aattcacttagggtcgagcatcc

SEQ ID NO: 2447323 - DNA, 16 bp, Homo sapiens
aattcagtttcataaa

SEQ ID NO: 2447324 - DNA, 17 bp, Homo sapiens
aattcataatcactcta

SEQ ID NO: 2447325 - DNA, 21 bp, Homo sapiens
aattcattaatctgcctccct

SEQ ID NO: 2447326 - DNA, 18 bp, Homo sapiens
aattccaacagtttaatg

SEQ ID NO: 2447327 - DNA, 20 bp, Homo sapiens
aattccaacagtttaatgaa

SEQ ID NO: 2447328 - DNA, 13 bp, Homo sapiens
aattccactcaaa

SEQ ID NO: 2447329 - DNA, 21 bp, Homo sapiens
aattcccgttttgtcactttt

SEQ ID NO: 2447330 - DNA, 13 bp, Homo sapiens
aattccgtcacca

SEQ ID NO: 2447331 - DNA, 19 bp, Homo sapiens
aattctaaatgaatgttta

SEQ ID NO: 2447332 - DNA, 16 bp, Homo sapiens
aattctataaggccat

SEQ ID NO: 2447333 - DNA, 21 bp, Homo sapiens
aattctggctggtagagcagg

SEQ ID NO: 2447334 - DNA, 16 bp, Homo sapiens
aattctgtgccttgtt

SEQ ID NO: 2447335 - DNA, 18 bp, Homo sapiens
aattctttcaatacagat

SEQ ID NO: 2447336 - DNA, 22 bp, Homo sapiens
aattgaaagtgggcaaaagctt

SEQ ID NO: 2447337 - DNA, 15 bp, Homo sapiens
aattgaaatgtaagg

SEQ ID NO: 2447338 - DNA, 21 bp, Homo sapiens
aattgaacctttgtgccctat

SEQ ID NO: 2447339 - DNA, 18 bp, Homo sapiens
aattgaagtaaacttttt

SEQ ID NO: 2447340 - DNA, 16 bp, Homo sapiens
aattgaatactttgaa

SEQ ID NO: 2447341 - DNA, 18 bp, Homo sapiens
aattgaatgcaaaccata

SEQ ID NO: 2447342 - DNA, 21 bp, Homo sapiens
aattgagtaatggtgtagaac

SEQ ID NO: 2447343 - DNA, 17 bp, Homo sapiens
aattgatcgacttgcca

SEQ ID NO: 2447344 - DNA, 18 bp, Homo sapiens
aattgcattgactttccc

SEQ ID NO: 2447345 - DNA, 20 bp, Homo sapiens
aattgcattgactttcccca

SEQ ID NO: 2447346 - DNA, 21 bp, Homo sapiens
aattgcattgactttccccac

SEQ ID NO: 2447347 - DNA, 23 bp, Homo sapiens
aattgccaaaaagtgaaataatg

SEQ ID NO: 2447348 - DNA, 23 bp, Homo sapiens
aattgccacctctaacagcacca

SEQ ID NO: 2447349 - DNA, 20 bp, Homo sapiens
aattgccttttttctgtata

SEQ ID NO: 2447350 - DNA, 23 bp, Homo sapiens
aattgccttttttctgtataaat

SEQ ID NO: 2447351 - DNA, 17 bp, Homo sapiens
aattgctgactgtagct

SEQ ID NO: 2447352 - DNA, 16 bp, Homo sapiens
aattgcttgtttgctt

SEQ ID NO: 2447353 - DNA, 19 bp, Homo sapiens
aattgcttgtttgcttcaa

SEQ ID NO: 2447354 - DNA, 15 bp, Homo sapiens
aattggatttcctaa

SEQ ID NO: 2447355 - DNA, 17 bp, Homo sapiens
aattggatttcctaata

SEQ ID NO: 2447356 - DNA, 16 bp, Homo sapiens
aattgggccagctttt

SEQ ID NO: 2447357 - DNA, 19 bp, Homo sapiens
aattgggccagcttttcaa

SEQ ID NO: 2447358 - DNA, 18 bp, Homo sapiens
aattgtgattagacagaa

SEQ ID NO: 2447359 - DNA, 20 bp, Homo sapiens
aattgtgattagacagaaca

SEQ ID NO: 2447360 - DNA, 16 bp, Homo sapiens
aattgtggtttatata

SEQ ID NO: 2447361 - DNA, 15 bp, Homo sapiens
aattgtgtagccttt

SEQ ID NO: 2447362 - DNA, 23 bp, Homo sapiens
aattgtgtgtgatgtgaagccaa

SEQ ID NO: 2447363 - DNA, 20 bp, Homo sapiens
aattgtgttttaattgtaaa

SEQ ID NO: 2447364 - DNA, 12 bp, Homo sapiens
aattgttgttct

SEQ ID NO: 2447365 - DNA, 15 bp, Homo sapiens
aattgttgttctgtt

SEQ ID NO: 2447366 - DNA, 17 bp, Homo sapiens
aattgttgttctgttaa

SEQ ID NO: 2447367 - DNA, 22 bp, Homo sapiens
aattgttgttctgttaactgaa

SEQ ID NO: 2447368 - DNA, 22 bp, Homo sapiens
aattgttttatctgaattttta

SEQ ID NO: 2447369 - DNA, 22 bp, Homo sapiens
aatttaaagcaggttcttgttg

SEQ ID NO: 2447370 - DNA, 16 bp, Homo sapiens
aatttacatcatttct

SEQ ID NO: 2447371 - DNA, 17 bp, Homo sapiens
aatttacctaagattac

SEQ ID NO: 2447372 - DNA, 16 bp, Homo sapiens
aatttagaaaacttta

SEQ ID NO: 2447373 - DNA, 14 bp, Homo sapiens
aatttagaaatcat

SEQ ID NO: 2447374 - DNA, 17 bp, Homo sapiens
aatttagaaatcatttt

SEQ ID NO: 2447375 - DNA, 17 bp, Homo sapiens
aatttagacttcaagca

SEQ ID NO: 2447376 - DNA, 16 bp, Homo sapiens
aatttagacttggatt

SEQ ID NO: 2447377 - DNA, 13 bp, Homo sapiens
aatttagcattgt

SEQ ID NO: 2447378 - DNA, 14 bp, Homo sapiens
aatttagcattgta

SEQ ID NO: 2447379 - DNA, 20 bp, Homo sapiens
aatttagtaaaccaatccta

SEQ ID NO: 2447380 - DNA, 17 bp, Homo sapiens
aatttagtgtatccata

SEQ ID NO: 2447381 - DNA, 14 bp, Homo sapiens
aatttagtttcata

SEQ ID NO: 2447382 - DNA, 21 bp, Homo sapiens
aatttagtttcatataaagta

SEQ ID NO: 2447383 - DNA, 22 bp, Homo sapiens
aatttagtttcatataaagtat

SEQ ID NO: 2447384 - DNA, 23 bp, Homo sapiens
aatttataacgtgttcaatattt

SEQ ID NO: 2447385 - DNA, 21 bp, Homo sapiens
aatttcggattttttccaaaa

SEQ ID NO: 2447386 - DNA, 17 bp, Homo sapiens
aatttgacttttctgta

SEQ ID NO: 2447387 - DNA, 20 bp, Homo sapiens
aatttgattgatttgaagaa

SEQ ID NO: 2447388 - DNA, 12 bp, Homo sapiens
aatttgcacagt

SEQ ID NO: 2447389 - DNA, 18 bp, Homo sapiens
aatttgcattaaattcac

SEQ ID NO: 2447390 - DNA, 21 bp, Homo sapiens
aatttgcattaaattcacaaa

SEQ ID NO: 2447391 - DNA, 13 bp, Homo sapiens
aatttgcctgctg

SEQ ID NO: 2447392 - DNA, 23 bp, Homo sapiens
aatttggatttaaaagcctgctc

SEQ ID NO: 2447393 - DNA, 17 bp, Homo sapiens
aatttgtaatgtcttga

SEQ ID NO: 2447394 - DNA, 20 bp, Homo sapiens
aatttgtaatgtcttgagct

SEQ ID NO: 2447395 - DNA, 19 bp, Homo sapiens
aatttgtactatttaactg

SEQ ID NO: 2447396 - DNA, 18 bp, Homo sapiens
aatttgttattttgcaac

SEQ ID NO: 2447397 - DNA, 14 bp, Homo sapiens
aatttgttcttgta

SEQ ID NO: 2447398 - DNA, 21 bp, Homo sapiens
aatttgttcttgtatttattg

SEQ ID NO: 2447399 - DNA, 14 bp, Homo sapiens
aattttagcttttg

SEQ ID NO: 2447400 - DNA, 19 bp, Homo sapiens
aattttagtagagacaggg

SEQ ID NO: 2447401 - DNA, 16 bp, Homo sapiens
aattttagtttttcat

SEQ ID NO: 2447402 - DNA, 18 bp, Homo sapiens
aattttagtttttcatta

SEQ ID NO: 2447403 - DNA, 20 bp, Homo sapiens
aattttatccctcacctgta

SEQ ID NO: 2447404 - DNA, 19 bp, Homo sapiens
aattttcctaataaagttc

SEQ ID NO: 2447405 - DNA, 22 bp, Homo sapiens
aattttcctgtcctctttcagc

SEQ ID NO: 2447406 - DNA, 15 bp, Homo sapiens
aattttgtgtaagaa

SEQ ID NO: 2447407 - DNA, 22 bp, Homo sapiens
aattttgtgtaagaaatacaga

SEQ ID NO: 2447408 - DNA, 14 bp, Homo sapiens
aatttttccaacta

SEQ ID NO: 2447409 - DNA, 17 bp, Homo sapiens
aattttttttaacattc

SEQ ID NO: 2447410 - DNA, 18 bp, Homo sapiens
aattttttttaacattcc

SEQ ID NO: 2447411 - DNA, 20 bp, Homo sapiens
aattttttttattagtattg

SEQ ID NO: 2447412 - DNA, 22 bp, Homo sapiens
acaaaaacaggtatatactttg

SEQ ID NO: 2447413 - DNA, 16 bp, Homo sapiens
acaaaaatactcagat

SEQ ID NO: 2447414 - DNA, 14 bp, Homo sapiens
acaaaaattaaaat

SEQ ID NO: 2447415 - DNA, 20 bp, Homo sapiens
acaaaaccccccagatatca

SEQ ID NO: 2447416 - DNA, 17 bp, Homo sapiens
acaaaactacatgagaa

SEQ ID NO: 2447417 - DNA, 23 bp, Homo sapiens
acaaaactacatgagaacaaaca

SEQ ID NO: 2447418 - DNA, 16 bp, Homo sapiens
acaaaactgcatttca

SEQ ID NO: 2447419 - DNA, 20 bp, Homo sapiens
acaaaagaagcccggctcct

SEQ ID NO: 2447420 - DNA, 23 bp, Homo sapiens
acaaaagaagcccggctcctggt

SEQ ID NO: 2447421 - DNA, 22 bp, Homo sapiens
acaaaataaccaatcctggaca

SEQ ID NO: 2447422 - DNA, 17 bp, Homo sapiens
acaaacacacacaaaag

SEQ ID NO: 2447423 - DNA, 20 bp, Homo sapiens
acaaactcgttttttacaaa

SEQ ID NO: 2447424 - DNA, 22 bp, Homo sapiens
acattcctcatgaatgtaaatt

SEQ ID NO: 2447425 - DNA, 14 bp, Homo sapiens
acattctgaatgct

SEQ ID NO: 2447426 - DNA, 22 bp, Homo sapiens
acatttaaaacattaaaatata

SEQ ID NO: 2447427 - DNA, 23 bp, Homo sapiens
acatttctctaagagaacaatgt

SEQ ID NO: 2447428 - DNA, 23 bp, Homo sapiens
acatttgctgttttaaacattaa

SEQ ID NO: 2447429 - DNA, 17 bp, Homo sapiens
acatttggaatactttt

SEQ ID NO: 2447430 - DNA, 20 bp, Homo sapiens
acatttggagtgttcccctt

SEQ ID NO: 2447431 - DNA, 21 bp, Homo sapiens
acatttgggagacatgtgaca

SEQ ID NO: 2447432 - DNA, 16 bp, Homo sapiens
acatttgtcagtattt

SEQ ID NO: 2447433 - DNA, 12 bp, Homo sapiens
acattttcagtg

SEQ ID NO: 2447434 - DNA, 19 bp, Homo sapiens
acattttctaagaaacatt

SEQ ID NO: 2447435 - DNA, 13 bp, Homo sapiens
acattttgaaagt

SEQ ID NO: 2447436 - DNA, 17 bp, Homo sapiens
acattttgaaagtctgt

SEQ ID NO: 2447437 - DNA, 16 bp, Homo sapiens
accaaaacagttaatc

SEQ ID NO: 2447438 - DNA, 14 bp, Homo sapiens
accaaaactgctcc

SEQ ID NO: 2447439 - DNA, 13 bp, Homo sapiens
accaaaagaagta

SEQ ID NO: 2447440 - DNA, 21 bp, Homo sapiens
accaaagtcctttttttccat

SEQ ID NO: 2447441 - DNA, 13 bp, Homo sapiens
accaaataagact

SEQ ID NO: 2447442 - DNA, 23 bp, Homo sapiens
accaaatcaaaatctctccactt

SEQ ID NO: 2447443 - DNA, 13 bp, Homo sapiens
accaaatctggaa

SEQ ID NO: 2447444 - DNA, 23 bp, Homo sapiens
accaacataaaaatgatctaaac

SEQ ID NO: 2447445 - DNA, 13 bp, Homo sapiens
accaaccctcagg

SEQ ID NO: 2447446 - DNA, 21 bp, Homo sapiens
accaaccctcagggcaaagcc

SEQ ID NO: 2447447 - DNA, 22 bp, Homo sapiens
accaactcctagttctagaaaa

SEQ ID NO: 2447448 - DNA, 17 bp, Homo sapiens
accaagcacagcagcct

SEQ ID NO: 2447449 - DNA, 13 bp, Homo sapiens
accaagcaggaaa

SEQ ID NO: 2447450 - DNA, 14 bp, Homo sapiens
accaagcatcttgg

SEQ ID NO: 2447451 - DNA, 13 bp, Homo sapiens
accaatcctggac

SEQ ID NO: 2447452 - DNA, 22 bp, Homo sapiens
accacaaactgtaatacaatga

SEQ ID NO: 2447453 - DNA, 21 bp, Homo sapiens
accacaacatgaggccactgg

SEQ ID NO: 2447454 - DNA, 18 bp, Homo sapiens
accacacccggctaattt

SEQ ID NO: 2447455 - DNA, 15 bp, Homo sapiens
accacagcacagcca

SEQ ID NO: 2447456 - DNA, 16 bp, Homo sapiens
accacagccagcacct

SEQ ID NO: 2447457 - DNA, 17 bp, Homo sapiens
accacagccagcacctg

SEQ ID NO: 2447458 - DNA, 23 bp, Homo sapiens
accacatgccccatcccatgctg

SEQ ID NO: 2447459 - DNA, 17 bp, Homo sapiens
accaccagggcatctct

SEQ ID NO: 2447460 - DNA, 19 bp, Homo sapiens
accaccctcactggctctc

SEQ ID NO: 2447461 - DNA, 20 bp, Homo sapiens
accaccctcactggctctcc

SEQ ID NO: 2447462 - DNA, 16 bp, Homo sapiens
accacgactggccagg

SEQ ID NO: 2447463 - DNA, 23 bp, Homo sapiens
accacgcccgtcctgcctgtggc

SEQ ID NO: 2447464 - DNA, 18 bp, Homo sapiens
accacgcctcttgaccag

SEQ ID NO: 2447465 - DNA, 13 bp, Homo sapiens
accactcagagac

SEQ ID NO: 2447466 - DNA, 20 bp, Homo sapiens
accactcagagacatgcaga

SEQ ID NO: 2447467 - DNA, 17 bp, Homo sapiens
accactctggcagccac

SEQ ID NO: 2447468 - DNA, 18 bp, Homo sapiens
accactctggcagccaca

SEQ ID NO: 2447469 - DNA, 12 bp, Homo sapiens
accactctgtaa

SEQ ID NO: 2447470 - DNA, 14 bp, Homo sapiens
accactctgtaatt

SEQ ID NO: 2447471 - DNA, 16 bp, Homo sapiens
accactgaaaaaatat

SEQ ID NO: 2447472 - DNA, 19 bp, Homo sapiens
accactgaaaaaatatatg

SEQ ID NO: 2447473 - DNA, 19 bp, Homo sapiens
accagaaccaattattttc

SEQ ID NO: 2447474 - DNA, 17 bp, Homo sapiens
accagaagctcccccag

SEQ ID NO: 2447475 - DNA, 15 bp, Homo sapiens
accagacacccagga

SEQ ID NO: 2447476 - DNA, 16 bp, Homo sapiens
accagacacccaggac

SEQ ID NO: 2447477 - DNA, 22 bp, Homo sapiens
accagcagacagagccaggaga

SEQ ID NO: 2447478 - DNA, 14 bp, Homo sapiens
accagccgtgagca

SEQ ID NO: 2447479 - DNA, 14 bp, Homo sapiens
accagcctggccca

SEQ ID NO: 2447480 - DNA, 14 bp, Homo sapiens
accagctcaggaca

SEQ ID NO: 2447481 - DNA, 18 bp, Homo sapiens
accagcttccttcagaga

SEQ ID NO: 2447482 - DNA, 16 bp, Homo sapiens
accaggatagagactg

SEQ ID NO: 2447483 - DNA, 20 bp, Homo sapiens
accaggcaccaaaagaagta

SEQ ID NO: 2447484 - DNA, 21 bp, Homo sapiens
accaggcaccaaaagaagtaa

SEQ ID NO: 2447485 - DNA, 15 bp, Homo sapiens
accaggcaccaggca

SEQ ID NO: 2447486 - DNA, 17 bp, Homo sapiens
accagggcatctctggg

SEQ ID NO: 2447487 - DNA, 18 bp, Homo sapiens
accagggcatctctgggc

SEQ ID NO: 2447488 - DNA, 19 bp, Homo sapiens
accagggcatctctgggct

SEQ ID NO: 2447489 - DNA, 22 bp, Homo sapiens
accagggcatctctgggctgga

SEQ ID NO: 2447490 - DNA, 14 bp, Homo sapiens
accaggggtttctc

SEQ ID NO: 2447491 - DNA, 21 bp, Homo sapiens
accagggtccttttgacactg

SEQ ID NO: 2447492 - DNA, 19 bp, Homo sapiens
accaggtccaatgagcttt

SEQ ID NO: 2447493 - DNA, 21 bp, Homo sapiens
accaggtccaatgagctttct

SEQ ID NO: 2447494 - DNA, 11 bp, Homo sapiens
accagtattta

SEQ ID NO: 2447495 - DNA, 14 bp, Homo sapiens
accagtatttagaa

SEQ ID NO: 2447496 - DNA, 17 bp, Homo sapiens
accagtccccccaccct

SEQ ID NO: 2447497 - DNA, 16 bp, Homo sapiens
accagttaatttttcc

SEQ ID NO: 2447498 - DNA, 16 bp, Homo sapiens
accagttctcatgggt

SEQ ID NO: 2447499 - DNA, 20 bp, Homo sapiens
accagttgcagtcactctag

SEQ ID NO: 2447500 - DNA, 21 bp, Homo sapiens
accagttgcagtcactctagt

SEQ ID NO: 2447501 - DNA, 14 bp, Homo sapiens
accagttgcctttt

SEQ ID NO: 2447502 - DNA, 16 bp, Homo sapiens
accagttgccttttat

SEQ ID NO: 2447503 - DNA, 18 bp, Homo sapiens
accataatgttacattat

SEQ ID NO: 2447504 - DNA, 11 bp, Homo sapiens
accatctccct

SEQ ID NO: 2447505 - DNA, 18 bp, Homo sapiens
accatctccctggtgctt

SEQ ID NO: 2447506 - DNA, 20 bp, Homo sapiens
accatgctcatctgctggtc

SEQ ID NO: 2447507 - DNA, 14 bp, Homo sapiens
accatgctgctggg

SEQ ID NO: 2447508 - DNA, 19 bp, Homo sapiens
accatgctgctggggaaga

SEQ ID NO: 2447509 - DNA, 21 bp, Homo sapiens
accatgctgctggggaagaca

SEQ ID NO: 2447510 - DNA, 17 bp, Homo sapiens
accatggttaagagtcc

SEQ ID NO: 2447511 - DNA, 21 bp, Homo sapiens
accatggttaagagtccaaga

SEQ ID NO: 2447512 - DNA, 11 bp, Homo sapiens
accatgtacat

SEQ ID NO: 2447513 - DNA, 17 bp, Homo sapiens
accatgtagaaaatttg

SEQ ID NO: 2447514 - DNA, 14 bp, Homo sapiens
accattaaaccatc

SEQ ID NO: 2447515 - DNA, 21 bp, Homo sapiens
accattccaagtctccacccc

SEQ ID NO: 2447516 - DNA, 13 bp, Homo sapiens
accatttcctcag

SEQ ID NO: 2447517 - DNA, 20 bp, Homo sapiens
accatttggcatccctgggc

SEQ ID NO: 2447518 - DNA, 18 bp, Homo sapiens
acccaaggtaccatccta

SEQ ID NO: 2447519 - DNA, 23 bp, Homo sapiens
acccacactcagatcctcctcat

SEQ ID NO: 2447520 - DNA, 18 bp, Homo sapiens
acccaccaaccctcaggg

SEQ ID NO: 2447521 - DNA, 14 bp, Homo sapiens
acccaccgggccac

SEQ ID NO: 2447522 - DNA, 16 bp, Homo sapiens
acccaccgggccactc

SEQ ID NO: 2447523 - DNA, 21 bp, Homo sapiens
acccacctgctagtgtgaatt

SEQ ID NO: 2447524 - DNA, 14 bp, Homo sapiens
acccacttctgcac

SEQ ID NO: 2447525 - DNA, 18 bp, Homo sapiens
acccagacataaaggaaa

SEQ ID NO: 2447526 - DNA, 19 bp, Homo sapiens
acccagacataaaggaaaa

SEQ ID NO: 2447527 - DNA, 17 bp, Homo sapiens
acccagccaggcccagc

SEQ ID NO: 2447528 - DNA, 22 bp, Homo sapiens
actcaaatggggccagatccag

SEQ ID NO: 2447529 - DNA, 17 bp, Homo sapiens
actcaaatgttctaagt

SEQ ID NO: 2447530 - DNA, 22 bp, Homo sapiens
actcaaatgttctaagtttcta

SEQ ID NO: 2447531 - DNA, 23 bp, Homo sapiens
actcaaccttaagacctactgtt

SEQ ID NO: 2447532 - DNA, 18 bp, Homo sapiens
actcaagttgattagaaa

SEQ ID NO: 2447533 - DNA, 13 bp, Homo sapiens
actcacacaggca

SEQ ID NO: 2447534 - DNA, 19 bp, Homo sapiens
actcacacaggcatttcct

SEQ ID NO: 2447535 - DNA, 13 bp, Homo sapiens
actcaccactgcc

SEQ ID NO: 2447536 - DNA, 22 bp, Homo sapiens
actcacctgcactaacagagtg

SEQ ID NO: 2447537 - DNA, 18 bp, Homo sapiens
actcactaattcattaat

SEQ ID NO: 2447538 - DNA, 16 bp, Homo sapiens
actcactccttttaaa

SEQ ID NO: 2447539 - DNA, 18 bp, Homo sapiens
actcactccttttaaaga

SEQ ID NO: 2447540 - DNA, 16 bp, Homo sapiens
actcacttttcccact

SEQ ID NO: 2447541 - DNA, 15 bp, Homo sapiens
actcagaagcctggg

SEQ ID NO: 2447542 - DNA, 16 bp, Homo sapiens
actcagaagcctgggg

SEQ ID NO: 2447543 - DNA, 17 bp, Homo sapiens
actcagaagcctggggg

SEQ ID NO: 2447544 - DNA, 21 bp, Homo sapiens
actcagaagcctgggggcctg

SEQ ID NO: 2447545 - DNA, 14 bp, Homo sapiens
actcagatccaggg

SEQ ID NO: 2447546 - DNA, 17 bp, Homo sapiens
actcagatcctcctcat

SEQ ID NO: 2447547 - DNA, 20 bp, Homo sapiens
actcagctttctttaaagtt

SEQ ID NO: 2447548 - DNA, 12 bp, Homo sapiens
actcaggagccc

SEQ ID NO: 2447549 - DNA, 17 bp, Homo sapiens
actcagggcagcgccag

SEQ ID NO: 2447550 - DNA, 17 bp, Homo sapiens
actcagtctctcttctc

SEQ ID NO: 2447551 - DNA, 23 bp, Homo sapiens
actcatacactcgtatgatactt

SEQ ID NO: 2447552 - DNA, 18 bp, Homo sapiens
actcatataattatatgt

SEQ ID NO: 2447553 - DNA, 15 bp, Homo sapiens
actcattctgaagga

SEQ ID NO: 2447554 - DNA, 19 bp, Homo sapiens
actcatttttcatgataat

SEQ ID NO: 2447555 - DNA, 16 bp, Homo sapiens
actccaggcccaaggc

SEQ ID NO: 2447556 - DNA, 16 bp, Homo sapiens
actcccacctgacaca

SEQ ID NO: 2447557 - DNA, 22 bp, Homo sapiens
actcccattcctgaagaaccag

SEQ ID NO: 2447558 - DNA, 20 bp, Homo sapiens
actccccacatcccatcgtc

SEQ ID NO: 2447559 - DNA, 14 bp, Homo sapiens
actccccgaagtct

SEQ ID NO: 2447560 - DNA, 19 bp, Homo sapiens
actccgtaacagattttgt

SEQ ID NO: 2447561 - DNA, 23 bp, Homo sapiens
actcctagctgtcctttttcctc

SEQ ID NO: 2447562 - DNA, 19 bp, Homo sapiens
actcctagttctagaaaaa

SEQ ID NO: 2447563 - DNA, 19 bp, Homo sapiens
actcctcccagggttttaa

SEQ ID NO: 2447564 - DNA, 14 bp, Homo sapiens
actcctctgactca

SEQ ID NO: 2447565 - DNA, 20 bp, Homo sapiens
actcctctgactcagggctc

SEQ ID NO: 2447566 - DNA, 13 bp, Homo sapiens
actcctctgctga

SEQ ID NO: 2447567 - DNA, 15 bp, Homo sapiens
actcctgacctcaag

SEQ ID NO: 2447568 - DNA, 16 bp, Homo sapiens
actcctgtgggagcct

SEQ ID NO: 2447569 - DNA, 14 bp, Homo sapiens
actccttcctgccc

SEQ ID NO: 2447570 - DNA, 15 bp, Homo sapiens
actccttcctgcccc

SEQ ID NO: 2447571 - DNA, 15 bp, Homo sapiens
actcgaatctgtgtg

SEQ ID NO: 2447572 - DNA, 18 bp, Homo sapiens
actcgctagcagtggcag

SEQ ID NO: 2447573 - DNA, 15 bp, Homo sapiens
actcgtctcccccaa

SEQ ID NO: 2447574 - DNA, 18 bp, Homo sapiens
actctaaagcaaatttat

SEQ ID NO: 2447575 - DNA, 14 bp, Homo sapiens
actctaagaaagaa

SEQ ID NO: 2447576 - DNA, 12 bp, Homo sapiens
actctaagatct

SEQ ID NO: 2447577 - DNA, 13 bp, Homo sapiens
actctaagatctt

SEQ ID NO: 2447578 - DNA, 17 bp, Homo sapiens
actctaagatcttagat

SEQ ID NO: 2447579 - DNA, 19 bp, Homo sapiens
actctacccatattacaga

SEQ ID NO: 2447580 - DNA, 17 bp, Homo sapiens
actctagtcaatgacat

SEQ ID NO: 2447581 - DNA, 22 bp, Homo sapiens
actctagtcaatgacatgaatt

SEQ ID NO: 2447582 - DNA, 13 bp, Homo sapiens
actctcagtctct

SEQ ID NO: 2447583 - DNA, 14 bp, Homo sapiens
actctcagtctctg

SEQ ID NO: 2447584 - DNA, 23 bp, Homo sapiens
actctcctaggcattctggacct

SEQ ID NO: 2447585 - DNA, 12 bp, Homo sapiens
actctcctgcct

SEQ ID NO: 2447586 - DNA, 21 bp, Homo sapiens
actctcttattgcctcacttc

SEQ ID NO: 2447587 - DNA, 23 bp, Homo sapiens
actctcttattgcctcacttcag

SEQ ID NO: 2447588 - DNA, 14 bp, Homo sapiens
actctgagtgtttt

SEQ ID NO: 2447589 - DNA, 15 bp, Homo sapiens
actctgcagcctcag

SEQ ID NO: 2447590 - DNA, 11 bp, Homo sapiens
actctgctctg

SEQ ID NO: 2447591 - DNA, 12 bp, Homo sapiens
actctgctctga

SEQ ID NO: 2447592 - DNA, 13 bp, Homo sapiens
actctgctctgat

SEQ ID NO: 2447593 - DNA, 12 bp, Homo sapiens
actctgcttctc

SEQ ID NO: 2447594 - DNA, 15 bp, Homo sapiens
actctgcttctctga

SEQ ID NO: 2447595 - DNA, 20 bp, Homo sapiens
actctgcttctctgacttct

SEQ ID NO: 2447596 - DNA, 15 bp, Homo sapiens
actctggcagccaca

SEQ ID NO: 2447597 - DNA, 16 bp, Homo sapiens
actctggtgcctccag

SEQ ID NO: 2447598 - DNA, 19 bp, Homo sapiens
actctggtggcacaggagt

SEQ ID NO: 2447599 - DNA, 13 bp, Homo sapiens
actctgtaattgc

SEQ ID NO: 2447600 - DNA, 19 bp, Homo sapiens
actctgtcctgaaggcctg

SEQ ID NO: 2447601 - DNA, 21 bp, Homo sapiens
actctgtgccagagcctgggg

SEQ ID NO: 2447602 - DNA, 22 bp, Homo sapiens
actcttaccatatgtttggtaa

SEQ ID NO: 2447603 - DNA, 15 bp, Homo sapiens
actcttcaaatgcct

SEQ ID NO: 2447604 - DNA, 14 bp, Homo sapiens
actcttgcctgttt

SEQ ID NO: 2447605 - DNA, 14 bp, Homo sapiens
actctttatgcttg

SEQ ID NO: 2447606 - DNA, 15 bp, Homo sapiens
actctttatgcttgc

SEQ ID NO: 2447607 - DNA, 17 bp, Homo sapiens
actctttatgcttgcaa

SEQ ID NO: 2447608 - DNA, 23 bp, Homo sapiens
actctttcggtaggtggaagcta

SEQ ID NO: 2447609 - DNA, 16 bp, Homo sapiens
actctttgagaaacaa

SEQ ID NO: 2447610 - DNA, 18 bp, Homo sapiens
actctttgagaaacaaca

SEQ ID NO: 2447611 - DNA, 12 bp, Homo sapiens
actctttgagag

SEQ ID NO: 2447612 - DNA, 15 bp, Homo sapiens
actctttgctgctgc

SEQ ID NO: 2447613 - DNA, 13 bp, Homo sapiens
actctttgtaaga

SEQ ID NO: 2447614 - DNA, 14 bp, Homo sapiens
actctttgtaagag

SEQ ID NO: 2447615 - DNA, 13 bp, Homo sapiens
actgaaaaaatat

SEQ ID NO: 2447616 - DNA, 14 bp, Homo sapiens
actgaaaaaatata

SEQ ID NO: 2447617 - DNA, 15 bp, Homo sapiens
actgaaaaaatatat

SEQ ID NO: 2447618 - DNA, 19 bp, Homo sapiens
actgaacaccattgaaggc

SEQ ID NO: 2447619 - DNA, 14 bp, Homo sapiens
actgaagcagcctc

SEQ ID NO: 2447620 - DNA, 13 bp, Homo sapiens
actgaagtgctta

SEQ ID NO: 2447621 - DNA, 22 bp, Homo sapiens
actgaataaattgtacagccgg

SEQ ID NO: 2447622 - DNA, 18 bp, Homo sapiens
actgaataccactctgta

SEQ ID NO: 2447623 - DNA, 19 bp, Homo sapiens
actgaataccactctgtaa

SEQ ID NO: 2447624 - DNA, 21 bp, Homo sapiens
actgaataccactctgtaatt

SEQ ID NO: 2447625 - DNA, 18 bp, Homo sapiens
actgacagcctcccaccc

SEQ ID NO: 2447626 - DNA, 14 bp, Homo sapiens
actgaccagaacta

SEQ ID NO: 2447627 - DNA, 14 bp, Homo sapiens
actgaccagcagct

SEQ ID NO: 2447628 - DNA, 20 bp, Homo sapiens
actgactattcttgatgtaa

SEQ ID NO: 2447629 - DNA, 22 bp, Homo sapiens
actgactattcttgatgtaaaa

SEQ ID NO: 2447630 - DNA, 21 bp, Homo sapiens
actgagaggacagagagaaat

SEQ ID NO: 2447631 - DNA, 12 bp, Homo sapiens
actgagggcagt

SEQ ID NO: 2447632 - DNA, 13 bp, Homo sapiens
actgagtgggaag

SEQ ID NO: 2447633 - DNA, 21 bp, Homo sapiens
agaaaagtatgttctaacctt

SEQ ID NO: 2447634 - DNA, 15 bp, Homo sapiens
agaaaatctttataa

SEQ ID NO: 2447635 - DNA, 22 bp, Homo sapiens
agaaaatgcggttataaaaaat

SEQ ID NO: 2447636 - DNA, 18 bp, Homo sapiens
agaaaatgttctgtttgc

SEQ ID NO: 2447637 - DNA, 17 bp, Homo sapiens
agaaaatgttgagaatc

SEQ ID NO: 2447638 - DNA, 16 bp, Homo sapiens
agaaaattctgtgcct

SEQ ID NO: 2447639 - DNA, 23 bp, Homo sapiens
agaaaattctgtgccttgttttt

SEQ ID NO: 2447640 - DNA, 15 bp, Homo sapiens
agaaacaacactgta

SEQ ID NO: 2447641 - DNA, 18 bp, Homo sapiens
agaaacaaggttttcagt

SEQ ID NO: 2447642 - DNA, 22 bp, Homo sapiens
agaaacagttggtaacttttgt

SEQ ID NO: 2447643 - DNA, 12 bp, Homo sapiens
agaaacatttat

SEQ ID NO: 2447644 - DNA, 19 bp, Homo sapiens
agaaacatttatattgata

SEQ ID NO: 2447645 - DNA, 13 bp, Homo sapiens
agaaaccagcttc

SEQ ID NO: 2447646 - DNA, 15 bp, Homo sapiens
agaaaccagcttcct

SEQ ID NO: 2447647 - DNA, 20 bp, Homo sapiens
agaaaccagcttccttcaga

SEQ ID NO: 2447648 - DNA, 21 bp, Homo sapiens
agaaaccagcttccttcagag

SEQ ID NO: 2447649 - DNA, 15 bp, Homo sapiens
agaaactgcagggaa

SEQ ID NO: 2447650 - DNA, 17 bp, Homo sapiens
agaaacttaaatgttat

SEQ ID NO: 2447651 - DNA, 20 bp, Homo sapiens
agaaacttaaatgttattat

SEQ ID NO: 2447652 - DNA, 23 bp, Homo sapiens
agaaacttaaatgttattatctg

SEQ ID NO: 2447653 - DNA, 22 bp, Homo sapiens
agaaagaggcaccaggaagccg

SEQ ID NO: 2447654 - DNA, 21 bp, Homo sapiens
agaaagaggtgaccccagggc

SEQ ID NO: 2447655 - DNA, 22 bp, Homo sapiens
agaaagaggtgaccccagggca

SEQ ID NO: 2447656 - DNA, 18 bp, Homo sapiens
agaaagcctgggtgacat

SEQ ID NO: 2447657 - DNA, 11 bp, Homo sapiens
agaaagctcaa

SEQ ID NO: 2447658 - DNA, 13 bp, Homo sapiens
agaaagctgactt

SEQ ID NO: 2447659 - DNA, 20 bp, Homo sapiens
agaaagctgacttggctggt

SEQ ID NO: 2447660 - DNA, 21 bp, Homo sapiens
agaaagctgacttggctggtg

SEQ ID NO: 2447661 - DNA, 18 bp, Homo sapiens
agaaaggaaaaacaaact

SEQ ID NO: 2447662 - DNA, 15 bp, Homo sapiens
agaaaggaagcattg

SEQ ID NO: 2447663 - DNA, 19 bp, Homo sapiens
agaaaggaagcattgtaaa

SEQ ID NO: 2447664 - DNA, 21 bp, Homo sapiens
agaaaggaagcattgtaaaat

SEQ ID NO: 2447665 - DNA, 16 bp, Homo sapiens
agaaaggctgttaaat

SEQ ID NO: 2447666 - DNA, 22 bp, Homo sapiens
agaaaggctgttaaatacagga

SEQ ID NO: 2447667 - DNA, 15 bp, Homo sapiens
agaaagggagggctc

SEQ ID NO: 2447668 - DNA, 19 bp, Homo sapiens
agaaagggagggctctgag

SEQ ID NO: 2447669 - DNA, 16 bp, Homo sapiens
agaaagggccctgggc

SEQ ID NO: 2447670 - DNA, 20 bp, Homo sapiens
agaaagggccctgggcctgc

SEQ ID NO: 2447671 - DNA, 15 bp, Homo sapiens
agaaaggggagccca

SEQ ID NO: 2447672 - DNA, 15 bp, Homo sapiens
agaaagtgcctgaca

SEQ ID NO: 2447673 - DNA, 14 bp, Homo sapiens
agaaagtgcctttc

SEQ ID NO: 2447674 - DNA, 17 bp, Homo sapiens
agaaagtgcctttcagg

SEQ ID NO: 2447675 - DNA, 20 bp, Homo sapiens
agaaataaaaggaagccaaa

SEQ ID NO: 2447676 - DNA, 16 bp, Homo sapiens
agaaataagtttttgt

SEQ ID NO: 2447677 - DNA, 23 bp, Homo sapiens
agaaataagtttttgtttcacag

SEQ ID NO: 2447678 - DNA, 14 bp, Homo sapiens
agaaatacaaaaat

SEQ ID NO: 2447679 - DNA, 23 bp, Homo sapiens
agaaatacaaaaatactcagata

SEQ ID NO: 2447680 - DNA, 19 bp, Homo sapiens
agaaatagcttatgaaaag

SEQ ID NO: 2447681 - DNA, 17 bp, Homo sapiens
agaaatcattttgcaat

SEQ ID NO: 2447682 - DNA, 22 bp, Homo sapiens
agaaatgccaagcacttctttt

SEQ ID NO: 2447683 - DNA, 19 bp, Homo sapiens
agaaattacctgtggatat

SEQ ID NO: 2447684 - DNA, 20 bp, Homo sapiens
agaaattcgtgtgttttttt

SEQ ID NO: 2447685 - DNA, 15 bp, Homo sapiens
agaaattgaatactt

SEQ ID NO: 2447686 - DNA, 17 bp, Homo sapiens
agaaattgaatactttg

SEQ ID NO: 2447687 - DNA, 17 bp, Homo sapiens
agaaattgtatattgta

SEQ ID NO: 2447688 - DNA, 20 bp, Homo sapiens
agaaattgtatattgtaatt

SEQ ID NO: 2447689 - DNA, 14 bp, Homo sapiens
agaaatttcacata

SEQ ID NO: 2447690 - DNA, 12 bp, Homo sapiens
agaacacttatg

SEQ ID NO: 2447691 - DNA, 16 bp, Homo sapiens
agaaccaaatctggaa

SEQ ID NO: 2447692 - DNA, 18 bp, Homo sapiens
agaaccaaatctggaagc

SEQ ID NO: 2447693 - DNA, 17 bp, Homo sapiens
agaacccagcccacccc

SEQ ID NO: 2447694 - DNA, 18 bp, Homo sapiens
agaacccagcccaccccc

SEQ ID NO: 2447695 - DNA, 19 bp, Homo sapiens
agaacccagcccacccccg

SEQ ID NO: 2447696 - DNA, 18 bp, Homo sapiens
agaaccggagagccagct

SEQ ID NO: 2447697 - DNA, 14 bp, Homo sapiens
agaacctaattcaa

SEQ ID NO: 2447698 - DNA, 21 bp, Homo sapiens
agaacctggaacttggggagt

SEQ ID NO: 2447699 - DNA, 12 bp, Homo sapiens
agaaccttctct

SEQ ID NO: 2447700 - DNA, 16 bp, Homo sapiens
agaacgctgatttaaa

SEQ ID NO: 2447701 - DNA, 20 bp, Homo sapiens
agaactgcaggccctggcct

SEQ ID NO: 2447702 - DNA, 18 bp, Homo sapiens
agaacttcagaaagactt

SEQ ID NO: 2447703 - DNA, 15 bp, Homo sapiens
agaactttgagctac

SEQ ID NO: 2447704 - DNA, 20 bp, Homo sapiens
agaactttgagctactgccg

SEQ ID NO: 2447705 - DNA, 13 bp, Homo sapiens
agaagaaacaagg

SEQ ID NO: 2447706 - DNA, 21 bp, Homo sapiens
agaagaaacaaggttttcagt

SEQ ID NO: 2447707 - DNA, 15 bp, Homo sapiens
agaagacaaactttg

SEQ ID NO: 2447708 - DNA, 22 bp, Homo sapiens
agaagcattctcattggaaatt

SEQ ID NO: 2447709 - DNA, 19 bp, Homo sapiens
agaagccagcttgtttaca

SEQ ID NO: 2447710 - DNA, 16 bp, Homo sapiens
agaagccatcacctca

SEQ ID NO: 2447711 - DNA, 14 bp, Homo sapiens
agaagcccccagct

SEQ ID NO: 2447712 - DNA, 17 bp, Homo sapiens
agaagcccccagctaag

SEQ ID NO: 2447713 - DNA, 20 bp, Homo sapiens
agaagcccggctcctggtca

SEQ ID NO: 2447714 - DNA, 10 bp, Homo sapiens
agaagcctgc

SEQ ID NO: 2447715 - DNA, 12 bp, Homo sapiens
agaagcctgggg

SEQ ID NO: 2447716 - DNA, 13 bp, Homo sapiens
agaagcctggggg

SEQ ID NO: 2447717 - DNA, 17 bp, Homo sapiens
agaagcctgggggcctg

SEQ ID NO: 2447718 - DNA, 15 bp, Homo sapiens
agaagccttcaagct

SEQ ID NO: 2447719 - DNA, 18 bp, Homo sapiens
agaagctaaggtttagat

SEQ ID NO: 2447720 - DNA, 13 bp, Homo sapiens
agaagctcagctg

SEQ ID NO: 2447721 - DNA, 17 bp, Homo sapiens
agaagctcagctgcatt

SEQ ID NO: 2447722 - DNA, 13 bp, Homo sapiens
agaagctccccca

SEQ ID NO: 2447723 - DNA, 17 bp, Homo sapiens
agaagctcctctcccca

SEQ ID NO: 2447724 - DNA, 20 bp, Homo sapiens
agaagctcctctccccagcc

SEQ ID NO: 2447725 - DNA, 22 bp, Homo sapiens
agaagctcctctccccagccca

SEQ ID NO: 2447726 - DNA, 16 bp, Homo sapiens
agaaggcaaaaatagt

SEQ ID NO: 2447727 - DNA, 23 bp, Homo sapiens
agaagggagggcagagctggtgc

SEQ ID NO: 2447728 - DNA, 21 bp, Homo sapiens
agaagggctgcttccctgaag

SEQ ID NO: 2447729 - DNA, 15 bp, Homo sapiens
agaagtaaaagcaaa

SEQ ID NO: 2447730 - DNA, 17 bp, Homo sapiens
agaagtagaaatcatag

SEQ ID NO: 2447731 - DNA, 15 bp, Homo sapiens
agaagtataaagaat

SEQ ID NO: 2447732 - DNA, 16 bp, Homo sapiens
agaagtataaagaatt

SEQ ID NO: 2447733 - DNA, 19 bp, Homo sapiens
agaagtataaagaattgtg

SEQ ID NO: 2447734 - DNA, 13 bp, Homo sapiens
agaagtatacata

SEQ ID NO: 2447735 - DNA, 14 bp, Homo sapiens
agaagtcacagggc

SEQ ID NO: 2447736 - DNA, 15 bp, Homo sapiens
agaagtcacagggca

SEQ ID NO: 2447737 - DNA, 14 bp, Homo sapiens
agatggtggcagta

SEQ ID NO: 2447738 - DNA, 15 bp, Homo sapiens
agatgtaattttgtg

SEQ ID NO: 2447739 - DNA, 14 bp, Homo sapiens
agatgtaggaggga

SEQ ID NO: 2447740 - DNA, 14 bp, Homo sapiens
agatgtcttggaac

SEQ ID NO: 2447741 - DNA, 18 bp, Homo sapiens
agatgtcttttcccattt

SEQ ID NO: 2447742 - DNA, 18 bp, Homo sapiens
agatgtgatattctaaga

SEQ ID NO: 2447743 - DNA, 19 bp, Homo sapiens
agatgtgatattctaagac

SEQ ID NO: 2447744 - DNA, 13 bp, Homo sapiens
agatgtgtgttga

SEQ ID NO: 2447745 - DNA, 21 bp, Homo sapiens
agatgtgtgttgatactgttg

SEQ ID NO: 2447746 - DNA, 22 bp, Homo sapiens
agatgtgtgttgatactgttgc

SEQ ID NO: 2447747 - DNA, 17 bp, Homo sapiens
agatgttctaagtcttt

SEQ ID NO: 2447748 - DNA, 19 bp, Homo sapiens
agatgtttattcttctaga

SEQ ID NO: 2447749 - DNA, 16 bp, Homo sapiens
agatgtttatttcagg

SEQ ID NO: 2447750 - DNA, 14 bp, Homo sapiens
agattatagattct

SEQ ID NO: 2447751 - DNA, 18 bp, Homo sapiens
agattatagattctaaag

SEQ ID NO: 2447752 - DNA, 23 bp, Homo sapiens
agattatagattctaaagattct

SEQ ID NO: 2447753 - DNA, 15 bp, Homo sapiens
agattatcgttttct

SEQ ID NO: 2447754 - DNA, 16 bp, Homo sapiens
agattcaaaggttcta

SEQ ID NO: 2447755 - DNA, 21 bp, Homo sapiens
agattcaaaggttctaggttt

SEQ ID NO: 2447756 - DNA, 18 bp, Homo sapiens
agattcaggtaatacaaa

SEQ ID NO: 2447757 - DNA, 16 bp, Homo sapiens
agattccggatcctaa

SEQ ID NO: 2447758 - DNA, 15 bp, Homo sapiens
agattccttcccatg

SEQ ID NO: 2447759 - DNA, 11 bp, Homo sapiens
agattctaaag

SEQ ID NO: 2447760 - DNA, 16 bp, Homo sapiens
agattctaaagattct

SEQ ID NO: 2447761 - DNA, 23 bp, Homo sapiens
agattctaaaggtccacaggtct

SEQ ID NO: 2447762 - DNA, 13 bp, Homo sapiens
agattctaatgat

SEQ ID NO: 2447763 - DNA, 16 bp, Homo sapiens
agattctatagttcta

SEQ ID NO: 2447764 - DNA, 20 bp, Homo sapiens
agattctatagttctagaca

SEQ ID NO: 2447765 - DNA, 23 bp, Homo sapiens
agattctctggctgtaaggctct

SEQ ID NO: 2447766 - DNA, 16 bp, Homo sapiens
agattctctgtgtcta

SEQ ID NO: 2447767 - DNA, 23 bp, Homo sapiens
agattctctgtgtctaagattct

SEQ ID NO: 2447768 - DNA, 20 bp, Homo sapiens
agattgaacctgaatattgc

SEQ ID NO: 2447769 - DNA, 17 bp, Homo sapiens
agattgacgacaagtgc

SEQ ID NO: 2447770 - DNA, 14 bp, Homo sapiens
agattgattgtatt

SEQ ID NO: 2447771 - DNA, 15 bp, Homo sapiens
agattgattgtattg

SEQ ID NO: 2447772 - DNA, 21 bp, Homo sapiens
agattgcagaaaattctgtgc

SEQ ID NO: 2447773 - DNA, 19 bp, Homo sapiens
agattggtgtttttttcta

SEQ ID NO: 2447774 - DNA, 16 bp, Homo sapiens
agatttattaaagaaa

SEQ ID NO: 2447775 - DNA, 19 bp, Homo sapiens
agatttattaaagaaaaaa

SEQ ID NO: 2447776 - DNA, 20 bp, Homo sapiens
agatttggggtataggtctc

SEQ ID NO: 2447777 - DNA, 22 bp, Homo sapiens
agatttgtttttaaactgtaca

SEQ ID NO: 2447778 - DNA, 18 bp, Homo sapiens
agattttaatcaaatttg

SEQ ID NO: 2447779 - DNA, 19 bp, Homo sapiens
agattttctgctactttgc

SEQ ID NO: 2447780 - DNA, 19 bp, Homo sapiens
agattttctggttctaaca

SEQ ID NO: 2447781 - DNA, 12 bp, Homo sapiens
agcaaaaaagaa

SEQ ID NO: 2447782 - DNA, 14 bp, Homo sapiens
agcaaaaaagaaaa

SEQ ID NO: 2447783 - DNA, 14 bp, Homo sapiens
agcaaaagaagaag

SEQ ID NO: 2447784 - DNA, 19 bp, Homo sapiens
agcaaactgcatgcccaga

SEQ ID NO: 2447785 - DNA, 16 bp, Homo sapiens
agcaaagcccccagag

SEQ ID NO: 2447786 - DNA, 17 bp, Homo sapiens
agcaaagcccccagagc

SEQ ID NO: 2447787 - DNA, 11 bp, Homo sapiens
agcaaatcacc

SEQ ID NO: 2447788 - DNA, 22 bp, Homo sapiens
agcaaatcatttgtttaaaaag

SEQ ID NO: 2447789 - DNA, 17 bp, Homo sapiens
agcaaatcgaatgaaat

SEQ ID NO: 2447790 - DNA, 16 bp, Homo sapiens
agcaaccccaggctga

SEQ ID NO: 2447791 - DNA, 18 bp, Homo sapiens
agcaacgctattccagct

SEQ ID NO: 2447792 - DNA, 21 bp, Homo sapiens
agcaactacagtctaaagctg

SEQ ID NO: 2447793 - DNA, 16 bp, Homo sapiens
agcaactaggccttca

SEQ ID NO: 2447794 - DNA, 14 bp, Homo sapiens
agcaactcttgatt

SEQ ID NO: 2447795 - DNA, 20 bp, Homo sapiens
agcaactcttgattatccat

SEQ ID NO: 2447796 - DNA, 21 bp, Homo sapiens
agcaacttgtcctagcacaga

SEQ ID NO: 2447797 - DNA, 19 bp, Homo sapiens
agcaagaaggcaaaaatag

SEQ ID NO: 2447798 - DNA, 21 bp, Homo sapiens
agcaagaccctaaacatccat

SEQ ID NO: 2447799 - DNA, 18 bp, Homo sapiens
agcaagcattcagaagaa

SEQ ID NO: 2447800 - DNA, 17 bp, Homo sapiens
agcaagcttaatggctg

SEQ ID NO: 2447801 - DNA, 12 bp, Homo sapiens
agcaaggcccga

SEQ ID NO: 2447802 - DNA, 17 bp, Homo sapiens
agcaaggcccgagcagc

SEQ ID NO: 2447803 - DNA, 15 bp, Homo sapiens
agcaagttcgtctgt

SEQ ID NO: 2447804 - DNA, 17 bp, Homo sapiens
agcaatacttggagggc

SEQ ID NO: 2447805 - DNA, 12 bp, Homo sapiens
agcaatatgcat

SEQ ID NO: 2447806 - DNA, 19 bp, Homo sapiens
agcacagagagtctggata

SEQ ID NO: 2447807 - DNA, 15 bp, Homo sapiens
agcacagatggccag

SEQ ID NO: 2447808 - DNA, 10 bp, Homo sapiens
agcacagcag

SEQ ID NO: 2447809 - DNA, 23 bp, Homo sapiens
agcacagccaacacgcacctgcc

SEQ ID NO: 2447810 - DNA, 20 bp, Homo sapiens
agcacagcttagatttcata

SEQ ID NO: 2447811 - DNA, 20 bp, Homo sapiens
agcacagcttgacctgaggc

SEQ ID NO: 2447812 - DNA, 17 bp, Homo sapiens
agcacaggctaattttt

SEQ ID NO: 2447813 - DNA, 19 bp, Homo sapiens
agcacatctcaacaggcct

SEQ ID NO: 2447814 - DNA, 20 bp, Homo sapiens
agcacatctcaacaggcctc

SEQ ID NO: 2447815 - DNA, 15 bp, Homo sapiens
agcacatctgcattt

SEQ ID NO: 2447816 - DNA, 16 bp, Homo sapiens
agcacatctgcatttt

SEQ ID NO: 2447817 - DNA, 16 bp, Homo sapiens
agcacatgtgctgccc

SEQ ID NO: 2447818 - DNA, 22 bp, Homo sapiens
agcaccaaatcaaaatctctcc

SEQ ID NO: 2447819 - DNA, 22 bp, Homo sapiens
agcaccaccaaacacagtgtat

SEQ ID NO: 2447820 - DNA, 19 bp, Homo sapiens
agcaccggaccagcctggc

SEQ ID NO: 2447821 - DNA, 22 bp, Homo sapiens
agcacctccaaccaaataagac

SEQ ID NO: 2447822 - DNA, 15 bp, Homo sapiens
agcacctcctcagcc

SEQ ID NO: 2447823 - DNA, 18 bp, Homo sapiens
agcacctcctcagcctga

SEQ ID NO: 2447824 - DNA, 21 bp, Homo sapiens
agcacggctctgtccccagcc

SEQ ID NO: 2447825 - DNA, 19 bp, Homo sapiens
agcactagccaaacctcac

SEQ ID NO: 2447826 - DNA, 15 bp, Homo sapiens
agcactgcctgctcc

SEQ ID NO: 2447827 - DNA, 16 bp, Homo sapiens
agcactgcctgctccc

SEQ ID NO: 2447828 - DNA, 15 bp, Homo sapiens
agcacttatttaatg

SEQ ID NO: 2447829 - DNA, 14 bp, Homo sapiens
agcacttggccctt

SEQ ID NO: 2447830 - DNA, 15 bp, Homo sapiens
agcacttggcccttc

SEQ ID NO: 2447831 - DNA, 22 bp, Homo sapiens
agcacttgggggttcaggcccg

SEQ ID NO: 2447832 - DNA, 21 bp, Homo sapiens
agcacttgtgggtttttgttt

SEQ ID NO: 2447833 - DNA, 21 bp, Homo sapiens
agcagaaaacccttgggccag

SEQ ID NO: 2447834 - DNA, 14 bp, Homo sapiens
agcagaaagtgcct

SEQ ID NO: 2447835 - DNA, 21 bp, Homo sapiens
agcagaaagtgcctttcagga

SEQ ID NO: 2447836 - DNA, 14 bp, Homo sapiens
agcagaagcagcaa

SEQ ID NO: 2447837 - DNA, 17 bp, Homo sapiens
agcagaaggggagatgg

SEQ ID NO: 2447838 - DNA, 18 bp, Homo sapiens
agcagacagagccaggag

SEQ ID NO: 2447839 - DNA, 19 bp, Homo sapiens
agcagacagagccaggaga

SEQ ID NO: 2447840 - DNA, 12 bp, Homo sapiens
agcagacaggcc

SEQ ID NO: 2447841 - DNA, 20 bp, Homo sapiens
agctcaaaggtttggaagga

SEQ ID NO: 2447842 - DNA, 23 bp, Homo sapiens
agctcaactctcttattgcctca

SEQ ID NO: 2447843 - DNA, 13 bp, Homo sapiens
agctcaatgagca

SEQ ID NO: 2447844 - DNA, 17 bp, Homo sapiens
agctcaatgagcatgtt

SEQ ID NO: 2447845 - DNA, 23 bp, Homo sapiens
agctcaatgagcatgtttagact

SEQ ID NO: 2447846 - DNA, 14 bp, Homo sapiens
agctcacaaggcag

SEQ ID NO: 2447847 - DNA, 19 bp, Homo sapiens
agctcacaaggcagcaagg

SEQ ID NO: 2447848 - DNA, 20 bp, Homo sapiens
agctcacgtcctgagaaagc

SEQ ID NO: 2447849 - DNA, 21 bp, Homo sapiens
agctcacgtcctgagaaagct

SEQ ID NO: 2447850 - DNA, 13 bp, Homo sapiens
agctcagctgcat

SEQ ID NO: 2447851 - DNA, 23 bp, Homo sapiens
agctcagctgcattccgcagccc

SEQ ID NO: 2447852 - DNA, 17 bp, Homo sapiens
agctcaggacagatgcc

SEQ ID NO: 2447853 - DNA, 18 bp, Homo sapiens
agctccactctgcttctc

SEQ ID NO: 2447854 - DNA, 24 bp, Homo sapiens
agctccactctgcttctctgactt

SEQ ID NO: 2447855 - DNA, 14 bp, Homo sapiens
agctccagcctgac

SEQ ID NO: 2447856 - DNA, 15 bp, Homo sapiens
agctccagtgtcctg

SEQ ID NO: 2447857 - DNA, 16 bp, Homo sapiens
agctccagtgtcctga

SEQ ID NO: 2447858 - DNA, 19 bp, Homo sapiens
agctccagtgtcctgagct

SEQ ID NO: 2447859 - DNA, 20 bp, Homo sapiens
agctccagtgtcctgagctc

SEQ ID NO: 2447860 - DNA, 23 bp, Homo sapiens
agctccagtgtcctgagctcagc

SEQ ID NO: 2447861 - DNA, 16 bp, Homo sapiens
agctcccacaagcctc

SEQ ID NO: 2447862 - DNA, 17 bp, Homo sapiens
agctcccacaagcctct

SEQ ID NO: 2447863 - DNA, 19 bp, Homo sapiens
agctcccacaagcctgagg

SEQ ID NO: 2447864 - DNA, 11 bp, Homo sapiens
agctcccacct

SEQ ID NO: 2447865 - DNA, 18 bp, Homo sapiens
agctcccctccccaactg

SEQ ID NO: 2447866 - DNA, 16 bp, Homo sapiens
agctccctgtgccccc

SEQ ID NO: 2447867 - DNA, 19 bp, Homo sapiens
agctccctgtgcccccagg

SEQ ID NO: 2447868 - DNA, 11 bp, Homo sapiens
agctcctcccc

SEQ ID NO: 2447869 - DNA, 19 bp, Homo sapiens
agctcctgaccagttgcag

SEQ ID NO: 2447870 - DNA, 11 bp, Homo sapiens
agctcctgtaa

SEQ ID NO: 2447871 - DNA, 14 bp, Homo sapiens
agctcctgtcccct

SEQ ID NO: 2447872 - DNA, 20 bp, Homo sapiens
agctcctgtcccctgctaca

SEQ ID NO: 2447873 - DNA, 24 bp, Homo sapiens
agctcctgtcccctgctacaccta

SEQ ID NO: 2447874 - DNA, 15 bp, Homo sapiens
agctcctgtggcccc

SEQ ID NO: 2447875 - DNA, 15 bp, Homo sapiens
agctccttcctggag

SEQ ID NO: 2447876 - DNA, 23 bp, Homo sapiens
agctcgatgtggtcacagctgta

SEQ ID NO: 2447877 - DNA, 14 bp, Homo sapiens
agctctagaatctg

SEQ ID NO: 2447878 - DNA, 18 bp, Homo sapiens
agctctgaaaccagtgtt

SEQ ID NO: 2447879 - DNA, 19 bp, Homo sapiens
agctctgaaaccagtgtta

SEQ ID NO: 2447880 - DNA, 17 bp, Homo sapiens
agctctgagaggccctg

SEQ ID NO: 2447881 - DNA, 21 bp, Homo sapiens
agctctgagaggccctggatc

SEQ ID NO: 2447882 - DNA, 23 bp, Homo sapiens
agctctgagaggccctggatcag

SEQ ID NO: 2447883 - DNA, 10 bp, Homo sapiens
agctctgagc

SEQ ID NO: 2447884 - DNA, 16 bp, Homo sapiens
agctctgagctgtcaa

SEQ ID NO: 2447885 - DNA, 15 bp, Homo sapiens
agctctgagggaaag

SEQ ID NO: 2447886 - DNA, 17 bp, Homo sapiens
agctctggacagcccca

SEQ ID NO: 2447887 - DNA, 18 bp, Homo sapiens
agctctggaggggagggg

SEQ ID NO: 2447888 - DNA, 14 bp, Homo sapiens
agctctggggtggg

SEQ ID NO: 2447889 - DNA, 19 bp, Homo sapiens
agctctggggtgggcagtt

SEQ ID NO: 2447890 - DNA, 22 bp, Homo sapiens
agctctggggtgggcagttttt

SEQ ID NO: 2447891 - DNA, 23 bp, Homo sapiens
agctctgtatcaggacccagagg

SEQ ID NO: 2447892 - DNA, 15 bp, Homo sapiens
agctctgttcttcct

SEQ ID NO: 2447893 - DNA, 17 bp, Homo sapiens
agctctgttcttcctca

SEQ ID NO: 2447894 - DNA, 19 bp, Homo sapiens
agctctgttcttcctcagc

SEQ ID NO: 2447895 - DNA, 16 bp, Homo sapiens
agctcttaactacagt

SEQ ID NO: 2447896 - DNA, 18 bp, Homo sapiens
agctcttcttaaagtatt

SEQ ID NO: 2447897 - DNA, 15 bp, Homo sapiens
agctcttggagctgt

SEQ ID NO: 2447898 - DNA, 15 bp, Homo sapiens
agctctttgtcaggg

SEQ ID NO: 2447899 - DNA, 16 bp, Homo sapiens
agctgacttggctggt

SEQ ID NO: 2447900 - DNA, 14 bp, Homo sapiens
agctgagcagggcc

SEQ ID NO: 2447901 - DNA, 12 bp, Homo sapiens
agctgagcgcca

SEQ ID NO: 2447902 - DNA, 18 bp, Homo sapiens
agctgagctcacaaggca

SEQ ID NO: 2447903 - DNA, 20 bp, Homo sapiens
agctgagctcacaaggcagc

SEQ ID NO: 2447904 - DNA, 16 bp, Homo sapiens
agctgaggcagcagtg

SEQ ID NO: 2447905 - DNA, 17 bp, Homo sapiens
agctgaggccacactca

SEQ ID NO: 2447906 - DNA, 22 bp, Homo sapiens
agctgaggccacactcagcaca

SEQ ID NO: 2447907 - DNA, 17 bp, Homo sapiens
agctgaggtgcccagga

SEQ ID NO: 2447908 - DNA, 13 bp, Homo sapiens
agctgagtttcct

SEQ ID NO: 2447909 - DNA, 20 bp, Homo sapiens
agctgatactttgacagtgt

SEQ ID NO: 2447910 - DNA, 23 bp, Homo sapiens
agctgccaggagcacggctctgt

SEQ ID NO: 2447911 - DNA, 24 bp, Homo sapiens
agctgccagtgtcctgagccccag

SEQ ID NO: 2447912 - DNA, 16 bp, Homo sapiens
agctgccccggcccct

SEQ ID NO: 2447913 - DNA, 19 bp, Homo sapiens
agctgccggtcgccctttg

SEQ ID NO: 2447914 - DNA, 13 bp, Homo sapiens
agctgcctggacc

SEQ ID NO: 2447915 - DNA, 23 bp, Homo sapiens
agctgcctgtccctaccccatgg

SEQ ID NO: 2447916 - DNA, 20 bp, Homo sapiens
agctgctccgaggacccagg

SEQ ID NO: 2447917 - DNA, 22 bp, Homo sapiens
agctgctccgaggacccaggaa

SEQ ID NO: 2447918 - DNA, 14 bp, Homo sapiens
agctggaccctgac

SEQ ID NO: 2447919 - DNA, 17 bp, Homo sapiens
agctggaccctgaccag

SEQ ID NO: 2447920 - DNA, 21 bp, Homo sapiens
agctggaggcaggggcttcct

SEQ ID NO: 2447921 - DNA, 22 bp, Homo sapiens
agctggcggctggggtcccagc

SEQ ID NO: 2447922 - DNA, 11 bp, Homo sapiens
agctggctcta

SEQ ID NO: 2447923 - DNA, 13 bp, Homo sapiens
agctggctctgag

SEQ ID NO: 2447924 - DNA, 14 bp, Homo sapiens
agctggctctgagc

SEQ ID NO: 2447925 - DNA, 14 bp, Homo sapiens
agctggggacctgg

SEQ ID NO: 2447926 - DNA, 15 bp, Homo sapiens
agctggggatccctc

SEQ ID NO: 2447927 - DNA, 15 bp, Homo sapiens
agctgggtcaggcag

SEQ ID NO: 2447928 - DNA, 17 bp, Homo sapiens
agctggtgcggctggcc

SEQ ID NO: 2447929 - DNA, 13 bp, Homo sapiens
agctggtgtagct

SEQ ID NO: 2447930 - DNA, 14 bp, Homo sapiens
agctggtgtagcta

SEQ ID NO: 2447931 - DNA, 18 bp, Homo sapiens
agctggtgtagctacaga

SEQ ID NO: 2447932 - DNA, 20 bp, Homo sapiens
agctggtgtagctacagaga

SEQ ID NO: 2447933 - DNA, 22 bp, Homo sapiens
agctggtgtagctacagagaaa

SEQ ID NO: 2447934 - DNA, 23 bp, Homo sapiens
agctggtgtagctacagagaaac

SEQ ID NO: 2447935 - DNA, 17 bp, Homo sapiens
agctgtcctttttcctc

SEQ ID NO: 2447936 - DNA, 21 bp, Homo sapiens
agctgtcctttttcctctcca

SEQ ID NO: 2447937 - DNA, 19 bp, Homo sapiens
agctgtcttttggaggacg

SEQ ID NO: 2447938 - DNA, 19 bp, Homo sapiens
agctgtgacttctatttta

SEQ ID NO: 2447939 - DNA, 18 bp, Homo sapiens
agctgtgcaggtggggag

SEQ ID NO: 2447940 - DNA, 15 bp, Homo sapiens
agctgtggttttctt

SEQ ID NO: 2447941 - DNA, 22 bp, Homo sapiens
agctgtgtgtttggaagactat

SEQ ID NO: 2447942 - DNA, 16 bp, Homo sapiens
agctgtttactaggga

SEQ ID NO: 2447943 - DNA, 12 bp, Homo sapiens
agcttaaaactt

SEQ ID NO: 2447944 - DNA, 16 bp, Homo sapiens
agcttaaaactttgaa

SEQ ID NO: 2447945 - DNA, 19 bp, Homo sapiens
aggcccacattggaagagc

SEQ ID NO: 2447946 - DNA, 20 bp, Homo sapiens
aggcccagccgaccccctct

SEQ ID NO: 2447947 - DNA, 17 bp, Homo sapiens
aggcccaggctgccgtc

SEQ ID NO: 2447948 - DNA, 13 bp, Homo sapiens
aggcccaggctgg

SEQ ID NO: 2447949 - DNA, 12 bp, Homo sapiens
aggccccagcct

SEQ ID NO: 2447950 - DNA, 13 bp, Homo sapiens
aggccccagcctc

SEQ ID NO: 2447951 - DNA, 20 bp, Homo sapiens
aggccccatgacctccagct

SEQ ID NO: 2447952 - DNA, 17 bp, Homo sapiens
aggcccccacttgcctc

SEQ ID NO: 2447953 - DNA, 18 bp, Homo sapiens
aggcccccacttgcctct

SEQ ID NO: 2447954 - DNA, 20 bp, Homo sapiens
aggcccccacttgcctcttc

SEQ ID NO: 2447955 - DNA, 19 bp, Homo sapiens
aggcccccatcatcctctg

SEQ ID NO: 2447956 - DNA, 20 bp, Homo sapiens
aggcccccatcatcctctgg

SEQ ID NO: 2447957 - DNA, 14 bp, Homo sapiens
aggcccgagcagct

SEQ ID NO: 2447958 - DNA, 18 bp, Homo sapiens
aggcccgagcagctgagc

SEQ ID NO: 2447959 - DNA, 19 bp, Homo sapiens
aggcccgagcagctgagca

SEQ ID NO: 2447960 - DNA, 21 bp, Homo sapiens
aggcccgagcagctgagcagg

SEQ ID NO: 2447961 - DNA, 22 bp, Homo sapiens
aggcccgagcagctgagcaggg

SEQ ID NO: 2447962 - DNA, 20 bp, Homo sapiens
aggccctccacacctgcggc

SEQ ID NO: 2447963 - DNA, 21 bp, Homo sapiens
aggccctccacacctgcggcc

SEQ ID NO: 2447964 - DNA, 22 bp, Homo sapiens
aggccctccctgttccccagag

SEQ ID NO: 2447965 - DNA, 22 bp, Homo sapiens
aggccctcgctgccagctctgt

SEQ ID NO: 2447966 - DNA, 13 bp, Homo sapiens
aggccctggatca

SEQ ID NO: 2447967 - DNA, 15 bp, Homo sapiens
aggccctggcctccc

SEQ ID NO: 2447968 - DNA, 21 bp, Homo sapiens
aggccctggcctcccctgcca

SEQ ID NO: 2447969 - DNA, 21 bp, Homo sapiens
aggccgtgacgtctgggtggc

SEQ ID NO: 2447970 - DNA, 15 bp, Homo sapiens
aggccgtggctgctg

SEQ ID NO: 2447971 - DNA, 19 bp, Homo sapiens
aggcctaccccgcagacac

SEQ ID NO: 2447972 - DNA, 22 bp, Homo sapiens
aggcctaccccgcagacacctt

SEQ ID NO: 2447973 - DNA, 21 bp, Homo sapiens
aggcctaggagggtcctctga

SEQ ID NO: 2447974 - DNA, 15 bp, Homo sapiens
aggcctaggattcta

SEQ ID NO: 2447975 - DNA, 15 bp, Homo sapiens
aggcctgcagggcct

SEQ ID NO: 2447976 - DNA, 13 bp, Homo sapiens
aggcctgggcagt

SEQ ID NO: 2447977 - DNA, 20 bp, Homo sapiens
aggcctgggccgctgccacg

SEQ ID NO: 2447978 - DNA, 18 bp, Homo sapiens
aggcctggggtgacccgg

SEQ ID NO: 2447979 - DNA, 20 bp, Homo sapiens
aggcctggggtgacccggca

SEQ ID NO: 2447980 - DNA, 24 bp, Homo sapiens
aggcctgtgtagctgtgacctgct

SEQ ID NO: 2447981 - DNA, 15 bp, Homo sapiens
aggcgctgctggtgt

SEQ ID NO: 2447982 - DNA, 21 bp, Homo sapiens
aggcgggcatggcgtggagga

SEQ ID NO: 2447983 - DNA, 16 bp, Homo sapiens
aggcggggcttgcctt

SEQ ID NO: 2447984 - DNA, 12 bp, Homo sapiens
aggctaattttt

SEQ ID NO: 2447985 - DNA, 20 bp, Homo sapiens
aggctacagagaagccttca

SEQ ID NO: 2447986 - DNA, 22 bp, Homo sapiens
aggctacttcggggctgggaag

SEQ ID NO: 2447987 - DNA, 22 bp, Homo sapiens
aggctatggacagggcatgcca

SEQ ID NO: 2447988 - DNA, 17 bp, Homo sapiens
aggctatttgtaaatct

SEQ ID NO: 2447989 - DNA, 22 bp, Homo sapiens
aggctatttgtaaatctgccac

SEQ ID NO: 2447990 - DNA, 15 bp, Homo sapiens
aggctcaaacaatga

SEQ ID NO: 2447991 - DNA, 16 bp, Homo sapiens
aggctcaggtccctgg

SEQ ID NO: 2447992 - DNA, 14 bp, Homo sapiens
aggctccagagggc

SEQ ID NO: 2447993 - DNA, 18 bp, Homo sapiens
aggctcgtggactgagtg

SEQ ID NO: 2447994 - DNA, 18 bp, Homo sapiens
aggctctctttgcccagt

SEQ ID NO: 2447995 - DNA, 15 bp, Homo sapiens
aggctctgtctggaa

SEQ ID NO: 2447996 - DNA, 19 bp, Homo sapiens
aggctcttagcagcttcca

SEQ ID NO: 2447997 - DNA, 21 bp, Homo sapiens
aggctgacacctaactcttct

SEQ ID NO: 2447998 - DNA, 16 bp, Homo sapiens
aggctgaccacagcac

SEQ ID NO: 2447999 - DNA, 17 bp, Homo sapiens
aggctgaccacagcaca

SEQ ID NO: 2448000 - DNA, 15 bp, Homo sapiens
aggctgaggctggca

SEQ ID NO: 2448001 - DNA, 21 bp, Homo sapiens
aggctgcattgaaaagagctg

SEQ ID NO: 2448002 - DNA, 12 bp, Homo sapiens
aggctgcccctc

SEQ ID NO: 2448003 - DNA, 17 bp, Homo sapiens
aggctgcccctctcacc

SEQ ID NO: 2448004 - DNA, 12 bp, Homo sapiens
aggctgccctcc

SEQ ID NO: 2448005 - DNA, 12 bp, Homo sapiens
aggctgcctgag

SEQ ID NO: 2448006 - DNA, 18 bp, Homo sapiens
aggctggaagatagctgt

SEQ ID NO: 2448007 - DNA, 19 bp, Homo sapiens
aggctggctccagatgcag

SEQ ID NO: 2448008 - DNA, 21 bp, Homo sapiens
aggctgggccatgtccaaaga

SEQ ID NO: 2448009 - DNA, 17 bp, Homo sapiens
aggctggtctaaaactc

SEQ ID NO: 2448010 - DNA, 22 bp, Homo sapiens
aggctggtctcaaactcctgac

SEQ ID NO: 2448011 - DNA, 15 bp, Homo sapiens
aggctgtaactactt

SEQ ID NO: 2448012 - DNA, 18 bp, Homo sapiens
aggctgtggaccatggag

SEQ ID NO: 2448013 - DNA, 16 bp, Homo sapiens
aggctgtggtcacagc

SEQ ID NO: 2448014 - DNA, 18 bp, Homo sapiens
aggctgtgtttggctttc

SEQ ID NO: 2448015 - DNA, 22 bp, Homo sapiens
aggctgtgtttggctttcaggg

SEQ ID NO: 2448016 - DNA, 14 bp, Homo sapiens
aggcttagtttgtg

SEQ ID NO: 2448017 - DNA, 19 bp, Homo sapiens
aggcttcaaaatgttatct

SEQ ID NO: 2448018 - DNA, 17 bp, Homo sapiens
aggcttctgctggggcc

SEQ ID NO: 2448019 - DNA, 14 bp, Homo sapiens
aggcttggttcctt

SEQ ID NO: 2448020 - DNA, 14 bp, Homo sapiens
aggcttgttgtgct

SEQ ID NO: 2448021 - DNA, 20 bp, Homo sapiens
agggaaaataggcaggaagc

SEQ ID NO: 2448022 - DNA, 13 bp, Homo sapiens
agggaaaggccag

SEQ ID NO: 2448023 - DNA, 18 bp, Homo sapiens
agggaaaggccagcactc

SEQ ID NO: 2448024 - DNA, 22 bp, Homo sapiens
agggaacccagctctaatacat

SEQ ID NO: 2448025 - DNA, 23 bp, Homo sapiens
agggaacccagctctaatacatt

SEQ ID NO: 2448026 - DNA, 16 bp, Homo sapiens
agggaaggcaggcagg

SEQ ID NO: 2448027 - DNA, 13 bp, Homo sapiens
agggaagggagcc

SEQ ID NO: 2448028 - DNA, 16 bp, Homo sapiens
agggaagggcctgcca

SEQ ID NO: 2448029 - DNA, 19 bp, Homo sapiens
agggaataaggtacaagaa

SEQ ID NO: 2448030 - DNA, 14 bp, Homo sapiens
agggacaaaggagc

SEQ ID NO: 2448031 - DNA, 19 bp, Homo sapiens
agggacaagtggactcagg

SEQ ID NO: 2448032 - DNA, 22 bp, Homo sapiens
agggacagatgaatgccgtgga

SEQ ID NO: 2448033 - DNA, 13 bp, Homo sapiens
agggacgcctggg

SEQ ID NO: 2448034 - DNA, 22 bp, Homo sapiens
agggacgcctgggggtgccagg

SEQ ID NO: 2448035 - DNA, 14 bp, Homo sapiens
agggagagcccagg

SEQ ID NO: 2448036 - DNA, 21 bp, Homo sapiens
agggagagcccaggagctccc

SEQ ID NO: 2448037 - DNA, 16 bp, Homo sapiens
agggagagggggctgg

SEQ ID NO: 2448038 - DNA, 11 bp, Homo sapiens
agggagccaag

SEQ ID NO: 2448039 - DNA, 13 bp, Homo sapiens
agggagccaaggg

SEQ ID NO: 2448040 - DNA, 19 bp, Homo sapiens
agggagcggccggccagcc

SEQ ID NO: 2448041 - DNA, 21 bp, Homo sapiens
agggagcggccggccagcccc

SEQ ID NO: 2448042 - DNA, 17 bp, Homo sapiens
agggaggcatggtctgc

SEQ ID NO: 2448043 - DNA, 23 bp, Homo sapiens
agggaggccgaagctaacaggga

SEQ ID NO: 2448044 - DNA, 15 bp, Homo sapiens
agggaggctgctgct

SEQ ID NO: 2448045 - DNA, 15 bp, Homo sapiens
agggaggctgggcgg

SEQ ID NO: 2448046 - DNA, 17 bp, Homo sapiens
agggaggctgggcgggt

SEQ ID NO: 2448047 - DNA, 14 bp, Homo sapiens
agggagggctctga

SEQ ID NO: 2448048 - DNA, 18 bp, Homo sapiens
agggagggctctgaggcg

SEQ ID NO: 2448049 - DNA, 15 bp, Homo sapiens
agtgccctgagccag

SEQ ID NO: 2448050 - DNA, 16 bp, Homo sapiens
agtgccctgagccagg

SEQ ID NO: 2448051 - DNA, 23 bp, Homo sapiens
agtgccctgagccagggtctcca

SEQ ID NO: 2448052 - DNA, 13 bp, Homo sapiens
agtgccttcaaca

SEQ ID NO: 2448053 - DNA, 19 bp, Homo sapiens
agtgcggtttactcactgc

SEQ ID NO: 2448054 - DNA, 21 bp, Homo sapiens
agtgctaaggttctaaggcct

SEQ ID NO: 2448055 - DNA, 14 bp, Homo sapiens
agtgctcaaggcca

SEQ ID NO: 2448056 - DNA, 16 bp, Homo sapiens
agtgctcaaggccagc

SEQ ID NO: 2448057 - DNA, 14 bp, Homo sapiens
agtgctccctcaca

SEQ ID NO: 2448058 - DNA, 17 bp, Homo sapiens
agtgctcttttctcctc

SEQ ID NO: 2448059 - DNA, 15 bp, Homo sapiens
agtgctgaacagtgg

SEQ ID NO: 2448060 - DNA, 21 bp, Homo sapiens
agtgctgagattacaggcatg

SEQ ID NO: 2448061 - DNA, 15 bp, Homo sapiens
agtgctgcactcaaa

SEQ ID NO: 2448062 - DNA, 21 bp, Homo sapiens
agtgctgtttattaatcttag

SEQ ID NO: 2448063 - DNA, 22 bp, Homo sapiens
agtgcttgcttttcatgcaaac

SEQ ID NO: 2448064 - DNA, 23 bp, Homo sapiens
agtgcttttaagtgaaaatggtc

SEQ ID NO: 2448065 - DNA, 18 bp, Homo sapiens
agtgcttttggcggggag

SEQ ID NO: 2448066 - DNA, 16 bp, Homo sapiens
agtggaacgaaaatga

SEQ ID NO: 2448067 - DNA, 19 bp, Homo sapiens
agtggagtctgccacccag

SEQ ID NO: 2448068 - DNA, 20 bp, Homo sapiens
agtggagtctgccacccagg

SEQ ID NO: 2448069 - DNA, 16 bp, Homo sapiens
agtggatcacaaagtg

SEQ ID NO: 2448070 - DNA, 18 bp, Homo sapiens
agtggatcactcaccatt

SEQ ID NO: 2448071 - DNA, 20 bp, Homo sapiens
agtggcagcccagccagcgt

SEQ ID NO: 2448072 - DNA, 20 bp, Homo sapiens
agtggcaggcagaggcccag

SEQ ID NO: 2448073 - DNA, 23 bp, Homo sapiens
agtggcaggcagaggcccaggct

SEQ ID NO: 2448074 - DNA, 19 bp, Homo sapiens
agtggcccatggcatttta

SEQ ID NO: 2448075 - DNA, 19 bp, Homo sapiens
agtggctggtccagggcta

SEQ ID NO: 2448076 - DNA, 22 bp, Homo sapiens
agtgggaagcccatcctgacca

SEQ ID NO: 2448077 - DNA, 14 bp, Homo sapiens
agtgggcaaaagct

SEQ ID NO: 2448078 - DNA, 16 bp, Homo sapiens
agtgggcttgattctg

SEQ ID NO: 2448079 - DNA, 19 bp, Homo sapiens
agtggggttatctctgtgt

SEQ ID NO: 2448080 - DNA, 21 bp, Homo sapiens
agtggggttatctctgtgtta

SEQ ID NO: 2448081 - DNA, 17 bp, Homo sapiens
agtgggtacccccagga

SEQ ID NO: 2448082 - DNA, 17 bp, Homo sapiens
agtggtaagctatgtcc

SEQ ID NO: 2448083 - DNA, 23 bp, Homo sapiens
agtggtttaggctatttgtaaat

SEQ ID NO: 2448084 - DNA, 14 bp, Homo sapiens
agtgtatgattact

SEQ ID NO: 2448085 - DNA, 17 bp, Homo sapiens
agtgtctttttttgtat

SEQ ID NO: 2448086 - DNA, 22 bp, Homo sapiens
agtgtctttttttgtatagtta

SEQ ID NO: 2448087 - DNA, 15 bp, Homo sapiens
agtgtgcaaggcagc

SEQ ID NO: 2448088 - DNA, 14 bp, Homo sapiens
agtgtgccttctct

SEQ ID NO: 2448089 - DNA, 14 bp, Homo sapiens
agtgtggactctgg

SEQ ID NO: 2448090 - DNA, 15 bp, Homo sapiens
agtgtggaggccact

SEQ ID NO: 2448091 - DNA, 20 bp, Homo sapiens
agtgttgagcatctgtcccc

SEQ ID NO: 2448092 - DNA, 15 bp, Homo sapiens
agtgtttaaaacttc

SEQ ID NO: 2448093 - DNA, 18 bp, Homo sapiens
agtgtttatcctttcata

SEQ ID NO: 2448094 - DNA, 20 bp, Homo sapiens
agtgtttatcctttcatata

SEQ ID NO: 2448095 - DNA, 21 bp, Homo sapiens
agtgttttatgagaaagcctt

SEQ ID NO: 2448096 - DNA, 19 bp, Homo sapiens
agttaacagacaacacgtt

SEQ ID NO: 2448097 - DNA, 19 bp, Homo sapiens
agttaatcatcaagagaat

SEQ ID NO: 2448098 - DNA, 23 bp, Homo sapiens
agttaatttttccaactactaat

SEQ ID NO: 2448099 - DNA, 16 bp, Homo sapiens
agttacagttctgtgg

SEQ ID NO: 2448100 - DNA, 16 bp, Homo sapiens
agttaccttatagtta

SEQ ID NO: 2448101 - DNA, 15 bp, Homo sapiens
agttactgtgtaatt

SEQ ID NO: 2448102 - DNA, 16 bp, Homo sapiens
agttactgtgtaatta

SEQ ID NO: 2448103 - DNA, 19 bp, Homo sapiens
agttactgtgtaattagtg

SEQ ID NO: 2448104 - DNA, 18 bp, Homo sapiens
agttagctaataaaaagc

SEQ ID NO: 2448105 - DNA, 20 bp, Homo sapiens
agttagctttaacttaaata

SEQ ID NO: 2448106 - DNA, 22 bp, Homo sapiens
agttagctttaacttaaatagt

SEQ ID NO: 2448107 - DNA, 15 bp, Homo sapiens
agttagttccactga

SEQ ID NO: 2448108 - DNA, 17 bp, Homo sapiens
agttagttccactgaga

SEQ ID NO: 2448109 - DNA, 22 bp, Homo sapiens
agttagtttgtatatattatta

SEQ ID NO: 2448110 - DNA, 17 bp, Homo sapiens
agttattaatttcttca

SEQ ID NO: 2448111 - DNA, 18 bp, Homo sapiens
agttattgcagtttatca

SEQ ID NO: 2448112 - DNA, 13 bp, Homo sapiens
agttcatgtaaat

SEQ ID NO: 2448113 - DNA, 14 bp, Homo sapiens
agttccaagagtct

SEQ ID NO: 2448114 - DNA, 16 bp, Homo sapiens
agttccagaaagtaaa

SEQ ID NO: 2448115 - DNA, 20 bp, Homo sapiens
agttcccagttggagctcca

SEQ ID NO: 2448116 - DNA, 21 bp, Homo sapiens
agttcccagttggagctccag

SEQ ID NO: 2448117 - DNA, 19 bp, Homo sapiens
agttcctctaacttggctc

SEQ ID NO: 2448118 - DNA, 13 bp, Homo sapiens
agttcctgctaaa

SEQ ID NO: 2448119 - DNA, 15 bp, Homo sapiens
agttcctgtggctcc

SEQ ID NO: 2448120 - DNA, 17 bp, Homo sapiens
agttcctgtggctccct

SEQ ID NO: 2448121 - DNA, 18 bp, Homo sapiens
agttcgcagccaccctga

SEQ ID NO: 2448122 - DNA, 13 bp, Homo sapiens
agttcgtctgttg

SEQ ID NO: 2448123 - DNA, 17 bp, Homo sapiens
agttctaagattctaat

SEQ ID NO: 2448124 - DNA, 17 bp, Homo sapiens
agttctaagattctgat

SEQ ID NO: 2448125 - DNA, 16 bp, Homo sapiens
agttctaataatttct

SEQ ID NO: 2448126 - DNA, 20 bp, Homo sapiens
agttctacctcaggcagctc

SEQ ID NO: 2448127 - DNA, 23 bp, Homo sapiens
agttctacctcaggcagctcaag

SEQ ID NO: 2448128 - DNA, 15 bp, Homo sapiens
agttctagaaaaaca

SEQ ID NO: 2448129 - DNA, 14 bp, Homo sapiens
agttctaggaaaat

SEQ ID NO: 2448130 - DNA, 12 bp, Homo sapiens
agttctgctcca

SEQ ID NO: 2448131 - DNA, 16 bp, Homo sapiens
agttctgctctggttg

SEQ ID NO: 2448132 - DNA, 19 bp, Homo sapiens
agttctgtggtttcatgtt

SEQ ID NO: 2448133 - DNA, 15 bp, Homo sapiens
agttctttgggccag

SEQ ID NO: 2448134 - DNA, 17 bp, Homo sapiens
agttctttgggccagac

SEQ ID NO: 2448135 - DNA, 21 bp, Homo sapiens
agttctttgttcatagcccag

SEQ ID NO: 2448136 - DNA, 12 bp, Homo sapiens
agttgaattttt

SEQ ID NO: 2448137 - DNA, 14 bp, Homo sapiens
agttgagacaagaa

SEQ ID NO: 2448138 - DNA, 11 bp, Homo sapiens
agttgaggcca

SEQ ID NO: 2448139 - DNA, 13 bp, Homo sapiens
agttgaggccact

SEQ ID NO: 2448140 - DNA, 17 bp, Homo sapiens
agttgataaagattttt

SEQ ID NO: 2448141 - DNA, 21 bp, Homo sapiens
agttgataaagattttttaat

SEQ ID NO: 2448142 - DNA, 13 bp, Homo sapiens
agttgatctggaa

SEQ ID NO: 2448143 - DNA, 23 bp, Homo sapiens
agttgatctggaacccagactca

SEQ ID NO: 2448144 - DNA, 15 bp, Homo sapiens
agttgcagctgtttt

SEQ ID NO: 2448145 - DNA, 17 bp, Homo sapiens
agttgcatgtagtaaca

SEQ ID NO: 2448146 - DNA, 20 bp, Homo sapiens
agttggagttttttgtacca

SEQ ID NO: 2448147 - DNA, 15 bp, Homo sapiens
agttgggcttgctat

SEQ ID NO: 2448148 - DNA, 19 bp, Homo sapiens
agttgggcttgctattctg

SEQ ID NO: 2448149 - DNA, 20 bp, Homo sapiens
agttgggcttgctattctgt

SEQ ID NO: 2448150 - DNA, 17 bp, Homo sapiens
agttggggtctggcagc

SEQ ID NO: 2448151 - DNA, 13 bp, Homo sapiens
agttggtaacttt

SEQ ID NO: 2448152 - DNA, 16 bp, Homo sapiens
agttggtaacttttgt

SEQ ID NO: 2448153 - DNA, 20 bp, Homo sapiens
atcaaaccctagccttgctt

SEQ ID NO: 2448154 - DNA, 21 bp, Homo sapiens
atcaaaccctagccttgcttg

SEQ ID NO: 2448155 - DNA, 17 bp, Homo sapiens
atcaaatggtatctttt

SEQ ID NO: 2448156 - DNA, 14 bp, Homo sapiens
atcaacatttctca

SEQ ID NO: 2448157 - DNA, 15 bp, Homo sapiens
atcaactttactgta

SEQ ID NO: 2448158 - DNA, 19 bp, Homo sapiens
atcaactttactgtaatat

SEQ ID NO: 2448159 - DNA, 18 bp, Homo sapiens
atcaaggccttattggaa

SEQ ID NO: 2448160 - DNA, 15 bp, Homo sapiens
atcaaggtcgttttt

SEQ ID NO: 2448161 - DNA, 16 bp, Homo sapiens
atcaagtaatacaaac

SEQ ID NO: 2448162 - DNA, 17 bp, Homo sapiens
atcaagtaatacaaact

SEQ ID NO: 2448163 - DNA, 16 bp, Homo sapiens
atcaagtatttgggaa

SEQ ID NO: 2448164 - DNA, 21 bp, Homo sapiens
atcaagtatttgggaagtgaa

SEQ ID NO: 2448165 - DNA, 13 bp, Homo sapiens
atcaagtctgttt

SEQ ID NO: 2448166 - DNA, 15 bp, Homo sapiens
atcaagtctgtttac

SEQ ID NO: 2448167 - DNA, 16 bp, Homo sapiens
atcaataatatatttt

SEQ ID NO: 2448168 - DNA, 20 bp, Homo sapiens
atcaataatatattttctgt

SEQ ID NO: 2448169 - DNA, 16 bp, Homo sapiens
atcaatcttgcatgta

SEQ ID NO: 2448170 - DNA, 16 bp, Homo sapiens
atcaattatagtttct

SEQ ID NO: 2448171 - DNA, 17 bp, Homo sapiens
atcaattatagtttctg

SEQ ID NO: 2448172 - DNA, 18 bp, Homo sapiens
atcaattatagtttctga

SEQ ID NO: 2448173 - DNA, 15 bp, Homo sapiens
atcacaaagtggaac

SEQ ID NO: 2448174 - DNA, 16 bp, Homo sapiens
atcacaagatggaatt

SEQ ID NO: 2448175 - DNA, 20 bp, Homo sapiens
atcacacacattgctgtgaa

SEQ ID NO: 2448176 - DNA, 15 bp, Homo sapiens
atcacagcccagccc

SEQ ID NO: 2448177 - DNA, 23 bp, Homo sapiens
atcaccacaaactgtaatacaat

SEQ ID NO: 2448178 - DNA, 19 bp, Homo sapiens
atcaccgtgggctccctga

SEQ ID NO: 2448179 - DNA, 20 bp, Homo sapiens
atcaccgtgggctccctgac

SEQ ID NO: 2448180 - DNA, 14 bp, Homo sapiens
atcacctatttcca

SEQ ID NO: 2448181 - DNA, 15 bp, Homo sapiens
atcacctatttccat

SEQ ID NO: 2448182 - DNA, 22 bp, Homo sapiens
atcacctcagatggcagctttt

SEQ ID NO: 2448183 - DNA, 18 bp, Homo sapiens
atcacgctttttgaaaaa

SEQ ID NO: 2448184 - DNA, 15 bp, Homo sapiens
atcactgagttttcc

SEQ ID NO: 2448185 - DNA, 23 bp, Homo sapiens
atcagaaagggagggctctgagg

SEQ ID NO: 2448186 - DNA, 12 bp, Homo sapiens
atcagaacagga

SEQ ID NO: 2448187 - DNA, 20 bp, Homo sapiens
atcagactaagccagcaccg

SEQ ID NO: 2448188 - DNA, 22 bp, Homo sapiens
atcagagatgcaccaccaagcc

SEQ ID NO: 2448189 - DNA, 20 bp, Homo sapiens
atcagagtgacatccaggag

SEQ ID NO: 2448190 - DNA, 22 bp, Homo sapiens
atcagatgctccaagattctag

SEQ ID NO: 2448191 - DNA, 15 bp, Homo sapiens
atcagcgtggccttg

SEQ ID NO: 2448192 - DNA, 19 bp, Homo sapiens
atcaggaatattttccaaa

SEQ ID NO: 2448193 - DNA, 16 bp, Homo sapiens
atcaggacccagagga

SEQ ID NO: 2448194 - DNA, 22 bp, Homo sapiens
atcaggctttcttaaagtgaga

SEQ ID NO: 2448195 - DNA, 14 bp, Homo sapiens
atcaggctttcttt

SEQ ID NO: 2448196 - DNA, 22 bp, Homo sapiens
atcaggctttcttttttttctt

SEQ ID NO: 2448197 - DNA, 16 bp, Homo sapiens
atcaggcttttgtttc

SEQ ID NO: 2448198 - DNA, 18 bp, Homo sapiens
atcagggaggtcattttg

SEQ ID NO: 2448199 - DNA, 20 bp, Homo sapiens
atcaggggtaggaatggaaa

SEQ ID NO: 2448200 - DNA, 19 bp, Homo sapiens
atcagtgtaccatttgcct

SEQ ID NO: 2448201 - DNA, 20 bp, Homo sapiens
atcagtttaaaagcacgaca

SEQ ID NO: 2448202 - DNA, 22 bp, Homo sapiens
atcagtttaaaagcacgacagt

SEQ ID NO: 2448203 - DNA, 13 bp, Homo sapiens
atcatcatggcca

SEQ ID NO: 2448204 - DNA, 16 bp, Homo sapiens
atcatccacacatgaa

SEQ ID NO: 2448205 - DNA, 17 bp, Homo sapiens
atcatgcctctgaggcc

SEQ ID NO: 2448206 - DNA, 20 bp, Homo sapiens
atcatgcctctgaggccagc

SEQ ID NO: 2448207 - DNA, 14 bp, Homo sapiens
atcatggccagctg

SEQ ID NO: 2448208 - DNA, 19 bp, Homo sapiens
atcatggccagctggaggc

SEQ ID NO: 2448209 - DNA, 15 bp, Homo sapiens
atcattcatttttgt

SEQ ID NO: 2448210 - DNA, 14 bp, Homo sapiens
atcattctctgtct

SEQ ID NO: 2448211 - DNA, 21 bp, Homo sapiens
atcattctctgtctcatccat

SEQ ID NO: 2448212 - DNA, 16 bp, Homo sapiens
atcatttcacttgtca

SEQ ID NO: 2448213 - DNA, 21 bp, Homo sapiens
atcatttctattaaatgagca

SEQ ID NO: 2448214 - DNA, 22 bp, Homo sapiens
atcattttgcaatcccttaata

SEQ ID NO: 2448215 - DNA, 13 bp, Homo sapiens
atccaaaagaagc

SEQ ID NO: 2448216 - DNA, 15 bp, Homo sapiens
atccaaagcagacag

SEQ ID NO: 2448217 - DNA, 19 bp, Homo sapiens
atccaagatattttaaaat

SEQ ID NO: 2448218 - DNA, 21 bp, Homo sapiens
atccaagcaccaccaaacaca

SEQ ID NO: 2448219 - DNA, 21 bp, Homo sapiens
atccaaggtggggtggaagct

SEQ ID NO: 2448220 - DNA, 16 bp, Homo sapiens
atccaagttaaatgta

SEQ ID NO: 2448221 - DNA, 12 bp, Homo sapiens
atccaggagctc

SEQ ID NO: 2448222 - DNA, 14 bp, Homo sapiens
atccaggcagatcc

SEQ ID NO: 2448223 - DNA, 19 bp, Homo sapiens
atccaggcagatccaggac

SEQ ID NO: 2448224 - DNA, 12 bp, Homo sapiens
atccagggacag

SEQ ID NO: 2448225 - DNA, 13 bp, Homo sapiens
atccagggacaga

SEQ ID NO: 2448226 - DNA, 14 bp, Homo sapiens
atccagggacagag

SEQ ID NO: 2448227 - DNA, 14 bp, Homo sapiens
atccaggtaatcca

SEQ ID NO: 2448228 - DNA, 13 bp, Homo sapiens
atccagtataaga

SEQ ID NO: 2448229 - DNA, 14 bp, Homo sapiens
atccataactgaac

SEQ ID NO: 2448230 - DNA, 20 bp, Homo sapiens
atccatattgagtcaaatgg

SEQ ID NO: 2448231 - DNA, 14 bp, Homo sapiens
atccatggccagca

SEQ ID NO: 2448232 - DNA, 15 bp, Homo sapiens
atccattctcctgag

SEQ ID NO: 2448233 - DNA, 19 bp, Homo sapiens
atccatttcccctccttcc

SEQ ID NO: 2448234 - DNA, 12 bp, Homo sapiens
atccatttctaa

SEQ ID NO: 2448235 - DNA, 13 bp, Homo sapiens
atccatttctaat

SEQ ID NO: 2448236 - DNA, 22 bp, Homo sapiens
atcccaaagttgttgtaacctg

SEQ ID NO: 2448237 - DNA, 17 bp, Homo sapiens
atcccaagtagaatctc

SEQ ID NO: 2448238 - DNA, 24 bp, Homo sapiens
atcccagccccctgaccactcaga

SEQ ID NO: 2448239 - DNA, 13 bp, Homo sapiens
atcccagctgcct

SEQ ID NO: 2448240 - DNA, 15 bp, Homo sapiens
atccccccatcttgc

SEQ ID NO: 2448241 - DNA, 20 bp, Homo sapiens
atccccccatcttgcttccc

SEQ ID NO: 2448242 - DNA, 15 bp, Homo sapiens
atcccccggcacctc

SEQ ID NO: 2448243 - DNA, 15 bp, Homo sapiens
atccccttctcccct

SEQ ID NO: 2448244 - DNA, 12 bp, Homo sapiens
atccccttgaac

SEQ ID NO: 2448245 - DNA, 19 bp, Homo sapiens
atcccgagcacctccacat

SEQ ID NO: 2448246 - DNA, 13 bp, Homo sapiens
atcccgtgttctc

SEQ ID NO: 2448247 - DNA, 17 bp, Homo sapiens
atccctcacctgtagca

SEQ ID NO: 2448248 - DNA, 13 bp, Homo sapiens
atccctcctgttg

SEQ ID NO: 2448249 - DNA, 17 bp, Homo sapiens
atccctctacagagctt

SEQ ID NO: 2448250 - DNA, 22 bp, Homo sapiens
atccctgaggactgatttcaga

SEQ ID NO: 2448251 - DNA, 16 bp, Homo sapiens
atccctggccccctcc

SEQ ID NO: 2448252 - DNA, 22 bp, Homo sapiens
atccctggccccctccctggat

SEQ ID NO: 2448253 - DNA, 13 bp, Homo sapiens
atccctgggcctg

SEQ ID NO: 2448254 - DNA, 15 bp, Homo sapiens
atccctgggccttgg

SEQ ID NO: 2448255 - DNA, 20 bp, Homo sapiens
atccctgggccttgggctcc

SEQ ID NO: 2448256 - DNA, 18 bp, Homo sapiens
atccctgtgttgtctcta

SEQ ID NO: 2448257 - DNA, 19 bp, Homo sapiens
atgtgcccagttaatcttg

SEQ ID NO: 2448258 - DNA, 11 bp, Homo sapiens
atgtgcctatt

SEQ ID NO: 2448259 - DNA, 14 bp, Homo sapiens
atgtgctttgagaa

SEQ ID NO: 2448260 - DNA, 18 bp, Homo sapiens
atgtggaactgctgccac

SEQ ID NO: 2448261 - DNA, 23 bp, Homo sapiens
atgtggaactgctgccactgagg

SEQ ID NO: 2448262 - DNA, 21 bp, Homo sapiens
atgtggcttgagaaatatgga

SEQ ID NO: 2448263 - DNA, 22 bp, Homo sapiens
atgtgggattatgggtcacagg

SEQ ID NO: 2448264 - DNA, 16 bp, Homo sapiens
atgtggggccaggtca

SEQ ID NO: 2448265 - DNA, 15 bp, Homo sapiens
atgtgggttccacag

SEQ ID NO: 2448266 - DNA, 18 bp, Homo sapiens
atgtgtagttcatgtaaa

SEQ ID NO: 2448267 - DNA, 21 bp, Homo sapiens
atgtgtctttagatagccctg

SEQ ID NO: 2448268 - DNA, 15 bp, Homo sapiens
atgtgtgtatatgga

SEQ ID NO: 2448269 - DNA, 21 bp, Homo sapiens
atgtgtgtccacgactgtctc

SEQ ID NO: 2448270 - DNA, 18 bp, Homo sapiens
atgtgtgttgatactgtt

SEQ ID NO: 2448271 - DNA, 19 bp, Homo sapiens
atgtgtgttgatactgttg

SEQ ID NO: 2448272 - DNA, 22 bp, Homo sapiens
atgtgtgttgatactgttgcac

SEQ ID NO: 2448273 - DNA, 23 bp, Homo sapiens
atgtgtttcacagtttgaaataa

SEQ ID NO: 2448274 - DNA, 16 bp, Homo sapiens
atgtgtttgctttctg

SEQ ID NO: 2448275 - DNA, 15 bp, Homo sapiens
atgttaaaaaaataa

SEQ ID NO: 2448276 - DNA, 21 bp, Homo sapiens
atgttaaaaaaataagaagaa

SEQ ID NO: 2448277 - DNA, 22 bp, Homo sapiens
atgttaaaaaaataagaagaat

SEQ ID NO: 2448278 - DNA, 12 bp, Homo sapiens
atgttaaaatgt

SEQ ID NO: 2448279 - DNA, 16 bp, Homo sapiens
atgttaaaatgtgttg

SEQ ID NO: 2448280 - DNA, 24 bp, Homo sapiens
atgttaaataggcggggcttgcct

SEQ ID NO: 2448281 - DNA, 14 bp, Homo sapiens
atgttaagttatat

SEQ ID NO: 2448282 - DNA, 16 bp, Homo sapiens
atgttatcttctcaag

SEQ ID NO: 2448283 - DNA, 21 bp, Homo sapiens
atgttatcttctcaagttcta

SEQ ID NO: 2448284 - DNA, 22 bp, Homo sapiens
atgttatcttctcaagttctaa

SEQ ID NO: 2448285 - DNA, 19 bp, Homo sapiens
atgttatttgtaatagatg

SEQ ID NO: 2448286 - DNA, 14 bp, Homo sapiens
atgttcaaagtcaa

SEQ ID NO: 2448287 - DNA, 14 bp, Homo sapiens
atgttccattaaac

SEQ ID NO: 2448288 - DNA, 15 bp, Homo sapiens
atgttccattaaacg

SEQ ID NO: 2448289 - DNA, 14 bp, Homo sapiens
atgttctaaggctc

SEQ ID NO: 2448290 - DNA, 17 bp, Homo sapiens
atgttctaaggctctga

SEQ ID NO: 2448291 - DNA, 15 bp, Homo sapiens
atgttctaagtttct

SEQ ID NO: 2448292 - DNA, 20 bp, Homo sapiens
atgttctattttttgttttg

SEQ ID NO: 2448293 - DNA, 14 bp, Homo sapiens
atgttctgtccctt

SEQ ID NO: 2448294 - DNA, 20 bp, Homo sapiens
atgttctgtcccttgccccc

SEQ ID NO: 2448295 - DNA, 17 bp, Homo sapiens
atgttctgtttgctgtg

SEQ ID NO: 2448296 - DNA, 16 bp, Homo sapiens
atgttctttggaaagt

SEQ ID NO: 2448297 - DNA, 16 bp, Homo sapiens
atgttgagaatcccaa

SEQ ID NO: 2448298 - DNA, 22 bp, Homo sapiens
atgttggacacctttaggttct

SEQ ID NO: 2448299 - DNA, 14 bp, Homo sapiens
atgttgtaatattt

SEQ ID NO: 2448300 - DNA, 17 bp, Homo sapiens
atgttgtaatatttctt

SEQ ID NO: 2448301 - DNA, 13 bp, Homo sapiens
atgttgtctaaga

SEQ ID NO: 2448302 - DNA, 22 bp, Homo sapiens
atgttgtctaagaaattgaata

SEQ ID NO: 2448303 - DNA, 15 bp, Homo sapiens
atgttgtgtttttaa

SEQ ID NO: 2448304 - DNA, 17 bp, Homo sapiens
atgttgttatttaaaga

SEQ ID NO: 2448305 - DNA, 14 bp, Homo sapiens
atgtttaaaccttt

SEQ ID NO: 2448306 - DNA, 16 bp, Homo sapiens
atgtttacactctttg

SEQ ID NO: 2448307 - DNA, 19 bp, Homo sapiens
atgtttagactttaacata

SEQ ID NO: 2448308 - DNA, 16 bp, Homo sapiens
atgtttattcttctag

SEQ ID NO: 2448309 - DNA, 17 bp, Homo sapiens
atgtttattcttctaga

SEQ ID NO: 2448310 - DNA, 21 bp, Homo sapiens
atgtttattcttctagagttc

SEQ ID NO: 2448311 - DNA, 15 bp, Homo sapiens
atgtttcaagaggag

SEQ ID NO: 2448312 - DNA, 17 bp, Homo sapiens
atgtttcacaaggtctt

SEQ ID NO: 2448313 - DNA, 23 bp, Homo sapiens
atgtttggctgctagaacatggt

SEQ ID NO: 2448314 - DNA, 18 bp, Homo sapiens
atgttttctgaaaatata

SEQ ID NO: 2448315 - DNA, 13 bp, Homo sapiens
atgtttttaatgt

SEQ ID NO: 2448316 - DNA, 14 bp, Homo sapiens
atgtttttaatgta

SEQ ID NO: 2448317 - DNA, 19 bp, Homo sapiens
atgtttttaatgtatagta

SEQ ID NO: 2448318 - DNA, 14 bp, Homo sapiens
atgtttttctaaag

SEQ ID NO: 2448319 - DNA, 22 bp, Homo sapiens
atgtttttgatcaaaaactatt

SEQ ID NO: 2448320 - DNA, 13 bp, Homo sapiens
attaaaaaagata

SEQ ID NO: 2448321 - DNA, 15 bp, Homo sapiens
attaaaaaagataaa

SEQ ID NO: 2448322 - DNA, 14 bp, Homo sapiens
attaaaagaatatc

SEQ ID NO: 2448323 - DNA, 11 bp, Homo sapiens
attaaaagact

SEQ ID NO: 2448324 - DNA, 13 bp, Homo sapiens
attaaaatataat

SEQ ID NO: 2448325 - DNA, 14 bp, Homo sapiens
attaaaccatctcc

SEQ ID NO: 2448326 - DNA, 16 bp, Homo sapiens
attaaaccatctccct

SEQ ID NO: 2448327 - DNA, 18 bp, Homo sapiens
attaaacttttaattcat

SEQ ID NO: 2448328 - DNA, 22 bp, Homo sapiens
attaaagaaaaaaatgtatttt

SEQ ID NO: 2448329 - DNA, 14 bp, Homo sapiens
attaaagaagacct

SEQ ID NO: 2448330 - DNA, 22 bp, Homo sapiens
attaaagaagacctgagaatgt

SEQ ID NO: 2448331 - DNA, 20 bp, Homo sapiens
attaaagaagggttgagctg

SEQ ID NO: 2448332 - DNA, 18 bp, Homo sapiens
attaaagtgctaaggttc

SEQ ID NO: 2448333 - DNA, 19 bp, Homo sapiens
attaaagtgctaaggttct

SEQ ID NO: 2448334 - DNA, 20 bp, Homo sapiens
attaaagtgctaaggttcta

SEQ ID NO: 2448335 - DNA, 21 bp, Homo sapiens
attaaagtgctaaggttctaa

SEQ ID NO: 2448336 - DNA, 23 bp, Homo sapiens
attaaagtgctaaggttctaagg

SEQ ID NO: 2448337 - DNA, 15 bp, Homo sapiens
attaaataagattct

SEQ ID NO: 2448338 - DNA, 16 bp, Homo sapiens
attaaataagattcta

SEQ ID NO: 2448339 - DNA, 15 bp, Homo sapiens
attaaatgacactca

SEQ ID NO: 2448340 - DNA, 17 bp, Homo sapiens
attaaattcacaaactt

SEQ ID NO: 2448341 - DNA, 15 bp, Homo sapiens
attaaattggaaagc

SEQ ID NO: 2448342 - DNA, 17 bp, Homo sapiens
attaaattggaaagcag

SEQ ID NO: 2448343 - DNA, 18 bp, Homo sapiens
attaacaaaatgtatgtc

SEQ ID NO: 2448344 - DNA, 18 bp, Homo sapiens
attaacataggtgaaagt

SEQ ID NO: 2448345 - DNA, 18 bp, Homo sapiens
attaactgggtaatgaaa

SEQ ID NO: 2448346 - DNA, 17 bp, Homo sapiens
attaagaaaggaagcat

SEQ ID NO: 2448347 - DNA, 12 bp, Homo sapiens
attaagaaatag

SEQ ID NO: 2448348 - DNA, 22 bp, Homo sapiens
attaagaaggcaaaaatgtaaa

SEQ ID NO: 2448349 - DNA, 13 bp, Homo sapiens
attaagttcttta

SEQ ID NO: 2448350 - DNA, 17 bp, Homo sapiens
attaatagcagcctttc

SEQ ID NO: 2448351 - DNA, 18 bp, Homo sapiens
attaatagcagcctttct

SEQ ID NO: 2448352 - DNA, 16 bp, Homo sapiens
attaatcagttcatta

SEQ ID NO: 2448353 - DNA, 19 bp, Homo sapiens
attaatcttagtgtatgat

SEQ ID NO: 2448354 - DNA, 22 bp, Homo sapiens
attaatcttagtgtatgattac

SEQ ID NO: 2448355 - DNA, 12 bp, Homo sapiens
attaatgcactt

SEQ ID NO: 2448356 - DNA, 13 bp, Homo sapiens
attaatgcccaga

SEQ ID NO: 2448357 - DNA, 14 bp, Homo sapiens
attaattctataag

SEQ ID NO: 2448358 - DNA, 16 bp, Homo sapiens
attaatttatgcagaa

SEQ ID NO: 2448359 - DNA, 14 bp, Homo sapiens
attaatttcttcac

SEQ ID NO: 2448360 - DNA, 18 bp, Homo sapiens
attaattttagtttttca

SEQ ID NO: 2448361 - DNA, 14 bp, Homo sapiens
attttggaatttgc

SEQ ID NO: 2448362 - DNA, 20 bp, Homo sapiens
attttggagagtttcctgaa

SEQ ID NO: 2448363 - DNA, 22 bp, Homo sapiens
attttggtaaaatacttcttga

SEQ ID NO: 2448364 - DNA, 20 bp, Homo sapiens
attttgtaatgtatcaaata

SEQ ID NO: 2448365 - DNA, 17 bp, Homo sapiens
attttgtgatgcaaata

SEQ ID NO: 2448366 - DNA, 21 bp, Homo sapiens
attttgttggcatagctctgg

SEQ ID NO: 2448367 - DNA, 13 bp, Homo sapiens
atttttaaacaag

SEQ ID NO: 2448368 - DNA, 17 bp, Homo sapiens
atttttacaatgtaatt

SEQ ID NO: 2448369 - DNA, 14 bp, Homo sapiens
atttttacagaatt

SEQ ID NO: 2448370 - DNA, 20 bp, Homo sapiens
atttttcaatagcacatatg

SEQ ID NO: 2448371 - DNA, 22 bp, Homo sapiens
atttttcaatagcacatatgga

SEQ ID NO: 2448372 - DNA, 18 bp, Homo sapiens
atttttcatgataatgaa

SEQ ID NO: 2448373 - DNA, 14 bp, Homo sapiens
atttttctcttcat

SEQ ID NO: 2448374 - DNA, 21 bp, Homo sapiens
atttttgataaagcctcaagg

SEQ ID NO: 2448375 - DNA, 19 bp, Homo sapiens
atttttgatactaagcatt

SEQ ID NO: 2448376 - DNA, 17 bp, Homo sapiens
atttttggaggtttatt

SEQ ID NO: 2448377 - DNA, 14 bp, Homo sapiens
attttttaaaaaag

SEQ ID NO: 2448378 - DNA, 23 bp, Homo sapiens
attttttccttcaaagtttaata

SEQ ID NO: 2448379 - DNA, 14 bp, Homo sapiens
attttttgtataat

SEQ ID NO: 2448380 - DNA, 16 bp, Homo sapiens
attttttttctttgaa

SEQ ID NO: 2448381 - DNA, 21 bp, Homo sapiens
attttttttctttgaataaat

SEQ ID NO: 2448382 - DNA, 15 bp, Homo sapiens
atttttttttcaatc

SEQ ID NO: 2448383 - DNA, 19 bp, Homo sapiens
attttttttttttctctca

SEQ ID NO: 2448384 - DNA, 12 bp, Homo sapiens
caaaaaagaaaa

SEQ ID NO: 2448385 - DNA, 22 bp, Homo sapiens
caaaaacaggtatatactttga

SEQ ID NO: 2448386 - DNA, 16 bp, Homo sapiens
caaaaactatttggga

SEQ ID NO: 2448387 - DNA, 14 bp, Homo sapiens
caaaaagaaccact

SEQ ID NO: 2448388 - DNA, 18 bp, Homo sapiens
caaaaagctaataccagt

SEQ ID NO: 2448389 - DNA, 21 bp, Homo sapiens
caaaaatttctgtaaaacagg

SEQ ID NO: 2448390 - DNA, 14 bp, Homo sapiens
caaaacaaactcat

SEQ ID NO: 2448391 - DNA, 14 bp, Homo sapiens
caaaacaatgttta

SEQ ID NO: 2448392 - DNA, 16 bp, Homo sapiens
caaaacaatgtttaaa

SEQ ID NO: 2448393 - DNA, 16 bp, Homo sapiens
caaaacacttgtaatt

SEQ ID NO: 2448394 - DNA, 16 bp, Homo sapiens
caaaaccaggtccaat

SEQ ID NO: 2448395 - DNA, 21 bp, Homo sapiens
caaaaccccccagatatcatc

SEQ ID NO: 2448396 - DNA, 11 bp, Homo sapiens
caaaactctac

SEQ ID NO: 2448397 - DNA, 19 bp, Homo sapiens
caaaactctacttaatcca

SEQ ID NO: 2448398 - DNA, 14 bp, Homo sapiens
caaaagaagaagtt

SEQ ID NO: 2448399 - DNA, 20 bp, Homo sapiens
caaaagaagaagtttcatca

SEQ ID NO: 2448400 - DNA, 18 bp, Homo sapiens
caaaagaagcccccagct

SEQ ID NO: 2448401 - DNA, 17 bp, Homo sapiens
caaaagaagtaaaagca

SEQ ID NO: 2448402 - DNA, 19 bp, Homo sapiens
caaaagaagtaaaagcaaa

SEQ ID NO: 2448403 - DNA, 21 bp, Homo sapiens
caaaagctatttaaagcatct

SEQ ID NO: 2448404 - DNA, 14 bp, Homo sapiens
caaaagttccaaga

SEQ ID NO: 2448405 - DNA, 21 bp, Homo sapiens
caaaatagggtatattttcct

SEQ ID NO: 2448406 - DNA, 22 bp, Homo sapiens
caaaatatattttgtttacaaa

SEQ ID NO: 2448407 - DNA, 23 bp, Homo sapiens
caaaatctctccactttcagctg

SEQ ID NO: 2448408 - DNA, 16 bp, Homo sapiens
caaaatcttgatcagt

SEQ ID NO: 2448409 - DNA, 18 bp, Homo sapiens
caaaatgctttttatttc

SEQ ID NO: 2448410 - DNA, 23 bp, Homo sapiens
caaaatgctttttatttctgcat

SEQ ID NO: 2448411 - DNA, 16 bp, Homo sapiens
caaaatgtatgtctgg

SEQ ID NO: 2448412 - DNA, 22 bp, Homo sapiens
caaaattgcaaatcttgaaatt

SEQ ID NO: 2448413 - DNA, 16 bp, Homo sapiens
caaacaaaaaggttct

SEQ ID NO: 2448414 - DNA, 16 bp, Homo sapiens
caaacaccaacataaa

SEQ ID NO: 2448415 - DNA, 19 bp, Homo sapiens
caaaccacgcctcttgacc

SEQ ID NO: 2448416 - DNA, 22 bp, Homo sapiens
caaaccacgcctcttgaccagg

SEQ ID NO: 2448417 - DNA, 18 bp, Homo sapiens
caaaccctagccttgctt

SEQ ID NO: 2448418 - DNA, 22 bp, Homo sapiens
caaacgccctttcctcctcagg

SEQ ID NO: 2448419 - DNA, 18 bp, Homo sapiens
caaactcctgacctcagg

SEQ ID NO: 2448420 - DNA, 14 bp, Homo sapiens
caaactgcatgccc

SEQ ID NO: 2448421 - DNA, 20 bp, Homo sapiens
caaactgggaacccctttcc

SEQ ID NO: 2448422 - DNA, 23 bp, Homo sapiens
caaactgggaacccctttcccac

SEQ ID NO: 2448423 - DNA, 18 bp, Homo sapiens
caaacttggatacttgga

SEQ ID NO: 2448424 - DNA, 18 bp, Homo sapiens
caaacttttatactcttt

SEQ ID NO: 2448425 - DNA, 14 bp, Homo sapiens
caaagaaagtgtat

SEQ ID NO: 2448426 - DNA, 18 bp, Homo sapiens
caaagaaccttctctatg

SEQ ID NO: 2448427 - DNA, 22 bp, Homo sapiens
caaagaaggcatttgcagggtc

SEQ ID NO: 2448428 - DNA, 14 bp, Homo sapiens
caaagaccctggct

SEQ ID NO: 2448429 - DNA, 17 bp, Homo sapiens
caaagaccctggctttc

SEQ ID NO: 2448430 - DNA, 20 bp, Homo sapiens
caaagaggctgaggctggca

SEQ ID NO: 2448431 - DNA, 12 bp, Homo sapiens
caaagaggctgc

SEQ ID NO: 2448432 - DNA, 15 bp, Homo sapiens
caaagaggctgcccc

SEQ ID NO: 2448433 - DNA, 21 bp, Homo sapiens
caaagaggctgcccctctcac

SEQ ID NO: 2448434 - DNA, 23 bp, Homo sapiens
caaagaggctgcccctctcacca

SEQ ID NO: 2448435 - DNA, 16 bp, Homo sapiens
caaagagttcaagaaa

SEQ ID NO: 2448436 - DNA, 18 bp, Homo sapiens
caaagagtttgatgaggc

SEQ ID NO: 2448437 - DNA, 18 bp, Homo sapiens
caaagatgaatgaagcaa

SEQ ID NO: 2448438 - DNA, 23 bp, Homo sapiens
caaagcaagcattcagaagaaaa

SEQ ID NO: 2448439 - DNA, 11 bp, Homo sapiens
caaagcacaga

SEQ ID NO: 2448440 - DNA, 17 bp, Homo sapiens
caaagcagacagctcca

SEQ ID NO: 2448441 - DNA, 13 bp, Homo sapiens
caaagcagccacg

SEQ ID NO: 2448442 - DNA, 23 bp, Homo sapiens
caaagccagcgtcctcctctgtg

SEQ ID NO: 2448443 - DNA, 14 bp, Homo sapiens
caaagccaggtccc

SEQ ID NO: 2448444 - DNA, 15 bp, Homo sapiens
caaagcccccagagc

SEQ ID NO: 2448445 - DNA, 15 bp, Homo sapiens
caaagcccttttata

SEQ ID NO: 2448446 - DNA, 19 bp, Homo sapiens
caaagcctgttcatggcag

SEQ ID NO: 2448447 - DNA, 20 bp, Homo sapiens
caaagcctgttcatggcaga

SEQ ID NO: 2448448 - DNA, 16 bp, Homo sapiens
caaagctttcctgccc

SEQ ID NO: 2448449 - DNA, 17 bp, Homo sapiens
caaaggaaggtggatgg

SEQ ID NO: 2448450 - DNA, 18 bp, Homo sapiens
caaaggacgcactgagca

SEQ ID NO: 2448451 - DNA, 11 bp, Homo sapiens
caaaggagcct

SEQ ID NO: 2448452 - DNA, 12 bp, Homo sapiens
caaaggagcctg

SEQ ID NO: 2448453 - DNA, 14 bp, Homo sapiens
caaaggagcctgtg

SEQ ID NO: 2448454 - DNA, 15 bp, Homo sapiens
caaaggagcctgtga

SEQ ID NO: 2448455 - DNA, 16 bp, Homo sapiens
caaaggagcctgtgaa

SEQ ID NO: 2448456 - DNA, 13 bp, Homo sapiens
caaagggtggaat

SEQ ID NO: 2448457 - DNA, 14 bp, Homo sapiens
caaaggtacttgga

SEQ ID NO: 2448458 - DNA, 14 bp, Homo sapiens
caaaggttctaggt

SEQ ID NO: 2448459 - DNA, 22 bp, Homo sapiens
caaaggttctaggtttcaaaga

SEQ ID NO: 2448460 - DNA, 23 bp, Homo sapiens
caaaggtttaaatgaacaagaga

SEQ ID NO: 2448461 - DNA, 16 bp, Homo sapiens
caaaggtttggaagga

SEQ ID NO: 2448462 - DNA, 21 bp, Homo sapiens
caaaggtttggaaggagcaga

SEQ ID NO: 2448463 - DNA, 18 bp, Homo sapiens
caaagtcataattgcatt

SEQ ID NO: 2448464 - DNA, 23 bp, Homo sapiens
caaagtcataattgcattgactt

SEQ ID NO: 2448465 - DNA, 18 bp, Homo sapiens
cacccccggcagcagccc

SEQ ID NO: 2448466 - DNA, 12 bp, Homo sapiens
caccccctgcag

SEQ ID NO: 2448467 - DNA, 13 bp, Homo sapiens
caccccctgcagc

SEQ ID NO: 2448468 - DNA, 17 bp, Homo sapiens
caccccctgcagcttgt

SEQ ID NO: 2448469 - DNA, 12 bp, Homo sapiens
caccccctttcc

SEQ ID NO: 2448470 - DNA, 21 bp, Homo sapiens
cacccggctgcagaggccaga

SEQ ID NO: 2448471 - DNA, 15 bp, Homo sapiens
caccctcttcctact

SEQ ID NO: 2448472 - DNA, 16 bp, Homo sapiens
caccctgaggagtctg

SEQ ID NO: 2448473 - DNA, 22 bp, Homo sapiens
caccctgaggagtctgaggtcc

SEQ ID NO: 2448474 - DNA, 22 bp, Homo sapiens
caccctgatttaggagaagcca

SEQ ID NO: 2448475 - DNA, 11 bp, Homo sapiens
caccctggagg

SEQ ID NO: 2448476 - DNA, 21 bp, Homo sapiens
caccctggccgagtccaagct

SEQ ID NO: 2448477 - DNA, 19 bp, Homo sapiens
caccctggcctagaccagc

SEQ ID NO: 2448478 - DNA, 14 bp, Homo sapiens
caccctgggccctg

SEQ ID NO: 2448479 - DNA, 17 bp, Homo sapiens
caccctgggccctgggc

SEQ ID NO: 2448480 - DNA, 16 bp, Homo sapiens
caccctgtactgttct

SEQ ID NO: 2448481 - DNA, 21 bp, Homo sapiens
caccctgtactgttctgtgtc

SEQ ID NO: 2448482 - DNA, 14 bp, Homo sapiens
caccctgtctgccc

SEQ ID NO: 2448483 - DNA, 14 bp, Homo sapiens
caccctgttcctgc

SEQ ID NO: 2448484 - DNA, 16 bp, Homo sapiens
cacccttctcccactc

SEQ ID NO: 2448485 - DNA, 19 bp, Homo sapiens
cacccttctcccactctcc

SEQ ID NO: 2448486 - DNA, 21 bp, Homo sapiens
cacccttctcccactctccta

SEQ ID NO: 2448487 - DNA, 17 bp, Homo sapiens
cacccttttccagctgg

SEQ ID NO: 2448488 - DNA, 14 bp, Homo sapiens
caccgaagcccaga

SEQ ID NO: 2448489 - DNA, 19 bp, Homo sapiens
caccggaccagcctggccc

SEQ ID NO: 2448490 - DNA, 21 bp, Homo sapiens
caccggctctcacctggccct

SEQ ID NO: 2448491 - DNA, 14 bp, Homo sapiens
caccgggccactcc

SEQ ID NO: 2448492 - DNA, 24 bp, Homo sapiens
caccgtgcccagccctaaacatca

SEQ ID NO: 2448493 - DNA, 18 bp, Homo sapiens
caccgtgggctccctgac

SEQ ID NO: 2448494 - DNA, 13 bp, Homo sapiens
caccgttctgtgc

SEQ ID NO: 2448495 - DNA, 14 bp, Homo sapiens
caccgttctgtgca

SEQ ID NO: 2448496 - DNA, 13 bp, Homo sapiens
caccgttgtctca

SEQ ID NO: 2448497 - DNA, 19 bp, Homo sapiens
caccgttgtctcatgccag

SEQ ID NO: 2448498 - DNA, 22 bp, Homo sapiens
caccgtttcttcctgccagcag

SEQ ID NO: 2448499 - DNA, 12 bp, Homo sapiens
cacctaaagaaa

SEQ ID NO: 2448500 - DNA, 20 bp, Homo sapiens
cacctaatccaggcagatcc

SEQ ID NO: 2448501 - DNA, 18 bp, Homo sapiens
cacctaccgagttcaagt

SEQ ID NO: 2448502 - DNA, 22 bp, Homo sapiens
cacctagctgaatgtttttcta

SEQ ID NO: 2448503 - DNA, 19 bp, Homo sapiens
cacctaggaagcctcagat

SEQ ID NO: 2448504 - DNA, 17 bp, Homo sapiens
cacctattatcccagct

SEQ ID NO: 2448505 - DNA, 19 bp, Homo sapiens
cacctcagatggcagcttt

SEQ ID NO: 2448506 - DNA, 16 bp, Homo sapiens
cacctccacatcctcc

SEQ ID NO: 2448507 - DNA, 22 bp, Homo sapiens
cacctcctgggttcaagcgatt

SEQ ID NO: 2448508 - DNA, 17 bp, Homo sapiens
cacctctaacagcacca

SEQ ID NO: 2448509 - DNA, 12 bp, Homo sapiens
cacctctgctgc

SEQ ID NO: 2448510 - DNA, 13 bp, Homo sapiens
cacctgaactgaa

SEQ ID NO: 2448511 - DNA, 17 bp, Homo sapiens
cacctgaactgaacacc

SEQ ID NO: 2448512 - DNA, 16 bp, Homo sapiens
cacctgccccaactct

SEQ ID NO: 2448513 - DNA, 20 bp, Homo sapiens
cacctgccctacctgcccca

SEQ ID NO: 2448514 - DNA, 13 bp, Homo sapiens
cacctgcctcagg

SEQ ID NO: 2448515 - DNA, 14 bp, Homo sapiens
cacctgcctcagga

SEQ ID NO: 2448516 - DNA, 18 bp, Homo sapiens
cacctggacccctgcatt

SEQ ID NO: 2448517 - DNA, 17 bp, Homo sapiens
cacctggctctcacctc

SEQ ID NO: 2448518 - DNA, 19 bp, Homo sapiens
cacctggctctcacctcta

SEQ ID NO: 2448519 - DNA, 16 bp, Homo sapiens
cacctgggagaaatct

SEQ ID NO: 2448520 - DNA, 18 bp, Homo sapiens
cacctgggccctggggcc

SEQ ID NO: 2448521 - DNA, 20 bp, Homo sapiens
cacctgggccctggggcctg

SEQ ID NO: 2448522 - DNA, 23 bp, Homo sapiens
cacctgggccctggggcctgtac

SEQ ID NO: 2448523 - DNA, 20 bp, Homo sapiens
cacctggtactccctctcag

SEQ ID NO: 2448524 - DNA, 18 bp, Homo sapiens
cacctgtagcacttactg

SEQ ID NO: 2448525 - DNA, 22 bp, Homo sapiens
cacctgtagcacttactggtag

SEQ ID NO: 2448526 - DNA, 16 bp, Homo sapiens
caccttccagctcctg

SEQ ID NO: 2448527 - DNA, 21 bp, Homo sapiens
caccttggacatcctcctccc

SEQ ID NO: 2448528 - DNA, 20 bp, Homo sapiens
cacctttactgtgcttattt

SEQ ID NO: 2448529 - DNA, 12 bp, Homo sapiens
cacctttttgca

SEQ ID NO: 2448530 - DNA, 17 bp, Homo sapiens
cacgaaatgttattttt

SEQ ID NO: 2448531 - DNA, 17 bp, Homo sapiens
cacgactggccagggcc

SEQ ID NO: 2448532 - DNA, 13 bp, Homo sapiens
cacgactgtctcc

SEQ ID NO: 2448533 - DNA, 12 bp, Homo sapiens
cacgagggctgg

SEQ ID NO: 2448534 - DNA, 14 bp, Homo sapiens
cacgcccgtcctgc

SEQ ID NO: 2448535 - DNA, 20 bp, Homo sapiens
cacgcccgtcctgcctgtgg

SEQ ID NO: 2448536 - DNA, 12 bp, Homo sapiens
cacgctccagct

SEQ ID NO: 2448537 - DNA, 13 bp, Homo sapiens
cacgctccagctg

SEQ ID NO: 2448538 - DNA, 15 bp, Homo sapiens
cacgctccagctgcc

SEQ ID NO: 2448539 - DNA, 23 bp, Homo sapiens
cacgctctctccaggcaggtctg

SEQ ID NO: 2448540 - DNA, 23 bp, Homo sapiens
cacggaccaaagggagtctgcca

SEQ ID NO: 2448541 - DNA, 17 bp, Homo sapiens
cacggagccactcctct

SEQ ID NO: 2448542 - DNA, 23 bp, Homo sapiens
cacggagtcgtggggtgtgctgg

SEQ ID NO: 2448543 - DNA, 22 bp, Homo sapiens
cacggcacctgggccctggggc

SEQ ID NO: 2448544 - DNA, 17 bp, Homo sapiens
cacggccacacagctgc

SEQ ID NO: 2448545 - DNA, 20 bp, Homo sapiens
cacggccacacagctgccgg

SEQ ID NO: 2448546 - DNA, 20 bp, Homo sapiens
cacggctctgtccccagcct

SEQ ID NO: 2448547 - DNA, 18 bp, Homo sapiens
cacgggcctgtccacagg

SEQ ID NO: 2448548 - DNA, 17 bp, Homo sapiens
cacgggtgtcacggcca

SEQ ID NO: 2448549 - DNA, 12 bp, Homo sapiens
cacgtggcctct

SEQ ID NO: 2448550 - DNA, 16 bp, Homo sapiens
cacgtgggctcatatg

SEQ ID NO: 2448551 - DNA, 22 bp, Homo sapiens
cacgtgtgtttttctattaaaa

SEQ ID NO: 2448552 - DNA, 16 bp, Homo sapiens
cacgtgtttgtgctgt

SEQ ID NO: 2448553 - DNA, 19 bp, Homo sapiens
cactaaaacacacaggtgc

SEQ ID NO: 2448554 - DNA, 21 bp, Homo sapiens
cactaaagcaggccttttgat

SEQ ID NO: 2448555 - DNA, 14 bp, Homo sapiens
cactaaccttgcct

SEQ ID NO: 2448556 - DNA, 21 bp, Homo sapiens
cactaacggttgagttttgac

SEQ ID NO: 2448557 - DNA, 20 bp, Homo sapiens
cactaacgttgagcccctgg

SEQ ID NO: 2448558 - DNA, 12 bp, Homo sapiens
cactaattcata

SEQ ID NO: 2448559 - DNA, 13 bp, Homo sapiens
cactactgacatg

SEQ ID NO: 2448560 - DNA, 21 bp, Homo sapiens
cactagacaagccagaacttg

SEQ ID NO: 2448561 - DNA, 14 bp, Homo sapiens
cactagccaaacct

SEQ ID NO: 2448562 - DNA, 11 bp, Homo sapiens
cactcaaggcg

SEQ ID NO: 2448563 - DNA, 17 bp, Homo sapiens
cactcaaggcggtgctt

SEQ ID NO: 2448564 - DNA, 17 bp, Homo sapiens
cactcactaggccccca

SEQ ID NO: 2448565 - DNA, 22 bp, Homo sapiens
cactcactaggcccccacttgc

SEQ ID NO: 2448566 - DNA, 13 bp, Homo sapiens
cactcagaagcct

SEQ ID NO: 2448567 - DNA, 15 bp, Homo sapiens
cactcagaagcctgg

SEQ ID NO: 2448568 - DNA, 16 bp, Homo sapiens
cactcagaagcctggg

SEQ ID NO: 2448569 - DNA, 13 bp, Homo sapiens
cagcacttccatg

SEQ ID NO: 2448570 - DNA, 16 bp, Homo sapiens
cagcacttggcccttc

SEQ ID NO: 2448571 - DNA, 17 bp, Homo sapiens
cagcacttgtccagctg

SEQ ID NO: 2448572 - DNA, 19 bp, Homo sapiens
cagcacttgtccagctgag

SEQ ID NO: 2448573 - DNA, 12 bp, Homo sapiens
cagcagacagag

SEQ ID NO: 2448574 - DNA, 14 bp, Homo sapiens
cagcagacagagcc

SEQ ID NO: 2448575 - DNA, 15 bp, Homo sapiens
cagcagacagagcca

SEQ ID NO: 2448576 - DNA, 17 bp, Homo sapiens
cagcagacagagccagg

SEQ ID NO: 2448577 - DNA, 18 bp, Homo sapiens
cagcagacagagccagga

SEQ ID NO: 2448578 - DNA, 22 bp, Homo sapiens
cagcagcacctgccctacctgc

SEQ ID NO: 2448579 - DNA, 12 bp, Homo sapiens
cagcagccagcc

SEQ ID NO: 2448580 - DNA, 13 bp, Homo sapiens
cagcagccagccc

SEQ ID NO: 2448581 - DNA, 14 bp, Homo sapiens
cagcagccagccct

SEQ ID NO: 2448582 - DNA, 17 bp, Homo sapiens
cagcagccagccctgcc

SEQ ID NO: 2448583 - DNA, 19 bp, Homo sapiens
cagcagccagccctgcctg

SEQ ID NO: 2448584 - DNA, 23 bp, Homo sapiens
cagcagccagccctgcctggagg

SEQ ID NO: 2448585 - DNA, 15 bp, Homo sapiens
cagcagccccacacc

SEQ ID NO: 2448586 - DNA, 20 bp, Homo sapiens
cagcagcccccagctcccac

SEQ ID NO: 2448587 - DNA, 19 bp, Homo sapiens
cagcagcctcgcccctggc

SEQ ID NO: 2448588 - DNA, 21 bp, Homo sapiens
cagcagcctcgcccctggcag

SEQ ID NO: 2448589 - DNA, 22 bp, Homo sapiens
cagcagcctcgcccctggcaga

SEQ ID NO: 2448590 - DNA, 23 bp, Homo sapiens
cagcagcctcgcccctggcagag

SEQ ID NO: 2448591 - DNA, 21 bp, Homo sapiens
cagcagcctggggctggcctc

SEQ ID NO: 2448592 - DNA, 14 bp, Homo sapiens
cagcaggggctgcc

SEQ ID NO: 2448593 - DNA, 22 bp, Homo sapiens
cagcaggggctgcccgagtctg

SEQ ID NO: 2448594 - DNA, 14 bp, Homo sapiens
cagcaggggtgtga

SEQ ID NO: 2448595 - DNA, 20 bp, Homo sapiens
cagcaggggttggggaaaca

SEQ ID NO: 2448596 - DNA, 19 bp, Homo sapiens
cagcagtgtgaggccaggg

SEQ ID NO: 2448597 - DNA, 23 bp, Homo sapiens
cagcatcagggttaagaagactt

SEQ ID NO: 2448598 - DNA, 19 bp, Homo sapiens
cagcatccccttgaactct

SEQ ID NO: 2448599 - DNA, 21 bp, Homo sapiens
cagcatcggacaagaccccca

SEQ ID NO: 2448600 - DNA, 18 bp, Homo sapiens
cagcatctccaagcagct

SEQ ID NO: 2448601 - DNA, 22 bp, Homo sapiens
cagcatctccaagcagcttaga

SEQ ID NO: 2448602 - DNA, 20 bp, Homo sapiens
cagcatctctaccttctccc

SEQ ID NO: 2448603 - DNA, 20 bp, Homo sapiens
cagcatctgggccttggcct

SEQ ID NO: 2448604 - DNA, 18 bp, Homo sapiens
cagcatgaatttgtaatg

SEQ ID NO: 2448605 - DNA, 16 bp, Homo sapiens
cagcatgcaatacata

SEQ ID NO: 2448606 - DNA, 13 bp, Homo sapiens
cagcatggaggag

SEQ ID NO: 2448607 - DNA, 22 bp, Homo sapiens
cagcatggcatccaagactctt

SEQ ID NO: 2448608 - DNA, 20 bp, Homo sapiens
cagcatgtacggattttcag

SEQ ID NO: 2448609 - DNA, 17 bp, Homo sapiens
cagcattcccaggtagg

SEQ ID NO: 2448610 - DNA, 23 bp, Homo sapiens
cagcattcccaggtaggccaagg

SEQ ID NO: 2448611 - DNA, 16 bp, Homo sapiens
cagccaaaccctgtct

SEQ ID NO: 2448612 - DNA, 23 bp, Homo sapiens
cagccaacacgcacctgcctcag

SEQ ID NO: 2448613 - DNA, 17 bp, Homo sapiens
cagccaactagcccctg

SEQ ID NO: 2448614 - DNA, 20 bp, Homo sapiens
cagccaactagcccctgggg

SEQ ID NO: 2448615 - DNA, 14 bp, Homo sapiens
cagccaagctctgc

SEQ ID NO: 2448616 - DNA, 16 bp, Homo sapiens
cagccacacttctcag

SEQ ID NO: 2448617 - DNA, 18 bp, Homo sapiens
cagccaccctgaggagtc

SEQ ID NO: 2448618 - DNA, 21 bp, Homo sapiens
cagccaccctgaggagtctga

SEQ ID NO: 2448619 - DNA, 21 bp, Homo sapiens
cagccaccgaagccgcctgtg

SEQ ID NO: 2448620 - DNA, 16 bp, Homo sapiens
cagccagcatctgggc

SEQ ID NO: 2448621 - DNA, 13 bp, Homo sapiens
cagccagccctgc

SEQ ID NO: 2448622 - DNA, 14 bp, Homo sapiens
cagccagccctgcc

SEQ ID NO: 2448623 - DNA, 18 bp, Homo sapiens
cagccagccctgcctgga

SEQ ID NO: 2448624 - DNA, 23 bp, Homo sapiens
cagccagcctcgcccatcccctt

SEQ ID NO: 2448625 - DNA, 19 bp, Homo sapiens
cagccagcgtcggtctgtg

SEQ ID NO: 2448626 - DNA, 15 bp, Homo sapiens
cagccagggagagcc

SEQ ID NO: 2448627 - DNA, 17 bp, Homo sapiens
cagccagggagagccca

SEQ ID NO: 2448628 - DNA, 20 bp, Homo sapiens
cagccagggagagcccagga

SEQ ID NO: 2448629 - DNA, 23 bp, Homo sapiens
cagccaggggagcagaggggcag

SEQ ID NO: 2448630 - DNA, 19 bp, Homo sapiens
cagccagtgccctgagcca

SEQ ID NO: 2448631 - DNA, 13 bp, Homo sapiens
cagccatcaaaat

SEQ ID NO: 2448632 - DNA, 16 bp, Homo sapiens
cagccatcaaaatgct

SEQ ID NO: 2448633 - DNA, 17 bp, Homo sapiens
cagccatcaaaatgctt

SEQ ID NO: 2448634 - DNA, 20 bp, Homo sapiens
cagccattggctatttaaaa

SEQ ID NO: 2448635 - DNA, 19 bp, Homo sapiens
cagcccaagtgaggcagcc

SEQ ID NO: 2448636 - DNA, 16 bp, Homo sapiens
cagcccacccccggca

SEQ ID NO: 2448637 - DNA, 18 bp, Homo sapiens
cagcccacccccggcagc

SEQ ID NO: 2448638 - DNA, 11 bp, Homo sapiens
cagcccagaga

SEQ ID NO: 2448639 - DNA, 13 bp, Homo sapiens
cagcccagagaca

SEQ ID NO: 2448640 - DNA, 20 bp, Homo sapiens
cagcccagcccgcccactgg

SEQ ID NO: 2448641 - DNA, 21 bp, Homo sapiens
cagcccagggctcctgcactt

SEQ ID NO: 2448642 - DNA, 21 bp, Homo sapiens
cagcccatggagattgacctg

SEQ ID NO: 2448643 - DNA, 20 bp, Homo sapiens
cagccccaccccagggcagc

SEQ ID NO: 2448644 - DNA, 18 bp, Homo sapiens
cagccccaccctggccta

SEQ ID NO: 2448645 - DNA, 16 bp, Homo sapiens
cagccccactcctctg

SEQ ID NO: 2448646 - DNA, 15 bp, Homo sapiens
cagccccagccaggg

SEQ ID NO: 2448647 - DNA, 21 bp, Homo sapiens
cagcccccagctcccacctcc

SEQ ID NO: 2448648 - DNA, 18 bp, Homo sapiens
cagccccctgaccactca

SEQ ID NO: 2448649 - DNA, 13 bp, Homo sapiens
cagcccctctggt

SEQ ID NO: 2448650 - DNA, 18 bp, Homo sapiens
cagcccctcttggagaag

SEQ ID NO: 2448651 - DNA, 12 bp, Homo sapiens
cagcccctttcc

SEQ ID NO: 2448652 - DNA, 15 bp, Homo sapiens
cagcccctttccctt

SEQ ID NO: 2448653 - DNA, 23 bp, Homo sapiens
cagcccctttcccttgtagctcc

SEQ ID NO: 2448654 - DNA, 19 bp, Homo sapiens
cagcccgcccactgggtaa

SEQ ID NO: 2448655 - DNA, 18 bp, Homo sapiens
cagccctagggtggagag

SEQ ID NO: 2448656 - DNA, 19 bp, Homo sapiens
cagccctcacacaccctgt

SEQ ID NO: 2448657 - DNA, 17 bp, Homo sapiens
cagccctcatcccgagc

SEQ ID NO: 2448658 - DNA, 17 bp, Homo sapiens
cagccctcctctgcact

SEQ ID NO: 2448659 - DNA, 13 bp, Homo sapiens
cagccctgcctgg

SEQ ID NO: 2448660 - DNA, 17 bp, Homo sapiens
cagccctgcctggagga

SEQ ID NO: 2448661 - DNA, 19 bp, Homo sapiens
cagccctgcctggaggacc

SEQ ID NO: 2448662 - DNA, 17 bp, Homo sapiens
cagccctgtcagcatga

SEQ ID NO: 2448663 - DNA, 21 bp, Homo sapiens
cagccctgtcagcatgaattt

SEQ ID NO: 2448664 - DNA, 23 bp, Homo sapiens
cagcccttgggggtcctcctcca

SEQ ID NO: 2448665 - DNA, 14 bp, Homo sapiens
cagccgaccccctc

SEQ ID NO: 2448666 - DNA, 17 bp, Homo sapiens
cagccgagcaggaggcc

SEQ ID NO: 2448667 - DNA, 18 bp, Homo sapiens
cagccgagcaggaggcct

SEQ ID NO: 2448668 - DNA, 21 bp, Homo sapiens
cagccgagcaggaggcctagg

SEQ ID NO: 2448669 - DNA, 23 bp, Homo sapiens
cagccgagcaggaggcctaggag

SEQ ID NO: 2448670 - DNA, 22 bp, Homo sapiens
cagccgaggtccctgctgccag

SEQ ID NO: 2448671 - DNA, 23 bp, Homo sapiens
cagccgcttggcgatgccagcca

SEQ ID NO: 2448672 - DNA, 19 bp, Homo sapiens
caggtccagctctggaggg

SEQ ID NO: 2448673 - DNA, 23 bp, Homo sapiens
caggtccagctctggaggggagg

SEQ ID NO: 2448674 - DNA, 13 bp, Homo sapiens
caggtccaggctg

SEQ ID NO: 2448675 - DNA, 16 bp, Homo sapiens
caggtccaggctgtgt

SEQ ID NO: 2448676 - DNA, 13 bp, Homo sapiens
caggtcctggtgg

SEQ ID NO: 2448677 - DNA, 14 bp, Homo sapiens
caggtcctggtggg

SEQ ID NO: 2448678 - DNA, 19 bp, Homo sapiens
caggtcctggtggggcagc

SEQ ID NO: 2448679 - DNA, 21 bp, Homo sapiens
caggtctgaagctcaactctc

SEQ ID NO: 2448680 - DNA, 16 bp, Homo sapiens
caggtctgggtggggc

SEQ ID NO: 2448681 - DNA, 21 bp, Homo sapiens
caggtgaggtcagcacatctc

SEQ ID NO: 2448682 - DNA, 21 bp, Homo sapiens
caggtgaggtctgttcctttt

SEQ ID NO: 2448683 - DNA, 21 bp, Homo sapiens
caggtgctgacttcatctccc

SEQ ID NO: 2448684 - DNA, 23 bp, Homo sapiens
caggtgctgacttcatctcccac

SEQ ID NO: 2448685 - DNA, 17 bp, Homo sapiens
caggtgctggggcctgg

SEQ ID NO: 2448686 - DNA, 14 bp, Homo sapiens
caggtgctggtccc

SEQ ID NO: 2448687 - DNA, 17 bp, Homo sapiens
caggtggccaagttcct

SEQ ID NO: 2448688 - DNA, 18 bp, Homo sapiens
caggtggccaagttcctc

SEQ ID NO: 2448689 - DNA, 19 bp, Homo sapiens
caggtggccaagttcctct

SEQ ID NO: 2448690 - DNA, 23 bp, Homo sapiens
caggtggggagactgggctgagg

SEQ ID NO: 2448691 - DNA, 18 bp, Homo sapiens
caggtgttaacattccaa

SEQ ID NO: 2448692 - DNA, 19 bp, Homo sapiens
caggtgttaacattccaag

SEQ ID NO: 2448693 - DNA, 13 bp, Homo sapiens
caggtgttgccaa

SEQ ID NO: 2448694 - DNA, 15 bp, Homo sapiens
caggttataacagtg

SEQ ID NO: 2448695 - DNA, 16 bp, Homo sapiens
caggttataacagtgt

SEQ ID NO: 2448696 - DNA, 17 bp, Homo sapiens
caggttcccaagctcag

SEQ ID NO: 2448697 - DNA, 15 bp, Homo sapiens
caggttccctcccag

SEQ ID NO: 2448698 - DNA, 18 bp, Homo sapiens
caggttcttgttggtgca

SEQ ID NO: 2448699 - DNA, 11 bp, Homo sapiens
caggtttttcc

SEQ ID NO: 2448700 - DNA, 12 bp, Homo sapiens
caggtttttccc

SEQ ID NO: 2448701 - DNA, 14 bp, Homo sapiens
cagtaaaccactga

SEQ ID NO: 2448702 - DNA, 21 bp, Homo sapiens
cagtaaaccactgaaaaaata

SEQ ID NO: 2448703 - DNA, 15 bp, Homo sapiens
cagtaacaggctcaa

SEQ ID NO: 2448704 - DNA, 9 bp, Homo sapiens
cagtaactg

SEQ ID NO: 2448705 - DNA, 10 bp, Homo sapiens
cagtaactgt

SEQ ID NO: 2448706 - DNA, 20 bp, Homo sapiens
cagtagaccttgttacttct

SEQ ID NO: 2448707 - DNA, 15 bp, Homo sapiens
cagtagattgcagaa

SEQ ID NO: 2448708 - DNA, 22 bp, Homo sapiens
cagtaggagcccagctctgaaa

SEQ ID NO: 2448709 - DNA, 22 bp, Homo sapiens
cagtaggtgcccagaataagtt

SEQ ID NO: 2448710 - DNA, 20 bp, Homo sapiens
cagtaggttatttagcttgg

SEQ ID NO: 2448711 - DNA, 16 bp, Homo sapiens
cagtatcatgccctgt

SEQ ID NO: 2448712 - DNA, 19 bp, Homo sapiens
cagtatgttcaaagtcaaa

SEQ ID NO: 2448713 - DNA, 17 bp, Homo sapiens
cagtatttagaagccaa

SEQ ID NO: 2448714 - DNA, 12 bp, Homo sapiens
cagtatttgtaa

SEQ ID NO: 2448715 - DNA, 13 bp, Homo sapiens
cagtatttgtaat

SEQ ID NO: 2448716 - DNA, 15 bp, Homo sapiens
cagtatttgtaatta

SEQ ID NO: 2448717 - DNA, 22 bp, Homo sapiens
cagtcaacctgggcaaagccta

SEQ ID NO: 2448718 - DNA, 15 bp, Homo sapiens
cagtcaatattttta

SEQ ID NO: 2448719 - DNA, 16 bp, Homo sapiens
cagtcacagccacccc

SEQ ID NO: 2448720 - DNA, 15 bp, Homo sapiens
cagtcactctagtca

SEQ ID NO: 2448721 - DNA, 21 bp, Homo sapiens
cagtcaggaaaggaatcattt

SEQ ID NO: 2448722 - DNA, 21 bp, Homo sapiens
cagtcattggctgtctcctag

SEQ ID NO: 2448723 - DNA, 23 bp, Homo sapiens
cagtccacctgaggaactgtctc

SEQ ID NO: 2448724 - DNA, 18 bp, Homo sapiens
cagtccagtcctatctgg

SEQ ID NO: 2448725 - DNA, 14 bp, Homo sapiens
cagtcccagagcag

SEQ ID NO: 2448726 - DNA, 15 bp, Homo sapiens
cagtcccagagcagg

SEQ ID NO: 2448727 - DNA, 20 bp, Homo sapiens
cagtccccccaccctcattc

SEQ ID NO: 2448728 - DNA, 15 bp, Homo sapiens
cagtcctatctgggc

SEQ ID NO: 2448729 - DNA, 20 bp, Homo sapiens
cagtcctatctgggcttcct

SEQ ID NO: 2448730 - DNA, 22 bp, Homo sapiens
cagtctaaagctggtttaatgt

SEQ ID NO: 2448731 - DNA, 14 bp, Homo sapiens
cagtctctgagcag

SEQ ID NO: 2448732 - DNA, 14 bp, Homo sapiens
cagtgaagacagaa

SEQ ID NO: 2448733 - DNA, 15 bp, Homo sapiens
cagtgaagacagaag

SEQ ID NO: 2448734 - DNA, 15 bp, Homo sapiens
cagtgaagttgctgc

SEQ ID NO: 2448735 - DNA, 19 bp, Homo sapiens
cagtgaagttgctgcttct

SEQ ID NO: 2448736 - DNA, 20 bp, Homo sapiens
cagtgaatgattcagtgtta

SEQ ID NO: 2448737 - DNA, 16 bp, Homo sapiens
cagtgacagacaggct

SEQ ID NO: 2448738 - DNA, 17 bp, Homo sapiens
cagtgacagacaggctc

SEQ ID NO: 2448739 - DNA, 18 bp, Homo sapiens
cagtgacagacaggctct

SEQ ID NO: 2448740 - DNA, 13 bp, Homo sapiens
cagtgaccctggc

SEQ ID NO: 2448741 - DNA, 16 bp, Homo sapiens
cagtgaccctggctcc

SEQ ID NO: 2448742 - DNA, 15 bp, Homo sapiens
cagtgacttctgaga

SEQ ID NO: 2448743 - DNA, 23 bp, Homo sapiens
cagtgagggtaagtattttcctg

SEQ ID NO: 2448744 - DNA, 16 bp, Homo sapiens
cagtgattgtcttaat

SEQ ID NO: 2448745 - DNA, 14 bp, Homo sapiens
cagtgcaacactgg

SEQ ID NO: 2448746 - DNA, 12 bp, Homo sapiens
cagtgcccccac

SEQ ID NO: 2448747 - DNA, 17 bp, Homo sapiens
cagtgcccccactgacc

SEQ ID NO: 2448748 - DNA, 13 bp, Homo sapiens
cagtgccctctcc

SEQ ID NO: 2448749 - DNA, 13 bp, Homo sapiens
cagtgccctgagc

SEQ ID NO: 2448750 - DNA, 15 bp, Homo sapiens
cagtgccctgagcca

SEQ ID NO: 2448751 - DNA, 14 bp, Homo sapiens
cagtgctccctcac

SEQ ID NO: 2448752 - DNA, 12 bp, Homo sapiens
cagtgctgtgct

SEQ ID NO: 2448753 - DNA, 16 bp, Homo sapiens
cagtgctgtgctgtgc

SEQ ID NO: 2448754 - DNA, 20 bp, Homo sapiens
cagtgcttttaagtgaaaat

SEQ ID NO: 2448755 - DNA, 20 bp, Homo sapiens
cagtggcaggcagaggccca

SEQ ID NO: 2448756 - DNA, 13 bp, Homo sapiens
cagtggggcagag

SEQ ID NO: 2448757 - DNA, 15 bp, Homo sapiens
cagtggggcagtcat

SEQ ID NO: 2448758 - DNA, 15 bp, Homo sapiens
cagtgtatggggcag

SEQ ID NO: 2448759 - DNA, 17 bp, Homo sapiens
cagtgtgaggccagggc

SEQ ID NO: 2448760 - DNA, 20 bp, Homo sapiens
cagtgtgcaaggcagccgtg

SEQ ID NO: 2448761 - DNA, 21 bp, Homo sapiens
cagtgtgcaaggcagccgtgg

SEQ ID NO: 2448762 - DNA, 19 bp, Homo sapiens
cagtgtggaggccactgtt

SEQ ID NO: 2448763 - DNA, 14 bp, Homo sapiens
cagtgttgtcacca

SEQ ID NO: 2448764 - DNA, 22 bp, Homo sapiens
cagtgttttctgggataagtaa

SEQ ID NO: 2448765 - DNA, 21 bp, Homo sapiens
cagtgtttttagacctgtgtt

SEQ ID NO: 2448766 - DNA, 19 bp, Homo sapiens
cagttaaaaaaaattttaa

SEQ ID NO: 2448767 - DNA, 12 bp, Homo sapiens
cagttaattttt

SEQ ID NO: 2448768 - DNA, 14 bp, Homo sapiens
cagttaatttttcc

SEQ ID NO: 2448769 - DNA, 20 bp, Homo sapiens
cagttaccattaaaccatct

SEQ ID NO: 2448770 - DNA, 16 bp, Homo sapiens
cagttatattttgcag

SEQ ID NO: 2448771 - DNA, 13 bp, Homo sapiens
cagttcaccctga

SEQ ID NO: 2448772 - DNA, 23 bp, Homo sapiens
cagttcatatgtaccatgtacat

SEQ ID NO: 2448773 - DNA, 18 bp, Homo sapiens
cagttcctgtggctccct

SEQ ID NO: 2448774 - DNA, 19 bp, Homo sapiens
cagttcctgtggctccctc

SEQ ID NO: 2448775 - DNA, 16 bp, Homo sapiens
cagttcgcagccaccc

SEQ ID NO: 2448776 - DNA, 18 bp, Homo sapiens
cagttcgcagccaccctg

SEQ ID NO: 2448777 - DNA, 13 bp, Homo sapiens
cattcgtgaaaac

SEQ ID NO: 2448778 - DNA, 15 bp, Homo sapiens
cattctcattggaaa

SEQ ID NO: 2448779 - DNA, 23 bp, Homo sapiens
cattctctgtctcatccatcatc

SEQ ID NO: 2448780 - DNA, 16 bp, Homo sapiens
cattctgaaggagccc

SEQ ID NO: 2448781 - DNA, 23 bp, Homo sapiens
cattctgactcggtttctccaaa

SEQ ID NO: 2448782 - DNA, 11 bp, Homo sapiens
cattctgcaag

SEQ ID NO: 2448783 - DNA, 17 bp, Homo sapiens
cattctgcctctctagg

SEQ ID NO: 2448784 - DNA, 14 bp, Homo sapiens
cattctgctccttc

SEQ ID NO: 2448785 - DNA, 16 bp, Homo sapiens
cattcttctctgttgt

SEQ ID NO: 2448786 - DNA, 16 bp, Homo sapiens
cattgaaaagagctga

SEQ ID NO: 2448787 - DNA, 16 bp, Homo sapiens
cattgaacacaaactg

SEQ ID NO: 2448788 - DNA, 22 bp, Homo sapiens
cattgaacacaaactgtaaata

SEQ ID NO: 2448789 - DNA, 14 bp, Homo sapiens
cattgaaggcttaa

SEQ ID NO: 2448790 - DNA, 23 bp, Homo sapiens
cattgaattcttggttgaggaaa

SEQ ID NO: 2448791 - DNA, 22 bp, Homo sapiens
cattgaccgcgactaatttcaa

SEQ ID NO: 2448792 - DNA, 20 bp, Homo sapiens
cattggaaatttagcattgt

SEQ ID NO: 2448793 - DNA, 14 bp, Homo sapiens
cattggaactggag

SEQ ID NO: 2448794 - DNA, 20 bp, Homo sapiens
cattggaagagcagcacctc

SEQ ID NO: 2448795 - DNA, 17 bp, Homo sapiens
cattggaataaggcatg

SEQ ID NO: 2448796 - DNA, 19 bp, Homo sapiens
cattggaatgttctcagat

SEQ ID NO: 2448797 - DNA, 21 bp, Homo sapiens
cattgtaaaagcattttgtaa

SEQ ID NO: 2448798 - DNA, 22 bp, Homo sapiens
cattgtaaaagcattttgtaat

SEQ ID NO: 2448799 - DNA, 18 bp, Homo sapiens
cattgtagcgtctttctt

SEQ ID NO: 2448800 - DNA, 15 bp, Homo sapiens
cattgtagtgctttg

SEQ ID NO: 2448801 - DNA, 20 bp, Homo sapiens
cattgtagtgctttgagaga

SEQ ID NO: 2448802 - DNA, 14 bp, Homo sapiens
cattgtatatgtga

SEQ ID NO: 2448803 - DNA, 15 bp, Homo sapiens
cattgtatgtggtca

SEQ ID NO: 2448804 - DNA, 16 bp, Homo sapiens
cattgtgattggcctg

SEQ ID NO: 2448805 - DNA, 18 bp, Homo sapiens
cattgtttagaaagaata

SEQ ID NO: 2448806 - DNA, 19 bp, Homo sapiens
catttaaaacattaaaata

SEQ ID NO: 2448807 - DNA, 20 bp, Homo sapiens
catttaaaacattaaaatat

SEQ ID NO: 2448808 - DNA, 22 bp, Homo sapiens
catttaaaagcataaggccgga

SEQ ID NO: 2448809 - DNA, 18 bp, Homo sapiens
catttaaatacagtcttc

SEQ ID NO: 2448810 - DNA, 19 bp, Homo sapiens
catttaacccccctgtaca

SEQ ID NO: 2448811 - DNA, 13 bp, Homo sapiens
catttaatagact

SEQ ID NO: 2448812 - DNA, 22 bp, Homo sapiens
catttaatggggaggacaaaat

SEQ ID NO: 2448813 - DNA, 15 bp, Homo sapiens
catttacaaactgaa

SEQ ID NO: 2448814 - DNA, 16 bp, Homo sapiens
catttacaaactgaag

SEQ ID NO: 2448815 - DNA, 19 bp, Homo sapiens
catttacaaactgaagagt

SEQ ID NO: 2448816 - DNA, 16 bp, Homo sapiens
catttagcatgttgtt

SEQ ID NO: 2448817 - DNA, 18 bp, Homo sapiens
catttagcctgtcctgtc

SEQ ID NO: 2448818 - DNA, 15 bp, Homo sapiens
catttatatattgaa

SEQ ID NO: 2448819 - DNA, 22 bp, Homo sapiens
catttatatattgaattaatat

SEQ ID NO: 2448820 - DNA, 14 bp, Homo sapiens
catttatattgata

SEQ ID NO: 2448821 - DNA, 20 bp, Homo sapiens
catttatattgataagatct

SEQ ID NO: 2448822 - DNA, 16 bp, Homo sapiens
catttatctataattt

SEQ ID NO: 2448823 - DNA, 22 bp, Homo sapiens
catttatctataatttacctaa

SEQ ID NO: 2448824 - DNA, 21 bp, Homo sapiens
catttcatctaccattttctg

SEQ ID NO: 2448825 - DNA, 18 bp, Homo sapiens
catttcccaacacaaaga

SEQ ID NO: 2448826 - DNA, 15 bp, Homo sapiens
catttcccctccttc

SEQ ID NO: 2448827 - DNA, 14 bp, Homo sapiens
catttcctcagact

SEQ ID NO: 2448828 - DNA, 22 bp, Homo sapiens
catttcctcagactctaagaaa

SEQ ID NO: 2448829 - DNA, 14 bp, Homo sapiens
catttcctgggtgg

SEQ ID NO: 2448830 - DNA, 22 bp, Homo sapiens
catttcctgggtggctactctg

SEQ ID NO: 2448831 - DNA, 11 bp, Homo sapiens
catttctaatt

SEQ ID NO: 2448832 - DNA, 19 bp, Homo sapiens
catttctaattatgtagct

SEQ ID NO: 2448833 - DNA, 23 bp, Homo sapiens
catttctatagccaaaaatagct

SEQ ID NO: 2448834 - DNA, 12 bp, Homo sapiens
catttctcaggc

SEQ ID NO: 2448835 - DNA, 15 bp, Homo sapiens
catttctttttggga

SEQ ID NO: 2448836 - DNA, 22 bp, Homo sapiens
catttctttttgggagagactt

SEQ ID NO: 2448837 - DNA, 19 bp, Homo sapiens
catttgaaacccctgtagg

SEQ ID NO: 2448838 - DNA, 22 bp, Homo sapiens
catttgcagggtcctcttctgg

SEQ ID NO: 2448839 - DNA, 17 bp, Homo sapiens
catttggaatacttttt

SEQ ID NO: 2448840 - DNA, 14 bp, Homo sapiens
catttgggtccagg

SEQ ID NO: 2448841 - DNA, 16 bp, Homo sapiens
catttgggtccaggag

SEQ ID NO: 2448842 - DNA, 18 bp, Homo sapiens
catttgggtccaggagga

SEQ ID NO: 2448843 - DNA, 21 bp, Homo sapiens
catttgtttctttctctgagg

SEQ ID NO: 2448844 - DNA, 22 bp, Homo sapiens
catttgtttctttctctgagga

SEQ ID NO: 2448845 - DNA, 19 bp, Homo sapiens
catttgttttgtttacaga

SEQ ID NO: 2448846 - DNA, 17 bp, Homo sapiens
cattttaaagttagtat

SEQ ID NO: 2448847 - DNA, 16 bp, Homo sapiens
cattttaattctctcc

SEQ ID NO: 2448848 - DNA, 23 bp, Homo sapiens
cattttctaagaaacatttatat

SEQ ID NO: 2448849 - DNA, 23 bp, Homo sapiens
cattttctggccagtgtttaaaa

SEQ ID NO: 2448850 - DNA, 12 bp, Homo sapiens
cattttgaaagt

SEQ ID NO: 2448851 - DNA, 19 bp, Homo sapiens
cattttgaaagtctgtcct

SEQ ID NO: 2448852 - DNA, 23 bp, Homo sapiens
cattttgaatcacatgaattatt

SEQ ID NO: 2448853 - DNA, 16 bp, Homo sapiens
cattttggtactttgg

SEQ ID NO: 2448854 - DNA, 13 bp, Homo sapiens
cattttgtaataa

SEQ ID NO: 2448855 - DNA, 16 bp, Homo sapiens
cattttgtaataataa

SEQ ID NO: 2448856 - DNA, 20 bp, Homo sapiens
catttttgtactaactagca

SEQ ID NO: 2448857 - DNA, 18 bp, Homo sapiens
catttttttttcaatcaa

SEQ ID NO: 2448858 - DNA, 16 bp, Homo sapiens
ccaaaaccgccagctc

SEQ ID NO: 2448859 - DNA, 19 bp, Homo sapiens
ccaaaaccgccagctctgt

SEQ ID NO: 2448860 - DNA, 23 bp, Homo sapiens
ccaaaaggtttaagaaatagaat

SEQ ID NO: 2448861 - DNA, 17 bp, Homo sapiens
ccaaaatgttgaaatat

SEQ ID NO: 2448862 - DNA, 18 bp, Homo sapiens
ccaaactcttccctctct

SEQ ID NO: 2448863 - DNA, 14 bp, Homo sapiens
ccaaagaacagcct

SEQ ID NO: 2448864 - DNA, 13 bp, Homo sapiens
ccaaagaggctgc

SEQ ID NO: 2448865 - DNA, 16 bp, Homo sapiens
ccaaagaggctgcccc

SEQ ID NO: 2448866 - DNA, 9 bp, Homo sapiens
ccaaagagt

SEQ ID NO: 2448867 - DNA, 17 bp, Homo sapiens
ccaaagcaagcaagagg

SEQ ID NO: 2448868 - DNA, 13 bp, Homo sapiens
ccaaagcagacag

SEQ ID NO: 2448869 - DNA, 20 bp, Homo sapiens
ccaaagctttcctgccccag

SEQ ID NO: 2448870 - DNA, 21 bp, Homo sapiens
ccaaaggacgcactgagcaac

SEQ ID NO: 2448871 - DNA, 19 bp, Homo sapiens
ccaaaggggacctggaagg

SEQ ID NO: 2448872 - DNA, 13 bp, Homo sapiens
ccaaagtcataat

SEQ ID NO: 2448873 - DNA, 14 bp, Homo sapiens
ccaaagtctctaat

SEQ ID NO: 2448874 - DNA, 15 bp, Homo sapiens
ccaaagtgctgagat

SEQ ID NO: 2448875 - DNA, 23 bp, Homo sapiens
ccaaagttctaataatttctaat

SEQ ID NO: 2448876 - DNA, 19 bp, Homo sapiens
ccaaagttgttgtaacctg

SEQ ID NO: 2448877 - DNA, 19 bp, Homo sapiens
ccaaatcaaaatctctcca

SEQ ID NO: 2448878 - DNA, 20 bp, Homo sapiens
ccaaatcaaaatctctccac

SEQ ID NO: 2448879 - DNA, 15 bp, Homo sapiens
ccaaattaaaaaaga

SEQ ID NO: 2448880 - DNA, 18 bp, Homo sapiens
ccaaattcagtttcataa

SEQ ID NO: 2448881 - DNA, 14 bp, Homo sapiens
ccacatccctgggc

SEQ ID NO: 2448882 - DNA, 20 bp, Homo sapiens
ccacatccctgggcctgctg

SEQ ID NO: 2448883 - DNA, 22 bp, Homo sapiens
ccacatccctgggcctgctgct

SEQ ID NO: 2448884 - DNA, 20 bp, Homo sapiens
ccacatgccatttgtactga

SEQ ID NO: 2448885 - DNA, 22 bp, Homo sapiens
ccacatgccatttgtactgacc

SEQ ID NO: 2448886 - DNA, 12 bp, Homo sapiens
ccacatgcccca

SEQ ID NO: 2448887 - DNA, 17 bp, Homo sapiens
ccacatggcacagagat

SEQ ID NO: 2448888 - DNA, 13 bp, Homo sapiens
ccacattaaagaa

SEQ ID NO: 2448889 - DNA, 14 bp, Homo sapiens
ccacattaaagaag

SEQ ID NO: 2448890 - DNA, 22 bp, Homo sapiens
ccacatttggaatactttttgt

SEQ ID NO: 2448891 - DNA, 14 bp, Homo sapiens
ccaccaaccctcag

SEQ ID NO: 2448892 - DNA, 17 bp, Homo sapiens
ccaccaaccctcagggc

SEQ ID NO: 2448893 - DNA, 14 bp, Homo sapiens
ccaccacagccagc

SEQ ID NO: 2448894 - DNA, 21 bp, Homo sapiens
ccaccacagccagcacctggc

SEQ ID NO: 2448895 - DNA, 13 bp, Homo sapiens
ccaccaggccacc

SEQ ID NO: 2448896 - DNA, 16 bp, Homo sapiens
ccaccatggccagcca

SEQ ID NO: 2448897 - DNA, 21 bp, Homo sapiens
ccaccatttggcatccctggg

SEQ ID NO: 2448898 - DNA, 22 bp, Homo sapiens
ccaccatttggcatccctgggc

SEQ ID NO: 2448899 - DNA, 17 bp, Homo sapiens
ccacccacttctgcact

SEQ ID NO: 2448900 - DNA, 14 bp, Homo sapiens
ccacccaggccagg

SEQ ID NO: 2448901 - DNA, 14 bp, Homo sapiens
ccacccatccctgt

SEQ ID NO: 2448902 - DNA, 14 bp, Homo sapiens
ccaccccagggcag

SEQ ID NO: 2448903 - DNA, 20 bp, Homo sapiens
ccaccccagggcagccaggg

SEQ ID NO: 2448904 - DNA, 16 bp, Homo sapiens
ccaccccgcctgccct

SEQ ID NO: 2448905 - DNA, 12 bp, Homo sapiens
ccaccctcactg

SEQ ID NO: 2448906 - DNA, 19 bp, Homo sapiens
ccaccctcactggctctcc

SEQ ID NO: 2448907 - DNA, 21 bp, Homo sapiens
ccaccctgagccggccccagg

SEQ ID NO: 2448908 - DNA, 19 bp, Homo sapiens
ccaccctgttcctgctgct

SEQ ID NO: 2448909 - DNA, 13 bp, Homo sapiens
ccaccgcccagag

SEQ ID NO: 2448910 - DNA, 20 bp, Homo sapiens
ccaccgggccactccttcct

SEQ ID NO: 2448911 - DNA, 15 bp, Homo sapiens
ccaccgttgtctcat

SEQ ID NO: 2448912 - DNA, 21 bp, Homo sapiens
ccacctagactgtaaacctct

SEQ ID NO: 2448913 - DNA, 16 bp, Homo sapiens
ccacctccccttgggc

SEQ ID NO: 2448914 - DNA, 14 bp, Homo sapiens
ccacctcctgacac

SEQ ID NO: 2448915 - DNA, 14 bp, Homo sapiens
ccacctctaacagc

SEQ ID NO: 2448916 - DNA, 23 bp, Homo sapiens
ccacctgacacaccaggcgctaa

SEQ ID NO: 2448917 - DNA, 12 bp, Homo sapiens
ccacctggaccc

SEQ ID NO: 2448918 - DNA, 17 bp, Homo sapiens
ccacctggacccctgca

SEQ ID NO: 2448919 - DNA, 18 bp, Homo sapiens
ccacctggctctcacctc

SEQ ID NO: 2448920 - DNA, 21 bp, Homo sapiens
ccacctggtactccctctcag

SEQ ID NO: 2448921 - DNA, 23 bp, Homo sapiens
ccacctggtactccctctcagga

SEQ ID NO: 2448922 - DNA, 11 bp, Homo sapiens
ccacctgtctc

SEQ ID NO: 2448923 - DNA, 12 bp, Homo sapiens
ccacctgtctca

SEQ ID NO: 2448924 - DNA, 15 bp, Homo sapiens
ccacctgtctcagcc

SEQ ID NO: 2448925 - DNA, 20 bp, Homo sapiens
ccacctgtctcagcctccca

SEQ ID NO: 2448926 - DNA, 16 bp, Homo sapiens
ccacctttgtttctcc

SEQ ID NO: 2448927 - DNA, 20 bp, Homo sapiens
ccacctttgtttctccccca

SEQ ID NO: 2448928 - DNA, 18 bp, Homo sapiens
ccacgctagggctggctc

SEQ ID NO: 2448929 - DNA, 15 bp, Homo sapiens
ccacgctcaccccct

SEQ ID NO: 2448930 - DNA, 12 bp, Homo sapiens
ccacgctccagc

SEQ ID NO: 2448931 - DNA, 13 bp, Homo sapiens
ccacgctccagct

SEQ ID NO: 2448932 - DNA, 16 bp, Homo sapiens
ccacgctccagctgcc

SEQ ID NO: 2448933 - DNA, 22 bp, Homo sapiens
ccacggaccaaagggagtctgc

SEQ ID NO: 2448934 - DNA, 21 bp, Homo sapiens
ccacggagccactcctctgac

SEQ ID NO: 2448935 - DNA, 19 bp, Homo sapiens
ccacggcacctgggccctg

SEQ ID NO: 2448936 - DNA, 21 bp, Homo sapiens
ccacgttggagaagcccgtgt

SEQ ID NO: 2448937 - DNA, 22 bp, Homo sapiens
ccactcactaggcccccacttg

SEQ ID NO: 2448938 - DNA, 16 bp, Homo sapiens
ccactccatctggtag

SEQ ID NO: 2448939 - DNA, 18 bp, Homo sapiens
ccactccctcctaaccta

SEQ ID NO: 2448940 - DNA, 19 bp, Homo sapiens
ccactccgagaggtgggcc

SEQ ID NO: 2448941 - DNA, 23 bp, Homo sapiens
ccactccgagaggtgggccagtc

SEQ ID NO: 2448942 - DNA, 12 bp, Homo sapiens
ccactcctctga

SEQ ID NO: 2448943 - DNA, 13 bp, Homo sapiens
ccactctgcttct

SEQ ID NO: 2448944 - DNA, 12 bp, Homo sapiens
ccactctggcag

SEQ ID NO: 2448945 - DNA, 14 bp, Homo sapiens
ccactctggcagcc

SEQ ID NO: 2448946 - DNA, 15 bp, Homo sapiens
ccactctggcagcca

SEQ ID NO: 2448947 - DNA, 19 bp, Homo sapiens
ccactctggcagccacact

SEQ ID NO: 2448948 - DNA, 17 bp, Homo sapiens
ccactgccccctgctgc

SEQ ID NO: 2448949 - DNA, 15 bp, Homo sapiens
ccactgccttcgctt

SEQ ID NO: 2448950 - DNA, 18 bp, Homo sapiens
ccactgccttcgcttctt

SEQ ID NO: 2448951 - DNA, 11 bp, Homo sapiens
ccactggagca

SEQ ID NO: 2448952 - DNA, 15 bp, Homo sapiens
ccactgtcctgggcc

SEQ ID NO: 2448953 - DNA, 14 bp, Homo sapiens
ccactgtgcctcag

SEQ ID NO: 2448954 - DNA, 20 bp, Homo sapiens
ccactgtgcctcagagacca

SEQ ID NO: 2448955 - DNA, 14 bp, Homo sapiens
ccactgttatcaaa

SEQ ID NO: 2448956 - DNA, 16 bp, Homo sapiens
ccacttaaaaattaaa

SEQ ID NO: 2448957 - DNA, 20 bp, Homo sapiens
ccacttaatgtatgttacca

SEQ ID NO: 2448958 - DNA, 15 bp, Homo sapiens
ccacttatagcctct

SEQ ID NO: 2448959 - DNA, 12 bp, Homo sapiens
ccacttctgcac

SEQ ID NO: 2448960 - DNA, 19 bp, Homo sapiens
ccacttcttgttccccact

SEQ ID NO: 2448961 - DNA, 13 bp, Homo sapiens
ccacttgcctctt

SEQ ID NO: 2448962 - DNA, 22 bp, Homo sapiens
ccacttgcctcttccttgaaga

SEQ ID NO: 2448963 - DNA, 13 bp, Homo sapiens
ccagaaaacaaaa

SEQ ID NO: 2448964 - DNA, 16 bp, Homo sapiens
ccagaaaacaaaactg

SEQ ID NO: 2448965 - DNA, 16 bp, Homo sapiens
ccagaagatgactgag

SEQ ID NO: 2448966 - DNA, 16 bp, Homo sapiens
ccagaagctcccccag

SEQ ID NO: 2448967 - DNA, 18 bp, Homo sapiens
ccagaagctcccccagca

SEQ ID NO: 2448968 - DNA, 18 bp, Homo sapiens
ccagaagtgtgactggct

SEQ ID NO: 2448969 - DNA, 19 bp, Homo sapiens
ccagaataagttattgcag

SEQ ID NO: 2448970 - DNA, 16 bp, Homo sapiens
ccagaatgctgtacat

SEQ ID NO: 2448971 - DNA, 16 bp, Homo sapiens
ccagacacccaggact

SEQ ID NO: 2448972 - DNA, 18 bp, Homo sapiens
ccagacataaaggaaaag

SEQ ID NO: 2448973 - DNA, 20 bp, Homo sapiens
ccagacatgccacaaggact

SEQ ID NO: 2448974 - DNA, 18 bp, Homo sapiens
ccagacctgatcctggag

SEQ ID NO: 2448975 - DNA, 20 bp, Homo sapiens
ccagacctgatcctggaggc

SEQ ID NO: 2448976 - DNA, 23 bp, Homo sapiens
ccagacctgttagcagacaggcc

SEQ ID NO: 2448977 - DNA, 17 bp, Homo sapiens
ccagacgcctggctgct

SEQ ID NO: 2448978 - DNA, 22 bp, Homo sapiens
ccagactagatggacctgcctg

SEQ ID NO: 2448979 - DNA, 18 bp, Homo sapiens
ccagactagatgtagtat

SEQ ID NO: 2448980 - DNA, 22 bp, Homo sapiens
ccagacttgttggcgtaggcta

SEQ ID NO: 2448981 - DNA, 16 bp, Homo sapiens
ccagagaaaggggagc

SEQ ID NO: 2448982 - DNA, 23 bp, Homo sapiens
ccagagaaaggggagcccactgt

SEQ ID NO: 2448983 - DNA, 19 bp, Homo sapiens
ccagagacacagcccccac

SEQ ID NO: 2448984 - DNA, 12 bp, Homo sapiens
ccagagagcccg

SEQ ID NO: 2448985 - DNA, 20 bp, Homo sapiens
cctctgtctcgagcgccctg

SEQ ID NO: 2448986 - DNA, 21 bp, Homo sapiens
cctctgtctcgagcgccctgc

SEQ ID NO: 2448987 - DNA, 22 bp, Homo sapiens
cctctgtctcgagcgccctgca

SEQ ID NO: 2448988 - DNA, 15 bp, Homo sapiens
cctctgtcttctgga

SEQ ID NO: 2448989 - DNA, 18 bp, Homo sapiens
cctctgtgaccaatgtct

SEQ ID NO: 2448990 - DNA, 18 bp, Homo sapiens
cctctgtgtatttgcttt

SEQ ID NO: 2448991 - DNA, 16 bp, Homo sapiens
cctctgttcaaagctg

SEQ ID NO: 2448992 - DNA, 16 bp, Homo sapiens
cctcttcagaggccct

SEQ ID NO: 2448993 - DNA, 16 bp, Homo sapiens
cctcttccatgctgtg

SEQ ID NO: 2448994 - DNA, 12 bp, Homo sapiens
cctcttccccag

SEQ ID NO: 2448995 - DNA, 13 bp, Homo sapiens
cctcttccccaga

SEQ ID NO: 2448996 - DNA, 19 bp, Homo sapiens
cctcttcctactggtctct

SEQ ID NO: 2448997 - DNA, 15 bp, Homo sapiens
cctcttctactcact

SEQ ID NO: 2448998 - DNA, 16 bp, Homo sapiens
cctcttctgggcctga

SEQ ID NO: 2448999 - DNA, 14 bp, Homo sapiens
cctcttgaccaggc

SEQ ID NO: 2449000 - DNA, 14 bp, Homo sapiens
cctcttgagcagtg

SEQ ID NO: 2449001 - DNA, 24 bp, Homo sapiens
cctcttgagcagtggctggtccag

SEQ ID NO: 2449002 - DNA, 12 bp, Homo sapiens
cctctttcagct

SEQ ID NO: 2449003 - DNA, 14 bp, Homo sapiens
cctctttcagctcc

SEQ ID NO: 2449004 - DNA, 14 bp, Homo sapiens
cctctttggctccc

SEQ ID NO: 2449005 - DNA, 18 bp, Homo sapiens
cctctttggctcccctgt

SEQ ID NO: 2449006 - DNA, 17 bp, Homo sapiens
cctcttttccttcccaa

SEQ ID NO: 2449007 - DNA, 19 bp, Homo sapiens
cctcttttttcgtttgttt

SEQ ID NO: 2449008 - DNA, 17 bp, Homo sapiens
cctgaaaacactgtgca

SEQ ID NO: 2449009 - DNA, 18 bp, Homo sapiens
cctgaaaacactgtgcac

SEQ ID NO: 2449010 - DNA, 22 bp, Homo sapiens
cctgaaaaggtttatgaaaaag

SEQ ID NO: 2449011 - DNA, 18 bp, Homo sapiens
cctgaaccccagggctgt

SEQ ID NO: 2449012 - DNA, 16 bp, Homo sapiens
cctgaaggcctgaggt

SEQ ID NO: 2449013 - DNA, 15 bp, Homo sapiens
cctgacacaccaggc

SEQ ID NO: 2449014 - DNA, 18 bp, Homo sapiens
cctgacacaccaggcgct

SEQ ID NO: 2449015 - DNA, 14 bp, Homo sapiens
cctgacactgctgg

SEQ ID NO: 2449016 - DNA, 23 bp, Homo sapiens
cctgaccaaacagccaactagcc

SEQ ID NO: 2449017 - DNA, 18 bp, Homo sapiens
cctgaccactcagagaca

SEQ ID NO: 2449018 - DNA, 14 bp, Homo sapiens
cctgaccagctgct

SEQ ID NO: 2449019 - DNA, 20 bp, Homo sapiens
cctgaccagctgctccgagg

SEQ ID NO: 2449020 - DNA, 12 bp, Homo sapiens
cctgaccagttg

SEQ ID NO: 2449021 - DNA, 20 bp, Homo sapiens
cctgaccagttgcagtcact

SEQ ID NO: 2449022 - DNA, 15 bp, Homo sapiens
cctgacctggccccc

SEQ ID NO: 2449023 - DNA, 18 bp, Homo sapiens
cctgacctgtgagcccag

SEQ ID NO: 2449024 - DNA, 19 bp, Homo sapiens
cctgacctgtgagcccagc

SEQ ID NO: 2449025 - DNA, 17 bp, Homo sapiens
cctgagaaagctcaaag

SEQ ID NO: 2449026 - DNA, 22 bp, Homo sapiens
cctgagatttattaaagaaaaa

SEQ ID NO: 2449027 - DNA, 18 bp, Homo sapiens
cctgagcaactcttgatt

SEQ ID NO: 2449028 - DNA, 23 bp, Homo sapiens
cctgagcaactcttgattatcca

SEQ ID NO: 2449029 - DNA, 14 bp, Homo sapiens
cctgagcactgcca

SEQ ID NO: 2449030 - DNA, 20 bp, Homo sapiens
cctgagcactgccaggaggg

SEQ ID NO: 2449031 - DNA, 18 bp, Homo sapiens
cctgagcagtccttggcc

SEQ ID NO: 2449032 - DNA, 18 bp, Homo sapiens
cctgagccagggtctcca

SEQ ID NO: 2449033 - DNA, 20 bp, Homo sapiens
cctgagccagggtctccaga

SEQ ID NO: 2449034 - DNA, 16 bp, Homo sapiens
cctgagccccagggag

SEQ ID NO: 2449035 - DNA, 16 bp, Homo sapiens
cctgagccggccccag

SEQ ID NO: 2449036 - DNA, 16 bp, Homo sapiens
cctgagcctgccgagc

SEQ ID NO: 2449037 - DNA, 19 bp, Homo sapiens
cctgagcgagtggagtctg

SEQ ID NO: 2449038 - DNA, 22 bp, Homo sapiens
cctgagcgagtggagtctgcca

SEQ ID NO: 2449039 - DNA, 14 bp, Homo sapiens
cctgagctctgata

SEQ ID NO: 2449040 - DNA, 16 bp, Homo sapiens
cctgagctgaggcagc

SEQ ID NO: 2449041 - DNA, 19 bp, Homo sapiens
cctgaggactgatttcaga

SEQ ID NO: 2449042 - DNA, 16 bp, Homo sapiens
cctgaggagtctgagg

SEQ ID NO: 2449043 - DNA, 20 bp, Homo sapiens
cctgagggaaaggccagcac

SEQ ID NO: 2449044 - DNA, 12 bp, Homo sapiens
cctgagggtctg

SEQ ID NO: 2449045 - DNA, 18 bp, Homo sapiens
cctgagggtctgtaggtt

SEQ ID NO: 2449046 - DNA, 23 bp, Homo sapiens
cctgagtactccacactgcacaa

SEQ ID NO: 2449047 - DNA, 18 bp, Homo sapiens
cctgagtcgtgacctgct

SEQ ID NO: 2449048 - DNA, 14 bp, Homo sapiens
cctgagtgcttgct

SEQ ID NO: 2449049 - DNA, 15 bp, Homo sapiens
cctgagtgcttgctt

SEQ ID NO: 2449050 - DNA, 17 bp, Homo sapiens
cctgagtgcttgctttt

SEQ ID NO: 2449051 - DNA, 14 bp, Homo sapiens
cctgatcccagaga

SEQ ID NO: 2449052 - DNA, 17 bp, Homo sapiens
cctgatcccagagagcc

SEQ ID NO: 2449053 - DNA, 23 bp, Homo sapiens
cctgatgctgacattcacctgcc

SEQ ID NO: 2449054 - DNA, 21 bp, Homo sapiens
cctgatttaggagaagccagg

SEQ ID NO: 2449055 - DNA, 19 bp, Homo sapiens
cctgcaaaaggactctcag

SEQ ID NO: 2449056 - DNA, 13 bp, Homo sapiens
cctgcaaactggg

SEQ ID NO: 2449057 - DNA, 18 bp, Homo sapiens
cctgcacagtgacttctg

SEQ ID NO: 2449058 - DNA, 14 bp, Homo sapiens
cctgcactggggag

SEQ ID NO: 2449059 - DNA, 13 bp, Homo sapiens
cctgcactgtaaa

SEQ ID NO: 2449060 - DNA, 14 bp, Homo sapiens
cctgcactgtaaaa

SEQ ID NO: 2449061 - DNA, 15 bp, Homo sapiens
cctgcactgtaaaat

SEQ ID NO: 2449062 - DNA, 14 bp, Homo sapiens
cctgcacttacttg

SEQ ID NO: 2449063 - DNA, 22 bp, Homo sapiens
cctgcaggaaggagctgcctgg

SEQ ID NO: 2449064 - DNA, 22 bp, Homo sapiens
cctgcaggatctcaccaggcag

SEQ ID NO: 2449065 - DNA, 23 bp, Homo sapiens
cctgcaggatctcaccaggcagc

SEQ ID NO: 2449066 - DNA, 12 bp, Homo sapiens
cctgcagggcct

SEQ ID NO: 2449067 - DNA, 14 bp, Homo sapiens
cctgcagggcctct

SEQ ID NO: 2449068 - DNA, 22 bp, Homo sapiens
cctgcataatgtttctggattt

SEQ ID NO: 2449069 - DNA, 19 bp, Homo sapiens
cctgcatggcatcctccag

SEQ ID NO: 2449070 - DNA, 20 bp, Homo sapiens
cctgcatggcatcctccagc

SEQ ID NO: 2449071 - DNA, 21 bp, Homo sapiens
cctgcatggcatcctccagcc

SEQ ID NO: 2449072 - DNA, 22 bp, Homo sapiens
cctgcatggcatcctccagccc

SEQ ID NO: 2449073 - DNA, 23 bp, Homo sapiens
cctgcatggcatcctccagcccc

SEQ ID NO: 2449074 - DNA, 16 bp, Homo sapiens
cctgcattggaactgg

SEQ ID NO: 2449075 - DNA, 20 bp, Homo sapiens
cctgcattggaactggaggc

SEQ ID NO: 2449076 - DNA, 22 bp, Homo sapiens
cctgcattggaactggaggcag

SEQ ID NO: 2449077 - DNA, 18 bp, Homo sapiens
cctgccaccaggccacct

SEQ ID NO: 2449078 - DNA, 13 bp, Homo sapiens
cctgccacctccc

SEQ ID NO: 2449079 - DNA, 15 bp, Homo sapiens
cctgccacctggacc

SEQ ID NO: 2449080 - DNA, 22 bp, Homo sapiens
cctgccacctggacccctgcat

SEQ ID NO: 2449081 - DNA, 22 bp, Homo sapiens
cctgccactcactaggccccca

SEQ ID NO: 2449082 - DNA, 14 bp, Homo sapiens
cctgccactgtgtg

SEQ ID NO: 2449083 - DNA, 14 bp, Homo sapiens
cctgccagcccctg

SEQ ID NO: 2449084 - DNA, 16 bp, Homo sapiens
cctgccagcccctgcc

SEQ ID NO: 2449085 - DNA, 14 bp, Homo sapiens
cctgccagctgcac

SEQ ID NO: 2449086 - DNA, 16 bp, Homo sapiens
cctgccagctgcactg

SEQ ID NO: 2449087 - DNA, 13 bp, Homo sapiens
cctgccagggcag

SEQ ID NO: 2449088 - DNA, 17 bp, Homo sapiens
cctgccatgtttagtga

SEQ ID NO: 2449089 - DNA, 16 bp, Homo sapiens
cctttttcctctccac

SEQ ID NO: 2449090 - DNA, 22 bp, Homo sapiens
ccttttttaggaagcaagctta

SEQ ID NO: 2449091 - DNA, 15 bp, Homo sapiens
ccttttttccccaga

SEQ ID NO: 2449092 - DNA, 18 bp, Homo sapiens
ccttttttccccagactt

SEQ ID NO: 2449093 - DNA, 17 bp, Homo sapiens
cgaaacacagaaacctt

SEQ ID NO: 2449094 - DNA, 13 bp, Homo sapiens
cgaaagctctaga

SEQ ID NO: 2449095 - DNA, 14 bp, Homo sapiens
cgaaagctctagaa

SEQ ID NO: 2449096 - DNA, 20 bp, Homo sapiens
cgaaataattgttgttctgt

SEQ ID NO: 2449097 - DNA, 12 bp, Homo sapiens
cgaatctctgtg

SEQ ID NO: 2449098 - DNA, 13 bp, Homo sapiens
cgaatgtgtcttt

SEQ ID NO: 2449099 - DNA, 18 bp, Homo sapiens
cgaatgtgtctttagata

SEQ ID NO: 2449100 - DNA, 21 bp, Homo sapiens
cgacactgcagccccacccag

SEQ ID NO: 2449101 - DNA, 23 bp, Homo sapiens
cgaccccctctccctgcatggca

SEQ ID NO: 2449102 - DNA, 13 bp, Homo sapiens
cgaccgccccctc

SEQ ID NO: 2449103 - DNA, 14 bp, Homo sapiens
cgactggccagggc

SEQ ID NO: 2449104 - DNA, 19 bp, Homo sapiens
cgagaaagaggcaccagga

SEQ ID NO: 2449105 - DNA, 17 bp, Homo sapiens
cgagagatcaaagatga

SEQ ID NO: 2449106 - DNA, 14 bp, Homo sapiens
cgagagatgtgtgt

SEQ ID NO: 2449107 - DNA, 14 bp, Homo sapiens
cgagaggtgggcca

SEQ ID NO: 2449108 - DNA, 15 bp, Homo sapiens
cgagaggtgggccag

SEQ ID NO: 2449109 - DNA, 19 bp, Homo sapiens
cgagaggtgggccagtctg

SEQ ID NO: 2449110 - DNA, 22 bp, Homo sapiens
cgagaggtgggccagtctgtgg

SEQ ID NO: 2449111 - DNA, 21 bp, Homo sapiens
cgagattatcgttttcttaaa

SEQ ID NO: 2449112 - DNA, 23 bp, Homo sapiens
cgagattatcgttttcttaaagt

SEQ ID NO: 2449113 - DNA, 15 bp, Homo sapiens
cgagcagtcctgcct

SEQ ID NO: 2449114 - DNA, 17 bp, Homo sapiens
cgagcagtcctgcctca

SEQ ID NO: 2449115 - DNA, 15 bp, Homo sapiens
cgagcgcccagctcc

SEQ ID NO: 2449116 - DNA, 19 bp, Homo sapiens
cgagcgcccagctcctgac

SEQ ID NO: 2449117 - DNA, 13 bp, Homo sapiens
cgagcgccctgca

SEQ ID NO: 2449118 - DNA, 14 bp, Homo sapiens
cgagcgccctgcag

SEQ ID NO: 2449119 - DNA, 22 bp, Homo sapiens
cgaggaatctgtgggtctggga

SEQ ID NO: 2449120 - DNA, 20 bp, Homo sapiens
cgaggaggtgtctcaggctg

SEQ ID NO: 2449121 - DNA, 13 bp, Homo sapiens
cgaggagtaacaa

SEQ ID NO: 2449122 - DNA, 21 bp, Homo sapiens
cgaggagtaacaatacaaatg

SEQ ID NO: 2449123 - DNA, 22 bp, Homo sapiens
cgaggagtaacaatacaaatgg

SEQ ID NO: 2449124 - DNA, 21 bp, Homo sapiens
cgagggcagggaccacaccct

SEQ ID NO: 2449125 - DNA, 11 bp, Homo sapiens
cgagggctggc

SEQ ID NO: 2449126 - DNA, 14 bp, Homo sapiens
cgagggctggctgg

SEQ ID NO: 2449127 - DNA, 17 bp, Homo sapiens
cgagggctggctggcct

SEQ ID NO: 2449128 - DNA, 23 bp, Homo sapiens
cgagggctggctggcctcaccca

SEQ ID NO: 2449129 - DNA, 18 bp, Homo sapiens
cgagtcattcgttctgtg

SEQ ID NO: 2449130 - DNA, 22 bp, Homo sapiens
cgagtgccttcaacacagcttg

SEQ ID NO: 2449131 - DNA, 20 bp, Homo sapiens
cgatactgcgactttctgcc

SEQ ID NO: 2449132 - DNA, 20 bp, Homo sapiens
cgatccacctgtctcagcct

SEQ ID NO: 2449133 - DNA, 20 bp, Homo sapiens
cgatgacacttgtacaatta

SEQ ID NO: 2449134 - DNA, 15 bp, Homo sapiens
cgatgcaatgaacac

SEQ ID NO: 2449135 - DNA, 21 bp, Homo sapiens
cgatgtggaactgctgccact

SEQ ID NO: 2449136 - DNA, 19 bp, Homo sapiens
cgattccctctcccaggcc

SEQ ID NO: 2449137 - DNA, 21 bp, Homo sapiens
cgattccctctcccaggcccc

SEQ ID NO: 2449138 - DNA, 14 bp, Homo sapiens
cgcaagttcccagt

SEQ ID NO: 2449139 - DNA, 14 bp, Homo sapiens
cgcaccattctgac

SEQ ID NO: 2449140 - DNA, 15 bp, Homo sapiens
cgcaccattctgact

SEQ ID NO: 2449141 - DNA, 12 bp, Homo sapiens
cgcagccaccct

SEQ ID NO: 2449142 - DNA, 22 bp, Homo sapiens
cgcagtccacttctgacagcct

SEQ ID NO: 2449143 - DNA, 16 bp, Homo sapiens
cgcagtgtggaggcca

SEQ ID NO: 2449144 - DNA, 21 bp, Homo sapiens
cgcagttttttttttcttgtc

SEQ ID NO: 2449145 - DNA, 13 bp, Homo sapiens
cgccactggggct

SEQ ID NO: 2449146 - DNA, 17 bp, Homo sapiens
cgccactggggctcaga

SEQ ID NO: 2449147 - DNA, 20 bp, Homo sapiens
cgccaggctgaccacagcac

SEQ ID NO: 2449148 - DNA, 20 bp, Homo sapiens
cgcccacaggaagcctgcag

SEQ ID NO: 2449149 - DNA, 21 bp, Homo sapiens
cgcccacaggaagcctgcagt

SEQ ID NO: 2449150 - DNA, 15 bp, Homo sapiens
cgcccagctcctgac

SEQ ID NO: 2449151 - DNA, 20 bp, Homo sapiens
cgcccaggctggagtgcagt

SEQ ID NO: 2449152 - DNA, 21 bp, Homo sapiens
cgccccaacccgtggaggctg

SEQ ID NO: 2449153 - DNA, 22 bp, Homo sapiens
cgccccaacccgtggaggctgc

SEQ ID NO: 2449154 - DNA, 20 bp, Homo sapiens
cgccccctccgccctgccac

SEQ ID NO: 2449155 - DNA, 20 bp, Homo sapiens
cgccctgcagaccctgccct

SEQ ID NO: 2449156 - DNA, 11 bp, Homo sapiens
cgccctgccac

SEQ ID NO: 2449157 - DNA, 15 bp, Homo sapiens
cgccgtctccagggg

SEQ ID NO: 2449158 - DNA, 17 bp, Homo sapiens
cgcctcttgaccaggct

SEQ ID NO: 2449159 - DNA, 17 bp, Homo sapiens
cgcctgagcccagggag

SEQ ID NO: 2449160 - DNA, 20 bp, Homo sapiens
cgcctgagcccagggaggcc

SEQ ID NO: 2449161 - DNA, 20 bp, Homo sapiens
cgcctgaggaacccttacag

SEQ ID NO: 2449162 - DNA, 22 bp, Homo sapiens
cgcctgccctcatggcccctct

SEQ ID NO: 2449163 - DNA, 21 bp, Homo sapiens
cgcctggcagtccgtgggacg

SEQ ID NO: 2449164 - DNA, 22 bp, Homo sapiens
cgcgactaatttcaaaatgctt

SEQ ID NO: 2449165 - DNA, 20 bp, Homo sapiens
cgcggaggaggagggaggcc

SEQ ID NO: 2449166 - DNA, 17 bp, Homo sapiens
cgcgtctaccctgggat

SEQ ID NO: 2449167 - DNA, 12 bp, Homo sapiens
cgcgtcttcctg

SEQ ID NO: 2449168 - DNA, 23 bp, Homo sapiens
cgctaattcaaggaatttcttaa

SEQ ID NO: 2449169 - DNA, 23 bp, Homo sapiens
cgctacaccactctggcagccac

SEQ ID NO: 2449170 - DNA, 20 bp, Homo sapiens
cgctactatgatttaatttg

SEQ ID NO: 2449171 - DNA, 15 bp, Homo sapiens
cgctagcagtggcag

SEQ ID NO: 2449172 - DNA, 20 bp, Homo sapiens
cgctagcagtggcaggcaga

SEQ ID NO: 2449173 - DNA, 16 bp, Homo sapiens
cgctccagctgccccg

SEQ ID NO: 2449174 - DNA, 16 bp, Homo sapiens
cgctccccactctgct

SEQ ID NO: 2449175 - DNA, 14 bp, Homo sapiens
cgctcctgcagccc

SEQ ID NO: 2449176 - DNA, 16 bp, Homo sapiens
cgctcctggcccagcc

SEQ ID NO: 2449177 - DNA, 13 bp, Homo sapiens
cgctctttgagaa

SEQ ID NO: 2449178 - DNA, 16 bp, Homo sapiens
cgctgagtggcagggg

SEQ ID NO: 2449179 - DNA, 19 bp, Homo sapiens
cgctgccagctctgtatca

SEQ ID NO: 2449180 - DNA, 18 bp, Homo sapiens
cgctgcttcgtgggatac

SEQ ID NO: 2449181 - DNA, 20 bp, Homo sapiens
cgctggactctcagtctctg

SEQ ID NO: 2449182 - DNA, 19 bp, Homo sapiens
cgctgggtggtaccctctg

SEQ ID NO: 2449183 - DNA, 22 bp, Homo sapiens
cgctgggtggtaccctctggag

SEQ ID NO: 2449184 - DNA, 16 bp, Homo sapiens
cgctgtcctttctaga

SEQ ID NO: 2449185 - DNA, 21 bp, Homo sapiens
cgctgtgccaggcgaggccct

SEQ ID NO: 2449186 - DNA, 14 bp, Homo sapiens
cgcttggagcagag

SEQ ID NO: 2449187 - DNA, 16 bp, Homo sapiens
cgctttgattcatagt

SEQ ID NO: 2449188 - DNA, 12 bp, Homo sapiens
cggaaagaagag

SEQ ID NO: 2449189 - DNA, 15 bp, Homo sapiens
cggaagggtaaacaa

SEQ ID NO: 2449190 - DNA, 18 bp, Homo sapiens
cggaagggtaaacaatat

SEQ ID NO: 2449191 - DNA, 16 bp, Homo sapiens
cggacaagacccccag

SEQ ID NO: 2449192 - DNA, 20 bp, Homo sapiens
cggacaagacccccagcact

SEQ ID NO: 2449193 - DNA, 17 bp, Homo sapiens
ctagagaagacaggctg

SEQ ID NO: 2449194 - DNA, 15 bp, Homo sapiens
ctagagcactgccac

SEQ ID NO: 2449195 - DNA, 13 bp, Homo sapiens
ctagagctcctcc

SEQ ID NO: 2449196 - DNA, 15 bp, Homo sapiens
ctagagtccaaggtt

SEQ ID NO: 2449197 - DNA, 23 bp, Homo sapiens
ctagagtccaaggtttaaagagt

SEQ ID NO: 2449198 - DNA, 24 bp, Homo sapiens
ctagagtgactcactaattcatta

SEQ ID NO: 2449199 - DNA, 14 bp, Homo sapiens
ctagatatcgactt

SEQ ID NO: 2449200 - DNA, 18 bp, Homo sapiens
ctagatcataaggcttca

SEQ ID NO: 2449201 - DNA, 16 bp, Homo sapiens
ctagatcctaagggtc

SEQ ID NO: 2449202 - DNA, 17 bp, Homo sapiens
ctagatcctaagggtcg

SEQ ID NO: 2449203 - DNA, 17 bp, Homo sapiens
ctagatgaagttttaca

SEQ ID NO: 2449204 - DNA, 16 bp, Homo sapiens
ctagatggacctgcct

SEQ ID NO: 2449205 - DNA, 16 bp, Homo sapiens
ctagatgtagtatttt

SEQ ID NO: 2449206 - DNA, 20 bp, Homo sapiens
ctagatgtagtattttttgt

SEQ ID NO: 2449207 - DNA, 22 bp, Homo sapiens
ctagatgtagtattttttgtat

SEQ ID NO: 2449208 - DNA, 22 bp, Homo sapiens
ctagatgtttattcttctagag

SEQ ID NO: 2449209 - DNA, 23 bp, Homo sapiens
ctagatgtttattcttctagagt

SEQ ID NO: 2449210 - DNA, 16 bp, Homo sapiens
ctagattcaaaggttc

SEQ ID NO: 2449211 - DNA, 18 bp, Homo sapiens
ctagattcaaaggttcta

SEQ ID NO: 2449212 - DNA, 20 bp, Homo sapiens
ctagattcaaaggttctagg

SEQ ID NO: 2449213 - DNA, 21 bp, Homo sapiens
ctagattcaaaggttctaggt

SEQ ID NO: 2449214 - DNA, 22 bp, Homo sapiens
ctagattccattggtccaagat

SEQ ID NO: 2449215 - DNA, 23 bp, Homo sapiens
ctagattccattggtccaagatt

SEQ ID NO: 2449216 - DNA, 18 bp, Homo sapiens
ctagatttaatataaagt

SEQ ID NO: 2449217 - DNA, 12 bp, Homo sapiens
ctagcagcaccg

SEQ ID NO: 2449218 - DNA, 19 bp, Homo sapiens
ctagcagcaccgttctgtg

SEQ ID NO: 2449219 - DNA, 20 bp, Homo sapiens
ctagcagcaccgttctgtgc

SEQ ID NO: 2449220 - DNA, 18 bp, Homo sapiens
ctagcagtggcaggcaga

SEQ ID NO: 2449221 - DNA, 20 bp, Homo sapiens
ctagcagtggcaggcagagg

SEQ ID NO: 2449222 - DNA, 23 bp, Homo sapiens
ctagcattgtaaaattatttcat

SEQ ID NO: 2449223 - DNA, 13 bp, Homo sapiens
ctagccaaacctc

SEQ ID NO: 2449224 - DNA, 17 bp, Homo sapiens
ctagccaaacctcacca

SEQ ID NO: 2449225 - DNA, 15 bp, Homo sapiens
ctagcccctggggtg

SEQ ID NO: 2449226 - DNA, 20 bp, Homo sapiens
ctagcctcaggggtctgagc

SEQ ID NO: 2449227 - DNA, 17 bp, Homo sapiens
ctagctgtcctttttcc

SEQ ID NO: 2449228 - DNA, 14 bp, Homo sapiens
ctagctgtgggggt

SEQ ID NO: 2449229 - DNA, 15 bp, Homo sapiens
ctaggaagaggagtg

SEQ ID NO: 2449230 - DNA, 21 bp, Homo sapiens
ctaggaccatggttaagagtc

SEQ ID NO: 2449231 - DNA, 23 bp, Homo sapiens
ctaggaccatggttaagagtcca

SEQ ID NO: 2449232 - DNA, 16 bp, Homo sapiens
ctaggagcaaagcctg

SEQ ID NO: 2449233 - DNA, 18 bp, Homo sapiens
ctaggagcaaagcctgtt

SEQ ID NO: 2449234 - DNA, 22 bp, Homo sapiens
ctaggagggagacactggcccc

SEQ ID NO: 2449235 - DNA, 23 bp, Homo sapiens
ctaggagggagacactggcccct

SEQ ID NO: 2449236 - DNA, 19 bp, Homo sapiens
ctaggcactgtagttctaa

SEQ ID NO: 2449237 - DNA, 17 bp, Homo sapiens
ctaggcattctggacct

SEQ ID NO: 2449238 - DNA, 21 bp, Homo sapiens
ctaggcattctggacctctgg

SEQ ID NO: 2449239 - DNA, 14 bp, Homo sapiens
ctaggccagagccc

SEQ ID NO: 2449240 - DNA, 13 bp, Homo sapiens
ctaggcccccact

SEQ ID NO: 2449241 - DNA, 15 bp, Homo sapiens
ctaggcccccacttg

SEQ ID NO: 2449242 - DNA, 16 bp, Homo sapiens
ctaggcccccacttgc

SEQ ID NO: 2449243 - DNA, 19 bp, Homo sapiens
ctaggcccccacttgcctc

SEQ ID NO: 2449244 - DNA, 16 bp, Homo sapiens
ctaggcctgggcagtg

SEQ ID NO: 2449245 - DNA, 22 bp, Homo sapiens
ctaggctctgtctggaagatgg

SEQ ID NO: 2449246 - DNA, 23 bp, Homo sapiens
ctaggctgcattgaaaagagctg

SEQ ID NO: 2449247 - DNA, 17 bp, Homo sapiens
ctagggccaagcccagc

SEQ ID NO: 2449248 - DNA, 18 bp, Homo sapiens
ctagggccaagcccagca

SEQ ID NO: 2449249 - DNA, 19 bp, Homo sapiens
ctaggtacgatgacagtgt

SEQ ID NO: 2449250 - DNA, 18 bp, Homo sapiens
ctaggtgctatttgtcat

SEQ ID NO: 2449251 - DNA, 13 bp, Homo sapiens
ctaggttctaaaa

SEQ ID NO: 2449252 - DNA, 22 bp, Homo sapiens
ctaggttttggagagtttgcct

SEQ ID NO: 2449253 - DNA, 22 bp, Homo sapiens
ctagtacttgggagacctgtaa

SEQ ID NO: 2449254 - DNA, 16 bp, Homo sapiens
ctagtcaatcaagtct

SEQ ID NO: 2449255 - DNA, 20 bp, Homo sapiens
ctagtcaatcaagtctgttt

SEQ ID NO: 2449256 - DNA, 17 bp, Homo sapiens
ctagtcacgcatgcagt

SEQ ID NO: 2449257 - DNA, 13 bp, Homo sapiens
ctagtcttttgct

SEQ ID NO: 2449258 - DNA, 14 bp, Homo sapiens
ctagtcttttgctt

SEQ ID NO: 2449259 - DNA, 16 bp, Homo sapiens
ctagtcttttgctttt

SEQ ID NO: 2449260 - DNA, 17 bp, Homo sapiens
ctagtgaaggcttctct

SEQ ID NO: 2449261 - DNA, 18 bp, Homo sapiens
ctagtgacttgtgtccca

SEQ ID NO: 2449262 - DNA, 18 bp, Homo sapiens
ctagtggccgaaccagaa

SEQ ID NO: 2449263 - DNA, 20 bp, Homo sapiens
ctagttatttacaggaactt

SEQ ID NO: 2449264 - DNA, 22 bp, Homo sapiens
ctagttatttacaggaacttca

SEQ ID NO: 2449265 - DNA, 23 bp, Homo sapiens
ctagttctagaaaaacaggcact

SEQ ID NO: 2449266 - DNA, 22 bp, Homo sapiens
ctagttctttgttcatagccca

SEQ ID NO: 2449267 - DNA, 11 bp, Homo sapiens
ctataaagcat

SEQ ID NO: 2449268 - DNA, 17 bp, Homo sapiens
ctataagaagccttaat

SEQ ID NO: 2449269 - DNA, 19 bp, Homo sapiens
ctatacgcagcgtgcttta

SEQ ID NO: 2449270 - DNA, 12 bp, Homo sapiens
ctatactgcttg

SEQ ID NO: 2449271 - DNA, 14 bp, Homo sapiens
ctatagatgtcttt

SEQ ID NO: 2449272 - DNA, 22 bp, Homo sapiens
ctatagatgtcttttcccattt

SEQ ID NO: 2449273 - DNA, 13 bp, Homo sapiens
ctatagccaaaaa

SEQ ID NO: 2449274 - DNA, 13 bp, Homo sapiens
ctatagttctaga

SEQ ID NO: 2449275 - DNA, 14 bp, Homo sapiens
ctatagttctagac

SEQ ID NO: 2449276 - DNA, 19 bp, Homo sapiens
ctatattacggtttgcccc

SEQ ID NO: 2449277 - DNA, 17 bp, Homo sapiens
ctatcacctatttccat

SEQ ID NO: 2449278 - DNA, 20 bp, Homo sapiens
ctatcgttctctctttgcat

SEQ ID NO: 2449279 - DNA, 18 bp, Homo sapiens
ctatctgggcttcctgga

SEQ ID NO: 2449280 - DNA, 19 bp, Homo sapiens
ctatctgggcttcctggag

SEQ ID NO: 2449281 - DNA, 11 bp, Homo sapiens
ctatctgtctg

SEQ ID NO: 2449282 - DNA, 18 bp, Homo sapiens
ctatctgtctggtggccc

SEQ ID NO: 2449283 - DNA, 17 bp, Homo sapiens
ctatgaattctaagtga

SEQ ID NO: 2449284 - DNA, 17 bp, Homo sapiens
ctatgagtctagatgtt

SEQ ID NO: 2449285 - DNA, 20 bp, Homo sapiens
ctatgatttaatttgaaata

SEQ ID NO: 2449286 - DNA, 19 bp, Homo sapiens
ctatgcatggtgccccagg

SEQ ID NO: 2449287 - DNA, 20 bp, Homo sapiens
ctatgcatggtgccccagga

SEQ ID NO: 2449288 - DNA, 20 bp, Homo sapiens
ctatgcatggtttcagcact

SEQ ID NO: 2449289 - DNA, 15 bp, Homo sapiens
ctatgcctctctaca

SEQ ID NO: 2449290 - DNA, 17 bp, Homo sapiens
ctatgctttgaaacaga

SEQ ID NO: 2449291 - DNA, 16 bp, Homo sapiens
ctatggagagccctgg

SEQ ID NO: 2449292 - DNA, 17 bp, Homo sapiens
ctatggagagccctggg

SEQ ID NO: 2449293 - DNA, 18 bp, Homo sapiens
ctatggagagccctggga

SEQ ID NO: 2449294 - DNA, 16 bp, Homo sapiens
ctatggtgctctgtct

SEQ ID NO: 2449295 - DNA, 23 bp, Homo sapiens
ctatggtgctctgtctacttgct

SEQ ID NO: 2449296 - DNA, 11 bp, Homo sapiens
ctcctcccagg

SEQ ID NO: 2449297 - DNA, 12 bp, Homo sapiens
ctcctcccaggg

SEQ ID NO: 2449298 - DNA, 14 bp, Homo sapiens
ctcctcccagggtt

SEQ ID NO: 2449299 - DNA, 19 bp, Homo sapiens
ctcctccccaactgtgggg

SEQ ID NO: 2449300 - DNA, 15 bp, Homo sapiens
ctcctcccctggagg

SEQ ID NO: 2449301 - DNA, 23 bp, Homo sapiens
ctcctcccctggagggggaatgg

SEQ ID NO: 2449302 - DNA, 10 bp, Homo sapiens
ctcctccctc

SEQ ID NO: 2449303 - DNA, 17 bp, Homo sapiens
ctcctctagctgtgggg

SEQ ID NO: 2449304 - DNA, 19 bp, Homo sapiens
ctcctctagctgtgggggt

SEQ ID NO: 2449305 - DNA, 18 bp, Homo sapiens
ctcctctccccagcccag

SEQ ID NO: 2449306 - DNA, 19 bp, Homo sapiens
ctcctctccccagcccaga

SEQ ID NO: 2449307 - DNA, 20 bp, Homo sapiens
ctcctctccccagcccagag

SEQ ID NO: 2449308 - DNA, 22 bp, Homo sapiens
ctcctctccccagcccagagac

SEQ ID NO: 2449309 - DNA, 18 bp, Homo sapiens
ctcctctgactcagggct

SEQ ID NO: 2449310 - DNA, 22 bp, Homo sapiens
ctcctctgactcagggctcctg

SEQ ID NO: 2449311 - DNA, 14 bp, Homo sapiens
ctcctctgctgacc

SEQ ID NO: 2449312 - DNA, 23 bp, Homo sapiens
ctcctgaaaaaaaacctgagatt

SEQ ID NO: 2449313 - DNA, 22 bp, Homo sapiens
ctcctgaaaaggtttatgaaaa

SEQ ID NO: 2449314 - DNA, 18 bp, Homo sapiens
ctcctgacacccttctcc

SEQ ID NO: 2449315 - DNA, 20 bp, Homo sapiens
ctcctgacacccttctccca

SEQ ID NO: 2449316 - DNA, 16 bp, Homo sapiens
ctcctgaccagttgca

SEQ ID NO: 2449317 - DNA, 16 bp, Homo sapiens
ctcctgagtgcttgct

SEQ ID NO: 2449318 - DNA, 18 bp, Homo sapiens
ctcctgcacttacttgct

SEQ ID NO: 2449319 - DNA, 20 bp, Homo sapiens
ctcctgcacttacttgctta

SEQ ID NO: 2449320 - DNA, 13 bp, Homo sapiens
ctcctgcccacgg

SEQ ID NO: 2449321 - DNA, 12 bp, Homo sapiens
ctcctgcctcta

SEQ ID NO: 2449322 - DNA, 22 bp, Homo sapiens
ctcctgcctctactgggaaggc

SEQ ID NO: 2449323 - DNA, 14 bp, Homo sapiens
ctcctgccttgaaa

SEQ ID NO: 2449324 - DNA, 21 bp, Homo sapiens
ctcctgctgctccctcagact

SEQ ID NO: 2449325 - DNA, 14 bp, Homo sapiens
ctcctggcccagcc

SEQ ID NO: 2449326 - DNA, 16 bp, Homo sapiens
ctcctggcccagcctt

SEQ ID NO: 2449327 - DNA, 17 bp, Homo sapiens
ctcctgggccctctctg

SEQ ID NO: 2449328 - DNA, 13 bp, Homo sapiens
ctcctgggctcag

SEQ ID NO: 2449329 - DNA, 21 bp, Homo sapiens
ctcctgggttttgtattctct

SEQ ID NO: 2449330 - DNA, 17 bp, Homo sapiens
ctcctggtcacctagga

SEQ ID NO: 2449331 - DNA, 18 bp, Homo sapiens
ctcctggtcacctaggaa

SEQ ID NO: 2449332 - DNA, 15 bp, Homo sapiens
ctcctggtgccacct

SEQ ID NO: 2449333 - DNA, 20 bp, Homo sapiens
ctcctgtaacatactggcct

SEQ ID NO: 2449334 - DNA, 22 bp, Homo sapiens
ctcctgtaacatactggcctgg

SEQ ID NO: 2449335 - DNA, 14 bp, Homo sapiens
ctcctgtcccctgc

SEQ ID NO: 2449336 - DNA, 18 bp, Homo sapiens
ctcctgtcccctgctaca

SEQ ID NO: 2449337 - DNA, 21 bp, Homo sapiens
ctcctgtcccctgctacacct

SEQ ID NO: 2449338 - DNA, 14 bp, Homo sapiens
ctcctgtgctcagc

SEQ ID NO: 2449339 - DNA, 19 bp, Homo sapiens
ctcctgtgctcagccctga

SEQ ID NO: 2449340 - DNA, 20 bp, Homo sapiens
ctcctgtggccccaccctgg

SEQ ID NO: 2449341 - DNA, 16 bp, Homo sapiens
ctcctgtgggagcctc

SEQ ID NO: 2449342 - DNA, 18 bp, Homo sapiens
ctcctgtgggagcctcgc

SEQ ID NO: 2449343 - DNA, 21 bp, Homo sapiens
ctccttcaacaattctaaaat

SEQ ID NO: 2449344 - DNA, 14 bp, Homo sapiens
ctccttcccaagtg

SEQ ID NO: 2449345 - DNA, 16 bp, Homo sapiens
ctccttcccatcgctg

SEQ ID NO: 2449346 - DNA, 17 bp, Homo sapiens
ctccttccctctctgga

SEQ ID NO: 2449347 - DNA, 18 bp, Homo sapiens
ctccttccctctctggag

SEQ ID NO: 2449348 - DNA, 11 bp, Homo sapiens
ctccttcctgc

SEQ ID NO: 2449349 - DNA, 15 bp, Homo sapiens
ctccttcctgcccca

SEQ ID NO: 2449350 - DNA, 14 bp, Homo sapiens
ctccttcctggaga

SEQ ID NO: 2449351 - DNA, 18 bp, Homo sapiens
ctccttctgagctcctgt

SEQ ID NO: 2449352 - DNA, 13 bp, Homo sapiens
ctccttgggccct

SEQ ID NO: 2449353 - DNA, 17 bp, Homo sapiens
ctccttgggccctttga

SEQ ID NO: 2449354 - DNA, 21 bp, Homo sapiens
ctccttggttcttgaggggac

SEQ ID NO: 2449355 - DNA, 14 bp, Homo sapiens
ctccttgtgccaga

SEQ ID NO: 2449356 - DNA, 19 bp, Homo sapiens
ctccttgtgggcctgggct

SEQ ID NO: 2449357 - DNA, 15 bp, Homo sapiens
ctcctttaattgtaa

SEQ ID NO: 2449358 - DNA, 10 bp, Homo sapiens
ctcctttcca

SEQ ID NO: 2449359 - DNA, 18 bp, Homo sapiens
ctcctttccataaatcct

SEQ ID NO: 2449360 - DNA, 18 bp, Homo sapiens
ctcctttctgagggcccg

SEQ ID NO: 2449361 - DNA, 13 bp, Homo sapiens
ctccttttcccaa

SEQ ID NO: 2449362 - DNA, 14 bp, Homo sapiens
ctcgaatctctgtg

SEQ ID NO: 2449363 - DNA, 17 bp, Homo sapiens
ctcgaatctctgtgcct

SEQ ID NO: 2449364 - DNA, 19 bp, Homo sapiens
ctcgacatgaaaattcaga

SEQ ID NO: 2449365 - DNA, 23 bp, Homo sapiens
ctcgagcagtcctgcctcagcct

SEQ ID NO: 2449366 - DNA, 15 bp, Homo sapiens
ctcgagcgccctgca

SEQ ID NO: 2449367 - DNA, 16 bp, Homo sapiens
ctcgagcgccctgcag

SEQ ID NO: 2449368 - DNA, 17 bp, Homo sapiens
ctcgagcgccctgcaga

SEQ ID NO: 2449369 - DNA, 23 bp, Homo sapiens
ctcgagcgccctgcagaccctgc

SEQ ID NO: 2449370 - DNA, 16 bp, Homo sapiens
ctcgaggggtgggctg

SEQ ID NO: 2449371 - DNA, 22 bp, Homo sapiens
ctcgcaacccgtgccaagtcca

SEQ ID NO: 2449372 - DNA, 15 bp, Homo sapiens
ctcgcccctggcaga

SEQ ID NO: 2449373 - DNA, 16 bp, Homo sapiens
ctcgcccctggcagag

SEQ ID NO: 2449374 - DNA, 17 bp, Homo sapiens
ctcgcccctggcagaga

SEQ ID NO: 2449375 - DNA, 20 bp, Homo sapiens
ctcgcccctggcagagatgc

SEQ ID NO: 2449376 - DNA, 23 bp, Homo sapiens
ctcgcctgacaaccactggtctg

SEQ ID NO: 2449377 - DNA, 15 bp, Homo sapiens
ctcgcggccctcagt

SEQ ID NO: 2449378 - DNA, 16 bp, Homo sapiens
ctcgcggccctcagta

SEQ ID NO: 2449379 - DNA, 22 bp, Homo sapiens
ctcgctagcagtggcaggcaga

SEQ ID NO: 2449380 - DNA, 15 bp, Homo sapiens
ctcgctccccactct

SEQ ID NO: 2449381 - DNA, 23 bp, Homo sapiens
ctcgctccccactctgctctgat

SEQ ID NO: 2449382 - DNA, 12 bp, Homo sapiens
ctcgctgccagc

SEQ ID NO: 2449383 - DNA, 13 bp, Homo sapiens
ctcgctgccagct

SEQ ID NO: 2449384 - DNA, 16 bp, Homo sapiens
ctcgctgccagctctg

SEQ ID NO: 2449385 - DNA, 18 bp, Homo sapiens
ctcgctgtcctttctaga

SEQ ID NO: 2449386 - DNA, 13 bp, Homo sapiens
ctcggcctgcccc

SEQ ID NO: 2449387 - DNA, 17 bp, Homo sapiens
ctcggccttcacaatct

SEQ ID NO: 2449388 - DNA, 19 bp, Homo sapiens
ctcggctccccatgtgtcc

SEQ ID NO: 2449389 - DNA, 16 bp, Homo sapiens
ctcggggatgtgtcct

SEQ ID NO: 2449390 - DNA, 16 bp, Homo sapiens
ctcggggtgcacagga

SEQ ID NO: 2449391 - DNA, 17 bp, Homo sapiens
ctcggggtgcacaggag

SEQ ID NO: 2449392 - DNA, 14 bp, Homo sapiens
ctcgtatagcatgc

SEQ ID NO: 2449393 - DNA, 17 bp, Homo sapiens
ctcgtctcttttaccct

SEQ ID NO: 2449394 - DNA, 23 bp, Homo sapiens
ctcgttgactggctgtgtgttgg

SEQ ID NO: 2449395 - DNA, 19 bp, Homo sapiens
ctcgtttgtgttctgtttt

SEQ ID NO: 2449396 - DNA, 15 bp, Homo sapiens
ctctaaaattataaa

SEQ ID NO: 2449397 - DNA, 16 bp, Homo sapiens
ctctaacgcctgagcc

SEQ ID NO: 2449398 - DNA, 18 bp, Homo sapiens
ctctaacgcctgagccca

SEQ ID NO: 2449399 - DNA, 14 bp, Homo sapiens
ctctaagaaagaac

SEQ ID NO: 2449400 - DNA, 15 bp, Homo sapiens
ctgagtgggaagccc

SEQ ID NO: 2449401 - DNA, 17 bp, Homo sapiens
ctgagtgggaagcccat

SEQ ID NO: 2449402 - DNA, 20 bp, Homo sapiens
ctgagttttccatggcagga

SEQ ID NO: 2449403 - DNA, 14 bp, Homo sapiens
ctgagttttgtgtt

SEQ ID NO: 2449404 - DNA, 17 bp, Homo sapiens
ctgataattttaaattc

SEQ ID NO: 2449405 - DNA, 20 bp, Homo sapiens
ctgatactttgacagtgttt

SEQ ID NO: 2449406 - DNA, 20 bp, Homo sapiens
ctgatagggtttgtgacagg

SEQ ID NO: 2449407 - DNA, 17 bp, Homo sapiens
ctgatcagaccacggct

SEQ ID NO: 2449408 - DNA, 20 bp, Homo sapiens
ctgatcagagccgtggtcct

SEQ ID NO: 2449409 - DNA, 21 bp, Homo sapiens
ctgatcccagagagcccgagg

SEQ ID NO: 2449410 - DNA, 12 bp, Homo sapiens
ctgatccctcta

SEQ ID NO: 2449411 - DNA, 17 bp, Homo sapiens
ctgatcctggaggccca

SEQ ID NO: 2449412 - DNA, 21 bp, Homo sapiens
ctgatcctggaggcccagttc

SEQ ID NO: 2449413 - DNA, 15 bp, Homo sapiens
ctgatcgccttcccc

SEQ ID NO: 2449414 - DNA, 22 bp, Homo sapiens
ctgatgaaaaattgctgactgt

SEQ ID NO: 2449415 - DNA, 22 bp, Homo sapiens
ctgatgcatcagaaagggaggg

SEQ ID NO: 2449416 - DNA, 12 bp, Homo sapiens
ctgatgctgaca

SEQ ID NO: 2449417 - DNA, 14 bp, Homo sapiens
ctgatgctgcccct

SEQ ID NO: 2449418 - DNA, 21 bp, Homo sapiens
ctgatgtctcctaagcacctg

SEQ ID NO: 2449419 - DNA, 16 bp, Homo sapiens
ctgatttaggagaagc

SEQ ID NO: 2449420 - DNA, 17 bp, Homo sapiens
ctgatttaggagaagcc

SEQ ID NO: 2449421 - DNA, 20 bp, Homo sapiens
ctgatttaggagaagccagg

SEQ ID NO: 2449422 - DNA, 18 bp, Homo sapiens
ctgatttgtaacccactg

SEQ ID NO: 2449423 - DNA, 14 bp, Homo sapiens
ctgcaaaaagaaaa

SEQ ID NO: 2449424 - DNA, 17 bp, Homo sapiens
ctgcaaaaggactctca

SEQ ID NO: 2449425 - DNA, 22 bp, Homo sapiens
ctgcaaacaccaacatgttggg

SEQ ID NO: 2449426 - DNA, 14 bp, Homo sapiens
ctgcaaactgggaa

SEQ ID NO: 2449427 - DNA, 15 bp, Homo sapiens
ctgcaaactgggaac

SEQ ID NO: 2449428 - DNA, 21 bp, Homo sapiens
ctgcaaactgggaaccccttt

SEQ ID NO: 2449429 - DNA, 19 bp, Homo sapiens
ctgcaaatactgtatattc

SEQ ID NO: 2449430 - DNA, 20 bp, Homo sapiens
ctgcaaatcaggcttttgtt

SEQ ID NO: 2449431 - DNA, 15 bp, Homo sapiens
ctgcaactcaaggac

SEQ ID NO: 2449432 - DNA, 23 bp, Homo sapiens
ctgcaactcaaggactttgcagc

SEQ ID NO: 2449433 - DNA, 17 bp, Homo sapiens
ctgcaagcacagccctt

SEQ ID NO: 2449434 - DNA, 18 bp, Homo sapiens
ctgcaaggtactctggtg

SEQ ID NO: 2449435 - DNA, 15 bp, Homo sapiens
ctgcaattcccctct

SEQ ID NO: 2449436 - DNA, 21 bp, Homo sapiens
ctgcacaataactcctcccag

SEQ ID NO: 2449437 - DNA, 19 bp, Homo sapiens
ctgcaccatgctgctgggg

SEQ ID NO: 2449438 - DNA, 20 bp, Homo sapiens
ctgcaccatgctgctgggga

SEQ ID NO: 2449439 - DNA, 21 bp, Homo sapiens
ctgcaccatgctgctggggaa

SEQ ID NO: 2449440 - DNA, 23 bp, Homo sapiens
ctgcaccatgctgctggggaaga

SEQ ID NO: 2449441 - DNA, 14 bp, Homo sapiens
ctgcactactgaca

SEQ ID NO: 2449442 - DNA, 16 bp, Homo sapiens
ctgcactactgacatg

SEQ ID NO: 2449443 - DNA, 20 bp, Homo sapiens
ctgcactccagtctgggtga

SEQ ID NO: 2449444 - DNA, 16 bp, Homo sapiens
ctgcactggggagccc

SEQ ID NO: 2449445 - DNA, 16 bp, Homo sapiens
ctgcactgtaaaatgt

SEQ ID NO: 2449446 - DNA, 18 bp, Homo sapiens
ctgcactgtaaaatgtgg

SEQ ID NO: 2449447 - DNA, 23 bp, Homo sapiens
ctgcacttgcggttccggcatgg

SEQ ID NO: 2449448 - DNA, 14 bp, Homo sapiens
ctgcagaccctgcc

SEQ ID NO: 2449449 - DNA, 14 bp, Homo sapiens
ctgcagacttccca

SEQ ID NO: 2449450 - DNA, 11 bp, Homo sapiens
ctgcagaggcc

SEQ ID NO: 2449451 - DNA, 13 bp, Homo sapiens
ctgcagaggccag

SEQ ID NO: 2449452 - DNA, 21 bp, Homo sapiens
ctgcagaggccagaggccccc

SEQ ID NO: 2449453 - DNA, 21 bp, Homo sapiens
ctgcagccccacccagatgcc

SEQ ID NO: 2449454 - DNA, 14 bp, Homo sapiens
ctgcagcctcagag

SEQ ID NO: 2449455 - DNA, 14 bp, Homo sapiens
ctgcagcctcagga

SEQ ID NO: 2449456 - DNA, 20 bp, Homo sapiens
ctgcagcctcaggactggga

SEQ ID NO: 2449457 - DNA, 19 bp, Homo sapiens
ctgcagcttgtagccagcc

SEQ ID NO: 2449458 - DNA, 21 bp, Homo sapiens
ctgcagcttgtagccagccgg

SEQ ID NO: 2449459 - DNA, 17 bp, Homo sapiens
ctgcaggaaggagctgc

SEQ ID NO: 2449460 - DNA, 19 bp, Homo sapiens
ctgcaggaaggagctgcct

SEQ ID NO: 2449461 - DNA, 21 bp, Homo sapiens
ctgcaggaaggagctgcctgg

SEQ ID NO: 2449462 - DNA, 21 bp, Homo sapiens
ctgcaggatctcaccaggcag

SEQ ID NO: 2449463 - DNA, 13 bp, Homo sapiens
ctgcaggccctgg

SEQ ID NO: 2449464 - DNA, 14 bp, Homo sapiens
ctgcaggccctggc

SEQ ID NO: 2449465 - DNA, 19 bp, Homo sapiens
ctgcaggccctggcctccc

SEQ ID NO: 2449466 - DNA, 14 bp, Homo sapiens
ctgcaggctgagtg

SEQ ID NO: 2449467 - DNA, 16 bp, Homo sapiens
ctgcaggctgagtgca

SEQ ID NO: 2449468 - DNA, 13 bp, Homo sapiens
ctgcagggcctct

SEQ ID NO: 2449469 - DNA, 15 bp, Homo sapiens
ctgcagggcctctgt

SEQ ID NO: 2449470 - DNA, 16 bp, Homo sapiens
ctgcagggcctctgtc

SEQ ID NO: 2449471 - DNA, 17 bp, Homo sapiens
ctgcagtaaatctttta

SEQ ID NO: 2449472 - DNA, 20 bp, Homo sapiens
ctgcataggagtttggagga

SEQ ID NO: 2449473 - DNA, 23 bp, Homo sapiens
ctgcataggagtttggaggaagt

SEQ ID NO: 2449474 - DNA, 14 bp, Homo sapiens
ctgcatatgttgaa

SEQ ID NO: 2449475 - DNA, 19 bp, Homo sapiens
ctgcatccattctcctgag

SEQ ID NO: 2449476 - DNA, 16 bp, Homo sapiens
ctgcatcctctggagc

SEQ ID NO: 2449477 - DNA, 18 bp, Homo sapiens
ctgcatcctctggagcca

SEQ ID NO: 2449478 - DNA, 13 bp, Homo sapiens
ctgcatgaaaaat

SEQ ID NO: 2449479 - DNA, 12 bp, Homo sapiens
ctgcatgcccag

SEQ ID NO: 2449480 - DNA, 13 bp, Homo sapiens
ctgcatgcccaga

SEQ ID NO: 2449481 - DNA, 22 bp, Homo sapiens
ctgcatgcccagagacccagcg

SEQ ID NO: 2449482 - DNA, 21 bp, Homo sapiens
ctgcatggcagggggctgctg

SEQ ID NO: 2449483 - DNA, 22 bp, Homo sapiens
ctgcatggcagggggctgctgc

SEQ ID NO: 2449484 - DNA, 21 bp, Homo sapiens
ctgcatggcatcctccagccc

SEQ ID NO: 2449485 - DNA, 17 bp, Homo sapiens
ctgcattgaaaagagct

SEQ ID NO: 2449486 - DNA, 18 bp, Homo sapiens
ctgcattgaaaagagctg

SEQ ID NO: 2449487 - DNA, 15 bp, Homo sapiens
ctgcattggaactgg

SEQ ID NO: 2449488 - DNA, 21 bp, Homo sapiens
ctgcattggaactggaggcag

SEQ ID NO: 2449489 - DNA, 16 bp, Homo sapiens
ctgccaaaggatgtga

SEQ ID NO: 2449490 - DNA, 21 bp, Homo sapiens
ctgccaagactgctgtggcca

SEQ ID NO: 2449491 - DNA, 22 bp, Homo sapiens
ctgccacagcctcccctgccag

SEQ ID NO: 2449492 - DNA, 23 bp, Homo sapiens
ctgccacagcctcccctgccagg

SEQ ID NO: 2449493 - DNA, 13 bp, Homo sapiens
ctgccaccaggcc

SEQ ID NO: 2449494 - DNA, 14 bp, Homo sapiens
ctgccaccaggcca

SEQ ID NO: 2449495 - DNA, 17 bp, Homo sapiens
ctgccaccaggccacct

SEQ ID NO: 2449496 - DNA, 17 bp, Homo sapiens
ctgccacccagccccag

SEQ ID NO: 2449497 - DNA, 20 bp, Homo sapiens
ctgccacccagccccagcca

SEQ ID NO: 2449498 - DNA, 14 bp, Homo sapiens
ctgccacccaggat

SEQ ID NO: 2449499 - DNA, 14 bp, Homo sapiens
ctgccacccttgac

SEQ ID NO: 2449500 - DNA, 14 bp, Homo sapiens
ctgccacctggacc

SEQ ID NO: 2449501 - DNA, 16 bp, Homo sapiens
ctgccacctggacccc

SEQ ID NO: 2449502 - DNA, 18 bp, Homo sapiens
ctgccactgaggggggat

SEQ ID NO: 2449503 - DNA, 14 bp, Homo sapiens
ctgccactgtgtga

SEQ ID NO: 2449504 - DNA, 18 bp, Homo sapiens
ctggcttggccacagcca

SEQ ID NO: 2449505 - DNA, 20 bp, Homo sapiens
ctggcttggccacagccagg

SEQ ID NO: 2449506 - DNA, 23 bp, Homo sapiens
ctggcttgggactaaatgccctg

SEQ ID NO: 2449507 - DNA, 18 bp, Homo sapiens
ctgggaaagcccctgccc

SEQ ID NO: 2449508 - DNA, 19 bp, Homo sapiens
ctgggaacccctttcccac

SEQ ID NO: 2449509 - DNA, 17 bp, Homo sapiens
ctgggaactcatctggt

SEQ ID NO: 2449510 - DNA, 23 bp, Homo sapiens
ctgggaaggctacttcggggctg

SEQ ID NO: 2449511 - DNA, 23 bp, Homo sapiens
ctgggaagtcgtccttactcctg

SEQ ID NO: 2449512 - DNA, 18 bp, Homo sapiens
ctgggaccaggcaccagg

SEQ ID NO: 2449513 - DNA, 16 bp, Homo sapiens
ctgggaccgctacacc

SEQ ID NO: 2449514 - DNA, 17 bp, Homo sapiens
ctgggaccgctacacca

SEQ ID NO: 2449515 - DNA, 15 bp, Homo sapiens
ctgggactcagcctt

SEQ ID NO: 2449516 - DNA, 18 bp, Homo sapiens
ctgggagaaatctggctt

SEQ ID NO: 2449517 - DNA, 21 bp, Homo sapiens
ctgggagaaatctggcttctg

SEQ ID NO: 2449518 - DNA, 18 bp, Homo sapiens
ctgggagaggcagcccag

SEQ ID NO: 2449519 - DNA, 20 bp, Homo sapiens
ctgggagcccccagcctgtc

SEQ ID NO: 2449520 - DNA, 23 bp, Homo sapiens
ctgggagcccccagcctgtcaga

SEQ ID NO: 2449521 - DNA, 16 bp, Homo sapiens
ctgggagctccactct

SEQ ID NO: 2449522 - DNA, 23 bp, Homo sapiens
ctgggagctccactctgcttctc

SEQ ID NO: 2449523 - DNA, 22 bp, Homo sapiens
ctgggagggacatgcttagcag

SEQ ID NO: 2449524 - DNA, 13 bp, Homo sapiens
ctgggagggcagc

SEQ ID NO: 2449525 - DNA, 20 bp, Homo sapiens
ctgggagggcagcagggcta

SEQ ID NO: 2449526 - DNA, 22 bp, Homo sapiens
ctgggagggcagcagggctacc

SEQ ID NO: 2449527 - DNA, 17 bp, Homo sapiens
ctgggagtcacacagtg

SEQ ID NO: 2449528 - DNA, 23 bp, Homo sapiens
ctgggagttgatcgcctttccca

SEQ ID NO: 2449529 - DNA, 15 bp, Homo sapiens
ctgggatagaggggt

SEQ ID NO: 2449530 - DNA, 22 bp, Homo sapiens
ctgggatctactttccctctgg

SEQ ID NO: 2449531 - DNA, 23 bp, Homo sapiens
ctgggatctactttccctctggg

SEQ ID NO: 2449532 - DNA, 23 bp, Homo sapiens
ctgggattcaggaaaaggcctgg

SEQ ID NO: 2449533 - DNA, 15 bp, Homo sapiens
ctgggcaagctggcg

SEQ ID NO: 2449534 - DNA, 22 bp, Homo sapiens
ctgggcatgaggggttcctccc

SEQ ID NO: 2449535 - DNA, 21 bp, Homo sapiens
ctgggccattctccacagcaa

SEQ ID NO: 2449536 - DNA, 22 bp, Homo sapiens
ctgggccattctccacagcaac

SEQ ID NO: 2449537 - DNA, 13 bp, Homo sapiens
ctgggcccatgaa

SEQ ID NO: 2449538 - DNA, 14 bp, Homo sapiens
ctgggccctgggct

SEQ ID NO: 2449539 - DNA, 18 bp, Homo sapiens
ctgggccctgggctggaa

SEQ ID NO: 2449540 - DNA, 15 bp, Homo sapiens
ctgggccctggggcc

SEQ ID NO: 2449541 - DNA, 17 bp, Homo sapiens
ctgggccctggggcctg

SEQ ID NO: 2449542 - DNA, 20 bp, Homo sapiens
ctgggcctgaccaaacagcc

SEQ ID NO: 2449543 - DNA, 12 bp, Homo sapiens
ctgggcctgctg

SEQ ID NO: 2449544 - DNA, 14 bp, Homo sapiens
ctgggcctgctgct

SEQ ID NO: 2449545 - DNA, 23 bp, Homo sapiens
ctgggcctggtctcaccctggag

SEQ ID NO: 2449546 - DNA, 18 bp, Homo sapiens
ctgggccttaggaagagc

SEQ ID NO: 2449547 - DNA, 11 bp, Homo sapiens
ctgggccttgg

SEQ ID NO: 2449548 - DNA, 14 bp, Homo sapiens
ctgggccttgggct

SEQ ID NO: 2449549 - DNA, 17 bp, Homo sapiens
ctgggccttgggctccg

SEQ ID NO: 2449550 - DNA, 15 bp, Homo sapiens
ctgggctcctccagg

SEQ ID NO: 2449551 - DNA, 17 bp, Homo sapiens
ctgggctcctccagggt

SEQ ID NO: 2449552 - DNA, 15 bp, Homo sapiens
ctgggctcctggacc

SEQ ID NO: 2449553 - DNA, 13 bp, Homo sapiens
ctgggctctgagt

SEQ ID NO: 2449554 - DNA, 12 bp, Homo sapiens
ctgggctgaggg

SEQ ID NO: 2449555 - DNA, 16 bp, Homo sapiens
ctgggctgagggagcc

SEQ ID NO: 2449556 - DNA, 19 bp, Homo sapiens
ctgggctgagggagcctgg

SEQ ID NO: 2449557 - DNA, 23 bp, Homo sapiens
ctgggctgagggagcctggcccc

SEQ ID NO: 2449558 - DNA, 13 bp, Homo sapiens
ctgggcttcctgg

SEQ ID NO: 2449559 - DNA, 17 bp, Homo sapiens
ctggggaagacagtggc

SEQ ID NO: 2449560 - DNA, 20 bp, Homo sapiens
ctggggacctggtaccctcc

SEQ ID NO: 2449561 - DNA, 14 bp, Homo sapiens
ctggggacttggcc

SEQ ID NO: 2449562 - DNA, 15 bp, Homo sapiens
ctggggacttggcct

SEQ ID NO: 2449563 - DNA, 17 bp, Homo sapiens
ctggggacttggcctct

SEQ ID NO: 2449564 - DNA, 11 bp, Homo sapiens
ctggggagcag

SEQ ID NO: 2449565 - DNA, 15 bp, Homo sapiens
ctggggagcaggcag

SEQ ID NO: 2449566 - DNA, 16 bp, Homo sapiens
ctggggagcaggcagc

SEQ ID NO: 2449567 - DNA, 17 bp, Homo sapiens
ctggggagcaggcagcc

SEQ ID NO: 2449568 - DNA, 20 bp, Homo sapiens
ctggggagcccgtctcagtg

SEQ ID NO: 2449569 - DNA, 14 bp, Homo sapiens
ctggggagcgggtc

SEQ ID NO: 2449570 - DNA, 22 bp, Homo sapiens
ctggggagcgggtctgctccca

SEQ ID NO: 2449571 - DNA, 19 bp, Homo sapiens
ctggggcaggctgggccat

SEQ ID NO: 2449572 - DNA, 15 bp, Homo sapiens
ctggggcctgggaca

SEQ ID NO: 2449573 - DNA, 22 bp, Homo sapiens
ctggggcctgtactgcctgctt

SEQ ID NO: 2449574 - DNA, 20 bp, Homo sapiens
ctggggctctaacgcctgag

SEQ ID NO: 2449575 - DNA, 22 bp, Homo sapiens
ctggggctctaacgcctgagcc

SEQ ID NO: 2449576 - DNA, 18 bp, Homo sapiens
ctgggggcacaagactga

SEQ ID NO: 2449577 - DNA, 13 bp, Homo sapiens
ctgggggcctggc

SEQ ID NO: 2449578 - DNA, 14 bp, Homo sapiens
ctgggggctgcagt

SEQ ID NO: 2449579 - DNA, 15 bp, Homo sapiens
ctggggggtggccag

SEQ ID NO: 2449580 - DNA, 16 bp, Homo sapiens
ctggggggtggccagg

SEQ ID NO: 2449581 - DNA, 19 bp, Homo sapiens
ctgggggtgccaggaccag

SEQ ID NO: 2449582 - DNA, 20 bp, Homo sapiens
ctggggtataaaactttcct

SEQ ID NO: 2449583 - DNA, 13 bp, Homo sapiens
ctggggtcccagc

SEQ ID NO: 2449584 - DNA, 14 bp, Homo sapiens
ctggggtcccagca

SEQ ID NO: 2449585 - DNA, 22 bp, Homo sapiens
ctggggtcccagcagctgccag

SEQ ID NO: 2449586 - DNA, 21 bp, Homo sapiens
ctggggtgacccggcaccccc

SEQ ID NO: 2449587 - DNA, 15 bp, Homo sapiens
ctggggtggccacca

SEQ ID NO: 2449588 - DNA, 18 bp, Homo sapiens
ctgggtaatgaaacaaag

SEQ ID NO: 2449589 - DNA, 20 bp, Homo sapiens
ctgggtacttcttgaaggtg

SEQ ID NO: 2449590 - DNA, 23 bp, Homo sapiens
ctgggtacttcttgaaggtgctg

SEQ ID NO: 2449591 - DNA, 19 bp, Homo sapiens
ctgggtctcaccggctctc

SEQ ID NO: 2449592 - DNA, 21 bp, Homo sapiens
ctgggtgctactggggaaact

SEQ ID NO: 2449593 - DNA, 20 bp, Homo sapiens
ctgggtggctactctgtgcc

SEQ ID NO: 2449594 - DNA, 22 bp, Homo sapiens
ctgggtggctactctgtgccag

SEQ ID NO: 2449595 - DNA, 16 bp, Homo sapiens
ctgggttgggatcagg

SEQ ID NO: 2449596 - DNA, 20 bp, Homo sapiens
ctgggttttgtattctctga

SEQ ID NO: 2449597 - DNA, 22 bp, Homo sapiens
ctgggttttgtattctctgagc

SEQ ID NO: 2449598 - DNA, 15 bp, Homo sapiens
ctggtaccctcctgg

SEQ ID NO: 2449599 - DNA, 21 bp, Homo sapiens
ctggtagaagggaaagcccat

SEQ ID NO: 2449600 - DNA, 22 bp, Homo sapiens
ctggtaggaatagcatgtcact

SEQ ID NO: 2449601 - DNA, 14 bp, Homo sapiens
ctggtatctcagaa

SEQ ID NO: 2449602 - DNA, 19 bp, Homo sapiens
ctggtatctcagaaagtgc

SEQ ID NO: 2449603 - DNA, 22 bp, Homo sapiens
ctggtatgtaaaagaaaatcca

SEQ ID NO: 2449604 - DNA, 20 bp, Homo sapiens
ctggtcaacttgagcatgtt

SEQ ID NO: 2449605 - DNA, 13 bp, Homo sapiens
ctggtccagggct

SEQ ID NO: 2449606 - DNA, 14 bp, Homo sapiens
ctggtccagggcta

SEQ ID NO: 2449607 - DNA, 22 bp, Homo sapiens
cttagtttgtgtgttgtctctt

SEQ ID NO: 2449608 - DNA, 23 bp, Homo sapiens
cttagtttgtgtgttgtctcttg

SEQ ID NO: 2449609 - DNA, 22 bp, Homo sapiens
cttataattctttcaatacaga

SEQ ID NO: 2449610 - DNA, 21 bp, Homo sapiens
cttatacgaaataattgttgt

SEQ ID NO: 2449611 - DNA, 22 bp, Homo sapiens
cttatacgaaataattgttgtt

SEQ ID NO: 2449612 - DNA, 16 bp, Homo sapiens
cttatagcctctgtct

SEQ ID NO: 2449613 - DNA, 15 bp, Homo sapiens
cttatagttactgtg

SEQ ID NO: 2449614 - DNA, 16 bp, Homo sapiens
cttatatctggcctct

SEQ ID NO: 2449615 - DNA, 21 bp, Homo sapiens
cttatatctggcctctgcttt

SEQ ID NO: 2449616 - DNA, 15 bp, Homo sapiens
cttatcctccctgta

SEQ ID NO: 2449617 - DNA, 20 bp, Homo sapiens
cttatcctccctgtaacttg

SEQ ID NO: 2449618 - DNA, 17 bp, Homo sapiens
cttatgcggttaatttt

SEQ ID NO: 2449619 - DNA, 19 bp, Homo sapiens
cttatgctcttaattgcca

SEQ ID NO: 2449620 - DNA, 15 bp, Homo sapiens
cttatgctgatttat

SEQ ID NO: 2449621 - DNA, 18 bp, Homo sapiens
cttatgctgtacccagtt

SEQ ID NO: 2449622 - DNA, 14 bp, Homo sapiens
cttatggaattgat

SEQ ID NO: 2449623 - DNA, 20 bp, Homo sapiens
cttatggaattgatttgcat

SEQ ID NO: 2449624 - DNA, 16 bp, Homo sapiens
cttatggatgtcccca

SEQ ID NO: 2449625 - DNA, 17 bp, Homo sapiens
cttatggatgtccccag

SEQ ID NO: 2449626 - DNA, 20 bp, Homo sapiens
cttatggatgtccccagcag

SEQ ID NO: 2449627 - DNA, 21 bp, Homo sapiens
cttattagagtgtctttccac

SEQ ID NO: 2449628 - DNA, 18 bp, Homo sapiens
cttattccatgactgctt

SEQ ID NO: 2449629 - DNA, 19 bp, Homo sapiens
cttattccatgactgcttg

SEQ ID NO: 2449630 - DNA, 13 bp, Homo sapiens
cttattgcctcac

SEQ ID NO: 2449631 - DNA, 22 bp, Homo sapiens
cttcaaaatgttatcttctcaa

SEQ ID NO: 2449632 - DNA, 23 bp, Homo sapiens
cttcaaaatgttatcttctcaag

SEQ ID NO: 2449633 - DNA, 11 bp, Homo sapiens
cttcaaactac

SEQ ID NO: 2449634 - DNA, 16 bp, Homo sapiens
cttcaaagtttaataa

SEQ ID NO: 2449635 - DNA, 13 bp, Homo sapiens
cttcaaatgcctg

SEQ ID NO: 2449636 - DNA, 22 bp, Homo sapiens
cttcaagcatggctattttata

SEQ ID NO: 2449637 - DNA, 13 bp, Homo sapiens
cttcaagctctga

SEQ ID NO: 2449638 - DNA, 12 bp, Homo sapiens
cttcagaaagac

SEQ ID NO: 2449639 - DNA, 20 bp, Homo sapiens
cttcagacagagaggactgt

SEQ ID NO: 2449640 - DNA, 19 bp, Homo sapiens
cttcagagagcagtgcttt

SEQ ID NO: 2449641 - DNA, 20 bp, Homo sapiens
cttcagagagcagtgctttt

SEQ ID NO: 2449642 - DNA, 22 bp, Homo sapiens
cttcagagagcagtgcttttgg

SEQ ID NO: 2449643 - DNA, 17 bp, Homo sapiens
cttcaggatcaagtcct

SEQ ID NO: 2449644 - DNA, 21 bp, Homo sapiens
cttcaggcccccgccttggcc

SEQ ID NO: 2449645 - DNA, 12 bp, Homo sapiens
cttcaggttctc

SEQ ID NO: 2449646 - DNA, 15 bp, Homo sapiens
cttcagttgtctctg

SEQ ID NO: 2449647 - DNA, 23 bp, Homo sapiens
cttcagttgtctctgatgcagct

SEQ ID NO: 2449648 - DNA, 20 bp, Homo sapiens
cttcagtttcacagaaaata

SEQ ID NO: 2449649 - DNA, 19 bp, Homo sapiens
cttcataacaattttagga

SEQ ID NO: 2449650 - DNA, 23 bp, Homo sapiens
cttcatacttgaacgttttctaa

SEQ ID NO: 2449651 - DNA, 21 bp, Homo sapiens
cttcatatcatccacacatga

SEQ ID NO: 2449652 - DNA, 13 bp, Homo sapiens
cttcatgtgtccc

SEQ ID NO: 2449653 - DNA, 14 bp, Homo sapiens
cttcatgtgtccca

SEQ ID NO: 2449654 - DNA, 17 bp, Homo sapiens
cttcatgtgtcccagaa

SEQ ID NO: 2449655 - DNA, 20 bp, Homo sapiens
cttccaaatcccctaagcag

SEQ ID NO: 2449656 - DNA, 15 bp, Homo sapiens
cttccaatgtctgga

SEQ ID NO: 2449657 - DNA, 13 bp, Homo sapiens
cttccacagggtc

SEQ ID NO: 2449658 - DNA, 23 bp, Homo sapiens
cttccacagggtcccacagccac

SEQ ID NO: 2449659 - DNA, 13 bp, Homo sapiens
cttccacccaggg

SEQ ID NO: 2449660 - DNA, 14 bp, Homo sapiens
cttccactgagggc

SEQ ID NO: 2449661 - DNA, 13 bp, Homo sapiens
cttccagctcctg

SEQ ID NO: 2449662 - DNA, 14 bp, Homo sapiens
cttccagctcctgt

SEQ ID NO: 2449663 - DNA, 15 bp, Homo sapiens
cttccagctcctgta

SEQ ID NO: 2449664 - DNA, 16 bp, Homo sapiens
cttccaggtgttactg

SEQ ID NO: 2449665 - DNA, 19 bp, Homo sapiens
cttccaggtgttactgtaa

SEQ ID NO: 2449666 - DNA, 17 bp, Homo sapiens
cttccagtttgctttgc

SEQ ID NO: 2449667 - DNA, 19 bp, Homo sapiens
cttcccagaggggcctgcc

SEQ ID NO: 2449668 - DNA, 16 bp, Homo sapiens
cttcccagctaggaag

SEQ ID NO: 2449669 - DNA, 15 bp, Homo sapiens
cttcccatccccagc

SEQ ID NO: 2449670 - DNA, 23 bp, Homo sapiens
cttccccacccaccaaccctcag

SEQ ID NO: 2449671 - DNA, 21 bp, Homo sapiens
cttccccagacgcctggctgc

SEQ ID NO: 2449672 - DNA, 16 bp, Homo sapiens
cttccccctctcccag

SEQ ID NO: 2449673 - DNA, 20 bp, Homo sapiens
cttccccttatcctccctgt

SEQ ID NO: 2449674 - DNA, 17 bp, Homo sapiens
cttccctcaccttggca

SEQ ID NO: 2449675 - DNA, 16 bp, Homo sapiens
cttccctctctggaga

SEQ ID NO: 2449676 - DNA, 18 bp, Homo sapiens
cttccctgaagctcccac

SEQ ID NO: 2449677 - DNA, 14 bp, Homo sapiens
cttccctgtgcctc

SEQ ID NO: 2449678 - DNA, 23 bp, Homo sapiens
cttccctgttttccccccaaggg

SEQ ID NO: 2449679 - DNA, 22 bp, Homo sapiens
cttcctaaatattatgagatgc

SEQ ID NO: 2449680 - DNA, 19 bp, Homo sapiens
cttcctaaattttcctgtc

SEQ ID NO: 2449681 - DNA, 20 bp, Homo sapiens
cttcctaaattttcctgtcc

SEQ ID NO: 2449682 - DNA, 12 bp, Homo sapiens
cttcctcagcca

SEQ ID NO: 2449683 - DNA, 16 bp, Homo sapiens
cttcctcagccagcct

SEQ ID NO: 2449684 - DNA, 22 bp, Homo sapiens
cttcctcatccaccccatccct

SEQ ID NO: 2449685 - DNA, 16 bp, Homo sapiens
cttcctcctccccact

SEQ ID NO: 2449686 - DNA, 12 bp, Homo sapiens
cttcctcctggg

SEQ ID NO: 2449687 - DNA, 20 bp, Homo sapiens
cttcctctcgcggccctcag

SEQ ID NO: 2449688 - DNA, 21 bp, Homo sapiens
cttcctctcgcggccctcagt

SEQ ID NO: 2449689 - DNA, 15 bp, Homo sapiens
cttcctgccagcagg

SEQ ID NO: 2449690 - DNA, 14 bp, Homo sapiens
cttcctgccagccc

SEQ ID NO: 2449691 - DNA, 18 bp, Homo sapiens
cttcctgccagcccctgc

SEQ ID NO: 2449692 - DNA, 16 bp, Homo sapiens
cttcctgcttgccaag

SEQ ID NO: 2449693 - DNA, 13 bp, Homo sapiens
cttcctggacagc

SEQ ID NO: 2449694 - DNA, 15 bp, Homo sapiens
cttcctggacagctg

SEQ ID NO: 2449695 - DNA, 21 bp, Homo sapiens
cttcctggacagctgtgcctc

SEQ ID NO: 2449696 - DNA, 14 bp, Homo sapiens
cttcctggagactg

SEQ ID NO: 2449697 - DNA, 19 bp, Homo sapiens
cttcctggagcagaagcag

SEQ ID NO: 2449698 - DNA, 21 bp, Homo sapiens
cttcctggagcagaagcagca

SEQ ID NO: 2449699 - DNA, 16 bp, Homo sapiens
cttcctgtccagctcc

SEQ ID NO: 2449700 - DNA, 19 bp, Homo sapiens
cttccttactcccaggcac

SEQ ID NO: 2449701 - DNA, 13 bp, Homo sapiens
cttccttcagaga

SEQ ID NO: 2449702 - DNA, 14 bp, Homo sapiens
cttccttcagagag

SEQ ID NO: 2449703 - DNA, 21 bp, Homo sapiens
cttccttgaagaactgcaggc

SEQ ID NO: 2449704 - DNA, 17 bp, Homo sapiens
cttcgacactgttctta

SEQ ID NO: 2449705 - DNA, 16 bp, Homo sapiens
cttcgagttcccaggg

SEQ ID NO: 2449706 - DNA, 18 bp, Homo sapiens
cttcgcttcttgcctctg

SEQ ID NO: 2449707 - DNA, 21 bp, Homo sapiens
cttcgcttcttgcctctgtgc

SEQ ID NO: 2449708 - DNA, 16 bp, Homo sapiens
cttcgggcccttccca

SEQ ID NO: 2449709 - DNA, 15 bp, Homo sapiens
cttcgggctgtgccc

SEQ ID NO: 2449710 - DNA, 14 bp, Homo sapiens
cttcggggctggga

SEQ ID NO: 2449711 - DNA, 14 bp, Homo sapiens
ctttttatatatat

SEQ ID NO: 2449712 - DNA, 13 bp, Homo sapiens
ctttttatttctg

SEQ ID NO: 2449713 - DNA, 20 bp, Homo sapiens
ctttttctctttccatgaca

SEQ ID NO: 2449714 - DNA, 19 bp, Homo sapiens
ctttttgggagagacttgt

SEQ ID NO: 2449715 - DNA, 23 bp, Homo sapiens
ctttttggtcgaggagtaacaat

SEQ ID NO: 2449716 - DNA, 22 bp, Homo sapiens
ctttttgtgatatgcacaatgt

SEQ ID NO: 2449717 - DNA, 16 bp, Homo sapiens
ctttttttgtatagtt

SEQ ID NO: 2449718 - DNA, 21 bp, Homo sapiens
ctttttttgtatagttaacac

SEQ ID NO: 2449719 - DNA, 13 bp, Homo sapiens
ctttttttgtgtg

SEQ ID NO: 2449720 - DNA, 22 bp, Homo sapiens
ctttttttgtgtgtatttgcta

SEQ ID NO: 2449721 - DNA, 16 bp, Homo sapiens
cttttttttttcttta

SEQ ID NO: 2449722 - DNA, 18 bp, Homo sapiens
cttttttttttctttata

SEQ ID NO: 2449723 - DNA, 18 bp, Homo sapiens
gaaaaaaaaattcacatg

SEQ ID NO: 2449724 - DNA, 18 bp, Homo sapiens
gaaaaaaaacctgagatt

SEQ ID NO: 2449725 - DNA, 20 bp, Homo sapiens
gaaaaaaatgtattttatgt

SEQ ID NO: 2449726 - DNA, 15 bp, Homo sapiens
gaaaaaaattgaaat

SEQ ID NO: 2449727 - DNA, 18 bp, Homo sapiens
gaaaaaaattgaaatgta

SEQ ID NO: 2449728 - DNA, 21 bp, Homo sapiens
gaaaaacaaactcgtttttta

SEQ ID NO: 2449729 - DNA, 23 bp, Homo sapiens
gaaaaacaaactcgttttttaca

SEQ ID NO: 2449730 - DNA, 18 bp, Homo sapiens
gaaaaacaggcacttggc

SEQ ID NO: 2449731 - DNA, 21 bp, Homo sapiens
gaaaaactttggaaccagact

SEQ ID NO: 2449732 - DNA, 22 bp, Homo sapiens
gaaaaactttggaaccagactc

SEQ ID NO: 2449733 - DNA, 14 bp, Homo sapiens
gaaaaagaagaatc

SEQ ID NO: 2449734 - DNA, 19 bp, Homo sapiens
gaaaaataaagaaaagatg

SEQ ID NO: 2449735 - DNA, 16 bp, Homo sapiens
gaaaaatctaagtgat

SEQ ID NO: 2449736 - DNA, 20 bp, Homo sapiens
gaaaaatctaagtgatataa

SEQ ID NO: 2449737 - DNA, 13 bp, Homo sapiens
gaaaacaaaactg

SEQ ID NO: 2449738 - DNA, 12 bp, Homo sapiens
gaaaacaggcac

SEQ ID NO: 2449739 - DNA, 18 bp, Homo sapiens
gaaaacaggcactgccct

SEQ ID NO: 2449740 - DNA, 20 bp, Homo sapiens
gaaaacccccaaaccagata

SEQ ID NO: 2449741 - DNA, 22 bp, Homo sapiens
gaaaacccttgggccagaagta

SEQ ID NO: 2449742 - DNA, 16 bp, Homo sapiens
gaaaactctttgctgc

SEQ ID NO: 2449743 - DNA, 22 bp, Homo sapiens
gaaaagaattgttgggggtttt

SEQ ID NO: 2449744 - DNA, 22 bp, Homo sapiens
gaaaagatgcactttgctttaa

SEQ ID NO: 2449745 - DNA, 12 bp, Homo sapiens
gaaaaggcctgg

SEQ ID NO: 2449746 - DNA, 17 bp, Homo sapiens
gaaaaggtttatgaaaa

SEQ ID NO: 2449747 - DNA, 20 bp, Homo sapiens
gaaaagtatattgataacct

SEQ ID NO: 2449748 - DNA, 17 bp, Homo sapiens
gaaaataggcaggaagc

SEQ ID NO: 2449749 - DNA, 16 bp, Homo sapiens
gaaaatataaccagcc

SEQ ID NO: 2449750 - DNA, 15 bp, Homo sapiens
gaaaatgtccaggaa

SEQ ID NO: 2449751 - DNA, 21 bp, Homo sapiens
gaaaatgttctgtttgctgtg

SEQ ID NO: 2449752 - DNA, 21 bp, Homo sapiens
gaaaatgttgagaatcccaaa

SEQ ID NO: 2449753 - DNA, 14 bp, Homo sapiens
gaaaattacaaaaa

SEQ ID NO: 2449754 - DNA, 18 bp, Homo sapiens
gaaaattagactgtgatt

SEQ ID NO: 2449755 - DNA, 16 bp, Homo sapiens
gaaaattatttgcata

SEQ ID NO: 2449756 - DNA, 17 bp, Homo sapiens
gaaaatttgttattttg

SEQ ID NO: 2449757 - DNA, 21 bp, Homo sapiens
gaaaatttgttattttgcaac

SEQ ID NO: 2449758 - DNA, 23 bp, Homo sapiens
gaaacaaagagttcaagaaataa

SEQ ID NO: 2449759 - DNA, 15 bp, Homo sapiens
gaaacaacactgtag

SEQ ID NO: 2449760 - DNA, 16 bp, Homo sapiens
gaaacaacactgtagt

SEQ ID NO: 2449761 - DNA, 20 bp, Homo sapiens
gaaacaactctttgagaaac

SEQ ID NO: 2449762 - DNA, 14 bp, Homo sapiens
gaaacaacttggaa

SEQ ID NO: 2449763 - DNA, 11 bp, Homo sapiens
gaaacagaaaa

SEQ ID NO: 2449764 - DNA, 19 bp, Homo sapiens
gaaacagttgcatgtagta

SEQ ID NO: 2449765 - DNA, 20 bp, Homo sapiens
gaaacagttgcatgtagtaa

SEQ ID NO: 2449766 - DNA, 19 bp, Homo sapiens
gaaacagttggtaactttt

SEQ ID NO: 2449767 - DNA, 23 bp, Homo sapiens
gaaacagttggtaacttttgtga

SEQ ID NO: 2449768 - DNA, 13 bp, Homo sapiens
gaaacctactgcc

SEQ ID NO: 2449769 - DNA, 20 bp, Homo sapiens
gaaactggccatggcctgca

SEQ ID NO: 2449770 - DNA, 19 bp, Homo sapiens
gaaacttaaatgttattat

SEQ ID NO: 2449771 - DNA, 21 bp, Homo sapiens
gaaacttaaatgttattatct

SEQ ID NO: 2449772 - DNA, 21 bp, Homo sapiens
gaaacttttcttaaaaagtta

SEQ ID NO: 2449773 - DNA, 18 bp, Homo sapiens
gaaacttttttatttaaa

SEQ ID NO: 2449774 - DNA, 17 bp, Homo sapiens
gaaagacgcactttggc

SEQ ID NO: 2449775 - DNA, 18 bp, Homo sapiens
gaaagagaaacagttggt

SEQ ID NO: 2449776 - DNA, 20 bp, Homo sapiens
gaaagaggcaccaggaagcc

SEQ ID NO: 2449777 - DNA, 17 bp, Homo sapiens
gaaagataattcactgt

SEQ ID NO: 2449778 - DNA, 18 bp, Homo sapiens
gaaagcagttgagacaag

SEQ ID NO: 2449779 - DNA, 16 bp, Homo sapiens
gaaagccccacccagg

SEQ ID NO: 2449780 - DNA, 10 bp, Homo sapiens
gaaagcctga

SEQ ID NO: 2449781 - DNA, 12 bp, Homo sapiens
gaaagcctgagt

SEQ ID NO: 2449782 - DNA, 15 bp, Homo sapiens
gaaagctgacttggc

SEQ ID NO: 2449783 - DNA, 20 bp, Homo sapiens
gaaagctgacttggctggtg

SEQ ID NO: 2449784 - DNA, 21 bp, Homo sapiens
gaaagctgacttggctggtgt

SEQ ID NO: 2449785 - DNA, 21 bp, Homo sapiens
gaaaggaagcattgtaaaata

SEQ ID NO: 2449786 - DNA, 16 bp, Homo sapiens
gaaaggccagcactcg

SEQ ID NO: 2449787 - DNA, 17 bp, Homo sapiens
gaaagggagggctctga

SEQ ID NO: 2449788 - DNA, 18 bp, Homo sapiens
gaaagggagggctctgag

SEQ ID NO: 2449789 - DNA, 20 bp, Homo sapiens
gaaagggagggctctgaggc

SEQ ID NO: 2449790 - DNA, 16 bp, Homo sapiens
gaaaggtggtgtttct

SEQ ID NO: 2449791 - DNA, 14 bp, Homo sapiens
gaaagtctgtcctt

SEQ ID NO: 2449792 - DNA, 15 bp, Homo sapiens
gaaagtgcctttcag

SEQ ID NO: 2449793 - DNA, 14 bp, Homo sapiens
gaaataaagtcaga

SEQ ID NO: 2449794 - DNA, 18 bp, Homo sapiens
gaaataagtgccctctcc

SEQ ID NO: 2449795 - DNA, 22 bp, Homo sapiens
gaaataatgtgtagttcatgta

SEQ ID NO: 2449796 - DNA, 19 bp, Homo sapiens
gaaatacagttctgctctg

SEQ ID NO: 2449797 - DNA, 14 bp, Homo sapiens
gaaatactatttaa

SEQ ID NO: 2449798 - DNA, 15 bp, Homo sapiens
gaaatagcttatgaa

SEQ ID NO: 2449799 - DNA, 18 bp, Homo sapiens
gaaatagcttatgaaaag

SEQ ID NO: 2449800 - DNA, 12 bp, Homo sapiens
gaaatatatatt

SEQ ID NO: 2449801 - DNA, 13 bp, Homo sapiens
gaaatatatatta

SEQ ID NO: 2449802 - DNA, 15 bp, Homo sapiens
gaaatatatattata

SEQ ID NO: 2449803 - DNA, 22 bp, Homo sapiens
gaaatatatattatacttgtaa

SEQ ID NO: 2449804 - DNA, 17 bp, Homo sapiens
gaaatatgcacaatagc

SEQ ID NO: 2449805 - DNA, 18 bp, Homo sapiens
gaaatatgcacaatagca

SEQ ID NO: 2449806 - DNA, 13 bp, Homo sapiens
gaaatcccttcat

SEQ ID NO: 2449807 - DNA, 15 bp, Homo sapiens
gaaatcccttcatac

SEQ ID NO: 2449808 - DNA, 12 bp, Homo sapiens
gaaatctcaccc

SEQ ID NO: 2449809 - DNA, 22 bp, Homo sapiens
gaaatgaggccatggactctgt

SEQ ID NO: 2449810 - DNA, 21 bp, Homo sapiens
gaaatggtactgtacagctgg

SEQ ID NO: 2449811 - DNA, 22 bp, Homo sapiens
gaaatgtttttaataaaagaaa

SEQ ID NO: 2449812 - DNA, 18 bp, Homo sapiens
gaaattaagaaggcaaaa

SEQ ID NO: 2449813 - DNA, 22 bp, Homo sapiens
gaaattaagaaggcaaaaatgt

SEQ ID NO: 2449814 - DNA, 11 bp, Homo sapiens
gacccctgcat

SEQ ID NO: 2449815 - DNA, 21 bp, Homo sapiens
gacccggcaccccctgcagct

SEQ ID NO: 2449816 - DNA, 19 bp, Homo sapiens
gacccgttcatgggggagg

SEQ ID NO: 2449817 - DNA, 23 bp, Homo sapiens
gacccgttcatgggggagggggc

SEQ ID NO: 2449818 - DNA, 23 bp, Homo sapiens
gaccctgcccttgtttggggcag

SEQ ID NO: 2449819 - DNA, 16 bp, Homo sapiens
gaccctggaggcccca

SEQ ID NO: 2449820 - DNA, 15 bp, Homo sapiens
gaccctggctttcat

SEQ ID NO: 2449821 - DNA, 12 bp, Homo sapiens
gacccttttcat

SEQ ID NO: 2449822 - DNA, 12 bp, Homo sapiens
gaccgccccctc

SEQ ID NO: 2449823 - DNA, 21 bp, Homo sapiens
gaccgctacaccactctggca

SEQ ID NO: 2449824 - DNA, 17 bp, Homo sapiens
gaccggcctgccaggag

SEQ ID NO: 2449825 - DNA, 18 bp, Homo sapiens
gaccggcctgccaggagg

SEQ ID NO: 2449826 - DNA, 16 bp, Homo sapiens
gacctaaatggcctca

SEQ ID NO: 2449827 - DNA, 23 bp, Homo sapiens
gacctacagggggtctggctggt

SEQ ID NO: 2449828 - DNA, 15 bp, Homo sapiens
gacctactgttctaa

SEQ ID NO: 2449829 - DNA, 16 bp, Homo sapiens
gacctatacctgtgtt

SEQ ID NO: 2449830 - DNA, 20 bp, Homo sapiens
gacctcagttttatcatttt

SEQ ID NO: 2449831 - DNA, 14 bp, Homo sapiens
gacctccagctgtt

SEQ ID NO: 2449832 - DNA, 14 bp, Homo sapiens
gacctctgacagca

SEQ ID NO: 2449833 - DNA, 15 bp, Homo sapiens
gacctctgggttggg

SEQ ID NO: 2449834 - DNA, 15 bp, Homo sapiens
gacctgaaattccaa

SEQ ID NO: 2449835 - DNA, 16 bp, Homo sapiens
gacctgagaatgtatc

SEQ ID NO: 2449836 - DNA, 11 bp, Homo sapiens
gacctgagcct

SEQ ID NO: 2449837 - DNA, 12 bp, Homo sapiens
gacctgagcctg

SEQ ID NO: 2449838 - DNA, 14 bp, Homo sapiens
gacctgaggctgtg

SEQ ID NO: 2449839 - DNA, 14 bp, Homo sapiens
gacctgatcctgga

SEQ ID NO: 2449840 - DNA, 15 bp, Homo sapiens
gacctgatcctggag

SEQ ID NO: 2449841 - DNA, 18 bp, Homo sapiens
gacctgatcctggaggcc

SEQ ID NO: 2449842 - DNA, 18 bp, Homo sapiens
gacctgctaggccagagc

SEQ ID NO: 2449843 - DNA, 23 bp, Homo sapiens
gacctgctaggccagagcccact

SEQ ID NO: 2449844 - DNA, 22 bp, Homo sapiens
gacctgctgagctctgagaggc

SEQ ID NO: 2449845 - DNA, 17 bp, Homo sapiens
gacctggtgctgcctct

SEQ ID NO: 2449846 - DNA, 15 bp, Homo sapiens
gacctgtgagcccag

SEQ ID NO: 2449847 - DNA, 23 bp, Homo sapiens
gacctgtgagcccagctgggtca

SEQ ID NO: 2449848 - DNA, 17 bp, Homo sapiens
gaccttgttacttctga

SEQ ID NO: 2449849 - DNA, 21 bp, Homo sapiens
gacgacaagtgctgaacagtg

SEQ ID NO: 2449850 - DNA, 15 bp, Homo sapiens
gacgcatatgagtaa

SEQ ID NO: 2449851 - DNA, 13 bp, Homo sapiens
gacgcctgaggaa

SEQ ID NO: 2449852 - DNA, 12 bp, Homo sapiens
gacgcctggggg

SEQ ID NO: 2449853 - DNA, 19 bp, Homo sapiens
gacgcctgggggtgccagg

SEQ ID NO: 2449854 - DNA, 18 bp, Homo sapiens
gacggaagggtaaacaat

SEQ ID NO: 2449855 - DNA, 14 bp, Homo sapiens
gacgtggctcagcc

SEQ ID NO: 2449856 - DNA, 15 bp, Homo sapiens
gacgtggctcagcca

SEQ ID NO: 2449857 - DNA, 19 bp, Homo sapiens
gactaaactttttttctgt

SEQ ID NO: 2449858 - DNA, 14 bp, Homo sapiens
gactaacactcaga

SEQ ID NO: 2449859 - DNA, 16 bp, Homo sapiens
gactaacactcagaag

SEQ ID NO: 2449860 - DNA, 23 bp, Homo sapiens
gactaagagaagttgtaaagtat

SEQ ID NO: 2449861 - DNA, 14 bp, Homo sapiens
gactaatggcatga

SEQ ID NO: 2449862 - DNA, 12 bp, Homo sapiens
gactaatttcaa

SEQ ID NO: 2449863 - DNA, 18 bp, Homo sapiens
gactagatgtagtatttt

SEQ ID NO: 2449864 - DNA, 17 bp, Homo sapiens
gactagcctggcttggg

SEQ ID NO: 2449865 - DNA, 16 bp, Homo sapiens
gactagggagccatgt

SEQ ID NO: 2449866 - DNA, 21 bp, Homo sapiens
gactatatttgggcctgctcc

SEQ ID NO: 2449867 - DNA, 16 bp, Homo sapiens
gactcaaatgttctaa

SEQ ID NO: 2449868 - DNA, 18 bp, Homo sapiens
gactcaaatgttctaagt

SEQ ID NO: 2449869 - DNA, 19 bp, Homo sapiens
gactcaagaagtgaagaat

SEQ ID NO: 2449870 - DNA, 20 bp, Homo sapiens
gactcaagaagtgaagaatg

SEQ ID NO: 2449871 - DNA, 16 bp, Homo sapiens
gactcaggagcctgtg

SEQ ID NO: 2449872 - DNA, 13 bp, Homo sapiens
gactcagggcagc

SEQ ID NO: 2449873 - DNA, 17 bp, Homo sapiens
gactcagggcagcgcca

SEQ ID NO: 2449874 - DNA, 23 bp, Homo sapiens
gactcagggcagcgccaggctga

SEQ ID NO: 2449875 - DNA, 12 bp, Homo sapiens
gactcagggctc

SEQ ID NO: 2449876 - DNA, 14 bp, Homo sapiens
gactcagggctcct

SEQ ID NO: 2449877 - DNA, 17 bp, Homo sapiens
gactcagggctcctggg

SEQ ID NO: 2449878 - DNA, 16 bp, Homo sapiens
gactcattctgaagga

SEQ ID NO: 2449879 - DNA, 17 bp, Homo sapiens
gactcattctgaaggag

SEQ ID NO: 2449880 - DNA, 22 bp, Homo sapiens
gactcccattcctgaagaacca

SEQ ID NO: 2449881 - DNA, 14 bp, Homo sapiens
gactcctagctgtc

SEQ ID NO: 2449882 - DNA, 19 bp, Homo sapiens
gactcctagctgtcctttt

SEQ ID NO: 2449883 - DNA, 14 bp, Homo sapiens
gactcgggggtggg

SEQ ID NO: 2449884 - DNA, 16 bp, Homo sapiens
gactctagagtccaag

SEQ ID NO: 2449885 - DNA, 18 bp, Homo sapiens
gactctattctttaactc

SEQ ID NO: 2449886 - DNA, 16 bp, Homo sapiens
gactctcagtctctga

SEQ ID NO: 2449887 - DNA, 20 bp, Homo sapiens
gactctcagtctctgagcag

SEQ ID NO: 2449888 - DNA, 14 bp, Homo sapiens
gactctgcagcctc

SEQ ID NO: 2449889 - DNA, 15 bp, Homo sapiens
gactctgcagcctca

SEQ ID NO: 2449890 - DNA, 13 bp, Homo sapiens
gactctgtcctga

SEQ ID NO: 2449891 - DNA, 24 bp, Homo sapiens
gactctgtcctgaaggcctgaggt

SEQ ID NO: 2449892 - DNA, 13 bp, Homo sapiens
gactctgtgctgg

SEQ ID NO: 2449893 - DNA, 17 bp, Homo sapiens
gactctgtgctggccag

SEQ ID NO: 2449894 - DNA, 18 bp, Homo sapiens
gactctgtgctggccagc

SEQ ID NO: 2449895 - DNA, 17 bp, Homo sapiens
gactcttttgccattaa

SEQ ID NO: 2449896 - DNA, 22 bp, Homo sapiens
gactgagtgggaagcccatcct

SEQ ID NO: 2449897 - DNA, 14 bp, Homo sapiens
gactgatgtctcct

SEQ ID NO: 2449898 - DNA, 16 bp, Homo sapiens
gactgatgtctcctaa

SEQ ID NO: 2449899 - DNA, 14 bp, Homo sapiens
gactgatttcagag

SEQ ID NO: 2449900 - DNA, 19 bp, Homo sapiens
gactgccaagactgctgtg

SEQ ID NO: 2449901 - DNA, 12 bp, Homo sapiens
gactgctgtggc

SEQ ID NO: 2449902 - DNA, 16 bp, Homo sapiens
gactgctgtggccagg

SEQ ID NO: 2449903 - DNA, 12 bp, Homo sapiens
gactgcttgccc

SEQ ID NO: 2449904 - DNA, 13 bp, Homo sapiens
gactgcttgccct

SEQ ID NO: 2449905 - DNA, 17 bp, Homo sapiens
gactgcttgccctaagc

SEQ ID NO: 2449906 - DNA, 22 bp, Homo sapiens
gactgcttgccctaagcagaaa

SEQ ID NO: 2449907 - DNA, 15 bp, Homo sapiens
gactggaacactaga

SEQ ID NO: 2449908 - DNA, 20 bp, Homo sapiens
gactggcttttattaatgca

SEQ ID NO: 2449909 - DNA, 22 bp, Homo sapiens
gactggcttttattaatgcact

SEQ ID NO: 2449910 - DNA, 16 bp, Homo sapiens
gactgggaccaggcac

SEQ ID NO: 2449911 - DNA, 18 bp, Homo sapiens
gactgggaccaggcacca

SEQ ID NO: 2449912 - DNA, 19 bp, Homo sapiens
gactgggagcccccagcct

SEQ ID NO: 2449913 - DNA, 21 bp, Homo sapiens
gactgggagcccccagcctgt

SEQ ID NO: 2449914 - DNA, 22 bp, Homo sapiens
gactgggagcccccagcctgtc

SEQ ID NO: 2449915 - DNA, 11 bp, Homo sapiens
gactggggcag

SEQ ID NO: 2449916 - DNA, 23 bp, Homo sapiens
gactgggtctcgctttgttgccc

SEQ ID NO: 2449917 - DNA, 22 bp, Homo sapiens
gactggtgttatcaccgtgggc

SEQ ID NO: 2449918 - DNA, 17 bp, Homo sapiens
gactgtaagttgggctt

SEQ ID NO: 2449919 - DNA, 20 bp, Homo sapiens
gagtcgtggggtgtgctggg

SEQ ID NO: 2449920 - DNA, 21 bp, Homo sapiens
gagtcgtggggtgtgctggga

SEQ ID NO: 2449921 - DNA, 22 bp, Homo sapiens
gagtctaaagatggagtttcta

SEQ ID NO: 2449922 - DNA, 17 bp, Homo sapiens
gagtctagattcaaagg

SEQ ID NO: 2449923 - DNA, 21 bp, Homo sapiens
gagtctagattcaaaggttct

SEQ ID NO: 2449924 - DNA, 22 bp, Homo sapiens
gagtctagattcaaaggttcta

SEQ ID NO: 2449925 - DNA, 14 bp, Homo sapiens
gagtctctctgggc

SEQ ID NO: 2449926 - DNA, 14 bp, Homo sapiens
gagtctgaggtcct

SEQ ID NO: 2449927 - DNA, 13 bp, Homo sapiens
gagtctgccaggg

SEQ ID NO: 2449928 - DNA, 20 bp, Homo sapiens
gagtcttgctctgtcgccca

SEQ ID NO: 2449929 - DNA, 16 bp, Homo sapiens
gagtctttggttctaa

SEQ ID NO: 2449930 - DNA, 22 bp, Homo sapiens
gagtctttggttctaaggacct

SEQ ID NO: 2449931 - DNA, 14 bp, Homo sapiens
gagtgaataaatgt

SEQ ID NO: 2449932 - DNA, 16 bp, Homo sapiens
gagtgactacacacag

SEQ ID NO: 2449933 - DNA, 14 bp, Homo sapiens
gagtgagacagact

SEQ ID NO: 2449934 - DNA, 19 bp, Homo sapiens
gagtgatagtcttttgctt

SEQ ID NO: 2449935 - DNA, 20 bp, Homo sapiens
gagtggagtctgccacccag

SEQ ID NO: 2449936 - DNA, 15 bp, Homo sapiens
gagtggcagcccagc

SEQ ID NO: 2449937 - DNA, 18 bp, Homo sapiens
gagtggcagcccagccag

SEQ ID NO: 2449938 - DNA, 16 bp, Homo sapiens
gagtggcaggggacag

SEQ ID NO: 2449939 - DNA, 19 bp, Homo sapiens
gagtggcaggggacaggag

SEQ ID NO: 2449940 - DNA, 13 bp, Homo sapiens
gagtgggaagccc

SEQ ID NO: 2449941 - DNA, 21 bp, Homo sapiens
gagtggggttatctctgtgtt

SEQ ID NO: 2449942 - DNA, 21 bp, Homo sapiens
gagtggtttaggctatttgta

SEQ ID NO: 2449943 - DNA, 19 bp, Homo sapiens
gagtgtcctcttccctctc

SEQ ID NO: 2449944 - DNA, 18 bp, Homo sapiens
gagtgtgcggctgtgtgt

SEQ ID NO: 2449945 - DNA, 23 bp, Homo sapiens
gagtgtgcgtggtggtccctggg

SEQ ID NO: 2449946 - DNA, 17 bp, Homo sapiens
gagttacagttctgtgg

SEQ ID NO: 2449947 - DNA, 19 bp, Homo sapiens
gagttagggactgaccagc

SEQ ID NO: 2449948 - DNA, 16 bp, Homo sapiens
gagttccagaaagtaa

SEQ ID NO: 2449949 - DNA, 16 bp, Homo sapiens
gagttctccctgtaca

SEQ ID NO: 2449950 - DNA, 12 bp, Homo sapiens
gagttgaggcca

SEQ ID NO: 2449951 - DNA, 16 bp, Homo sapiens
gagttgaggccactgt

SEQ ID NO: 2449952 - DNA, 16 bp, Homo sapiens
gagttgatctggaacc

SEQ ID NO: 2449953 - DNA, 19 bp, Homo sapiens
gagttgatctggaacccag

SEQ ID NO: 2449954 - DNA, 14 bp, Homo sapiens
gagtttaaaatcat

SEQ ID NO: 2449955 - DNA, 20 bp, Homo sapiens
gagtttagggaacaatttgg

SEQ ID NO: 2449956 - DNA, 22 bp, Homo sapiens
gagtttatgttccattaaacga

SEQ ID NO: 2449957 - DNA, 13 bp, Homo sapiens
gagtttctaaggt

SEQ ID NO: 2449958 - DNA, 22 bp, Homo sapiens
gagtttggagagagcagactgg

SEQ ID NO: 2449959 - DNA, 21 bp, Homo sapiens
gataaaacatctttgaaatta

SEQ ID NO: 2449960 - DNA, 14 bp, Homo sapiens
gataaagagacagt

SEQ ID NO: 2449961 - DNA, 17 bp, Homo sapiens
gataaagcctcaaggtt

SEQ ID NO: 2449962 - DNA, 20 bp, Homo sapiens
gataactgaaaattatttaa

SEQ ID NO: 2449963 - DNA, 14 bp, Homo sapiens
gataagatctttta

SEQ ID NO: 2449964 - DNA, 20 bp, Homo sapiens
gataagatcttttattttgc

SEQ ID NO: 2449965 - DNA, 14 bp, Homo sapiens
gataatgaacagaa

SEQ ID NO: 2449966 - DNA, 23 bp, Homo sapiens
gatacatccaaagcagacagctc

SEQ ID NO: 2449967 - DNA, 17 bp, Homo sapiens
gataccacctttactgt

SEQ ID NO: 2449968 - DNA, 18 bp, Homo sapiens
gataccacctttactgtg

SEQ ID NO: 2449969 - DNA, 19 bp, Homo sapiens
gataccatgctgtaaggat

SEQ ID NO: 2449970 - DNA, 13 bp, Homo sapiens
gatacccccctct

SEQ ID NO: 2449971 - DNA, 20 bp, Homo sapiens
gatactgcgactttctgcct

SEQ ID NO: 2449972 - DNA, 21 bp, Homo sapiens
gatactgttgcacgtgtgttt

SEQ ID NO: 2449973 - DNA, 22 bp, Homo sapiens
gatacttcgacactgttcttag

SEQ ID NO: 2449974 - DNA, 19 bp, Homo sapiens
gatagaaatgccaagcact

SEQ ID NO: 2449975 - DNA, 17 bp, Homo sapiens
gatagatgctggcccag

SEQ ID NO: 2449976 - DNA, 22 bp, Homo sapiens
gatagattttctgctactttgc

SEQ ID NO: 2449977 - DNA, 16 bp, Homo sapiens
gatagccctgtcctgg

SEQ ID NO: 2449978 - DNA, 23 bp, Homo sapiens
gatagttttcatccataactgaa

SEQ ID NO: 2449979 - DNA, 15 bp, Homo sapiens
gatatattttctttc

SEQ ID NO: 2449980 - DNA, 14 bp, Homo sapiens
gatatgcgtattat

SEQ ID NO: 2449981 - DNA, 13 bp, Homo sapiens
gatattctaagac

SEQ ID NO: 2449982 - DNA, 18 bp, Homo sapiens
gatcaattatagtttctg

SEQ ID NO: 2449983 - DNA, 20 bp, Homo sapiens
gatcaattatagtttctgag

SEQ ID NO: 2449984 - DNA, 12 bp, Homo sapiens
gatcacaagatg

SEQ ID NO: 2449985 - DNA, 14 bp, Homo sapiens
gatcacaagatgga

SEQ ID NO: 2449986 - DNA, 17 bp, Homo sapiens
gatcagatgctccaaga

SEQ ID NO: 2449987 - DNA, 22 bp, Homo sapiens
gatcagccccaccctggcctag

SEQ ID NO: 2449988 - DNA, 13 bp, Homo sapiens
gatcagcgtggcc

SEQ ID NO: 2449989 - DNA, 17 bp, Homo sapiens
gatcagtatttaactaa

SEQ ID NO: 2449990 - DNA, 21 bp, Homo sapiens
gatcagttaagaaatttcaca

SEQ ID NO: 2449991 - DNA, 15 bp, Homo sapiens
gatcatgtgtggaag

SEQ ID NO: 2449992 - DNA, 13 bp, Homo sapiens
gatccaaaagaag

SEQ ID NO: 2449993 - DNA, 16 bp, Homo sapiens
gatccaaaagaagccc

SEQ ID NO: 2449994 - DNA, 23 bp, Homo sapiens
gatccaaaagaagcccccagcta

SEQ ID NO: 2449995 - DNA, 23 bp, Homo sapiens
gatccaggagctccagtgtcctg

SEQ ID NO: 2449996 - DNA, 22 bp, Homo sapiens
gatccagggacagaggccccag

SEQ ID NO: 2449997 - DNA, 16 bp, Homo sapiens
gatccagtataagact

SEQ ID NO: 2449998 - DNA, 21 bp, Homo sapiens
gatcccaagtagaatctcagt

SEQ ID NO: 2449999 - DNA, 12 bp, Homo sapiens
gatccctcatct

SEQ ID NO: 2450000 - DNA, 14 bp, Homo sapiens
gatccctcatctgt

SEQ ID NO: 2450001 - DNA, 23 bp, Homo sapiens
gatccctcccccccatgcactgt

SEQ ID NO: 2450002 - DNA, 14 bp, Homo sapiens
gatccctgtgttgt

SEQ ID NO: 2450003 - DNA, 19 bp, Homo sapiens
gatccctgtgttgtctcta

SEQ ID NO: 2450004 - DNA, 15 bp, Homo sapiens
gatcctcctgcagac

SEQ ID NO: 2450005 - DNA, 21 bp, Homo sapiens
gatcctcctgcagaccacgcc

SEQ ID NO: 2450006 - DNA, 12 bp, Homo sapiens
gatcctggaggc

SEQ ID NO: 2450007 - DNA, 19 bp, Homo sapiens
gatcctgtgtggagaggga

SEQ ID NO: 2450008 - DNA, 12 bp, Homo sapiens
gatcgccttccc

SEQ ID NO: 2450009 - DNA, 13 bp, Homo sapiens
gatcgccttcccc

SEQ ID NO: 2450010 - DNA, 16 bp, Homo sapiens
gatcgccttccccacc

SEQ ID NO: 2450011 - DNA, 20 bp, Homo sapiens
gatctacttctgtaattgtg

SEQ ID NO: 2450012 - DNA, 20 bp, Homo sapiens
gatctactttccctctggga

SEQ ID NO: 2450013 - DNA, 14 bp, Homo sapiens
gatctatttcatgt

SEQ ID NO: 2450014 - DNA, 16 bp, Homo sapiens
gatctatttcatgttt

SEQ ID NO: 2450015 - DNA, 14 bp, Homo sapiens
gatctcaccaggca

SEQ ID NO: 2450016 - DNA, 15 bp, Homo sapiens
gatctccctgagatg

SEQ ID NO: 2450017 - DNA, 11 bp, Homo sapiens
gatctctgaag

SEQ ID NO: 2450018 - DNA, 22 bp, Homo sapiens
gatctgagtcagagccatgtct

SEQ ID NO: 2450019 - DNA, 23 bp, Homo sapiens
gatctgatagggtttgtgacagg

SEQ ID NO: 2450020 - DNA, 15 bp, Homo sapiens
gatctggaacccaga

SEQ ID NO: 2450021 - DNA, 16 bp, Homo sapiens
gatctggaacccagac

SEQ ID NO: 2450022 - DNA, 12 bp, Homo sapiens
gatctggaacct

SEQ ID NO: 2450023 - DNA, 17 bp, Homo sapiens
gcagaggcctgcagggc

SEQ ID NO: 2450024 - DNA, 21 bp, Homo sapiens
gcagaggcctgcagggcctct

SEQ ID NO: 2450025 - DNA, 17 bp, Homo sapiens
gcagaggcctgggctgg

SEQ ID NO: 2450026 - DNA, 12 bp, Homo sapiens
gcagagggctgg

SEQ ID NO: 2450027 - DNA, 13 bp, Homo sapiens
gcagagggctgga

SEQ ID NO: 2450028 - DNA, 14 bp, Homo sapiens
gcagagggctggag

SEQ ID NO: 2450029 - DNA, 16 bp, Homo sapiens
gcagagggctggaggc

SEQ ID NO: 2450030 - DNA, 18 bp, Homo sapiens
gcagagggctggaggccc

SEQ ID NO: 2450031 - DNA, 21 bp, Homo sapiens
gcagagggctggaggcccagg

SEQ ID NO: 2450032 - DNA, 18 bp, Homo sapiens
gcagagttacagttctgt

SEQ ID NO: 2450033 - DNA, 22 bp, Homo sapiens
gcagatgacctcgtactcagga

SEQ ID NO: 2450034 - DNA, 16 bp, Homo sapiens
gcagatgtaggaggga

SEQ ID NO: 2450035 - DNA, 17 bp, Homo sapiens
gcagatgtaggagggac

SEQ ID NO: 2450036 - DNA, 17 bp, Homo sapiens
gcagattcagaaatgag

SEQ ID NO: 2450037 - DNA, 19 bp, Homo sapiens
gcagcaacttgtcctagca

SEQ ID NO: 2450038 - DNA, 22 bp, Homo sapiens
gcagcaaggcccgagcagctga

SEQ ID NO: 2450039 - DNA, 18 bp, Homo sapiens
gcagcaccgttctgtgca

SEQ ID NO: 2450040 - DNA, 18 bp, Homo sapiens
gcagcacctcctcagcct

SEQ ID NO: 2450041 - DNA, 15 bp, Homo sapiens
gcagcagccagccct

SEQ ID NO: 2450042 - DNA, 17 bp, Homo sapiens
gcagcagccagccctgc

SEQ ID NO: 2450043 - DNA, 18 bp, Homo sapiens
gcagcagccagccctgcc

SEQ ID NO: 2450044 - DNA, 20 bp, Homo sapiens
gcagcagccagccctgcctg

SEQ ID NO: 2450045 - DNA, 23 bp, Homo sapiens
gcagcagccagccctgcctggag

SEQ ID NO: 2450046 - DNA, 13 bp, Homo sapiens
gcagcagccccca

SEQ ID NO: 2450047 - DNA, 19 bp, Homo sapiens
gcagcagggctaccctgag

SEQ ID NO: 2450048 - DNA, 20 bp, Homo sapiens
gcagcagggctaccctgagc

SEQ ID NO: 2450049 - DNA, 14 bp, Homo sapiens
gcagcaggggttgg

SEQ ID NO: 2450050 - DNA, 15 bp, Homo sapiens
gcagcagtgtgaggc

SEQ ID NO: 2450051 - DNA, 19 bp, Homo sapiens
gcagcagtgtgaggccagg

SEQ ID NO: 2450052 - DNA, 20 bp, Homo sapiens
gcagcagtgtgaggccaggg

SEQ ID NO: 2450053 - DNA, 21 bp, Homo sapiens
gcagcagtgtgaggccagggc

SEQ ID NO: 2450054 - DNA, 22 bp, Homo sapiens
gcagcatctctaccttctcccc

SEQ ID NO: 2450055 - DNA, 22 bp, Homo sapiens
gcagccacacttctcaggacac

SEQ ID NO: 2450056 - DNA, 12 bp, Homo sapiens
gcagccaccctg

SEQ ID NO: 2450057 - DNA, 13 bp, Homo sapiens
gcagccagcatct

SEQ ID NO: 2450058 - DNA, 13 bp, Homo sapiens
gcagccagccctg

SEQ ID NO: 2450059 - DNA, 15 bp, Homo sapiens
gcagccagccctgcc

SEQ ID NO: 2450060 - DNA, 21 bp, Homo sapiens
gcagccagccctgcctggagg

SEQ ID NO: 2450061 - DNA, 12 bp, Homo sapiens
gcagcccagcca

SEQ ID NO: 2450062 - DNA, 14 bp, Homo sapiens
gcagcccaggaagt

SEQ ID NO: 2450063 - DNA, 22 bp, Homo sapiens
gcagccccacaccagggccagc

SEQ ID NO: 2450064 - DNA, 14 bp, Homo sapiens
gcagccccacccag

SEQ ID NO: 2450065 - DNA, 23 bp, Homo sapiens
gcagcccccagctcccacctccc

SEQ ID NO: 2450066 - DNA, 23 bp, Homo sapiens
gcagccgaggtccctgctgccag

SEQ ID NO: 2450067 - DNA, 19 bp, Homo sapiens
gcagccggcacagggtctg

SEQ ID NO: 2450068 - DNA, 15 bp, Homo sapiens
gcagcctcagagaca

SEQ ID NO: 2450069 - DNA, 23 bp, Homo sapiens
gcagcctcagagacatcagccct

SEQ ID NO: 2450070 - DNA, 16 bp, Homo sapiens
gcagcctcgcccctgg

SEQ ID NO: 2450071 - DNA, 19 bp, Homo sapiens
gcagcctcgcccctggcag

SEQ ID NO: 2450072 - DNA, 20 bp, Homo sapiens
gcagcctcgcccctggcaga

SEQ ID NO: 2450073 - DNA, 16 bp, Homo sapiens
gcagcctctccccagg

SEQ ID NO: 2450074 - DNA, 17 bp, Homo sapiens
gcagcctggggctggcc

SEQ ID NO: 2450075 - DNA, 12 bp, Homo sapiens
gcagccttgtga

SEQ ID NO: 2450076 - DNA, 17 bp, Homo sapiens
gcagcctttgcctcccc

SEQ ID NO: 2450077 - DNA, 16 bp, Homo sapiens
gcagcgaccgccccct

SEQ ID NO: 2450078 - DNA, 17 bp, Homo sapiens
gcagcgaccgccccctc

SEQ ID NO: 2450079 - DNA, 14 bp, Homo sapiens
gcagcgccaggctg

SEQ ID NO: 2450080 - DNA, 23 bp, Homo sapiens
gcagctcaagcagcgaccgcccc

SEQ ID NO: 2450081 - DNA, 15 bp, Homo sapiens
gcagctgagcagggc

SEQ ID NO: 2450082 - DNA, 16 bp, Homo sapiens
gcagctgagcagggcc

SEQ ID NO: 2450083 - DNA, 19 bp, Homo sapiens
gcagctgagcagggccggg

SEQ ID NO: 2450084 - DNA, 20 bp, Homo sapiens
gcagctgagcagggccgggg

SEQ ID NO: 2450085 - DNA, 17 bp, Homo sapiens
gcagctgccaggagcac

SEQ ID NO: 2450086 - DNA, 17 bp, Homo sapiens
gcagcttctgccccctg

SEQ ID NO: 2450087 - DNA, 22 bp, Homo sapiens
gcagcttctgccccctgcagaa

SEQ ID NO: 2450088 - DNA, 19 bp, Homo sapiens
gcagcttgtagccagccgg

SEQ ID NO: 2450089 - DNA, 22 bp, Homo sapiens
gcagcttgtagccagccggggc

SEQ ID NO: 2450090 - DNA, 19 bp, Homo sapiens
gcagctttagaatcccagc

SEQ ID NO: 2450091 - DNA, 16 bp, Homo sapiens
gcagcttttaaaagat

SEQ ID NO: 2450092 - DNA, 15 bp, Homo sapiens
gcaggaaggagctgc

SEQ ID NO: 2450093 - DNA, 20 bp, Homo sapiens
gcaggaaggagctgcctgga

SEQ ID NO: 2450094 - DNA, 11 bp, Homo sapiens
gcaggaaggct

SEQ ID NO: 2450095 - DNA, 23 bp, Homo sapiens
gcaggactccaggcccaaggctc

SEQ ID NO: 2450096 - DNA, 13 bp, Homo sapiens
gcaggactgatgt

SEQ ID NO: 2450097 - DNA, 14 bp, Homo sapiens
gcaggactgatgtc

SEQ ID NO: 2450098 - DNA, 18 bp, Homo sapiens
gcaggactgatgtctcct

SEQ ID NO: 2450099 - DNA, 19 bp, Homo sapiens
gcaggactgatgtctccta

SEQ ID NO: 2450100 - DNA, 23 bp, Homo sapiens
gcaggactgatgtctcctaagca

SEQ ID NO: 2450101 - DNA, 14 bp, Homo sapiens
gcaggaggggggag

SEQ ID NO: 2450102 - DNA, 14 bp, Homo sapiens
gcaggagtagctga

SEQ ID NO: 2450103 - DNA, 15 bp, Homo sapiens
gcaggagtagctgag

SEQ ID NO: 2450104 - DNA, 16 bp, Homo sapiens
gcaggagtagctgagc

SEQ ID NO: 2450105 - DNA, 17 bp, Homo sapiens
gcaggatctcaccaggc

SEQ ID NO: 2450106 - DNA, 22 bp, Homo sapiens
gcaggattgaaaatgtccagga

SEQ ID NO: 2450107 - DNA, 20 bp, Homo sapiens
gcaggattggggaagagagc

SEQ ID NO: 2450108 - DNA, 20 bp, Homo sapiens
gcaggcagaggcccaggctg

SEQ ID NO: 2450109 - DNA, 21 bp, Homo sapiens
gcaggcagaggcccaggctgc

SEQ ID NO: 2450110 - DNA, 19 bp, Homo sapiens
gcaggcagccagcatctgg

SEQ ID NO: 2450111 - DNA, 15 bp, Homo sapiens
gcaggcaggctccca

SEQ ID NO: 2450112 - DNA, 15 bp, Homo sapiens
gcaggcagggctctc

SEQ ID NO: 2450113 - DNA, 16 bp, Homo sapiens
gcaggcagggctctcc

SEQ ID NO: 2450114 - DNA, 18 bp, Homo sapiens
gcaggccacctggctctc

SEQ ID NO: 2450115 - DNA, 22 bp, Homo sapiens
gcaggccagctgtggttttctt

SEQ ID NO: 2450116 - DNA, 14 bp, Homo sapiens
gcaggccctggcct

SEQ ID NO: 2450117 - DNA, 14 bp, Homo sapiens
gcaggctcccaggg

SEQ ID NO: 2450118 - DNA, 22 bp, Homo sapiens
gcaggctcccagggacacctgg

SEQ ID NO: 2450119 - DNA, 23 bp, Homo sapiens
gcaggctcccagggacacctggg

SEQ ID NO: 2450120 - DNA, 10 bp, Homo sapiens
gcaggctggg

SEQ ID NO: 2450121 - DNA, 11 bp, Homo sapiens
gcaggctgggc

SEQ ID NO: 2450122 - DNA, 12 bp, Homo sapiens
gcaggctgggcc

SEQ ID NO: 2450123 - DNA, 19 bp, Homo sapiens
gcagggagcggccggccag

SEQ ID NO: 2450124 - DNA, 21 bp, Homo sapiens
gcagggccccaggcattgcca

SEQ ID NO: 2450125 - DNA, 14 bp, Homo sapiens
gcagggccggggaa

SEQ ID NO: 2450126 - DNA, 13 bp, Homo sapiens
gcagggcctctgt

SEQ ID NO: 2450127 - DNA, 12 bp, Homo sapiens
gccctggggcct

SEQ ID NO: 2450128 - DNA, 18 bp, Homo sapiens
gccctggggcctgtactg

SEQ ID NO: 2450129 - DNA, 21 bp, Homo sapiens
gccctggggcctgtactgcct

SEQ ID NO: 2450130 - DNA, 22 bp, Homo sapiens
gccctggggcctgtactgcctg

SEQ ID NO: 2450131 - DNA, 15 bp, Homo sapiens
gccctggtggccctc

SEQ ID NO: 2450132 - DNA, 18 bp, Homo sapiens
gccctggtggccctctcc

SEQ ID NO: 2450133 - DNA, 22 bp, Homo sapiens
gccctgtcagcatgaatttgta

SEQ ID NO: 2450134 - DNA, 13 bp, Homo sapiens
gccctgtcctggt

SEQ ID NO: 2450135 - DNA, 21 bp, Homo sapiens
gccctgtgcaacctcttggcc

SEQ ID NO: 2450136 - DNA, 12 bp, Homo sapiens
gcccttcctgga

SEQ ID NO: 2450137 - DNA, 16 bp, Homo sapiens
gcccttcctggacagc

SEQ ID NO: 2450138 - DNA, 17 bp, Homo sapiens
gcccttcctggacagct

SEQ ID NO: 2450139 - DNA, 23 bp, Homo sapiens
gcccttcctggacagctgtgcct

SEQ ID NO: 2450140 - DNA, 17 bp, Homo sapiens
gcccttgagtccccatt

SEQ ID NO: 2450141 - DNA, 20 bp, Homo sapiens
gcccttgggggtcctcctcc

SEQ ID NO: 2450142 - DNA, 22 bp, Homo sapiens
gcccttgggggtcctcctccag

SEQ ID NO: 2450143 - DNA, 19 bp, Homo sapiens
gcccttgtttggggcagga

SEQ ID NO: 2450144 - DNA, 19 bp, Homo sapiens
gccctttcggatccaggga

SEQ ID NO: 2450145 - DNA, 15 bp, Homo sapiens
gccgaagctaacagg

SEQ ID NO: 2450146 - DNA, 19 bp, Homo sapiens
gccgaagctaacagggaag

SEQ ID NO: 2450147 - DNA, 20 bp, Homo sapiens
gccgaccccctctccctgca

SEQ ID NO: 2450148 - DNA, 23 bp, Homo sapiens
gccgaccccctctccctgcatgg

SEQ ID NO: 2450149 - DNA, 24 bp, Homo sapiens
gccgaccccctctccctgcatggc

SEQ ID NO: 2450150 - DNA, 15 bp, Homo sapiens
gccgagcaggaggcc

SEQ ID NO: 2450151 - DNA, 18 bp, Homo sapiens
gccgagtccaagctggga

SEQ ID NO: 2450152 - DNA, 17 bp, Homo sapiens
gccgatatactctagat

SEQ ID NO: 2450153 - DNA, 17 bp, Homo sapiens
gccgccccctgcccccc

SEQ ID NO: 2450154 - DNA, 13 bp, Homo sapiens
gccgccgcctctt

SEQ ID NO: 2450155 - DNA, 15 bp, Homo sapiens
gccgcgggacagcca

SEQ ID NO: 2450156 - DNA, 12 bp, Homo sapiens
gccgctgccacg

SEQ ID NO: 2450157 - DNA, 19 bp, Homo sapiens
gccgcttggcgatgccagc

SEQ ID NO: 2450158 - DNA, 21 bp, Homo sapiens
gccggcacagggtctgctctt

SEQ ID NO: 2450159 - DNA, 14 bp, Homo sapiens
gccggccagcccct

SEQ ID NO: 2450160 - DNA, 19 bp, Homo sapiens
gccggctgtgcagtcctgg

SEQ ID NO: 2450161 - DNA, 21 bp, Homo sapiens
gccggctgtgcagtcctgggt

SEQ ID NO: 2450162 - DNA, 20 bp, Homo sapiens
gccgggaccaccctgagccg

SEQ ID NO: 2450163 - DNA, 20 bp, Homo sapiens
gccggggaactggccaagct

SEQ ID NO: 2450164 - DNA, 14 bp, Homo sapiens
gccgggtctgcctc

SEQ ID NO: 2450165 - DNA, 14 bp, Homo sapiens
gccgtaatttaact

SEQ ID NO: 2450166 - DNA, 16 bp, Homo sapiens
gccgtctccaggggct

SEQ ID NO: 2450167 - DNA, 21 bp, Homo sapiens
gccgtctccaggggctgcttc

SEQ ID NO: 2450168 - DNA, 23 bp, Homo sapiens
gccgtctccaggggctgcttcct

SEQ ID NO: 2450169 - DNA, 14 bp, Homo sapiens
gccgtgacgtctgg

SEQ ID NO: 2450170 - DNA, 22 bp, Homo sapiens
gccgtggattgcacgtggcctc

SEQ ID NO: 2450171 - DNA, 23 bp, Homo sapiens
gccgtggattgcacgtggcctct

SEQ ID NO: 2450172 - DNA, 20 bp, Homo sapiens
gccgtggctgctgtgggaaa

SEQ ID NO: 2450173 - DNA, 17 bp, Homo sapiens
gccgtgggccccaccct

SEQ ID NO: 2450174 - DNA, 21 bp, Homo sapiens
gcctacagaacttcagaaaga

SEQ ID NO: 2450175 - DNA, 21 bp, Homo sapiens
gcctaccccgcagacaccttg

SEQ ID NO: 2450176 - DNA, 12 bp, Homo sapiens
gcctagaaacaa

SEQ ID NO: 2450177 - DNA, 22 bp, Homo sapiens
gcctagaccagcagacagagcc

SEQ ID NO: 2450178 - DNA, 17 bp, Homo sapiens
gcctaggcctgggcagt

SEQ ID NO: 2450179 - DNA, 19 bp, Homo sapiens
gcctaggcctgggcagtgg

SEQ ID NO: 2450180 - DNA, 12 bp, Homo sapiens
gcctaggctgca

SEQ ID NO: 2450181 - DNA, 14 bp, Homo sapiens
gcctaggctgcatt

SEQ ID NO: 2450182 - DNA, 22 bp, Homo sapiens
gcctagtgaaggcttctctctg

SEQ ID NO: 2450183 - DNA, 23 bp, Homo sapiens
gcctagtgaaggcttctctctgt

SEQ ID NO: 2450184 - DNA, 14 bp, Homo sapiens
gcctatggagagcc

SEQ ID NO: 2450185 - DNA, 16 bp, Homo sapiens
gcctatggagagccct

SEQ ID NO: 2450186 - DNA, 19 bp, Homo sapiens
gcctatggagagccctggg

SEQ ID NO: 2450187 - DNA, 18 bp, Homo sapiens
gcctattgctagagctcc

SEQ ID NO: 2450188 - DNA, 20 bp, Homo sapiens
gcctattgctagagctcctc

SEQ ID NO: 2450189 - DNA, 15 bp, Homo sapiens
gcctcaaaggcccgc

SEQ ID NO: 2450190 - DNA, 14 bp, Homo sapiens
gcctcaatgccagt

SEQ ID NO: 2450191 - DNA, 15 bp, Homo sapiens
gcctcacccacccct

SEQ ID NO: 2450192 - DNA, 17 bp, Homo sapiens
gcctcacccacccctgc

SEQ ID NO: 2450193 - DNA, 19 bp, Homo sapiens
gcctcacccacccctgcac

SEQ ID NO: 2450194 - DNA, 19 bp, Homo sapiens
gcctcagaagtgcatctgg

SEQ ID NO: 2450195 - DNA, 18 bp, Homo sapiens
gcctcagattccttccca

SEQ ID NO: 2450196 - DNA, 22 bp, Homo sapiens
gcctcagattccttcccatgga

SEQ ID NO: 2450197 - DNA, 23 bp, Homo sapiens
gcctcaggactgggagcccccag

SEQ ID NO: 2450198 - DNA, 17 bp, Homo sapiens
gcctcagtgaccctggc

SEQ ID NO: 2450199 - DNA, 18 bp, Homo sapiens
gcctcatgctggagggag

SEQ ID NO: 2450200 - DNA, 13 bp, Homo sapiens
gcctcatgtggct

SEQ ID NO: 2450201 - DNA, 14 bp, Homo sapiens
gcctcatgtggctg

SEQ ID NO: 2450202 - DNA, 15 bp, Homo sapiens
gcctcatgtggctgg

SEQ ID NO: 2450203 - DNA, 16 bp, Homo sapiens
gcctcatgtggctgga

SEQ ID NO: 2450204 - DNA, 17 bp, Homo sapiens
gcctcatgtggctggaa

SEQ ID NO: 2450205 - DNA, 15 bp, Homo sapiens
gcctcatttttttcc

SEQ ID NO: 2450206 - DNA, 21 bp, Homo sapiens
gcctcatttttttccttgcaa

SEQ ID NO: 2450207 - DNA, 22 bp, Homo sapiens
gcctccaattttttaagtgaaa

SEQ ID NO: 2450208 - DNA, 20 bp, Homo sapiens
gcctccagccgccggctgtg

SEQ ID NO: 2450209 - DNA, 15 bp, Homo sapiens
gcctccatgggcccc

SEQ ID NO: 2450210 - DNA, 19 bp, Homo sapiens
gcctccatgggccccaggg

SEQ ID NO: 2450211 - DNA, 11 bp, Homo sapiens
gcctcccccac

SEQ ID NO: 2450212 - DNA, 13 bp, Homo sapiens
gcctcccccactt

SEQ ID NO: 2450213 - DNA, 21 bp, Homo sapiens
gcctcccctctccttcctgtg

SEQ ID NO: 2450214 - DNA, 18 bp, Homo sapiens
gcctccctgaagcctttg

SEQ ID NO: 2450215 - DNA, 14 bp, Homo sapiens
gcctcccttgtggc

SEQ ID NO: 2450216 - DNA, 18 bp, Homo sapiens
gcctccgtcccctgccca

SEQ ID NO: 2450217 - DNA, 15 bp, Homo sapiens
gcctcctcatcccgt

SEQ ID NO: 2450218 - DNA, 17 bp, Homo sapiens
gcctcctcatcccgtgt

SEQ ID NO: 2450219 - DNA, 12 bp, Homo sapiens
gcctcctccctc

SEQ ID NO: 2450220 - DNA, 21 bp, Homo sapiens
gcctcctccctccctctccga

SEQ ID NO: 2450221 - DNA, 13 bp, Homo sapiens
gcctcctgccggc

SEQ ID NO: 2450222 - DNA, 20 bp, Homo sapiens
gcctcctgccggctccttgg

SEQ ID NO: 2450223 - DNA, 16 bp, Homo sapiens
gcctcgaaacacagaa

SEQ ID NO: 2450224 - DNA, 16 bp, Homo sapiens
gcctcgcccatcccct

SEQ ID NO: 2450225 - DNA, 17 bp, Homo sapiens
gcctcgcccctggcaga

SEQ ID NO: 2450226 - DNA, 24 bp, Homo sapiens
gcctcgctccccactctgctctga

SEQ ID NO: 2450227 - DNA, 15 bp, Homo sapiens
gcctctactgggaag

SEQ ID NO: 2450228 - DNA, 20 bp, Homo sapiens
gcctctcccaggcaggggcc

SEQ ID NO: 2450229 - DNA, 18 bp, Homo sapiens
gcctctccccaggtccag

SEQ ID NO: 2450230 - DNA, 20 bp, Homo sapiens
gctgctcggggtgcacagga

SEQ ID NO: 2450231 - DNA, 22 bp, Homo sapiens
gctgctcggggtgcacaggagg

SEQ ID NO: 2450232 - DNA, 15 bp, Homo sapiens
gctgctgagaacctg

SEQ ID NO: 2450233 - DNA, 18 bp, Homo sapiens
gctgctgagaacctggcc

SEQ ID NO: 2450234 - DNA, 19 bp, Homo sapiens
gctgctgagaacctggcct

SEQ ID NO: 2450235 - DNA, 20 bp, Homo sapiens
gctgctgagaacctggcctt

SEQ ID NO: 2450236 - DNA, 22 bp, Homo sapiens
gctgctgctcttggctggaccc

SEQ ID NO: 2450237 - DNA, 15 bp, Homo sapiens
gctgctgctgggctc

SEQ ID NO: 2450238 - DNA, 13 bp, Homo sapiens
gctgctgggctca

SEQ ID NO: 2450239 - DNA, 19 bp, Homo sapiens
gctgctgggctcagtgaag

SEQ ID NO: 2450240 - DNA, 18 bp, Homo sapiens
gctgctggggaagacagt

SEQ ID NO: 2450241 - DNA, 19 bp, Homo sapiens
gctgctggggaagacagtg

SEQ ID NO: 2450242 - DNA, 18 bp, Homo sapiens
gctgctgtccctccccct

SEQ ID NO: 2450243 - DNA, 13 bp, Homo sapiens
gctgctgtctggg

SEQ ID NO: 2450244 - DNA, 19 bp, Homo sapiens
gctgcttccctgaagctcc

SEQ ID NO: 2450245 - DNA, 17 bp, Homo sapiens
gctgcttcctcctggaa

SEQ ID NO: 2450246 - DNA, 21 bp, Homo sapiens
gctgcttctcccaggcaaggc

SEQ ID NO: 2450247 - DNA, 22 bp, Homo sapiens
gctgcttctcccaggcaaggct

SEQ ID NO: 2450248 - DNA, 23 bp, Homo sapiens
gctgcttctcccaggcaaggctg

SEQ ID NO: 2450249 - DNA, 12 bp, Homo sapiens
gctggacccagc

SEQ ID NO: 2450250 - DNA, 13 bp, Homo sapiens
gctggaggagccc

SEQ ID NO: 2450251 - DNA, 17 bp, Homo sapiens
gctggaggagcccaggc

SEQ ID NO: 2450252 - DNA, 15 bp, Homo sapiens
gctggatgagctccc

SEQ ID NO: 2450253 - DNA, 23 bp, Homo sapiens
gctggatgagctcccacaagcct

SEQ ID NO: 2450254 - DNA, 14 bp, Homo sapiens
gctggcaacacaga

SEQ ID NO: 2450255 - DNA, 19 bp, Homo sapiens
gctggcaacacagaggcag

SEQ ID NO: 2450256 - DNA, 16 bp, Homo sapiens
gctggccagcgagcgc

SEQ ID NO: 2450257 - DNA, 18 bp, Homo sapiens
gctggccatggagaaagc

SEQ ID NO: 2450258 - DNA, 16 bp, Homo sapiens
gctggcccagggccca

SEQ ID NO: 2450259 - DNA, 17 bp, Homo sapiens
gctggcccagggcccag

SEQ ID NO: 2450260 - DNA, 20 bp, Homo sapiens
gctggcccagggcccagagc

SEQ ID NO: 2450261 - DNA, 17 bp, Homo sapiens
gctggccgctgtgccag

SEQ ID NO: 2450262 - DNA, 19 bp, Homo sapiens
gctggccgctgtgccaggc

SEQ ID NO: 2450263 - DNA, 21 bp, Homo sapiens
gctggcctcacccacccctgc

SEQ ID NO: 2450264 - DNA, 13 bp, Homo sapiens
gctggcctctgcg

SEQ ID NO: 2450265 - DNA, 22 bp, Homo sapiens
gctggctccagatgcagggcag

SEQ ID NO: 2450266 - DNA, 23 bp, Homo sapiens
gctggctccagatgcagggcagt

SEQ ID NO: 2450267 - DNA, 12 bp, Homo sapiens
gctggctctgag

SEQ ID NO: 2450268 - DNA, 15 bp, Homo sapiens
gctggctgagggcag

SEQ ID NO: 2450269 - DNA, 12 bp, Homo sapiens
gctggctggcct

SEQ ID NO: 2450270 - DNA, 22 bp, Homo sapiens
gctgggaacagtgtgcaaggca

SEQ ID NO: 2450271 - DNA, 14 bp, Homo sapiens
gctgggactacagg

SEQ ID NO: 2450272 - DNA, 15 bp, Homo sapiens
gctgggagaggcagc

SEQ ID NO: 2450273 - DNA, 22 bp, Homo sapiens
gctgggaggaaggacttccctg

SEQ ID NO: 2450274 - DNA, 18 bp, Homo sapiens
gctgggatagaggggtca

SEQ ID NO: 2450275 - DNA, 22 bp, Homo sapiens
gctgggcctggtctcaccctgg

SEQ ID NO: 2450276 - DNA, 14 bp, Homo sapiens
gctgggctcagtga

SEQ ID NO: 2450277 - DNA, 12 bp, Homo sapiens
gctggggcctgg

SEQ ID NO: 2450278 - DNA, 13 bp, Homo sapiens
gctggggcctggg

SEQ ID NO: 2450279 - DNA, 15 bp, Homo sapiens
gctggggcctgggac

SEQ ID NO: 2450280 - DNA, 14 bp, Homo sapiens
gctggggtcccagc

SEQ ID NO: 2450281 - DNA, 16 bp, Homo sapiens
gctggggtcccagcag

SEQ ID NO: 2450282 - DNA, 17 bp, Homo sapiens
gctggggtcccagcagc

SEQ ID NO: 2450283 - DNA, 13 bp, Homo sapiens
gctggggtgcagg

SEQ ID NO: 2450284 - DNA, 13 bp, Homo sapiens
gctgggtcaggca

SEQ ID NO: 2450285 - DNA, 23 bp, Homo sapiens
gctgggtccatatcacacacatt

SEQ ID NO: 2450286 - DNA, 16 bp, Homo sapiens
gctgggttcatttgtg

SEQ ID NO: 2450287 - DNA, 24 bp, Homo sapiens
gctggtatctcagaaagtgcctga

SEQ ID NO: 2450288 - DNA, 20 bp, Homo sapiens
gctggtcctatggcctcatg

SEQ ID NO: 2450289 - DNA, 20 bp, Homo sapiens
gctggtctcaaactcctgac

SEQ ID NO: 2450290 - DNA, 20 bp, Homo sapiens
gctggtgcggctggccatgg

SEQ ID NO: 2450291 - DNA, 21 bp, Homo sapiens
gctggtgggctggccgctgtg

SEQ ID NO: 2450292 - DNA, 18 bp, Homo sapiens
gctggtgggtgcctaggc

SEQ ID NO: 2450293 - DNA, 17 bp, Homo sapiens
gctggtgtagctacaga

SEQ ID NO: 2450294 - DNA, 20 bp, Homo sapiens
gctggtgtagctacagagaa

SEQ ID NO: 2450295 - DNA, 23 bp, Homo sapiens
gctggtgtagctacagagaaacc

SEQ ID NO: 2450296 - DNA, 17 bp, Homo sapiens
gctggtgtggtacagag

SEQ ID NO: 2450297 - DNA, 16 bp, Homo sapiens
gctggtgttaacagaa

SEQ ID NO: 2450298 - DNA, 17 bp, Homo sapiens
gctggtgttaacagaag

SEQ ID NO: 2450299 - DNA, 21 bp, Homo sapiens
gctggtgttaacagaagggag

SEQ ID NO: 2450300 - DNA, 15 bp, Homo sapiens
gctgtaaggctctag

SEQ ID NO: 2450301 - DNA, 16 bp, Homo sapiens
gctgtaaggctctaga

SEQ ID NO: 2450302 - DNA, 23 bp, Homo sapiens
gctgtaaggctctagatcataag

SEQ ID NO: 2450303 - DNA, 16 bp, Homo sapiens
gctgtacccagtttct

SEQ ID NO: 2450304 - DNA, 12 bp, Homo sapiens
gctgtattgtct

SEQ ID NO: 2450305 - DNA, 15 bp, Homo sapiens
gctgtattgtctgaa

SEQ ID NO: 2450306 - DNA, 13 bp, Homo sapiens
gctgtcacaggcg

SEQ ID NO: 2450307 - DNA, 21 bp, Homo sapiens
gctgtcagtgtatggggcagc

SEQ ID NO: 2450308 - DNA, 22 bp, Homo sapiens
gctgtcatctgtgcactgccca

SEQ ID NO: 2450309 - DNA, 21 bp, Homo sapiens
gctgtccccccactccctcac

SEQ ID NO: 2450310 - DNA, 14 bp, Homo sapiens
gctgtcctttctag

SEQ ID NO: 2450311 - DNA, 14 bp, Homo sapiens
gctgtcctttttcc

SEQ ID NO: 2450312 - DNA, 22 bp, Homo sapiens
gctgtgacctgctgagctctga

SEQ ID NO: 2450313 - DNA, 23 bp, Homo sapiens
gctgtgacctgctgagctctgag

SEQ ID NO: 2450314 - DNA, 15 bp, Homo sapiens
gctgtgaggctgtcc

SEQ ID NO: 2450315 - DNA, 19 bp, Homo sapiens
gctgtgagttctccctgta

SEQ ID NO: 2450316 - DNA, 21 bp, Homo sapiens
gctgtgccaggcgaggccctt

SEQ ID NO: 2450317 - DNA, 16 bp, Homo sapiens
gctgtgcgcccagggc

SEQ ID NO: 2450318 - DNA, 23 bp, Homo sapiens
gctgtggcaggccagctgtggtt

SEQ ID NO: 2450319 - DNA, 23 bp, Homo sapiens
gctgtggtgtgtccccctctgtc

SEQ ID NO: 2450320 - DNA, 16 bp, Homo sapiens
gctgtgtaagatttgt

SEQ ID NO: 2450321 - DNA, 23 bp, Homo sapiens
gctgtgtaagatttgtttttaaa

SEQ ID NO: 2450322 - DNA, 22 bp, Homo sapiens
gctgtgtccaaaaccgccagct

SEQ ID NO: 2450323 - DNA, 23 bp, Homo sapiens
gctgtgtttggctttcagggagg

SEQ ID NO: 2450324 - DNA, 13 bp, Homo sapiens
gctgttaaataca

SEQ ID NO: 2450325 - DNA, 16 bp, Homo sapiens
gctgttaaatacagga

SEQ ID NO: 2450326 - DNA, 22 bp, Homo sapiens
gctgttaaatacaggaaacagt

SEQ ID NO: 2450327 - DNA, 19 bp, Homo sapiens
gctgttttgttatataatt

SEQ ID NO: 2450328 - DNA, 23 bp, Homo sapiens
gctgttttgttgacattctgaat

SEQ ID NO: 2450329 - DNA, 17 bp, Homo sapiens
gcttaaaataagcaggt

SEQ ID NO: 2450330 - DNA, 21 bp, Homo sapiens
gcttaaaataagcaggtggat

SEQ ID NO: 2450331 - DNA, 22 bp, Homo sapiens
gcttaaacccatattgtaaaac

SEQ ID NO: 2450332 - DNA, 16 bp, Homo sapiens
gcttagagttggccat

SEQ ID NO: 2450333 - DNA, 20 bp, Homo sapiens
ggagtggtttaggctatttg

SEQ ID NO: 2450334 - DNA, 13 bp, Homo sapiens
ggagtgtcctctt

SEQ ID NO: 2450335 - DNA, 20 bp, Homo sapiens
ggagtgtcctcttccctctc

SEQ ID NO: 2450336 - DNA, 24 bp, Homo sapiens
ggagtgtcctcttccctctctgca

SEQ ID NO: 2450337 - DNA, 16 bp, Homo sapiens
ggagtgtgcgtggtgg

SEQ ID NO: 2450338 - DNA, 12 bp, Homo sapiens
ggagtgttcccc

SEQ ID NO: 2450339 - DNA, 20 bp, Homo sapiens
ggagtgttccccttccactg

SEQ ID NO: 2450340 - DNA, 22 bp, Homo sapiens
ggagttagggactgaccagcag

SEQ ID NO: 2450341 - DNA, 17 bp, Homo sapiens
ggagttgatctggaacc

SEQ ID NO: 2450342 - DNA, 22 bp, Homo sapiens
ggagttgatctggaacccagac

SEQ ID NO: 2450343 - DNA, 16 bp, Homo sapiens
ggagttttttgtacca

SEQ ID NO: 2450344 - DNA, 18 bp, Homo sapiens
ggatagatgctggcccag

SEQ ID NO: 2450345 - DNA, 20 bp, Homo sapiens
ggatagatgctggcccaggg

SEQ ID NO: 2450346 - DNA, 21 bp, Homo sapiens
ggataggccttcattaacaaa

SEQ ID NO: 2450347 - DNA, 15 bp, Homo sapiens
ggatcagcgtggcct

SEQ ID NO: 2450348 - DNA, 17 bp, Homo sapiens
ggatccaaactgatcca

SEQ ID NO: 2450349 - DNA, 13 bp, Homo sapiens
ggatccagggagg

SEQ ID NO: 2450350 - DNA, 14 bp, Homo sapiens
ggatctatttcatg

SEQ ID NO: 2450351 - DNA, 16 bp, Homo sapiens
ggatctcaccaggcag

SEQ ID NO: 2450352 - DNA, 22 bp, Homo sapiens
ggatctcaccaggcagcctctg

SEQ ID NO: 2450353 - DNA, 24 bp, Homo sapiens
ggatctcattggacccttccatgg

SEQ ID NO: 2450354 - DNA, 23 bp, Homo sapiens
ggatgagctcccacaagcctgag

SEQ ID NO: 2450355 - DNA, 22 bp, Homo sapiens
ggatgccaatattaaatctgct

SEQ ID NO: 2450356 - DNA, 11 bp, Homo sapiens
ggatgcctcct

SEQ ID NO: 2450357 - DNA, 14 bp, Homo sapiens
ggatggacatcttg

SEQ ID NO: 2450358 - DNA, 16 bp, Homo sapiens
ggatggccccagcaca

SEQ ID NO: 2450359 - DNA, 22 bp, Homo sapiens
ggatgggggaactcagatccag

SEQ ID NO: 2450360 - DNA, 16 bp, Homo sapiens
ggatggtagttttttc

SEQ ID NO: 2450361 - DNA, 20 bp, Homo sapiens
ggatggtagttttttcatct

SEQ ID NO: 2450362 - DNA, 19 bp, Homo sapiens
ggatggtcttacagcaggc

SEQ ID NO: 2450363 - DNA, 16 bp, Homo sapiens
ggatgtgacagtggcg

SEQ ID NO: 2450364 - DNA, 18 bp, Homo sapiens
ggatgtgattgtggaatg

SEQ ID NO: 2450365 - DNA, 19 bp, Homo sapiens
ggatgtgggttccacagac

SEQ ID NO: 2450366 - DNA, 14 bp, Homo sapiens
ggatgtgtcctgac

SEQ ID NO: 2450367 - DNA, 15 bp, Homo sapiens
ggatgtgtcctgaca

SEQ ID NO: 2450368 - DNA, 18 bp, Homo sapiens
ggattaacctctgcacta

SEQ ID NO: 2450369 - DNA, 19 bp, Homo sapiens
ggattatgggtcacaggaa

SEQ ID NO: 2450370 - DNA, 14 bp, Homo sapiens
ggattctggttcca

SEQ ID NO: 2450371 - DNA, 23 bp, Homo sapiens
ggattctgtacatgcattgagct

SEQ ID NO: 2450372 - DNA, 14 bp, Homo sapiens
ggattctttccatt

SEQ ID NO: 2450373 - DNA, 19 bp, Homo sapiens
ggattgcaatatctgaagc

SEQ ID NO: 2450374 - DNA, 19 bp, Homo sapiens
ggattgcgagagatgtgtg

SEQ ID NO: 2450375 - DNA, 17 bp, Homo sapiens
ggatttaaaagcctgct

SEQ ID NO: 2450376 - DNA, 18 bp, Homo sapiens
ggatttaaaagcctgctc

SEQ ID NO: 2450377 - DNA, 19 bp, Homo sapiens
ggatttaaaagcctgctca

SEQ ID NO: 2450378 - DNA, 12 bp, Homo sapiens
ggcaaaactcta

SEQ ID NO: 2450379 - DNA, 13 bp, Homo sapiens
ggcaaaattgcaa

SEQ ID NO: 2450380 - DNA, 14 bp, Homo sapiens
ggcaaagccaggtc

SEQ ID NO: 2450381 - DNA, 19 bp, Homo sapiens
ggcaaaggaaggtggatgg

SEQ ID NO: 2450382 - DNA, 12 bp, Homo sapiens
ggcaaataaaag

SEQ ID NO: 2450383 - DNA, 14 bp, Homo sapiens
ggcaacacagaggc

SEQ ID NO: 2450384 - DNA, 19 bp, Homo sapiens
ggcaacagatctggaacct

SEQ ID NO: 2450385 - DNA, 17 bp, Homo sapiens
ggcaatgccacagccct

SEQ ID NO: 2450386 - DNA, 11 bp, Homo sapiens
ggcaattttgt

SEQ ID NO: 2450387 - DNA, 14 bp, Homo sapiens
ggcacacagctact

SEQ ID NO: 2450388 - DNA, 19 bp, Homo sapiens
ggcacaggagtgtcctctt

SEQ ID NO: 2450389 - DNA, 14 bp, Homo sapiens
ggcacaggccccct

SEQ ID NO: 2450390 - DNA, 15 bp, Homo sapiens
ggcacaggccccctt

SEQ ID NO: 2450391 - DNA, 18 bp, Homo sapiens
ggcacagggtctgctctt

SEQ ID NO: 2450392 - DNA, 15 bp, Homo sapiens
ggcaccaggaagccg

SEQ ID NO: 2450393 - DNA, 17 bp, Homo sapiens
ggcaccaggggtttctc

SEQ ID NO: 2450394 - DNA, 15 bp, Homo sapiens
ggcaccccctgcagc

SEQ ID NO: 2450395 - DNA, 22 bp, Homo sapiens
ggcaccgaagcccagagggtct

SEQ ID NO: 2450396 - DNA, 15 bp, Homo sapiens
ggcacctaatccagg

SEQ ID NO: 2450397 - DNA, 17 bp, Homo sapiens
ggcacctaatccaggca

SEQ ID NO: 2450398 - DNA, 21 bp, Homo sapiens
ggcacctacactcacctgcac

SEQ ID NO: 2450399 - DNA, 13 bp, Homo sapiens
ggcacctgggccc

SEQ ID NO: 2450400 - DNA, 19 bp, Homo sapiens
ggcacgggtgtcacggcca

SEQ ID NO: 2450401 - DNA, 12 bp, Homo sapiens
ggcactgccctg

SEQ ID NO: 2450402 - DNA, 17 bp, Homo sapiens
ggcacttggcagccttg

SEQ ID NO: 2450403 - DNA, 17 bp, Homo sapiens
ggcagaaggcaaaccca

SEQ ID NO: 2450404 - DNA, 12 bp, Homo sapiens
ggcagagcccaa

SEQ ID NO: 2450405 - DNA, 13 bp, Homo sapiens
ggcagagctggtg

SEQ ID NO: 2450406 - DNA, 14 bp, Homo sapiens
ggcagaggcccagg

SEQ ID NO: 2450407 - DNA, 22 bp, Homo sapiens
ggcagaggcccaggctgccgtc

SEQ ID NO: 2450408 - DNA, 13 bp, Homo sapiens
ggcagaggcctgg

SEQ ID NO: 2450409 - DNA, 18 bp, Homo sapiens
ggcagagttacagttctg

SEQ ID NO: 2450410 - DNA, 21 bp, Homo sapiens
ggcagatgacctcgtactcag

SEQ ID NO: 2450411 - DNA, 17 bp, Homo sapiens
ggcagatgtaggaggga

SEQ ID NO: 2450412 - DNA, 20 bp, Homo sapiens
ggcagatgtaggagggactg

SEQ ID NO: 2450413 - DNA, 16 bp, Homo sapiens
ggcagcaaggcccgag

SEQ ID NO: 2450414 - DNA, 17 bp, Homo sapiens
ggcagcaaggcccgagc

SEQ ID NO: 2450415 - DNA, 22 bp, Homo sapiens
ggcagcaaggcccgagcagctg

SEQ ID NO: 2450416 - DNA, 12 bp, Homo sapiens
ggcagcagccag

SEQ ID NO: 2450417 - DNA, 14 bp, Homo sapiens
ggcagcagccagcc

SEQ ID NO: 2450418 - DNA, 13 bp, Homo sapiens
ggcagcagggcta

SEQ ID NO: 2450419 - DNA, 13 bp, Homo sapiens
ggcagcagtgtga

SEQ ID NO: 2450420 - DNA, 19 bp, Homo sapiens
ggcagccagcatctgggcc

SEQ ID NO: 2450421 - DNA, 20 bp, Homo sapiens
ggcagccagcatctgggcct

SEQ ID NO: 2450422 - DNA, 13 bp, Homo sapiens
ggcagccagggag

SEQ ID NO: 2450423 - DNA, 17 bp, Homo sapiens
ggcagccagtgccctga

SEQ ID NO: 2450424 - DNA, 19 bp, Homo sapiens
ggcagccagtgccctgagc

SEQ ID NO: 2450425 - DNA, 23 bp, Homo sapiens
ggcagccagtgccctgagccagg

SEQ ID NO: 2450426 - DNA, 11 bp, Homo sapiens
ggcagcccagc

SEQ ID NO: 2450427 - DNA, 16 bp, Homo sapiens
ggcagcccagccagcg

SEQ ID NO: 2450428 - DNA, 18 bp, Homo sapiens
ggcagcccagccagcgtc

SEQ ID NO: 2450429 - DNA, 14 bp, Homo sapiens
ggcagcctcccatc

SEQ ID NO: 2450430 - DNA, 22 bp, Homo sapiens
ggcagcctcccatccagggccc

SEQ ID NO: 2450431 - DNA, 19 bp, Homo sapiens
ggcagcctctggggggtgg

SEQ ID NO: 2450432 - DNA, 14 bp, Homo sapiens
ggcagcgccaggct

SEQ ID NO: 2450433 - DNA, 15 bp, Homo sapiens
ggcagctctggacag

SEQ ID NO: 2450434 - DNA, 20 bp, Homo sapiens
ggcagctctggacagcccca

SEQ ID NO: 2450435 - DNA, 16 bp, Homo sapiens
ggcagcttctgccccc

SEQ ID NO: 2450436 - DNA, 14 bp, Homo sapiens
ggcaggcagggctc

SEQ ID NO: 2450437 - DNA, 15 bp, Homo sapiens
gggaactggccaagc

SEQ ID NO: 2450438 - DNA, 19 bp, Homo sapiens
gggaactggccaagctgag

SEQ ID NO: 2450439 - DNA, 20 bp, Homo sapiens
gggaactggccaagctgagg

SEQ ID NO: 2450440 - DNA, 12 bp, Homo sapiens
gggaagacagtg

SEQ ID NO: 2450441 - DNA, 13 bp, Homo sapiens
gggaagcagcagc

SEQ ID NO: 2450442 - DNA, 17 bp, Homo sapiens
gggaagcagcagcctcg

SEQ ID NO: 2450443 - DNA, 15 bp, Homo sapiens
gggaagctagtcttt

SEQ ID NO: 2450444 - DNA, 15 bp, Homo sapiens
gggaaggaggagcct

SEQ ID NO: 2450445 - DNA, 22 bp, Homo sapiens
gggaaggctacttcggggctgg

SEQ ID NO: 2450446 - DNA, 14 bp, Homo sapiens
gggaatcagaactc

SEQ ID NO: 2450447 - DNA, 16 bp, Homo sapiens
gggacaaaggagcctg

SEQ ID NO: 2450448 - DNA, 19 bp, Homo sapiens
gggacaagtggactcaggg

SEQ ID NO: 2450449 - DNA, 18 bp, Homo sapiens
gggacagaggccccagcc

SEQ ID NO: 2450450 - DNA, 21 bp, Homo sapiens
gggacagaggccccagcctcc

SEQ ID NO: 2450451 - DNA, 22 bp, Homo sapiens
gggaccgctacaccactctggc

SEQ ID NO: 2450452 - DNA, 19 bp, Homo sapiens
gggacctagggaggcatgg

SEQ ID NO: 2450453 - DNA, 19 bp, Homo sapiens
gggactacaggcgtgagcc

SEQ ID NO: 2450454 - DNA, 20 bp, Homo sapiens
gggactacaggcgtgagcca

SEQ ID NO: 2450455 - DNA, 16 bp, Homo sapiens
gggactgctaaataaa

SEQ ID NO: 2450456 - DNA, 17 bp, Homo sapiens
gggactgtcgctgcttc

SEQ ID NO: 2450457 - DNA, 19 bp, Homo sapiens
gggagacactggcccctca

SEQ ID NO: 2450458 - DNA, 20 bp, Homo sapiens
gggagactgggctgagggag

SEQ ID NO: 2450459 - DNA, 12 bp, Homo sapiens
gggagaggcagc

SEQ ID NO: 2450460 - DNA, 17 bp, Homo sapiens
gggagaggggcctcaaa

SEQ ID NO: 2450461 - DNA, 13 bp, Homo sapiens
gggagcaggcagc

SEQ ID NO: 2450462 - DNA, 14 bp, Homo sapiens
gggagcaggcagcc

SEQ ID NO: 2450463 - DNA, 14 bp, Homo sapiens
gggagccaagggat

SEQ ID NO: 2450464 - DNA, 19 bp, Homo sapiens
gggagccatgcgccccctc

SEQ ID NO: 2450465 - DNA, 10 bp, Homo sapiens
gggagcccac

SEQ ID NO: 2450466 - DNA, 15 bp, Homo sapiens
gggagcccccagcct

SEQ ID NO: 2450467 - DNA, 15 bp, Homo sapiens
gggagctgggcctgg

SEQ ID NO: 2450468 - DNA, 22 bp, Homo sapiens
gggagggattctggttccaggg

SEQ ID NO: 2450469 - DNA, 13 bp, Homo sapiens
gggagggcagcag

SEQ ID NO: 2450470 - DNA, 14 bp, Homo sapiens
gggagggctctgag

SEQ ID NO: 2450471 - DNA, 19 bp, Homo sapiens
gggagggctctgaggcgcc

SEQ ID NO: 2450472 - DNA, 14 bp, Homo sapiens
gggaggggctcctt

SEQ ID NO: 2450473 - DNA, 15 bp, Homo sapiens
gggaggggctccttt

SEQ ID NO: 2450474 - DNA, 15 bp, Homo sapiens
gggagggggatccga

SEQ ID NO: 2450475 - DNA, 14 bp, Homo sapiens
gggagggggcagaa

SEQ ID NO: 2450476 - DNA, 15 bp, Homo sapiens
gggagttaagacctg

SEQ ID NO: 2450477 - DNA, 20 bp, Homo sapiens
gggagttaagacctggcagc

SEQ ID NO: 2450478 - DNA, 23 bp, Homo sapiens
gggagttaagacctggcagctct

SEQ ID NO: 2450479 - DNA, 22 bp, Homo sapiens
gggagttgtcaagtctctgctg

SEQ ID NO: 2450480 - DNA, 20 bp, Homo sapiens
gggatccctcccccccatgc

SEQ ID NO: 2450481 - DNA, 17 bp, Homo sapiens
gggatccgactgctttg

SEQ ID NO: 2450482 - DNA, 22 bp, Homo sapiens
gggatctactttccctctggga

SEQ ID NO: 2450483 - DNA, 17 bp, Homo sapiens
gggatggtggagggcca

SEQ ID NO: 2450484 - DNA, 13 bp, Homo sapiens
gggatgtgtcctg

SEQ ID NO: 2450485 - DNA, 20 bp, Homo sapiens
gggattacaggcgtgagcca

SEQ ID NO: 2450486 - DNA, 22 bp, Homo sapiens
gggattcaggaaaaggcctggg

SEQ ID NO: 2450487 - DNA, 12 bp, Homo sapiens
gggcaaagccag

SEQ ID NO: 2450488 - DNA, 20 bp, Homo sapiens
gggcaaagccaggtccctct

SEQ ID NO: 2450489 - DNA, 14 bp, Homo sapiens
gggcaaagcctagt

SEQ ID NO: 2450490 - DNA, 23 bp, Homo sapiens
gggcacaagactgacgccagggt

SEQ ID NO: 2450491 - DNA, 12 bp, Homo sapiens
gggcacaggagc

SEQ ID NO: 2450492 - DNA, 13 bp, Homo sapiens
gggcacaggagct

SEQ ID NO: 2450493 - DNA, 15 bp, Homo sapiens
gggcacaggagctac

SEQ ID NO: 2450494 - DNA, 21 bp, Homo sapiens
gggcacaggagctacctgtgt

SEQ ID NO: 2450495 - DNA, 18 bp, Homo sapiens
gggcaccaggggtttctc

SEQ ID NO: 2450496 - DNA, 20 bp, Homo sapiens
gggcaccaggggtttctcgc

SEQ ID NO: 2450497 - DNA, 19 bp, Homo sapiens
gggcacccccagcctgggc

SEQ ID NO: 2450498 - DNA, 21 bp, Homo sapiens
gggcacgggtgtcacggccag

SEQ ID NO: 2450499 - DNA, 14 bp, Homo sapiens
gggcagagcccaag

SEQ ID NO: 2450500 - DNA, 11 bp, Homo sapiens
gggcagagctg

SEQ ID NO: 2450501 - DNA, 13 bp, Homo sapiens
gggcagagggctg

SEQ ID NO: 2450502 - DNA, 15 bp, Homo sapiens
gggcagagggctgga

SEQ ID NO: 2450503 - DNA, 16 bp, Homo sapiens
gggcagagggctggag

SEQ ID NO: 2450504 - DNA, 22 bp, Homo sapiens
gggcagagggctggaggcccag

SEQ ID NO: 2450505 - DNA, 17 bp, Homo sapiens
gggcagcagccagccct

SEQ ID NO: 2450506 - DNA, 19 bp, Homo sapiens
gggcagcagccagccctgc

SEQ ID NO: 2450507 - DNA, 23 bp, Homo sapiens
gggcagcagccagccctgcctgg

SEQ ID NO: 2450508 - DNA, 14 bp, Homo sapiens
gggcagcagggcta

SEQ ID NO: 2450509 - DNA, 15 bp, Homo sapiens
gggcagcgccaggct

SEQ ID NO: 2450510 - DNA, 17 bp, Homo sapiens
gggcagctcctctgtct

SEQ ID NO: 2450511 - DNA, 21 bp, Homo sapiens
gggcagctcctctgtctcgag

SEQ ID NO: 2450512 - DNA, 22 bp, Homo sapiens
gggcagctcctctgtctcgagc

SEQ ID NO: 2450513 - DNA, 14 bp, Homo sapiens
gggcaggagtagct

SEQ ID NO: 2450514 - DNA, 12 bp, Homo sapiens
gggcaggctggg

SEQ ID NO: 2450515 - DNA, 13 bp, Homo sapiens
gggcaggctgggc

SEQ ID NO: 2450516 - DNA, 12 bp, Homo sapiens
gggcagggagcg

SEQ ID NO: 2450517 - DNA, 15 bp, Homo sapiens
gggcagtacctgagg

SEQ ID NO: 2450518 - DNA, 17 bp, Homo sapiens
gggcagtacctgagggt

SEQ ID NO: 2450519 - DNA, 20 bp, Homo sapiens
gggcagtacctgagggtctg

SEQ ID NO: 2450520 - DNA, 17 bp, Homo sapiens
gggcagtcattatccag

SEQ ID NO: 2450521 - DNA, 21 bp, Homo sapiens
gggcagttcgcagccaccctg

SEQ ID NO: 2450522 - DNA, 14 bp, Homo sapiens
gggcataaattatt

SEQ ID NO: 2450523 - DNA, 14 bp, Homo sapiens
gggcatggcgtgga

SEQ ID NO: 2450524 - DNA, 16 bp, Homo sapiens
gggccaaggacctgag

SEQ ID NO: 2450525 - DNA, 12 bp, Homo sapiens
gggccactcctt

SEQ ID NO: 2450526 - DNA, 16 bp, Homo sapiens
gggccactccttcctg

SEQ ID NO: 2450527 - DNA, 19 bp, Homo sapiens
gggccactccttcctgccc

SEQ ID NO: 2450528 - DNA, 12 bp, Homo sapiens
gggccagagcca

SEQ ID NO: 2450529 - DNA, 13 bp, Homo sapiens
gggccagagccag

SEQ ID NO: 2450530 - DNA, 15 bp, Homo sapiens
gggccagagccaggg

SEQ ID NO: 2450531 - DNA, 13 bp, Homo sapiens
gggccagatccag

SEQ ID NO: 2450532 - DNA, 17 bp, Homo sapiens
gggccagatccagcctg

SEQ ID NO: 2450533 - DNA, 10 bp, Homo sapiens
gggccaggcc

SEQ ID NO: 2450534 - DNA, 23 bp, Homo sapiens
gggccatgatggcaacagatctg

SEQ ID NO: 2450535 - DNA, 19 bp, Homo sapiens
gggccatgctgaggcctgg

SEQ ID NO: 2450536 - DNA, 20 bp, Homo sapiens
gggccatgctgaggcctggg

SEQ ID NO: 2450537 - DNA, 21 bp, Homo sapiens
gggccatgctgaggcctgggc

SEQ ID NO: 2450538 - DNA, 23 bp, Homo sapiens
gggccatgctgaggcctgggccg

SEQ ID NO: 2450539 - DNA, 15 bp, Homo sapiens
gggccatgtccaaag

SEQ ID NO: 2450540 - DNA, 17 bp, Homo sapiens
gggccatgtccaaagag

SEQ ID NO: 2450541 - DNA, 22 bp, Homo sapiens
gggccatgtccaaagaggctgc

SEQ ID NO: 2450542 - DNA, 13 bp, Homo sapiens
gtaaaaaatttat

SEQ ID NO: 2450543 - DNA, 11 bp, Homo sapiens
gtaaaacattt

SEQ ID NO: 2450544 - DNA, 15 bp, Homo sapiens
gtaaaatattttgaa

SEQ ID NO: 2450545 - DNA, 12 bp, Homo sapiens
gtaaaatcttgt

SEQ ID NO: 2450546 - DNA, 15 bp, Homo sapiens
gtaaaatcttgtcat

SEQ ID NO: 2450547 - DNA, 18 bp, Homo sapiens
gtaaaatcttgtcatgtg

SEQ ID NO: 2450548 - DNA, 19 bp, Homo sapiens
gtaaaatcttgtcatgtgt

SEQ ID NO: 2450549 - DNA, 20 bp, Homo sapiens
gtaaaatcttgtcatgtgta

SEQ ID NO: 2450550 - DNA, 22 bp, Homo sapiens
gtaaaatcttgtcatgtgtata

SEQ ID NO: 2450551 - DNA, 20 bp, Homo sapiens
gtaaacaaactgtgtaactg

SEQ ID NO: 2450552 - DNA, 13 bp, Homo sapiens
gtaaaccactgaa

SEQ ID NO: 2450553 - DNA, 16 bp, Homo sapiens
gtaaaccactgaaaaa

SEQ ID NO: 2450554 - DNA, 13 bp, Homo sapiens
gtaaagaattatt

SEQ ID NO: 2450555 - DNA, 16 bp, Homo sapiens
gtaaagatcaataaaa

SEQ ID NO: 2450556 - DNA, 14 bp, Homo sapiens
gtaaagtacttgta

SEQ ID NO: 2450557 - DNA, 17 bp, Homo sapiens
gtaaagtacttgtagtt

SEQ ID NO: 2450558 - DNA, 22 bp, Homo sapiens
gtaaagtatgtattatttacat

SEQ ID NO: 2450559 - DNA, 14 bp, Homo sapiens
gtaaataaaaagaa

SEQ ID NO: 2450560 - DNA, 21 bp, Homo sapiens
gtaaataactggaaaacagaa

SEQ ID NO: 2450561 - DNA, 16 bp, Homo sapiens
gtaaataatacattat

SEQ ID NO: 2450562 - DNA, 21 bp, Homo sapiens
gtaaatacaattttttttatt

SEQ ID NO: 2450563 - DNA, 11 bp, Homo sapiens
gtaaatataaa

SEQ ID NO: 2450564 - DNA, 12 bp, Homo sapiens
gtaaatataaag

SEQ ID NO: 2450565 - DNA, 14 bp, Homo sapiens
gtaaatataaagac

SEQ ID NO: 2450566 - DNA, 19 bp, Homo sapiens
gtaaatataaagacgtttt

SEQ ID NO: 2450567 - DNA, 21 bp, Homo sapiens
gtaaatcacgctttttgaaaa

SEQ ID NO: 2450568 - DNA, 22 bp, Homo sapiens
gtaaattattaatttatgcaga

SEQ ID NO: 2450569 - DNA, 19 bp, Homo sapiens
gtaaattggcatggaaatt

SEQ ID NO: 2450570 - DNA, 18 bp, Homo sapiens
gtaacaatacaaatggat

SEQ ID NO: 2450571 - DNA, 19 bp, Homo sapiens
gtaacaatacaaatggatt

SEQ ID NO: 2450572 - DNA, 20 bp, Homo sapiens
gtaacactaatatatttaaa

SEQ ID NO: 2450573 - DNA, 22 bp, Homo sapiens
gtaacatttgctgttttaaaca

SEQ ID NO: 2450574 - DNA, 16 bp, Homo sapiens
gtaacgcgtcttcctg

SEQ ID NO: 2450575 - DNA, 12 bp, Homo sapiens
gtaactacttta

SEQ ID NO: 2450576 - DNA, 14 bp, Homo sapiens
gtaactgcctagaa

SEQ ID NO: 2450577 - DNA, 20 bp, Homo sapiens
gtaacttcttatggaattga

SEQ ID NO: 2450578 - DNA, 16 bp, Homo sapiens
gtaagaaatacagact

SEQ ID NO: 2450579 - DNA, 18 bp, Homo sapiens
gtaagattatagattcta

SEQ ID NO: 2450580 - DNA, 13 bp, Homo sapiens
gtaagatttcctt

SEQ ID NO: 2450581 - DNA, 18 bp, Homo sapiens
gtaagatttccttctttt

SEQ ID NO: 2450582 - DNA, 19 bp, Homo sapiens
gtaaggatccggaaagaag

SEQ ID NO: 2450583 - DNA, 13 bp, Homo sapiens
gtaaggctctaga

SEQ ID NO: 2450584 - DNA, 14 bp, Homo sapiens
gtaaggctctagat

SEQ ID NO: 2450585 - DNA, 13 bp, Homo sapiens
gtaaggctgtgta

SEQ ID NO: 2450586 - DNA, 13 bp, Homo sapiens
gtaagtacagaga

SEQ ID NO: 2450587 - DNA, 18 bp, Homo sapiens
gtaagtacagagaagcca

SEQ ID NO: 2450588 - DNA, 18 bp, Homo sapiens
gtaagttgggcttgctat

SEQ ID NO: 2450589 - DNA, 15 bp, Homo sapiens
gtaataaactttaat

SEQ ID NO: 2450590 - DNA, 21 bp, Homo sapiens
gtaataaggttttaatttagt

SEQ ID NO: 2450591 - DNA, 22 bp, Homo sapiens
gtaatcaatctactcaaagcat

SEQ ID NO: 2450592 - DNA, 14 bp, Homo sapiens
gtaatcaatgtttc

SEQ ID NO: 2450593 - DNA, 13 bp, Homo sapiens
gtaatccctgctt

SEQ ID NO: 2450594 - DNA, 23 bp, Homo sapiens
gtaatggcagttatattttgcag

SEQ ID NO: 2450595 - DNA, 19 bp, Homo sapiens
gtaatgtcttgagctctat

SEQ ID NO: 2450596 - DNA, 17 bp, Homo sapiens
gtaatgttaatattgat

SEQ ID NO: 2450597 - DNA, 18 bp, Homo sapiens
gtaatgttaatattgatt

SEQ ID NO: 2450598 - DNA, 18 bp, Homo sapiens
gtaattaaaagcaaatca

SEQ ID NO: 2450599 - DNA, 21 bp, Homo sapiens
gtaattaaaagcaaatcattt

SEQ ID NO: 2450600 - DNA, 17 bp, Homo sapiens
gtaattcaggtttttcc

SEQ ID NO: 2450601 - DNA, 14 bp, Homo sapiens
gtaattctaaatga

SEQ ID NO: 2450602 - DNA, 15 bp, Homo sapiens
gtaattctaaatgaa

SEQ ID NO: 2450603 - DNA, 18 bp, Homo sapiens
gtaattctaaatgaatgt

SEQ ID NO: 2450604 - DNA, 22 bp, Homo sapiens
gtaattctaaatgaatgtttac

SEQ ID NO: 2450605 - DNA, 15 bp, Homo sapiens
gtaattgacatgtgc

SEQ ID NO: 2450606 - DNA, 18 bp, Homo sapiens
gtaattgtactaaagcca

SEQ ID NO: 2450607 - DNA, 23 bp, Homo sapiens
gtaattgtactaaagccaaacat

SEQ ID NO: 2450608 - DNA, 15 bp, Homo sapiens
gtaattgtgtggatt

SEQ ID NO: 2450609 - DNA, 21 bp, Homo sapiens
gtaattgtgtggattctttaa

SEQ ID NO: 2450610 - DNA, 18 bp, Homo sapiens
gtaatttagaaatcattt

SEQ ID NO: 2450611 - DNA, 20 bp, Homo sapiens
gtaattttacacgcttttgt

SEQ ID NO: 2450612 - DNA, 22 bp, Homo sapiens
gtaattttacacgcttttgtga

SEQ ID NO: 2450613 - DNA, 14 bp, Homo sapiens
gtaattttggattt

SEQ ID NO: 2450614 - DNA, 17 bp, Homo sapiens
gtaattttggattttgc

SEQ ID NO: 2450615 - DNA, 20 bp, Homo sapiens
gtaattttgtgtaagaaata

SEQ ID NO: 2450616 - DNA, 12 bp, Homo sapiens
gtacagagaagc

SEQ ID NO: 2450617 - DNA, 15 bp, Homo sapiens
gtacagagaagccat

SEQ ID NO: 2450618 - DNA, 17 bp, Homo sapiens
gtacagagaagccatca

SEQ ID NO: 2450619 - DNA, 21 bp, Homo sapiens
gtacagagtgtggactctggt

SEQ ID NO: 2450620 - DNA, 21 bp, Homo sapiens
gtacagcgcggaggaggaggg

SEQ ID NO: 2450621 - DNA, 21 bp, Homo sapiens
gtacagtatgggggttgtaaa

SEQ ID NO: 2450622 - DNA, 21 bp, Homo sapiens
gtacagtgtctttttttgtat

SEQ ID NO: 2450623 - DNA, 19 bp, Homo sapiens
gtacataccctggccgccc

SEQ ID NO: 2450624 - DNA, 11 bp, Homo sapiens
gtacatgagaa

SEQ ID NO: 2450625 - DNA, 22 bp, Homo sapiens
gtacatttgggagtttttatga

SEQ ID NO: 2450626 - DNA, 18 bp, Homo sapiens
gtaccacccatccctgtg

SEQ ID NO: 2450627 - DNA, 15 bp, Homo sapiens
gtaccagataacttt

SEQ ID NO: 2450628 - DNA, 17 bp, Homo sapiens
gtaccagataacttttt

SEQ ID NO: 2450629 - DNA, 17 bp, Homo sapiens
gtaccagatgcagctca

SEQ ID NO: 2450630 - DNA, 16 bp, Homo sapiens
gtaccagttaattttt

SEQ ID NO: 2450631 - DNA, 23 bp, Homo sapiens
gtaccagttaatttttccaacta

SEQ ID NO: 2450632 - DNA, 19 bp, Homo sapiens
gtaccctctcagctccagg

SEQ ID NO: 2450633 - DNA, 18 bp, Homo sapiens
gtaccgcgtctaccctgg

SEQ ID NO: 2450634 - DNA, 15 bp, Homo sapiens
gtacctggggccaaa

SEQ ID NO: 2450635 - DNA, 15 bp, Homo sapiens
gtaccttgtgcccag

SEQ ID NO: 2450636 - DNA, 16 bp, Homo sapiens
gtaccttgtgcccagg

SEQ ID NO: 2450637 - DNA, 21 bp, Homo sapiens
gtaccttttgaggagccccag

SEQ ID NO: 2450638 - DNA, 15 bp, Homo sapiens
gtacgatgacagtgt

SEQ ID NO: 2450639 - DNA, 18 bp, Homo sapiens
gtactatttaactgacta

SEQ ID NO: 2450640 - DNA, 18 bp, Homo sapiens
gtactccacactgcacaa

SEQ ID NO: 2450641 - DNA, 16 bp, Homo sapiens
gtactgcctgcttggg

SEQ ID NO: 2450642 - DNA, 22 bp, Homo sapiens
gtacttgccttattagagtgtc

SEQ ID NO: 2450643 - DNA, 17 bp, Homo sapiens
gtagaacactaattcat

SEQ ID NO: 2450644 - DNA, 14 bp, Homo sapiens
gtagaagggaaagc

SEQ ID NO: 2450645 - DNA, 14 bp, Homo sapiens
gtagaattgtatat

SEQ ID NO: 2450646 - DNA, 22 bp, Homo sapiens
gtgacagggcgggggtggcggc

SEQ ID NO: 2450647 - DNA, 16 bp, Homo sapiens
gtgacatcggaaaaat

SEQ ID NO: 2450648 - DNA, 18 bp, Homo sapiens
gtgacatcggaaaaataa

SEQ ID NO: 2450649 - DNA, 21 bp, Homo sapiens
gtgacattgcatcaaagcatc

SEQ ID NO: 2450650 - DNA, 15 bp, Homo sapiens
gtgaccaatgtcttg

SEQ ID NO: 2450651 - DNA, 14 bp, Homo sapiens
gtgaccccagggca

SEQ ID NO: 2450652 - DNA, 23 bp, Homo sapiens
gtgaccccagggcacaggagcta

SEQ ID NO: 2450653 - DNA, 15 bp, Homo sapiens
gtgacccccagctcc

SEQ ID NO: 2450654 - DNA, 17 bp, Homo sapiens
gtgacccggcaccccct

SEQ ID NO: 2450655 - DNA, 18 bp, Homo sapiens
gtgacccggcaccccctg

SEQ ID NO: 2450656 - DNA, 21 bp, Homo sapiens
gtgacccggcaccccctgcag

SEQ ID NO: 2450657 - DNA, 15 bp, Homo sapiens
gtgaccggacttttc

SEQ ID NO: 2450658 - DNA, 13 bp, Homo sapiens
gtgacctgctgag

SEQ ID NO: 2450659 - DNA, 18 bp, Homo sapiens
gtgacctgctgagctctg

SEQ ID NO: 2450660 - DNA, 17 bp, Homo sapiens
gtgactaatggcatgag

SEQ ID NO: 2450661 - DNA, 15 bp, Homo sapiens
gtgagaaatttaaac

SEQ ID NO: 2450662 - DNA, 20 bp, Homo sapiens
gtgagaacctgggttgcaga

SEQ ID NO: 2450663 - DNA, 20 bp, Homo sapiens
gtgagcatggaacacttcga

SEQ ID NO: 2450664 - DNA, 20 bp, Homo sapiens
gtgagcccagctgggtcagg

SEQ ID NO: 2450665 - DNA, 17 bp, Homo sapiens
gtgagctgagcaggcca

SEQ ID NO: 2450666 - DNA, 18 bp, Homo sapiens
gtgaggagcttgaaaccc

SEQ ID NO: 2450667 - DNA, 23 bp, Homo sapiens
gtgaggcaatgggagctgaggcc

SEQ ID NO: 2450668 - DNA, 14 bp, Homo sapiens
gtgaggccagggca

SEQ ID NO: 2450669 - DNA, 22 bp, Homo sapiens
gtgagtcaatacatagtgctgc

SEQ ID NO: 2450670 - DNA, 14 bp, Homo sapiens
gtgagtcaccactt

SEQ ID NO: 2450671 - DNA, 18 bp, Homo sapiens
gtgagtctctctgggcct

SEQ ID NO: 2450672 - DNA, 22 bp, Homo sapiens
gtgagttctccctgtacagtgt

SEQ ID NO: 2450673 - DNA, 16 bp, Homo sapiens
gtgatcatgtgtggaa

SEQ ID NO: 2450674 - DNA, 18 bp, Homo sapiens
gtgatcatgtgtggaagt

SEQ ID NO: 2450675 - DNA, 19 bp, Homo sapiens
gtgatgagggcagcagcca

SEQ ID NO: 2450676 - DNA, 20 bp, Homo sapiens
gtgatgagggcagcagccag

SEQ ID NO: 2450677 - DNA, 21 bp, Homo sapiens
gtgatgagggcagcagccagc

SEQ ID NO: 2450678 - DNA, 23 bp, Homo sapiens
gtgatggagtgctgttttgttat

SEQ ID NO: 2450679 - DNA, 14 bp, Homo sapiens
gtgatgggggagag

SEQ ID NO: 2450680 - DNA, 15 bp, Homo sapiens
gtgatgtaccagttt

SEQ ID NO: 2450681 - DNA, 18 bp, Homo sapiens
gtgatgtcatacagagaa

SEQ ID NO: 2450682 - DNA, 21 bp, Homo sapiens
gtgatgtcatacagagaagtc

SEQ ID NO: 2450683 - DNA, 14 bp, Homo sapiens
gtgattgtggaatg

SEQ ID NO: 2450684 - DNA, 22 bp, Homo sapiens
gtgatttaagggcccaggtcag

SEQ ID NO: 2450685 - DNA, 24 bp, Homo sapiens
gtgcaacagggtatggactatctg

SEQ ID NO: 2450686 - DNA, 20 bp, Homo sapiens
gtgcaagttgaggacttctt

SEQ ID NO: 2450687 - DNA, 22 bp, Homo sapiens
gtgcaataaatctgacccagtg

SEQ ID NO: 2450688 - DNA, 23 bp, Homo sapiens
gtgcaatgtgtataaacaagaaa

SEQ ID NO: 2450689 - DNA, 18 bp, Homo sapiens
gtgcaatttcaaggttct

SEQ ID NO: 2450690 - DNA, 20 bp, Homo sapiens
gtgcaatttcaaggttctaa

SEQ ID NO: 2450691 - DNA, 18 bp, Homo sapiens
gtgcacaaaacccagacc

SEQ ID NO: 2450692 - DNA, 13 bp, Homo sapiens
gtgcacaggaggg

SEQ ID NO: 2450693 - DNA, 19 bp, Homo sapiens
gtgcactgcccatggacag

SEQ ID NO: 2450694 - DNA, 20 bp, Homo sapiens
gtgcactgcccatggacagg

SEQ ID NO: 2450695 - DNA, 21 bp, Homo sapiens
gtgcactgcccatggacaggc

SEQ ID NO: 2450696 - DNA, 22 bp, Homo sapiens
gtgcagtatcatgccctgtgca

SEQ ID NO: 2450697 - DNA, 12 bp, Homo sapiens
gtgccagagcct

SEQ ID NO: 2450698 - DNA, 14 bp, Homo sapiens
gtgccagagcctgg

SEQ ID NO: 2450699 - DNA, 15 bp, Homo sapiens
gtgccagagcctggg

SEQ ID NO: 2450700 - DNA, 16 bp, Homo sapiens
gtgccagagcctgggg

SEQ ID NO: 2450701 - DNA, 17 bp, Homo sapiens
gtgccagagcctggggc

SEQ ID NO: 2450702 - DNA, 18 bp, Homo sapiens
gtgccagagcctggggct

SEQ ID NO: 2450703 - DNA, 16 bp, Homo sapiens
gtgccaggaccagtca

SEQ ID NO: 2450704 - DNA, 19 bp, Homo sapiens
gtgcccaagccagaggctg

SEQ ID NO: 2450705 - DNA, 20 bp, Homo sapiens
gtgcccaagccagaggctgg

SEQ ID NO: 2450706 - DNA, 16 bp, Homo sapiens
gtgcccagaataagtt

SEQ ID NO: 2450707 - DNA, 13 bp, Homo sapiens
gtgcccaggagaa

SEQ ID NO: 2450708 - DNA, 14 bp, Homo sapiens
gtgccccaggacca

SEQ ID NO: 2450709 - DNA, 21 bp, Homo sapiens
gtgcccccttcaagcctgtgc

SEQ ID NO: 2450710 - DNA, 15 bp, Homo sapiens
gtgccccttccgcca

SEQ ID NO: 2450711 - DNA, 17 bp, Homo sapiens
gtgccccttccgccact

SEQ ID NO: 2450712 - DNA, 19 bp, Homo sapiens
gtgccccttccgccactgg

SEQ ID NO: 2450713 - DNA, 15 bp, Homo sapiens
gtgccctctcccacc

SEQ ID NO: 2450714 - DNA, 17 bp, Homo sapiens
gtgccctctcccaccct

SEQ ID NO: 2450715 - DNA, 20 bp, Homo sapiens
gtgccctctcccaccctctt

SEQ ID NO: 2450716 - DNA, 21 bp, Homo sapiens
gtgccctctcccaccctcttc

SEQ ID NO: 2450717 - DNA, 13 bp, Homo sapiens
gtgccctctgggc

SEQ ID NO: 2450718 - DNA, 14 bp, Homo sapiens
gtgccctctgggct

SEQ ID NO: 2450719 - DNA, 12 bp, Homo sapiens
gtgccctgagcc

SEQ ID NO: 2450720 - DNA, 15 bp, Homo sapiens
gtgcctaggcctggg

SEQ ID NO: 2450721 - DNA, 18 bp, Homo sapiens
gtgcctaggcctgggcag

SEQ ID NO: 2450722 - DNA, 21 bp, Homo sapiens
gtgcctattgctagagctcct

SEQ ID NO: 2450723 - DNA, 15 bp, Homo sapiens
gtgcctcagagacca

SEQ ID NO: 2450724 - DNA, 23 bp, Homo sapiens
gtgcctccagaggggctcaggtc

SEQ ID NO: 2450725 - DNA, 16 bp, Homo sapiens
gtgcctcctccctccc

SEQ ID NO: 2450726 - DNA, 21 bp, Homo sapiens
gtgcctcctccctccctctcc

SEQ ID NO: 2450727 - DNA, 15 bp, Homo sapiens
gtgcctcgctcccca

SEQ ID NO: 2450728 - DNA, 21 bp, Homo sapiens
gtgcctcgctccccactctgc

SEQ ID NO: 2450729 - DNA, 16 bp, Homo sapiens
gtgcctgcaggggagc

SEQ ID NO: 2450730 - DNA, 22 bp, Homo sapiens
gtgcctgtgtccatgcgctcag

SEQ ID NO: 2450731 - DNA, 20 bp, Homo sapiens
gtgccttcaacacagcttgt

SEQ ID NO: 2450732 - DNA, 13 bp, Homo sapiens
gtgccttgttttt

SEQ ID NO: 2450733 - DNA, 16 bp, Homo sapiens
gtgcggctggccatgg

SEQ ID NO: 2450734 - DNA, 15 bp, Homo sapiens
gtgcgtccacgagct

SEQ ID NO: 2450735 - DNA, 20 bp, Homo sapiens
gtgcgtggtggtccctgggt

SEQ ID NO: 2450736 - DNA, 13 bp, Homo sapiens
gtgctaaggttct

SEQ ID NO: 2450737 - DNA, 19 bp, Homo sapiens
gtgctaggaagaggagtgg

SEQ ID NO: 2450738 - DNA, 13 bp, Homo sapiens
gtgctctccattc

SEQ ID NO: 2450739 - DNA, 16 bp, Homo sapiens
gtgctctttgttttgt

SEQ ID NO: 2450740 - DNA, 15 bp, Homo sapiens
gtgctgctgtgtgct

SEQ ID NO: 2450741 - DNA, 16 bp, Homo sapiens
gtgctgctgtgtgctt

SEQ ID NO: 2450742 - DNA, 18 bp, Homo sapiens
gtgctggaattctaacaa

SEQ ID NO: 2450743 - DNA, 18 bp, Homo sapiens
gtgctggaggttggatct

SEQ ID NO: 2450744 - DNA, 17 bp, Homo sapiens
gtgctgggagaggcagc

SEQ ID NO: 2450745 - DNA, 18 bp, Homo sapiens
gtgctgggagaggcagcc

SEQ ID NO: 2450746 - DNA, 23 bp, Homo sapiens
gtgctgggagctccactctgctt

SEQ ID NO: 2450747 - DNA, 20 bp, Homo sapiens
gtgctggtcccggggccagc

SEQ ID NO: 2450748 - DNA, 15 bp, Homo sapiens
gtgctgtttattaat

SEQ ID NO: 2450749 - DNA, 12 bp, Homo sapiens
gttgtgccaaat

SEQ ID NO: 2450750 - DNA, 13 bp, Homo sapiens
gttgttcgggcca

SEQ ID NO: 2450751 - DNA, 15 bp, Homo sapiens
gttgttctgttaact

SEQ ID NO: 2450752 - DNA, 11 bp, Homo sapiens
gtttaaaactt

SEQ ID NO: 2450753 - DNA, 16 bp, Homo sapiens
gtttaaagaaagtgta

SEQ ID NO: 2450754 - DNA, 19 bp, Homo sapiens
gtttaaatgaacaagagaa

SEQ ID NO: 2450755 - DNA, 17 bp, Homo sapiens
gtttaagccaaaacaat

SEQ ID NO: 2450756 - DNA, 20 bp, Homo sapiens
gtttaagccaaaacaatgtt

SEQ ID NO: 2450757 - DNA, 20 bp, Homo sapiens
gtttaatgaagatctaaata

SEQ ID NO: 2450758 - DNA, 18 bp, Homo sapiens
gtttaatttttatttctt

SEQ ID NO: 2450759 - DNA, 19 bp, Homo sapiens
gtttacaaaatcaggtaac

SEQ ID NO: 2450760 - DNA, 14 bp, Homo sapiens
gtttacatgcttat

SEQ ID NO: 2450761 - DNA, 15 bp, Homo sapiens
gtttaccagttgcct

SEQ ID NO: 2450762 - DNA, 14 bp, Homo sapiens
gtttagctctgaga

SEQ ID NO: 2450763 - DNA, 22 bp, Homo sapiens
gtttatcctttcatatagttag

SEQ ID NO: 2450764 - DNA, 21 bp, Homo sapiens
gtttatgttccattaaacgat

SEQ ID NO: 2450765 - DNA, 21 bp, Homo sapiens
gtttattaatcttagtgtatg

SEQ ID NO: 2450766 - DNA, 18 bp, Homo sapiens
gtttcaacggaaagtgct

SEQ ID NO: 2450767 - DNA, 13 bp, Homo sapiens
gtttcaagaggag

SEQ ID NO: 2450768 - DNA, 18 bp, Homo sapiens
gtttcaaggcactctaga

SEQ ID NO: 2450769 - DNA, 23 bp, Homo sapiens
gtttcaaggcactctagattcca

SEQ ID NO: 2450770 - DNA, 21 bp, Homo sapiens
gtttcatgttagttaccttat

SEQ ID NO: 2450771 - DNA, 13 bp, Homo sapiens
gtttccagcattc

SEQ ID NO: 2450772 - DNA, 16 bp, Homo sapiens
gtttccagcattccca

SEQ ID NO: 2450773 - DNA, 19 bp, Homo sapiens
gtttccagcattcccaggt

SEQ ID NO: 2450774 - DNA, 16 bp, Homo sapiens
gtttcccaagagctac

SEQ ID NO: 2450775 - DNA, 18 bp, Homo sapiens
gtttcctctagttctttg

SEQ ID NO: 2450776 - DNA, 22 bp, Homo sapiens
gtttcctctagttctttgttca

SEQ ID NO: 2450777 - DNA, 23 bp, Homo sapiens
gtttcgtggggaggtctaatcta

SEQ ID NO: 2450778 - DNA, 15 bp, Homo sapiens
gtttctaaactggag

SEQ ID NO: 2450779 - DNA, 18 bp, Homo sapiens
gtttctaaactggagact

SEQ ID NO: 2450780 - DNA, 16 bp, Homo sapiens
gtttctaagattctaa

SEQ ID NO: 2450781 - DNA, 17 bp, Homo sapiens
gtttctaagattctaaa

SEQ ID NO: 2450782 - DNA, 18 bp, Homo sapiens
gtttctaagattctaaag

SEQ ID NO: 2450783 - DNA, 22 bp, Homo sapiens
gtttctaaggtccggtgttcta

SEQ ID NO: 2450784 - DNA, 18 bp, Homo sapiens
gtttctccaaactgaagc

SEQ ID NO: 2450785 - DNA, 11 bp, Homo sapiens
gtttctccccc

SEQ ID NO: 2450786 - DNA, 17 bp, Homo sapiens
gtttctcccccatgttc

SEQ ID NO: 2450787 - DNA, 18 bp, Homo sapiens
gtttctggtggtctgttg

SEQ ID NO: 2450788 - DNA, 17 bp, Homo sapiens
gtttcttcctgccagca

SEQ ID NO: 2450789 - DNA, 13 bp, Homo sapiens
gtttcttgcctca

SEQ ID NO: 2450790 - DNA, 19 bp, Homo sapiens
gtttctttctctgaggaca

SEQ ID NO: 2450791 - DNA, 19 bp, Homo sapiens
gtttgactagatgatggat

SEQ ID NO: 2450792 - DNA, 18 bp, Homo sapiens
gtttgcaaaaaatgtttt

SEQ ID NO: 2450793 - DNA, 14 bp, Homo sapiens
gtttgcacttcctc

SEQ ID NO: 2450794 - DNA, 21 bp, Homo sapiens
gtttgcttcatgtgtcccaga

SEQ ID NO: 2450795 - DNA, 13 bp, Homo sapiens
gtttggaaggagc

SEQ ID NO: 2450796 - DNA, 17 bp, Homo sapiens
gtttgggtttttttcct

SEQ ID NO: 2450797 - DNA, 22 bp, Homo sapiens
gtttgtagtgccactgttgttt

SEQ ID NO: 2450798 - DNA, 13 bp, Homo sapiens
gtttgtatgaaac

SEQ ID NO: 2450799 - DNA, 16 bp, Homo sapiens
gtttgtgacagggcgg

SEQ ID NO: 2450800 - DNA, 17 bp, Homo sapiens
gtttgtgttctgttttg

SEQ ID NO: 2450801 - DNA, 22 bp, Homo sapiens
gtttgttggttggttttcttct

SEQ ID NO: 2450802 - DNA, 12 bp, Homo sapiens
gtttgtttttgg

SEQ ID NO: 2450803 - DNA, 15 bp, Homo sapiens
gttttaaaaagccag

SEQ ID NO: 2450804 - DNA, 22 bp, Homo sapiens
gttttaactgtggatattgtta

SEQ ID NO: 2450805 - DNA, 14 bp, Homo sapiens
gttttaatttaaac

SEQ ID NO: 2450806 - DNA, 20 bp, Homo sapiens
gttttacaagttggagtcac

SEQ ID NO: 2450807 - DNA, 21 bp, Homo sapiens
gttttacattgttgagctatt

SEQ ID NO: 2450808 - DNA, 12 bp, Homo sapiens
gttttaggttct

SEQ ID NO: 2450809 - DNA, 16 bp, Homo sapiens
gttttaggttctaaag

SEQ ID NO: 2450810 - DNA, 21 bp, Homo sapiens
gttttaggttctaaagttcta

SEQ ID NO: 2450811 - DNA, 12 bp, Homo sapiens
gttttatatatt

SEQ ID NO: 2450812 - DNA, 19 bp, Homo sapiens
gttttatatattatatgga

SEQ ID NO: 2450813 - DNA, 21 bp, Homo sapiens
gttttatgagaaagccttctt

SEQ ID NO: 2450814 - DNA, 19 bp, Homo sapiens
gttttcatccataactgaa

SEQ ID NO: 2450815 - DNA, 20 bp, Homo sapiens
gttttcatccataactgaac

SEQ ID NO: 2450816 - DNA, 17 bp, Homo sapiens
gttttcctatgctttga

SEQ ID NO: 2450817 - DNA, 21 bp, Homo sapiens
gttttcctatgctttgaaaca

SEQ ID NO: 2450818 - DNA, 14 bp, Homo sapiens
gttttctaattgct

SEQ ID NO: 2450819 - DNA, 17 bp, Homo sapiens
gttttctctcggctccc

SEQ ID NO: 2450820 - DNA, 19 bp, Homo sapiens
gttttctctcggctcccca

SEQ ID NO: 2450821 - DNA, 20 bp, Homo sapiens
gttttgatttaatgttttca

SEQ ID NO: 2450822 - DNA, 15 bp, Homo sapiens
gttttgcacagccaa

SEQ ID NO: 2450823 - DNA, 22 bp, Homo sapiens
gttttggctgaaattctcctgg

SEQ ID NO: 2450824 - DNA, 15 bp, Homo sapiens
gttttgtattctctg

SEQ ID NO: 2450825 - DNA, 14 bp, Homo sapiens
gttttgtgtctctt

SEQ ID NO: 2450826 - DNA, 16 bp, Homo sapiens
gttttgtgtctcttat

SEQ ID NO: 2450827 - DNA, 17 bp, Homo sapiens
gttttgtgtttgttgta

SEQ ID NO: 2450828 - DNA, 21 bp, Homo sapiens
gttttgttgacattctgaatg

SEQ ID NO: 2450829 - DNA, 13 bp, Homo sapiens
gttttgtttacag

SEQ ID NO: 2450830 - DNA, 20 bp, Homo sapiens
gttttgtttcgctctttgag

SEQ ID NO: 2450831 - DNA, 15 bp, Homo sapiens
gtttttaaactgtac

SEQ ID NO: 2450832 - DNA, 20 bp, Homo sapiens
gtttttaaactgtacagtgt

SEQ ID NO: 2450833 - DNA, 22 bp, Homo sapiens
gtttttaaactgtacagtgtct

SEQ ID NO: 2450834 - DNA, 21 bp, Homo sapiens
gtttttacaaatgttaaaatg

SEQ ID NO: 2450835 - DNA, 16 bp, Homo sapiens
gtttttactgctctga

SEQ ID NO: 2450836 - DNA, 18 bp, Homo sapiens
gtttttactgctctgaga

SEQ ID NO: 2450837 - DNA, 15 bp, Homo sapiens
gtttttatgagaaac

SEQ ID NO: 2450838 - DNA, 13 bp, Homo sapiens
gtttttctaaagg

SEQ ID NO: 2450839 - DNA, 15 bp, Homo sapiens
gtttttctattaaaa

SEQ ID NO: 2450840 - DNA, 16 bp, Homo sapiens
gtttttctattaaaag

SEQ ID NO: 2450841 - DNA, 21 bp, Homo sapiens
gtttttctattaaaagactca

SEQ ID NO: 2450842 - DNA, 22 bp, Homo sapiens
gtttttctattaaaagactcat

SEQ ID NO: 2450843 - DNA, 13 bp, Homo sapiens
gtttttgagatat

SEQ ID NO: 2450844 - DNA, 12 bp, Homo sapiens
gttttttaagtc

SEQ ID NO: 2450845 - DNA, 11 bp, Homo sapiens
gttttttcatc

SEQ ID NO: 2450846 - DNA, 19 bp, Homo sapiens
taaaaaaaaagatctgttt

SEQ ID NO: 2450847 - DNA, 15 bp, Homo sapiens
taaaaaaaagatgaa

SEQ ID NO: 2450848 - DNA, 20 bp, Homo sapiens
taaaaaaataagaagaatgc

SEQ ID NO: 2450849 - DNA, 12 bp, Homo sapiens
taaaaaagataa

SEQ ID NO: 2450850 - DNA, 12 bp, Homo sapiens
taaaaaatggtt

SEQ ID NO: 2450851 - DNA, 20 bp, Homo sapiens
taaaaacagatttggaaaga

SEQ ID NO: 2450852 - DNA, 20 bp, Homo sapiens
taaaaagttttagttttgat

SEQ ID NO: 2450853 - DNA, 14 bp, Homo sapiens
taataaggttttaa

SEQ ID NO: 2450854 - DNA, 22 bp, Homo sapiens
taataatttagacttcaagcat

SEQ ID NO: 2450855 - DNA, 20 bp, Homo sapiens
taatacattccaactcgtat

SEQ ID NO: 2450856 - DNA, 15 bp, Homo sapiens
taatactaccttgaa

SEQ ID NO: 2450857 - DNA, 18 bp, Homo sapiens
taatactcaaatgagtaa

SEQ ID NO: 2450858 - DNA, 20 bp, Homo sapiens
taatactcaaatgagtaaca

SEQ ID NO: 2450859 - DNA, 20 bp, Homo sapiens
taatagaataaaggcagttt

SEQ ID NO: 2450860 - DNA, 21 bp, Homo sapiens
taatagatgtttgatagattt

SEQ ID NO: 2450861 - DNA, 14 bp, Homo sapiens
taatagcagccttt

SEQ ID NO: 2450862 - DNA, 15 bp, Homo sapiens
taatagcagcctttc

SEQ ID NO: 2450863 - DNA, 21 bp, Homo sapiens
taatataaagtagtcctgtga

SEQ ID NO: 2450864 - DNA, 13 bp, Homo sapiens
taatataaatgca

SEQ ID NO: 2450865 - DNA, 16 bp, Homo sapiens
taatatactatattta

SEQ ID NO: 2450866 - DNA, 19 bp, Homo sapiens
taatatatattatcttttc

SEQ ID NO: 2450867 - DNA, 14 bp, Homo sapiens
taatatatttaaaa

SEQ ID NO: 2450868 - DNA, 21 bp, Homo sapiens
taatatattttctgttttctt

SEQ ID NO: 2450869 - DNA, 12 bp, Homo sapiens
taatatcctaaa

SEQ ID NO: 2450870 - DNA, 15 bp, Homo sapiens
taatatcctaaacat

SEQ ID NO: 2450871 - DNA, 22 bp, Homo sapiens
taatatggccacagtagtcttg

SEQ ID NO: 2450872 - DNA, 16 bp, Homo sapiens
taatattgatttatta

SEQ ID NO: 2450873 - DNA, 20 bp, Homo sapiens
taatattttcctcctgagtg

SEQ ID NO: 2450874 - DNA, 20 bp, Homo sapiens
taatcactctaattaattgt

SEQ ID NO: 2450875 - DNA, 15 bp, Homo sapiens
taatcatataataaa

SEQ ID NO: 2450876 - DNA, 20 bp, Homo sapiens
taatcatataataaatgtac

SEQ ID NO: 2450877 - DNA, 19 bp, Homo sapiens
taatccaggcagatccagg

SEQ ID NO: 2450878 - DNA, 22 bp, Homo sapiens
taatccaggcagatccaggact

SEQ ID NO: 2450879 - DNA, 23 bp, Homo sapiens
taatccaggcagatccaggacta

SEQ ID NO: 2450880 - DNA, 14 bp, Homo sapiens
taatccccttctcc

SEQ ID NO: 2450881 - DNA, 15 bp, Homo sapiens
taatccccttctccc

SEQ ID NO: 2450882 - DNA, 17 bp, Homo sapiens
taatccccttctcccct

SEQ ID NO: 2450883 - DNA, 21 bp, Homo sapiens
taatccccttctcccctgcac

SEQ ID NO: 2450884 - DNA, 17 bp, Homo sapiens
taatccctgctttttgt

SEQ ID NO: 2450885 - DNA, 18 bp, Homo sapiens
taatccgccaatattagt

SEQ ID NO: 2450886 - DNA, 17 bp, Homo sapiens
taatctagatatcgact

SEQ ID NO: 2450887 - DNA, 13 bp, Homo sapiens
taatctgaataaa

SEQ ID NO: 2450888 - DNA, 22 bp, Homo sapiens
taatctgaataaagtgtaacaa

SEQ ID NO: 2450889 - DNA, 18 bp, Homo sapiens
taatcttagtgtatgatt

SEQ ID NO: 2450890 - DNA, 16 bp, Homo sapiens
taatcttgaattgtaa

SEQ ID NO: 2450891 - DNA, 23 bp, Homo sapiens
taatgaaacaaagagttcaagaa

SEQ ID NO: 2450892 - DNA, 16 bp, Homo sapiens
taatgaagaaagtgga

SEQ ID NO: 2450893 - DNA, 15 bp, Homo sapiens
taatgaagatctaaa

SEQ ID NO: 2450894 - DNA, 16 bp, Homo sapiens
taatgaagatctaaat

SEQ ID NO: 2450895 - DNA, 20 bp, Homo sapiens
taatgacaggcctgtccaac

SEQ ID NO: 2450896 - DNA, 15 bp, Homo sapiens
taatgctttgaaatt

SEQ ID NO: 2450897 - DNA, 19 bp, Homo sapiens
taatggtgtagaacactaa

SEQ ID NO: 2450898 - DNA, 19 bp, Homo sapiens
taatgtatcaaatacattt

SEQ ID NO: 2450899 - DNA, 17 bp, Homo sapiens
taatgtatgttaccaaa

SEQ ID NO: 2450900 - DNA, 18 bp, Homo sapiens
taatgtgtagttcatgta

SEQ ID NO: 2450901 - DNA, 20 bp, Homo sapiens
taatgtgtagttcatgtaaa

SEQ ID NO: 2450902 - DNA, 17 bp, Homo sapiens
taatgttaatattgatt

SEQ ID NO: 2450903 - DNA, 21 bp, Homo sapiens
taatgttggacacctttaggt

SEQ ID NO: 2450904 - DNA, 15 bp, Homo sapiens
taatgtttaaaacat

SEQ ID NO: 2450905 - DNA, 23 bp, Homo sapiens
taatgttttttgccacagctttt

SEQ ID NO: 2450906 - DNA, 16 bp, Homo sapiens
taattacctactctgg

SEQ ID NO: 2450907 - DNA, 14 bp, Homo sapiens
taattatataactg

SEQ ID NO: 2450908 - DNA, 20 bp, Homo sapiens
taattatggagtcattttta

SEQ ID NO: 2450909 - DNA, 14 bp, Homo sapiens
taattatgtagctc

SEQ ID NO: 2450910 - DNA, 12 bp, Homo sapiens
taattattattc

SEQ ID NO: 2450911 - DNA, 17 bp, Homo sapiens
taattattatttatata

SEQ ID NO: 2450912 - DNA, 18 bp, Homo sapiens
taattatttatgtatggt

SEQ ID NO: 2450913 - DNA, 20 bp, Homo sapiens
taattcaaggaatttcttaa

SEQ ID NO: 2450914 - DNA, 22 bp, Homo sapiens
taattcaaggaatttcttaact

SEQ ID NO: 2450915 - DNA, 16 bp, Homo sapiens
taattcaattcaaagc

SEQ ID NO: 2450916 - DNA, 22 bp, Homo sapiens
taattcacagtgctcttttctc

SEQ ID NO: 2450917 - DNA, 20 bp, Homo sapiens
taattcactgtactatcagg

SEQ ID NO: 2450918 - DNA, 15 bp, Homo sapiens
taattccacaccttt

SEQ ID NO: 2450919 - DNA, 19 bp, Homo sapiens
taattcctcaacgtattgt

SEQ ID NO: 2450920 - DNA, 18 bp, Homo sapiens
taattctaaatgaatgtt

SEQ ID NO: 2450921 - DNA, 15 bp, Homo sapiens
taattctatgcctgt

SEQ ID NO: 2450922 - DNA, 14 bp, Homo sapiens
taattctcattaaa

SEQ ID NO: 2450923 - DNA, 20 bp, Homo sapiens
taattctttcaatacagata

SEQ ID NO: 2450924 - DNA, 14 bp, Homo sapiens
taattgccacctct

SEQ ID NO: 2450925 - DNA, 23 bp, Homo sapiens
taattgccacctctaacagcacc

SEQ ID NO: 2450926 - DNA, 20 bp, Homo sapiens
taattgcttatttattgtat

SEQ ID NO: 2450927 - DNA, 18 bp, Homo sapiens
taattgggccagcttttc

SEQ ID NO: 2450928 - DNA, 18 bp, Homo sapiens
taattggtccgatctttg

SEQ ID NO: 2450929 - DNA, 22 bp, Homo sapiens
taattgtactaaagccaaacat

SEQ ID NO: 2450930 - DNA, 23 bp, Homo sapiens
taattgtgattagacagaacacc

SEQ ID NO: 2450931 - DNA, 15 bp, Homo sapiens
taattgttgttctgt

SEQ ID NO: 2450932 - DNA, 18 bp, Homo sapiens
taattgttgttctgttaa

SEQ ID NO: 2450933 - DNA, 20 bp, Homo sapiens
taattgttgttctgttaact

SEQ ID NO: 2450934 - DNA, 21 bp, Homo sapiens
taattgttgttctgttaactg

SEQ ID NO: 2450935 - DNA, 19 bp, Homo sapiens
taatttaactttctgggtt

SEQ ID NO: 2450936 - DNA, 19 bp, Homo sapiens
taatttacaaaaatataaa

SEQ ID NO: 2450937 - DNA, 22 bp, Homo sapiens
taatttacctaagattacaaat

SEQ ID NO: 2450938 - DNA, 15 bp, Homo sapiens
taatttagaaatcat

SEQ ID NO: 2450939 - DNA, 17 bp, Homo sapiens
taatttagacttggatt

SEQ ID NO: 2450940 - DNA, 15 bp, Homo sapiens
taatttcaaaatgct

SEQ ID NO: 2450941 - DNA, 16 bp, Homo sapiens
taatttcaaaatgctt

SEQ ID NO: 2450942 - DNA, 23 bp, Homo sapiens
taatttcaggaggaatactgaac

SEQ ID NO: 2450943 - DNA, 20 bp, Homo sapiens
taattttacacgcttttgtg

SEQ ID NO: 2450944 - DNA, 21 bp, Homo sapiens
taattttagtttttcattaaa

SEQ ID NO: 2450945 - DNA, 15 bp, Homo sapiens
taattttgcctttaa

SEQ ID NO: 2450946 - DNA, 19 bp, Homo sapiens
taattttgtgtaagaaata

SEQ ID NO: 2450947 - DNA, 23 bp, Homo sapiens
taatttttgatactaagcattga

SEQ ID NO: 2450948 - DNA, 14 bp, Homo sapiens
tacaaaaatataaa

SEQ ID NO: 2450949 - DNA, 18 bp, Homo sapiens
tacaaaaatataaaatat

SEQ ID NO: 2450950 - DNA, 14 bp, Homo sapiens
tacaaaacaaactc

SEQ ID NO: 2450951 - DNA, 21 bp, Homo sapiens
tacaaaagaagggctggtatt

SEQ ID NO: 2450952 - DNA, 15 bp, Homo sapiens
tacaaactgaagagt

SEQ ID NO: 2450953 - DNA, 17 bp, Homo sapiens
tacaaagcccttttata

SEQ ID NO: 2450954 - DNA, 17 bp, Homo sapiens
tacaaaggtttaaatga

SEQ ID NO: 2450955 - DNA, 20 bp, Homo sapiens
tacaaaggtttaaatgaaca

SEQ ID NO: 2450956 - DNA, 16 bp, Homo sapiens
tagcgttcttgtaatt

SEQ ID NO: 2450957 - DNA, 19 bp, Homo sapiens
tagctaaacggattccaaa

SEQ ID NO: 2450958 - DNA, 21 bp, Homo sapiens
tagctaataaaaagcttttgt

SEQ ID NO: 2450959 - DNA, 19 bp, Homo sapiens
tagctaataacatgtgaaa

SEQ ID NO: 2450960 - DNA, 13 bp, Homo sapiens
tagctacagagaa

SEQ ID NO: 2450961 - DNA, 24 bp, Homo sapiens
tagctacagagaaaccagcttcct

SEQ ID NO: 2450962 - DNA, 13 bp, Homo sapiens
tagctcaatgagc

SEQ ID NO: 2450963 - DNA, 18 bp, Homo sapiens
tagctcaatgagcatgtt

SEQ ID NO: 2450964 - DNA, 11 bp, Homo sapiens
tagctcctccc

SEQ ID NO: 2450965 - DNA, 15 bp, Homo sapiens
tagctcctcccctgg

SEQ ID NO: 2450966 - DNA, 20 bp, Homo sapiens
tagctcctgtggccccaccc

SEQ ID NO: 2450967 - DNA, 11 bp, Homo sapiens
tagctctgaga

SEQ ID NO: 2450968 - DNA, 22 bp, Homo sapiens
tagctctggggtgggcagtttt

SEQ ID NO: 2450969 - DNA, 23 bp, Homo sapiens
tagctcttgttgagccgtgggca

SEQ ID NO: 2450970 - DNA, 18 bp, Homo sapiens
tagctctttgtcagggag

SEQ ID NO: 2450971 - DNA, 12 bp, Homo sapiens
tagctgagctca

SEQ ID NO: 2450972 - DNA, 22 bp, Homo sapiens
tagctgtcctttttcctctcca

SEQ ID NO: 2450973 - DNA, 14 bp, Homo sapiens
tagctgtgacctgc

SEQ ID NO: 2450974 - DNA, 15 bp, Homo sapiens
tagctgtgacctgct

SEQ ID NO: 2450975 - DNA, 18 bp, Homo sapiens
tagctgtgacctgctgag

SEQ ID NO: 2450976 - DNA, 22 bp, Homo sapiens
tagctgtgacctgctgagctct

SEQ ID NO: 2450977 - DNA, 12 bp, Homo sapiens
tagcttatgaaa

SEQ ID NO: 2450978 - DNA, 22 bp, Homo sapiens
tagctttggaagtttagctctg

SEQ ID NO: 2450979 - DNA, 19 bp, Homo sapiens
tagcttttgtgggggactg

SEQ ID NO: 2450980 - DNA, 20 bp, Homo sapiens
taggaaatctagaagtagtc

SEQ ID NO: 2450981 - DNA, 14 bp, Homo sapiens
taggaagcctcaga

SEQ ID NO: 2450982 - DNA, 22 bp, Homo sapiens
taggaccaagcatcttgggggg

SEQ ID NO: 2450983 - DNA, 19 bp, Homo sapiens
taggaccatggttaagagt

SEQ ID NO: 2450984 - DNA, 22 bp, Homo sapiens
taggacctttccaccacagcca

SEQ ID NO: 2450985 - DNA, 20 bp, Homo sapiens
taggagaaccaaatctggaa

SEQ ID NO: 2450986 - DNA, 14 bp, Homo sapiens
taggagagaaggta

SEQ ID NO: 2450987 - DNA, 16 bp, Homo sapiens
taggagcaaagcctgt

SEQ ID NO: 2450988 - DNA, 17 bp, Homo sapiens
taggagcaaagcctgtt

SEQ ID NO: 2450989 - DNA, 17 bp, Homo sapiens
taggatttatttaaaat

SEQ ID NO: 2450990 - DNA, 21 bp, Homo sapiens
taggattttttttaatgttta

SEQ ID NO: 2450991 - DNA, 19 bp, Homo sapiens
taggcactgtagttctaag

SEQ ID NO: 2450992 - DNA, 22 bp, Homo sapiens
taggcaggaagcccaattgctg

SEQ ID NO: 2450993 - DNA, 12 bp, Homo sapiens
taggcatttcct

SEQ ID NO: 2450994 - DNA, 16 bp, Homo sapiens
taggccagagcccact

SEQ ID NO: 2450995 - DNA, 17 bp, Homo sapiens
taggccagagcccactc

SEQ ID NO: 2450996 - DNA, 13 bp, Homo sapiens
taggccagcaggg

SEQ ID NO: 2450997 - DNA, 19 bp, Homo sapiens
taggcccccacttgcctct

SEQ ID NO: 2450998 - DNA, 21 bp, Homo sapiens
taggcccccacttgcctcttc

SEQ ID NO: 2450999 - DNA, 15 bp, Homo sapiens
taggctacagagaag

SEQ ID NO: 2451000 - DNA, 16 bp, Homo sapiens
taggctacagagaagc

SEQ ID NO: 2451001 - DNA, 18 bp, Homo sapiens
taggctacagagaagcct

SEQ ID NO: 2451002 - DNA, 19 bp, Homo sapiens
taggctacagagaagcctt

SEQ ID NO: 2451003 - DNA, 20 bp, Homo sapiens
taggctacagagaagccttc

SEQ ID NO: 2451004 - DNA, 20 bp, Homo sapiens
taggctggagttagggactg

SEQ ID NO: 2451005 - DNA, 18 bp, Homo sapiens
taggcttagtttgtgtgt

SEQ ID NO: 2451006 - DNA, 12 bp, Homo sapiens
tagggagccatg

SEQ ID NO: 2451007 - DNA, 17 bp, Homo sapiens
tagggagccatttgaga

SEQ ID NO: 2451008 - DNA, 17 bp, Homo sapiens
tagggatccctcatctg

SEQ ID NO: 2451009 - DNA, 14 bp, Homo sapiens
tagggatgcctcct

SEQ ID NO: 2451010 - DNA, 18 bp, Homo sapiens
taggggaggggctccttt

SEQ ID NO: 2451011 - DNA, 19 bp, Homo sapiens
taggggcccctctcagccc

SEQ ID NO: 2451012 - DNA, 16 bp, Homo sapiens
tagggggctggaggag

SEQ ID NO: 2451013 - DNA, 19 bp, Homo sapiens
tagggtacatggtgctggg

SEQ ID NO: 2451014 - DNA, 22 bp, Homo sapiens
tagggtctggaacaccaggctg

SEQ ID NO: 2451015 - DNA, 19 bp, Homo sapiens
tagggtttccctactgaag

SEQ ID NO: 2451016 - DNA, 19 bp, Homo sapiens
taggtctgaaatttttctt

SEQ ID NO: 2451017 - DNA, 15 bp, Homo sapiens
taggtgatccatgta

SEQ ID NO: 2451018 - DNA, 16 bp, Homo sapiens
taggtgatccatgtaa

SEQ ID NO: 2451019 - DNA, 15 bp, Homo sapiens
taggttctaaagttc

SEQ ID NO: 2451020 - DNA, 17 bp, Homo sapiens
taggttctaaagttcta

SEQ ID NO: 2451021 - DNA, 13 bp, Homo sapiens
taggttgcacact

SEQ ID NO: 2451022 - DNA, 17 bp, Homo sapiens
taggttgcacactttgg

SEQ ID NO: 2451023 - DNA, 19 bp, Homo sapiens
taggttgcacactttggta

SEQ ID NO: 2451024 - DNA, 11 bp, Homo sapiens
taggtttcaaa

SEQ ID NO: 2451025 - DNA, 18 bp, Homo sapiens
tagtaaatcacgcttttt

SEQ ID NO: 2451026 - DNA, 14 bp, Homo sapiens
tagtaacactaata

SEQ ID NO: 2451027 - DNA, 15 bp, Homo sapiens
tagtaacactaatat

SEQ ID NO: 2451028 - DNA, 18 bp, Homo sapiens
tagtaacttcttatggaa

SEQ ID NO: 2451029 - DNA, 14 bp, Homo sapiens
tagtaccaaaataa

SEQ ID NO: 2451030 - DNA, 16 bp, Homo sapiens
tagtaggcatttttac

SEQ ID NO: 2451031 - DNA, 22 bp, Homo sapiens
tagtattgttgtccttttcata

SEQ ID NO: 2451032 - DNA, 19 bp, Homo sapiens
tagtattttttgtataatt

SEQ ID NO: 2451033 - DNA, 15 bp, Homo sapiens
tagtcaatcaagtct

SEQ ID NO: 2451034 - DNA, 18 bp, Homo sapiens
tagtcaatcaagtctgtt

SEQ ID NO: 2451035 - DNA, 21 bp, Homo sapiens
tagtcaatcaagtctgtttac

SEQ ID NO: 2451036 - DNA, 11 bp, Homo sapiens
tagtcctgtga

SEQ ID NO: 2451037 - DNA, 18 bp, Homo sapiens
tagtctcagtgaagacta

SEQ ID NO: 2451038 - DNA, 19 bp, Homo sapiens
tagtctcagtttgtgtgtc

SEQ ID NO: 2451039 - DNA, 12 bp, Homo sapiens
tagtcttttgct

SEQ ID NO: 2451040 - DNA, 16 bp, Homo sapiens
tagtcttttgcttttg

SEQ ID NO: 2451041 - DNA, 18 bp, Homo sapiens
tagtgaatactgctacag

SEQ ID NO: 2451042 - DNA, 22 bp, Homo sapiens
tagtgccacttaatgtatgtta

SEQ ID NO: 2451043 - DNA, 17 bp, Homo sapiens
tagtgctacagggtcca

SEQ ID NO: 2451044 - DNA, 22 bp, Homo sapiens
tagtgctgctgtgtgctttttt

SEQ ID NO: 2451045 - DNA, 15 bp, Homo sapiens
tagtgctttgagaga

SEQ ID NO: 2451046 - DNA, 15 bp, Homo sapiens
tagtgtatgattact

SEQ ID NO: 2451047 - DNA, 14 bp, Homo sapiens
tagttaagacatga

SEQ ID NO: 2451048 - DNA, 16 bp, Homo sapiens
tagttaatcatcaaga

SEQ ID NO: 2451049 - DNA, 20 bp, Homo sapiens
tagttaatcatcaagagaat

SEQ ID NO: 2451050 - DNA, 17 bp, Homo sapiens
tagttaccttatagtta

SEQ ID NO: 2451051 - DNA, 18 bp, Homo sapiens
tagttaccttatagttac

SEQ ID NO: 2451052 - DNA, 23 bp, Homo sapiens
tagttaccttatagttactgtgt

SEQ ID NO: 2451053 - DNA, 19 bp, Homo sapiens
tagttactgtgtaattagt

SEQ ID NO: 2451054 - DNA, 16 bp, Homo sapiens
tagttctagaaaaaca

SEQ ID NO: 2451055 - DNA, 12 bp, Homo sapiens
tagttctagaca

SEQ ID NO: 2451056 - DNA, 23 bp, Homo sapiens
tagttctagacatggaggttcta

SEQ ID NO: 2451057 - DNA, 19 bp, Homo sapiens
tagttctgctccagacagg

SEQ ID NO: 2451058 - DNA, 17 bp, Homo sapiens
tataaaaaatggttcag

SEQ ID NO: 2451059 - DNA, 18 bp, Homo sapiens
tataaaaagcttccatga

SEQ ID NO: 2451060 - DNA, 23 bp, Homo sapiens
tattgataagatcttttattttg

SEQ ID NO: 2451061 - DNA, 20 bp, Homo sapiens
tattgcagtttatcattcaa

SEQ ID NO: 2451062 - DNA, 17 bp, Homo sapiens
tattgctgagaagcaaa

SEQ ID NO: 2451063 - DNA, 16 bp, Homo sapiens
tattgtgtttgtgtat

SEQ ID NO: 2451064 - DNA, 22 bp, Homo sapiens
tattgttacgtagcctaaggct

SEQ ID NO: 2451065 - DNA, 17 bp, Homo sapiens
tattgttcagcatgcaa

SEQ ID NO: 2451066 - DNA, 15 bp, Homo sapiens
tattgttctcacact

SEQ ID NO: 2451067 - DNA, 14 bp, Homo sapiens
tattgttgaaaaag

SEQ ID NO: 2451068 - DNA, 17 bp, Homo sapiens
tattgttgaaaaagttt

SEQ ID NO: 2451069 - DNA, 17 bp, Homo sapiens
tattgttgcattgcttt

SEQ ID NO: 2451070 - DNA, 18 bp, Homo sapiens
tattgttgtccttttcat

SEQ ID NO: 2451071 - DNA, 14 bp, Homo sapiens
tatttaaaaaacta

SEQ ID NO: 2451072 - DNA, 15 bp, Homo sapiens
tatttaaaagtgtca

SEQ ID NO: 2451073 - DNA, 15 bp, Homo sapiens
tatttaaaatagcaa

SEQ ID NO: 2451074 - DNA, 21 bp, Homo sapiens
tatttaaaatagcaaaagaag

SEQ ID NO: 2451075 - DNA, 13 bp, Homo sapiens
tatttaactgact

SEQ ID NO: 2451076 - DNA, 14 bp, Homo sapiens
tatttaatgctgtg

SEQ ID NO: 2451077 - DNA, 21 bp, Homo sapiens
tatttagatgataaagagaca

SEQ ID NO: 2451078 - DNA, 17 bp, Homo sapiens
tatttataaatatattt

SEQ ID NO: 2451079 - DNA, 16 bp, Homo sapiens
tatttatatatgtatt

SEQ ID NO: 2451080 - DNA, 20 bp, Homo sapiens
tatttattgactttgacaat

SEQ ID NO: 2451081 - DNA, 18 bp, Homo sapiens
tatttcaaattggagctt

SEQ ID NO: 2451082 - DNA, 15 bp, Homo sapiens
tatttcacaacagcc

SEQ ID NO: 2451083 - DNA, 21 bp, Homo sapiens
tatttcaggcattggatattt

SEQ ID NO: 2451084 - DNA, 13 bp, Homo sapiens
tatttcatgtttt

SEQ ID NO: 2451085 - DNA, 17 bp, Homo sapiens
tatttctgcatatgttg

SEQ ID NO: 2451086 - DNA, 21 bp, Homo sapiens
tatttgaatgatttttcttta

SEQ ID NO: 2451087 - DNA, 17 bp, Homo sapiens
tatttggaaataaagtc

SEQ ID NO: 2451088 - DNA, 19 bp, Homo sapiens
tatttggaaataaagtcag

SEQ ID NO: 2451089 - DNA, 14 bp, Homo sapiens
tatttgggaagtga

SEQ ID NO: 2451090 - DNA, 15 bp, Homo sapiens
tatttgggaagtgaa

SEQ ID NO: 2451091 - DNA, 22 bp, Homo sapiens
tatttggtgattacattttaaa

SEQ ID NO: 2451092 - DNA, 16 bp, Homo sapiens
tatttgtaaaatgaca

SEQ ID NO: 2451093 - DNA, 20 bp, Homo sapiens
tatttgtaatagatgtttga

SEQ ID NO: 2451094 - DNA, 14 bp, Homo sapiens
tatttgtaattaaa

SEQ ID NO: 2451095 - DNA, 18 bp, Homo sapiens
tatttgtataaaagtgtg

SEQ ID NO: 2451096 - DNA, 22 bp, Homo sapiens
tatttgtataaaagtgtgaaat

SEQ ID NO: 2451097 - DNA, 20 bp, Homo sapiens
tatttgtcatgctgggattt

SEQ ID NO: 2451098 - DNA, 12 bp, Homo sapiens
tatttgtgtttt

SEQ ID NO: 2451099 - DNA, 19 bp, Homo sapiens
tatttgtgttttaatttaa

SEQ ID NO: 2451100 - DNA, 19 bp, Homo sapiens
tatttgttaatagttcctg

SEQ ID NO: 2451101 - DNA, 22 bp, Homo sapiens
tattttaaaatagcgttcttgt

SEQ ID NO: 2451102 - DNA, 13 bp, Homo sapiens
tattttaaaattt

SEQ ID NO: 2451103 - DNA, 16 bp, Homo sapiens
tattttaaagaattgt

SEQ ID NO: 2451104 - DNA, 12 bp, Homo sapiens
tattttatgtta

SEQ ID NO: 2451105 - DNA, 17 bp, Homo sapiens
tattttattatgaagaa

SEQ ID NO: 2451106 - DNA, 16 bp, Homo sapiens
tattttcaaaaccagg

SEQ ID NO: 2451107 - DNA, 19 bp, Homo sapiens
tattttcaatagccactaa

SEQ ID NO: 2451108 - DNA, 14 bp, Homo sapiens
tattttcagatgtg

SEQ ID NO: 2451109 - DNA, 19 bp, Homo sapiens
tattttcatccttgtctta

SEQ ID NO: 2451110 - DNA, 21 bp, Homo sapiens
tattttcctatattacggttt

SEQ ID NO: 2451111 - DNA, 12 bp, Homo sapiens
tattttgaatca

SEQ ID NO: 2451112 - DNA, 13 bp, Homo sapiens
tattttgaatcaa

SEQ ID NO: 2451113 - DNA, 16 bp, Homo sapiens
tattttgaatcaataa

SEQ ID NO: 2451114 - DNA, 22 bp, Homo sapiens
tattttgaatcaataatatatt

SEQ ID NO: 2451115 - DNA, 17 bp, Homo sapiens
tattttgatgtaaagat

SEQ ID NO: 2451116 - DNA, 21 bp, Homo sapiens
tatttttaattaattgggcca

SEQ ID NO: 2451117 - DNA, 11 bp, Homo sapiens
tatttttgccg

SEQ ID NO: 2451118 - DNA, 12 bp, Homo sapiens
tattttttaatt

SEQ ID NO: 2451119 - DNA, 19 bp, Homo sapiens
tattttttcttttctttac

SEQ ID NO: 2451120 - DNA, 17 bp, Homo sapiens
tatttttttctattttt

SEQ ID NO: 2451121 - DNA, 18 bp, Homo sapiens
tatttttttttaagctct

SEQ ID NO: 2451122 - DNA, 22 bp, Homo sapiens
tcaaaaactttggagtcccctc

SEQ ID NO: 2451123 - DNA, 17 bp, Homo sapiens
tcaaaacacttgtaatt

SEQ ID NO: 2451124 - DNA, 24 bp, Homo sapiens
tcaaaacacttgtaattttgtatc

SEQ ID NO: 2451125 - DNA, 22 bp, Homo sapiens
tcaaaaccaggtccaatgagct

SEQ ID NO: 2451126 - DNA, 21 bp, Homo sapiens
tcaaaagttccaagagtctaa

SEQ ID NO: 2451127 - DNA, 13 bp, Homo sapiens
tcaaaagtttgtt

SEQ ID NO: 2451128 - DNA, 21 bp, Homo sapiens
tcaaaatctctccactttcag

SEQ ID NO: 2451129 - DNA, 21 bp, Homo sapiens
tcaaaatgttatcttctcaag

SEQ ID NO: 2451130 - DNA, 14 bp, Homo sapiens
tcaaacaatgacaa

SEQ ID NO: 2451131 - DNA, 15 bp, Homo sapiens
tcaaacattttctgg

SEQ ID NO: 2451132 - DNA, 12 bp, Homo sapiens
tcaaacattttg

SEQ ID NO: 2451133 - DNA, 15 bp, Homo sapiens
tcaaacattttgaaa

SEQ ID NO: 2451134 - DNA, 15 bp, Homo sapiens
tcaaaccctagcctt

SEQ ID NO: 2451135 - DNA, 16 bp, Homo sapiens
tcaaaccctagccttg

SEQ ID NO: 2451136 - DNA, 19 bp, Homo sapiens
tcaaaccctagccttgctt

SEQ ID NO: 2451137 - DNA, 20 bp, Homo sapiens
tcaaaccctagccttgcttg

SEQ ID NO: 2451138 - DNA, 21 bp, Homo sapiens
tcaaactactttgctgctaat

SEQ ID NO: 2451139 - DNA, 21 bp, Homo sapiens
tcaaagaggctgaggctggca

SEQ ID NO: 2451140 - DNA, 15 bp, Homo sapiens
tcaaagcaagcattc

SEQ ID NO: 2451141 - DNA, 22 bp, Homo sapiens
tcaaagcaagcattcagaagaa

SEQ ID NO: 2451142 - DNA, 20 bp, Homo sapiens
tcaaagcaaggaaactatgt

SEQ ID NO: 2451143 - DNA, 15 bp, Homo sapiens
tcaaaggtacttgga

SEQ ID NO: 2451144 - DNA, 16 bp, Homo sapiens
tcaaaggttctaggtt

SEQ ID NO: 2451145 - DNA, 22 bp, Homo sapiens
tcaaatacatttaaaacattaa

SEQ ID NO: 2451146 - DNA, 15 bp, Homo sapiens
tcaaatctaccactg

SEQ ID NO: 2451147 - DNA, 20 bp, Homo sapiens
tcaaatctaccactgtatga

SEQ ID NO: 2451148 - DNA, 23 bp, Homo sapiens
tcaaatgaatggaggaactttcc

SEQ ID NO: 2451149 - DNA, 20 bp, Homo sapiens
tcaaatgttctaagtttcta

SEQ ID NO: 2451150 - DNA, 14 bp, Homo sapiens
tcaacaattctaaa

SEQ ID NO: 2451151 - DNA, 15 bp, Homo sapiens
tcaacaattctaaaa

SEQ ID NO: 2451152 - DNA, 17 bp, Homo sapiens
tcaacaattctaaaatg

SEQ ID NO: 2451153 - DNA, 14 bp, Homo sapiens
tcaacaccatgatt

SEQ ID NO: 2451154 - DNA, 22 bp, Homo sapiens
tcaacaccatgattcctttaac

SEQ ID NO: 2451155 - DNA, 19 bp, Homo sapiens
tcaacagcagggtgggctt

SEQ ID NO: 2451156 - DNA, 23 bp, Homo sapiens
tcaacaggcctcagggctccttg

SEQ ID NO: 2451157 - DNA, 18 bp, Homo sapiens
tcaacagtaaaccactga

SEQ ID NO: 2451158 - DNA, 20 bp, Homo sapiens
tcaacagtaaaccactgaaa

SEQ ID NO: 2451159 - DNA, 15 bp, Homo sapiens
tcaacagtgaagaca

SEQ ID NO: 2451160 - DNA, 15 bp, Homo sapiens
tcaacagttttccta

SEQ ID NO: 2451161 - DNA, 20 bp, Homo sapiens
tcaacagttttcctatgctt

SEQ ID NO: 2451162 - DNA, 15 bp, Homo sapiens
tcaacccctcccctc

SEQ ID NO: 2451163 - DNA, 19 bp, Homo sapiens
tcaacccctcccctccatc

SEQ ID NO: 2451164 - DNA, 16 bp, Homo sapiens
tcatgcctctgaggcc

SEQ ID NO: 2451165 - DNA, 20 bp, Homo sapiens
tcatgcgatgacacttgtac

SEQ ID NO: 2451166 - DNA, 12 bp, Homo sapiens
tcatgctgcctt

SEQ ID NO: 2451167 - DNA, 14 bp, Homo sapiens
tcatgctgggattt

SEQ ID NO: 2451168 - DNA, 18 bp, Homo sapiens
tcatggcagatgtaggag

SEQ ID NO: 2451169 - DNA, 22 bp, Homo sapiens
tcatggcagatgtaggagggac

SEQ ID NO: 2451170 - DNA, 18 bp, Homo sapiens
tcatggcccctctgacct

SEQ ID NO: 2451171 - DNA, 14 bp, Homo sapiens
tcatgtaaactgtg

SEQ ID NO: 2451172 - DNA, 16 bp, Homo sapiens
tcatgtaaactgtgca

SEQ ID NO: 2451173 - DNA, 16 bp, Homo sapiens
tcatgtacaagatgaa

SEQ ID NO: 2451174 - DNA, 13 bp, Homo sapiens
tcatgtggctgga

SEQ ID NO: 2451175 - DNA, 14 bp, Homo sapiens
tcatgtgtataaaa

SEQ ID NO: 2451176 - DNA, 14 bp, Homo sapiens
tcatgtgtcccaga

SEQ ID NO: 2451177 - DNA, 15 bp, Homo sapiens
tcatgtttttgatca

SEQ ID NO: 2451178 - DNA, 18 bp, Homo sapiens
tcattaatctgcctccct

SEQ ID NO: 2451179 - DNA, 13 bp, Homo sapiens
tcattaattctat

SEQ ID NO: 2451180 - DNA, 19 bp, Homo sapiens
tcattagtcatgtttatct

SEQ ID NO: 2451181 - DNA, 22 bp, Homo sapiens
tcattagtcatgtttatctgct

SEQ ID NO: 2451182 - DNA, 23 bp, Homo sapiens
tcattattcgtagatattggaca

SEQ ID NO: 2451183 - DNA, 17 bp, Homo sapiens
tcattatttatgtattg

SEQ ID NO: 2451184 - DNA, 22 bp, Homo sapiens
tcattcaagtgtaaaatatttt

SEQ ID NO: 2451185 - DNA, 22 bp, Homo sapiens
tcattcacatcgcagattctcc

SEQ ID NO: 2451186 - DNA, 16 bp, Homo sapiens
tcattccatgtgccca

SEQ ID NO: 2451187 - DNA, 17 bp, Homo sapiens
tcattccttcagatttg

SEQ ID NO: 2451188 - DNA, 15 bp, Homo sapiens
tcattcgttctgtgg

SEQ ID NO: 2451189 - DNA, 15 bp, Homo sapiens
tcattctctgtctca

SEQ ID NO: 2451190 - DNA, 19 bp, Homo sapiens
tcattctctgtctcatcca

SEQ ID NO: 2451191 - DNA, 19 bp, Homo sapiens
tcattggaaatttagcatt

SEQ ID NO: 2451192 - DNA, 13 bp, Homo sapiens
tcattgtaatcac

SEQ ID NO: 2451193 - DNA, 16 bp, Homo sapiens
tcatttagcctgtcct

SEQ ID NO: 2451194 - DNA, 17 bp, Homo sapiens
tcatttagcctgtcctg

SEQ ID NO: 2451195 - DNA, 18 bp, Homo sapiens
tcatttatctataattta

SEQ ID NO: 2451196 - DNA, 13 bp, Homo sapiens
tcatttctatttc

SEQ ID NO: 2451197 - DNA, 17 bp, Homo sapiens
tcatttctatttctcct

SEQ ID NO: 2451198 - DNA, 14 bp, Homo sapiens
tcatttctcatcca

SEQ ID NO: 2451199 - DNA, 21 bp, Homo sapiens
tcatttgtttaaaaaggcagt

SEQ ID NO: 2451200 - DNA, 14 bp, Homo sapiens
tcattttaattatt

SEQ ID NO: 2451201 - DNA, 12 bp, Homo sapiens
tcatttttacaa

SEQ ID NO: 2451202 - DNA, 20 bp, Homo sapiens
tccaaaaccgccagctctgt

SEQ ID NO: 2451203 - DNA, 21 bp, Homo sapiens
tccaaaaccgccagctctgtt

SEQ ID NO: 2451204 - DNA, 12 bp, Homo sapiens
tccaaaactgcc

SEQ ID NO: 2451205 - DNA, 13 bp, Homo sapiens
tccaaaactgcct

SEQ ID NO: 2451206 - DNA, 14 bp, Homo sapiens
tccaaaagaagccc

SEQ ID NO: 2451207 - DNA, 16 bp, Homo sapiens
tccaaaatgtgcctat

SEQ ID NO: 2451208 - DNA, 14 bp, Homo sapiens
tccaaagaggctgc

SEQ ID NO: 2451209 - DNA, 15 bp, Homo sapiens
tccaaagaggctgcc

SEQ ID NO: 2451210 - DNA, 16 bp, Homo sapiens
tccaaagaggctgccc

SEQ ID NO: 2451211 - DNA, 19 bp, Homo sapiens
tccaaagaggctgcccctc

SEQ ID NO: 2451212 - DNA, 20 bp, Homo sapiens
tccaaagagtagaattgcat

SEQ ID NO: 2451213 - DNA, 23 bp, Homo sapiens
tccaaagagtagaattgcattga

SEQ ID NO: 2451214 - DNA, 17 bp, Homo sapiens
tccaaagtcataattgc

SEQ ID NO: 2451215 - DNA, 14 bp, Homo sapiens
tccaaagtctctaa

SEQ ID NO: 2451216 - DNA, 18 bp, Homo sapiens
tccaaagtctctaattct

SEQ ID NO: 2451217 - DNA, 12 bp, Homo sapiens
tccaaattcagt

SEQ ID NO: 2451218 - DNA, 17 bp, Homo sapiens
tccaacaccaagcacag

SEQ ID NO: 2451219 - DNA, 18 bp, Homo sapiens
tccaacagtttaatgaag

SEQ ID NO: 2451220 - DNA, 21 bp, Homo sapiens
tccaacagtttaatgaagatc

SEQ ID NO: 2451221 - DNA, 20 bp, Homo sapiens
tccaagaatccacatttcta

SEQ ID NO: 2451222 - DNA, 23 bp, Homo sapiens
tccaagaatccacatttctaaaa

SEQ ID NO: 2451223 - DNA, 16 bp, Homo sapiens
tccaagactctagagt

SEQ ID NO: 2451224 - DNA, 21 bp, Homo sapiens
tccaagagctacataatttag

SEQ ID NO: 2451225 - DNA, 14 bp, Homo sapiens
tccaagattctaga

SEQ ID NO: 2451226 - DNA, 19 bp, Homo sapiens
tccaagcagcttagagttg

SEQ ID NO: 2451227 - DNA, 21 bp, Homo sapiens
tccaagcccagcccatggaga

SEQ ID NO: 2451228 - DNA, 23 bp, Homo sapiens
tccaagccccatcttctaaatgg

SEQ ID NO: 2451229 - DNA, 16 bp, Homo sapiens
tccaaggtttaaagag

SEQ ID NO: 2451230 - DNA, 15 bp, Homo sapiens
tccaagttaaatgta

SEQ ID NO: 2451231 - DNA, 20 bp, Homo sapiens
tccaatcaatcttgcatgta

SEQ ID NO: 2451232 - DNA, 14 bp, Homo sapiens
tccaatgagctttc

SEQ ID NO: 2451233 - DNA, 18 bp, Homo sapiens
tccaatgagctttctgaa

SEQ ID NO: 2451234 - DNA, 19 bp, Homo sapiens
tccaatgagctttctgaac

SEQ ID NO: 2451235 - DNA, 21 bp, Homo sapiens
tccaatgagctttctgaacag

SEQ ID NO: 2451236 - DNA, 17 bp, Homo sapiens
tccaatgtctggagacc

SEQ ID NO: 2451237 - DNA, 19 bp, Homo sapiens
tccaattagtttccttttt

SEQ ID NO: 2451238 - DNA, 22 bp, Homo sapiens
tccaattataagaggatatgaa

SEQ ID NO: 2451239 - DNA, 19 bp, Homo sapiens
tccacaagcttctgtcctg

SEQ ID NO: 2451240 - DNA, 15 bp, Homo sapiens
tccacacctgcggcc

SEQ ID NO: 2451241 - DNA, 15 bp, Homo sapiens
tccacaccttttatt

SEQ ID NO: 2451242 - DNA, 21 bp, Homo sapiens
tccacaccttttattgacaca

SEQ ID NO: 2451243 - DNA, 15 bp, Homo sapiens
tccacactgcacaat

SEQ ID NO: 2451244 - DNA, 22 bp, Homo sapiens
tccacagacggaagggtaaaca

SEQ ID NO: 2451245 - DNA, 23 bp, Homo sapiens
tccacagacggaagggtaaacaa

SEQ ID NO: 2451246 - DNA, 17 bp, Homo sapiens
tccacagcaaccccagg

SEQ ID NO: 2451247 - DNA, 18 bp, Homo sapiens
tccacagcctgcaagtca

SEQ ID NO: 2451248 - DNA, 17 bp, Homo sapiens
tccacagggtcccacag

SEQ ID NO: 2451249 - DNA, 16 bp, Homo sapiens
tccacaggtctagact

SEQ ID NO: 2451250 - DNA, 17 bp, Homo sapiens
tccacaggtctagacta

SEQ ID NO: 2451251 - DNA, 12 bp, Homo sapiens
tccacatcctcc

SEQ ID NO: 2451252 - DNA, 15 bp, Homo sapiens
tccacatttctaaaa

SEQ ID NO: 2451253 - DNA, 12 bp, Homo sapiens
tccacccagggg

SEQ ID NO: 2451254 - DNA, 22 bp, Homo sapiens
tccacccaggggcagccccagg

SEQ ID NO: 2451255 - DNA, 22 bp, Homo sapiens
tccaccccatccctccccagtt

SEQ ID NO: 2451256 - DNA, 21 bp, Homo sapiens
tccacccctttctagaccaat

SEQ ID NO: 2451257 - DNA, 22 bp, Homo sapiens
tccacccctttctagaccaata

SEQ ID NO: 2451258 - DNA, 20 bp, Homo sapiens
tccacctggtactccctctc

SEQ ID NO: 2451259 - DNA, 19 bp, Homo sapiens
tccacgactgtctccatgg

SEQ ID NO: 2451260 - DNA, 15 bp, Homo sapiens
tccacggagccactc

SEQ ID NO: 2451261 - DNA, 20 bp, Homo sapiens
tccacgttctgctcatcatt

SEQ ID NO: 2451262 - DNA, 21 bp, Homo sapiens
tccacgttctgctcatcattc

SEQ ID NO: 2451263 - DNA, 15 bp, Homo sapiens
tccactctgcttctc

SEQ ID NO: 2451264 - DNA, 21 bp, Homo sapiens
tccactctgcttctctgactt

SEQ ID NO: 2451265 - DNA, 14 bp, Homo sapiens
tccacttctgacag

SEQ ID NO: 2451266 - DNA, 17 bp, Homo sapiens
tccacttctgacagcct

SEQ ID NO: 2451267 - DNA, 12 bp, Homo sapiens
tccactttcagc

SEQ ID NO: 2451268 - DNA, 18 bp, Homo sapiens
tctaaaatgtgatgttct

SEQ ID NO: 2451269 - DNA, 22 bp, Homo sapiens
tctaaaatgtgatgttctaagg

SEQ ID NO: 2451270 - DNA, 18 bp, Homo sapiens
tctaaaattataaatgac

SEQ ID NO: 2451271 - DNA, 16 bp, Homo sapiens
tctaaacccaatccaa

SEQ ID NO: 2451272 - DNA, 13 bp, Homo sapiens
tctaaactggaga

SEQ ID NO: 2451273 - DNA, 19 bp, Homo sapiens
tctaaactggagactgtgt

SEQ ID NO: 2451274 - DNA, 17 bp, Homo sapiens
tctaaacttccccatct

SEQ ID NO: 2451275 - DNA, 20 bp, Homo sapiens
tctaaagattctatagttct

SEQ ID NO: 2451276 - DNA, 22 bp, Homo sapiens
tctaaagattctatagttctag

SEQ ID NO: 2451277 - DNA, 23 bp, Homo sapiens
tctaaagattctatagttctaga

SEQ ID NO: 2451278 - DNA, 14 bp, Homo sapiens
tctaaagctctgac

SEQ ID NO: 2451279 - DNA, 21 bp, Homo sapiens
tctaaagctggtttaatgttt

SEQ ID NO: 2451280 - DNA, 16 bp, Homo sapiens
tctaaagttctaagat

SEQ ID NO: 2451281 - DNA, 19 bp, Homo sapiens
tctaaagttctaagattct

SEQ ID NO: 2451282 - DNA, 20 bp, Homo sapiens
tctaaagttctaagattctg

SEQ ID NO: 2451283 - DNA, 21 bp, Homo sapiens
tctaaagttctaagattctga

SEQ ID NO: 2451284 - DNA, 16 bp, Homo sapiens
tctaaatatggactgc

SEQ ID NO: 2451285 - DNA, 12 bp, Homo sapiens
tctaacaagtca

SEQ ID NO: 2451286 - DNA, 23 bp, Homo sapiens
tctaacaagtcataggttaatat

SEQ ID NO: 2451287 - DNA, 13 bp, Homo sapiens
tctaacaatgaca

SEQ ID NO: 2451288 - DNA, 22 bp, Homo sapiens
tctaacagcaccaaatcaaaat

SEQ ID NO: 2451289 - DNA, 20 bp, Homo sapiens
tctaacagccctcctctgca

SEQ ID NO: 2451290 - DNA, 23 bp, Homo sapiens
tctaacagccctcctctgcactc

SEQ ID NO: 2451291 - DNA, 22 bp, Homo sapiens
tctaacctttacatgaggactc

SEQ ID NO: 2451292 - DNA, 15 bp, Homo sapiens
tctaacgcctgagcc

SEQ ID NO: 2451293 - DNA, 16 bp, Homo sapiens
tctaacgcctgagccc

SEQ ID NO: 2451294 - DNA, 13 bp, Homo sapiens
tctaagaaagaac

SEQ ID NO: 2451295 - DNA, 12 bp, Homo sapiens
tctaagaaattg

SEQ ID NO: 2451296 - DNA, 18 bp, Homo sapiens
tctaagactcaaatgttc

SEQ ID NO: 2451297 - DNA, 19 bp, Homo sapiens
tctaagactcaaatgttct

SEQ ID NO: 2451298 - DNA, 20 bp, Homo sapiens
tctaagacttactctaagat

SEQ ID NO: 2451299 - DNA, 15 bp, Homo sapiens
tctaagatcttagat

SEQ ID NO: 2451300 - DNA, 19 bp, Homo sapiens
tctaagatcttagattctc

SEQ ID NO: 2451301 - DNA, 21 bp, Homo sapiens
tctaagatcttagattctctg

SEQ ID NO: 2451302 - DNA, 18 bp, Homo sapiens
tctaagatgtgatattct

SEQ ID NO: 2451303 - DNA, 12 bp, Homo sapiens
tctaagattcta

SEQ ID NO: 2451304 - DNA, 13 bp, Homo sapiens
tctaagattctaa

SEQ ID NO: 2451305 - DNA, 19 bp, Homo sapiens
tctaagattctaaaggtcc

SEQ ID NO: 2451306 - DNA, 14 bp, Homo sapiens
tctaagattctaat

SEQ ID NO: 2451307 - DNA, 15 bp, Homo sapiens
tctaagattctaatg

SEQ ID NO: 2451308 - DNA, 16 bp, Homo sapiens
tctaagattctaatga

SEQ ID NO: 2451309 - DNA, 20 bp, Homo sapiens
tctaagattctaatgatgat

SEQ ID NO: 2451310 - DNA, 16 bp, Homo sapiens
tctaagattctagatc

SEQ ID NO: 2451311 - DNA, 17 bp, Homo sapiens
tctaaggacctgaaatt

SEQ ID NO: 2451312 - DNA, 21 bp, Homo sapiens
tctaaggcctaggattctaaa

SEQ ID NO: 2451313 - DNA, 15 bp, Homo sapiens
tctaaggctctgaga

SEQ ID NO: 2451314 - DNA, 17 bp, Homo sapiens
tctaaggctctgagagt

SEQ ID NO: 2451315 - DNA, 23 bp, Homo sapiens
tctaaggtccggtgttctaagat

SEQ ID NO: 2451316 - DNA, 14 bp, Homo sapiens
tctaagtaaataca

SEQ ID NO: 2451317 - DNA, 15 bp, Homo sapiens
tctaagtaaatacaa

SEQ ID NO: 2451318 - DNA, 20 bp, Homo sapiens
tctaagtaaatacaattttt

SEQ ID NO: 2451319 - DNA, 14 bp, Homo sapiens
tctaagtctttcca

SEQ ID NO: 2451320 - DNA, 13 bp, Homo sapiens
tctaagtttctaa

SEQ ID NO: 2451321 - DNA, 22 bp, Homo sapiens
tctaagtttctaagattctaaa

SEQ ID NO: 2451322 - DNA, 20 bp, Homo sapiens
tctaatctagatatcgactt

SEQ ID NO: 2451323 - DNA, 15 bp, Homo sapiens
tctaattaattgtaa

SEQ ID NO: 2451324 - DNA, 17 bp, Homo sapiens
tctaattaattgtaatc

SEQ ID NO: 2451325 - DNA, 18 bp, Homo sapiens
tctaattatgtagctctt

SEQ ID NO: 2451326 - DNA, 21 bp, Homo sapiens
tctaattctattaaagtgcta

SEQ ID NO: 2451327 - DNA, 13 bp, Homo sapiens
tctaattgcttat

SEQ ID NO: 2451328 - DNA, 18 bp, Homo sapiens
tctaattgcttatttatt

SEQ ID NO: 2451329 - DNA, 14 bp, Homo sapiens
tctaatttttaaga

SEQ ID NO: 2451330 - DNA, 19 bp, Homo sapiens
tctacagagcttccctgac

SEQ ID NO: 2451331 - DNA, 18 bp, Homo sapiens
tctacagtctcgtctctt

SEQ ID NO: 2451332 - DNA, 15 bp, Homo sapiens
tctacatcttctgcc

SEQ ID NO: 2451333 - DNA, 17 bp, Homo sapiens
tctacatcttctgcctt

SEQ ID NO: 2451334 - DNA, 20 bp, Homo sapiens
tctaccattttctggttctt

SEQ ID NO: 2451335 - DNA, 21 bp, Homo sapiens
tctaccccagactagatgtag

SEQ ID NO: 2451336 - DNA, 17 bp, Homo sapiens
tctacctagatttaata

SEQ ID NO: 2451337 - DNA, 21 bp, Homo sapiens
tctacctagatttaatataaa

SEQ ID NO: 2451338 - DNA, 16 bp, Homo sapiens
tctaccttctccccag

SEQ ID NO: 2451339 - DNA, 20 bp, Homo sapiens
tctaccttctccccagctcc

SEQ ID NO: 2451340 - DNA, 19 bp, Homo sapiens
tctactgggaaggctactt

SEQ ID NO: 2451341 - DNA, 20 bp, Homo sapiens
tctactgggaaggctacttc

SEQ ID NO: 2451342 - DNA, 21 bp, Homo sapiens
tctacttaatccaatgggttt

SEQ ID NO: 2451343 - DNA, 12 bp, Homo sapiens
tctactttgaag

SEQ ID NO: 2451344 - DNA, 22 bp, Homo sapiens
tctagaaaaacaggcacttggc

SEQ ID NO: 2451345 - DNA, 18 bp, Homo sapiens
tctagaacttgaccccct

SEQ ID NO: 2451346 - DNA, 22 bp, Homo sapiens
tctagaatctgcaattcaaaag

SEQ ID NO: 2451347 - DNA, 20 bp, Homo sapiens
tctagatgaagttttacatt

SEQ ID NO: 2451348 - DNA, 23 bp, Homo sapiens
tctagatgaagttttacattgtt

SEQ ID NO: 2451349 - DNA, 17 bp, Homo sapiens
tctagattcaaaggttc

SEQ ID NO: 2451350 - DNA, 20 bp, Homo sapiens
tctagggtacatggtgctgg

SEQ ID NO: 2451351 - DNA, 23 bp, Homo sapiens
tctagggtacatggtgctgggag

SEQ ID NO: 2451352 - DNA, 21 bp, Homo sapiens
tctaggtacgatgacagtgtt

SEQ ID NO: 2451353 - DNA, 14 bp, Homo sapiens
tctaggttctaaaa

SEQ ID NO: 2451354 - DNA, 15 bp, Homo sapiens
tctaggtttcaaaga

SEQ ID NO: 2451355 - DNA, 20 bp, Homo sapiens
tctaggtttcaaagatgctg

SEQ ID NO: 2451356 - DNA, 14 bp, Homo sapiens
tctataaactataa

SEQ ID NO: 2451357 - DNA, 15 bp, Homo sapiens
tctataaagcattta

SEQ ID NO: 2451358 - DNA, 19 bp, Homo sapiens
tctatagccaaaaatagct

SEQ ID NO: 2451359 - DNA, 20 bp, Homo sapiens
tctatagccaaaaatagcta

SEQ ID NO: 2451360 - DNA, 18 bp, Homo sapiens
tctatgagtctagatgtt

SEQ ID NO: 2451361 - DNA, 15 bp, Homo sapiens
tctatgggtgttatc

SEQ ID NO: 2451362 - DNA, 11 bp, Homo sapiens
tctattaaaag

SEQ ID NO: 2451363 - DNA, 14 bp, Homo sapiens
tctattaaaagact

SEQ ID NO: 2451364 - DNA, 17 bp, Homo sapiens
tctattaaaagactcat

SEQ ID NO: 2451365 - DNA, 19 bp, Homo sapiens
tctattaaaagactcatcc

SEQ ID NO: 2451366 - DNA, 22 bp, Homo sapiens
tctattaaaagactcatccgtc

SEQ ID NO: 2451367 - DNA, 23 bp, Homo sapiens
tctattaaagtgctaaggttcta

SEQ ID NO: 2451368 - DNA, 18 bp, Homo sapiens
tctattcgccacacagta

SEQ ID NO: 2451369 - DNA, 19 bp, Homo sapiens
tctattcgccacacagtat

SEQ ID NO: 2451370 - DNA, 14 bp, Homo sapiens
tctatttcactgga

SEQ ID NO: 2451371 - DNA, 18 bp, Homo sapiens
tctggcagccacacttct

SEQ ID NO: 2451372 - DNA, 21 bp, Homo sapiens
tctggcagccacacttctcag

SEQ ID NO: 2451373 - DNA, 16 bp, Homo sapiens
tctggcagcctcccat

SEQ ID NO: 2451374 - DNA, 18 bp, Homo sapiens
tctggcattagaattatt

SEQ ID NO: 2451375 - DNA, 17 bp, Homo sapiens
tctggccaggaagcttt

SEQ ID NO: 2451376 - DNA, 13 bp, Homo sapiens
tctggcctggcca

SEQ ID NO: 2451377 - DNA, 16 bp, Homo sapiens
tctggctgtaaggctc

SEQ ID NO: 2451378 - DNA, 21 bp, Homo sapiens
tctggctgtaaggctctagat

SEQ ID NO: 2451379 - DNA, 18 bp, Homo sapiens
tctggcttctggccagga

SEQ ID NO: 2451380 - DNA, 15 bp, Homo sapiens
tctgggagtcacaca

SEQ ID NO: 2451381 - DNA, 12 bp, Homo sapiens
tctgggcctgac

SEQ ID NO: 2451382 - DNA, 15 bp, Homo sapiens
tctgggccttggcct

SEQ ID NO: 2451383 - DNA, 18 bp, Homo sapiens
tctgggccttggcctgga

SEQ ID NO: 2451384 - DNA, 20 bp, Homo sapiens
tctgggccttggcctggagc

SEQ ID NO: 2451385 - DNA, 14 bp, Homo sapiens
tctgggctctgagt

SEQ ID NO: 2451386 - DNA, 13 bp, Homo sapiens
tctgggcttcctg

SEQ ID NO: 2451387 - DNA, 15 bp, Homo sapiens
tctgggcttcctgga

SEQ ID NO: 2451388 - DNA, 18 bp, Homo sapiens
tctgggcttcctggagca

SEQ ID NO: 2451389 - DNA, 19 bp, Homo sapiens
tctggggagcaggcagcca

SEQ ID NO: 2451390 - DNA, 19 bp, Homo sapiens
tctgggggctgaggagcag

SEQ ID NO: 2451391 - DNA, 19 bp, Homo sapiens
tctggggggtggccaggcc

SEQ ID NO: 2451392 - DNA, 23 bp, Homo sapiens
tctggtagaagggaaagcccata

SEQ ID NO: 2451393 - DNA, 17 bp, Homo sapiens
tctggtgagtcaccact

SEQ ID NO: 2451394 - DNA, 15 bp, Homo sapiens
tctggtgcctccaga

SEQ ID NO: 2451395 - DNA, 12 bp, Homo sapiens
tctggtggcccc

SEQ ID NO: 2451396 - DNA, 13 bp, Homo sapiens
tctggtgttctat

SEQ ID NO: 2451397 - DNA, 21 bp, Homo sapiens
tctggtgttggacaagcttct

SEQ ID NO: 2451398 - DNA, 13 bp, Homo sapiens
tctggttccaggg

SEQ ID NO: 2451399 - DNA, 14 bp, Homo sapiens
tctggttccagggt

SEQ ID NO: 2451400 - DNA, 21 bp, Homo sapiens
tctggttccagggtccctctg

SEQ ID NO: 2451401 - DNA, 11 bp, Homo sapiens
tctggttctaa

SEQ ID NO: 2451402 - DNA, 13 bp, Homo sapiens
tctggttctaaca

SEQ ID NO: 2451403 - DNA, 14 bp, Homo sapiens
tctggttctcaatt

SEQ ID NO: 2451404 - DNA, 20 bp, Homo sapiens
tctggttctcaattccaaca

SEQ ID NO: 2451405 - DNA, 20 bp, Homo sapiens
tctggttgtttctgttccaa

SEQ ID NO: 2451406 - DNA, 16 bp, Homo sapiens
tctgtaaatctacaca

SEQ ID NO: 2451407 - DNA, 14 bp, Homo sapiens
tctgtaagaaacct

SEQ ID NO: 2451408 - DNA, 16 bp, Homo sapiens
tctgtaattcaggttt

SEQ ID NO: 2451409 - DNA, 13 bp, Homo sapiens
tctgtaattgtgt

SEQ ID NO: 2451410 - DNA, 12 bp, Homo sapiens
tctgtaccagtt

SEQ ID NO: 2451411 - DNA, 15 bp, Homo sapiens
tctgtaggttgcaca

SEQ ID NO: 2451412 - DNA, 20 bp, Homo sapiens
tctgtataaatgtctttaat

SEQ ID NO: 2451413 - DNA, 15 bp, Homo sapiens
tctgtatatactttt

SEQ ID NO: 2451414 - DNA, 19 bp, Homo sapiens
tctgtcagtcacagccacc

SEQ ID NO: 2451415 - DNA, 12 bp, Homo sapiens
tctgtcagttct

SEQ ID NO: 2451416 - DNA, 16 bp, Homo sapiens
tctgtcccttgccccc

SEQ ID NO: 2451417 - DNA, 14 bp, Homo sapiens
tctgtcctcagcct

SEQ ID NO: 2451418 - DNA, 15 bp, Homo sapiens
tctgtcctcagcctt

SEQ ID NO: 2451419 - DNA, 21 bp, Homo sapiens
tctgtcctcagccttgccaga

SEQ ID NO: 2451420 - DNA, 23 bp, Homo sapiens
tctgtcctcagccttgccagaga

SEQ ID NO: 2451421 - DNA, 18 bp, Homo sapiens
tctgtctacttgctcagg

SEQ ID NO: 2451422 - DNA, 23 bp, Homo sapiens
tctgtctacttgctcaggtactt

SEQ ID NO: 2451423 - DNA, 13 bp, Homo sapiens
tctgtctcatcca

SEQ ID NO: 2451424 - DNA, 13 bp, Homo sapiens
tctgtctggtggc

SEQ ID NO: 2451425 - DNA, 16 bp, Homo sapiens
tctgtctggtggcccc

SEQ ID NO: 2451426 - DNA, 20 bp, Homo sapiens
tctgtgccagagcctggggc

SEQ ID NO: 2451427 - DNA, 16 bp, Homo sapiens
tctgtgtctaagattc

SEQ ID NO: 2451428 - DNA, 17 bp, Homo sapiens
tctgtgtctaagattct

SEQ ID NO: 2451429 - DNA, 20 bp, Homo sapiens
tctgtgtctaagattctaga

SEQ ID NO: 2451430 - DNA, 22 bp, Homo sapiens
tctgtgtctaagattctagatc

SEQ ID NO: 2451431 - DNA, 23 bp, Homo sapiens
tctgtgtctaagattctagatca

SEQ ID NO: 2451432 - DNA, 11 bp, Homo sapiens
tctgtgtcttt

SEQ ID NO: 2451433 - DNA, 20 bp, Homo sapiens
tctgttaactgaataccact

SEQ ID NO: 2451434 - DNA, 13 bp, Homo sapiens
tctgttccaaatt

SEQ ID NO: 2451435 - DNA, 17 bp, Homo sapiens
tctgttccaaattcagt

SEQ ID NO: 2451436 - DNA, 15 bp, Homo sapiens
tctgttctagttttt

SEQ ID NO: 2451437 - DNA, 16 bp, Homo sapiens
tctgttctgtttcaag

SEQ ID NO: 2451438 - DNA, 17 bp, Homo sapiens
tctgttcttcctcagcc

SEQ ID NO: 2451439 - DNA, 18 bp, Homo sapiens
tctgttggcaggctggcc

SEQ ID NO: 2451440 - DNA, 20 bp, Homo sapiens
tctgttggcaggctggccag

SEQ ID NO: 2451441 - DNA, 12 bp, Homo sapiens
tctgtttcaagg

SEQ ID NO: 2451442 - DNA, 13 bp, Homo sapiens
tctgtttgctgtg

SEQ ID NO: 2451443 - DNA, 19 bp, Homo sapiens
tcttaaagtgccagtattt

SEQ ID NO: 2451444 - DNA, 16 bp, Homo sapiens
tcttaaataagaaact

SEQ ID NO: 2451445 - DNA, 19 bp, Homo sapiens
tcttaaataagaaactttt

SEQ ID NO: 2451446 - DNA, 12 bp, Homo sapiens
tcttaagggcac

SEQ ID NO: 2451447 - DNA, 19 bp, Homo sapiens
tcttaattgccacctctaa

SEQ ID NO: 2451448 - DNA, 15 bp, Homo sapiens
tcttacttggaactg

SEQ ID NO: 2451449 - DNA, 21 bp, Homo sapiens
tcttagctatcattgcttcct

SEQ ID NO: 2451450 - DNA, 16 bp, Homo sapiens
tcttagctcaatgagc

SEQ ID NO: 2451451 - DNA, 17 bp, Homo sapiens
tcttagtctaggtcctt

SEQ ID NO: 2451452 - DNA, 14 bp, Homo sapiens
tcttagtgtatgat

SEQ ID NO: 2451453 - DNA, 17 bp, Homo sapiens
tcttatagttctaggca

SEQ ID NO: 2451454 - DNA, 15 bp, Homo sapiens
tcttatgctgtaccc

SEQ ID NO: 2451455 - DNA, 14 bp, Homo sapiens
tcttatggaattga

SEQ ID NO: 2451456 - DNA, 14 bp, Homo sapiens
tcttcaaatgcctg

SEQ ID NO: 2451457 - DNA, 14 bp, Homo sapiens
tcttcaagaaatct

SEQ ID NO: 2451458 - DNA, 14 bp, Homo sapiens
tcttccatgctgtg

SEQ ID NO: 2451459 - DNA, 17 bp, Homo sapiens
tcttccatgctgtgcgc

SEQ ID NO: 2451460 - DNA, 14 bp, Homo sapiens
tcttccatttgcaa

SEQ ID NO: 2451461 - DNA, 13 bp, Homo sapiens
tcttccccagacg

SEQ ID NO: 2451462 - DNA, 16 bp, Homo sapiens
tcttccccctctccca

SEQ ID NO: 2451463 - DNA, 16 bp, Homo sapiens
tcttccctctctgcag

SEQ ID NO: 2451464 - DNA, 20 bp, Homo sapiens
tcttccggcccctcccctcc

SEQ ID NO: 2451465 - DNA, 17 bp, Homo sapiens
tcttcctactggtctct

SEQ ID NO: 2451466 - DNA, 14 bp, Homo sapiens
tcttcctcagccag

SEQ ID NO: 2451467 - DNA, 17 bp, Homo sapiens
tcttcctcagccagcct

SEQ ID NO: 2451468 - DNA, 18 bp, Homo sapiens
tcttcctcagccagcctc

SEQ ID NO: 2451469 - DNA, 18 bp, Homo sapiens
tcttcctgagtggtgcca

SEQ ID NO: 2451470 - DNA, 13 bp, Homo sapiens
tcttctaaacttc

SEQ ID NO: 2451471 - DNA, 12 bp, Homo sapiens
tcttctaaatgg

SEQ ID NO: 2451472 - DNA, 22 bp, Homo sapiens
tcttctactcacttttcccact

SEQ ID NO: 2451473 - DNA, 12 bp, Homo sapiens
tcttctagagtt

SEQ ID NO: 2451474 - DNA, 17 bp, Homo sapiens
tcttctagagttcagag

SEQ ID NO: 2451475 - DNA, 17 bp, Homo sapiens
tcttctaggttctaaaa

SEQ ID NO: 2451476 - DNA, 13 bp, Homo sapiens
tgagatattaatg

SEQ ID NO: 2451477 - DNA, 20 bp, Homo sapiens
tgagatattaatgcccagac

SEQ ID NO: 2451478 - DNA, 15 bp, Homo sapiens
tgagatgctggcttg

SEQ ID NO: 2451479 - DNA, 17 bp, Homo sapiens
tgagattgaatttcact

SEQ ID NO: 2451480 - DNA, 18 bp, Homo sapiens
tgagatttattaaagaaa

SEQ ID NO: 2451481 - DNA, 21 bp, Homo sapiens
tgagcaacgctattccagctg

SEQ ID NO: 2451482 - DNA, 13 bp, Homo sapiens
tgagcactgccag

SEQ ID NO: 2451483 - DNA, 16 bp, Homo sapiens
tgagcactgccaggag

SEQ ID NO: 2451484 - DNA, 19 bp, Homo sapiens
tgagcactgccaggaggga

SEQ ID NO: 2451485 - DNA, 22 bp, Homo sapiens
tgagcaggccacacttcaaact

SEQ ID NO: 2451486 - DNA, 12 bp, Homo sapiens
tgagcagggccg

SEQ ID NO: 2451487 - DNA, 14 bp, Homo sapiens
tgagcagggccggg

SEQ ID NO: 2451488 - DNA, 16 bp, Homo sapiens
tgagcagggccgggga

SEQ ID NO: 2451489 - DNA, 17 bp, Homo sapiens
tgagcagtccttggcct

SEQ ID NO: 2451490 - DNA, 21 bp, Homo sapiens
tgagcataggtgatccatgta

SEQ ID NO: 2451491 - DNA, 18 bp, Homo sapiens
tgagcatctgtccccctt

SEQ ID NO: 2451492 - DNA, 15 bp, Homo sapiens
tgagcatgttactga

SEQ ID NO: 2451493 - DNA, 15 bp, Homo sapiens
tgagcatgtttagac

SEQ ID NO: 2451494 - DNA, 12 bp, Homo sapiens
tgagccaccacg

SEQ ID NO: 2451495 - DNA, 12 bp, Homo sapiens
tgagcccaggga

SEQ ID NO: 2451496 - DNA, 14 bp, Homo sapiens
tgagccccagggag

SEQ ID NO: 2451497 - DNA, 15 bp, Homo sapiens
tgagcccctggaggc

SEQ ID NO: 2451498 - DNA, 22 bp, Homo sapiens
tgagcgaggagatgctccttgg

SEQ ID NO: 2451499 - DNA, 18 bp, Homo sapiens
tgagcgcctccatccaag

SEQ ID NO: 2451500 - DNA, 21 bp, Homo sapiens
tgagctactgccgtcagtgct

SEQ ID NO: 2451501 - DNA, 24 bp, Homo sapiens
tgagctactgccgtcagtgctgtg

SEQ ID NO: 2451502 - DNA, 17 bp, Homo sapiens
tgagctagaaccctctg

SEQ ID NO: 2451503 - DNA, 18 bp, Homo sapiens
tgagctcacaaggcagca

SEQ ID NO: 2451504 - DNA, 22 bp, Homo sapiens
tgagctcacaaggcagcaaggc

SEQ ID NO: 2451505 - DNA, 15 bp, Homo sapiens
tgagctcccacaagc

SEQ ID NO: 2451506 - DNA, 19 bp, Homo sapiens
tgagctcccacaagcctga

SEQ ID NO: 2451507 - DNA, 20 bp, Homo sapiens
tgagctcccacaagcctgag

SEQ ID NO: 2451508 - DNA, 21 bp, Homo sapiens
tgagctcccacaagcctgagg

SEQ ID NO: 2451509 - DNA, 18 bp, Homo sapiens
tgagctcctgtcccctgc

SEQ ID NO: 2451510 - DNA, 21 bp, Homo sapiens
tgagctcctgtcccctgctac

SEQ ID NO: 2451511 - DNA, 22 bp, Homo sapiens
tgagctcctgtcccctgctaca

SEQ ID NO: 2451512 - DNA, 20 bp, Homo sapiens
tgagctctattatgaatgtg

SEQ ID NO: 2451513 - DNA, 15 bp, Homo sapiens
tgagctctgagaggc

SEQ ID NO: 2451514 - DNA, 15 bp, Homo sapiens
tgagctgaccagccg

SEQ ID NO: 2451515 - DNA, 20 bp, Homo sapiens
tgagcttaaaatacaagact

SEQ ID NO: 2451516 - DNA, 22 bp, Homo sapiens
tgagcttaaaatacaagactgc

SEQ ID NO: 2451517 - DNA, 13 bp, Homo sapiens
tgagctttctgaa

SEQ ID NO: 2451518 - DNA, 22 bp, Homo sapiens
tgaggagcagcaggagggggga

SEQ ID NO: 2451519 - DNA, 20 bp, Homo sapiens
tgaggagctggggatccctc

SEQ ID NO: 2451520 - DNA, 15 bp, Homo sapiens
tgaggagtctgaggt

SEQ ID NO: 2451521 - DNA, 21 bp, Homo sapiens
tgaggagtctgaggtcctgag

SEQ ID NO: 2451522 - DNA, 12 bp, Homo sapiens
tgaggcaaaaga

SEQ ID NO: 2451523 - DNA, 12 bp, Homo sapiens
tgaggccacact

SEQ ID NO: 2451524 - DNA, 20 bp, Homo sapiens
tgaggccacactcagcacaa

SEQ ID NO: 2451525 - DNA, 16 bp, Homo sapiens
tgaggccagcctggcc

SEQ ID NO: 2451526 - DNA, 17 bp, Homo sapiens
tgaggccagcctggcct

SEQ ID NO: 2451527 - DNA, 18 bp, Homo sapiens
tgaggccagcctggcctc

SEQ ID NO: 2451528 - DNA, 20 bp, Homo sapiens
tgaggccagcctggcctcct

SEQ ID NO: 2451529 - DNA, 22 bp, Homo sapiens
tgaggccagcctggcctcctgc

SEQ ID NO: 2451530 - DNA, 14 bp, Homo sapiens
tgaggccagggcag

SEQ ID NO: 2451531 - DNA, 15 bp, Homo sapiens
tgaggccagggcaga

SEQ ID NO: 2451532 - DNA, 13 bp, Homo sapiens
tgaggccctccac

SEQ ID NO: 2451533 - DNA, 11 bp, Homo sapiens
tgaggcctgga

SEQ ID NO: 2451534 - DNA, 12 bp, Homo sapiens
tgaggcctggac

SEQ ID NO: 2451535 - DNA, 23 bp, Homo sapiens
tgaggcctggactttcctgcaac

SEQ ID NO: 2451536 - DNA, 20 bp, Homo sapiens
tgaggcgagaagggctgctt

SEQ ID NO: 2451537 - DNA, 21 bp, Homo sapiens
tgaggcgagaagggctgcttc

SEQ ID NO: 2451538 - DNA, 11 bp, Homo sapiens
tgaggctggca

SEQ ID NO: 2451539 - DNA, 14 bp, Homo sapiens
tgaggctggcacag

SEQ ID NO: 2451540 - DNA, 17 bp, Homo sapiens
tgaggctggcacaggac

SEQ ID NO: 2451541 - DNA, 13 bp, Homo sapiens
tgaggctgtcctg

SEQ ID NO: 2451542 - DNA, 13 bp, Homo sapiens
tgagggcagcagc

SEQ ID NO: 2451543 - DNA, 21 bp, Homo sapiens
tgagggcagttcgcagccacc

SEQ ID NO: 2451544 - DNA, 16 bp, Homo sapiens
tgaggggaccaggagt

SEQ ID NO: 2451545 - DNA, 22 bp, Homo sapiens
tgaggggttcctcccctccagc

SEQ ID NO: 2451546 - DNA, 18 bp, Homo sapiens
tgagggtctgtaggttgc

SEQ ID NO: 2451547 - DNA, 14 bp, Homo sapiens
tgaggtctgttcct

SEQ ID NO: 2451548 - DNA, 16 bp, Homo sapiens
tgaggtctgttccttt

SEQ ID NO: 2451549 - DNA, 16 bp, Homo sapiens
tgaggtgcccaggaga

SEQ ID NO: 2451550 - DNA, 20 bp, Homo sapiens
tgaggtgtcagagaaaatga

SEQ ID NO: 2451551 - DNA, 15 bp, Homo sapiens
tgaggtgtccaactg

SEQ ID NO: 2451552 - DNA, 17 bp, Homo sapiens
tgaggttactggaaatt

SEQ ID NO: 2451553 - DNA, 19 bp, Homo sapiens
tgagtaacatttgctgttt

SEQ ID NO: 2451554 - DNA, 19 bp, Homo sapiens
tgagtaatggtgtagaaca

SEQ ID NO: 2451555 - DNA, 20 bp, Homo sapiens
tgagtactccacactgcaca

SEQ ID NO: 2451556 - DNA, 21 bp, Homo sapiens
tgagtactccacactgcacaa

SEQ ID NO: 2451557 - DNA, 14 bp, Homo sapiens
tgagtattaaaatg

SEQ ID NO: 2451558 - DNA, 17 bp, Homo sapiens
tgagtattaaaatgtat

SEQ ID NO: 2451559 - DNA, 18 bp, Homo sapiens
tgagtctttggttctaag

SEQ ID NO: 2451560 - DNA, 13 bp, Homo sapiens
tgagtgggaagcc

SEQ ID NO: 2451561 - DNA, 14 bp, Homo sapiens
tgagtgggaagccc

SEQ ID NO: 2451562 - DNA, 22 bp, Homo sapiens
tgagtgtgcggctgtgtgtgca

SEQ ID NO: 2451563 - DNA, 21 bp, Homo sapiens
tgagtgttttatgagaaagcc

SEQ ID NO: 2451564 - DNA, 19 bp, Homo sapiens
tgagttggggtctggcagc

SEQ ID NO: 2451565 - DNA, 19 bp, Homo sapiens
tgagtttgtcgctcatgtg

SEQ ID NO: 2451566 - DNA, 20 bp, Homo sapiens
tgagtttgtcgctcatgtgt

SEQ ID NO: 2451567 - DNA, 13 bp, Homo sapiens
tgagttttccatg

SEQ ID NO: 2451568 - DNA, 15 bp, Homo sapiens
tgataaagagacagt

SEQ ID NO: 2451569 - DNA, 14 bp, Homo sapiens
tgataatagattct

SEQ ID NO: 2451570 - DNA, 16 bp, Homo sapiens
tgataatgaacagaac

SEQ ID NO: 2451571 - DNA, 18 bp, Homo sapiens
tgataccacctttactgt

SEQ ID NO: 2451572 - DNA, 15 bp, Homo sapiens
tgatacccccctctg

SEQ ID NO: 2451573 - DNA, 18 bp, Homo sapiens
tgatacccccctctgtct

SEQ ID NO: 2451574 - DNA, 15 bp, Homo sapiens
tgatacgatgcttca

SEQ ID NO: 2451575 - DNA, 16 bp, Homo sapiens
tgatacgatgcttcaa

SEQ ID NO: 2451576 - DNA, 22 bp, Homo sapiens
tgatactaataaactaataatt

SEQ ID NO: 2451577 - DNA, 13 bp, Homo sapiens
tgatactgttgca

SEQ ID NO: 2451578 - DNA, 16 bp, Homo sapiens
tgatactgttgcacgt

SEQ ID NO: 2451579 - DNA, 18 bp, Homo sapiens
tgatactgttgcacgtgt

SEQ ID NO: 2451580 - DNA, 18 bp, Homo sapiens
tgctaacggtgctcaggg

SEQ ID NO: 2451581 - DNA, 22 bp, Homo sapiens
tgctaagagaagtagaaatcat

SEQ ID NO: 2451582 - DNA, 14 bp, Homo sapiens
tgctaaggttctaa

SEQ ID NO: 2451583 - DNA, 18 bp, Homo sapiens
tgctaatattttcctcct

SEQ ID NO: 2451584 - DNA, 18 bp, Homo sapiens
tgctaccagtatttagaa

SEQ ID NO: 2451585 - DNA, 22 bp, Homo sapiens
tgctaccagtatttagaagcca

SEQ ID NO: 2451586 - DNA, 13 bp, Homo sapiens
tgctactggggaa

SEQ ID NO: 2451587 - DNA, 18 bp, Homo sapiens
tgctactggggaaactgg

SEQ ID NO: 2451588 - DNA, 15 bp, Homo sapiens
tgctagaacatggtt

SEQ ID NO: 2451589 - DNA, 13 bp, Homo sapiens
tgctagagctcct

SEQ ID NO: 2451590 - DNA, 12 bp, Homo sapiens
tgctaggaagag

SEQ ID NO: 2451591 - DNA, 14 bp, Homo sapiens
tgctatggttttct

SEQ ID NO: 2451592 - DNA, 17 bp, Homo sapiens
tgctatggttttctcca

SEQ ID NO: 2451593 - DNA, 11 bp, Homo sapiens
tgctattctgt

SEQ ID NO: 2451594 - DNA, 13 bp, Homo sapiens
tgctattctgtcc

SEQ ID NO: 2451595 - DNA, 16 bp, Homo sapiens
tgctattctgtcccta

SEQ ID NO: 2451596 - DNA, 19 bp, Homo sapiens
tgctcacccagtgccctct

SEQ ID NO: 2451597 - DNA, 16 bp, Homo sapiens
tgctcagctgtcaagg

SEQ ID NO: 2451598 - DNA, 20 bp, Homo sapiens
tgctcagctgtcaaggctca

SEQ ID NO: 2451599 - DNA, 21 bp, Homo sapiens
tgctcatcattctctgtctca

SEQ ID NO: 2451600 - DNA, 23 bp, Homo sapiens
tgctcatcattctctgtctcatc

SEQ ID NO: 2451601 - DNA, 14 bp, Homo sapiens
tgctcatctgctgg

SEQ ID NO: 2451602 - DNA, 13 bp, Homo sapiens
tgctccagacagg

SEQ ID NO: 2451603 - DNA, 14 bp, Homo sapiens
tgctccagacctga

SEQ ID NO: 2451604 - DNA, 21 bp, Homo sapiens
tgctccagacctgatcctgga

SEQ ID NO: 2451605 - DNA, 21 bp, Homo sapiens
tgctcccaaggggcctgagca

SEQ ID NO: 2451606 - DNA, 14 bp, Homo sapiens
tgctccctcagact

SEQ ID NO: 2451607 - DNA, 15 bp, Homo sapiens
tgctcctcttcccca

SEQ ID NO: 2451608 - DNA, 18 bp, Homo sapiens
tgctcctggatctccctg

SEQ ID NO: 2451609 - DNA, 16 bp, Homo sapiens
tgctccttgggccctt

SEQ ID NO: 2451610 - DNA, 18 bp, Homo sapiens
tgctccttgggccctttg

SEQ ID NO: 2451611 - DNA, 14 bp, Homo sapiens
tgctcgccctgcgg

SEQ ID NO: 2451612 - DNA, 18 bp, Homo sapiens
tgctcggggtgcacagga

SEQ ID NO: 2451613 - DNA, 20 bp, Homo sapiens
tgctctccattctgctcctt

SEQ ID NO: 2451614 - DNA, 10 bp, Homo sapiens
tgctctcctc

SEQ ID NO: 2451615 - DNA, 15 bp, Homo sapiens
tgctctctttctgtc

SEQ ID NO: 2451616 - DNA, 11 bp, Homo sapiens
tgctctgagaa

SEQ ID NO: 2451617 - DNA, 14 bp, Homo sapiens
tgctctgatccctc

SEQ ID NO: 2451618 - DNA, 17 bp, Homo sapiens
tgctctgatgcatcaga

SEQ ID NO: 2451619 - DNA, 23 bp, Homo sapiens
tgctctgcgtgtcacctgtgctt

SEQ ID NO: 2451620 - DNA, 21 bp, Homo sapiens
tgctcttaattgccacctcta

SEQ ID NO: 2451621 - DNA, 14 bp, Homo sapiens
tgctcttggctgga

SEQ ID NO: 2451622 - DNA, 19 bp, Homo sapiens
tgctcttggctggacccag

SEQ ID NO: 2451623 - DNA, 13 bp, Homo sapiens
tgctctttctctg

SEQ ID NO: 2451624 - DNA, 14 bp, Homo sapiens
tgctctttctctgc

SEQ ID NO: 2451625 - DNA, 15 bp, Homo sapiens
tgctctttctctgcc

SEQ ID NO: 2451626 - DNA, 22 bp, Homo sapiens
tgctctttgttttgtgtctctt

SEQ ID NO: 2451627 - DNA, 13 bp, Homo sapiens
tgctcttttctcc

SEQ ID NO: 2451628 - DNA, 16 bp, Homo sapiens
tgctgaaaatgtcctt

SEQ ID NO: 2451629 - DNA, 18 bp, Homo sapiens
tgctgaaaatgtccttgt

SEQ ID NO: 2451630 - DNA, 14 bp, Homo sapiens
tgctgacggccagg

SEQ ID NO: 2451631 - DNA, 20 bp, Homo sapiens
tgctgacggccagggagaag

SEQ ID NO: 2451632 - DNA, 20 bp, Homo sapiens
tgctgacgggacccacatgc

SEQ ID NO: 2451633 - DNA, 17 bp, Homo sapiens
tgctgactgtagctttg

SEQ ID NO: 2451634 - DNA, 22 bp, Homo sapiens
tgctgactgtagctttggaagt

SEQ ID NO: 2451635 - DNA, 21 bp, Homo sapiens
tgctgagaacctggccttcag

SEQ ID NO: 2451636 - DNA, 14 bp, Homo sapiens
tgctgagctctgag

SEQ ID NO: 2451637 - DNA, 13 bp, Homo sapiens
tgctgaggcctgg

SEQ ID NO: 2451638 - DNA, 19 bp, Homo sapiens
tgctgcaagcacagccctt

SEQ ID NO: 2451639 - DNA, 12 bp, Homo sapiens
tgctgccagctt

SEQ ID NO: 2451640 - DNA, 18 bp, Homo sapiens
tgctgccccatcagtgct

SEQ ID NO: 2451641 - DNA, 21 bp, Homo sapiens
tgctgccccatcagtgctccc

SEQ ID NO: 2451642 - DNA, 16 bp, Homo sapiens
tgctgcctccctctgc

SEQ ID NO: 2451643 - DNA, 16 bp, Homo sapiens
tgctgctccctcagac

SEQ ID NO: 2451644 - DNA, 17 bp, Homo sapiens
tgctgctccctcagact

SEQ ID NO: 2451645 - DNA, 13 bp, Homo sapiens
tgctgctgggctc

SEQ ID NO: 2451646 - DNA, 21 bp, Homo sapiens
tgctgctggggaagacagtgg

SEQ ID NO: 2451647 - DNA, 23 bp, Homo sapiens
tgctgctggggaagacagtggcc

SEQ ID NO: 2451648 - DNA, 13 bp, Homo sapiens
tgctgctgtccct

SEQ ID NO: 2451649 - DNA, 15 bp, Homo sapiens
tgctgcttctcccag

SEQ ID NO: 2451650 - DNA, 19 bp, Homo sapiens
tgctgcttctcccaggcaa

SEQ ID NO: 2451651 - DNA, 18 bp, Homo sapiens
tgctggaaaataatactg

SEQ ID NO: 2451652 - DNA, 17 bp, Homo sapiens
tgctggaattctaacaa

SEQ ID NO: 2451653 - DNA, 22 bp, Homo sapiens
tgctggagaggccccagccgct

SEQ ID NO: 2451654 - DNA, 16 bp, Homo sapiens
tgctggcccagggccc

SEQ ID NO: 2451655 - DNA, 17 bp, Homo sapiens
tgctggcccagggccca

SEQ ID NO: 2451656 - DNA, 18 bp, Homo sapiens
tgctggcccagggcccag

SEQ ID NO: 2451657 - DNA, 18 bp, Homo sapiens
tgctgggactcagccttc

SEQ ID NO: 2451658 - DNA, 16 bp, Homo sapiens
tgctgggagaggcagc

SEQ ID NO: 2451659 - DNA, 17 bp, Homo sapiens
tgctgggagaggcagcc

SEQ ID NO: 2451660 - DNA, 22 bp, Homo sapiens
tgctgggagctccactctgctt

SEQ ID NO: 2451661 - DNA, 16 bp, Homo sapiens
tgctgggatttccaac

SEQ ID NO: 2451662 - DNA, 13 bp, Homo sapiens
tgctgggctcagt

SEQ ID NO: 2451663 - DNA, 17 bp, Homo sapiens
tgctgggctcagtgaag

SEQ ID NO: 2451664 - DNA, 23 bp, Homo sapiens
tgctggggcctgggacaactgct

SEQ ID NO: 2451665 - DNA, 18 bp, Homo sapiens
tgctggggcctggttccc

SEQ ID NO: 2451666 - DNA, 13 bp, Homo sapiens
tgctggtccgtgg

SEQ ID NO: 2451667 - DNA, 16 bp, Homo sapiens
tgctggtccgtgggac

SEQ ID NO: 2451668 - DNA, 13 bp, Homo sapiens
tgctggtttgtag

SEQ ID NO: 2451669 - DNA, 13 bp, Homo sapiens
tgctgtccctccc

SEQ ID NO: 2451670 - DNA, 13 bp, Homo sapiens
tgctgtcttaaac

SEQ ID NO: 2451671 - DNA, 22 bp, Homo sapiens
tgctgtgatacgatgcttcaag

SEQ ID NO: 2451672 - DNA, 22 bp, Homo sapiens
tgctgtggaactacattactgt

SEQ ID NO: 2451673 - DNA, 13 bp, Homo sapiens
tgctgtggccagg

SEQ ID NO: 2451674 - DNA, 16 bp, Homo sapiens
tgctgtggtgtgtccc

SEQ ID NO: 2451675 - DNA, 15 bp, Homo sapiens
tgctgtgtgcttttt

SEQ ID NO: 2451676 - DNA, 14 bp, Homo sapiens
tgctgtttattaat

SEQ ID NO: 2451677 - DNA, 23 bp, Homo sapiens
tgctgttttaaacattaatagca

SEQ ID NO: 2451678 - DNA, 20 bp, Homo sapiens
tgcttagtgtacttggagta

SEQ ID NO: 2451679 - DNA, 21 bp, Homo sapiens
tgcttatggtaccagatgcag

SEQ ID NO: 2451680 - DNA, 19 bp, Homo sapiens
tgcttatttattgtattct

SEQ ID NO: 2451681 - DNA, 16 bp, Homo sapiens
tgcttcaagagaaaat

SEQ ID NO: 2451682 - DNA, 14 bp, Homo sapiens
tgcttcacaatgtt

SEQ ID NO: 2451683 - DNA, 13 bp, Homo sapiens
tgcttcctcctgg

SEQ ID NO: 2451684 - DNA, 22 bp, Homo sapiens
tgcttcctgtcttatcctccac

SEQ ID NO: 2451685 - DNA, 19 bp, Homo sapiens
tgggagaaatctggcttct

SEQ ID NO: 2451686 - DNA, 23 bp, Homo sapiens
tgggagaatcgctcctgcagccc

SEQ ID NO: 2451687 - DNA, 14 bp, Homo sapiens
tgggagacatgtga

SEQ ID NO: 2451688 - DNA, 14 bp, Homo sapiens
tgggagaggcagcc

SEQ ID NO: 2451689 - DNA, 15 bp, Homo sapiens
tgggagaggcagccc

SEQ ID NO: 2451690 - DNA, 13 bp, Homo sapiens
tgggagagggcgc

SEQ ID NO: 2451691 - DNA, 19 bp, Homo sapiens
tgggagcaaactgcatgcc

SEQ ID NO: 2451692 - DNA, 14 bp, Homo sapiens
tgggagccgggtct

SEQ ID NO: 2451693 - DNA, 19 bp, Homo sapiens
tgggagctccactctgctt

SEQ ID NO: 2451694 - DNA, 14 bp, Homo sapiens
tgggaggctcccct

SEQ ID NO: 2451695 - DNA, 16 bp, Homo sapiens
tgggagggaggctcag

SEQ ID NO: 2451696 - DNA, 22 bp, Homo sapiens
tgggagggaggctcaggtccct

SEQ ID NO: 2451697 - DNA, 14 bp, Homo sapiens
tgggagggcagcag

SEQ ID NO: 2451698 - DNA, 20 bp, Homo sapiens
tgggaggtgttggctgcacg

SEQ ID NO: 2451699 - DNA, 20 bp, Homo sapiens
tgggagtttttatgagaaac

SEQ ID NO: 2451700 - DNA, 17 bp, Homo sapiens
tgggatggtggagggcc

SEQ ID NO: 2451701 - DNA, 18 bp, Homo sapiens
tgggatggtggagggcca

SEQ ID NO: 2451702 - DNA, 20 bp, Homo sapiens
tgggattcaggaaaaggcct

SEQ ID NO: 2451703 - DNA, 21 bp, Homo sapiens
tgggattcaggaaaaggcctg

SEQ ID NO: 2451704 - DNA, 21 bp, Homo sapiens
tgggattctggacaggatgtg

SEQ ID NO: 2451705 - DNA, 22 bp, Homo sapiens
tgggcaagctggcggctggggt

SEQ ID NO: 2451706 - DNA, 18 bp, Homo sapiens
tgggcagagctggctctg

SEQ ID NO: 2451707 - DNA, 23 bp, Homo sapiens
tgggcagaggaccaggctgtagg

SEQ ID NO: 2451708 - DNA, 15 bp, Homo sapiens
tgggcagttttttga

SEQ ID NO: 2451709 - DNA, 19 bp, Homo sapiens
tgggcatcttttgtattaa

SEQ ID NO: 2451710 - DNA, 23 bp, Homo sapiens
tgggccaacaaagaacactaact

SEQ ID NO: 2451711 - DNA, 18 bp, Homo sapiens
tgggccagacatgccaca

SEQ ID NO: 2451712 - DNA, 20 bp, Homo sapiens
tgggccagtctgtggatcag

SEQ ID NO: 2451713 - DNA, 19 bp, Homo sapiens
tgggccattctccacagca

SEQ ID NO: 2451714 - DNA, 15 bp, Homo sapiens
tgggcccacacctcc

SEQ ID NO: 2451715 - DNA, 16 bp, Homo sapiens
tgggccccaccctcgg

SEQ ID NO: 2451716 - DNA, 14 bp, Homo sapiens
tgggccctgggctg

SEQ ID NO: 2451717 - DNA, 16 bp, Homo sapiens
tgggccctgggctgga

SEQ ID NO: 2451718 - DNA, 17 bp, Homo sapiens
tgggccctgggctggaa

SEQ ID NO: 2451719 - DNA, 13 bp, Homo sapiens
tgggccctggggc

SEQ ID NO: 2451720 - DNA, 13 bp, Homo sapiens
tgggccgctgcca

SEQ ID NO: 2451721 - DNA, 14 bp, Homo sapiens
tgggcctaggctgc

SEQ ID NO: 2451722 - DNA, 16 bp, Homo sapiens
tgggcctgctccagac

SEQ ID NO: 2451723 - DNA, 19 bp, Homo sapiens
tgggcctgctccagacctg

SEQ ID NO: 2451724 - DNA, 12 bp, Homo sapiens
tgggcctgctgc

SEQ ID NO: 2451725 - DNA, 13 bp, Homo sapiens
tgggcctgggctc

SEQ ID NO: 2451726 - DNA, 19 bp, Homo sapiens
tgggcctgggctcctggac

SEQ ID NO: 2451727 - DNA, 20 bp, Homo sapiens
tgggcctgggctcctggacc

SEQ ID NO: 2451728 - DNA, 23 bp, Homo sapiens
tgggcctggttaaataaggcagg

SEQ ID NO: 2451729 - DNA, 17 bp, Homo sapiens
tgggccttggcctggag

SEQ ID NO: 2451730 - DNA, 18 bp, Homo sapiens
tgggccttggcctggagc

SEQ ID NO: 2451731 - DNA, 19 bp, Homo sapiens
tgggccttggcctggagca

SEQ ID NO: 2451732 - DNA, 14 bp, Homo sapiens
tgggccttgggctc

SEQ ID NO: 2451733 - DNA, 15 bp, Homo sapiens
tgggctcctccaggg

SEQ ID NO: 2451734 - DNA, 11 bp, Homo sapiens
tgggctcctgg

SEQ ID NO: 2451735 - DNA, 22 bp, Homo sapiens
tgggctctgcaattcccctctg

SEQ ID NO: 2451736 - DNA, 15 bp, Homo sapiens
tgggctggatgagct

SEQ ID NO: 2451737 - DNA, 23 bp, Homo sapiens
tgggctggccgctgtgccaggcg

SEQ ID NO: 2451738 - DNA, 21 bp, Homo sapiens
tgggctggtatctcagaaagt

SEQ ID NO: 2451739 - DNA, 13 bp, Homo sapiens
tgggcttatatct

SEQ ID NO: 2451740 - DNA, 14 bp, Homo sapiens
tgggcttcagctgc

SEQ ID NO: 2451741 - DNA, 14 bp, Homo sapiens
tgggcttcccaagg

SEQ ID NO: 2451742 - DNA, 15 bp, Homo sapiens
tgggcttcctggagc

SEQ ID NO: 2451743 - DNA, 20 bp, Homo sapiens
tgggcttcctggagcagaag

SEQ ID NO: 2451744 - DNA, 21 bp, Homo sapiens
tgggcttgctattctgtccct

SEQ ID NO: 2451745 - DNA, 13 bp, Homo sapiens
tgggcttgggcct

SEQ ID NO: 2451746 - DNA, 14 bp, Homo sapiens
tgggcttgggccta

SEQ ID NO: 2451747 - DNA, 18 bp, Homo sapiens
tgggcttgggcctaggct

SEQ ID NO: 2451748 - DNA, 19 bp, Homo sapiens
tgggcttgtggggcctggg

SEQ ID NO: 2451749 - DNA, 22 bp, Homo sapiens
tggggaaaggggtcggctgacc

SEQ ID NO: 2451750 - DNA, 23 bp, Homo sapiens
tggggaaaggggtcggctgacca

SEQ ID NO: 2451751 - DNA, 17 bp, Homo sapiens
tggggaagacagtggcc

SEQ ID NO: 2451752 - DNA, 15 bp, Homo sapiens
tggggaagagagcct

SEQ ID NO: 2451753 - DNA, 16 bp, Homo sapiens
tggggaagggcctgcc

SEQ ID NO: 2451754 - DNA, 19 bp, Homo sapiens
tggggacttggcctctctc

SEQ ID NO: 2451755 - DNA, 17 bp, Homo sapiens
tggggagcaggcagcca

SEQ ID NO: 2451756 - DNA, 12 bp, Homo sapiens
tggggaggacaa

SEQ ID NO: 2451757 - DNA, 22 bp, Homo sapiens
tggggagggattctggttccag

SEQ ID NO: 2451758 - DNA, 17 bp, Homo sapiens
tggggagttaagacctg

SEQ ID NO: 2451759 - DNA, 16 bp, Homo sapiens
tggggcagctcctctg

SEQ ID NO: 2451760 - DNA, 22 bp, Homo sapiens
tggggcaggagtagctgagctc

SEQ ID NO: 2451761 - DNA, 18 bp, Homo sapiens
tggggccagatccagcct

SEQ ID NO: 2451762 - DNA, 19 bp, Homo sapiens
tggggccagatccagcctg

SEQ ID NO: 2451763 - DNA, 20 bp, Homo sapiens
tggggccagatccagcctgg

SEQ ID NO: 2451764 - DNA, 22 bp, Homo sapiens
tggggcctgggacaactgctcc

SEQ ID NO: 2451765 - DNA, 14 bp, Homo sapiens
tggggcctgggagg

SEQ ID NO: 2451766 - DNA, 14 bp, Homo sapiens
tggggcctggttcc

SEQ ID NO: 2451767 - DNA, 18 bp, Homo sapiens
tggggcctgtactgcctg

SEQ ID NO: 2451768 - DNA, 19 bp, Homo sapiens
tggggcctgtactgcctgc

SEQ ID NO: 2451769 - DNA, 17 bp, Homo sapiens
tggggctcacacacctg

SEQ ID NO: 2451770 - DNA, 17 bp, Homo sapiens
tggggctctaacgcctg

SEQ ID NO: 2451771 - DNA, 21 bp, Homo sapiens
tggggctctaacgcctgagcc

SEQ ID NO: 2451772 - DNA, 24 bp, Homo sapiens
tggggctctaacgcctgagcccag

SEQ ID NO: 2451773 - DNA, 14 bp, Homo sapiens
tggggctggcctcc

SEQ ID NO: 2451774 - DNA, 16 bp, Homo sapiens
tggggctggttctgta

SEQ ID NO: 2451775 - DNA, 11 bp, Homo sapiens
tgggggcctgg

SEQ ID NO: 2451776 - DNA, 12 bp, Homo sapiens
tgggggcctggc

SEQ ID NO: 2451777 - DNA, 17 bp, Homo sapiens
tgggggctgaggagcag

SEQ ID NO: 2451778 - DNA, 14 bp, Homo sapiens
tgggggggtggccg

SEQ ID NO: 2451779 - DNA, 24 bp, Homo sapiens
tggggggtgatgagggcagcagcc

SEQ ID NO: 2451780 - DNA, 16 bp, Homo sapiens
tggggggtggccaggc

SEQ ID NO: 2451781 - DNA, 21 bp, Homo sapiens
tgggggtcctcctccagggac

SEQ ID NO: 2451782 - DNA, 14 bp, Homo sapiens
tgggggtgccagga

SEQ ID NO: 2451783 - DNA, 18 bp, Homo sapiens
tgggggttgtaaattggc

SEQ ID NO: 2451784 - DNA, 12 bp, Homo sapiens
tgggggtttttt

SEQ ID NO: 2451785 - DNA, 19 bp, Homo sapiens
tggggtatggattctaaaa

SEQ ID NO: 2451786 - DNA, 20 bp, Homo sapiens
tggggtatggattctaaaat

SEQ ID NO: 2451787 - DNA, 23 bp, Homo sapiens
tggggtctcacagtgttgcccag

SEQ ID NO: 2451788 - DNA, 21 bp, Homo sapiens
tggggtctggagttgatctgg

SEQ ID NO: 2451789 - DNA, 13 bp, Homo sapiens
tgtctggttctca

SEQ ID NO: 2451790 - DNA, 22 bp, Homo sapiens
tgtctggttctcaattccaaca

SEQ ID NO: 2451791 - DNA, 18 bp, Homo sapiens
tgtcttaaactaaatgtg

SEQ ID NO: 2451792 - DNA, 14 bp, Homo sapiens
tgtcttaattatta

SEQ ID NO: 2451793 - DNA, 14 bp, Homo sapiens
tgtcttgagctcta

SEQ ID NO: 2451794 - DNA, 15 bp, Homo sapiens
tgtctttaatgcaat

SEQ ID NO: 2451795 - DNA, 15 bp, Homo sapiens
tgtctttagatagcc

SEQ ID NO: 2451796 - DNA, 19 bp, Homo sapiens
tgtcttttcccatttatct

SEQ ID NO: 2451797 - DNA, 22 bp, Homo sapiens
tgtctttttttgtatagttaac

SEQ ID NO: 2451798 - DNA, 22 bp, Homo sapiens
tgtgaaaatggtccaggagaag

SEQ ID NO: 2451799 - DNA, 14 bp, Homo sapiens
tgtgaaatttacat

SEQ ID NO: 2451800 - DNA, 13 bp, Homo sapiens
tgtgaacccagga

SEQ ID NO: 2451801 - DNA, 21 bp, Homo sapiens
tgtgaacccaggacaagcatg

SEQ ID NO: 2451802 - DNA, 10 bp, Homo sapiens
tgtgaagcca

SEQ ID NO: 2451803 - DNA, 20 bp, Homo sapiens
tgtgaagccaattcagacag

SEQ ID NO: 2451804 - DNA, 13 bp, Homo sapiens
tgtgaaggaccct

SEQ ID NO: 2451805 - DNA, 17 bp, Homo sapiens
tgtgaaggtgatttaag

SEQ ID NO: 2451806 - DNA, 16 bp, Homo sapiens
tgtgaatcaagggtca

SEQ ID NO: 2451807 - DNA, 21 bp, Homo sapiens
tgtgaatcaagggtcaggcct

SEQ ID NO: 2451808 - DNA, 23 bp, Homo sapiens
tgtgaatgaacactcttttgctt

SEQ ID NO: 2451809 - DNA, 21 bp, Homo sapiens
tgtgacataccccctccccca

SEQ ID NO: 2451810 - DNA, 18 bp, Homo sapiens
tgtgacatttatatattg

SEQ ID NO: 2451811 - DNA, 15 bp, Homo sapiens
tgtgaccacaacatg

SEQ ID NO: 2451812 - DNA, 17 bp, Homo sapiens
tgtgacccccagctccg

SEQ ID NO: 2451813 - DNA, 15 bp, Homo sapiens
tgtgacctgctgagc

SEQ ID NO: 2451814 - DNA, 18 bp, Homo sapiens
tgtgacctgctgagctct

SEQ ID NO: 2451815 - DNA, 16 bp, Homo sapiens
tgtgacttttgtgaaa

SEQ ID NO: 2451816 - DNA, 21 bp, Homo sapiens
tgtgagaagtgaatgctggga

SEQ ID NO: 2451817 - DNA, 23 bp, Homo sapiens
tgtgagaagtgaatgctgggact

SEQ ID NO: 2451818 - DNA, 15 bp, Homo sapiens
tgtgagaggtttgac

SEQ ID NO: 2451819 - DNA, 16 bp, Homo sapiens
tgtgagaggtttgact

SEQ ID NO: 2451820 - DNA, 14 bp, Homo sapiens
tgtgagcccagctg

SEQ ID NO: 2451821 - DNA, 17 bp, Homo sapiens
tgtgaggccagggcaga

SEQ ID NO: 2451822 - DNA, 21 bp, Homo sapiens
tgtgagtcaatacatagtgct

SEQ ID NO: 2451823 - DNA, 22 bp, Homo sapiens
tgtgagtctttggttctaagga

SEQ ID NO: 2451824 - DNA, 21 bp, Homo sapiens
tgtgagtttaccttgtatact

SEQ ID NO: 2451825 - DNA, 21 bp, Homo sapiens
tgtgatatgcacaatgtagat

SEQ ID NO: 2451826 - DNA, 16 bp, Homo sapiens
tgtgatgaatactgta

SEQ ID NO: 2451827 - DNA, 15 bp, Homo sapiens
tgtgatggagtgctg

SEQ ID NO: 2451828 - DNA, 20 bp, Homo sapiens
tgtgatgtcatacagagaag

SEQ ID NO: 2451829 - DNA, 14 bp, Homo sapiens
tgtgatgttctaag

SEQ ID NO: 2451830 - DNA, 17 bp, Homo sapiens
tgtgattggcctgtaga

SEQ ID NO: 2451831 - DNA, 14 bp, Homo sapiens
tgtgattgtggaat

SEQ ID NO: 2451832 - DNA, 20 bp, Homo sapiens
tgtgcaacagggtatggact

SEQ ID NO: 2451833 - DNA, 17 bp, Homo sapiens
tgtgcaaggcagccgtg

SEQ ID NO: 2451834 - DNA, 15 bp, Homo sapiens
tgtgcaatgtgtata

SEQ ID NO: 2451835 - DNA, 20 bp, Homo sapiens
tgtgcaatgtgtataaacaa

SEQ ID NO: 2451836 - DNA, 17 bp, Homo sapiens
tgtgcacatctgtgtct

SEQ ID NO: 2451837 - DNA, 13 bp, Homo sapiens
tgtgcactgccca

SEQ ID NO: 2451838 - DNA, 12 bp, Homo sapiens
tgtgccagagcc

SEQ ID NO: 2451839 - DNA, 13 bp, Homo sapiens
tgtgccagagcct

SEQ ID NO: 2451840 - DNA, 16 bp, Homo sapiens
tgtgccagagcctggg

SEQ ID NO: 2451841 - DNA, 18 bp, Homo sapiens
tgtgccagagcctggggc

SEQ ID NO: 2451842 - DNA, 18 bp, Homo sapiens
tgtgccagggcaatgatg

SEQ ID NO: 2451843 - DNA, 19 bp, Homo sapiens
tgtgcccagggttttgccc

SEQ ID NO: 2451844 - DNA, 16 bp, Homo sapiens
tgtgcccccagggtcc

SEQ ID NO: 2451845 - DNA, 22 bp, Homo sapiens
tgtgcccccagggtcctgggag

SEQ ID NO: 2451846 - DNA, 18 bp, Homo sapiens
tgtgccccttccgccact

SEQ ID NO: 2451847 - DNA, 16 bp, Homo sapiens
tgtgccccttgacaac

SEQ ID NO: 2451848 - DNA, 13 bp, Homo sapiens
tgtgccctatcac

SEQ ID NO: 2451849 - DNA, 14 bp, Homo sapiens
tgtgccctctgggc

SEQ ID NO: 2451850 - DNA, 17 bp, Homo sapiens
tgtgccctctgggctct

SEQ ID NO: 2451851 - DNA, 21 bp, Homo sapiens
tgtgccctctgggctctgagt

SEQ ID NO: 2451852 - DNA, 19 bp, Homo sapiens
tgtgcctattgctagagct

SEQ ID NO: 2451853 - DNA, 14 bp, Homo sapiens
tgtgcctcagagac

SEQ ID NO: 2451854 - DNA, 16 bp, Homo sapiens
tgtgcctcctccctcc

SEQ ID NO: 2451855 - DNA, 21 bp, Homo sapiens
tgtgcctcgctccccactctg

SEQ ID NO: 2451856 - DNA, 15 bp, Homo sapiens
tgtgccttgtttttt

SEQ ID NO: 2451857 - DNA, 18 bp, Homo sapiens
tgtgccttgttttttgtt

SEQ ID NO: 2451858 - DNA, 21 bp, Homo sapiens
tgtgcgtggtggtccctgggt

SEQ ID NO: 2451859 - DNA, 12 bp, Homo sapiens
tgtgctgtgtgt

SEQ ID NO: 2451860 - DNA, 15 bp, Homo sapiens
tgtgctgtgtgtgac

SEQ ID NO: 2451861 - DNA, 17 bp, Homo sapiens
tgtgctttttttgtgtg

SEQ ID NO: 2451862 - DNA, 18 bp, Homo sapiens
tgtggaactgctgccact

SEQ ID NO: 2451863 - DNA, 22 bp, Homo sapiens
tgtggaccatggagtggcagcc

SEQ ID NO: 2451864 - DNA, 19 bp, Homo sapiens
tgtggagagggaatgtgaa

SEQ ID NO: 2451865 - DNA, 20 bp, Homo sapiens
tgtggagagggaatgtgaaa

SEQ ID NO: 2451866 - DNA, 16 bp, Homo sapiens
tgtggagccgaggcct

SEQ ID NO: 2451867 - DNA, 14 bp, Homo sapiens
tgtggattctttaa

SEQ ID NO: 2451868 - DNA, 21 bp, Homo sapiens
tgtggcaggggttagagcagg

SEQ ID NO: 2451869 - DNA, 23 bp, Homo sapiens
tgtggcaggggttagagcaggac

SEQ ID NO: 2451870 - DNA, 13 bp, Homo sapiens
tgtggccaggagg

SEQ ID NO: 2451871 - DNA, 14 bp, Homo sapiens
tgtggccaggaggt

SEQ ID NO: 2451872 - DNA, 12 bp, Homo sapiens
tgtggccccacc

SEQ ID NO: 2451873 - DNA, 17 bp, Homo sapiens
tgtggcctaagaggctg

SEQ ID NO: 2451874 - DNA, 18 bp, Homo sapiens
tgtggcgccgtctccagg

SEQ ID NO: 2451875 - DNA, 13 bp, Homo sapiens
tgtgggattatgg

SEQ ID NO: 2451876 - DNA, 15 bp, Homo sapiens
tgtgggcctgggctc

SEQ ID NO: 2451877 - DNA, 15 bp, Homo sapiens
tgtggggccaggtca

SEQ ID NO: 2451878 - DNA, 14 bp, Homo sapiens
tgtggggcctggga

SEQ ID NO: 2451879 - DNA, 16 bp, Homo sapiens
tgtggggcctgggagg

SEQ ID NO: 2451880 - DNA, 15 bp, Homo sapiens
tgtgggggactgtaa

SEQ ID NO: 2451881 - DNA, 22 bp, Homo sapiens
tgtggggggtaatccctgcttt

SEQ ID NO: 2451882 - DNA, 21 bp, Homo sapiens
tgtggtaagcaacatggcttt

SEQ ID NO: 2451883 - DNA, 14 bp, Homo sapiens
tgtggtacagagaa

SEQ ID NO: 2451884 - DNA, 16 bp, Homo sapiens
tgtggtacagagaagc

SEQ ID NO: 2451885 - DNA, 16 bp, Homo sapiens
tgtggtgagggaagac

SEQ ID NO: 2451886 - DNA, 21 bp, Homo sapiens
tgtggttctgagatggctccc

SEQ ID NO: 2451887 - DNA, 20 bp, Homo sapiens
tgtggttttcttttgccatg

SEQ ID NO: 2451888 - DNA, 13 bp, Homo sapiens
tgtgtaagatttg

SEQ ID NO: 2451889 - DNA, 13 bp, Homo sapiens
tgtgtagcctttt

SEQ ID NO: 2451890 - DNA, 22 bp, Homo sapiens
tgtgtagctgtgacctgctgag

SEQ ID NO: 2451891 - DNA, 14 bp, Homo sapiens
tgtgtagttcatgt

SEQ ID NO: 2451892 - DNA, 22 bp, Homo sapiens
tgtgtataaacaagaaaaataa

SEQ ID NO: 2451893 - DNA, 21 bp, Homo sapiens
ttagagaagtatacataagtt

SEQ ID NO: 2451894 - DNA, 22 bp, Homo sapiens
ttagatgttctaagtctttcca

SEQ ID NO: 2451895 - DNA, 20 bp, Homo sapiens
ttagattctctgtgtctaag

SEQ ID NO: 2451896 - DNA, 22 bp, Homo sapiens
ttagattctctgtgtctaagat

SEQ ID NO: 2451897 - DNA, 14 bp, Homo sapiens
ttagatttcatagt

SEQ ID NO: 2451898 - DNA, 18 bp, Homo sapiens
ttagatttcatagttcag

SEQ ID NO: 2451899 - DNA, 19 bp, Homo sapiens
ttagattttacatgaagta

SEQ ID NO: 2451900 - DNA, 21 bp, Homo sapiens
ttagattttacatgaagtatt

SEQ ID NO: 2451901 - DNA, 23 bp, Homo sapiens
ttagattttacatgaagtatttt

SEQ ID NO: 2451902 - DNA, 18 bp, Homo sapiens
ttagcattttaattctct

SEQ ID NO: 2451903 - DNA, 22 bp, Homo sapiens
ttagcctggacctctgacagca

SEQ ID NO: 2451904 - DNA, 12 bp, Homo sapiens
ttagcctgtcct

SEQ ID NO: 2451905 - DNA, 14 bp, Homo sapiens
ttagcctgtcctgt

SEQ ID NO: 2451906 - DNA, 20 bp, Homo sapiens
ttagccttttttccccagac

SEQ ID NO: 2451907 - DNA, 15 bp, Homo sapiens
ttagctaataaaaag

SEQ ID NO: 2451908 - DNA, 22 bp, Homo sapiens
ttagctaataaaaagcttttgt

SEQ ID NO: 2451909 - DNA, 23 bp, Homo sapiens
ttagctaataaaaagcttttgtc

SEQ ID NO: 2451910 - DNA, 14 bp, Homo sapiens
ttagctcaatgagc

SEQ ID NO: 2451911 - DNA, 22 bp, Homo sapiens
ttaggaagagccttccacccag

SEQ ID NO: 2451912 - DNA, 12 bp, Homo sapiens
ttaggagaagcc

SEQ ID NO: 2451913 - DNA, 16 bp, Homo sapiens
ttaggagaagccagga

SEQ ID NO: 2451914 - DNA, 17 bp, Homo sapiens
ttaggagctaaggctct

SEQ ID NO: 2451915 - DNA, 23 bp, Homo sapiens
ttaggctatttgtaaatctgcca

SEQ ID NO: 2451916 - DNA, 16 bp, Homo sapiens
ttagggaacaatttgg

SEQ ID NO: 2451917 - DNA, 16 bp, Homo sapiens
ttaggttctaaagttc

SEQ ID NO: 2451918 - DNA, 12 bp, Homo sapiens
ttagtaacatgt

SEQ ID NO: 2451919 - DNA, 16 bp, Homo sapiens
ttagtattgttgtcct

SEQ ID NO: 2451920 - DNA, 18 bp, Homo sapiens
ttagtattgttgtccttt

SEQ ID NO: 2451921 - DNA, 19 bp, Homo sapiens
ttagtcatgtttatctgct

SEQ ID NO: 2451922 - DNA, 22 bp, Homo sapiens
ttagtcctgttatagacgagaa

SEQ ID NO: 2451923 - DNA, 12 bp, Homo sapiens
ttagtctcagtt

SEQ ID NO: 2451924 - DNA, 21 bp, Homo sapiens
ttagtctcagtttgtgtgtct

SEQ ID NO: 2451925 - DNA, 22 bp, Homo sapiens
ttagtctcagtttgtgtgtctt

SEQ ID NO: 2451926 - DNA, 13 bp, Homo sapiens
ttagtgtatccat

SEQ ID NO: 2451927 - DNA, 18 bp, Homo sapiens
ttagtgtatgattactgg

SEQ ID NO: 2451928 - DNA, 21 bp, Homo sapiens
ttagttaccttatagttactg

SEQ ID NO: 2451929 - DNA, 15 bp, Homo sapiens
ttagtttgtatatat

SEQ ID NO: 2451930 - DNA, 12 bp, Homo sapiens
ttagttttgatt

SEQ ID NO: 2451931 - DNA, 15 bp, Homo sapiens
ttataaaaaatggtt

SEQ ID NO: 2451932 - DNA, 19 bp, Homo sapiens
ttataaatactgcaaatca

SEQ ID NO: 2451933 - DNA, 17 bp, Homo sapiens
ttataactgtaaagatg

SEQ ID NO: 2451934 - DNA, 18 bp, Homo sapiens
ttataactgtaaagatgt

SEQ ID NO: 2451935 - DNA, 15 bp, Homo sapiens
ttataagaaagcctg

SEQ ID NO: 2451936 - DNA, 16 bp, Homo sapiens
ttataagaaagcctga

SEQ ID NO: 2451937 - DNA, 14 bp, Homo sapiens
ttataattctcatt

SEQ ID NO: 2451938 - DNA, 17 bp, Homo sapiens
ttataattctcattaaa

SEQ ID NO: 2451939 - DNA, 21 bp, Homo sapiens
ttataattctttcaatacaga

SEQ ID NO: 2451940 - DNA, 23 bp, Homo sapiens
ttataattctttcaatacagata

SEQ ID NO: 2451941 - DNA, 13 bp, Homo sapiens
ttatacactgtgt

SEQ ID NO: 2451942 - DNA, 15 bp, Homo sapiens
ttatacagctgtatt

SEQ ID NO: 2451943 - DNA, 21 bp, Homo sapiens
ttatacagctgtattgtctga

SEQ ID NO: 2451944 - DNA, 14 bp, Homo sapiens
ttatacgaaataat

SEQ ID NO: 2451945 - DNA, 12 bp, Homo sapiens
ttatagattcta

SEQ ID NO: 2451946 - DNA, 21 bp, Homo sapiens
ttatagattctaaagattcta

SEQ ID NO: 2451947 - DNA, 15 bp, Homo sapiens
ttatagcctctgtct

SEQ ID NO: 2451948 - DNA, 17 bp, Homo sapiens
ttatagcctctgtctgg

SEQ ID NO: 2451949 - DNA, 24 bp, Homo sapiens
ttataggatttatttaaaatagca

SEQ ID NO: 2451950 - DNA, 21 bp, Homo sapiens
ttatagtgaatactgctacag

SEQ ID NO: 2451951 - DNA, 12 bp, Homo sapiens
ttatagtttctg

SEQ ID NO: 2451952 - DNA, 15 bp, Homo sapiens
ttatagtttctgagg

SEQ ID NO: 2451953 - DNA, 20 bp, Homo sapiens
ttatataattgccaaaaagt

SEQ ID NO: 2451954 - DNA, 14 bp, Homo sapiens
ttatatatatatat

SEQ ID NO: 2451955 - DNA, 14 bp, Homo sapiens
ttatatatgtattt

SEQ ID NO: 2451956 - DNA, 20 bp, Homo sapiens
ttatatggaaatatatatta

SEQ ID NO: 2451957 - DNA, 22 bp, Homo sapiens
ttatatgtaccctctgaaatac

SEQ ID NO: 2451958 - DNA, 24 bp, Homo sapiens
ttatatgtaccctctgaaatacat

SEQ ID NO: 2451959 - DNA, 17 bp, Homo sapiens
ttatattgataagatct

SEQ ID NO: 2451960 - DNA, 18 bp, Homo sapiens
ttatcaaaccctagcctt

SEQ ID NO: 2451961 - DNA, 21 bp, Homo sapiens
ttatcaaaccctagccttgct

SEQ ID NO: 2451962 - DNA, 19 bp, Homo sapiens
ttatcacacaaagcagaat

SEQ ID NO: 2451963 - DNA, 21 bp, Homo sapiens
ttatcaccgtgggctccctga

SEQ ID NO: 2451964 - DNA, 19 bp, Homo sapiens
ttatcacctagctgaatgt

SEQ ID NO: 2451965 - DNA, 14 bp, Homo sapiens
ttatcagtcaatat

SEQ ID NO: 2451966 - DNA, 17 bp, Homo sapiens
ttatccctcacctgtag

SEQ ID NO: 2451967 - DNA, 20 bp, Homo sapiens
ttatccctcacctgtagcag

SEQ ID NO: 2451968 - DNA, 11 bp, Homo sapiens
ttatcctccct

SEQ ID NO: 2451969 - DNA, 18 bp, Homo sapiens
ttatcctccctgtaactt

SEQ ID NO: 2451970 - DNA, 17 bp, Homo sapiens
ttatctaatttataaaa

SEQ ID NO: 2451971 - DNA, 22 bp, Homo sapiens
ttatctataatttacctaagat

SEQ ID NO: 2451972 - DNA, 20 bp, Homo sapiens
ttatctgaatttttaaacaa

SEQ ID NO: 2451973 - DNA, 16 bp, Homo sapiens
ttatctgtcagctgca

SEQ ID NO: 2451974 - DNA, 22 bp, Homo sapiens
ttatcttctcaagttctaagat

SEQ ID NO: 2451975 - DNA, 15 bp, Homo sapiens
ttatctttttacctt

SEQ ID NO: 2451976 - DNA, 17 bp, Homo sapiens
ttatgaatgtgaagcct

SEQ ID NO: 2451977 - DNA, 19 bp, Homo sapiens
ttatgaatgtgaagccttc

SEQ ID NO: 2451978 - DNA, 20 bp, Homo sapiens
ttatgaatgtgaagccttcc

SEQ ID NO: 2451979 - DNA, 15 bp, Homo sapiens
ttatgactgccaaga

SEQ ID NO: 2451980 - DNA, 13 bp, Homo sapiens
ttatgagaaactt

SEQ ID NO: 2451981 - DNA, 13 bp, Homo sapiens
ttatgatctggcc

SEQ ID NO: 2451982 - DNA, 21 bp, Homo sapiens
ttatgatctggcccttgctta

SEQ ID NO: 2451983 - DNA, 21 bp, Homo sapiens
ttatgctcttaattgccacct

SEQ ID NO: 2451984 - DNA, 21 bp, Homo sapiens
ttatggtaactgctttctgtt

SEQ ID NO: 2451985 - DNA, 13 bp, Homo sapiens
ttatgtagctctt

SEQ ID NO: 2451986 - DNA, 18 bp, Homo sapiens
ttatgtggttttagattt

SEQ ID NO: 2451987 - DNA, 14 bp, Homo sapiens
ttattaaagaaaaa

SEQ ID NO: 2451988 - DNA, 22 bp, Homo sapiens
ttattaaagaaaaaaatgtatt

SEQ ID NO: 2451989 - DNA, 19 bp, Homo sapiens
ttattaatatatattatct

SEQ ID NO: 2451990 - DNA, 20 bp, Homo sapiens
ttattaatatatattatctt

SEQ ID NO: 2451991 - DNA, 18 bp, Homo sapiens
ttattaatgcactttcta

SEQ ID NO: 2451992 - DNA, 18 bp, Homo sapiens
ttattacgtatgtctggt

SEQ ID NO: 2451993 - DNA, 15 bp, Homo sapiens
ttattacttgtaaat

SEQ ID NO: 2451994 - DNA, 17 bp, Homo sapiens
ttattagagtgtctttc

SEQ ID NO: 2451995 - DNA, 18 bp, Homo sapiens
ttattagtattgttgtcc

SEQ ID NO: 2451996 - DNA, 15 bp, Homo sapiens
ttctgaaaatataac

SEQ ID NO: 2451997 - DNA, 13 bp, Homo sapiens
ttctgaacagctg

SEQ ID NO: 2451998 - DNA, 15 bp, Homo sapiens
ttctgaacagctggt

SEQ ID NO: 2451999 - DNA, 18 bp, Homo sapiens
ttctgaatgcttctaagt

SEQ ID NO: 2452000 - DNA, 23 bp, Homo sapiens
ttctgaatgcttctaagtaaata

SEQ ID NO: 2452001 - DNA, 19 bp, Homo sapiens
ttctgagatggctcccagg

SEQ ID NO: 2452002 - DNA, 23 bp, Homo sapiens
ttctgagatggctcccaggggct

SEQ ID NO: 2452003 - DNA, 13 bp, Homo sapiens
ttctgagctcctg

SEQ ID NO: 2452004 - DNA, 15 bp, Homo sapiens
ttctgagctcctgtc

SEQ ID NO: 2452005 - DNA, 13 bp, Homo sapiens
ttctgagtacaga

SEQ ID NO: 2452006 - DNA, 19 bp, Homo sapiens
ttctgagttttgtgtttgt

SEQ ID NO: 2452007 - DNA, 21 bp, Homo sapiens
ttctgagttttgtgtttgttg

SEQ ID NO: 2452008 - DNA, 23 bp, Homo sapiens
ttctgattttaggagctaaggct

SEQ ID NO: 2452009 - DNA, 22 bp, Homo sapiens
ttctgcagtaaatcttttacaa

SEQ ID NO: 2452010 - DNA, 21 bp, Homo sapiens
ttctgcatatgttgaatactt

SEQ ID NO: 2452011 - DNA, 16 bp, Homo sapiens
ttctgccccctgcaga

SEQ ID NO: 2452012 - DNA, 19 bp, Homo sapiens
ttctgccccctgcagaacc

SEQ ID NO: 2452013 - DNA, 17 bp, Homo sapiens
ttctgcctctctaggac

SEQ ID NO: 2452014 - DNA, 12 bp, Homo sapiens
ttctgcctgcca

SEQ ID NO: 2452015 - DNA, 18 bp, Homo sapiens
ttctgcctgccagctgca

SEQ ID NO: 2452016 - DNA, 14 bp, Homo sapiens
ttctgcctggagac

SEQ ID NO: 2452017 - DNA, 13 bp, Homo sapiens
ttctgcctttgcc

SEQ ID NO: 2452018 - DNA, 15 bp, Homo sapiens
ttctgctcagctctg

SEQ ID NO: 2452019 - DNA, 19 bp, Homo sapiens
ttctgctcatcattctctg

SEQ ID NO: 2452020 - DNA, 15 bp, Homo sapiens
ttctgctccagacag

SEQ ID NO: 2452021 - DNA, 17 bp, Homo sapiens
ttctgctctggttgttt

SEQ ID NO: 2452022 - DNA, 22 bp, Homo sapiens
ttctgctctggttgtttctgtt

SEQ ID NO: 2452023 - DNA, 18 bp, Homo sapiens
ttctggacctctgggttg

SEQ ID NO: 2452024 - DNA, 21 bp, Homo sapiens
ttctggattccccatctcagg

SEQ ID NO: 2452025 - DNA, 18 bp, Homo sapiens
ttctggccagtgtttaaa

SEQ ID NO: 2452026 - DNA, 21 bp, Homo sapiens
ttctggccagtgtttaaaact

SEQ ID NO: 2452027 - DNA, 22 bp, Homo sapiens
ttctggccagtgtttaaaactt

SEQ ID NO: 2452028 - DNA, 21 bp, Homo sapiens
ttctgggagggcagcagggct

SEQ ID NO: 2452029 - DNA, 18 bp, Homo sapiens
ttctggggcaggctgggc

SEQ ID NO: 2452030 - DNA, 19 bp, Homo sapiens
ttctgtaagaaacctactg

SEQ ID NO: 2452031 - DNA, 16 bp, Homo sapiens
ttctgtaattcaggtt

SEQ ID NO: 2452032 - DNA, 21 bp, Homo sapiens
ttctgtaattcaggtttttcc

SEQ ID NO: 2452033 - DNA, 14 bp, Homo sapiens
ttctgtaccagtta

SEQ ID NO: 2452034 - DNA, 21 bp, Homo sapiens
ttctgtaccagttaatttttc

SEQ ID NO: 2452035 - DNA, 15 bp, Homo sapiens
ttctgtatatacttt

SEQ ID NO: 2452036 - DNA, 17 bp, Homo sapiens
ttctgtcttctacagat

SEQ ID NO: 2452037 - DNA, 22 bp, Homo sapiens
ttctgtggtttcatgttagtta

SEQ ID NO: 2452038 - DNA, 15 bp, Homo sapiens
ttctgttaactgaat

SEQ ID NO: 2452039 - DNA, 16 bp, Homo sapiens
ttctgttaactgaata

SEQ ID NO: 2452040 - DNA, 17 bp, Homo sapiens
ttctgttccaaattcag

SEQ ID NO: 2452041 - DNA, 21 bp, Homo sapiens
ttctgttctagttttttactt

SEQ ID NO: 2452042 - DNA, 17 bp, Homo sapiens
ttcttaaacacttgcaa

SEQ ID NO: 2452043 - DNA, 16 bp, Homo sapiens
ttcttagctcaatgag

SEQ ID NO: 2452044 - DNA, 23 bp, Homo sapiens
ttcttagctcaatgagcatgttt

SEQ ID NO: 2452045 - DNA, 15 bp, Homo sapiens
ttcttatggaattga

SEQ ID NO: 2452046 - DNA, 16 bp, Homo sapiens
ttcttcaccaaatctt

SEQ ID NO: 2452047 - DNA, 14 bp, Homo sapiens
ttcttcactgcaac

SEQ ID NO: 2452048 - DNA, 21 bp, Homo sapiens
ttcttcataacaattttagga

SEQ ID NO: 2452049 - DNA, 13 bp, Homo sapiens
ttcttcctggccg

SEQ ID NO: 2452050 - DNA, 23 bp, Homo sapiens
ttcttgaggggaagctagtcttt

SEQ ID NO: 2452051 - DNA, 19 bp, Homo sapiens
ttcttgaggggaccaggag

SEQ ID NO: 2452052 - DNA, 15 bp, Homo sapiens
ttcttgatgtaaaat

SEQ ID NO: 2452053 - DNA, 17 bp, Homo sapiens
ttcttgcctctgtgctg

SEQ ID NO: 2452054 - DNA, 11 bp, Homo sapiens
ttcttgtctat

SEQ ID NO: 2452055 - DNA, 14 bp, Homo sapiens
ttcttgtctataaa

SEQ ID NO: 2452056 - DNA, 16 bp, Homo sapiens
ttcttgtctataaagc

SEQ ID NO: 2452057 - DNA, 22 bp, Homo sapiens
ttcttgtctataaagcatttaa

SEQ ID NO: 2452058 - DNA, 20 bp, Homo sapiens
ttctttaaaatgtaaagcca

SEQ ID NO: 2452059 - DNA, 11 bp, Homo sapiens
ttctttagaac

SEQ ID NO: 2452060 - DNA, 22 bp, Homo sapiens
ttctttataagaaagcctgagt

SEQ ID NO: 2452061 - DNA, 15 bp, Homo sapiens
ttctttccatttgca

SEQ ID NO: 2452062 - DNA, 17 bp, Homo sapiens
ttctttgaataaatgtc

SEQ ID NO: 2452063 - DNA, 18 bp, Homo sapiens
ttctttgaataaatgtca

SEQ ID NO: 2452064 - DNA, 13 bp, Homo sapiens
ttcttttccccct

SEQ ID NO: 2452065 - DNA, 14 bp, Homo sapiens
ttcttttgccatga

SEQ ID NO: 2452066 - DNA, 23 bp, Homo sapiens
ttcttttggtaaagactggcttt

SEQ ID NO: 2452067 - DNA, 15 bp, Homo sapiens
ttctttttgaagtat

SEQ ID NO: 2452068 - DNA, 16 bp, Homo sapiens
ttctttttgaagtatt

SEQ ID NO: 2452069 - DNA, 16 bp, Homo sapiens
ttgaaaaagacattca

SEQ ID NO: 2452070 - DNA, 13 bp, Homo sapiens
ttgaaaaagcgaa

SEQ ID NO: 2452071 - DNA, 15 bp, Homo sapiens
ttgaaaaagtttgtt

SEQ ID NO: 2452072 - DNA, 13 bp, Homo sapiens
ttgaaaagagctg

SEQ ID NO: 2452073 - DNA, 19 bp, Homo sapiens
ttgaaaccaccttttatta

SEQ ID NO: 2452074 - DNA, 21 bp, Homo sapiens
ttgaaaggttttttttcagtt

SEQ ID NO: 2452075 - DNA, 17 bp, Homo sapiens
ttgaaatgtaaggctgt

SEQ ID NO: 2452076 - DNA, 18 bp, Homo sapiens
ttgaaattaacctctcac

SEQ ID NO: 2452077 - DNA, 17 bp, Homo sapiens
ttgaacctttgtgccct

SEQ ID NO: 2452078 - DNA, 20 bp, Homo sapiens
ttgaactcttcactcttcaa

SEQ ID NO: 2452079 - DNA, 19 bp, Homo sapiens
ttgaagaactgcaggccct

SEQ ID NO: 2452080 - DNA, 20 bp, Homo sapiens
ttgaagcaaatcgaatgaaa

SEQ ID NO: 2452081 - DNA, 17 bp, Homo sapiens
ttgaaggcaaaattgca

SEQ ID NO: 2452082 - DNA, 11 bp, Homo sapiens
ttgaaggctta

SEQ ID NO: 2452083 - DNA, 20 bp, Homo sapiens
ttgaagggaggggctgtgtt

SEQ ID NO: 2452084 - DNA, 19 bp, Homo sapiens
ttgaagggccagagccagg

SEQ ID NO: 2452085 - DNA, 16 bp, Homo sapiens
ttgaagtaaacttttt

SEQ ID NO: 2452086 - DNA, 19 bp, Homo sapiens
ttgaagttagctttaactt

SEQ ID NO: 2452087 - DNA, 23 bp, Homo sapiens
ttgaagttagctttaacttaaat

SEQ ID NO: 2452088 - DNA, 19 bp, Homo sapiens
ttgaatactttgaatgtgt

SEQ ID NO: 2452089 - DNA, 10 bp, Homo sapiens
ttgaatcaat

SEQ ID NO: 2452090 - DNA, 23 bp, Homo sapiens
ttgaatcaataatatattttctg

SEQ ID NO: 2452091 - DNA, 15 bp, Homo sapiens
ttgaatcacatgaat

SEQ ID NO: 2452092 - DNA, 20 bp, Homo sapiens
ttgaatgatttttctttaca

SEQ ID NO: 2452093 - DNA, 21 bp, Homo sapiens
ttgaatgatttttctttacaa

SEQ ID NO: 2452094 - DNA, 21 bp, Homo sapiens
ttgaattcttggttgaggaaa

SEQ ID NO: 2452095 - DNA, 15 bp, Homo sapiens
ttgaattgtaactgt

SEQ ID NO: 2452096 - DNA, 18 bp, Homo sapiens
ttgacaactggcaggcag

SEQ ID NO: 2452097 - DNA, 16 bp, Homo sapiens
ttgacacagaaaatgt

SEQ ID NO: 2452098 - DNA, 12 bp, Homo sapiens
ttgacacctgct

SEQ ID NO: 2452099 - DNA, 14 bp, Homo sapiens
ttgacactgctcta

SEQ ID NO: 2452100 - DNA, 21 bp, Homo sapiens
tttaatgtttaaaacatcatt

SEQ ID NO: 2452101 - DNA, 21 bp, Homo sapiens
tttaattgtaaagtaaaagct

SEQ ID NO: 2452102 - DNA, 15 bp, Homo sapiens
tttacaaactgaaga

SEQ ID NO: 2452103 - DNA, 21 bp, Homo sapiens
tttacaatcagccacattcta

SEQ ID NO: 2452104 - DNA, 18 bp, Homo sapiens
tttacacaatagaattat

SEQ ID NO: 2452105 - DNA, 15 bp, Homo sapiens
tttacacgcttttgt

SEQ ID NO: 2452106 - DNA, 17 bp, Homo sapiens
tttacacgcttttgtga

SEQ ID NO: 2452107 - DNA, 16 bp, Homo sapiens
tttacactctttgtaa

SEQ ID NO: 2452108 - DNA, 14 bp, Homo sapiens
tttacagaattgct

SEQ ID NO: 2452109 - DNA, 16 bp, Homo sapiens
tttacatgcttattcc

SEQ ID NO: 2452110 - DNA, 18 bp, Homo sapiens
tttacatgcttattccat

SEQ ID NO: 2452111 - DNA, 15 bp, Homo sapiens
tttacctaagattac

SEQ ID NO: 2452112 - DNA, 17 bp, Homo sapiens
tttactgctctgagaat

SEQ ID NO: 2452113 - DNA, 23 bp, Homo sapiens
tttactgtaatataaagtattca

SEQ ID NO: 2452114 - DNA, 22 bp, Homo sapiens
tttagaagccaactatgattat

SEQ ID NO: 2452115 - DNA, 14 bp, Homo sapiens
tttagaatcccagc

SEQ ID NO: 2452116 - DNA, 20 bp, Homo sapiens
tttagacagtctcactttgt

SEQ ID NO: 2452117 - DNA, 15 bp, Homo sapiens
tttagacttcaagca

SEQ ID NO: 2452118 - DNA, 19 bp, Homo sapiens
tttagattttctggttcta

SEQ ID NO: 2452119 - DNA, 19 bp, Homo sapiens
tttagcattttaattctct

SEQ ID NO: 2452120 - DNA, 10 bp, Homo sapiens
tttaggaaat

SEQ ID NO: 2452121 - DNA, 23 bp, Homo sapiens
tttaggagctaaggctctatgag

SEQ ID NO: 2452122 - DNA, 17 bp, Homo sapiens
tttaggataaaataatg

SEQ ID NO: 2452123 - DNA, 16 bp, Homo sapiens
tttaggttctaaagtt

SEQ ID NO: 2452124 - DNA, 21 bp, Homo sapiens
tttagtagcagtgattgtctt

SEQ ID NO: 2452125 - DNA, 24 bp, Homo sapiens
tttagtggtagcatatagattgtc

SEQ ID NO: 2452126 - DNA, 20 bp, Homo sapiens
tttataaatactgcaaatca

SEQ ID NO: 2452127 - DNA, 12 bp, Homo sapiens
tttataagcatc

SEQ ID NO: 2452128 - DNA, 13 bp, Homo sapiens
tttataagcatca

SEQ ID NO: 2452129 - DNA, 16 bp, Homo sapiens
tttataagcatcatta

SEQ ID NO: 2452130 - DNA, 18 bp, Homo sapiens
tttataagcatcattatt

SEQ ID NO: 2452131 - DNA, 20 bp, Homo sapiens
tttataagcatcattattta

SEQ ID NO: 2452132 - DNA, 21 bp, Homo sapiens
tttataagcatcattatttat

SEQ ID NO: 2452133 - DNA, 17 bp, Homo sapiens
tttataattctcattaa

SEQ ID NO: 2452134 - DNA, 20 bp, Homo sapiens
tttataattctcattaaaag

SEQ ID NO: 2452135 - DNA, 13 bp, Homo sapiens
tttatacagctgt

SEQ ID NO: 2452136 - DNA, 21 bp, Homo sapiens
tttatacagctgtattgtctg

SEQ ID NO: 2452137 - DNA, 22 bp, Homo sapiens
tttatacagctgtattgtctga

SEQ ID NO: 2452138 - DNA, 16 bp, Homo sapiens
tttatactctttctgt

SEQ ID NO: 2452139 - DNA, 19 bp, Homo sapiens
tttatatatatatataaag

SEQ ID NO: 2452140 - DNA, 14 bp, Homo sapiens
tttatatattatat

SEQ ID NO: 2452141 - DNA, 17 bp, Homo sapiens
tttatatattatatgga

SEQ ID NO: 2452142 - DNA, 14 bp, Homo sapiens
tttatatgtacatg

SEQ ID NO: 2452143 - DNA, 22 bp, Homo sapiens
tttatcaaaccctagccttgct

SEQ ID NO: 2452144 - DNA, 16 bp, Homo sapiens
tttatcccaaagttgt

SEQ ID NO: 2452145 - DNA, 20 bp, Homo sapiens
tttatcgctgggaaatgaga

SEQ ID NO: 2452146 - DNA, 12 bp, Homo sapiens
tttatcttttta

SEQ ID NO: 2452147 - DNA, 16 bp, Homo sapiens
tttatctttttacctt

SEQ ID NO: 2452148 - DNA, 21 bp, Homo sapiens
tttatggtaactgctttctgt

SEQ ID NO: 2452149 - DNA, 19 bp, Homo sapiens
tttatgtagtaattgacat

SEQ ID NO: 2452150 - DNA, 11 bp, Homo sapiens
tttatgtattg

SEQ ID NO: 2452151 - DNA, 19 bp, Homo sapiens
tttatgtattgtgcaatgt

SEQ ID NO: 2452152 - DNA, 14 bp, Homo sapiens
tttatgttatatat

SEQ ID NO: 2452153 - DNA, 14 bp, Homo sapiens
tttattaaagaaaa

SEQ ID NO: 2452154 - DNA, 17 bp, Homo sapiens
tttattaatatatatta

SEQ ID NO: 2452155 - DNA, 17 bp, Homo sapiens
tttattaatgcactttc

SEQ ID NO: 2452156 - DNA, 14 bp, Homo sapiens
tttattacgtatgt

SEQ ID NO: 2452157 - DNA, 16 bp, Homo sapiens
tttattacgtatgtct

SEQ ID NO: 2452158 - DNA, 20 bp, Homo sapiens
tttattagtattgttgtcct

SEQ ID NO: 2452159 - DNA, 22 bp, Homo sapiens
tttattccagaatgctgtacat

SEQ ID NO: 2452160 - DNA, 14 bp, Homo sapiens
tttattcttctaga

SEQ ID NO: 2452161 - DNA, 15 bp, Homo sapiens
tttattgacacagaa

SEQ ID NO: 2452162 - DNA, 22 bp, Homo sapiens
tttattgactttgacaattact

SEQ ID NO: 2452163 - DNA, 15 bp, Homo sapiens
tttattggttttgca

SEQ ID NO: 2452164 - DNA, 23 bp, Homo sapiens
tttattggttttgcagaagaagg

SEQ ID NO: 2452165 - DNA, 22 bp, Homo sapiens
tttatttaacttttagtaaagt

SEQ ID NO: 2452166 - DNA, 19 bp, Homo sapiens
tttatttaatgctgtggca

SEQ ID NO: 2452167 - DNA, 13 bp, Homo sapiens
tttatttcctccc

SEQ ID NO: 2452168 - DNA, 14 bp, Homo sapiens
tttattttgacata

SEQ ID NO: 2452169 - DNA, 17 bp, Homo sapiens
tttatttttcatttagt

SEQ ID NO: 2452170 - DNA, 21 bp, Homo sapiens
tttcaaaaccaggtccaatga

SEQ ID NO: 2452171 - DNA, 18 bp, Homo sapiens
tttcaaaaccttttgaaa

SEQ ID NO: 2452172 - DNA, 13 bp, Homo sapiens
tttcaaagatgct

SEQ ID NO: 2452173 - DNA, 20 bp, Homo sapiens
tttcaacagtgaagacagaa

SEQ ID NO: 2452174 - DNA, 17 bp, Homo sapiens
tttcaaggcactctaga

SEQ ID NO: 2452175 - DNA, 14 bp, Homo sapiens
tttcaaggttctaa

SEQ ID NO: 2452176 - DNA, 16 bp, Homo sapiens
tttcaaggttctaacc

SEQ ID NO: 2452177 - DNA, 15 bp, Homo sapiens
tttcaatagcacata

SEQ ID NO: 2452178 - DNA, 21 bp, Homo sapiens
tttcaatagccactaaccttg

SEQ ID NO: 2452179 - DNA, 13 bp, Homo sapiens
tttcaatcaactt

SEQ ID NO: 2452180 - DNA, 19 bp, Homo sapiens
tttcaatcaactttactgt

SEQ ID NO: 2452181 - DNA, 20 bp, Homo sapiens
tttcaatcaactttactgta

SEQ ID NO: 2452182 - DNA, 14 bp, Homo sapiens
tttcacaaggtctt

SEQ ID NO: 2452183 - DNA, 17 bp, Homo sapiens
tttcacaaggtctttaa

SEQ ID NO: 2452184 - DNA, 21 bp, Homo sapiens
tttcacatagcccacttacat

SEQ ID NO: 2452185 - DNA, 22 bp, Homo sapiens
tttcacatagcccacttacatt

SEQ ID NO: 2452186 - DNA, 22 bp, Homo sapiens
tttcaccatttgattatgtagc

SEQ ID NO: 2452187 - DNA, 22 bp, Homo sapiens
tttcaccccacccttcccctcc

SEQ ID NO: 2452188 - DNA, 21 bp, Homo sapiens
tttcactgtctttaattctgt

SEQ ID NO: 2452189 - DNA, 16 bp, Homo sapiens
tttcagaagttagttt

SEQ ID NO: 2452190 - DNA, 20 bp, Homo sapiens
tttcagaagttagtttgtat

SEQ ID NO: 2452191 - DNA, 22 bp, Homo sapiens
tttcagaagttagtttgtatat

SEQ ID NO: 2452192 - DNA, 15 bp, Homo sapiens
tttcagaatatgtca

SEQ ID NO: 2452193 - DNA, 21 bp, Homo sapiens
tttcagactcccattcctgaa

SEQ ID NO: 2452194 - DNA, 20 bp, Homo sapiens
tttcagcactagccaaacct

SEQ ID NO: 2452195 - DNA, 18 bp, Homo sapiens
tttcagcgactccgttgg

SEQ ID NO: 2452196 - DNA, 16 bp, Homo sapiens
tttcagctcctgacca

SEQ ID NO: 2452197 - DNA, 13 bp, Homo sapiens
tttcaggatctat

SEQ ID NO: 2452198 - DNA, 14 bp, Homo sapiens
tttcaggatctatt

SEQ ID NO: 2452199 - DNA, 16 bp, Homo sapiens
tttcaggatctatttt

SEQ ID NO: 2452200 - DNA, 14 bp, Homo sapiens
tttcagtattatat

SEQ ID NO: 2452201 - DNA, 11 bp, Homo sapiens
tttcagtgagg

SEQ ID NO: 2452202 - DNA, 20 bp, Homo sapiens
tttcatacattttctaagaa

SEQ ID NO: 2452203 - DNA, 17 bp, Homo sapiens
tttcataggtctgaaat

SEQ ID NO: 2452204 - DNA, 21 bp, Homo sapiens
ttttttggccatctgctcctg

SEQ ID NO: 2452205 - DNA, 14 bp, Homo sapiens
ttttttgtaccatt

SEQ ID NO: 2452206 - DNA, 15 bp, Homo sapiens
ttttttgtatagtta

SEQ ID NO: 2452207 - DNA, 12 bp, Homo sapiens
ttttttgttgac

SEQ ID NO: 2452208 - DNA, 10 bp, Homo sapiens
tttttttgca

SEQ ID NO: 2452209 - DNA, 13 bp, Homo sapiens
aaaaaaaagcttc

SEQ ID NO: 2452210 - DNA, 14 bp, Homo sapiens
aaaaaaaagttgca

SEQ ID NO: 2452211 - DNA, 19 bp, Homo sapiens
aaaaaaacctgagatttat

SEQ ID NO: 2452212 - DNA, 12 bp, Homo sapiens
aaaaaaagatga

SEQ ID NO: 2452213 - DNA, 21 bp, Homo sapiens
aaaaactttggaaccagactc

SEQ ID NO: 2452214 - DNA, 23 bp, Homo sapiens
aaaaagaaaggctgttaaataca

SEQ ID NO: 2452215 - DNA, 18 bp, Homo sapiens
aaaaagaagcaacctcag

SEQ ID NO: 2452216 - DNA, 19 bp, Homo sapiens
aaaaagataaacacaagat

SEQ ID NO: 2452217 - DNA, 14 bp, Homo sapiens
aaaaagatcccaaa

SEQ ID NO: 2452218 - DNA, 19 bp, Homo sapiens
aaaaagcttaaaactttga

SEQ ID NO: 2452219 - DNA, 22 bp, Homo sapiens
aaaaagtgttgatcaaccattc

SEQ ID NO: 2452220 - DNA, 15 bp, Homo sapiens
aaaaagttgcagctg

SEQ ID NO: 2452221 - DNA, 14 bp, Homo sapiens
aaaaataagaagaa

SEQ ID NO: 2452222 - DNA, 18 bp, Homo sapiens
aaaaataagtcaacagta

SEQ ID NO: 2452223 - DNA, 21 bp, Homo sapiens
aaaaataagtcaacagtaaac

SEQ ID NO: 2452224 - DNA, 12 bp, Homo sapiens
aaaaataataat

SEQ ID NO: 2452225 - DNA, 14 bp, Homo sapiens
aaaaatactcagat

SEQ ID NO: 2452226 - DNA, 23 bp, Homo sapiens
aaaaatagtttggatatgtaaaa

SEQ ID NO: 2452227 - DNA, 19 bp, Homo sapiens
aaaaatcatgggccagagc

SEQ ID NO: 2452228 - DNA, 23 bp, Homo sapiens
aaaaatgtttttggtcttttata

SEQ ID NO: 2452229 - DNA, 14 bp, Homo sapiens
aaaaattgaaatgt

SEQ ID NO: 2452230 - DNA, 14 bp, Homo sapiens
aaaaattgtgatca

SEQ ID NO: 2452231 - DNA, 21 bp, Homo sapiens
aaaaattgttaatttttccta

SEQ ID NO: 2452232 - DNA, 15 bp, Homo sapiens
aaaacaaactcattc

SEQ ID NO: 2452233 - DNA, 13 bp, Homo sapiens
aaaacagaagcct

SEQ ID NO: 2452234 - DNA, 17 bp, Homo sapiens
aaaacaggtagaattat

SEQ ID NO: 2452235 - DNA, 18 bp, Homo sapiens
aaaacaggtatatacttt

SEQ ID NO: 2452236 - DNA, 21 bp, Homo sapiens
aaaacaggtcttcatcgaatc

SEQ ID NO: 2452237 - DNA, 19 bp, Homo sapiens
aaaacatgtttatttttct

SEQ ID NO: 2452238 - DNA, 12 bp, Homo sapiens
aaaacatttatt

SEQ ID NO: 2452239 - DNA, 20 bp, Homo sapiens
aaaacccttgggccagaagt

SEQ ID NO: 2452240 - DNA, 22 bp, Homo sapiens
aaaactacaaccaatggaatgt

SEQ ID NO: 2452241 - DNA, 19 bp, Homo sapiens
aaaactatatgtatggttt

SEQ ID NO: 2452242 - DNA, 17 bp, Homo sapiens
aaaactccaccttccca

SEQ ID NO: 2452243 - DNA, 21 bp, Homo sapiens
aaaactctacttaatccaatg

SEQ ID NO: 2452244 - DNA, 15 bp, Homo sapiens
aaaactctttcggta

SEQ ID NO: 2452245 - DNA, 20 bp, Homo sapiens
aaaactttcctcgcctgaca

SEQ ID NO: 2452246 - DNA, 12 bp, Homo sapiens
aaaagaagaagt

SEQ ID NO: 2452247 - DNA, 15 bp, Homo sapiens
aaaagacattcagga

SEQ ID NO: 2452248 - DNA, 10 bp, Homo sapiens
aaaagatccc

SEQ ID NO: 2452249 - DNA, 18 bp, Homo sapiens
aaaagatgcactttgctt

SEQ ID NO: 2452250 - DNA, 16 bp, Homo sapiens
aaaagcaaaaaagaaa

SEQ ID NO: 2452251 - DNA, 14 bp, Homo sapiens
aaaagcaaatcatt

SEQ ID NO: 2452252 - DNA, 15 bp, Homo sapiens
aaaagcattttgtaa

SEQ ID NO: 2452253 - DNA, 23 bp, Homo sapiens
aaaagccaggttccacagaggac

SEQ ID NO: 2452254 - DNA, 19 bp, Homo sapiens
aaaagcgtgagcttaaaat

SEQ ID NO: 2452255 - DNA, 23 bp, Homo sapiens
aaaagcgtgagcttaaaatacaa

SEQ ID NO: 2452256 - DNA, 15 bp, Homo sapiens
aaaagcttacaaata

SEQ ID NO: 2452257 - DNA, 21 bp, Homo sapiens
aaaagcttagctttagaaaca

SEQ ID NO: 2452258 - DNA, 23 bp, Homo sapiens
aaaagcttagctttagaaacagt

SEQ ID NO: 2452259 - DNA, 14 bp, Homo sapiens
aaaaggataagtga

SEQ ID NO: 2452260 - DNA, 12 bp, Homo sapiens
aaaaggcctggg

SEQ ID NO: 2452261 - DNA, 13 bp, Homo sapiens
aaaaggcctgggg

SEQ ID NO: 2452262 - DNA, 14 bp, Homo sapiens
aaaaggtttacaga

SEQ ID NO: 2452263 - DNA, 23 bp, Homo sapiens
aaaagtgggttttttagttgaat

SEQ ID NO: 2452264 - DNA, 13 bp, Homo sapiens
aaaagttccaaga

SEQ ID NO: 2452265 - DNA, 18 bp, Homo sapiens
aaaagttgcagctgtttt

SEQ ID NO: 2452266 - DNA, 12 bp, Homo sapiens
aaaagtttgttt

SEQ ID NO: 2452267 - DNA, 20 bp, Homo sapiens
aaaagttttttattatgcat

SEQ ID NO: 2452268 - DNA, 23 bp, Homo sapiens
aaaataaatgtcaccaggtactt

SEQ ID NO: 2452269 - DNA, 14 bp, Homo sapiens
aaaataagtcaaca

SEQ ID NO: 2452270 - DNA, 13 bp, Homo sapiens
aaaataattttgt

SEQ ID NO: 2452271 - DNA, 10 bp, Homo sapiens
aaaatacatg

SEQ ID NO: 2452272 - DNA, 11 bp, Homo sapiens
aaaatactttt

SEQ ID NO: 2452273 - DNA, 22 bp, Homo sapiens
aaaatacttttactctgcctac

SEQ ID NO: 2452274 - DNA, 15 bp, Homo sapiens
aaaatagacaaatag

SEQ ID NO: 2452275 - DNA, 22 bp, Homo sapiens
aaaatagataagagtagaaact

SEQ ID NO: 2452276 - DNA, 15 bp, Homo sapiens
aaaatagcgttcttg

SEQ ID NO: 2452277 - DNA, 19 bp, Homo sapiens
aaaatagcgttcttgtaat

SEQ ID NO: 2452278 - DNA, 13 bp, Homo sapiens
aaaataggcagga

SEQ ID NO: 2452279 - DNA, 21 bp, Homo sapiens
aaaatagggtatattttccta

SEQ ID NO: 2452280 - DNA, 20 bp, Homo sapiens
aaaatagtttggatatgtaa

SEQ ID NO: 2452281 - DNA, 14 bp, Homo sapiens
aaaatatgtaccaa

SEQ ID NO: 2452282 - DNA, 13 bp, Homo sapiens
aaaatcaaatggt

SEQ ID NO: 2452283 - DNA, 21 bp, Homo sapiens
aaaatcaggtggcttttgcgg

SEQ ID NO: 2452284 - DNA, 19 bp, Homo sapiens
aaaatctctccactttcag

SEQ ID NO: 2452285 - DNA, 12 bp, Homo sapiens
aaaatcttgtca

SEQ ID NO: 2452286 - DNA, 13 bp, Homo sapiens
aaaatcttgtcat

SEQ ID NO: 2452287 - DNA, 22 bp, Homo sapiens
aaaatgcggttataaaaaatgg

SEQ ID NO: 2452288 - DNA, 15 bp, Homo sapiens
aaaatgctaggttct

SEQ ID NO: 2452289 - DNA, 19 bp, Homo sapiens
aaaatgctggctatagatg

SEQ ID NO: 2452290 - DNA, 19 bp, Homo sapiens
aaaatgctttttatttctg

SEQ ID NO: 2452291 - DNA, 22 bp, Homo sapiens
aaaatgtaagattatagattct

SEQ ID NO: 2452292 - DNA, 11 bp, Homo sapiens
aaaatgtattt

SEQ ID NO: 2452293 - DNA, 13 bp, Homo sapiens
aaaatgtatttta

SEQ ID NO: 2452294 - DNA, 17 bp, Homo sapiens
aaaatgtattttatgtt

SEQ ID NO: 2452295 - DNA, 18 bp, Homo sapiens
aaaatgtcttgtgttacc

SEQ ID NO: 2452296 - DNA, 17 bp, Homo sapiens
aaaatgtgatgttctaa

SEQ ID NO: 2452297 - DNA, 22 bp, Homo sapiens
aaaatgttatcttctcaagttc

SEQ ID NO: 2452298 - DNA, 23 bp, Homo sapiens
aaaattagactgtgattcagaaa

SEQ ID NO: 2452299 - DNA, 16 bp, Homo sapiens
aaaattatagaagttt

SEQ ID NO: 2452300 - DNA, 20 bp, Homo sapiens
aaagcaagctgattaaatga

SEQ ID NO: 2452301 - DNA, 19 bp, Homo sapiens
aaagcacgaaatgttattt

SEQ ID NO: 2452302 - DNA, 17 bp, Homo sapiens
aaagcacgacagtggat

SEQ ID NO: 2452303 - DNA, 14 bp, Homo sapiens
aaagcaggttcttg

SEQ ID NO: 2452304 - DNA, 17 bp, Homo sapiens
aaagcaggttcttgttg

SEQ ID NO: 2452305 - DNA, 19 bp, Homo sapiens
aaagcaggttcttgttggt

SEQ ID NO: 2452306 - DNA, 15 bp, Homo sapiens
aaagcagtatttttc

SEQ ID NO: 2452307 - DNA, 19 bp, Homo sapiens
aaagccaggtccctctcat

SEQ ID NO: 2452308 - DNA, 13 bp, Homo sapiens
aaagccatgctgg

SEQ ID NO: 2452309 - DNA, 14 bp, Homo sapiens
aaagcccccagagc

SEQ ID NO: 2452310 - DNA, 22 bp, Homo sapiens
aaagcccccagagcccaggctc

SEQ ID NO: 2452311 - DNA, 13 bp, Homo sapiens
aaagcctgctcaa

SEQ ID NO: 2452312 - DNA, 18 bp, Homo sapiens
aaagcctgggtgacattt

SEQ ID NO: 2452313 - DNA, 20 bp, Homo sapiens
aaagcctgggtttggtgtat

SEQ ID NO: 2452314 - DNA, 23 bp, Homo sapiens
aaagcctgggtttggtgtatggt

SEQ ID NO: 2452315 - DNA, 17 bp, Homo sapiens
aaagcctgttcatggca

SEQ ID NO: 2452316 - DNA, 20 bp, Homo sapiens
aaagctagaattgagtgttt

SEQ ID NO: 2452317 - DNA, 16 bp, Homo sapiens
aaagctggtttaatgt

SEQ ID NO: 2452318 - DNA, 18 bp, Homo sapiens
aaagctgtgtgtttggaa

SEQ ID NO: 2452319 - DNA, 16 bp, Homo sapiens
aaagcttaaaactttg

SEQ ID NO: 2452320 - DNA, 19 bp, Homo sapiens
aaagcttaaaactttgaag

SEQ ID NO: 2452321 - DNA, 20 bp, Homo sapiens
aaagcttccatgattctatt

SEQ ID NO: 2452322 - DNA, 13 bp, Homo sapiens
aaagctttcctgc

SEQ ID NO: 2452323 - DNA, 14 bp, Homo sapiens
aaagctttcctgcc

SEQ ID NO: 2452324 - DNA, 22 bp, Homo sapiens
aaagctttcctgccccaggcct

SEQ ID NO: 2452325 - DNA, 16 bp, Homo sapiens
aaagcttttgtctaca

SEQ ID NO: 2452326 - DNA, 15 bp, Homo sapiens
aaaggaagccaaaga

SEQ ID NO: 2452327 - DNA, 17 bp, Homo sapiens
aaaggaatcatttctat

SEQ ID NO: 2452328 - DNA, 15 bp, Homo sapiens
aaaggacgcactgag

SEQ ID NO: 2452329 - DNA, 12 bp, Homo sapiens
aaaggagcctgt

SEQ ID NO: 2452330 - DNA, 23 bp, Homo sapiens
aaaggagcctgtgaacccaggac

SEQ ID NO: 2452331 - DNA, 14 bp, Homo sapiens
aaaggatgtgatat

SEQ ID NO: 2452332 - DNA, 17 bp, Homo sapiens
aaaggatgtgatatata

SEQ ID NO: 2452333 - DNA, 19 bp, Homo sapiens
aaaggatgtgatatataag

SEQ ID NO: 2452334 - DNA, 23 bp, Homo sapiens
aaaggatgtgatatataagtgta

SEQ ID NO: 2452335 - DNA, 13 bp, Homo sapiens
aaaggatgtgatt

SEQ ID NO: 2452336 - DNA, 14 bp, Homo sapiens
aaaggcaagcactt

SEQ ID NO: 2452337 - DNA, 23 bp, Homo sapiens
aaaggcagttaccattaaaccat

SEQ ID NO: 2452338 - DNA, 10 bp, Homo sapiens
aaaggcctgg

SEQ ID NO: 2452339 - DNA, 11 bp, Homo sapiens
aaaggcctggg

SEQ ID NO: 2452340 - DNA, 20 bp, Homo sapiens
aaaggctgttaaatacagga

SEQ ID NO: 2452341 - DNA, 21 bp, Homo sapiens
aaagggagaagtgacattgca

SEQ ID NO: 2452342 - DNA, 19 bp, Homo sapiens
aaagggagggctctgaggc

SEQ ID NO: 2452343 - DNA, 19 bp, Homo sapiens
aaagggccctccttcctaa

SEQ ID NO: 2452344 - DNA, 11 bp, Homo sapiens
aaaggggagac

SEQ ID NO: 2452345 - DNA, 19 bp, Homo sapiens
aaaggtccacaggtctaga

SEQ ID NO: 2452346 - DNA, 18 bp, Homo sapiens
aaaggtttaaatgaacaa

SEQ ID NO: 2452347 - DNA, 21 bp, Homo sapiens
aaaggtttggaaggagcagaa

SEQ ID NO: 2452348 - DNA, 18 bp, Homo sapiens
aaaggttttttttcagtt

SEQ ID NO: 2452349 - DNA, 17 bp, Homo sapiens
aaagtacactctgctgt

SEQ ID NO: 2452350 - DNA, 15 bp, Homo sapiens
aaagtacttgtagtt

SEQ ID NO: 2452351 - DNA, 16 bp, Homo sapiens
aaagtacttgtagttc

SEQ ID NO: 2452352 - DNA, 16 bp, Homo sapiens
aaagtagtcctgtgaa

SEQ ID NO: 2452353 - DNA, 17 bp, Homo sapiens
aaagtatgtattattta

SEQ ID NO: 2452354 - DNA, 19 bp, Homo sapiens
aaagtatgtattatttaca

SEQ ID NO: 2452355 - DNA, 21 bp, Homo sapiens
aaagtattcaacaatttcaat

SEQ ID NO: 2452356 - DNA, 17 bp, Homo sapiens
aaagtcataattgcatt

SEQ ID NO: 2452357 - DNA, 18 bp, Homo sapiens
aaagtcctttttttccat

SEQ ID NO: 2452358 - DNA, 12 bp, Homo sapiens
aaagtctcttgt

SEQ ID NO: 2452359 - DNA, 19 bp, Homo sapiens
aaagtctgtccttgaagga

SEQ ID NO: 2452360 - DNA, 15 bp, Homo sapiens
aaagtgaaataatgt

SEQ ID NO: 2452361 - DNA, 17 bp, Homo sapiens
aaagtgaaataatgtgt

SEQ ID NO: 2452362 - DNA, 14 bp, Homo sapiens
aaagtgagagcacg

SEQ ID NO: 2452363 - DNA, 16 bp, Homo sapiens
aaagtgcctttcagga

SEQ ID NO: 2452364 - DNA, 16 bp, Homo sapiens
aaagtgctaaggttct

SEQ ID NO: 2452365 - DNA, 23 bp, Homo sapiens
aaagtgctaaggttctaaggcct

SEQ ID NO: 2452366 - DNA, 20 bp, Homo sapiens
aaagtggaaaacaaggaagt

SEQ ID NO: 2452367 - DNA, 20 bp, Homo sapiens
aaagtggaacgaaaatgaaa

SEQ ID NO: 2452368 - DNA, 22 bp, Homo sapiens
aaagtgggttttttagttgaat

SEQ ID NO: 2452369 - DNA, 14 bp, Homo sapiens
aaagtgtatttgga

SEQ ID NO: 2452370 - DNA, 23 bp, Homo sapiens
aaagtgtatttggaaataaagtc

SEQ ID NO: 2452371 - DNA, 16 bp, Homo sapiens
aaagttaccagtgcct

SEQ ID NO: 2452372 - DNA, 20 bp, Homo sapiens
aaagttagtatcttttgata

SEQ ID NO: 2452373 - DNA, 15 bp, Homo sapiens
aaagttctaagattc

SEQ ID NO: 2452374 - DNA, 17 bp, Homo sapiens
aaagttctaagattctg

SEQ ID NO: 2452375 - DNA, 18 bp, Homo sapiens
aaagttctaataatttct

SEQ ID NO: 2452376 - DNA, 19 bp, Homo sapiens
aaagttctaataatttcta

SEQ ID NO: 2452377 - DNA, 22 bp, Homo sapiens
aagccgtgctcgccccagcagg

SEQ ID NO: 2452378 - DNA, 23 bp, Homo sapiens
aagcctaaaagtgggcttgattc

SEQ ID NO: 2452379 - DNA, 15 bp, Homo sapiens
aagcctgatgctgac

SEQ ID NO: 2452380 - DNA, 20 bp, Homo sapiens
aagcctgggggcctggctgg

SEQ ID NO: 2452381 - DNA, 17 bp, Homo sapiens
aagcctgttcatggcag

SEQ ID NO: 2452382 - DNA, 18 bp, Homo sapiens
aagcctgttcatggcaga

SEQ ID NO: 2452383 - DNA, 13 bp, Homo sapiens
aagccttcaagct

SEQ ID NO: 2452384 - DNA, 14 bp, Homo sapiens
aagccttcaagctc

SEQ ID NO: 2452385 - DNA, 18 bp, Homo sapiens
aagccttcaagctctgag

SEQ ID NO: 2452386 - DNA, 22 bp, Homo sapiens
aagccttccccttatcctccct

SEQ ID NO: 2452387 - DNA, 14 bp, Homo sapiens
aagggtcaggcctt

SEQ ID NO: 2452388 - DNA, 19 bp, Homo sapiens
aagggtcgaaagctctaga

SEQ ID NO: 2452389 - DNA, 14 bp, Homo sapiens
aaggtaaaatgcca

SEQ ID NO: 2452390 - DNA, 18 bp, Homo sapiens
aaggtaaaatgccatgat

SEQ ID NO: 2452391 - DNA, 19 bp, Homo sapiens
aaggtaaataaaaagaaag

SEQ ID NO: 2452392 - DNA, 14 bp, Homo sapiens
aaggtacttggata

SEQ ID NO: 2452393 - DNA, 18 bp, Homo sapiens
aaggtactttcatatttt

SEQ ID NO: 2452394 - DNA, 19 bp, Homo sapiens
aaggtccacaggtctagac

SEQ ID NO: 2452395 - DNA, 21 bp, Homo sapiens
aaggtccggtgttctaagatg

SEQ ID NO: 2452396 - DNA, 18 bp, Homo sapiens
aaggtcgtttttttcatt

SEQ ID NO: 2452397 - DNA, 19 bp, Homo sapiens
aaggtgacatcggaaaaat

SEQ ID NO: 2452398 - DNA, 21 bp, Homo sapiens
aaggtgacatcggaaaaataa

SEQ ID NO: 2452399 - DNA, 18 bp, Homo sapiens
aaggtgctgacggccagg

SEQ ID NO: 2452400 - DNA, 18 bp, Homo sapiens
aaggtgtcctacagaaaa

SEQ ID NO: 2452401 - DNA, 12 bp, Homo sapiens
aaggttctaggt

SEQ ID NO: 2452402 - DNA, 21 bp, Homo sapiens
aaggttctcaggtgttgccaa

SEQ ID NO: 2452403 - DNA, 17 bp, Homo sapiens
aaggttcttactgcttg

SEQ ID NO: 2452404 - DNA, 21 bp, Homo sapiens
aaggtttaaagagtctagatt

SEQ ID NO: 2452405 - DNA, 14 bp, Homo sapiens
aaggtttaaatgaa

SEQ ID NO: 2452406 - DNA, 19 bp, Homo sapiens
aaggtttggaaggagcaga

SEQ ID NO: 2452407 - DNA, 20 bp, Homo sapiens
aaggttttaggttctaaagt

SEQ ID NO: 2452408 - DNA, 20 bp, Homo sapiens
aaggttttataaggctgatg

SEQ ID NO: 2452409 - DNA, 20 bp, Homo sapiens
aagtaaactttttgttctgg

SEQ ID NO: 2452410 - DNA, 12 bp, Homo sapiens
aagtaaatacaa

SEQ ID NO: 2452411 - DNA, 15 bp, Homo sapiens
aagtaaatacaattt

SEQ ID NO: 2452412 - DNA, 19 bp, Homo sapiens
aagtacactctgctgtttg

SEQ ID NO: 2452413 - DNA, 11 bp, Homo sapiens
aagtacagaga

SEQ ID NO: 2452414 - DNA, 13 bp, Homo sapiens
aagtacagagaag

SEQ ID NO: 2452415 - DNA, 16 bp, Homo sapiens
aagtacagagaagcca

SEQ ID NO: 2452416 - DNA, 17 bp, Homo sapiens
aagtacagagaagccat

SEQ ID NO: 2452417 - DNA, 12 bp, Homo sapiens
aagtaccagact

SEQ ID NO: 2452418 - DNA, 13 bp, Homo sapiens
aagtatgttctaa

SEQ ID NO: 2452419 - DNA, 12 bp, Homo sapiens
aagtattattag

SEQ ID NO: 2452420 - DNA, 21 bp, Homo sapiens
aagtatttcaaattggagctt

SEQ ID NO: 2452421 - DNA, 19 bp, Homo sapiens
aagtatttgttaatttaga

SEQ ID NO: 2452422 - DNA, 21 bp, Homo sapiens
aagtatttgttaatttagaaa

SEQ ID NO: 2452423 - DNA, 17 bp, Homo sapiens
aagtattttcataagta

SEQ ID NO: 2452424 - DNA, 14 bp, Homo sapiens
aagtcaacagtaaa

SEQ ID NO: 2452425 - DNA, 21 bp, Homo sapiens
aagtcaacagtaaaccactga

SEQ ID NO: 2452426 - DNA, 13 bp, Homo sapiens
aagtcaaggagaa

SEQ ID NO: 2452427 - DNA, 19 bp, Homo sapiens
aagtcacagggcagtacct

SEQ ID NO: 2452428 - DNA, 23 bp, Homo sapiens
aagtcacagggcagtacctgagg

SEQ ID NO: 2452429 - DNA, 21 bp, Homo sapiens
aagtcacggctgcgcactgtg

SEQ ID NO: 2452430 - DNA, 20 bp, Homo sapiens
aagtcagatggaaaattcat

SEQ ID NO: 2452431 - DNA, 23 bp, Homo sapiens
aagtcagatggaaaattcatttt

SEQ ID NO: 2452432 - DNA, 14 bp, Homo sapiens
aagtcataattgca

SEQ ID NO: 2452433 - DNA, 23 bp, Homo sapiens
aagtcatcttgctaccagtattt

SEQ ID NO: 2452434 - DNA, 21 bp, Homo sapiens
aagtcctttttttccatcttt

SEQ ID NO: 2452435 - DNA, 19 bp, Homo sapiens
aagtcgtccttactcctgt

SEQ ID NO: 2452436 - DNA, 20 bp, Homo sapiens
aagtcgtccttactcctgtg

SEQ ID NO: 2452437 - DNA, 22 bp, Homo sapiens
aagtcgtccttactcctgtggg

SEQ ID NO: 2452438 - DNA, 15 bp, Homo sapiens
aagtctctgctggcc

SEQ ID NO: 2452439 - DNA, 18 bp, Homo sapiens
aagtctgtccttgaagga

SEQ ID NO: 2452440 - DNA, 17 bp, Homo sapiens
aagtctttctctttccc

SEQ ID NO: 2452441 - DNA, 14 bp, Homo sapiens
aagtcttttgttcg

SEQ ID NO: 2452442 - DNA, 16 bp, Homo sapiens
aagtgaaataatgtgt

SEQ ID NO: 2452443 - DNA, 19 bp, Homo sapiens
aagtgagggctcactcagc

SEQ ID NO: 2452444 - DNA, 17 bp, Homo sapiens
aagtgcagaatgctcct

SEQ ID NO: 2452445 - DNA, 14 bp, Homo sapiens
aagtgccagtattt

SEQ ID NO: 2452446 - DNA, 15 bp, Homo sapiens
aagtgccagtatttt

SEQ ID NO: 2452447 - DNA, 18 bp, Homo sapiens
aagtgccctccaggcttt

SEQ ID NO: 2452448 - DNA, 13 bp, Homo sapiens
aagtgccctctcc

SEQ ID NO: 2452449 - DNA, 13 bp, Homo sapiens
aagtgcctttcag

SEQ ID NO: 2452450 - DNA, 17 bp, Homo sapiens
aagtgctaaggttctaa

SEQ ID NO: 2452451 - DNA, 18 bp, Homo sapiens
aagtgctaaggttctaag

SEQ ID NO: 2452452 - DNA, 19 bp, Homo sapiens
aagtgctgcactcaaatga

SEQ ID NO: 2452453 - DNA, 18 bp, Homo sapiens
aagtgctgtttattaatc

SEQ ID NO: 2452454 - DNA, 20 bp, Homo sapiens
aagtgctgtttattaatctt

SEQ ID NO: 2452455 - DNA, 19 bp, Homo sapiens
aagtggccaagaagcagtg

SEQ ID NO: 2452456 - DNA, 11 bp, Homo sapiens
aagtgggacag

SEQ ID NO: 2452457 - DNA, 12 bp, Homo sapiens
aagtgggcttga

SEQ ID NO: 2452458 - DNA, 16 bp, Homo sapiens
aagtgggcttgattct

SEQ ID NO: 2452459 - DNA, 18 bp, Homo sapiens
aagtggttccctctctta

SEQ ID NO: 2452460 - DNA, 16 bp, Homo sapiens
aagtgtcaactctttg

SEQ ID NO: 2452461 - DNA, 22 bp, Homo sapiens
aagtgttagccttttttcccca

SEQ ID NO: 2452462 - DNA, 18 bp, Homo sapiens
aagttagttccactgaga

SEQ ID NO: 2452463 - DNA, 19 bp, Homo sapiens
aagttagttccactgagac

SEQ ID NO: 2452464 - DNA, 14 bp, Homo sapiens
aagttataagactc

SEQ ID NO: 2452465 - DNA, 15 bp, Homo sapiens
aagttattaacttta

SEQ ID NO: 2452466 - DNA, 17 bp, Homo sapiens
aagttattaactttaat

SEQ ID NO: 2452467 - DNA, 14 bp, Homo sapiens
aagttattgcagtt

SEQ ID NO: 2452468 - DNA, 15 bp, Homo sapiens
aagttccaagagtct

SEQ ID NO: 2452469 - DNA, 16 bp, Homo sapiens
aagttccaagagtcta

SEQ ID NO: 2452470 - DNA, 21 bp, Homo sapiens
aagttccaagagtctaaagat

SEQ ID NO: 2452471 - DNA, 21 bp, Homo sapiens
aagttctaataatttctaatg

SEQ ID NO: 2452472 - DNA, 16 bp, Homo sapiens
aagttgagatagtttt

SEQ ID NO: 2452473 - DNA, 18 bp, Homo sapiens
aagttgagatagttttca

SEQ ID NO: 2452474 - DNA, 14 bp, Homo sapiens
aagttgattagaaa

SEQ ID NO: 2452475 - DNA, 17 bp, Homo sapiens
aagttgcagctgttttg

SEQ ID NO: 2452476 - DNA, 21 bp, Homo sapiens
aagttgcagctgttttgttga

SEQ ID NO: 2452477 - DNA, 20 bp, Homo sapiens
aagttgggcttgctattctg

SEQ ID NO: 2452478 - DNA, 21 bp, Homo sapiens
aagttggggacacatgtattt

SEQ ID NO: 2452479 - DNA, 17 bp, Homo sapiens
aagtttaataaatttat

SEQ ID NO: 2452480 - DNA, 20 bp, Homo sapiens
aagtttatcagtaaataact

SEQ ID NO: 2452481 - DNA, 17 bp, Homo sapiens
aagtttctaagattcta

SEQ ID NO: 2452482 - DNA, 20 bp, Homo sapiens
aagtttctaagattctaaag

SEQ ID NO: 2452483 - DNA, 15 bp, Homo sapiens
aagttttatatatta

SEQ ID NO: 2452484 - DNA, 19 bp, Homo sapiens
aaattgcaaatcttgaaat

SEQ ID NO: 2452485 - DNA, 23 bp, Homo sapiens
aaattggcatggaaatttaaagc

SEQ ID NO: 2452486 - DNA, 15 bp, Homo sapiens
aaattgtacagccgg

SEQ ID NO: 2452487 - DNA, 13 bp, Homo sapiens
aaattgtatattg

SEQ ID NO: 2452488 - DNA, 14 bp, Homo sapiens
aaatttgattgatt

SEQ ID NO: 2452489 - DNA, 13 bp, Homo sapiens
aaatttgtactat

SEQ ID NO: 2452490 - DNA, 22 bp, Homo sapiens
aaattttcctgtcctctttcag

SEQ ID NO: 2452491 - DNA, 23 bp, Homo sapiens
aaattttcctgtcctctttcagc

SEQ ID NO: 2452492 - DNA, 17 bp, Homo sapiens
aaatttttcttcttgag

SEQ ID NO: 2452493 - DNA, 17 bp, Homo sapiens
aacaaaactgcatttca

SEQ ID NO: 2452494 - DNA, 22 bp, Homo sapiens
aacaaaagaagcccggctcctg

SEQ ID NO: 2452495 - DNA, 17 bp, Homo sapiens
aacaaaatgtatgtctg

SEQ ID NO: 2452496 - DNA, 20 bp, Homo sapiens
aacaaactcgttttttacaa

SEQ ID NO: 2452497 - DNA, 17 bp, Homo sapiens
aacaaactgtgtaactg

SEQ ID NO: 2452498 - DNA, 17 bp, Homo sapiens
aacaaagagttcaagaa

SEQ ID NO: 2452499 - DNA, 14 bp, Homo sapiens
aacaaagcagccac

SEQ ID NO: 2452500 - DNA, 19 bp, Homo sapiens
aacaaatgccaaattaaaa

SEQ ID NO: 2452501 - DNA, 14 bp, Homo sapiens
aacaacactgtagt

SEQ ID NO: 2452502 - DNA, 17 bp, Homo sapiens
aacaagaaaaataaaga

SEQ ID NO: 2452503 - DNA, 14 bp, Homo sapiens
aacaaggaagtcaa

SEQ ID NO: 2452504 - DNA, 20 bp, Homo sapiens
aacaagtatttgttaattta

SEQ ID NO: 2452505 - DNA, 17 bp, Homo sapiens
aacaatcttcctgttta

SEQ ID NO: 2452506 - DNA, 24 bp, Homo sapiens
aacaatgaataaaaactcaaggag

SEQ ID NO: 2452507 - DNA, 12 bp, Homo sapiens
aacaattctaaa

SEQ ID NO: 2452508 - DNA, 16 bp, Homo sapiens
aacaattgaagtaaac

SEQ ID NO: 2452509 - DNA, 17 bp, Homo sapiens
aacaattgaagtaaact

SEQ ID NO: 2452510 - DNA, 20 bp, Homo sapiens
aacaattgtgtagccttttt

SEQ ID NO: 2452511 - DNA, 14 bp, Homo sapiens
aacaatttggcaat

SEQ ID NO: 2452512 - DNA, 19 bp, Homo sapiens
aacaatttggcaattttgt

SEQ ID NO: 2452513 - DNA, 19 bp, Homo sapiens
aacacagcagttctgcaga

SEQ ID NO: 2452514 - DNA, 15 bp, Homo sapiens
aacaccaacataaaa

SEQ ID NO: 2452515 - DNA, 18 bp, Homo sapiens
aacaccaagcacagcagc

SEQ ID NO: 2452516 - DNA, 19 bp, Homo sapiens
aacaccattgaaggcttaa

SEQ ID NO: 2452517 - DNA, 16 bp, Homo sapiens
aacacccatttttcct

SEQ ID NO: 2452518 - DNA, 21 bp, Homo sapiens
aacacccatttttccttttgc

SEQ ID NO: 2452519 - DNA, 16 bp, Homo sapiens
aacacctcctcatgta

SEQ ID NO: 2452520 - DNA, 20 bp, Homo sapiens
aacactaatatatttaaaaa

SEQ ID NO: 2452521 - DNA, 16 bp, Homo sapiens
aacactaattcataat

SEQ ID NO: 2452522 - DNA, 18 bp, Homo sapiens
aacactcagaagcctggg

SEQ ID NO: 2452523 - DNA, 20 bp, Homo sapiens
aacactcagaagcctggggg

SEQ ID NO: 2452524 - DNA, 19 bp, Homo sapiens
aacactcttttgctttatt

SEQ ID NO: 2452525 - DNA, 19 bp, Homo sapiens
aacactggggacttggcct

SEQ ID NO: 2452526 - DNA, 23 bp, Homo sapiens
aacactggggacttggcctctct

SEQ ID NO: 2452527 - DNA, 17 bp, Homo sapiens
aacagaaattgtatatt

SEQ ID NO: 2452528 - DNA, 21 bp, Homo sapiens
aacagaaattgtatattgtaa

SEQ ID NO: 2452529 - DNA, 12 bp, Homo sapiens
aacagaacactt

SEQ ID NO: 2452530 - DNA, 19 bp, Homo sapiens
aacagagactgaatagata

SEQ ID NO: 2452531 - DNA, 12 bp, Homo sapiens
aacagaggatat

SEQ ID NO: 2452532 - DNA, 14 bp, Homo sapiens
aacagatcagtaaa

SEQ ID NO: 2452533 - DNA, 22 bp, Homo sapiens
aacagcatgtacggattttcag

SEQ ID NO: 2452534 - DNA, 12 bp, Homo sapiens
aacagctggtgt

SEQ ID NO: 2452535 - DNA, 17 bp, Homo sapiens
aacaggcactgccctgg

SEQ ID NO: 2452536 - DNA, 18 bp, Homo sapiens
aacaggcacttggcagcc

SEQ ID NO: 2452537 - DNA, 21 bp, Homo sapiens
aacaggcacttggcagccttg

SEQ ID NO: 2452538 - DNA, 13 bp, Homo sapiens
aacagggaaggca

SEQ ID NO: 2452539 - DNA, 22 bp, Homo sapiens
aacagggaaggcaggcagggct

SEQ ID NO: 2452540 - DNA, 23 bp, Homo sapiens
aacagggaaggcaggcagggctc

SEQ ID NO: 2452541 - DNA, 17 bp, Homo sapiens
aacaggtatatactttg

SEQ ID NO: 2452542 - DNA, 19 bp, Homo sapiens
aacaggttataacagtgtt

SEQ ID NO: 2452543 - DNA, 15 bp, Homo sapiens
aacagtaaaccactg

SEQ ID NO: 2452544 - DNA, 18 bp, Homo sapiens
aacagtaaaccactgaaa

SEQ ID NO: 2452545 - DNA, 13 bp, Homo sapiens
aacagtgtttaaa

SEQ ID NO: 2452546 - DNA, 22 bp, Homo sapiens
aacagttgcatgtagtaacact

SEQ ID NO: 2452547 - DNA, 15 bp, Homo sapiens
aacagtttaatgaag

SEQ ID NO: 2452548 - DNA, 12 bp, Homo sapiens
aacagttttcct

SEQ ID NO: 2452549 - DNA, 13 bp, Homo sapiens
aacataaaaatga

SEQ ID NO: 2452550 - DNA, 15 bp, Homo sapiens
aacataagctatttt

SEQ ID NO: 2452551 - DNA, 18 bp, Homo sapiens
aacataagctatttttct

SEQ ID NO: 2452552 - DNA, 22 bp, Homo sapiens
aacataagctatttttctaact

SEQ ID NO: 2452553 - DNA, 15 bp, Homo sapiens
aacatagacagaaga

SEQ ID NO: 2452554 - DNA, 16 bp, Homo sapiens
aacatagacagaagaa

SEQ ID NO: 2452555 - DNA, 19 bp, Homo sapiens
aacatagacagaagaaaca

SEQ ID NO: 2452556 - DNA, 15 bp, Homo sapiens
aacatatatatacta

SEQ ID NO: 2452557 - DNA, 13 bp, Homo sapiens
aacatcacagccc

SEQ ID NO: 2452558 - DNA, 19 bp, Homo sapiens
aacatcattactataagaa

SEQ ID NO: 2452559 - DNA, 11 bp, Homo sapiens
aacatccaaaa

SEQ ID NO: 2452560 - DNA, 15 bp, Homo sapiens
aacatccaaaatctt

SEQ ID NO: 2452561 - DNA, 16 bp, Homo sapiens
aacatctgagtcctgg

SEQ ID NO: 2452562 - DNA, 22 bp, Homo sapiens
aacatctttgaaattatgtaaa

SEQ ID NO: 2452563 - DNA, 18 bp, Homo sapiens
aacatgaggccactggag

SEQ ID NO: 2452564 - DNA, 21 bp, Homo sapiens
aacatgatgaggtagtacctt

SEQ ID NO: 2452565 - DNA, 20 bp, Homo sapiens
aagagctacgtatttaatag

SEQ ID NO: 2452566 - DNA, 12 bp, Homo sapiens
aagagctcagga

SEQ ID NO: 2452567 - DNA, 18 bp, Homo sapiens
aagaggcaccaggaagcc

SEQ ID NO: 2452568 - DNA, 17 bp, Homo sapiens
aagaggctgcccctctc

SEQ ID NO: 2452569 - DNA, 23 bp, Homo sapiens
aagaggctgcccctctcaccaaa

SEQ ID NO: 2452570 - DNA, 16 bp, Homo sapiens
aagagggacgcctggg

SEQ ID NO: 2452571 - DNA, 17 bp, Homo sapiens
aagaggtgaccccaggg

SEQ ID NO: 2452572 - DNA, 20 bp, Homo sapiens
aagaggtgaccccagggcac

SEQ ID NO: 2452573 - DNA, 22 bp, Homo sapiens
aagaggtgaccccagggcacag

SEQ ID NO: 2452574 - DNA, 15 bp, Homo sapiens
aagagtagaattgca

SEQ ID NO: 2452575 - DNA, 14 bp, Homo sapiens
aagagtctagattc

SEQ ID NO: 2452576 - DNA, 20 bp, Homo sapiens
aagagtctagattcaaaggt

SEQ ID NO: 2452577 - DNA, 14 bp, Homo sapiens
aagagttggctggt

SEQ ID NO: 2452578 - DNA, 23 bp, Homo sapiens
acacttctcaggacacaggcctg

SEQ ID NO: 2452579 - DNA, 19 bp, Homo sapiens
acactttgcactgatatat

SEQ ID NO: 2452580 - DNA, 15 bp, Homo sapiens
acagaaaccttttta

SEQ ID NO: 2452581 - DNA, 12 bp, Homo sapiens
acagaaatttaa

SEQ ID NO: 2452582 - DNA, 16 bp, Homo sapiens
acagaacatagacaga

SEQ ID NO: 2452583 - DNA, 18 bp, Homo sapiens
acagaactctttcaaaac

SEQ ID NO: 2452584 - DNA, 21 bp, Homo sapiens
acagaacttcagaaagacttg

SEQ ID NO: 2452585 - DNA, 22 bp, Homo sapiens
acagaattactgtaactgatta

SEQ ID NO: 2452586 - DNA, 15 bp, Homo sapiens
acagacaggctctta

SEQ ID NO: 2452587 - DNA, 18 bp, Homo sapiens
acagacgctgctgtcaca

SEQ ID NO: 2452588 - DNA, 14 bp, Homo sapiens
acagactattttta

SEQ ID NO: 2452589 - DNA, 13 bp, Homo sapiens
acagagaaaccag

SEQ ID NO: 2452590 - DNA, 14 bp, Homo sapiens
acagagaaaccagc

SEQ ID NO: 2452591 - DNA, 16 bp, Homo sapiens
acagagaaaccagctt

SEQ ID NO: 2452592 - DNA, 11 bp, Homo sapiens
acagagaagcc

SEQ ID NO: 2452593 - DNA, 13 bp, Homo sapiens
acagagaagccag

SEQ ID NO: 2452594 - DNA, 14 bp, Homo sapiens
acagagaagccagc

SEQ ID NO: 2452595 - DNA, 15 bp, Homo sapiens
acagagaagccagct

SEQ ID NO: 2452596 - DNA, 16 bp, Homo sapiens
acagagaagccagctt

SEQ ID NO: 2452597 - DNA, 20 bp, Homo sapiens
acagagaagccatcacctca

SEQ ID NO: 2452598 - DNA, 14 bp, Homo sapiens
acagagaagccttc

SEQ ID NO: 2452599 - DNA, 15 bp, Homo sapiens
acagagaagccttca

SEQ ID NO: 2452600 - DNA, 16 bp, Homo sapiens
acagagaagccttcaa

SEQ ID NO: 2452601 - DNA, 23 bp, Homo sapiens
acagagaagccttcaagctctga

SEQ ID NO: 2452602 - DNA, 13 bp, Homo sapiens
acagagaagtcac

SEQ ID NO: 2452603 - DNA, 16 bp, Homo sapiens
acagagaagtcacagg

SEQ ID NO: 2452604 - DNA, 21 bp, Homo sapiens
acagagaagtcacagggcagt

SEQ ID NO: 2452605 - DNA, 20 bp, Homo sapiens
acagagactgaatagatatg

SEQ ID NO: 2452606 - DNA, 17 bp, Homo sapiens
acagagccaggagaagc

SEQ ID NO: 2452607 - DNA, 22 bp, Homo sapiens
acagagcgtgagctgagcaggc

SEQ ID NO: 2452608 - DNA, 23 bp, Homo sapiens
acagagcgtgagctgagcaggcc

SEQ ID NO: 2452609 - DNA, 16 bp, Homo sapiens
acagaggacacagaga

SEQ ID NO: 2452610 - DNA, 15 bp, Homo sapiens
acagaggccccagcc

SEQ ID NO: 2452611 - DNA, 12 bp, Homo sapiens
acagagggctgc

SEQ ID NO: 2452612 - DNA, 14 bp, Homo sapiens
acagagtggccgtc

SEQ ID NO: 2452613 - DNA, 14 bp, Homo sapiens
acagataactgaaa

SEQ ID NO: 2452614 - DNA, 21 bp, Homo sapiens
acagatctggaacctcagcct

SEQ ID NO: 2452615 - DNA, 18 bp, Homo sapiens
acagatgccacacaagga

SEQ ID NO: 2452616 - DNA, 13 bp, Homo sapiens
acagatgcctcct

SEQ ID NO: 2452617 - DNA, 17 bp, Homo sapiens
acagatgcctccttcct

SEQ ID NO: 2452618 - DNA, 18 bp, Homo sapiens
acagatgcctccttcctc

SEQ ID NO: 2452619 - DNA, 22 bp, Homo sapiens
acagcagcctggggctggcctc

SEQ ID NO: 2452620 - DNA, 11 bp, Homo sapiens
acagcatctcc

SEQ ID NO: 2452621 - DNA, 20 bp, Homo sapiens
acagcatctccaagcagctt

SEQ ID NO: 2452622 - DNA, 22 bp, Homo sapiens
acagcatctccaagcagcttag

SEQ ID NO: 2452623 - DNA, 14 bp, Homo sapiens
acagccaaatttaa

SEQ ID NO: 2452624 - DNA, 20 bp, Homo sapiens
acagccaacacgcacctgcc

SEQ ID NO: 2452625 - DNA, 22 bp, Homo sapiens
acagccaacacgcacctgcctc

SEQ ID NO: 2452626 - DNA, 17 bp, Homo sapiens
acagccaactagcccct

SEQ ID NO: 2452627 - DNA, 21 bp, Homo sapiens
acagccaactagcccctgggg

SEQ ID NO: 2452628 - DNA, 13 bp, Homo sapiens
acagccagcacct

SEQ ID NO: 2452629 - DNA, 14 bp, Homo sapiens
acagccccaccctg

SEQ ID NO: 2452630 - DNA, 14 bp, Homo sapiens
acagccctgtcagc

SEQ ID NO: 2452631 - DNA, 22 bp, Homo sapiens
acagcccttatgcggttaattt

SEQ ID NO: 2452632 - DNA, 17 bp, Homo sapiens
acagcctgacaacattt

SEQ ID NO: 2452633 - DNA, 21 bp, Homo sapiens
acagctaattctactcacagt

SEQ ID NO: 2452634 - DNA, 23 bp, Homo sapiens
acagctactctccccacgagggc

SEQ ID NO: 2452635 - DNA, 14 bp, Homo sapiens
acagctggaccctg

SEQ ID NO: 2452636 - DNA, 23 bp, Homo sapiens
acagctggggtgcagggatgtgg

SEQ ID NO: 2452637 - DNA, 16 bp, Homo sapiens
acagctggtgtagcta

SEQ ID NO: 2452638 - DNA, 22 bp, Homo sapiens
acagctgtatagctgcttccag

SEQ ID NO: 2452639 - DNA, 12 bp, Homo sapiens
acagctgtgcct

SEQ ID NO: 2452640 - DNA, 13 bp, Homo sapiens
acagctgtgcctc

SEQ ID NO: 2452641 - DNA, 15 bp, Homo sapiens
acagctgtgcctcgc

SEQ ID NO: 2452642 - DNA, 18 bp, Homo sapiens
acagcttagatttcatag

SEQ ID NO: 2452643 - DNA, 15 bp, Homo sapiens
acagcttgacctgag

SEQ ID NO: 2452644 - DNA, 19 bp, Homo sapiens
acagcttgacctgaggctg

SEQ ID NO: 2452645 - DNA, 22 bp, Homo sapiens
acagcttgacctgaggctgtgg

SEQ ID NO: 2452646 - DNA, 23 bp, Homo sapiens
acagcttgtctcttgcctgccac

SEQ ID NO: 2452647 - DNA, 13 bp, Homo sapiens
acagcttttgcaa

SEQ ID NO: 2452648 - DNA, 19 bp, Homo sapiens
acaggaaactcctgtgacc

SEQ ID NO: 2452649 - DNA, 20 bp, Homo sapiens
acaggaaactcctgtgacca

SEQ ID NO: 2452650 - DNA, 22 bp, Homo sapiens
acaggacatgcggtagccagca

SEQ ID NO: 2452651 - DNA, 18 bp, Homo sapiens
acaggactaacactcaga

SEQ ID NO: 2452652 - DNA, 22 bp, Homo sapiens
acaggactaacactcagaagcc

SEQ ID NO: 2452653 - DNA, 24 bp, Homo sapiens
acaggactaacactcagaagcctg

SEQ ID NO: 2452654 - DNA, 23 bp, Homo sapiens
acaggagctacctgtgtggacag

SEQ ID NO: 2452655 - DNA, 23 bp, Homo sapiens
acaggagtgtcctcttccctctc

SEQ ID NO: 2452656 - DNA, 18 bp, Homo sapiens
acaggatgtgtttgcttt

SEQ ID NO: 2452657 - DNA, 16 bp, Homo sapiens
acaggcactgccctgg

SEQ ID NO: 2452658 - DNA, 18 bp, Homo sapiens
acaggcactgccctggtg

SEQ ID NO: 2452659 - DNA, 13 bp, Homo sapiens
acaggcacttggc

SEQ ID NO: 2452660 - DNA, 16 bp, Homo sapiens
acaggcacttggcagc

SEQ ID NO: 2452661 - DNA, 21 bp, Homo sapiens
acaggcagccagtgccctgag

SEQ ID NO: 2452662 - DNA, 18 bp, Homo sapiens
acaggcatttcctgggtg

SEQ ID NO: 2452663 - DNA, 21 bp, Homo sapiens
acaggcccccttgagtggggt

SEQ ID NO: 2452664 - DNA, 16 bp, Homo sapiens
acaggccgccctgcgg

SEQ ID NO: 2452665 - DNA, 13 bp, Homo sapiens
acaggcctcaggg

SEQ ID NO: 2452666 - DNA, 12 bp, Homo sapiens
acaggctcaggc

SEQ ID NO: 2452667 - DNA, 14 bp, Homo sapiens
acaggctcaggcag

SEQ ID NO: 2452668 - DNA, 15 bp, Homo sapiens
acaggctcttagcag

SEQ ID NO: 2452669 - DNA, 16 bp, Homo sapiens
acaggcttctgagcag

SEQ ID NO: 2452670 - DNA, 23 bp, Homo sapiens
acaggcttctgagcagcgagcct

SEQ ID NO: 2452671 - DNA, 13 bp, Homo sapiens
acagggaaggcag

SEQ ID NO: 2452672 - DNA, 22 bp, Homo sapiens
acagggaaggcaggcagggctc

SEQ ID NO: 2452673 - DNA, 22 bp, Homo sapiens
acagggaattaggcccccatca

SEQ ID NO: 2452674 - DNA, 23 bp, Homo sapiens
acagggcggtaccttgtgcccag

SEQ ID NO: 2452675 - DNA, 14 bp, Homo sapiens
acaggggcttgact

SEQ ID NO: 2452676 - DNA, 15 bp, Homo sapiens
acagggggtctggct

SEQ ID NO: 2452677 - DNA, 14 bp, Homo sapiens
acagggtctgctct

SEQ ID NO: 2452678 - DNA, 15 bp, Homo sapiens
acagggtctgctctt

SEQ ID NO: 2452679 - DNA, 15 bp, Homo sapiens
acaggtaatataaaa

SEQ ID NO: 2452680 - DNA, 16 bp, Homo sapiens
acaggtatatactttg

SEQ ID NO: 2452681 - DNA, 19 bp, Homo sapiens
acaggtatatactttgaaa

SEQ ID NO: 2452682 - DNA, 21 bp, Homo sapiens
acagtcattggaataaggcat

SEQ ID NO: 2452683 - DNA, 15 bp, Homo sapiens
acagtctaaagctgg

SEQ ID NO: 2452684 - DNA, 14 bp, Homo sapiens
acagtcttccattt

SEQ ID NO: 2452685 - DNA, 14 bp, Homo sapiens
acagtgaagacaga

SEQ ID NO: 2452686 - DNA, 17 bp, Homo sapiens
acagtgacttctgagat

SEQ ID NO: 2452687 - DNA, 17 bp, Homo sapiens
acagtgctcttttctcc

SEQ ID NO: 2452688 - DNA, 21 bp, Homo sapiens
acagtgctcttttctcctcac

SEQ ID NO: 2452689 - DNA, 18 bp, Homo sapiens
acagtggatcacaaagtg

SEQ ID NO: 2452690 - DNA, 13 bp, Homo sapiens
acagtgtgcaagg

SEQ ID NO: 2452691 - DNA, 21 bp, Homo sapiens
acagtgtttatcctttcatat

SEQ ID NO: 2452692 - DNA, 22 bp, Homo sapiens
acagttctgtggtttcatgtta

SEQ ID NO: 2452693 - DNA, 20 bp, Homo sapiens
acagttctttgggccagaca

SEQ ID NO: 2452694 - DNA, 22 bp, Homo sapiens
acagttgaagggaggggctgtg

SEQ ID NO: 2452695 - DNA, 13 bp, Homo sapiens
acagttgcatgta

SEQ ID NO: 2452696 - DNA, 15 bp, Homo sapiens
acagttggtaacttt

SEQ ID NO: 2452697 - DNA, 16 bp, Homo sapiens
acagttggtaactttt

SEQ ID NO: 2452698 - DNA, 24 bp, Homo sapiens
acagttggtaacttttgtgaatta

SEQ ID NO: 2452699 - DNA, 15 bp, Homo sapiens
acagtttgaaataag

SEQ ID NO: 2452700 - DNA, 20 bp, Homo sapiens
acagttttcctatgctttga

SEQ ID NO: 2452701 - DNA, 19 bp, Homo sapiens
acataaaaatgatctaaac

SEQ ID NO: 2452702 - DNA, 16 bp, Homo sapiens
acataaaggaaaagac

SEQ ID NO: 2452703 - DNA, 20 bp, Homo sapiens
acataaaggaaaagacacat

SEQ ID NO: 2452704 - DNA, 16 bp, Homo sapiens
acataaccactgcttc

SEQ ID NO: 2452705 - DNA, 18 bp, Homo sapiens
acataagctatttttcta

SEQ ID NO: 2452706 - DNA, 19 bp, Homo sapiens
acataagctatttttctaa

SEQ ID NO: 2452707 - DNA, 19 bp, Homo sapiens
acataagtttaggataaaa

SEQ ID NO: 2452708 - DNA, 16 bp, Homo sapiens
acataattcactctga

SEQ ID NO: 2452709 - DNA, 18 bp, Homo sapiens
acataattcactctgagt

SEQ ID NO: 2452710 - DNA, 18 bp, Homo sapiens
acatacagaattactgta

SEQ ID NO: 2452711 - DNA, 19 bp, Homo sapiens
acatacagaattactgtaa

SEQ ID NO: 2452712 - DNA, 20 bp, Homo sapiens
acatacagaattactgtaac

SEQ ID NO: 2452713 - DNA, 14 bp, Homo sapiens
acataccccctccc

SEQ ID NO: 2452714 - DNA, 22 bp, Homo sapiens
acataccctgacctggccccct

SEQ ID NO: 2452715 - DNA, 20 bp, Homo sapiens
acataccctggccgccccct

SEQ ID NO: 2452716 - DNA, 13 bp, Homo sapiens
acatacgtgcaca

SEQ ID NO: 2452717 - DNA, 14 bp, Homo sapiens
acatactcattttt

SEQ ID NO: 2452718 - DNA, 16 bp, Homo sapiens
acatactcatttttca

SEQ ID NO: 2452719 - DNA, 18 bp, Homo sapiens
acatactggcctggactg

SEQ ID NO: 2452720 - DNA, 16 bp, Homo sapiens
acatacttgaagggcc

SEQ ID NO: 2452721 - DNA, 20 bp, Homo sapiens
acatacttgaagggccagag

SEQ ID NO: 2452722 - DNA, 22 bp, Homo sapiens
acatacttgaagggccagagcc

SEQ ID NO: 2452723 - DNA, 23 bp, Homo sapiens
acatacttgaagggccagagcca

SEQ ID NO: 2452724 - DNA, 22 bp, Homo sapiens
acatagagccgggtgtccccaa

SEQ ID NO: 2452725 - DNA, 16 bp, Homo sapiens
acatagcccacttaca

SEQ ID NO: 2452726 - DNA, 14 bp, Homo sapiens
acatagtattcatg

SEQ ID NO: 2452727 - DNA, 15 bp, Homo sapiens
acatatcttagatgg

SEQ ID NO: 2452728 - DNA, 17 bp, Homo sapiens
acatatgatctgtctgt

SEQ ID NO: 2452729 - DNA, 19 bp, Homo sapiens
acatatgatctgtctgtgg

SEQ ID NO: 2452730 - DNA, 17 bp, Homo sapiens
acatatggaattttgca

SEQ ID NO: 2452731 - DNA, 14 bp, Homo sapiens
acatcacagcccag

SEQ ID NO: 2452732 - DNA, 15 bp, Homo sapiens
acatcaggtttttcc

SEQ ID NO: 2452733 - DNA, 11 bp, Homo sapiens
acatcatttct

SEQ ID NO: 2452734 - DNA, 12 bp, Homo sapiens
acatccctgggc

SEQ ID NO: 2452735 - DNA, 20 bp, Homo sapiens
acatccctgggcctgctgct

SEQ ID NO: 2452736 - DNA, 13 bp, Homo sapiens
acatcctcctccc

SEQ ID NO: 2452737 - DNA, 14 bp, Homo sapiens
acatcggaaaaata

SEQ ID NO: 2452738 - DNA, 17 bp, Homo sapiens
acatctcaacaggcctc

SEQ ID NO: 2452739 - DNA, 20 bp, Homo sapiens
acatctcaacaggcctcagg

SEQ ID NO: 2452740 - DNA, 21 bp, Homo sapiens
acatctgaggttttatttcat

SEQ ID NO: 2452741 - DNA, 15 bp, Homo sapiens
acatctgtgtcttgt

SEQ ID NO: 2452742 - DNA, 23 bp, Homo sapiens
acatcttgtcattttttttcttt

SEQ ID NO: 2452743 - DNA, 14 bp, Homo sapiens
acatctttgaaatt

SEQ ID NO: 2452744 - DNA, 14 bp, Homo sapiens
acatgaacttagat

SEQ ID NO: 2452745 - DNA, 22 bp, Homo sapiens
acatgaacttagattttacatg

SEQ ID NO: 2452746 - DNA, 16 bp, Homo sapiens
acatgaagaagctaaa

SEQ ID NO: 2452747 - DNA, 13 bp, Homo sapiens
acatgaagctgtt

SEQ ID NO: 2452748 - DNA, 19 bp, Homo sapiens
acatgaagctgttgtgtga

SEQ ID NO: 2452749 - DNA, 23 bp, Homo sapiens
acatgaaggtaaataaaaagaaa

SEQ ID NO: 2452750 - DNA, 13 bp, Homo sapiens
acatgaagtattt

SEQ ID NO: 2452751 - DNA, 17 bp, Homo sapiens
acatgaattattacagt

SEQ ID NO: 2452752 - DNA, 22 bp, Homo sapiens
acatgaattttagcttttgtgg

SEQ ID NO: 2452753 - DNA, 21 bp, Homo sapiens
acatgaccctaaatcttgact

SEQ ID NO: 2452754 - DNA, 13 bp, Homo sapiens
acatgaggactct

SEQ ID NO: 2452755 - DNA, 17 bp, Homo sapiens
acatgccatttgtactg

SEQ ID NO: 2452756 - DNA, 18 bp, Homo sapiens
acatgctaagagaagtag

SEQ ID NO: 2452757 - DNA, 16 bp, Homo sapiens
acatgctccagattag

SEQ ID NO: 2452758 - DNA, 23 bp, Homo sapiens
acatgcttattccatgactgctt

SEQ ID NO: 2452759 - DNA, 17 bp, Homo sapiens
acatggaggttctaagg

SEQ ID NO: 2452760 - DNA, 15 bp, Homo sapiens
acatggggaggagga

SEQ ID NO: 2452761 - DNA, 19 bp, Homo sapiens
acatggttaccatgtcttt

SEQ ID NO: 2452762 - DNA, 21 bp, Homo sapiens
acatgtcagtaccttcaaact

SEQ ID NO: 2452763 - DNA, 23 bp, Homo sapiens
acatgtcctgcctattatctgtc

SEQ ID NO: 2452764 - DNA, 14 bp, Homo sapiens
acatgtgacattta

SEQ ID NO: 2452765 - DNA, 22 bp, Homo sapiens
acatgtgccagggcaatgatga

SEQ ID NO: 2452766 - DNA, 18 bp, Homo sapiens
acatgtggggccaggtca

SEQ ID NO: 2452767 - DNA, 13 bp, Homo sapiens
acatgtttccagc

SEQ ID NO: 2452768 - DNA, 14 bp, Homo sapiens
acatgtttccagca

SEQ ID NO: 2452769 - DNA, 23 bp, Homo sapiens
acatgtttccagcattcccaggt

SEQ ID NO: 2452770 - DNA, 16 bp, Homo sapiens
acatgttttaaagaaa

SEQ ID NO: 2452771 - DNA, 18 bp, Homo sapiens
acattaatatacttgaat

SEQ ID NO: 2452772 - DNA, 14 bp, Homo sapiens
acattagaagacaa

SEQ ID NO: 2452773 - DNA, 14 bp, Homo sapiens
acattagtctcagt

SEQ ID NO: 2452774 - DNA, 19 bp, Homo sapiens
acattatgtggttttagat

SEQ ID NO: 2452775 - DNA, 21 bp, Homo sapiens
acattatgtggttttagattt

SEQ ID NO: 2452776 - DNA, 18 bp, Homo sapiens
acattattatcaacaata

SEQ ID NO: 2452777 - DNA, 24 bp, Homo sapiens
acattcaaaatagggtatattttc

SEQ ID NO: 2452778 - DNA, 18 bp, Homo sapiens
acattcaacagagactga

SEQ ID NO: 2452779 - DNA, 13 bp, Homo sapiens
acattcacctgcc

SEQ ID NO: 2452780 - DNA, 22 bp, Homo sapiens
acattccaactcgtatagcatg

SEQ ID NO: 2452781 - DNA, 19 bp, Homo sapiens
acattcctcatgaatgtaa

SEQ ID NO: 2452782 - DNA, 20 bp, Homo sapiens
acattcctcatgaatgtaaa

SEQ ID NO: 2452783 - DNA, 18 bp, Homo sapiens
acattctgaatgcttcta

SEQ ID NO: 2452784 - DNA, 20 bp, Homo sapiens
acattctgaatgcttctaag

SEQ ID NO: 2452785 - DNA, 18 bp, Homo sapiens
acattgcatcaaagcatc

SEQ ID NO: 2452786 - DNA, 15 bp, Homo sapiens
acattgcgtttgacc

SEQ ID NO: 2452787 - DNA, 23 bp, Homo sapiens
acattgcgtttgaccttttatgt

SEQ ID NO: 2452788 - DNA, 17 bp, Homo sapiens
acattggaatgttctca

SEQ ID NO: 2452789 - DNA, 22 bp, Homo sapiens
acattggcacctaatccaggca

SEQ ID NO: 2452790 - DNA, 15 bp, Homo sapiens
acatttacaaactga

SEQ ID NO: 2452791 - DNA, 16 bp, Homo sapiens
acatttacaaactgaa

SEQ ID NO: 2452792 - DNA, 21 bp, Homo sapiens
acatttacaaactgaagagta

SEQ ID NO: 2452793 - DNA, 14 bp, Homo sapiens
acatttatttcctc

SEQ ID NO: 2452794 - DNA, 13 bp, Homo sapiens
acatttctaaaat

SEQ ID NO: 2452795 - DNA, 20 bp, Homo sapiens
acatttctatagccaaaaat

SEQ ID NO: 2452796 - DNA, 23 bp, Homo sapiens
acatttgctttttgtgatatgca

SEQ ID NO: 2452797 - DNA, 15 bp, Homo sapiens
acatttggagtgttc

SEQ ID NO: 2452798 - DNA, 19 bp, Homo sapiens
acatttgggagacatgtga

SEQ ID NO: 2452799 - DNA, 20 bp, Homo sapiens
acatttgggagtttttatga

SEQ ID NO: 2452800 - DNA, 14 bp, Homo sapiens
acatttgtcagtat

SEQ ID NO: 2452801 - DNA, 15 bp, Homo sapiens
acatttgtcagtatt

SEQ ID NO: 2452802 - DNA, 18 bp, Homo sapiens
acattttctaagaaacat

SEQ ID NO: 2452803 - DNA, 13 bp, Homo sapiens
accaaaactgctc

SEQ ID NO: 2452804 - DNA, 18 bp, Homo sapiens
accaaagatgaatgaagc

SEQ ID NO: 2452805 - DNA, 11 bp, Homo sapiens
accaaagttct

SEQ ID NO: 2452806 - DNA, 14 bp, Homo sapiens
accaaagttctaat

SEQ ID NO: 2452807 - DNA, 21 bp, Homo sapiens
accaaagttctaataatttct

SEQ ID NO: 2452808 - DNA, 14 bp, Homo sapiens
accaaatcaaaatc

SEQ ID NO: 2452809 - DNA, 15 bp, Homo sapiens
accaacataaaaatg

SEQ ID NO: 2452810 - DNA, 14 bp, Homo sapiens
accaaccctcaggg

SEQ ID NO: 2452811 - DNA, 19 bp, Homo sapiens
accaagatggcccatcctg

SEQ ID NO: 2452812 - DNA, 16 bp, Homo sapiens
accaagcacagcagcc

SEQ ID NO: 2452813 - DNA, 23 bp, Homo sapiens
accaagccaagggaacctgtgtc

SEQ ID NO: 2452814 - DNA, 17 bp, Homo sapiens
accaagctgagtttcct

SEQ ID NO: 2452815 - DNA, 20 bp, Homo sapiens
accaatcattttaattatta

SEQ ID NO: 2452816 - DNA, 14 bp, Homo sapiens
accaatgtacccac

SEQ ID NO: 2452817 - DNA, 21 bp, Homo sapiens
accaatgtacccaccgggcca

SEQ ID NO: 2452818 - DNA, 12 bp, Homo sapiens
accaatgtcttg

SEQ ID NO: 2452819 - DNA, 18 bp, Homo sapiens
accacaaactgtaataca

SEQ ID NO: 2452820 - DNA, 13 bp, Homo sapiens
accacaacatgag

SEQ ID NO: 2452821 - DNA, 17 bp, Homo sapiens
accacacccacactcag

SEQ ID NO: 2452822 - DNA, 19 bp, Homo sapiens
accacagccagcacctggc

SEQ ID NO: 2452823 - DNA, 17 bp, Homo sapiens
accacaggctcaggcag

SEQ ID NO: 2452824 - DNA, 15 bp, Homo sapiens
accacattgcttttc

SEQ ID NO: 2452825 - DNA, 12 bp, Homo sapiens
accaccagctgt

SEQ ID NO: 2452826 - DNA, 15 bp, Homo sapiens
accaccagctgtgtc

SEQ ID NO: 2452827 - DNA, 21 bp, Homo sapiens
accaccagggcatctctgggc

SEQ ID NO: 2452828 - DNA, 12 bp, Homo sapiens
accaccctgagc

SEQ ID NO: 2452829 - DNA, 15 bp, Homo sapiens
accacctttactgtg

SEQ ID NO: 2452830 - DNA, 20 bp, Homo sapiens
accacctttactgtgcttat

SEQ ID NO: 2452831 - DNA, 20 bp, Homo sapiens
accacctttgtttctccccc

SEQ ID NO: 2452832 - DNA, 21 bp, Homo sapiens
accacgcccgtcctgcctgtg

SEQ ID NO: 2452833 - DNA, 14 bp, Homo sapiens
accacgtccagctg

SEQ ID NO: 2452834 - DNA, 15 bp, Homo sapiens
accactagcctcagg

SEQ ID NO: 2452835 - DNA, 14 bp, Homo sapiens
accactcagagaca

SEQ ID NO: 2452836 - DNA, 16 bp, Homo sapiens
accactctggcagcca

SEQ ID NO: 2452837 - DNA, 21 bp, Homo sapiens
accactgccccctgctgccat

SEQ ID NO: 2452838 - DNA, 19 bp, Homo sapiens
accagaagctcccccagca

SEQ ID NO: 2452839 - DNA, 13 bp, Homo sapiens
accagataacttt

SEQ ID NO: 2452840 - DNA, 14 bp, Homo sapiens
accagatgcagctc

SEQ ID NO: 2452841 - DNA, 12 bp, Homo sapiens
accagatgctga

SEQ ID NO: 2452842 - DNA, 20 bp, Homo sapiens
accagcagacagagccagga

SEQ ID NO: 2452843 - DNA, 23 bp, Homo sapiens
accagcgaggaggctccagaggg

SEQ ID NO: 2452844 - DNA, 13 bp, Homo sapiens
accagctcagcac

SEQ ID NO: 2452845 - DNA, 14 bp, Homo sapiens
accagctcagcact

SEQ ID NO: 2452846 - DNA, 17 bp, Homo sapiens
accagcttccttcagag

SEQ ID NO: 2452847 - DNA, 21 bp, Homo sapiens
accagcttccttcagagagca

SEQ ID NO: 2452848 - DNA, 23 bp, Homo sapiens
accagcttccttcagagagcagt

SEQ ID NO: 2452849 - DNA, 20 bp, Homo sapiens
accaggagtgggtggggagt

SEQ ID NO: 2452850 - DNA, 17 bp, Homo sapiens
accaggatagagactgg

SEQ ID NO: 2452851 - DNA, 21 bp, Homo sapiens
accaggcagcctctggggggt

SEQ ID NO: 2452852 - DNA, 12 bp, Homo sapiens
accaggccacct

SEQ ID NO: 2452853 - DNA, 14 bp, Homo sapiens
accaggccacctcc

SEQ ID NO: 2452854 - DNA, 17 bp, Homo sapiens
accaggccacctcccca

SEQ ID NO: 2452855 - DNA, 15 bp, Homo sapiens
accagggctccagcc

SEQ ID NO: 2452856 - DNA, 18 bp, Homo sapiens
accaggtccaatgagctt

SEQ ID NO: 2452857 - DNA, 19 bp, Homo sapiens
accagtatttagaagccaa

SEQ ID NO: 2452858 - DNA, 12 bp, Homo sapiens
accagtgcctta

SEQ ID NO: 2452859 - DNA, 15 bp, Homo sapiens
accagttgcctttta

SEQ ID NO: 2452860 - DNA, 15 bp, Homo sapiens
accataatgttacat

SEQ ID NO: 2452861 - DNA, 18 bp, Homo sapiens
accatcctaggctgacac

SEQ ID NO: 2452862 - DNA, 12 bp, Homo sapiens
accatctccctg

SEQ ID NO: 2452863 - DNA, 14 bp, Homo sapiens
accatctccctggt

SEQ ID NO: 2452864 - DNA, 16 bp, Homo sapiens
accatctccctggtgc

SEQ ID NO: 2452865 - DNA, 15 bp, Homo sapiens
accatgattccttta

SEQ ID NO: 2452866 - DNA, 19 bp, Homo sapiens
accatgccaggctaatttt

SEQ ID NO: 2452867 - DNA, 17 bp, Homo sapiens
accatgctgctggggaa

SEQ ID NO: 2452868 - DNA, 18 bp, Homo sapiens
accatgctgctggggaag

SEQ ID NO: 2452869 - DNA, 23 bp, Homo sapiens
accatgctgctggggaagacagt

SEQ ID NO: 2452870 - DNA, 19 bp, Homo sapiens
accatggttaagagtccaa

SEQ ID NO: 2452871 - DNA, 12 bp, Homo sapiens
accatgtaatgg

SEQ ID NO: 2452872 - DNA, 16 bp, Homo sapiens
accatgtctttctctc

SEQ ID NO: 2452873 - DNA, 19 bp, Homo sapiens
accattaaaccatctccct

SEQ ID NO: 2452874 - DNA, 13 bp, Homo sapiens
accattaaccaga

SEQ ID NO: 2452875 - DNA, 13 bp, Homo sapiens
accattgaaggct

SEQ ID NO: 2452876 - DNA, 18 bp, Homo sapiens
accattgaattcttggtt

SEQ ID NO: 2452877 - DNA, 23 bp, Homo sapiens
accatttggatcctgtgtggaga

SEQ ID NO: 2452878 - DNA, 22 bp, Homo sapiens
accatttggcatccctgggcct

SEQ ID NO: 2452879 - DNA, 14 bp, Homo sapiens
actctggtgcctcc

SEQ ID NO: 2452880 - DNA, 14 bp, Homo sapiens
actctgtaattgca

SEQ ID NO: 2452881 - DNA, 16 bp, Homo sapiens
actctgtgccagagcc

SEQ ID NO: 2452882 - DNA, 18 bp, Homo sapiens
actctgtgccagagcctg

SEQ ID NO: 2452883 - DNA, 20 bp, Homo sapiens
actctgtgccagagcctggg

SEQ ID NO: 2452884 - DNA, 22 bp, Homo sapiens
actctgtgccagagcctggggc

SEQ ID NO: 2452885 - DNA, 23 bp, Homo sapiens
actctgtgccagagcctggggct

SEQ ID NO: 2452886 - DNA, 16 bp, Homo sapiens
actctgtgctggccag

SEQ ID NO: 2452887 - DNA, 14 bp, Homo sapiens
actcttaatcaaat

SEQ ID NO: 2452888 - DNA, 22 bp, Homo sapiens
actcttgcacagtcactgctct

SEQ ID NO: 2452889 - DNA, 22 bp, Homo sapiens
actctttctgtatatacttttt

SEQ ID NO: 2452890 - DNA, 14 bp, Homo sapiens
actcttttgcttta

SEQ ID NO: 2452891 - DNA, 20 bp, Homo sapiens
actcttttgctttattccag

SEQ ID NO: 2452892 - DNA, 16 bp, Homo sapiens
actgaaaaaatatatg

SEQ ID NO: 2452893 - DNA, 20 bp, Homo sapiens
actgaaaaggaggggtctgg

SEQ ID NO: 2452894 - DNA, 17 bp, Homo sapiens
actgaaaattatttaaa

SEQ ID NO: 2452895 - DNA, 19 bp, Homo sapiens
actgaacatctgagtcctg

SEQ ID NO: 2452896 - DNA, 23 bp, Homo sapiens
actgaacatctgagtcctggatg

SEQ ID NO: 2452897 - DNA, 18 bp, Homo sapiens
actgaactcactttcctc

SEQ ID NO: 2452898 - DNA, 13 bp, Homo sapiens
actgaagcagcct

SEQ ID NO: 2452899 - DNA, 13 bp, Homo sapiens
actgaagcttttt

SEQ ID NO: 2452900 - DNA, 14 bp, Homo sapiens
actgaagcttttta

SEQ ID NO: 2452901 - DNA, 17 bp, Homo sapiens
actgaataccactctgt

SEQ ID NO: 2452902 - DNA, 15 bp, Homo sapiens
actgaccagcagctt

SEQ ID NO: 2452903 - DNA, 14 bp, Homo sapiens
actgacgccagggt

SEQ ID NO: 2452904 - DNA, 18 bp, Homo sapiens
actgactattcttgatgt

SEQ ID NO: 2452905 - DNA, 15 bp, Homo sapiens
actgactttgcttgc

SEQ ID NO: 2452906 - DNA, 17 bp, Homo sapiens
actgactttgcttgctt

SEQ ID NO: 2452907 - DNA, 20 bp, Homo sapiens
actgagcaacgctattccag

SEQ ID NO: 2452908 - DNA, 22 bp, Homo sapiens
actgagcaacgctattccagct

SEQ ID NO: 2452909 - DNA, 20 bp, Homo sapiens
actgaggggggatccagttt

SEQ ID NO: 2452910 - DNA, 13 bp, Homo sapiens
actgagttttcca

SEQ ID NO: 2452911 - DNA, 22 bp, Homo sapiens
actgatatatcatgagtgaata

SEQ ID NO: 2452912 - DNA, 11 bp, Homo sapiens
actgatgctgc

SEQ ID NO: 2452913 - DNA, 12 bp, Homo sapiens
actgatgctgcc

SEQ ID NO: 2452914 - DNA, 15 bp, Homo sapiens
actgatgctgcccct

SEQ ID NO: 2452915 - DNA, 19 bp, Homo sapiens
actgatgctgcccctcatc

SEQ ID NO: 2452916 - DNA, 17 bp, Homo sapiens
actgatgtctcctaagc

SEQ ID NO: 2452917 - DNA, 13 bp, Homo sapiens
actgatgttgtgt

SEQ ID NO: 2452918 - DNA, 18 bp, Homo sapiens
actgatgttgtgttttta

SEQ ID NO: 2452919 - DNA, 22 bp, Homo sapiens
actgcaaaaagaaaatctttat

SEQ ID NO: 2452920 - DNA, 21 bp, Homo sapiens
actgcaaatcaggcttttgtt

SEQ ID NO: 2452921 - DNA, 22 bp, Homo sapiens
actgcaaatcaggcttttgttt

SEQ ID NO: 2452922 - DNA, 21 bp, Homo sapiens
actgcacaataactcctccca

SEQ ID NO: 2452923 - DNA, 18 bp, Homo sapiens
actgcacctgcctccagc

SEQ ID NO: 2452924 - DNA, 14 bp, Homo sapiens
actgcaggccctgg

SEQ ID NO: 2452925 - DNA, 22 bp, Homo sapiens
actgcatgcccagagacccagc

SEQ ID NO: 2452926 - DNA, 23 bp, Homo sapiens
actgcattcttctgagcactgtt

SEQ ID NO: 2452927 - DNA, 18 bp, Homo sapiens
actgccaagactgctgtg

SEQ ID NO: 2452928 - DNA, 19 bp, Homo sapiens
actgccaagactgctgtgg

SEQ ID NO: 2452929 - DNA, 20 bp, Homo sapiens
actgccaagactgctgtggc

SEQ ID NO: 2452930 - DNA, 13 bp, Homo sapiens
actgccaggaggg

SEQ ID NO: 2452931 - DNA, 14 bp, Homo sapiens
actgccaggaggga

SEQ ID NO: 2452932 - DNA, 16 bp, Homo sapiens
actgccccctgctgcc

SEQ ID NO: 2452933 - DNA, 19 bp, Homo sapiens
actgccccctgctgccatg

SEQ ID NO: 2452934 - DNA, 11 bp, Homo sapiens
actgccctggt

SEQ ID NO: 2452935 - DNA, 15 bp, Homo sapiens
actgccgtaatttaa

SEQ ID NO: 2452936 - DNA, 20 bp, Homo sapiens
actgccgtcagtgctgtgct

SEQ ID NO: 2452937 - DNA, 13 bp, Homo sapiens
actgcctagaaac

SEQ ID NO: 2452938 - DNA, 15 bp, Homo sapiens
actgcctagaaacaa

SEQ ID NO: 2452939 - DNA, 20 bp, Homo sapiens
actgcctagaaacaacactg

SEQ ID NO: 2452940 - DNA, 11 bp, Homo sapiens
actgcctgctc

SEQ ID NO: 2452941 - DNA, 15 bp, Homo sapiens
actgcctgctcccat

SEQ ID NO: 2452942 - DNA, 14 bp, Homo sapiens
actgcctgcttggg

SEQ ID NO: 2452943 - DNA, 22 bp, Homo sapiens
actgccttcgcttcttgcctct

SEQ ID NO: 2452944 - DNA, 21 bp, Homo sapiens
actgcgactttctgcctggag

SEQ ID NO: 2452945 - DNA, 14 bp, Homo sapiens
actgctacagcaat

SEQ ID NO: 2452946 - DNA, 12 bp, Homo sapiens
actgctctgaga

SEQ ID NO: 2452947 - DNA, 12 bp, Homo sapiens
actgctgccact

SEQ ID NO: 2452948 - DNA, 14 bp, Homo sapiens
actgctgccactga

SEQ ID NO: 2452949 - DNA, 17 bp, Homo sapiens
actgctgccactgaggg

SEQ ID NO: 2452950 - DNA, 17 bp, Homo sapiens
actgctgtggccaggag

SEQ ID NO: 2452951 - DNA, 20 bp, Homo sapiens
actgctgtggccaggaggtg

SEQ ID NO: 2452952 - DNA, 15 bp, Homo sapiens
actgcttgaggaaaa

SEQ ID NO: 2452953 - DNA, 18 bp, Homo sapiens
actgcttgaggaaaacaa

SEQ ID NO: 2452954 - DNA, 22 bp, Homo sapiens
actgcttgccctaagcagaaag

SEQ ID NO: 2452955 - DNA, 12 bp, Homo sapiens
actgctttctgt

SEQ ID NO: 2452956 - DNA, 16 bp, Homo sapiens
actgctttctgttcca

SEQ ID NO: 2452957 - DNA, 17 bp, Homo sapiens
actgctttctgttccaa

SEQ ID NO: 2452958 - DNA, 19 bp, Homo sapiens
actgctttctgttccaaat

SEQ ID NO: 2452959 - DNA, 16 bp, Homo sapiens
actggaaaacagaaca

SEQ ID NO: 2452960 - DNA, 23 bp, Homo sapiens
actggaaaacagaacacttatgt

SEQ ID NO: 2452961 - DNA, 16 bp, Homo sapiens
actggaacactagaca

SEQ ID NO: 2452962 - DNA, 18 bp, Homo sapiens
actggaaggggaagggac

SEQ ID NO: 2452963 - DNA, 17 bp, Homo sapiens
actggaatcctttcagc

SEQ ID NO: 2452964 - DNA, 17 bp, Homo sapiens
actggagtgtgcgtggt

SEQ ID NO: 2452965 - DNA, 15 bp, Homo sapiens
actggccatggcctg

SEQ ID NO: 2452966 - DNA, 15 bp, Homo sapiens
actggcctcaaagca

SEQ ID NO: 2452967 - DNA, 20 bp, Homo sapiens
actggcttttattaatgcac

SEQ ID NO: 2452968 - DNA, 19 bp, Homo sapiens
actgggaacccctttccca

SEQ ID NO: 2452969 - DNA, 11 bp, Homo sapiens
actgggaaggc

SEQ ID NO: 2452970 - DNA, 15 bp, Homo sapiens
actgggaccaggcac

SEQ ID NO: 2452971 - DNA, 17 bp, Homo sapiens
actgggagcccccagcc

SEQ ID NO: 2452972 - DNA, 21 bp, Homo sapiens
actgggagcccccagcctgtc

SEQ ID NO: 2452973 - DNA, 17 bp, Homo sapiens
actgggaggctcccctt

SEQ ID NO: 2452974 - DNA, 19 bp, Homo sapiens
actggggacttggcctctc

SEQ ID NO: 2452975 - DNA, 15 bp, Homo sapiens
actggggctcagagc

SEQ ID NO: 2452976 - DNA, 14 bp, Homo sapiens
actgggtaatgaaa

SEQ ID NO: 2452977 - DNA, 22 bp, Homo sapiens
actggtgttatcaccgtgggct

SEQ ID NO: 2452978 - DNA, 21 bp, Homo sapiens
actgtaaaatgtgggattatg

SEQ ID NO: 2452979 - DNA, 22 bp, Homo sapiens
actgtaaaatgtgggattatgg

SEQ ID NO: 2452980 - DNA, 18 bp, Homo sapiens
actgtaaataaaaagaaa

SEQ ID NO: 2452981 - DNA, 16 bp, Homo sapiens
actgtaactgattaca

SEQ ID NO: 2452982 - DNA, 14 bp, Homo sapiens
actgtacagctggc

SEQ ID NO: 2452983 - DNA, 11 bp, Homo sapiens
actgtacagtg

SEQ ID NO: 2452984 - DNA, 12 bp, Homo sapiens
actgtacagtgt

SEQ ID NO: 2452985 - DNA, 21 bp, Homo sapiens
actgtacagtgtctttttttg

SEQ ID NO: 2452986 - DNA, 17 bp, Homo sapiens
actgtagttctaagact

SEQ ID NO: 2452987 - DNA, 16 bp, Homo sapiens
actgtatattacagat

SEQ ID NO: 2452988 - DNA, 22 bp, Homo sapiens
actgtatctaggcaacatagta

SEQ ID NO: 2452989 - DNA, 22 bp, Homo sapiens
actgtcatcctcaaagaaagtg

SEQ ID NO: 2452990 - DNA, 16 bp, Homo sapiens
actgtcccttgcctca

SEQ ID NO: 2452991 - DNA, 16 bp, Homo sapiens
actgtcctgggcctgc

SEQ ID NO: 2452992 - DNA, 19 bp, Homo sapiens
actgtcctgggcctgcaga

SEQ ID NO: 2452993 - DNA, 16 bp, Homo sapiens
actgtgaaggaccctt

SEQ ID NO: 2452994 - DNA, 22 bp, Homo sapiens
actgtgattcagaaaatgttct

SEQ ID NO: 2452995 - DNA, 19 bp, Homo sapiens
actgtgcacatctgtgtct

SEQ ID NO: 2452996 - DNA, 20 bp, Homo sapiens
actgtgcctcagagaccagg

SEQ ID NO: 2452997 - DNA, 20 bp, Homo sapiens
actgtgcttatttttttaag

SEQ ID NO: 2452998 - DNA, 12 bp, Homo sapiens
actgtgtaactg

SEQ ID NO: 2452999 - DNA, 21 bp, Homo sapiens
actgtgtaagggccagaaata

SEQ ID NO: 2453000 - DNA, 20 bp, Homo sapiens
actgtgtgtgccctctgggc

SEQ ID NO: 2453001 - DNA, 22 bp, Homo sapiens
actgtgtgtgccctctgggctc

SEQ ID NO: 2453002 - DNA, 23 bp, Homo sapiens
actgtgtgtgccctctgggctct

SEQ ID NO: 2453003 - DNA, 12 bp, Homo sapiens
actgtgttcctt

SEQ ID NO: 2453004 - DNA, 18 bp, Homo sapiens
actgttctaaagctctga

SEQ ID NO: 2453005 - DNA, 15 bp, Homo sapiens
actgttctgtgtctt

SEQ ID NO: 2453006 - DNA, 13 bp, Homo sapiens
actgttcttagct

SEQ ID NO: 2453007 - DNA, 10 bp, Homo sapiens
actgttgcac

SEQ ID NO: 2453008 - DNA, 19 bp, Homo sapiens
acgctccagctgccccggc

SEQ ID NO: 2453009 - DNA, 12 bp, Homo sapiens
acgctgctgtca

SEQ ID NO: 2453010 - DNA, 14 bp, Homo sapiens
acgctttgattcat

SEQ ID NO: 2453011 - DNA, 16 bp, Homo sapiens
acgctttgattcatag

SEQ ID NO: 2453012 - DNA, 23 bp, Homo sapiens
acgcttttgtgatggagtgctgt

SEQ ID NO: 2453013 - DNA, 23 bp, Homo sapiens
acggacaaaaccccccagatatc

SEQ ID NO: 2453014 - DNA, 20 bp, Homo sapiens
acggagcactgcacctgcct

SEQ ID NO: 2453015 - DNA, 20 bp, Homo sapiens
acggagccactcctctgact

SEQ ID NO: 2453016 - DNA, 21 bp, Homo sapiens
acggagccactcctctgactc

SEQ ID NO: 2453017 - DNA, 14 bp, Homo sapiens
acggattttcagtt

SEQ ID NO: 2453018 - DNA, 19 bp, Homo sapiens
acggcacctgggccctggg

SEQ ID NO: 2453019 - DNA, 21 bp, Homo sapiens
acggcacctgggccctggggc

SEQ ID NO: 2453020 - DNA, 23 bp, Homo sapiens
acggcacctgggccctggggcct

SEQ ID NO: 2453021 - DNA, 17 bp, Homo sapiens
acggccacacagctgcc

SEQ ID NO: 2453022 - DNA, 18 bp, Homo sapiens
acggccacacagctgccg

SEQ ID NO: 2453023 - DNA, 13 bp, Homo sapiens
acggccacatcaa

SEQ ID NO: 2453024 - DNA, 18 bp, Homo sapiens
acggccacatcaaagagg

SEQ ID NO: 2453025 - DNA, 17 bp, Homo sapiens
acggccagggagaagct

SEQ ID NO: 2453026 - DNA, 18 bp, Homo sapiens
acggctcgatttctccag

SEQ ID NO: 2453027 - DNA, 19 bp, Homo sapiens
acggctcgatttctccagg

SEQ ID NO: 2453028 - DNA, 15 bp, Homo sapiens
acgggtgccagaagc

SEQ ID NO: 2453029 - DNA, 16 bp, Homo sapiens
acgggtgtcacggcca

SEQ ID NO: 2453030 - DNA, 18 bp, Homo sapiens
acgggtgtcacggccagg

SEQ ID NO: 2453031 - DNA, 21 bp, Homo sapiens
acgggtgtcacggccaggcag

SEQ ID NO: 2453032 - DNA, 19 bp, Homo sapiens
acgtaaagtacttgtagtt

SEQ ID NO: 2453033 - DNA, 15 bp, Homo sapiens
acgtaataaggtttt

SEQ ID NO: 2453034 - DNA, 14 bp, Homo sapiens
acgtactctggtta

SEQ ID NO: 2453035 - DNA, 17 bp, Homo sapiens
acgtatgtctggttctc

SEQ ID NO: 2453036 - DNA, 18 bp, Homo sapiens
acgtatgtctggttctca

SEQ ID NO: 2453037 - DNA, 20 bp, Homo sapiens
acgtccatcacgttagctgt

SEQ ID NO: 2453038 - DNA, 19 bp, Homo sapiens
acgtgacacaaacacacac

SEQ ID NO: 2453039 - DNA, 14 bp, Homo sapiens
acgtggctcagcca

SEQ ID NO: 2453040 - DNA, 15 bp, Homo sapiens
acgtgtgctgggatc

SEQ ID NO: 2453041 - DNA, 14 bp, Homo sapiens
acgtgtgtttttct

SEQ ID NO: 2453042 - DNA, 16 bp, Homo sapiens
acgtgtgtttttctat

SEQ ID NO: 2453043 - DNA, 22 bp, Homo sapiens
acgtgtgtttttctattaaaag

SEQ ID NO: 2453044 - DNA, 16 bp, Homo sapiens
acgttgagcccctgga

SEQ ID NO: 2453045 - DNA, 23 bp, Homo sapiens
acgtttaagccaaaacaatgttt

SEQ ID NO: 2453046 - DNA, 17 bp, Homo sapiens
acgttttctaattgctt

SEQ ID NO: 2453047 - DNA, 18 bp, Homo sapiens
acgttttctaattgctta

SEQ ID NO: 2453048 - DNA, 19 bp, Homo sapiens
acgttttctaattgcttat

SEQ ID NO: 2453049 - DNA, 15 bp, Homo sapiens
actaaaaaaaagatg

SEQ ID NO: 2453050 - DNA, 20 bp, Homo sapiens
actaaaataattttgtaatg

SEQ ID NO: 2453051 - DNA, 23 bp, Homo sapiens
actaaagccaaacatatatatac

SEQ ID NO: 2453052 - DNA, 17 bp, Homo sapiens
actaacactcagaagcc

SEQ ID NO: 2453053 - DNA, 20 bp, Homo sapiens
actaacactcagaagcctgg

SEQ ID NO: 2453054 - DNA, 21 bp, Homo sapiens
actaacactcagaagcctggg

SEQ ID NO: 2453055 - DNA, 17 bp, Homo sapiens
actaacatgtcctgcct

SEQ ID NO: 2453056 - DNA, 15 bp, Homo sapiens
actaaccaagctgag

SEQ ID NO: 2453057 - DNA, 18 bp, Homo sapiens
actaaccaagctgagttt

SEQ ID NO: 2453058 - DNA, 21 bp, Homo sapiens
actaaccatgtgttatgtttt

SEQ ID NO: 2453059 - DNA, 17 bp, Homo sapiens
actaaccttgcctggta

SEQ ID NO: 2453060 - DNA, 18 bp, Homo sapiens
actaacgttgagcccctg

SEQ ID NO: 2453061 - DNA, 16 bp, Homo sapiens
actaagagaagttgta

SEQ ID NO: 2453062 - DNA, 19 bp, Homo sapiens
actaataaactaataattg

SEQ ID NO: 2453063 - DNA, 11 bp, Homo sapiens
actaataattg

SEQ ID NO: 2453064 - DNA, 16 bp, Homo sapiens
actaatagaataaagg

SEQ ID NO: 2453065 - DNA, 22 bp, Homo sapiens
actaatggcatgagaaatacaa

SEQ ID NO: 2453066 - DNA, 19 bp, Homo sapiens
actaatttcaaaatgcttt

SEQ ID NO: 2453067 - DNA, 20 bp, Homo sapiens
actaatttcaaaatgctttt

SEQ ID NO: 2453068 - DNA, 21 bp, Homo sapiens
actacaaaggtttaaatgaac

SEQ ID NO: 2453069 - DNA, 20 bp, Homo sapiens
actacatgagaacaaacaga

SEQ ID NO: 2453070 - DNA, 19 bp, Homo sapiens
actactaatagaataaagg

SEQ ID NO: 2453071 - DNA, 18 bp, Homo sapiens
actactgacatgtggggc

SEQ ID NO: 2453072 - DNA, 16 bp, Homo sapiens
actactgtgttatgca

SEQ ID NO: 2453073 - DNA, 15 bp, Homo sapiens
actagacaagccaga

SEQ ID NO: 2453074 - DNA, 17 bp, Homo sapiens
actagacaccaaagttc

SEQ ID NO: 2453075 - DNA, 16 bp, Homo sapiens
actagacctccagctg

SEQ ID NO: 2453076 - DNA, 18 bp, Homo sapiens
actagaggtgagaaattt

SEQ ID NO: 2453077 - DNA, 15 bp, Homo sapiens
actagagtctgaaca

SEQ ID NO: 2453078 - DNA, 20 bp, Homo sapiens
actagagtctgaacagctgt

SEQ ID NO: 2453079 - DNA, 21 bp, Homo sapiens
actagagtctgaacagctgta

SEQ ID NO: 2453080 - DNA, 13 bp, Homo sapiens
actagatgatgga

SEQ ID NO: 2453081 - DNA, 17 bp, Homo sapiens
actagccaaacctcacc

SEQ ID NO: 2453082 - DNA, 22 bp, Homo sapiens
actagccaaacctcaccaactc

SEQ ID NO: 2453083 - DNA, 13 bp, Homo sapiens
actagctcttgtt

SEQ ID NO: 2453084 - DNA, 18 bp, Homo sapiens
actaggaaatccattcac

SEQ ID NO: 2453085 - DNA, 22 bp, Homo sapiens
actaggcccccacttgcctctt

SEQ ID NO: 2453086 - DNA, 22 bp, Homo sapiens
actaggccttgcggctcctcag

SEQ ID NO: 2453087 - DNA, 18 bp, Homo sapiens
actagggagccatgtttc

SEQ ID NO: 2453088 - DNA, 18 bp, Homo sapiens
actataagaactttgagc

SEQ ID NO: 2453089 - DNA, 23 bp, Homo sapiens
actatatttgggcctgctccaga

SEQ ID NO: 2453090 - DNA, 20 bp, Homo sapiens
actatctctactgaatgtca

SEQ ID NO: 2453091 - DNA, 14 bp, Homo sapiens
actatctgtctggt

SEQ ID NO: 2453092 - DNA, 17 bp, Homo sapiens
actatctgtctggtggc

SEQ ID NO: 2453093 - DNA, 18 bp, Homo sapiens
actatctttcagctccag

SEQ ID NO: 2453094 - DNA, 21 bp, Homo sapiens
actatgcatggtgccccagga

SEQ ID NO: 2453095 - DNA, 22 bp, Homo sapiens
actatgcatggtgccccaggac

SEQ ID NO: 2453096 - DNA, 24 bp, Homo sapiens
actatggataaactaaacacgtga

SEQ ID NO: 2453097 - DNA, 14 bp, Homo sapiens
actatgtggatgtg

SEQ ID NO: 2453098 - DNA, 17 bp, Homo sapiens
actattcttgatgtaaa

SEQ ID NO: 2453099 - DNA, 22 bp, Homo sapiens
actattcttgatgtaaaatctt

SEQ ID NO: 2453100 - DNA, 23 bp, Homo sapiens
actattcttgatgtaaaatcttg

SEQ ID NO: 2453101 - DNA, 13 bp, Homo sapiens
actatttaactga

SEQ ID NO: 2453102 - DNA, 15 bp, Homo sapiens
actatttaactgact

SEQ ID NO: 2453103 - DNA, 17 bp, Homo sapiens
actatttaactgactat

SEQ ID NO: 2453104 - DNA, 12 bp, Homo sapiens
actattttcaga

SEQ ID NO: 2453105 - DNA, 14 bp, Homo sapiens
actcaaatgagtaa

SEQ ID NO: 2453106 - DNA, 17 bp, Homo sapiens
actcaaatgagtaacat

SEQ ID NO: 2453107 - DNA, 23 bp, Homo sapiens
actcaaatggggccagatccagc

SEQ ID NO: 2453108 - DNA, 18 bp, Homo sapiens
actcaaatgttctaagtt

SEQ ID NO: 2453109 - DNA, 17 bp, Homo sapiens
actcaagaagtgaagaa

SEQ ID NO: 2453110 - DNA, 17 bp, Homo sapiens
actcaaggactttgcag

SEQ ID NO: 2453111 - DNA, 12 bp, Homo sapiens
actcacacaggc

SEQ ID NO: 2453112 - DNA, 21 bp, Homo sapiens
aggcattctggacctctgggt

SEQ ID NO: 2453113 - DNA, 13 bp, Homo sapiens
aggcattgccaag

SEQ ID NO: 2453114 - DNA, 18 bp, Homo sapiens
aggcattgccaagggctt

SEQ ID NO: 2453115 - DNA, 21 bp, Homo sapiens
aggcattgccaagggctttgt

SEQ ID NO: 2453116 - DNA, 14 bp, Homo sapiens
aggcattggatatt

SEQ ID NO: 2453117 - DNA, 14 bp, Homo sapiens
aggcatttcctggg

SEQ ID NO: 2453118 - DNA, 17 bp, Homo sapiens
aggccaagaaacgtctt

SEQ ID NO: 2453119 - DNA, 19 bp, Homo sapiens
aggccaaggtgtcctacag

SEQ ID NO: 2453120 - DNA, 20 bp, Homo sapiens
aggccaaggtgtcctacaga

SEQ ID NO: 2453121 - DNA, 21 bp, Homo sapiens
aggccaaggtgtcctacagaa

SEQ ID NO: 2453122 - DNA, 21 bp, Homo sapiens
aggccacacttcaaactactt

SEQ ID NO: 2453123 - DNA, 15 bp, Homo sapiens
aggccacctccccag

SEQ ID NO: 2453124 - DNA, 14 bp, Homo sapiens
aggccactggagac

SEQ ID NO: 2453125 - DNA, 14 bp, Homo sapiens
aggccactgtgttc

SEQ ID NO: 2453126 - DNA, 15 bp, Homo sapiens
aggccagagcccact

SEQ ID NO: 2453127 - DNA, 18 bp, Homo sapiens
aggccagaggcccccagc

SEQ ID NO: 2453128 - DNA, 13 bp, Homo sapiens
aggccagcagggg

SEQ ID NO: 2453129 - DNA, 15 bp, Homo sapiens
aggccagcaggggct

SEQ ID NO: 2453130 - DNA, 21 bp, Homo sapiens
aggccagcctggcctcctgcc

SEQ ID NO: 2453131 - DNA, 23 bp, Homo sapiens
aggccagcctggcctcctgcctc

SEQ ID NO: 2453132 - DNA, 20 bp, Homo sapiens
aggccagctgtggttttctt

SEQ ID NO: 2453133 - DNA, 21 bp, Homo sapiens
aggccagctgtggttttcttt

SEQ ID NO: 2453134 - DNA, 19 bp, Homo sapiens
aggccaggactctgcagcc

SEQ ID NO: 2453135 - DNA, 15 bp, Homo sapiens
aggccagggcagagt

SEQ ID NO: 2453136 - DNA, 22 bp, Homo sapiens
aggccatctgggctcctccagg

SEQ ID NO: 2453137 - DNA, 13 bp, Homo sapiens
aggccatggactc

SEQ ID NO: 2453138 - DNA, 18 bp, Homo sapiens
aggccatggactctgtcc

SEQ ID NO: 2453139 - DNA, 13 bp, Homo sapiens
aggccattattgt

SEQ ID NO: 2453140 - DNA, 18 bp, Homo sapiens
aggcccaggctgccgtcc

SEQ ID NO: 2453141 - DNA, 17 bp, Homo sapiens
aggcccagttcaccctg

SEQ ID NO: 2453142 - DNA, 16 bp, Homo sapiens
aggccccatgacctcc

SEQ ID NO: 2453143 - DNA, 18 bp, Homo sapiens
aggcccccagcccagggc

SEQ ID NO: 2453144 - DNA, 22 bp, Homo sapiens
aggcccccagcccagggctcct

SEQ ID NO: 2453145 - DNA, 21 bp, Homo sapiens
aggcccccatcatcctctggc

SEQ ID NO: 2453146 - DNA, 19 bp, Homo sapiens
aggcccccgccttggcctg

SEQ ID NO: 2453147 - DNA, 18 bp, Homo sapiens
aggccctcaagtctttct

SEQ ID NO: 2453148 - DNA, 23 bp, Homo sapiens
aggccctcaagtctttctctttc

SEQ ID NO: 2453149 - DNA, 18 bp, Homo sapiens
aggccctccacacctgcg

SEQ ID NO: 2453150 - DNA, 15 bp, Homo sapiens
aggccctcgctgcca

SEQ ID NO: 2453151 - DNA, 21 bp, Homo sapiens
aggccctggatcagcgtggcc

SEQ ID NO: 2453152 - DNA, 22 bp, Homo sapiens
aggccctggcctcccctgccac

SEQ ID NO: 2453153 - DNA, 23 bp, Homo sapiens
aggccctggcctcccctgccacc

SEQ ID NO: 2453154 - DNA, 18 bp, Homo sapiens
aggccgggaaaaagccca

SEQ ID NO: 2453155 - DNA, 19 bp, Homo sapiens
aggcctaattctatgcctg

SEQ ID NO: 2453156 - DNA, 17 bp, Homo sapiens
aggcctagtcctgcgaa

SEQ ID NO: 2453157 - DNA, 18 bp, Homo sapiens
aggcctcagggctccttg

SEQ ID NO: 2453158 - DNA, 21 bp, Homo sapiens
aggcctgaaagaggctgaggc

SEQ ID NO: 2453159 - DNA, 23 bp, Homo sapiens
aggcctgaaagaggctgaggcct

SEQ ID NO: 2453160 - DNA, 19 bp, Homo sapiens
aggcctgaggttactggaa

SEQ ID NO: 2453161 - DNA, 13 bp, Homo sapiens
aggcctgcagggc

SEQ ID NO: 2453162 - DNA, 18 bp, Homo sapiens
aggcctgcagggcctctg

SEQ ID NO: 2453163 - DNA, 19 bp, Homo sapiens
aggcctggactttcctgca

SEQ ID NO: 2453164 - DNA, 14 bp, Homo sapiens
aggcctgggcagtg

SEQ ID NO: 2453165 - DNA, 15 bp, Homo sapiens
aggcctgggcagtgg

SEQ ID NO: 2453166 - DNA, 19 bp, Homo sapiens
aggcctgggccgctgccac

SEQ ID NO: 2453167 - DNA, 21 bp, Homo sapiens
aggcctgggccgctgccacgt

SEQ ID NO: 2453168 - DNA, 11 bp, Homo sapiens
aggcctggggt

SEQ ID NO: 2453169 - DNA, 20 bp, Homo sapiens
aggcctgtgtagctgtgacc

SEQ ID NO: 2453170 - DNA, 19 bp, Homo sapiens
aggggaccctccgctctgt

SEQ ID NO: 2453171 - DNA, 23 bp, Homo sapiens
aggggacctggaagggaggtggg

SEQ ID NO: 2453172 - DNA, 21 bp, Homo sapiens
aggggagacctcagaagtaaa

SEQ ID NO: 2453173 - DNA, 12 bp, Homo sapiens
aggggagcccac

SEQ ID NO: 2453174 - DNA, 17 bp, Homo sapiens
aggggagcccactgtcc

SEQ ID NO: 2453175 - DNA, 18 bp, Homo sapiens
aggggaggggctcctttc

SEQ ID NO: 2453176 - DNA, 13 bp, Homo sapiens
aggggcagaggcc

SEQ ID NO: 2453177 - DNA, 19 bp, Homo sapiens
aggggcccctctcagccct

SEQ ID NO: 2453178 - DNA, 19 bp, Homo sapiens
aggggccgatgcccagaga

SEQ ID NO: 2453179 - DNA, 12 bp, Homo sapiens
aggggcctgagc

SEQ ID NO: 2453180 - DNA, 19 bp, Homo sapiens
aggggcctgccacctggac

SEQ ID NO: 2453181 - DNA, 20 bp, Homo sapiens
aggggcctgccacctggacc

SEQ ID NO: 2453182 - DNA, 22 bp, Homo sapiens
aggggcctgccacctggacccc

SEQ ID NO: 2453183 - DNA, 14 bp, Homo sapiens
aggggcctggagat

SEQ ID NO: 2453184 - DNA, 15 bp, Homo sapiens
aggggctccctccgc

SEQ ID NO: 2453185 - DNA, 18 bp, Homo sapiens
aggggctgcttcctcctg

SEQ ID NO: 2453186 - DNA, 20 bp, Homo sapiens
aggggctgcttcctcctgga

SEQ ID NO: 2453187 - DNA, 16 bp, Homo sapiens
aggggcttcctggtgc

SEQ ID NO: 2453188 - DNA, 22 bp, Homo sapiens
agggggaaggtggggtcctgga

SEQ ID NO: 2453189 - DNA, 19 bp, Homo sapiens
agggggatccgactgcttt

SEQ ID NO: 2453190 - DNA, 13 bp, Homo sapiens
agggggctgctgc

SEQ ID NO: 2453191 - DNA, 14 bp, Homo sapiens
agggggctgctgct

SEQ ID NO: 2453192 - DNA, 13 bp, Homo sapiens
agggggctggagg

SEQ ID NO: 2453193 - DNA, 16 bp, Homo sapiens
agggggtctggctggt

SEQ ID NO: 2453194 - DNA, 17 bp, Homo sapiens
agggggtctggctggtg

SEQ ID NO: 2453195 - DNA, 16 bp, Homo sapiens
aggggtaggggctggg

SEQ ID NO: 2453196 - DNA, 18 bp, Homo sapiens
aggggtaggggctgggaa

SEQ ID NO: 2453197 - DNA, 21 bp, Homo sapiens
aggggtcggctgaccatgctc

SEQ ID NO: 2453198 - DNA, 17 bp, Homo sapiens
aggggttcctcccctcc

SEQ ID NO: 2453199 - DNA, 22 bp, Homo sapiens
aggggttcctcccctccagctc

SEQ ID NO: 2453200 - DNA, 16 bp, Homo sapiens
aggggttggggaaaca

SEQ ID NO: 2453201 - DNA, 18 bp, Homo sapiens
agggtacatggtgctggg

SEQ ID NO: 2453202 - DNA, 16 bp, Homo sapiens
agggtaggcaggattg

SEQ ID NO: 2453203 - DNA, 18 bp, Homo sapiens
agggtaggcaggattggg

SEQ ID NO: 2453204 - DNA, 15 bp, Homo sapiens
agggtatgaagagtg

SEQ ID NO: 2453205 - DNA, 21 bp, Homo sapiens
agggtatggactatctgtctg

SEQ ID NO: 2453206 - DNA, 14 bp, Homo sapiens
agggtatttgaccc

SEQ ID NO: 2453207 - DNA, 19 bp, Homo sapiens
agggtcagacgcctgagga

SEQ ID NO: 2453208 - DNA, 12 bp, Homo sapiens
agggtcaggcct

SEQ ID NO: 2453209 - DNA, 13 bp, Homo sapiens
agggtcaggcctt

SEQ ID NO: 2453210 - DNA, 23 bp, Homo sapiens
agggtcccccactctaaagcaaa

SEQ ID NO: 2453211 - DNA, 15 bp, Homo sapiens
agggtccctctgtgt

SEQ ID NO: 2453212 - DNA, 18 bp, Homo sapiens
agggtccctctgtgtatt

SEQ ID NO: 2453213 - DNA, 13 bp, Homo sapiens
agggtctgctctt

SEQ ID NO: 2453214 - DNA, 20 bp, Homo sapiens
agggtctgctctttctctgc

SEQ ID NO: 2453215 - DNA, 22 bp, Homo sapiens
agggtctgctctttctctgcca

SEQ ID NO: 2453216 - DNA, 22 bp, Homo sapiens
agggtctgggggcacaagactg

SEQ ID NO: 2453217 - DNA, 20 bp, Homo sapiens
agggtctgtaggttgcacac

SEQ ID NO: 2453218 - DNA, 19 bp, Homo sapiens
agggtgagttggcttacct

SEQ ID NO: 2453219 - DNA, 20 bp, Homo sapiens
agggtggttcaacaaagaaa

SEQ ID NO: 2453220 - DNA, 12 bp, Homo sapiens
agggtgtgtgct

SEQ ID NO: 2453221 - DNA, 17 bp, Homo sapiens
agggttgaccccagagg

SEQ ID NO: 2453222 - DNA, 22 bp, Homo sapiens
agggtttccctactgaagccct

SEQ ID NO: 2453223 - DNA, 18 bp, Homo sapiens
agggtttgtgacagggcg

SEQ ID NO: 2453224 - DNA, 15 bp, Homo sapiens
agggttttaactttg

SEQ ID NO: 2453225 - DNA, 12 bp, Homo sapiens
agggttttgccc

SEQ ID NO: 2453226 - DNA, 13 bp, Homo sapiens
agggttttgcccc

SEQ ID NO: 2453227 - DNA, 14 bp, Homo sapiens
aggtaaaatgccat

SEQ ID NO: 2453228 - DNA, 16 bp, Homo sapiens
aggtaaaatgccatga

SEQ ID NO: 2453229 - DNA, 14 bp, Homo sapiens
aggtaaataaaaag

SEQ ID NO: 2453230 - DNA, 19 bp, Homo sapiens
aggtaactaactgcataca

SEQ ID NO: 2453231 - DNA, 22 bp, Homo sapiens
aggtaagaagttttaaaaagcc

SEQ ID NO: 2453232 - DNA, 18 bp, Homo sapiens
aggtaatataaaaagctt

SEQ ID NO: 2453233 - DNA, 22 bp, Homo sapiens
aggtagaattatctaatttata

SEQ ID NO: 2453234 - DNA, 23 bp, Homo sapiens
aggtaggccaaggtgtcctacag

SEQ ID NO: 2453235 - DNA, 19 bp, Homo sapiens
aggctgtgtaagatttgtt

SEQ ID NO: 2453236 - DNA, 15 bp, Homo sapiens
aggcttagtttgtgt

SEQ ID NO: 2453237 - DNA, 16 bp, Homo sapiens
aggcttctctctgtgg

SEQ ID NO: 2453238 - DNA, 18 bp, Homo sapiens
aggcttctgctggggcct

SEQ ID NO: 2453239 - DNA, 21 bp, Homo sapiens
aggcttgggatttgctgtgta

SEQ ID NO: 2453240 - DNA, 20 bp, Homo sapiens
aggcttggttccttcccaat

SEQ ID NO: 2453241 - DNA, 16 bp, Homo sapiens
aggcttgttgtgcttt

SEQ ID NO: 2453242 - DNA, 23 bp, Homo sapiens
aggctttatgataatagattctc

SEQ ID NO: 2453243 - DNA, 22 bp, Homo sapiens
aggcttttgtttcctttttcag

SEQ ID NO: 2453244 - DNA, 13 bp, Homo sapiens
agggaaagcccat

SEQ ID NO: 2453245 - DNA, 23 bp, Homo sapiens
agggaacaatttggcaattttgt

SEQ ID NO: 2453246 - DNA, 14 bp, Homo sapiens
agggaacctgtgtc

SEQ ID NO: 2453247 - DNA, 13 bp, Homo sapiens
agggaagagtttt

SEQ ID NO: 2453248 - DNA, 18 bp, Homo sapiens
agggaagcagcagcctcg

SEQ ID NO: 2453249 - DNA, 15 bp, Homo sapiens
agggaaggcaggcag

SEQ ID NO: 2453250 - DNA, 18 bp, Homo sapiens
agggaaggcaggcagggc

SEQ ID NO: 2453251 - DNA, 16 bp, Homo sapiens
agggaagggagccaag

SEQ ID NO: 2453252 - DNA, 13 bp, Homo sapiens
agggaagggcctg

SEQ ID NO: 2453253 - DNA, 14 bp, Homo sapiens
agggaagggcctgc

SEQ ID NO: 2453254 - DNA, 14 bp, Homo sapiens
agggaatgtgaaat

SEQ ID NO: 2453255 - DNA, 18 bp, Homo sapiens
agggacaaaggagcctgt

SEQ ID NO: 2453256 - DNA, 19 bp, Homo sapiens
agggacaaaggagcctgtg

SEQ ID NO: 2453257 - DNA, 20 bp, Homo sapiens
agggacaaaggagcctgtga

SEQ ID NO: 2453258 - DNA, 22 bp, Homo sapiens
agggacaagtggactcagggca

SEQ ID NO: 2453259 - DNA, 14 bp, Homo sapiens
agggacacctggga

SEQ ID NO: 2453260 - DNA, 14 bp, Homo sapiens
agggacatgcttag

SEQ ID NO: 2453261 - DNA, 18 bp, Homo sapiens
agggaccacaccctgtac

SEQ ID NO: 2453262 - DNA, 15 bp, Homo sapiens
agggacgcctggggg

SEQ ID NO: 2453263 - DNA, 18 bp, Homo sapiens
agggacgcctgggggtgc

SEQ ID NO: 2453264 - DNA, 22 bp, Homo sapiens
agggacttcaggatcaagtcct

SEQ ID NO: 2453265 - DNA, 20 bp, Homo sapiens
agggagacactggcccctca

SEQ ID NO: 2453266 - DNA, 18 bp, Homo sapiens
agggagagcccaggagct

SEQ ID NO: 2453267 - DNA, 19 bp, Homo sapiens
agggagagcccaggagctc

SEQ ID NO: 2453268 - DNA, 13 bp, Homo sapiens
agggagagggggc

SEQ ID NO: 2453269 - DNA, 10 bp, Homo sapiens
agggagccaa

SEQ ID NO: 2453270 - DNA, 17 bp, Homo sapiens
agggagccaagggatgg

SEQ ID NO: 2453271 - DNA, 20 bp, Homo sapiens
agggagccaagggatggaca

SEQ ID NO: 2453272 - DNA, 14 bp, Homo sapiens
agggagcctggccc

SEQ ID NO: 2453273 - DNA, 22 bp, Homo sapiens
agggagcggccggccagcccct

SEQ ID NO: 2453274 - DNA, 16 bp, Homo sapiens
agggaggccgaagcta

SEQ ID NO: 2453275 - DNA, 15 bp, Homo sapiens
agggaggctggtcct

SEQ ID NO: 2453276 - DNA, 13 bp, Homo sapiens
agggagggagtgg

SEQ ID NO: 2453277 - DNA, 17 bp, Homo sapiens
agggagggcagagctgg

SEQ ID NO: 2453278 - DNA, 20 bp, Homo sapiens
agggagggctctgaggcgcc

SEQ ID NO: 2453279 - DNA, 13 bp, Homo sapiens
agggagtctgcca

SEQ ID NO: 2453280 - DNA, 18 bp, Homo sapiens
agggagtctgccagggcc

SEQ ID NO: 2453281 - DNA, 16 bp, Homo sapiens
agggatccctcatctg

SEQ ID NO: 2453282 - DNA, 22 bp, Homo sapiens
agggatccctcatctgtccctc

SEQ ID NO: 2453283 - DNA, 15 bp, Homo sapiens
agggatggacatctt

SEQ ID NO: 2453284 - DNA, 17 bp, Homo sapiens
agggatggacatcttgt

SEQ ID NO: 2453285 - DNA, 13 bp, Homo sapiens
agggatgtgggtt

SEQ ID NO: 2453286 - DNA, 22 bp, Homo sapiens
agggatgtgggttccacagacg

SEQ ID NO: 2453287 - DNA, 14 bp, Homo sapiens
agggcaaagccagg

SEQ ID NO: 2453288 - DNA, 15 bp, Homo sapiens
agggcacaggagcta

SEQ ID NO: 2453289 - DNA, 17 bp, Homo sapiens
agggcacaggagctacc

SEQ ID NO: 2453290 - DNA, 19 bp, Homo sapiens
agggcacaggagctacctg

SEQ ID NO: 2453291 - DNA, 14 bp, Homo sapiens
agggcaccaggggt

SEQ ID NO: 2453292 - DNA, 12 bp, Homo sapiens
agggcagagctg

SEQ ID NO: 2453293 - DNA, 15 bp, Homo sapiens
agggcagagctggtg

SEQ ID NO: 2453294 - DNA, 17 bp, Homo sapiens
agggcagagctggtgcg

SEQ ID NO: 2453295 - DNA, 12 bp, Homo sapiens
agggcagagtga

SEQ ID NO: 2453296 - DNA, 12 bp, Homo sapiens
agggcagcagcc

SEQ ID NO: 2453297 - DNA, 15 bp, Homo sapiens
agggcagcagccagc

SEQ ID NO: 2453298 - DNA, 20 bp, Homo sapiens
agggcagcagccagccctgc

SEQ ID NO: 2453299 - DNA, 20 bp, Homo sapiens
atctcctgccttcctcctgg

SEQ ID NO: 2453300 - DNA, 22 bp, Homo sapiens
atctctaccttctccccagctc

SEQ ID NO: 2453301 - DNA, 14 bp, Homo sapiens
atctctccctcccc

SEQ ID NO: 2453302 - DNA, 18 bp, Homo sapiens
atctctgaagccacaaat

SEQ ID NO: 2453303 - DNA, 22 bp, Homo sapiens
atctctgggctggatgagctcc

SEQ ID NO: 2453304 - DNA, 23 bp, Homo sapiens
atctctgggctggatgagctccc

SEQ ID NO: 2453305 - DNA, 19 bp, Homo sapiens
atctctttttgctttcgaa

SEQ ID NO: 2453306 - DNA, 21 bp, Homo sapiens
atctgaataaagtgtaacaat

SEQ ID NO: 2453307 - DNA, 20 bp, Homo sapiens
atctgaatttttaaacaagt

SEQ ID NO: 2453308 - DNA, 12 bp, Homo sapiens
atctgacccagt

SEQ ID NO: 2453309 - DNA, 20 bp, Homo sapiens
atctgacccagtgcccccac

SEQ ID NO: 2453310 - DNA, 12 bp, Homo sapiens
atctgatagggt

SEQ ID NO: 2453311 - DNA, 22 bp, Homo sapiens
atctgatagggtttgtgacagg

SEQ ID NO: 2453312 - DNA, 21 bp, Homo sapiens
atctgcaattcaaaagttcca

SEQ ID NO: 2453313 - DNA, 23 bp, Homo sapiens
atctgcattttcaccccaccctt

SEQ ID NO: 2453314 - DNA, 15 bp, Homo sapiens
atctgccacaaaaac

SEQ ID NO: 2453315 - DNA, 17 bp, Homo sapiens
atctgcgtgacaataaa

SEQ ID NO: 2453316 - DNA, 22 bp, Homo sapiens
atctgcgtgacaataaaacatt

SEQ ID NO: 2453317 - DNA, 19 bp, Homo sapiens
atgattaaataagattcta

SEQ ID NO: 2453318 - DNA, 22 bp, Homo sapiens
atgattctatttatatgtacat

SEQ ID NO: 2453319 - DNA, 20 bp, Homo sapiens
atgatttcagttctaggaaa

SEQ ID NO: 2453320 - DNA, 13 bp, Homo sapiens
atgatttccttga

SEQ ID NO: 2453321 - DNA, 18 bp, Homo sapiens
atgatttccttgaatgtg

SEQ ID NO: 2453322 - DNA, 15 bp, Homo sapiens
atgatttttctttac

SEQ ID NO: 2453323 - DNA, 13 bp, Homo sapiens
atgcaaaagcaag

SEQ ID NO: 2453324 - DNA, 16 bp, Homo sapiens
atgcaaactctttggt

SEQ ID NO: 2453325 - DNA, 15 bp, Homo sapiens
atgcacctaaagaaa

SEQ ID NO: 2453326 - DNA, 21 bp, Homo sapiens
atgcactgttccccctgtgca

SEQ ID NO: 2453327 - DNA, 19 bp, Homo sapiens
atgcacttataattttcct

SEQ ID NO: 2453328 - DNA, 22 bp, Homo sapiens
atgcactttctatcctctgtaa

SEQ ID NO: 2453329 - DNA, 15 bp, Homo sapiens
atgcactttgcttta

SEQ ID NO: 2453330 - DNA, 16 bp, Homo sapiens
atgcactttgctttaa

SEQ ID NO: 2453331 - DNA, 22 bp, Homo sapiens
atgcactttgctttaatataaa

SEQ ID NO: 2453332 - DNA, 12 bp, Homo sapiens
atgcagaatgtt

SEQ ID NO: 2453333 - DNA, 19 bp, Homo sapiens
atgcagaatgttgattaca

SEQ ID NO: 2453334 - DNA, 15 bp, Homo sapiens
atgcagaggcctgca

SEQ ID NO: 2453335 - DNA, 22 bp, Homo sapiens
atgcagaggcctgcagggcctc

SEQ ID NO: 2453336 - DNA, 13 bp, Homo sapiens
atgcagggcagtc

SEQ ID NO: 2453337 - DNA, 14 bp, Homo sapiens
atgcagttgtctct

SEQ ID NO: 2453338 - DNA, 12 bp, Homo sapiens
atgcatatttgt

SEQ ID NO: 2453339 - DNA, 16 bp, Homo sapiens
atgcatatttgtttat

SEQ ID NO: 2453340 - DNA, 18 bp, Homo sapiens
atgcatcagaaagggagg

SEQ ID NO: 2453341 - DNA, 20 bp, Homo sapiens
atgcatctgtttattctata

SEQ ID NO: 2453342 - DNA, 20 bp, Homo sapiens
atgcatggtgccccaggacc

SEQ ID NO: 2453343 - DNA, 21 bp, Homo sapiens
atgcatggtgccccaggacca

SEQ ID NO: 2453344 - DNA, 13 bp, Homo sapiens
atgcatggtttca

SEQ ID NO: 2453345 - DNA, 17 bp, Homo sapiens
atgcatggtttcagcac

SEQ ID NO: 2453346 - DNA, 19 bp, Homo sapiens
atgcatggtttcagcacta

SEQ ID NO: 2453347 - DNA, 18 bp, Homo sapiens
atgcattatatcaaatct

SEQ ID NO: 2453348 - DNA, 17 bp, Homo sapiens
atgcattcttctctgtt

SEQ ID NO: 2453349 - DNA, 20 bp, Homo sapiens
atgcatttgggtccaggagg

SEQ ID NO: 2453350 - DNA, 17 bp, Homo sapiens
atgccaaaaaaaaatac

SEQ ID NO: 2453351 - DNA, 19 bp, Homo sapiens
atgccaaaaaaaaatacat

SEQ ID NO: 2453352 - DNA, 13 bp, Homo sapiens
atgccaaattaaa

SEQ ID NO: 2453353 - DNA, 15 bp, Homo sapiens
atgccaaattaaaaa

SEQ ID NO: 2453354 - DNA, 17 bp, Homo sapiens
atgccacagccctgtca

SEQ ID NO: 2453355 - DNA, 18 bp, Homo sapiens
atgccacagccctgtcag

SEQ ID NO: 2453356 - DNA, 15 bp, Homo sapiens
atgccacattcaaaa

SEQ ID NO: 2453357 - DNA, 14 bp, Homo sapiens
atgccactgccttc

SEQ ID NO: 2453358 - DNA, 17 bp, Homo sapiens
atgccagtaacaggctc

SEQ ID NO: 2453359 - DNA, 22 bp, Homo sapiens
atgccagtaacgcgtcttcctg

SEQ ID NO: 2453360 - DNA, 14 bp, Homo sapiens
atgccatcatctcc

SEQ ID NO: 2453361 - DNA, 16 bp, Homo sapiens
atgccatttgtactga

SEQ ID NO: 2453362 - DNA, 10 bp, Homo sapiens
atgcccagag

SEQ ID NO: 2453363 - DNA, 14 bp, Homo sapiens
atgcccagagaccc

SEQ ID NO: 2453364 - DNA, 17 bp, Homo sapiens
atgcccggctaattttt

SEQ ID NO: 2453365 - DNA, 13 bp, Homo sapiens
atgccctgtgcaa

SEQ ID NO: 2453366 - DNA, 16 bp, Homo sapiens
atgcctccttcctctt

SEQ ID NO: 2453367 - DNA, 12 bp, Homo sapiens
atgcctctgagg

SEQ ID NO: 2453368 - DNA, 24 bp, Homo sapiens
atgccttggtttttactgctctga

SEQ ID NO: 2453369 - DNA, 18 bp, Homo sapiens
atgcggtagccagcacac

SEQ ID NO: 2453370 - DNA, 20 bp, Homo sapiens
atgcggtagccagcacacag

SEQ ID NO: 2453371 - DNA, 21 bp, Homo sapiens
atgcggtagccagcacacagg

SEQ ID NO: 2453372 - DNA, 13 bp, Homo sapiens
atgctaggttcta

SEQ ID NO: 2453373 - DNA, 18 bp, Homo sapiens
atgctcaggtgctggggc

SEQ ID NO: 2453374 - DNA, 13 bp, Homo sapiens
atgctcatctgct

SEQ ID NO: 2453375 - DNA, 14 bp, Homo sapiens
atgctcatctgctg

SEQ ID NO: 2453376 - DNA, 20 bp, Homo sapiens
atgctccaagattctagatg

SEQ ID NO: 2453377 - DNA, 13 bp, Homo sapiens
atgctcctcttcc

SEQ ID NO: 2453378 - DNA, 18 bp, Homo sapiens
atgctcctcttccccaga

SEQ ID NO: 2453379 - DNA, 23 bp, Homo sapiens
atgctcctcttccccagacgcct

SEQ ID NO: 2453380 - DNA, 22 bp, Homo sapiens
atgctgaggcctgggccgctgc

SEQ ID NO: 2453381 - DNA, 12 bp, Homo sapiens
atgctgcccctc

SEQ ID NO: 2453382 - DNA, 23 bp, Homo sapiens
atgctgccttattcagggaagga

SEQ ID NO: 2453383 - DNA, 13 bp, Homo sapiens
atgctgctgggga

SEQ ID NO: 2453384 - DNA, 20 bp, Homo sapiens
atgctgctggggaagacagt

SEQ ID NO: 2453385 - DNA, 21 bp, Homo sapiens
atgctgctggggaagacagtg

SEQ ID NO: 2453386 - DNA, 13 bp, Homo sapiens
atgctggcccagg

SEQ ID NO: 2453387 - DNA, 22 bp, Homo sapiens
atgctggcccagggcccagagc

SEQ ID NO: 2453388 - DNA, 22 bp, Homo sapiens
atgctgtacatctattttggat

SEQ ID NO: 2453389 - DNA, 23 bp, Homo sapiens
atgctgtacatctattttggatt

SEQ ID NO: 2453390 - DNA, 22 bp, Homo sapiens
atgctgtgagtctttggttcta

SEQ ID NO: 2453391 - DNA, 17 bp, Homo sapiens
atgcttaaaataagcag

SEQ ID NO: 2453392 - DNA, 15 bp, Homo sapiens
atgcttattccatga

SEQ ID NO: 2453393 - DNA, 22 bp, Homo sapiens
atgcttattccatgactgcttg

SEQ ID NO: 2453394 - DNA, 15 bp, Homo sapiens
atgcttctaagtaaa

SEQ ID NO: 2453395 - DNA, 20 bp, Homo sapiens
atgcttctaagtaaatacaa

SEQ ID NO: 2453396 - DNA, 19 bp, Homo sapiens
atgcttctataattttgcc

SEQ ID NO: 2453397 - DNA, 20 bp, Homo sapiens
atgcttctataattttgcct

SEQ ID NO: 2453398 - DNA, 23 bp, Homo sapiens
atgcttctataattttgccttta

SEQ ID NO: 2453399 - DNA, 19 bp, Homo sapiens
atgcttgcaaaaactacaa

SEQ ID NO: 2453400 - DNA, 23 bp, Homo sapiens
atgcttgggaagactcctagctg

SEQ ID NO: 2453401 - DNA, 18 bp, Homo sapiens
atgctttgaaacagaaaa

SEQ ID NO: 2453402 - DNA, 19 bp, Homo sapiens
atgctttgaaattgaacct

SEQ ID NO: 2453403 - DNA, 16 bp, Homo sapiens
atgctttttatttctg

SEQ ID NO: 2453404 - DNA, 23 bp, Homo sapiens
atgctttttatttctgcatatgt

SEQ ID NO: 2453405 - DNA, 13 bp, Homo sapiens
atggaaaggatgg

SEQ ID NO: 2453406 - DNA, 15 bp, Homo sapiens
atggaaatttaaagc

SEQ ID NO: 2453407 - DNA, 13 bp, Homo sapiens
atggaattgattt

SEQ ID NO: 2453408 - DNA, 17 bp, Homo sapiens
atggaattgatttgcat

SEQ ID NO: 2453409 - DNA, 13 bp, Homo sapiens
atggacaatggac

SEQ ID NO: 2453410 - DNA, 14 bp, Homo sapiens
atggacaggctggc

SEQ ID NO: 2453411 - DNA, 12 bp, Homo sapiens
atggacatcttg

SEQ ID NO: 2453412 - DNA, 17 bp, Homo sapiens
atggacatcttgtcatt

SEQ ID NO: 2453413 - DNA, 19 bp, Homo sapiens
atggacatcttgtcatttt

SEQ ID NO: 2453414 - DNA, 20 bp, Homo sapiens
atggacatcttgtcattttt

SEQ ID NO: 2453415 - DNA, 13 bp, Homo sapiens
atggaccggagag

SEQ ID NO: 2453416 - DNA, 13 bp, Homo sapiens
atggactctgtcc

SEQ ID NO: 2453417 - DNA, 15 bp, Homo sapiens
atggactctgtcctg

SEQ ID NO: 2453418 - DNA, 12 bp, Homo sapiens
atggagaaagct

SEQ ID NO: 2453419 - DNA, 13 bp, Homo sapiens
atggagaaagctg

SEQ ID NO: 2453420 - DNA, 18 bp, Homo sapiens
atggagagccctgggacc

SEQ ID NO: 2453421 - DNA, 17 bp, Homo sapiens
atggagattgacctgga

SEQ ID NO: 2453422 - DNA, 16 bp, Homo sapiens
atggagggaataatac

SEQ ID NO: 2453423 - DNA, 17 bp, Homo sapiens
atggagtggcagcccag

SEQ ID NO: 2453424 - DNA, 22 bp, Homo sapiens
atggagtggcagcccagccagc

SEQ ID NO: 2453425 - DNA, 13 bp, Homo sapiens
atggagtttctaa

SEQ ID NO: 2453426 - DNA, 22 bp, Homo sapiens
atggatgccaatattaaatctg

SEQ ID NO: 2453427 - DNA, 18 bp, Homo sapiens
atggatgtccccagcaga

SEQ ID NO: 2453428 - DNA, 13 bp, Homo sapiens
atggattctaaaa

SEQ ID NO: 2453429 - DNA, 15 bp, Homo sapiens
atggattctaaaatg

SEQ ID NO: 2453430 - DNA, 18 bp, Homo sapiens
atggcaaaggaaggtgga

SEQ ID NO: 2453431 - DNA, 14 bp, Homo sapiens
atggcaacagatct

SEQ ID NO: 2453432 - DNA, 17 bp, Homo sapiens
atggcaacagatctgga

SEQ ID NO: 2453433 - DNA, 15 bp, Homo sapiens
atggcagaaggcaaa

SEQ ID NO: 2453434 - DNA, 17 bp, Homo sapiens
atggcagggggctgctg

SEQ ID NO: 2453435 - DNA, 24 bp, Homo sapiens
atggcagggggtggaattattact

SEQ ID NO: 2453436 - DNA, 16 bp, Homo sapiens
atggcatcctccagcc

SEQ ID NO: 2453437 - DNA, 15 bp, Homo sapiens
atggcatgagaaata

SEQ ID NO: 2453438 - DNA, 18 bp, Homo sapiens
atggcatgagaaatacaa

SEQ ID NO: 2453439 - DNA, 13 bp, Homo sapiens
atggccagcagca

SEQ ID NO: 2453440 - DNA, 19 bp, Homo sapiens
atggccagccccttagaca

SEQ ID NO: 2453441 - DNA, 22 bp, Homo sapiens
atggccagccccttagacagag

SEQ ID NO: 2453442 - DNA, 14 bp, Homo sapiens
atggccagctggag

SEQ ID NO: 2453443 - DNA, 23 bp, Homo sapiens
atggcccctctgacctgcactgg

SEQ ID NO: 2453444 - DNA, 22 bp, Homo sapiens
atggccgtgaatgggtgcccac

SEQ ID NO: 2453445 - DNA, 17 bp, Homo sapiens
atggcctgcaaactggg

SEQ ID NO: 2453446 - DNA, 14 bp, Homo sapiens
atggccttcatatc

SEQ ID NO: 2453447 - DNA, 19 bp, Homo sapiens
atggcgtaagtacagagaa

SEQ ID NO: 2453448 - DNA, 22 bp, Homo sapiens
atggcgtaagtacagagaagcc

SEQ ID NO: 2453449 - DNA, 17 bp, Homo sapiens
atgggagacccttgaca

SEQ ID NO: 2453450 - DNA, 17 bp, Homo sapiens
atgggagccgggtctgc

SEQ ID NO: 2453451 - DNA, 20 bp, Homo sapiens
atgggagccgggtctgcctc

SEQ ID NO: 2453452 - DNA, 23 bp, Homo sapiens
atgggaggctcacccccttctcc

SEQ ID NO: 2453453 - DNA, 14 bp, Homo sapiens
atgggattctggac

SEQ ID NO: 2453454 - DNA, 17 bp, Homo sapiens
atgggattctggacagg

SEQ ID NO: 2453455 - DNA, 16 bp, Homo sapiens
atgggcatcttttgta

SEQ ID NO: 2453456 - DNA, 20 bp, Homo sapiens
atgggcatcttttgtattaa

SEQ ID NO: 2453457 - DNA, 14 bp, Homo sapiens
atggggccagatcc

SEQ ID NO: 2453458 - DNA, 21 bp, Homo sapiens
atgggggaaagcaaagcacag

SEQ ID NO: 2453459 - DNA, 12 bp, Homo sapiens
atgggtagggta

SEQ ID NO: 2453460 - DNA, 14 bp, Homo sapiens
atgggtcacaggaa

SEQ ID NO: 2453461 - DNA, 17 bp, Homo sapiens
atgggtgcccacagtgt

SEQ ID NO: 2453462 - DNA, 18 bp, Homo sapiens
atggtaaaaaatttataa

SEQ ID NO: 2453463 - DNA, 23 bp, Homo sapiens
atggtaactgctttctgttccaa

SEQ ID NO: 2453464 - DNA, 16 bp, Homo sapiens
atggtaccagatgcag

SEQ ID NO: 2453465 - DNA, 17 bp, Homo sapiens
atggtagttttttcatc

SEQ ID NO: 2453466 - DNA, 19 bp, Homo sapiens
atggtcacacactgatgct

SEQ ID NO: 2453467 - DNA, 19 bp, Homo sapiens
atggtccaattagtttcct

SEQ ID NO: 2453468 - DNA, 20 bp, Homo sapiens
atggtccaattagtttcctt

SEQ ID NO: 2453469 - DNA, 13 bp, Homo sapiens
atggtccaggaga

SEQ ID NO: 2453470 - DNA, 23 bp, Homo sapiens
atggtcgagaaagaggcaccagg

SEQ ID NO: 2453471 - DNA, 16 bp, Homo sapiens
atggtcttacagcagg

SEQ ID NO: 2453472 - DNA, 19 bp, Homo sapiens
atggtgccccaggaccagc

SEQ ID NO: 2453473 - DNA, 21 bp, Homo sapiens
atggtgccccaggaccagctc

SEQ ID NO: 2453474 - DNA, 22 bp, Homo sapiens
atggtgccccaggaccagctca

SEQ ID NO: 2453475 - DNA, 20 bp, Homo sapiens
atggtggactcgcctgtaat

SEQ ID NO: 2453476 - DNA, 15 bp, Homo sapiens
atggtgttctcctgc

SEQ ID NO: 2453477 - DNA, 18 bp, Homo sapiens
atggttctggctgtttga

SEQ ID NO: 2453478 - DNA, 19 bp, Homo sapiens
atggttctggctgtttgag

SEQ ID NO: 2453479 - DNA, 13 bp, Homo sapiens
atggtttcagcac

SEQ ID NO: 2453480 - DNA, 15 bp, Homo sapiens
atggtttcagcacta

SEQ ID NO: 2453481 - DNA, 20 bp, Homo sapiens
atggttttctccaagagcta

SEQ ID NO: 2453482 - DNA, 17 bp, Homo sapiens
atggtttttgagatatt

SEQ ID NO: 2453483 - DNA, 18 bp, Homo sapiens
atggtttttgagatatta

SEQ ID NO: 2453484 - DNA, 21 bp, Homo sapiens
atgtaaaacatttattttgac

SEQ ID NO: 2453485 - DNA, 17 bp, Homo sapiens
atgtaaaagaaaatcca

SEQ ID NO: 2453486 - DNA, 14 bp, Homo sapiens
atgtaaaatcttgt

SEQ ID NO: 2453487 - DNA, 15 bp, Homo sapiens
atgtaaaatcttgtc

SEQ ID NO: 2453488 - DNA, 16 bp, Homo sapiens
atgtaaaatcttgtca

SEQ ID NO: 2453489 - DNA, 20 bp, Homo sapiens
atgtaaaatcttgtcatgtg

SEQ ID NO: 2453490 - DNA, 21 bp, Homo sapiens
atgtaaaatcttgtcatgtgt

SEQ ID NO: 2453491 - DNA, 23 bp, Homo sapiens
atgtaaaatcttgtcatgtgtat

SEQ ID NO: 2453492 - DNA, 13 bp, Homo sapiens
atgtaaagacaaa

SEQ ID NO: 2453493 - DNA, 17 bp, Homo sapiens
atgtaaagatcaataaa

SEQ ID NO: 2453494 - DNA, 13 bp, Homo sapiens
atgtaaatatttt

SEQ ID NO: 2453495 - DNA, 23 bp, Homo sapiens
atgtaaatattttaaagaattgt

SEQ ID NO: 2453496 - DNA, 23 bp, Homo sapiens
atgtaaattatcaggcaaatttg

SEQ ID NO: 2453497 - DNA, 14 bp, Homo sapiens
atgtaaattatgta

SEQ ID NO: 2453498 - DNA, 15 bp, Homo sapiens
atgtaaatttgtact

SEQ ID NO: 2453499 - DNA, 18 bp, Homo sapiens
atgtaactgcctagaaac

SEQ ID NO: 2453500 - DNA, 17 bp, Homo sapiens
atgtaagattatagatt

SEQ ID NO: 2453501 - DNA, 20 bp, Homo sapiens
atgtaagattatagattcta

SEQ ID NO: 2453502 - DNA, 24 bp, Homo sapiens
atgtaagattatagattctaaaga

SEQ ID NO: 2453503 - DNA, 15 bp, Homo sapiens
atgtaataaacttta

SEQ ID NO: 2453504 - DNA, 16 bp, Homo sapiens
atgtaattttgtgtaa

SEQ ID NO: 2453505 - DNA, 14 bp, Homo sapiens
atgtacattaatta

SEQ ID NO: 2453506 - DNA, 21 bp, Homo sapiens
atgtaccatgtacatgaagaa

SEQ ID NO: 2453507 - DNA, 16 bp, Homo sapiens
atgtacccaccgggcc

SEQ ID NO: 2453508 - DNA, 18 bp, Homo sapiens
atgtacggattttcagtt

SEQ ID NO: 2453509 - DNA, 13 bp, Homo sapiens
atgtaggagggac

SEQ ID NO: 2453510 - DNA, 12 bp, Homo sapiens
atgtagtaacac

SEQ ID NO: 2453511 - DNA, 15 bp, Homo sapiens
atgtagtaacactaa

SEQ ID NO: 2453512 - DNA, 16 bp, Homo sapiens
atgtagtaacactaat

SEQ ID NO: 2453513 - DNA, 12 bp, Homo sapiens
atgtagtatttt

SEQ ID NO: 2453514 - DNA, 19 bp, Homo sapiens
atgtatgcatgttgtctaa

SEQ ID NO: 2453515 - DNA, 22 bp, Homo sapiens
atgtatggtgcaatgtgtgtat

SEQ ID NO: 2453516 - DNA, 22 bp, Homo sapiens
atgtattgcacattgtaaaaag

SEQ ID NO: 2453517 - DNA, 17 bp, Homo sapiens
atgtatttataaatata

SEQ ID NO: 2453518 - DNA, 22 bp, Homo sapiens
atgtcaagggttcaagattgtt

SEQ ID NO: 2453519 - DNA, 14 bp, Homo sapiens
atgtcatacagaga

SEQ ID NO: 2453520 - DNA, 17 bp, Homo sapiens
atgtcatacagagaagt

SEQ ID NO: 2453521 - DNA, 14 bp, Homo sapiens
atgtcatgctgcct

SEQ ID NO: 2453522 - DNA, 16 bp, Homo sapiens
atgtcatttcagaagt

SEQ ID NO: 2453523 - DNA, 18 bp, Homo sapiens
atgtccaaagaggctgcc

SEQ ID NO: 2453524 - DNA, 19 bp, Homo sapiens
atgtccaaagaggctgccc

SEQ ID NO: 2453525 - DNA, 20 bp, Homo sapiens
atgtccaaagaggctgcccc

SEQ ID NO: 2453526 - DNA, 22 bp, Homo sapiens
atgtccaaagaggctgcccctc

SEQ ID NO: 2453527 - DNA, 14 bp, Homo sapiens
atgtccatttacac

SEQ ID NO: 2453528 - DNA, 16 bp, Homo sapiens
atgtcctgcctattat

SEQ ID NO: 2453529 - DNA, 22 bp, Homo sapiens
atgtcctgcctattatctgtca

SEQ ID NO: 2453530 - DNA, 19 bp, Homo sapiens
atgtcgtggacacacacag

SEQ ID NO: 2453531 - DNA, 20 bp, Homo sapiens
atgtcgtggacacacacaga

SEQ ID NO: 2453532 - DNA, 18 bp, Homo sapiens
atgtctcctaagcacctg

SEQ ID NO: 2453533 - DNA, 20 bp, Homo sapiens
atgtctcctaagcacctgta

SEQ ID NO: 2453534 - DNA, 13 bp, Homo sapiens
atgtctggagacc

SEQ ID NO: 2453535 - DNA, 18 bp, Homo sapiens
atgtctggagaccaccag

SEQ ID NO: 2453536 - DNA, 23 bp, Homo sapiens
atgtctggagaccaccagggcat

SEQ ID NO: 2453537 - DNA, 15 bp, Homo sapiens
atgtcttctccctgg

SEQ ID NO: 2453538 - DNA, 15 bp, Homo sapiens
atgtcttgagctcta

SEQ ID NO: 2453539 - DNA, 20 bp, Homo sapiens
atgtcttggaacattggaat

SEQ ID NO: 2453540 - DNA, 10 bp, Homo sapiens
atgtcttgtg

SEQ ID NO: 2453541 - DNA, 11 bp, Homo sapiens
atgtcttgtgt

SEQ ID NO: 2453542 - DNA, 23 bp, Homo sapiens
atgtgaaatttacatcatttctt

SEQ ID NO: 2453543 - DNA, 12 bp, Homo sapiens
atgtgaagcctt

SEQ ID NO: 2453544 - DNA, 15 bp, Homo sapiens
atgtgaagccttccc

SEQ ID NO: 2453545 - DNA, 17 bp, Homo sapiens
atgtgatatataagtgt

SEQ ID NO: 2453546 - DNA, 22 bp, Homo sapiens
atgtgatatataagtgtacata

SEQ ID NO: 2453547 - DNA, 23 bp, Homo sapiens
atgtgatatataagtgtacatat

SEQ ID NO: 2453548 - DNA, 14 bp, Homo sapiens
atgtgatgttctaa

SEQ ID NO: 2453549 - DNA, 22 bp, Homo sapiens
atgtgattgtggaatggagatt

SEQ ID NO: 2453550 - DNA, 13 bp, Homo sapiens
atgtgcaatagaa

SEQ ID NO: 2453551 - DNA, 21 bp, Homo sapiens
atgtgccagggcaatgatgaa

SEQ ID NO: 2453552 - DNA, 17 bp, Homo sapiens
atgtggaactgctgcca

SEQ ID NO: 2453553 - DNA, 20 bp, Homo sapiens
atgtggctggaagatcctgc

SEQ ID NO: 2453554 - DNA, 13 bp, Homo sapiens
atgtgggattatg

SEQ ID NO: 2453555 - DNA, 14 bp, Homo sapiens
atgtgggattatgg

SEQ ID NO: 2453556 - DNA, 17 bp, Homo sapiens
atgtgggttccacagac

SEQ ID NO: 2453557 - DNA, 16 bp, Homo sapiens
atgtggtcacagctgt

SEQ ID NO: 2453558 - DNA, 19 bp, Homo sapiens
atgtggtcacagctgtata

SEQ ID NO: 2453559 - DNA, 22 bp, Homo sapiens
atgtggtcacagctgtatagct

SEQ ID NO: 2453560 - DNA, 19 bp, Homo sapiens
atgtgtagttcatgtaaat

SEQ ID NO: 2453561 - DNA, 14 bp, Homo sapiens
atgtgtataaacaa

SEQ ID NO: 2453562 - DNA, 12 bp, Homo sapiens
atgtgtcccaga

SEQ ID NO: 2453563 - DNA, 14 bp, Homo sapiens
atgtgtcccagaag

SEQ ID NO: 2453564 - DNA, 16 bp, Homo sapiens
atgtgtcccagaagat

SEQ ID NO: 2453565 - DNA, 14 bp, Homo sapiens
atgtgtcctgacac

SEQ ID NO: 2453566 - DNA, 13 bp, Homo sapiens
atgtgtcctggtt

SEQ ID NO: 2453567 - DNA, 16 bp, Homo sapiens
atgtgtgtatatggac

SEQ ID NO: 2453568 - DNA, 22 bp, Homo sapiens
atgtgtgtccacgactgtctcc

SEQ ID NO: 2453569 - DNA, 23 bp, Homo sapiens
atgtgtgtccacgactgtctcca

SEQ ID NO: 2453570 - DNA, 16 bp, Homo sapiens
atgtgtgttgatactg

SEQ ID NO: 2453571 - DNA, 17 bp, Homo sapiens
atgtgtgttgatactgt

SEQ ID NO: 2453572 - DNA, 21 bp, Homo sapiens
atgtgtgttgatactgttgca

SEQ ID NO: 2453573 - DNA, 22 bp, Homo sapiens
atgtgttggggaagggcctgcc

SEQ ID NO: 2453574 - DNA, 22 bp, Homo sapiens
atgtgtttcacagtttgaaata

SEQ ID NO: 2453575 - DNA, 15 bp, Homo sapiens
atgtgtttgctttct

SEQ ID NO: 2453576 - DNA, 19 bp, Homo sapiens
atgttaaaaaaataagaag

SEQ ID NO: 2453577 - DNA, 15 bp, Homo sapiens
atgttaaaatgtgtt

SEQ ID NO: 2453578 - DNA, 14 bp, Homo sapiens
atgttacattatta

SEQ ID NO: 2453579 - DNA, 23 bp, Homo sapiens
atgttagttaccttatagttact

SEQ ID NO: 2453580 - DNA, 17 bp, Homo sapiens
atgttatatataaatat

SEQ ID NO: 2453581 - DNA, 19 bp, Homo sapiens
atgttatatataaatatat

SEQ ID NO: 2453582 - DNA, 15 bp, Homo sapiens
atgttatcttctcaa

SEQ ID NO: 2453583 - DNA, 23 bp, Homo sapiens
atgttcaaagtcaaataactcct

SEQ ID NO: 2453584 - DNA, 14 bp, Homo sapiens
atgttcacttttga

SEQ ID NO: 2453585 - DNA, 11 bp, Homo sapiens
atgttccttcc

SEQ ID NO: 2453586 - DNA, 17 bp, Homo sapiens
atgttctaacctttaca

SEQ ID NO: 2453587 - DNA, 20 bp, Homo sapiens
atgttctaaggctctgagag

SEQ ID NO: 2453588 - DNA, 19 bp, Homo sapiens
atgttctaagtctttccat

SEQ ID NO: 2453589 - DNA, 13 bp, Homo sapiens
atgttctaagttt

SEQ ID NO: 2453590 - DNA, 20 bp, Homo sapiens
atgttctaagtttctaagat

SEQ ID NO: 2453591 - DNA, 21 bp, Homo sapiens
atgttctaagtttctaagatt

SEQ ID NO: 2453592 - DNA, 13 bp, Homo sapiens
atgttctgtccct

SEQ ID NO: 2453593 - DNA, 23 bp, Homo sapiens
atgttctgtcccttgcccccctg

SEQ ID NO: 2453594 - DNA, 13 bp, Homo sapiens
atgttctgtttgc

SEQ ID NO: 2453595 - DNA, 16 bp, Homo sapiens
atgttctgtttgctgt

SEQ ID NO: 2453596 - DNA, 19 bp, Homo sapiens
atgttgaatactttttaca

SEQ ID NO: 2453597 - DNA, 20 bp, Homo sapiens
atgttgctgaaaaatgggca

SEQ ID NO: 2453598 - DNA, 17 bp, Homo sapiens
atgttggacacctttag

SEQ ID NO: 2453599 - DNA, 14 bp, Homo sapiens
atgttgtaagcaac

SEQ ID NO: 2453600 - DNA, 19 bp, Homo sapiens
atgtttacactctttgtaa

SEQ ID NO: 2453601 - DNA, 17 bp, Homo sapiens
atgtttagactttaaca

SEQ ID NO: 2453602 - DNA, 21 bp, Homo sapiens
atgtttagactttaacataag

SEQ ID NO: 2453603 - DNA, 14 bp, Homo sapiens
atgtttatctgctt

SEQ ID NO: 2453604 - DNA, 19 bp, Homo sapiens
atgtttattcttctagagt

SEQ ID NO: 2453605 - DNA, 21 bp, Homo sapiens
atgtttcaagaggagccccca

SEQ ID NO: 2453606 - DNA, 19 bp, Homo sapiens
atgtttccagcattcccag

SEQ ID NO: 2453607 - DNA, 20 bp, Homo sapiens
atgtttccagcattcccagg

SEQ ID NO: 2453608 - DNA, 20 bp, Homo sapiens
atgtttcctctagttctttg

SEQ ID NO: 2453609 - DNA, 15 bp, Homo sapiens
atgtttcttctaggt

SEQ ID NO: 2453610 - DNA, 22 bp, Homo sapiens
atgtttcttctaggttctaaaa

SEQ ID NO: 2453611 - DNA, 21 bp, Homo sapiens
atgtttgatagattttctgct

SEQ ID NO: 2453612 - DNA, 18 bp, Homo sapiens
atgttttcgaaaatcaaa

SEQ ID NO: 2453613 - DNA, 20 bp, Homo sapiens
atgttttctgaaaatataac

SEQ ID NO: 2453614 - DNA, 23 bp, Homo sapiens
agttctgtggtttcatgttagtt

SEQ ID NO: 2453615 - DNA, 17 bp, Homo sapiens
agttctttaaaatgtaa

SEQ ID NO: 2453616 - DNA, 21 bp, Homo sapiens
agttctttgggccagacatgc

SEQ ID NO: 2453617 - DNA, 22 bp, Homo sapiens
agttctttgttcatagcccagt

SEQ ID NO: 2453618 - DNA, 19 bp, Homo sapiens
agttctttttgaagtattt

SEQ ID NO: 2453619 - DNA, 14 bp, Homo sapiens
agttgaagcaaatc

SEQ ID NO: 2453620 - DNA, 12 bp, Homo sapiens
agttgaatattg

SEQ ID NO: 2453621 - DNA, 21 bp, Homo sapiens
agttgaattttttttaacatt

SEQ ID NO: 2453622 - DNA, 22 bp, Homo sapiens
agttgaattttttttaacattc

SEQ ID NO: 2453623 - DNA, 23 bp, Homo sapiens
agttgaattttttttaacattcc

SEQ ID NO: 2453624 - DNA, 17 bp, Homo sapiens
agttgagacaagaaaat

SEQ ID NO: 2453625 - DNA, 15 bp, Homo sapiens
agttgaggacttctt

SEQ ID NO: 2453626 - DNA, 16 bp, Homo sapiens
agttgaggacttcttg

SEQ ID NO: 2453627 - DNA, 23 bp, Homo sapiens
agttgataaagattttttaataa

SEQ ID NO: 2453628 - DNA, 18 bp, Homo sapiens
agttgatctggaacccag

SEQ ID NO: 2453629 - DNA, 21 bp, Homo sapiens
agttgatctggaacccagact

SEQ ID NO: 2453630 - DNA, 23 bp, Homo sapiens
agttgatttttttttttttttcc

SEQ ID NO: 2453631 - DNA, 17 bp, Homo sapiens
agttgcagctgttttgt

SEQ ID NO: 2453632 - DNA, 21 bp, Homo sapiens
agttgcatgtagtaacactaa

SEQ ID NO: 2453633 - DNA, 13 bp, Homo sapiens
agttgcttttcag

SEQ ID NO: 2453634 - DNA, 15 bp, Homo sapiens
agttggcttacctgg

SEQ ID NO: 2453635 - DNA, 20 bp, Homo sapiens
agttgtatttaacagaaatt

SEQ ID NO: 2453636 - DNA, 23 bp, Homo sapiens
agttgtatttaacagaaattgta

SEQ ID NO: 2453637 - DNA, 20 bp, Homo sapiens
agttgtcccgattgtaactc

SEQ ID NO: 2453638 - DNA, 12 bp, Homo sapiens
agttgtctctga

SEQ ID NO: 2453639 - DNA, 22 bp, Homo sapiens
agttgtctctgatgcagcttat

SEQ ID NO: 2453640 - DNA, 21 bp, Homo sapiens
agttgtgtctggcagtttata

SEQ ID NO: 2453641 - DNA, 15 bp, Homo sapiens
agttgttagattaag

SEQ ID NO: 2453642 - DNA, 23 bp, Homo sapiens
agttgttcgggccaaggacctga

SEQ ID NO: 2453643 - DNA, 17 bp, Homo sapiens
agtttaataaatttatt

SEQ ID NO: 2453644 - DNA, 21 bp, Homo sapiens
agtttagggaacaatttggca

SEQ ID NO: 2453645 - DNA, 16 bp, Homo sapiens
agtttatatttaactc

SEQ ID NO: 2453646 - DNA, 14 bp, Homo sapiens
agtttatcattcaa

SEQ ID NO: 2453647 - DNA, 22 bp, Homo sapiens
agtttcacagaaaataaggcac

SEQ ID NO: 2453648 - DNA, 16 bp, Homo sapiens
agtttcatataaagta

SEQ ID NO: 2453649 - DNA, 21 bp, Homo sapiens
agtttcatgtacaagatgaag

SEQ ID NO: 2453650 - DNA, 18 bp, Homo sapiens
agtttcctttttaatatg

SEQ ID NO: 2453651 - DNA, 16 bp, Homo sapiens
agtttctaaactggag

SEQ ID NO: 2453652 - DNA, 17 bp, Homo sapiens
agtttctaaactggaga

SEQ ID NO: 2453653 - DNA, 16 bp, Homo sapiens
agtttctaagattcta

SEQ ID NO: 2453654 - DNA, 11 bp, Homo sapiens
agtttctaagg

SEQ ID NO: 2453655 - DNA, 22 bp, Homo sapiens
agtttctgtcgttaaaaacaga

SEQ ID NO: 2453656 - DNA, 14 bp, Homo sapiens
agtttgattattca

SEQ ID NO: 2453657 - DNA, 17 bp, Homo sapiens
agtttggatatgtaaaa

SEQ ID NO: 2453658 - DNA, 16 bp, Homo sapiens
agtttgtgtgtcttaa

SEQ ID NO: 2453659 - DNA, 14 bp, Homo sapiens
agtttgtgtgttgt

SEQ ID NO: 2453660 - DNA, 13 bp, Homo sapiens
agttttaactgtg

SEQ ID NO: 2453661 - DNA, 15 bp, Homo sapiens
agttttatcattttc

SEQ ID NO: 2453662 - DNA, 20 bp, Homo sapiens
agttttccatggcaggaagg

SEQ ID NO: 2453663 - DNA, 17 bp, Homo sapiens
agttttttattatgcat

SEQ ID NO: 2453664 - DNA, 20 bp, Homo sapiens
agttttttcatcttcagttg

SEQ ID NO: 2453665 - DNA, 23 bp, Homo sapiens
agttttttcatcttcagttgtct

SEQ ID NO: 2453666 - DNA, 22 bp, Homo sapiens
agttttttgaaaatgggctcaa

SEQ ID NO: 2453667 - DNA, 19 bp, Homo sapiens
agttttttttttcttgtct

SEQ ID NO: 2453668 - DNA, 11 bp, Homo sapiens
ataaaaaagat

SEQ ID NO: 2453669 - DNA, 15 bp, Homo sapiens
ataaaaaagatccca

SEQ ID NO: 2453670 - DNA, 16 bp, Homo sapiens
ataaaaaagatcccaa

SEQ ID NO: 2453671 - DNA, 17 bp, Homo sapiens
ataaaaaagatcccaaa

SEQ ID NO: 2453672 - DNA, 14 bp, Homo sapiens
ataaaaagaaaggc

SEQ ID NO: 2453673 - DNA, 14 bp, Homo sapiens
ataaaaataaaaaa

SEQ ID NO: 2453674 - DNA, 16 bp, Homo sapiens
ataaaaatgatctaaa

SEQ ID NO: 2453675 - DNA, 12 bp, Homo sapiens
ataaaacaggta

SEQ ID NO: 2453676 - DNA, 20 bp, Homo sapiens
ataaaacatctttgaaatta

SEQ ID NO: 2453677 - DNA, 17 bp, Homo sapiens
ataaaagataaattatt

SEQ ID NO: 2453678 - DNA, 20 bp, Homo sapiens
ataaaagatgaaagagcagt

SEQ ID NO: 2453679 - DNA, 19 bp, Homo sapiens
ataaaaggaagccaaagag

SEQ ID NO: 2453680 - DNA, 23 bp, Homo sapiens
ataaaataatgggattttctttt

SEQ ID NO: 2453681 - DNA, 16 bp, Homo sapiens
ataaaatttgttgcat

SEQ ID NO: 2453682 - DNA, 17 bp, Homo sapiens
ataaacaagaaaaataa

SEQ ID NO: 2453683 - DNA, 20 bp, Homo sapiens
ataaactttaatataaagta

SEQ ID NO: 2453684 - DNA, 22 bp, Homo sapiens
ataaactttaatataaagtagt

SEQ ID NO: 2453685 - DNA, 13 bp, Homo sapiens
ataaagaaaagat

SEQ ID NO: 2453686 - DNA, 15 bp, Homo sapiens
ataaagaaaagatgc

SEQ ID NO: 2453687 - DNA, 16 bp, Homo sapiens
ataaagaaaagatgca

SEQ ID NO: 2453688 - DNA, 20 bp, Homo sapiens
ataaagacgttttataagca

SEQ ID NO: 2453689 - DNA, 21 bp, Homo sapiens
ataaagacgttttataagcat

SEQ ID NO: 2453690 - DNA, 13 bp, Homo sapiens
ataaagatttttt

SEQ ID NO: 2453691 - DNA, 21 bp, Homo sapiens
ataaagattttttaataattt

SEQ ID NO: 2453692 - DNA, 14 bp, Homo sapiens
ataaagcatttaac

SEQ ID NO: 2453693 - DNA, 15 bp, Homo sapiens
ataaaggaaaagaca

SEQ ID NO: 2453694 - DNA, 21 bp, Homo sapiens
ataaaggatgtgattgtggaa

SEQ ID NO: 2453695 - DNA, 16 bp, Homo sapiens
ataaaggcagttttct

SEQ ID NO: 2453696 - DNA, 16 bp, Homo sapiens
ataaagtagtcctgtg

SEQ ID NO: 2453697 - DNA, 14 bp, Homo sapiens
ataaagtatcatca

SEQ ID NO: 2453698 - DNA, 16 bp, Homo sapiens
ataaagttgataaaga

SEQ ID NO: 2453699 - DNA, 21 bp, Homo sapiens
ataaagttgataaagattttt

SEQ ID NO: 2453700 - DNA, 22 bp, Homo sapiens
ataaagttttatatattatatg

SEQ ID NO: 2453701 - DNA, 18 bp, Homo sapiens
ataaatactgcaaatcag

SEQ ID NO: 2453702 - DNA, 13 bp, Homo sapiens
ataaatatatcta

SEQ ID NO: 2453703 - DNA, 12 bp, Homo sapiens
ataaatatatta

SEQ ID NO: 2453704 - DNA, 18 bp, Homo sapiens
ataaatatattattactt

SEQ ID NO: 2453705 - DNA, 23 bp, Homo sapiens
ataaatatattattacttgtaaa

SEQ ID NO: 2453706 - DNA, 19 bp, Homo sapiens
ataaattattgtttttctt

SEQ ID NO: 2453707 - DNA, 19 bp, Homo sapiens
ataaattgatttttataaa

SEQ ID NO: 2453708 - DNA, 12 bp, Homo sapiens
ataaatttgact

SEQ ID NO: 2453709 - DNA, 21 bp, Homo sapiens
ataaatttgacttttctgtaa

SEQ ID NO: 2453710 - DNA, 12 bp, Homo sapiens
ataaccactgct

SEQ ID NO: 2453711 - DNA, 22 bp, Homo sapiens
ataacctgtctcacctggactt

SEQ ID NO: 2453712 - DNA, 18 bp, Homo sapiens
ataacgtgttcaatattt

SEQ ID NO: 2453713 - DNA, 15 bp, Homo sapiens
ataactaacatgtcc

SEQ ID NO: 2453714 - DNA, 18 bp, Homo sapiens
ataactcctcccagggtt

SEQ ID NO: 2453715 - DNA, 14 bp, Homo sapiens
ataactgaaaatta

SEQ ID NO: 2453716 - DNA, 14 bp, Homo sapiens
ataactgaacatcc

SEQ ID NO: 2453717 - DNA, 17 bp, Homo sapiens
ataactggaaaacagaa

SEQ ID NO: 2453718 - DNA, 20 bp, Homo sapiens
atactttttacaattaaaaa

SEQ ID NO: 2453719 - DNA, 16 bp, Homo sapiens
atagaaatgccaagca

SEQ ID NO: 2453720 - DNA, 19 bp, Homo sapiens
atagaaatgccaagcactt

SEQ ID NO: 2453721 - DNA, 20 bp, Homo sapiens
atagaataaaggcagttttc

SEQ ID NO: 2453722 - DNA, 16 bp, Homo sapiens
atagacaaatagaaaa

SEQ ID NO: 2453723 - DNA, 19 bp, Homo sapiens
atagacaaatagaaaatgg

SEQ ID NO: 2453724 - DNA, 16 bp, Homo sapiens
atagacagaagaaaca

SEQ ID NO: 2453725 - DNA, 17 bp, Homo sapiens
atagacagaagaaacaa

SEQ ID NO: 2453726 - DNA, 19 bp, Homo sapiens
atagacagaagaaacaagg

SEQ ID NO: 2453727 - DNA, 15 bp, Homo sapiens
atagacagcatgaga

SEQ ID NO: 2453728 - DNA, 15 bp, Homo sapiens
atagacttaaatctc

SEQ ID NO: 2453729 - DNA, 14 bp, Homo sapiens
atagagctgtatta

SEQ ID NO: 2453730 - DNA, 21 bp, Homo sapiens
atagataaaacatctttgaaa

SEQ ID NO: 2453731 - DNA, 14 bp, Homo sapiens
atagatgtcttttc

SEQ ID NO: 2453732 - DNA, 14 bp, Homo sapiens
atagattctaaaga

SEQ ID NO: 2453733 - DNA, 15 bp, Homo sapiens
atagattctaaagat

SEQ ID NO: 2453734 - DNA, 16 bp, Homo sapiens
atagattctaaagatt

SEQ ID NO: 2453735 - DNA, 13 bp, Homo sapiens
atagcaaagaatt

SEQ ID NO: 2453736 - DNA, 19 bp, Homo sapiens
atagcaatacttggagggc

SEQ ID NO: 2453737 - DNA, 17 bp, Homo sapiens
atagcacaggctaattt

SEQ ID NO: 2453738 - DNA, 13 bp, Homo sapiens
atagcagcctttc

SEQ ID NO: 2453739 - DNA, 13 bp, Homo sapiens
atagccacatttg

SEQ ID NO: 2453740 - DNA, 16 bp, Homo sapiens
atagccacatttggaa

SEQ ID NO: 2453741 - DNA, 21 bp, Homo sapiens
atagccacatttggaatactt

SEQ ID NO: 2453742 - DNA, 12 bp, Homo sapiens
atagccatattt

SEQ ID NO: 2453743 - DNA, 22 bp, Homo sapiens
atagccatatttgtaaaatgac

SEQ ID NO: 2453744 - DNA, 23 bp, Homo sapiens
atagccatatttgtaaaatgaca

SEQ ID NO: 2453745 - DNA, 13 bp, Homo sapiens
atagcccacttac

SEQ ID NO: 2453746 - DNA, 14 bp, Homo sapiens
atagccctgtcctg

SEQ ID NO: 2453747 - DNA, 13 bp, Homo sapiens
atagctaaatacc

SEQ ID NO: 2453748 - DNA, 12 bp, Homo sapiens
atagctctgggg

SEQ ID NO: 2453749 - DNA, 15 bp, Homo sapiens
atagctgcttccagt

SEQ ID NO: 2453750 - DNA, 12 bp, Homo sapiens
atagctgtgact

SEQ ID NO: 2453751 - DNA, 18 bp, Homo sapiens
atagcttatgaaaagaat

SEQ ID NO: 2453752 - DNA, 14 bp, Homo sapiens
ataggacctttcca

SEQ ID NO: 2453753 - DNA, 23 bp, Homo sapiens
ataggacctttccaccacagcca

SEQ ID NO: 2453754 - DNA, 21 bp, Homo sapiens
ataggatttatttaaaatagc

SEQ ID NO: 2453755 - DNA, 23 bp, Homo sapiens
ataggatttatttaaaatagcaa

SEQ ID NO: 2453756 - DNA, 13 bp, Homo sapiens
ataggcaggaagc

SEQ ID NO: 2453757 - DNA, 18 bp, Homo sapiens
ataggtctcatctcttca

SEQ ID NO: 2453758 - DNA, 19 bp, Homo sapiens
ataggtctcatctcttcag

SEQ ID NO: 2453759 - DNA, 14 bp, Homo sapiens
ataggtctgaaatt

SEQ ID NO: 2453760 - DNA, 23 bp, Homo sapiens
ataggtgatccatgtaactgcct

SEQ ID NO: 2453761 - DNA, 12 bp, Homo sapiens
ataggtttagag

SEQ ID NO: 2453762 - DNA, 19 bp, Homo sapiens
atagtaaatcacgcttttt

SEQ ID NO: 2453763 - DNA, 19 bp, Homo sapiens
atagtaacttcttatggaa

SEQ ID NO: 2453764 - DNA, 17 bp, Homo sapiens
atagtaccaatcatttt

SEQ ID NO: 2453765 - DNA, 13 bp, Homo sapiens
atagtgaatactg

SEQ ID NO: 2453766 - DNA, 14 bp, Homo sapiens
atagttaacacact

SEQ ID NO: 2453767 - DNA, 15 bp, Homo sapiens
atagttaacacacta

SEQ ID NO: 2453768 - DNA, 17 bp, Homo sapiens
atagttaacacactacc

SEQ ID NO: 2453769 - DNA, 18 bp, Homo sapiens
atagttactgtgtaatta

SEQ ID NO: 2453770 - DNA, 15 bp, Homo sapiens
atagttagaacctgg

SEQ ID NO: 2453771 - DNA, 18 bp, Homo sapiens
atagtttggatatgtaaa

SEQ ID NO: 2453772 - DNA, 20 bp, Homo sapiens
atagttttcatccataactg

SEQ ID NO: 2453773 - DNA, 23 bp, Homo sapiens
atagttttcatccataactgaac

SEQ ID NO: 2453774 - DNA, 16 bp, Homo sapiens
atataaagacgtttta

SEQ ID NO: 2453775 - DNA, 24 bp, Homo sapiens
atataaagtatcatcagtgtagaa

SEQ ID NO: 2453776 - DNA, 17 bp, Homo sapiens
atataaagttttatata

SEQ ID NO: 2453777 - DNA, 16 bp, Homo sapiens
atataaatatatattc

SEQ ID NO: 2453778 - DNA, 17 bp, Homo sapiens
atataactgtatttgaa

SEQ ID NO: 2453779 - DNA, 20 bp, Homo sapiens
atataactgtatttgaaata

SEQ ID NO: 2453780 - DNA, 15 bp, Homo sapiens
atataagtgtacata

SEQ ID NO: 2453781 - DNA, 17 bp, Homo sapiens
atataatcatcaagtaa

SEQ ID NO: 2453782 - DNA, 14 bp, Homo sapiens
atataattatatgt

SEQ ID NO: 2453783 - DNA, 15 bp, Homo sapiens
atataattatatgtt

SEQ ID NO: 2453784 - DNA, 22 bp, Homo sapiens
atatactattaaaaaggtttac

SEQ ID NO: 2453785 - DNA, 22 bp, Homo sapiens
atatactctagatgaagtttta

SEQ ID NO: 2453786 - DNA, 17 bp, Homo sapiens
atatagttagctaataa

SEQ ID NO: 2453787 - DNA, 20 bp, Homo sapiens
atatataagtgtacatatgt

SEQ ID NO: 2453788 - DNA, 14 bp, Homo sapiens
atatatactattaa

SEQ ID NO: 2453789 - DNA, 14 bp, Homo sapiens
atatatataaatat

SEQ ID NO: 2453790 - DNA, 23 bp, Homo sapiens
atatatattctattacattttca

SEQ ID NO: 2453791 - DNA, 17 bp, Homo sapiens
atatatcacccagacat

SEQ ID NO: 2453792 - DNA, 15 bp, Homo sapiens
atatatcatgagtga

SEQ ID NO: 2453793 - DNA, 17 bp, Homo sapiens
atatattatacttgtaa

SEQ ID NO: 2453794 - DNA, 14 bp, Homo sapiens
atatattatatgga

SEQ ID NO: 2453795 - DNA, 16 bp, Homo sapiens
atatattatatggaaa

SEQ ID NO: 2453796 - DNA, 20 bp, Homo sapiens
atatattatatggaaatata

SEQ ID NO: 2453797 - DNA, 13 bp, Homo sapiens
atatattatcttt

SEQ ID NO: 2453798 - DNA, 13 bp, Homo sapiens
atatcacagaaaa

SEQ ID NO: 2453799 - DNA, 14 bp, Homo sapiens
atatcacccagaca

SEQ ID NO: 2453800 - DNA, 16 bp, Homo sapiens
atatcacccagacata

SEQ ID NO: 2453801 - DNA, 19 bp, Homo sapiens
atatcacccagacataaag

SEQ ID NO: 2453802 - DNA, 22 bp, Homo sapiens
atatcacccagacataaaggaa

SEQ ID NO: 2453803 - DNA, 15 bp, Homo sapiens
atatccctacatgta

SEQ ID NO: 2453804 - DNA, 20 bp, Homo sapiens
atatccctcctgttgggaga

SEQ ID NO: 2453805 - DNA, 13 bp, Homo sapiens
atatcctaaacat

SEQ ID NO: 2453806 - DNA, 13 bp, Homo sapiens
atatcctgcttga

SEQ ID NO: 2453807 - DNA, 21 bp, Homo sapiens
atatctaccccagactagatg

SEQ ID NO: 2453808 - DNA, 19 bp, Homo sapiens
atatctggcctctgctttc

SEQ ID NO: 2453809 - DNA, 15 bp, Homo sapiens
atatctgtaatggta

SEQ ID NO: 2453810 - DNA, 16 bp, Homo sapiens
atatctgtaatggtac

SEQ ID NO: 2453811 - DNA, 16 bp, Homo sapiens
atatgaagacataaac

SEQ ID NO: 2453812 - DNA, 16 bp, Homo sapiens
atatgatctgtctgtg

SEQ ID NO: 2453813 - DNA, 21 bp, Homo sapiens
atatgatgttaaaaaaataag

SEQ ID NO: 2453814 - DNA, 14 bp, Homo sapiens
atatgcacttataa

SEQ ID NO: 2453815 - DNA, 18 bp, Homo sapiens
atatgcttaaaataagca

SEQ ID NO: 2453816 - DNA, 15 bp, Homo sapiens
atatggaaatatata

SEQ ID NO: 2453817 - DNA, 22 bp, Homo sapiens
atatggacaaaacaagaaagac

SEQ ID NO: 2453818 - DNA, 15 bp, Homo sapiens
atatggacacttaat

SEQ ID NO: 2453819 - DNA, 23 bp, Homo sapiens
atatggccacagtagtcttgatg

SEQ ID NO: 2453820 - DNA, 13 bp, Homo sapiens
atatgtaaaacat

SEQ ID NO: 2453821 - DNA, 15 bp, Homo sapiens
atatgtaaaacattt

SEQ ID NO: 2453822 - DNA, 24 bp, Homo sapiens
atatgtaaaacatttattttgaca

SEQ ID NO: 2453823 - DNA, 18 bp, Homo sapiens
atccagttttgtcaatgc

SEQ ID NO: 2453824 - DNA, 14 bp, Homo sapiens
atccatcatcatgt

SEQ ID NO: 2453825 - DNA, 18 bp, Homo sapiens
atccatcatcatgtgtgt

SEQ ID NO: 2453826 - DNA, 12 bp, Homo sapiens
atccatgcctca

SEQ ID NO: 2453827 - DNA, 18 bp, Homo sapiens
atccatttcccctccttc

SEQ ID NO: 2453828 - DNA, 20 bp, Homo sapiens
atcccaaagttgttgtaacc

SEQ ID NO: 2453829 - DNA, 18 bp, Homo sapiens
atcccagagagcccgagg

SEQ ID NO: 2453830 - DNA, 14 bp, Homo sapiens
atcccagccccctg

SEQ ID NO: 2453831 - DNA, 14 bp, Homo sapiens
atcccagctgccta

SEQ ID NO: 2453832 - DNA, 17 bp, Homo sapiens
atccccccatcttgctt

SEQ ID NO: 2453833 - DNA, 13 bp, Homo sapiens
atccccttctccc

SEQ ID NO: 2453834 - DNA, 21 bp, Homo sapiens
atccccttgaggtctcagccc

SEQ ID NO: 2453835 - DNA, 17 bp, Homo sapiens
atcccgagcacctccac

SEQ ID NO: 2453836 - DNA, 14 bp, Homo sapiens
atccctacatgtat

SEQ ID NO: 2453837 - DNA, 13 bp, Homo sapiens
atccctcacctgt

SEQ ID NO: 2453838 - DNA, 17 bp, Homo sapiens
atccctcaccttctgag

SEQ ID NO: 2453839 - DNA, 11 bp, Homo sapiens
atccctcatct

SEQ ID NO: 2453840 - DNA, 13 bp, Homo sapiens
atccctcatctgt

SEQ ID NO: 2453841 - DNA, 17 bp, Homo sapiens
atccctcatctgtccct

SEQ ID NO: 2453842 - DNA, 15 bp, Homo sapiens
atccctccccagttc

SEQ ID NO: 2453843 - DNA, 16 bp, Homo sapiens
atccctccccagttca

SEQ ID NO: 2453844 - DNA, 19 bp, Homo sapiens
atccctcccccccatgcac

SEQ ID NO: 2453845 - DNA, 12 bp, Homo sapiens
atccctcctgtt

SEQ ID NO: 2453846 - DNA, 10 bp, Homo sapiens
atccctggcc

SEQ ID NO: 2453847 - DNA, 11 bp, Homo sapiens
atccctggccc

SEQ ID NO: 2453848 - DNA, 14 bp, Homo sapiens
atccctgggcctgc

SEQ ID NO: 2453849 - DNA, 17 bp, Homo sapiens
atccctgggcctgctgc

SEQ ID NO: 2453850 - DNA, 20 bp, Homo sapiens
atccctgggcctgctgctga

SEQ ID NO: 2453851 - DNA, 16 bp, Homo sapiens
atcccttcatacttga

SEQ ID NO: 2453852 - DNA, 22 bp, Homo sapiens
atccggcaacatcaacccgagt

SEQ ID NO: 2453853 - DNA, 14 bp, Homo sapiens
atcctaaacatcat

SEQ ID NO: 2453854 - DNA, 22 bp, Homo sapiens
atcctaagggtcgaaagctcta

SEQ ID NO: 2453855 - DNA, 15 bp, Homo sapiens
atcctagatcctaag

SEQ ID NO: 2453856 - DNA, 21 bp, Homo sapiens
atcctatgcatggtttcagca

SEQ ID NO: 2453857 - DNA, 12 bp, Homo sapiens
atcctatgtttt

SEQ ID NO: 2453858 - DNA, 15 bp, Homo sapiens
atcctcaaagaaagt

SEQ ID NO: 2453859 - DNA, 16 bp, Homo sapiens
atcctcaaagaaagtg

SEQ ID NO: 2453860 - DNA, 21 bp, Homo sapiens
atcctcaaagaaagtgtattg

SEQ ID NO: 2453861 - DNA, 15 bp, Homo sapiens
atcctcaatccagct

SEQ ID NO: 2453862 - DNA, 11 bp, Homo sapiens
atcctccctgt

SEQ ID NO: 2453863 - DNA, 16 bp, Homo sapiens
atcctctcttcctctt

SEQ ID NO: 2453864 - DNA, 14 bp, Homo sapiens
atcctctttttcca

SEQ ID NO: 2453865 - DNA, 12 bp, Homo sapiens
atcctgcttgat

SEQ ID NO: 2453866 - DNA, 22 bp, Homo sapiens
atcctggacatgaagattcttt

SEQ ID NO: 2453867 - DNA, 18 bp, Homo sapiens
atcctgtattcagacaga

SEQ ID NO: 2453868 - DNA, 14 bp, Homo sapiens
atcctgtgtggaga

SEQ ID NO: 2453869 - DNA, 16 bp, Homo sapiens
atcctgtgtggagagg

SEQ ID NO: 2453870 - DNA, 19 bp, Homo sapiens
atcctgtgtgttaagctct

SEQ ID NO: 2453871 - DNA, 14 bp, Homo sapiens
atccttagatctgg

SEQ ID NO: 2453872 - DNA, 20 bp, Homo sapiens
atcctttcatatagttagct

SEQ ID NO: 2453873 - DNA, 15 bp, Homo sapiens
atcgccttccccacc

SEQ ID NO: 2453874 - DNA, 14 bp, Homo sapiens
atcggccacagggc

SEQ ID NO: 2453875 - DNA, 18 bp, Homo sapiens
atcgttctctctttgcat

SEQ ID NO: 2453876 - DNA, 14 bp, Homo sapiens
atcgttgcccccat

SEQ ID NO: 2453877 - DNA, 18 bp, Homo sapiens
atcgttttcttaaagtgc

SEQ ID NO: 2453878 - DNA, 22 bp, Homo sapiens
atctaaatatggactgctcagg

SEQ ID NO: 2453879 - DNA, 13 bp, Homo sapiens
atctaacctcatc

SEQ ID NO: 2453880 - DNA, 15 bp, Homo sapiens
atctaacctcatctt

SEQ ID NO: 2453881 - DNA, 17 bp, Homo sapiens
atctaagtgatataaat

SEQ ID NO: 2453882 - DNA, 20 bp, Homo sapiens
atctaccccagactagatgt

SEQ ID NO: 2453883 - DNA, 19 bp, Homo sapiens
atctacttctgtaattgtg

SEQ ID NO: 2453884 - DNA, 11 bp, Homo sapiens
atctataattt

SEQ ID NO: 2453885 - DNA, 16 bp, Homo sapiens
atctatagaactgaat

SEQ ID NO: 2453886 - DNA, 21 bp, Homo sapiens
atctataggaagattgaacct

SEQ ID NO: 2453887 - DNA, 22 bp, Homo sapiens
atctatcttaatactaaggaac

SEQ ID NO: 2453888 - DNA, 13 bp, Homo sapiens
atctatttttgga

SEQ ID NO: 2453889 - DNA, 21 bp, Homo sapiens
atctatttttggaggtttatt

SEQ ID NO: 2453890 - DNA, 18 bp, Homo sapiens
atctcaccaggcagcctc

SEQ ID NO: 2453891 - DNA, 13 bp, Homo sapiens
atctcaccccatc

SEQ ID NO: 2453892 - DNA, 14 bp, Homo sapiens
atctcaccccatcc

SEQ ID NO: 2453893 - DNA, 23 bp, Homo sapiens
atctcaccccatcccacaccctg

SEQ ID NO: 2453894 - DNA, 16 bp, Homo sapiens
atctcagaaagtgcct

SEQ ID NO: 2453895 - DNA, 20 bp, Homo sapiens
atctcagaaagtgcctgaca

SEQ ID NO: 2453896 - DNA, 18 bp, Homo sapiens
atctcaggccagagccaa

SEQ ID NO: 2453897 - DNA, 15 bp, Homo sapiens
atctcagtgaagaat

SEQ ID NO: 2453898 - DNA, 20 bp, Homo sapiens
atctcatctcagtgaagaat

SEQ ID NO: 2453899 - DNA, 21 bp, Homo sapiens
atctcatgcccctggctggga

SEQ ID NO: 2453900 - DNA, 17 bp, Homo sapiens
atctcattgcttacaag

SEQ ID NO: 2453901 - DNA, 19 bp, Homo sapiens
atctcattggacccttcca

SEQ ID NO: 2453902 - DNA, 20 bp, Homo sapiens
atctcattggacccttccat

SEQ ID NO: 2453903 - DNA, 16 bp, Homo sapiens
atctccagcggccctg

SEQ ID NO: 2453904 - DNA, 19 bp, Homo sapiens
atctcccacctagcagcac

SEQ ID NO: 2453905 - DNA, 20 bp, Homo sapiens
atctccctgagatgggcttc

SEQ ID NO: 2453906 - DNA, 13 bp, Homo sapiens
atctccctgcctc

SEQ ID NO: 2453907 - DNA, 18 bp, Homo sapiens
caagcctctgcccaggca

SEQ ID NO: 2453908 - DNA, 11 bp, Homo sapiens
caagcctgagg

SEQ ID NO: 2453909 - DNA, 21 bp, Homo sapiens
caagcctgagggaaaggccag

SEQ ID NO: 2453910 - DNA, 13 bp, Homo sapiens
caagcggtgtctc

SEQ ID NO: 2453911 - DNA, 15 bp, Homo sapiens
caagcggtgtctctc

SEQ ID NO: 2453912 - DNA, 21 bp, Homo sapiens
caagctaggtgctatttgtca

SEQ ID NO: 2453913 - DNA, 21 bp, Homo sapiens
caagctcactccccaaccccc

SEQ ID NO: 2453914 - DNA, 21 bp, Homo sapiens
caagctcagaggcgcactgtg

SEQ ID NO: 2453915 - DNA, 14 bp, Homo sapiens
caagctccaagccc

SEQ ID NO: 2453916 - DNA, 17 bp, Homo sapiens
caagctgaggtgcccag

SEQ ID NO: 2453917 - DNA, 19 bp, Homo sapiens
caagctgaggtgcccagga

SEQ ID NO: 2453918 - DNA, 15 bp, Homo sapiens
caagctgagtttcct

SEQ ID NO: 2453919 - DNA, 22 bp, Homo sapiens
caagctgagtttcctatgggaa

SEQ ID NO: 2453920 - DNA, 15 bp, Homo sapiens
caagcttctgagacg

SEQ ID NO: 2453921 - DNA, 13 bp, Homo sapiens
caagcttctgtcc

SEQ ID NO: 2453922 - DNA, 15 bp, Homo sapiens
caagcttctgtcctg

SEQ ID NO: 2453923 - DNA, 16 bp, Homo sapiens
caagcttctgtcctgc

SEQ ID NO: 2453924 - DNA, 18 bp, Homo sapiens
caagcttctgtcctgccc

SEQ ID NO: 2453925 - DNA, 14 bp, Homo sapiens
caaggacttcctgt

SEQ ID NO: 2453926 - DNA, 22 bp, Homo sapiens
caaggacttcctgtccagctcc

SEQ ID NO: 2453927 - DNA, 16 bp, Homo sapiens
caaggactttgtacat

SEQ ID NO: 2453928 - DNA, 18 bp, Homo sapiens
caaggagtatgcagggag

SEQ ID NO: 2453929 - DNA, 17 bp, Homo sapiens
caaggatagatgctggc

SEQ ID NO: 2453930 - DNA, 23 bp, Homo sapiens
caaggatagatgctggcccaggg

SEQ ID NO: 2453931 - DNA, 16 bp, Homo sapiens
caaggcactctagatt

SEQ ID NO: 2453932 - DNA, 17 bp, Homo sapiens
caaggcactctagattc

SEQ ID NO: 2453933 - DNA, 19 bp, Homo sapiens
caaggcactctagattcca

SEQ ID NO: 2453934 - DNA, 16 bp, Homo sapiens
caaggcagaggcctgg

SEQ ID NO: 2453935 - DNA, 14 bp, Homo sapiens
caaggcccgagcag

SEQ ID NO: 2453936 - DNA, 16 bp, Homo sapiens
caaggcccgagcagct

SEQ ID NO: 2453937 - DNA, 20 bp, Homo sapiens
caaggcccgagcagctgagc

SEQ ID NO: 2453938 - DNA, 15 bp, Homo sapiens
caagggaaaagtctc

SEQ ID NO: 2453939 - DNA, 16 bp, Homo sapiens
caagggaaaagtctct

SEQ ID NO: 2453940 - DNA, 15 bp, Homo sapiens
caagggaacctgtgt

SEQ ID NO: 2453941 - DNA, 14 bp, Homo sapiens
caagggaggctgct

SEQ ID NO: 2453942 - DNA, 20 bp, Homo sapiens
caagggctttgttttgcaca

SEQ ID NO: 2453943 - DNA, 15 bp, Homo sapiens
caaggggcctgagca

SEQ ID NO: 2453944 - DNA, 15 bp, Homo sapiens
caaggtaccatccta

SEQ ID NO: 2453945 - DNA, 20 bp, Homo sapiens
caaggtcctctgtcagtcac

SEQ ID NO: 2453946 - DNA, 13 bp, Homo sapiens
caaggtgtcctac

SEQ ID NO: 2453947 - DNA, 15 bp, Homo sapiens
caaggtgtcctacag

SEQ ID NO: 2453948 - DNA, 18 bp, Homo sapiens
caaggtgtcctacagaaa

SEQ ID NO: 2453949 - DNA, 18 bp, Homo sapiens
caaggtttaaagagtcta

SEQ ID NO: 2453950 - DNA, 18 bp, Homo sapiens
caaggttttaggttctaa

SEQ ID NO: 2453951 - DNA, 20 bp, Homo sapiens
caaggttttaggttctaaag

SEQ ID NO: 2453952 - DNA, 21 bp, Homo sapiens
caaggttttaggttctaaagt

SEQ ID NO: 2453953 - DNA, 18 bp, Homo sapiens
caagtatactagggagcc

SEQ ID NO: 2453954 - DNA, 16 bp, Homo sapiens
caagtatttgttaatt

SEQ ID NO: 2453955 - DNA, 22 bp, Homo sapiens
caagtatttgttaatttagaaa

SEQ ID NO: 2453956 - DNA, 15 bp, Homo sapiens
caagtatttttaatt

SEQ ID NO: 2453957 - DNA, 23 bp, Homo sapiens
caagtcagtccaggatgctaaca

SEQ ID NO: 2453958 - DNA, 20 bp, Homo sapiens
caagtcataggttaatattt

SEQ ID NO: 2453959 - DNA, 14 bp, Homo sapiens
caagtctgtttact

SEQ ID NO: 2453960 - DNA, 16 bp, Homo sapiens
caagtggactcagggc

SEQ ID NO: 2453961 - DNA, 17 bp, Homo sapiens
caagtggtccacaagct

SEQ ID NO: 2453962 - DNA, 16 bp, Homo sapiens
caagtgtaaaatattt

SEQ ID NO: 2453963 - DNA, 21 bp, Homo sapiens
caagtgtaaaatattttgaat

SEQ ID NO: 2453964 - DNA, 13 bp, Homo sapiens
caagttaaatgta

SEQ ID NO: 2453965 - DNA, 15 bp, Homo sapiens
caagttattaatttc

SEQ ID NO: 2453966 - DNA, 15 bp, Homo sapiens
caagttcgtctgttg

SEQ ID NO: 2453967 - DNA, 14 bp, Homo sapiens
caagttctaagatt

SEQ ID NO: 2453968 - DNA, 19 bp, Homo sapiens
caagttgttcgggccaagg

SEQ ID NO: 2453969 - DNA, 19 bp, Homo sapiens
caataactcctcccagggt

SEQ ID NO: 2453970 - DNA, 13 bp, Homo sapiens
caataatatattt

SEQ ID NO: 2453971 - DNA, 14 bp, Homo sapiens
caataatatatttt

SEQ ID NO: 2453972 - DNA, 16 bp, Homo sapiens
caatacaaatggattt

SEQ ID NO: 2453973 - DNA, 16 bp, Homo sapiens
caatacagatatattt

SEQ ID NO: 2453974 - DNA, 16 bp, Homo sapiens
caatagcacatatgga

SEQ ID NO: 2453975 - DNA, 17 bp, Homo sapiens
caatagccactaacctt

SEQ ID NO: 2453976 - DNA, 22 bp, Homo sapiens
caatagccactaaccttgcctg

SEQ ID NO: 2453977 - DNA, 23 bp, Homo sapiens
caatatctgaagccctcccaggt

SEQ ID NO: 2453978 - DNA, 14 bp, Homo sapiens
caatattaaatctg

SEQ ID NO: 2453979 - DNA, 16 bp, Homo sapiens
caatcaactttactgt

SEQ ID NO: 2453980 - DNA, 18 bp, Homo sapiens
caatcaagtctgtttact

SEQ ID NO: 2453981 - DNA, 16 bp, Homo sapiens
caatcaatcttgcatg

SEQ ID NO: 2453982 - DNA, 20 bp, Homo sapiens
caatccagtggacttcgcag

SEQ ID NO: 2453983 - DNA, 20 bp, Homo sapiens
caatccctcaccttctgagt

SEQ ID NO: 2453984 - DNA, 14 bp, Homo sapiens
caatcctatgcatg

SEQ ID NO: 2453985 - DNA, 18 bp, Homo sapiens
caatcctatgcatggttt

SEQ ID NO: 2453986 - DNA, 23 bp, Homo sapiens
caatcctatgcatggtttcagca

SEQ ID NO: 2453987 - DNA, 14 bp, Homo sapiens
caatcctatgtttt

SEQ ID NO: 2453988 - DNA, 20 bp, Homo sapiens
caatcctatgtttttgttca

SEQ ID NO: 2453989 - DNA, 15 bp, Homo sapiens
caatcctcccagaaa

SEQ ID NO: 2453990 - DNA, 16 bp, Homo sapiens
caatctactcaaagca

SEQ ID NO: 2453991 - DNA, 17 bp, Homo sapiens
caatgaacatccctttt

SEQ ID NO: 2453992 - DNA, 20 bp, Homo sapiens
caatgaataaaaactcaagg

SEQ ID NO: 2453993 - DNA, 15 bp, Homo sapiens
caatgacaaagcaga

SEQ ID NO: 2453994 - DNA, 16 bp, Homo sapiens
caatgacaaagcagat

SEQ ID NO: 2453995 - DNA, 13 bp, Homo sapiens
caatgacatgaat

SEQ ID NO: 2453996 - DNA, 14 bp, Homo sapiens
caatgacatgaatt

SEQ ID NO: 2453997 - DNA, 14 bp, Homo sapiens
caatgagctttctg

SEQ ID NO: 2453998 - DNA, 16 bp, Homo sapiens
caatgagctttctgaa

SEQ ID NO: 2453999 - DNA, 23 bp, Homo sapiens
caatgagctttctgaacagctgg

SEQ ID NO: 2454000 - DNA, 14 bp, Homo sapiens
caatgatgaatgag

SEQ ID NO: 2454001 - DNA, 17 bp, Homo sapiens
caatgcacctaaagaaa

SEQ ID NO: 2454002 - DNA, 18 bp, Homo sapiens
caatgcacctaaagaaaa

SEQ ID NO: 2454003 - DNA, 23 bp, Homo sapiens
atttctttttgggagagacttgt

SEQ ID NO: 2454004 - DNA, 16 bp, Homo sapiens
atttgaaataagaatt

SEQ ID NO: 2454005 - DNA, 22 bp, Homo sapiens
atttgaatgatttttctttaca

SEQ ID NO: 2454006 - DNA, 15 bp, Homo sapiens
atttgcaagggaaaa

SEQ ID NO: 2454007 - DNA, 21 bp, Homo sapiens
atttgcataacaattcctcta

SEQ ID NO: 2454008 - DNA, 16 bp, Homo sapiens
atttgcattgaacaca

SEQ ID NO: 2454009 - DNA, 22 bp, Homo sapiens
atttgcattgaacacaaactgt

SEQ ID NO: 2454010 - DNA, 16 bp, Homo sapiens
atttgcatttgtttat

SEQ ID NO: 2454011 - DNA, 16 bp, Homo sapiens
atttgctaatttttat

SEQ ID NO: 2454012 - DNA, 18 bp, Homo sapiens
atttgctttttgtgatat

SEQ ID NO: 2454013 - DNA, 15 bp, Homo sapiens
atttggaatactttt

SEQ ID NO: 2454014 - DNA, 20 bp, Homo sapiens
atttggatttaaaagcctgc

SEQ ID NO: 2454015 - DNA, 17 bp, Homo sapiens
atttgggagacatgtga

SEQ ID NO: 2454016 - DNA, 19 bp, Homo sapiens
atttgggagacatgtgaca

SEQ ID NO: 2454017 - DNA, 14 bp, Homo sapiens
atttgggtccagga

SEQ ID NO: 2454018 - DNA, 17 bp, Homo sapiens
atttgggttctgcctgc

SEQ ID NO: 2454019 - DNA, 15 bp, Homo sapiens
atttgtaaaatgaca

SEQ ID NO: 2454020 - DNA, 19 bp, Homo sapiens
atttgtaaaatgacaatca

SEQ ID NO: 2454021 - DNA, 12 bp, Homo sapiens
atttgtaaatct

SEQ ID NO: 2454022 - DNA, 23 bp, Homo sapiens
atttgtaacccactgagaggaca

SEQ ID NO: 2454023 - DNA, 18 bp, Homo sapiens
atttgtactatttaactg

SEQ ID NO: 2454024 - DNA, 20 bp, Homo sapiens
atttgtactatttaactgac

SEQ ID NO: 2454025 - DNA, 16 bp, Homo sapiens
atttgtatatggtatt

SEQ ID NO: 2454026 - DNA, 19 bp, Homo sapiens
atttgttaatttagaaaac

SEQ ID NO: 2454027 - DNA, 23 bp, Homo sapiens
atttgttaatttagaaaacttta

SEQ ID NO: 2454028 - DNA, 15 bp, Homo sapiens
atttgttttgtttac

SEQ ID NO: 2454029 - DNA, 18 bp, Homo sapiens
atttgttttgtttacaga

SEQ ID NO: 2454030 - DNA, 17 bp, Homo sapiens
atttgtttttaaactgt

SEQ ID NO: 2454031 - DNA, 20 bp, Homo sapiens
atttgtttttaaactgtaca

SEQ ID NO: 2454032 - DNA, 15 bp, Homo sapiens
attttaaaatttgtt

SEQ ID NO: 2454033 - DNA, 13 bp, Homo sapiens
attttaaacacat

SEQ ID NO: 2454034 - DNA, 23 bp, Homo sapiens
attttaaacacattaggaaaagt

SEQ ID NO: 2454035 - DNA, 12 bp, Homo sapiens
attttaaagaat

SEQ ID NO: 2454036 - DNA, 13 bp, Homo sapiens
attttaaagaatt

SEQ ID NO: 2454037 - DNA, 12 bp, Homo sapiens
attttaaagaca

SEQ ID NO: 2454038 - DNA, 12 bp, Homo sapiens
attttaaagtta

SEQ ID NO: 2454039 - DNA, 14 bp, Homo sapiens
attttaaagttagt

SEQ ID NO: 2454040 - DNA, 15 bp, Homo sapiens
attttaataaaaata

SEQ ID NO: 2454041 - DNA, 18 bp, Homo sapiens
attttaataaaaataatt

SEQ ID NO: 2454042 - DNA, 14 bp, Homo sapiens
attttacatgaagt

SEQ ID NO: 2454043 - DNA, 19 bp, Homo sapiens
attttacatgaagtatttt

SEQ ID NO: 2454044 - DNA, 13 bp, Homo sapiens
attttagcttttg

SEQ ID NO: 2454045 - DNA, 20 bp, Homo sapiens
attttaggagctaaggctct

SEQ ID NO: 2454046 - DNA, 22 bp, Homo sapiens
attttaggagctaaggctctat

SEQ ID NO: 2454047 - DNA, 23 bp, Homo sapiens
attttagtttttcattaaataaa

SEQ ID NO: 2454048 - DNA, 22 bp, Homo sapiens
attttataggcatacctcctat

SEQ ID NO: 2454049 - DNA, 14 bp, Homo sapiens
attttatggtgcat

SEQ ID NO: 2454050 - DNA, 13 bp, Homo sapiens
attttatgttata

SEQ ID NO: 2454051 - DNA, 17 bp, Homo sapiens
attttatgttatatata

SEQ ID NO: 2454052 - DNA, 23 bp, Homo sapiens
attttatgttatatataaatata

SEQ ID NO: 2454053 - DNA, 12 bp, Homo sapiens
attttattatga

SEQ ID NO: 2454054 - DNA, 22 bp, Homo sapiens
attttattatgaagaaggtgaa

SEQ ID NO: 2454055 - DNA, 16 bp, Homo sapiens
attttcaaaaccaggt

SEQ ID NO: 2454056 - DNA, 15 bp, Homo sapiens
attttcaccccaccc

SEQ ID NO: 2454057 - DNA, 14 bp, Homo sapiens
attttccaaatgta

SEQ ID NO: 2454058 - DNA, 17 bp, Homo sapiens
attttctctcaggtgaa

SEQ ID NO: 2454059 - DNA, 17 bp, Homo sapiens
attttctggttctaaca

SEQ ID NO: 2454060 - DNA, 19 bp, Homo sapiens
attttctggttctaacatt

SEQ ID NO: 2454061 - DNA, 15 bp, Homo sapiens
attttgaaagtctgt

SEQ ID NO: 2454062 - DNA, 19 bp, Homo sapiens
attttgaagtgctgtttat

SEQ ID NO: 2454063 - DNA, 14 bp, Homo sapiens
attttgaatcaata

SEQ ID NO: 2454064 - DNA, 15 bp, Homo sapiens
attttgaatcaataa

SEQ ID NO: 2454065 - DNA, 17 bp, Homo sapiens
attttgatgtaaagatg

SEQ ID NO: 2454066 - DNA, 13 bp, Homo sapiens
attttgcctttaa

SEQ ID NO: 2454067 - DNA, 22 bp, Homo sapiens
attttggagagtttcctgaaac

SEQ ID NO: 2454068 - DNA, 19 bp, Homo sapiens
attttgggttttgggtctt

SEQ ID NO: 2454069 - DNA, 18 bp, Homo sapiens
attttggtccaagttgtg

SEQ ID NO: 2454070 - DNA, 23 bp, Homo sapiens
attttgtaatgtatcaaatacat

SEQ ID NO: 2454071 - DNA, 18 bp, Homo sapiens
attttgtgatgcaaataa

SEQ ID NO: 2454072 - DNA, 11 bp, Homo sapiens
attttgtttac

SEQ ID NO: 2454073 - DNA, 12 bp, Homo sapiens
attttgtttaca

SEQ ID NO: 2454074 - DNA, 14 bp, Homo sapiens
atttttaaaatgta

SEQ ID NO: 2454075 - DNA, 16 bp, Homo sapiens
atttttaaaatgtaca

SEQ ID NO: 2454076 - DNA, 19 bp, Homo sapiens
atttttacaatgtaattat

SEQ ID NO: 2454077 - DNA, 22 bp, Homo sapiens
atttttacagaattgcttgttt

SEQ ID NO: 2454078 - DNA, 23 bp, Homo sapiens
atttttatattaaccagatatat

SEQ ID NO: 2454079 - DNA, 13 bp, Homo sapiens
atttttatttctt

SEQ ID NO: 2454080 - DNA, 15 bp, Homo sapiens
atttttctcttcatt

SEQ ID NO: 2454081 - DNA, 14 bp, Homo sapiens
atttttcttcttga

SEQ ID NO: 2454082 - DNA, 16 bp, Homo sapiens
atttttctttaactgc

SEQ ID NO: 2454083 - DNA, 14 bp, Homo sapiens
atttttctttacaa

SEQ ID NO: 2454084 - DNA, 18 bp, Homo sapiens
atttttggaggtttatta

SEQ ID NO: 2454085 - DNA, 21 bp, Homo sapiens
atttttgttttgtttttacaa

SEQ ID NO: 2454086 - DNA, 17 bp, Homo sapiens
attttttaaaaaagctt

SEQ ID NO: 2454087 - DNA, 20 bp, Homo sapiens
attttttaaaaaagcttaaa

SEQ ID NO: 2454088 - DNA, 16 bp, Homo sapiens
attttttaaaaagcaa

SEQ ID NO: 2454089 - DNA, 18 bp, Homo sapiens
attttttaaaaagcaaaa

SEQ ID NO: 2454090 - DNA, 21 bp, Homo sapiens
attttttaagtgaaaatatag

SEQ ID NO: 2454091 - DNA, 20 bp, Homo sapiens
attttttaattattatttat

SEQ ID NO: 2454092 - DNA, 21 bp, Homo sapiens
attttttccttcaaagtttaa

SEQ ID NO: 2454093 - DNA, 15 bp, Homo sapiens
attttttgtataatt

SEQ ID NO: 2454094 - DNA, 21 bp, Homo sapiens
attttttgttgacattagtct

SEQ ID NO: 2454095 - DNA, 14 bp, Homo sapiens
attttttttaacat

SEQ ID NO: 2454096 - DNA, 20 bp, Homo sapiens
attttttttctttgaataaa

SEQ ID NO: 2454097 - DNA, 15 bp, Homo sapiens
attttttttctttta

SEQ ID NO: 2454098 - DNA, 20 bp, Homo sapiens
atttttttttaagctctgag

SEQ ID NO: 2454099 - DNA, 19 bp, Homo sapiens
atttttttttttttttcct

SEQ ID NO: 2454100 - DNA, 20 bp, Homo sapiens
caaaaacaggtatatacttt

SEQ ID NO: 2454101 - DNA, 23 bp, Homo sapiens
caaaaactttggagtcccctcac

SEQ ID NO: 2454102 - DNA, 17 bp, Homo sapiens
caaaaagaaccacttgt

SEQ ID NO: 2454103 - DNA, 15 bp, Homo sapiens
caaaaagtgaaataa

SEQ ID NO: 2454104 - DNA, 12 bp, Homo sapiens
caaaaatataaa

SEQ ID NO: 2454105 - DNA, 23 bp, Homo sapiens
caaaaatataaaatatgaagaca

SEQ ID NO: 2454106 - DNA, 18 bp, Homo sapiens
caaaacacttgtaatttt

SEQ ID NO: 2454107 - DNA, 18 bp, Homo sapiens
caaattactttgtgaata

SEQ ID NO: 2454108 - DNA, 21 bp, Homo sapiens
caaattactttgtgaatagaa

SEQ ID NO: 2454109 - DNA, 12 bp, Homo sapiens
caaattcagttt

SEQ ID NO: 2454110 - DNA, 17 bp, Homo sapiens
caaattcagtttcataa

SEQ ID NO: 2454111 - DNA, 17 bp, Homo sapiens
cagacataaaggaaaag

SEQ ID NO: 2454112 - DNA, 19 bp, Homo sapiens
cagacataaaggaaaagac

SEQ ID NO: 2454113 - DNA, 20 bp, Homo sapiens
cagacatctgaggttttatt

SEQ ID NO: 2454114 - DNA, 18 bp, Homo sapiens
cagacatgccacaaggac

SEQ ID NO: 2454115 - DNA, 16 bp, Homo sapiens
cagaccacattgcttt

SEQ ID NO: 2454116 - DNA, 16 bp, Homo sapiens
cagaccataatgttac

SEQ ID NO: 2454117 - DNA, 22 bp, Homo sapiens
cagacctaggatttcatgattt

SEQ ID NO: 2454118 - DNA, 13 bp, Homo sapiens
cagacctgatcct

SEQ ID NO: 2454119 - DNA, 20 bp, Homo sapiens
cagacctgatcctggaggcc

SEQ ID NO: 2454120 - DNA, 23 bp, Homo sapiens
cagacctgatcctggaggcccag

SEQ ID NO: 2454121 - DNA, 13 bp, Homo sapiens
cagacgcctggct

SEQ ID NO: 2454122 - DNA, 15 bp, Homo sapiens
cagactaagccagca

SEQ ID NO: 2454123 - DNA, 18 bp, Homo sapiens
cagactaagccagcaccg

SEQ ID NO: 2454124 - DNA, 21 bp, Homo sapiens
cagactagatggacctgcctg

SEQ ID NO: 2454125 - DNA, 19 bp, Homo sapiens
cagactagatgtagtattt

SEQ ID NO: 2454126 - DNA, 20 bp, Homo sapiens
cagactagatgtagtatttt

SEQ ID NO: 2454127 - DNA, 20 bp, Homo sapiens
cagactatttttagattttc

SEQ ID NO: 2454128 - DNA, 22 bp, Homo sapiens
cagactatttttagattttctt

SEQ ID NO: 2454129 - DNA, 17 bp, Homo sapiens
cagactcccattcctga

SEQ ID NO: 2454130 - DNA, 19 bp, Homo sapiens
cagactcccattcctgaag

SEQ ID NO: 2454131 - DNA, 20 bp, Homo sapiens
cagactcccattcctgaaga

SEQ ID NO: 2454132 - DNA, 17 bp, Homo sapiens
cagactctaagaaagaa

SEQ ID NO: 2454133 - DNA, 18 bp, Homo sapiens
cagactctaagaaagaac

SEQ ID NO: 2454134 - DNA, 23 bp, Homo sapiens
cagactgacagtttacagacgct

SEQ ID NO: 2454135 - DNA, 14 bp, Homo sapiens
cagacttcccagct

SEQ ID NO: 2454136 - DNA, 21 bp, Homo sapiens
cagagaaaatgaattttttcc

SEQ ID NO: 2454137 - DNA, 14 bp, Homo sapiens
cagagaaaccagct

SEQ ID NO: 2454138 - DNA, 14 bp, Homo sapiens
cagagaaccaggct

SEQ ID NO: 2454139 - DNA, 13 bp, Homo sapiens
cagagaagccagc

SEQ ID NO: 2454140 - DNA, 19 bp, Homo sapiens
cagagaagccagcttgttt

SEQ ID NO: 2454141 - DNA, 20 bp, Homo sapiens
cagagaagccagcttgttta

SEQ ID NO: 2454142 - DNA, 21 bp, Homo sapiens
cagagaagccagcttgtttac

SEQ ID NO: 2454143 - DNA, 14 bp, Homo sapiens
cagagaagccatca

SEQ ID NO: 2454144 - DNA, 22 bp, Homo sapiens
cagagaagccatcacctcagat

SEQ ID NO: 2454145 - DNA, 11 bp, Homo sapiens
cagagaagcct

SEQ ID NO: 2454146 - DNA, 13 bp, Homo sapiens
cagagaagccttc

SEQ ID NO: 2454147 - DNA, 16 bp, Homo sapiens
cagagaagccttcaag

SEQ ID NO: 2454148 - DNA, 13 bp, Homo sapiens
cagagaagtcaca

SEQ ID NO: 2454149 - DNA, 19 bp, Homo sapiens
cagagaagtcacagggcag

SEQ ID NO: 2454150 - DNA, 20 bp, Homo sapiens
cagagacatacttgaagggc

SEQ ID NO: 2454151 - DNA, 21 bp, Homo sapiens
cagagacatacttgaagggcc

SEQ ID NO: 2454152 - DNA, 14 bp, Homo sapiens
cagagacatgcaga

SEQ ID NO: 2454153 - DNA, 17 bp, Homo sapiens
cagagagcagtgctttt

SEQ ID NO: 2454154 - DNA, 20 bp, Homo sapiens
cagagatccaaaagaagccc

SEQ ID NO: 2454155 - DNA, 20 bp, Homo sapiens
cagagatgcaccaccaagcc

SEQ ID NO: 2454156 - DNA, 21 bp, Homo sapiens
cagagatgcaccaccaagcca

SEQ ID NO: 2454157 - DNA, 16 bp, Homo sapiens
cagagattctgaacta

SEQ ID NO: 2454158 - DNA, 16 bp, Homo sapiens
cagagcacctgctgtc

SEQ ID NO: 2454159 - DNA, 13 bp, Homo sapiens
cagagccaggaga

SEQ ID NO: 2454160 - DNA, 20 bp, Homo sapiens
cagagccatgtcttctccct

SEQ ID NO: 2454161 - DNA, 19 bp, Homo sapiens
cagagcccactccatctgg

SEQ ID NO: 2454162 - DNA, 14 bp, Homo sapiens
cagagcccaggctc

SEQ ID NO: 2454163 - DNA, 23 bp, Homo sapiens
cagagccctgtgaggctgggtcc

SEQ ID NO: 2454164 - DNA, 20 bp, Homo sapiens
cagagccgtggtcctttggg

SEQ ID NO: 2454165 - DNA, 19 bp, Homo sapiens
cagagcgtgagctgagcag

SEQ ID NO: 2454166 - DNA, 13 bp, Homo sapiens
cagagctggtgcg

SEQ ID NO: 2454167 - DNA, 20 bp, Homo sapiens
cagagctggtgcggctggcc

SEQ ID NO: 2454168 - DNA, 23 bp, Homo sapiens
cagagctggtgcggctggccatg

SEQ ID NO: 2454169 - DNA, 23 bp, Homo sapiens
cagagcttccctgactcattctg

SEQ ID NO: 2454170 - DNA, 18 bp, Homo sapiens
cagaggagccaccagttc

SEQ ID NO: 2454171 - DNA, 20 bp, Homo sapiens
cagaggccagaggcccccag

SEQ ID NO: 2454172 - DNA, 17 bp, Homo sapiens
cagaggcccccagccca

SEQ ID NO: 2454173 - DNA, 12 bp, Homo sapiens
cagaggccctca

SEQ ID NO: 2454174 - DNA, 19 bp, Homo sapiens
cagaggcctgggctgggaa

SEQ ID NO: 2454175 - DNA, 18 bp, Homo sapiens
cagaggcgcactgtgacc

SEQ ID NO: 2454176 - DNA, 21 bp, Homo sapiens
cagaggctcagattgtaatat

SEQ ID NO: 2454177 - DNA, 12 bp, Homo sapiens
cagaggctgggt

SEQ ID NO: 2454178 - DNA, 13 bp, Homo sapiens
cagaggctgggtt

SEQ ID NO: 2454179 - DNA, 15 bp, Homo sapiens
cagagggctggaggc

SEQ ID NO: 2454180 - DNA, 19 bp, Homo sapiens
cagagggctggaggcccag

SEQ ID NO: 2454181 - DNA, 16 bp, Homo sapiens
cagaggggcagaggcc

SEQ ID NO: 2454182 - DNA, 20 bp, Homo sapiens
cagaggggcctgccacctgg

SEQ ID NO: 2454183 - DNA, 21 bp, Homo sapiens
cagaggggcctgccacctgga

SEQ ID NO: 2454184 - DNA, 16 bp, Homo sapiens
cagagggtctgggggc

SEQ ID NO: 2454185 - DNA, 17 bp, Homo sapiens
cagagggtctgggggca

SEQ ID NO: 2454186 - DNA, 13 bp, Homo sapiens
cagaggtctccca

SEQ ID NO: 2454187 - DNA, 18 bp, Homo sapiens
cagagtgtggactctggt

SEQ ID NO: 2454188 - DNA, 22 bp, Homo sapiens
cagccccaccccagggcagcca

SEQ ID NO: 2454189 - DNA, 23 bp, Homo sapiens
cagccccaccccagggcagccag

SEQ ID NO: 2454190 - DNA, 15 bp, Homo sapiens
cagccccactcctct

SEQ ID NO: 2454191 - DNA, 18 bp, Homo sapiens
cagccccactcctctgct

SEQ ID NO: 2454192 - DNA, 18 bp, Homo sapiens
cagcccccacccccaagg

SEQ ID NO: 2454193 - DNA, 19 bp, Homo sapiens
cagcccccagctcccacct

SEQ ID NO: 2454194 - DNA, 14 bp, Homo sapiens
cagccccctcacag

SEQ ID NO: 2454195 - DNA, 14 bp, Homo sapiens
cagccccctcctgg

SEQ ID NO: 2454196 - DNA, 22 bp, Homo sapiens
cagccccctcctggtgccacct

SEQ ID NO: 2454197 - DNA, 21 bp, Homo sapiens
cagccccctgaccactcagag

SEQ ID NO: 2454198 - DNA, 14 bp, Homo sapiens
cagcccctctggtc

SEQ ID NO: 2454199 - DNA, 21 bp, Homo sapiens
cagcccctctggtcgctcctg

SEQ ID NO: 2454200 - DNA, 21 bp, Homo sapiens
cagcccctcttggagaagtct

SEQ ID NO: 2454201 - DNA, 14 bp, Homo sapiens
cagcccgcacacct

SEQ ID NO: 2454202 - DNA, 16 bp, Homo sapiens
cagccctaaacatcat

SEQ ID NO: 2454203 - DNA, 14 bp, Homo sapiens
cagccctcatcccg

SEQ ID NO: 2454204 - DNA, 13 bp, Homo sapiens
cagccctgcacca

SEQ ID NO: 2454205 - DNA, 17 bp, Homo sapiens
cagccctgcaccatgct

SEQ ID NO: 2454206 - DNA, 23 bp, Homo sapiens
cagccctgcaccatgctgctggg

SEQ ID NO: 2454207 - DNA, 15 bp, Homo sapiens
cagccctgcctggag

SEQ ID NO: 2454208 - DNA, 21 bp, Homo sapiens
cagccctgcctggaggacctg

SEQ ID NO: 2454209 - DNA, 16 bp, Homo sapiens
cagccctgtcttccta

SEQ ID NO: 2454210 - DNA, 15 bp, Homo sapiens
cagccgaccccctct

SEQ ID NO: 2454211 - DNA, 18 bp, Homo sapiens
cagccgccggctgtgcag

SEQ ID NO: 2454212 - DNA, 17 bp, Homo sapiens
cagccgcgcatcagact

SEQ ID NO: 2454213 - DNA, 11 bp, Homo sapiens
cagccgcttgg

SEQ ID NO: 2454214 - DNA, 18 bp, Homo sapiens
cagccggcacagggtctg

SEQ ID NO: 2454215 - DNA, 23 bp, Homo sapiens
cagccggcacagggtctgctctt

SEQ ID NO: 2454216 - DNA, 17 bp, Homo sapiens
cagcctcaggactggga

SEQ ID NO: 2454217 - DNA, 19 bp, Homo sapiens
cagcctcaggactgggagc

SEQ ID NO: 2454218 - DNA, 13 bp, Homo sapiens
caatgtaattatt

SEQ ID NO: 2454219 - DNA, 22 bp, Homo sapiens
caatgtaattatttatgtatgg

SEQ ID NO: 2454220 - DNA, 16 bp, Homo sapiens
caatgtagataagtgt

SEQ ID NO: 2454221 - DNA, 21 bp, Homo sapiens
caatgtagataagtgttctgt

SEQ ID NO: 2454222 - DNA, 14 bp, Homo sapiens
caatgtctggagac

SEQ ID NO: 2454223 - DNA, 21 bp, Homo sapiens
caatgtcttgatgcatgcact

SEQ ID NO: 2454224 - DNA, 16 bp, Homo sapiens
caatgtgtataaacaa

SEQ ID NO: 2454225 - DNA, 18 bp, Homo sapiens
caatgtgtataaacaaga

SEQ ID NO: 2454226 - DNA, 14 bp, Homo sapiens
caatgtgtgtatat

SEQ ID NO: 2454227 - DNA, 17 bp, Homo sapiens
caatgtgtgtatatgga

SEQ ID NO: 2454228 - DNA, 23 bp, Homo sapiens
caattaaaaaaaaagatctgttt

SEQ ID NO: 2454229 - DNA, 19 bp, Homo sapiens
caattaattatcttttcaa

SEQ ID NO: 2454230 - DNA, 15 bp, Homo sapiens
caattactcaggttt

SEQ ID NO: 2454231 - DNA, 17 bp, Homo sapiens
caattcaaaagttccaa

SEQ ID NO: 2454232 - DNA, 13 bp, Homo sapiens
caattcaaagctg

SEQ ID NO: 2454233 - DNA, 18 bp, Homo sapiens
caattccaacagtttaat

SEQ ID NO: 2454234 - DNA, 22 bp, Homo sapiens
caattccaacagtttaatgaag

SEQ ID NO: 2454235 - DNA, 13 bp, Homo sapiens
caattccacctgc

SEQ ID NO: 2454236 - DNA, 12 bp, Homo sapiens
caattcccctct

SEQ ID NO: 2454237 - DNA, 17 bp, Homo sapiens
caattgaagtaaacttt

SEQ ID NO: 2454238 - DNA, 21 bp, Homo sapiens
caattgaagtaaactttttgt

SEQ ID NO: 2454239 - DNA, 21 bp, Homo sapiens
caattgacaacagttacataa

SEQ ID NO: 2454240 - DNA, 21 bp, Homo sapiens
caattgcacgcggagtgagtt

SEQ ID NO: 2454241 - DNA, 23 bp, Homo sapiens
caattgcacgcggagtgagtttt

SEQ ID NO: 2454242 - DNA, 14 bp, Homo sapiens
caattgcatctccc

SEQ ID NO: 2454243 - DNA, 17 bp, Homo sapiens
caattgcatctcccaga

SEQ ID NO: 2454244 - DNA, 15 bp, Homo sapiens
caatttatttgaatg

SEQ ID NO: 2454245 - DNA, 14 bp, Homo sapiens
caatttcaataaaa

SEQ ID NO: 2454246 - DNA, 13 bp, Homo sapiens
caatttcggattt

SEQ ID NO: 2454247 - DNA, 16 bp, Homo sapiens
caatttctactttgaa

SEQ ID NO: 2454248 - DNA, 21 bp, Homo sapiens
caatttctactttgaagtcat

SEQ ID NO: 2454249 - DNA, 15 bp, Homo sapiens
caatttctgtgttgc

SEQ ID NO: 2454250 - DNA, 20 bp, Homo sapiens
caatttctgtgttgccaagc

SEQ ID NO: 2454251 - DNA, 18 bp, Homo sapiens
caatttggcaattttgtg

SEQ ID NO: 2454252 - DNA, 19 bp, Homo sapiens
caatttggcaattttgtgg

SEQ ID NO: 2454253 - DNA, 13 bp, Homo sapiens
caatttttatatt

SEQ ID NO: 2454254 - DNA, 16 bp, Homo sapiens
cacaaaacccagacct

SEQ ID NO: 2454255 - DNA, 22 bp, Homo sapiens
cacaaaataaccaatcctggac

SEQ ID NO: 2454256 - DNA, 23 bp, Homo sapiens
cacaaactgtaaataaaaagaaa

SEQ ID NO: 2454257 - DNA, 16 bp, Homo sapiens
cacaaattagttatat

SEQ ID NO: 2454258 - DNA, 13 bp, Homo sapiens
cacaagaatggat

SEQ ID NO: 2454259 - DNA, 18 bp, Homo sapiens
cacaagatggaatttatc

SEQ ID NO: 2454260 - DNA, 17 bp, Homo sapiens
cacaagattggtgtttt

SEQ ID NO: 2454261 - DNA, 22 bp, Homo sapiens
cacaagattggtgtttttttct

SEQ ID NO: 2454262 - DNA, 23 bp, Homo sapiens
cacaagattggtgtttttttcta

SEQ ID NO: 2454263 - DNA, 15 bp, Homo sapiens
cacaagcctctgccc

SEQ ID NO: 2454264 - DNA, 20 bp, Homo sapiens
cacaagcctctgcccaggca

SEQ ID NO: 2454265 - DNA, 22 bp, Homo sapiens
cacaagcctctgcccaggcact

SEQ ID NO: 2454266 - DNA, 12 bp, Homo sapiens
cacaagcctgag

SEQ ID NO: 2454267 - DNA, 16 bp, Homo sapiens
cacaaggacttcctgt

SEQ ID NO: 2454268 - DNA, 17 bp, Homo sapiens
cacaaggatagatgctg

SEQ ID NO: 2454269 - DNA, 15 bp, Homo sapiens
cacaaggcagcaagg

SEQ ID NO: 2454270 - DNA, 16 bp, Homo sapiens
cacaataaatggctgt

SEQ ID NO: 2454271 - DNA, 16 bp, Homo sapiens
cacaataactcctccc

SEQ ID NO: 2454272 - DNA, 23 bp, Homo sapiens
cacaatgagattgaatttcactg

SEQ ID NO: 2454273 - DNA, 16 bp, Homo sapiens
cacacaagaagaaggg

SEQ ID NO: 2454274 - DNA, 18 bp, Homo sapiens
cacacagctactctcccc

SEQ ID NO: 2454275 - DNA, 14 bp, Homo sapiens
cacacagctgccgg

SEQ ID NO: 2454276 - DNA, 10 bp, Homo sapiens
cacacaggca

SEQ ID NO: 2454277 - DNA, 19 bp, Homo sapiens
cacacaggcatttcctggg

SEQ ID NO: 2454278 - DNA, 20 bp, Homo sapiens
cacacaggcatttcctgggt

SEQ ID NO: 2454279 - DNA, 21 bp, Homo sapiens
cacacaggcatttcctgggtg

SEQ ID NO: 2454280 - DNA, 17 bp, Homo sapiens
cacaccccactcccaca

SEQ ID NO: 2454281 - DNA, 21 bp, Homo sapiens
cacaccctgtactgttctgtg

SEQ ID NO: 2454282 - DNA, 10 bp, Homo sapiens
cacacctcct

SEQ ID NO: 2454283 - DNA, 19 bp, Homo sapiens
cacacctccttccctctct

SEQ ID NO: 2454284 - DNA, 16 bp, Homo sapiens
cacacctgtagcactt

SEQ ID NO: 2454285 - DNA, 22 bp, Homo sapiens
cacaccttttattgacacagaa

SEQ ID NO: 2454286 - DNA, 23 bp, Homo sapiens
cacaccttttattgacacagaaa

SEQ ID NO: 2454287 - DNA, 19 bp, Homo sapiens
cacactaaccaagctgagt

SEQ ID NO: 2454288 - DNA, 21 bp, Homo sapiens
cacactaccgaatgtgtcttt

SEQ ID NO: 2454289 - DNA, 18 bp, Homo sapiens
cacactgatgcttagatg

SEQ ID NO: 2454290 - DNA, 12 bp, Homo sapiens
cacactttggta

SEQ ID NO: 2454291 - DNA, 23 bp, Homo sapiens
cacagaaaataaggcacccatct

SEQ ID NO: 2454292 - DNA, 12 bp, Homo sapiens
cacagaaacctt

SEQ ID NO: 2454293 - DNA, 17 bp, Homo sapiens
cacagagattctgaact

SEQ ID NO: 2454294 - DNA, 21 bp, Homo sapiens
cacagaggcagcccgcacacc

SEQ ID NO: 2454295 - DNA, 13 bp, Homo sapiens
cacagatggccag

SEQ ID NO: 2454296 - DNA, 14 bp, Homo sapiens
cacagcacaaatta

SEQ ID NO: 2454297 - DNA, 14 bp, Homo sapiens
cacagcagcctggg

SEQ ID NO: 2454298 - DNA, 16 bp, Homo sapiens
cacagcattgtatatg

SEQ ID NO: 2454299 - DNA, 16 bp, Homo sapiens
cacagccaaatttaaa

SEQ ID NO: 2454300 - DNA, 13 bp, Homo sapiens
cacagccacccct

SEQ ID NO: 2454301 - DNA, 18 bp, Homo sapiens
cacagccaggggagcaga

SEQ ID NO: 2454302 - DNA, 19 bp, Homo sapiens
cacagccctgtcagcatga

SEQ ID NO: 2454303 - DNA, 14 bp, Homo sapiens
cacagcctcccctg

SEQ ID NO: 2454304 - DNA, 19 bp, Homo sapiens
cacagcctcccctgccagg

SEQ ID NO: 2454305 - DNA, 21 bp, Homo sapiens
cacagcctcccctgccagggc

SEQ ID NO: 2454306 - DNA, 16 bp, Homo sapiens
cacagctactctcccc

SEQ ID NO: 2454307 - DNA, 17 bp, Homo sapiens
cacagctgtatagctgc

SEQ ID NO: 2454308 - DNA, 20 bp, Homo sapiens
cacagctgtatagctgcttc

SEQ ID NO: 2454309 - DNA, 16 bp, Homo sapiens
cacagcttagatttca

SEQ ID NO: 2454310 - DNA, 22 bp, Homo sapiens
aggtgtctcaggctgcctgagt

SEQ ID NO: 2454311 - DNA, 14 bp, Homo sapiens
aggtgtgagactgg

SEQ ID NO: 2454312 - DNA, 15 bp, Homo sapiens
aggtgtgagactggg

SEQ ID NO: 2454313 - DNA, 17 bp, Homo sapiens
aggtgttaacattccaa

SEQ ID NO: 2454314 - DNA, 23 bp, Homo sapiens
aggtgttaacattccaagactct

SEQ ID NO: 2454315 - DNA, 16 bp, Homo sapiens
aggtgttactgtaatt

SEQ ID NO: 2454316 - DNA, 23 bp, Homo sapiens
aggtgttatttggaaccttgttt

SEQ ID NO: 2454317 - DNA, 12 bp, Homo sapiens
aggtgttgccaa

SEQ ID NO: 2454318 - DNA, 18 bp, Homo sapiens
aggtgttttgttcaccat

SEQ ID NO: 2454319 - DNA, 22 bp, Homo sapiens
aggtgttttgttcaccattata

SEQ ID NO: 2454320 - DNA, 15 bp, Homo sapiens
aggttatcagtgctt

SEQ ID NO: 2454321 - DNA, 14 bp, Homo sapiens
aggttcaacttatt

SEQ ID NO: 2454322 - DNA, 15 bp, Homo sapiens
aggttcagccaaggt

SEQ ID NO: 2454323 - DNA, 15 bp, Homo sapiens
aggttcccaagctca

SEQ ID NO: 2454324 - DNA, 13 bp, Homo sapiens
aggttctaaagtt

SEQ ID NO: 2454325 - DNA, 18 bp, Homo sapiens
aggttctaaagttctaag

SEQ ID NO: 2454326 - DNA, 15 bp, Homo sapiens
aggttctaaggccta

SEQ ID NO: 2454327 - DNA, 17 bp, Homo sapiens
aggttctaggtttcaaa

SEQ ID NO: 2454328 - DNA, 22 bp, Homo sapiens
aggttctccgttagctcctgtg

SEQ ID NO: 2454329 - DNA, 14 bp, Homo sapiens
aggttcttactgct

SEQ ID NO: 2454330 - DNA, 13 bp, Homo sapiens
aggttgcacactt

SEQ ID NO: 2454331 - DNA, 17 bp, Homo sapiens
aggttgcacactttggt

SEQ ID NO: 2454332 - DNA, 15 bp, Homo sapiens
aggttggctctgcca

SEQ ID NO: 2454333 - DNA, 16 bp, Homo sapiens
aggttggctctgccag

SEQ ID NO: 2454334 - DNA, 13 bp, Homo sapiens
aggtttaaagagt

SEQ ID NO: 2454335 - DNA, 22 bp, Homo sapiens
aggtttaaatgaacaagagaag

SEQ ID NO: 2454336 - DNA, 18 bp, Homo sapiens
aggtttgcagtcccaagc

SEQ ID NO: 2454337 - DNA, 14 bp, Homo sapiens
aggtttggaaggag

SEQ ID NO: 2454338 - DNA, 22 bp, Homo sapiens
aggtttggaaggagcagaaaac

SEQ ID NO: 2454339 - DNA, 16 bp, Homo sapiens
aggttttaatttagta

SEQ ID NO: 2454340 - DNA, 20 bp, Homo sapiens
aggttttaatttagtaaacc

SEQ ID NO: 2454341 - DNA, 22 bp, Homo sapiens
aggttttaatttagtaaaccaa

SEQ ID NO: 2454342 - DNA, 15 bp, Homo sapiens
aggttttaggttcta

SEQ ID NO: 2454343 - DNA, 16 bp, Homo sapiens
aggttttaggttctaa

SEQ ID NO: 2454344 - DNA, 17 bp, Homo sapiens
aggttttaggttctaaa

SEQ ID NO: 2454345 - DNA, 18 bp, Homo sapiens
aggttttaggttctaaag

SEQ ID NO: 2454346 - DNA, 23 bp, Homo sapiens
aggttttaggttctaaagttcta

SEQ ID NO: 2454347 - DNA, 17 bp, Homo sapiens
aggttttataaggctga

SEQ ID NO: 2454348 - DNA, 20 bp, Homo sapiens
aggttttatttcatttttca

SEQ ID NO: 2454349 - DNA, 10 bp, Homo sapiens
aggttttcag

SEQ ID NO: 2454350 - DNA, 17 bp, Homo sapiens
aggttttttttcagttg

SEQ ID NO: 2454351 - DNA, 14 bp, Homo sapiens
agtaaactttttgt

SEQ ID NO: 2454352 - DNA, 20 bp, Homo sapiens
agtaaatgtgattcacctct

SEQ ID NO: 2454353 - DNA, 19 bp, Homo sapiens
agtaacaatacaaatggat

SEQ ID NO: 2454354 - DNA, 12 bp, Homo sapiens
agtaacactaat

SEQ ID NO: 2454355 - DNA, 13 bp, Homo sapiens
agtaacactaata

SEQ ID NO: 2454356 - DNA, 17 bp, Homo sapiens
agtaacgcgtcttcctg

SEQ ID NO: 2454357 - DNA, 18 bp, Homo sapiens
agtaacgcgtcttcctga

SEQ ID NO: 2454358 - DNA, 22 bp, Homo sapiens
agtaatcaatctactcaaagca

SEQ ID NO: 2454359 - DNA, 13 bp, Homo sapiens
agtaatctgcatt

SEQ ID NO: 2454360 - DNA, 14 bp, Homo sapiens
agtaatggtgtaga

SEQ ID NO: 2454361 - DNA, 16 bp, Homo sapiens
agtaatggtgtagaac

SEQ ID NO: 2454362 - DNA, 19 bp, Homo sapiens
agtaatggtgtagaacact

SEQ ID NO: 2454363 - DNA, 17 bp, Homo sapiens
agtaatttagaaatcat

SEQ ID NO: 2454364 - DNA, 17 bp, Homo sapiens
agtacactctgctgttt

SEQ ID NO: 2454365 - DNA, 14 bp, Homo sapiens
agtacagagaagcc

SEQ ID NO: 2454366 - DNA, 16 bp, Homo sapiens
agtacagagaagccat

SEQ ID NO: 2454367 - DNA, 17 bp, Homo sapiens
agtacagagaagccatc

SEQ ID NO: 2454368 - DNA, 20 bp, Homo sapiens
agtacagagaagccatcacc

SEQ ID NO: 2454369 - DNA, 16 bp, Homo sapiens
agtaccaatcatttta

SEQ ID NO: 2454370 - DNA, 12 bp, Homo sapiens
agtaccatttaa

SEQ ID NO: 2454371 - DNA, 15 bp, Homo sapiens
agtacctgagggtct

SEQ ID NO: 2454372 - DNA, 19 bp, Homo sapiens
agtacctgagggtctgtag

SEQ ID NO: 2454373 - DNA, 22 bp, Homo sapiens
agtacctgagggtctgtaggtt

SEQ ID NO: 2454374 - DNA, 13 bp, Homo sapiens
agtacctgggcaa

SEQ ID NO: 2454375 - DNA, 16 bp, Homo sapiens
agtacgaacctacagt

SEQ ID NO: 2454376 - DNA, 15 bp, Homo sapiens
agtactccacactgc

SEQ ID NO: 2454377 - DNA, 18 bp, Homo sapiens
agtactccacactgcaca

SEQ ID NO: 2454378 - DNA, 17 bp, Homo sapiens
agtacttgtagttccac

SEQ ID NO: 2454379 - DNA, 20 bp, Homo sapiens
cagcctcaggactgggagcc

SEQ ID NO: 2454380 - DNA, 15 bp, Homo sapiens
cagcctcccaaagtg

SEQ ID NO: 2454381 - DNA, 19 bp, Homo sapiens
cagcctcccacccccatct

SEQ ID NO: 2454382 - DNA, 20 bp, Homo sapiens
cagcctcccctgccagggca

SEQ ID NO: 2454383 - DNA, 14 bp, Homo sapiens
cagcctccctgaag

SEQ ID NO: 2454384 - DNA, 16 bp, Homo sapiens
cagcctccctgaagcc

SEQ ID NO: 2454385 - DNA, 18 bp, Homo sapiens
cagcctccctgaagcctt

SEQ ID NO: 2454386 - DNA, 18 bp, Homo sapiens
cagcctctcccctgcctg

SEQ ID NO: 2454387 - DNA, 20 bp, Homo sapiens
cagcctgaaccccagggctg

SEQ ID NO: 2454388 - DNA, 21 bp, Homo sapiens
cagcctgagcaactcttgatt

SEQ ID NO: 2454389 - DNA, 14 bp, Homo sapiens
cagcctggccagac

SEQ ID NO: 2454390 - DNA, 17 bp, Homo sapiens
cagcctggccagacaca

SEQ ID NO: 2454391 - DNA, 12 bp, Homo sapiens
cagcctggcctc

SEQ ID NO: 2454392 - DNA, 14 bp, Homo sapiens
cagcctggcctcct

SEQ ID NO: 2454393 - DNA, 17 bp, Homo sapiens
cagcctggcctcctgcc

SEQ ID NO: 2454394 - DNA, 12 bp, Homo sapiens
cagcctgggaaa

SEQ ID NO: 2454395 - DNA, 11 bp, Homo sapiens
cagcctgggcc

SEQ ID NO: 2454396 - DNA, 13 bp, Homo sapiens
cagcctgggccta

SEQ ID NO: 2454397 - DNA, 17 bp, Homo sapiens
cagcctgggcctatgga

SEQ ID NO: 2454398 - DNA, 20 bp, Homo sapiens
cagcctgggcctatggagag

SEQ ID NO: 2454399 - DNA, 15 bp, Homo sapiens
cagcctgggcgctgg

SEQ ID NO: 2454400 - DNA, 23 bp, Homo sapiens
cagcctgtcagatccaggagctc

SEQ ID NO: 2454401 - DNA, 23 bp, Homo sapiens
cagccttcagacagagaggactg

SEQ ID NO: 2454402 - DNA, 17 bp, Homo sapiens
cagcctttgcctccccg

SEQ ID NO: 2454403 - DNA, 21 bp, Homo sapiens
cagcctttgttccccactgga

SEQ ID NO: 2454404 - DNA, 23 bp, Homo sapiens
cagcctttgttccccactggagc

SEQ ID NO: 2454405 - DNA, 20 bp, Homo sapiens
cagcctttttgtttcaatga

SEQ ID NO: 2454406 - DNA, 20 bp, Homo sapiens
cagcgattccctctcccagg

SEQ ID NO: 2454407 - DNA, 22 bp, Homo sapiens
cagcgattccctctcccaggcc

SEQ ID NO: 2454408 - DNA, 12 bp, Homo sapiens
cagcgccaggct

SEQ ID NO: 2454409 - DNA, 18 bp, Homo sapiens
cagcgccaggctgaccac

SEQ ID NO: 2454410 - DNA, 21 bp, Homo sapiens
cagcgccaggctgaccacagc

SEQ ID NO: 2454411 - DNA, 18 bp, Homo sapiens
cagcgtcggtctgtgccc

SEQ ID NO: 2454412 - DNA, 15 bp, Homo sapiens
cagcgtgctttaaaa

SEQ ID NO: 2454413 - DNA, 22 bp, Homo sapiens
cagcgtggaggggtaggggctg

SEQ ID NO: 2454414 - DNA, 14 bp, Homo sapiens
cagcgtggccttgt

SEQ ID NO: 2454415 - DNA, 21 bp, Homo sapiens
cagcgttcctagagaagacag

SEQ ID NO: 2454416 - DNA, 16 bp, Homo sapiens
cagctaagaacctgga

SEQ ID NO: 2454417 - DNA, 20 bp, Homo sapiens
cagctaagctcacgtcctga

SEQ ID NO: 2454418 - DNA, 21 bp, Homo sapiens
cagctaccctttttctccagc

SEQ ID NO: 2454419 - DNA, 15 bp, Homo sapiens
cagctactctcccca

SEQ ID NO: 2454420 - DNA, 17 bp, Homo sapiens
cagctacttcctcctcc

SEQ ID NO: 2454421 - DNA, 15 bp, Homo sapiens
cagctagtgacccac

SEQ ID NO: 2454422 - DNA, 19 bp, Homo sapiens
cagctagtgacccacatgc

SEQ ID NO: 2454423 - DNA, 20 bp, Homo sapiens
cagctagtgacccacatgcc

SEQ ID NO: 2454424 - DNA, 22 bp, Homo sapiens
cagctagtgacccacatgccat

SEQ ID NO: 2454425 - DNA, 16 bp, Homo sapiens
cagctcaggacagatg

SEQ ID NO: 2454426 - DNA, 18 bp, Homo sapiens
cagctcaggacagatgcc

SEQ ID NO: 2454427 - DNA, 22 bp, Homo sapiens
cagctcaggacagatgccacac

SEQ ID NO: 2454428 - DNA, 21 bp, Homo sapiens
cagctcatccatgcctcagaa

SEQ ID NO: 2454429 - DNA, 17 bp, Homo sapiens
cagctccaacctgcaaa

SEQ ID NO: 2454430 - DNA, 13 bp, Homo sapiens
cagctccaccctg

SEQ ID NO: 2454431 - DNA, 19 bp, Homo sapiens
cagctcccacaagcctctg

SEQ ID NO: 2454432 - DNA, 11 bp, Homo sapiens
cagctcccagg

SEQ ID NO: 2454433 - DNA, 18 bp, Homo sapiens
cagctccccctccctccc

SEQ ID NO: 2454434 - DNA, 20 bp, Homo sapiens
cagctccccctccctcccct

SEQ ID NO: 2454435 - DNA, 19 bp, Homo sapiens
cagctccctgtgcccccag

SEQ ID NO: 2454436 - DNA, 16 bp, Homo sapiens
cagctccggcctgtcc

SEQ ID NO: 2454437 - DNA, 15 bp, Homo sapiens
cagctcctctgtctc

SEQ ID NO: 2454438 - DNA, 15 bp, Homo sapiens
cagctcctgaccagt

SEQ ID NO: 2454439 - DNA, 20 bp, Homo sapiens
cagctcctgaccagttgcag

SEQ ID NO: 2454440 - DNA, 14 bp, Homo sapiens
cagctccttcctgg

SEQ ID NO: 2454441 - DNA, 18 bp, Homo sapiens
cagctctggacagcccca

SEQ ID NO: 2454442 - DNA, 23 bp, Homo sapiens
cagctctggacagccccaccctg

SEQ ID NO: 2454443 - DNA, 21 bp, Homo sapiens
cagctctgttcttcctcagcc

SEQ ID NO: 2454444 - DNA, 14 bp, Homo sapiens
cagctgagaggctg

SEQ ID NO: 2454445 - DNA, 14 bp, Homo sapiens
cagctgagcagggc

SEQ ID NO: 2454446 - DNA, 16 bp, Homo sapiens
cagctgagcagggccg

SEQ ID NO: 2454447 - DNA, 12 bp, Homo sapiens
cagctgcactga

SEQ ID NO: 2454448 - DNA, 15 bp, Homo sapiens
cagctgccaggagca

SEQ ID NO: 2454449 - DNA, 11 bp, Homo sapiens
cagctgccagt

SEQ ID NO: 2454450 - DNA, 22 bp, Homo sapiens
cagctgccccggcccctccccc

SEQ ID NO: 2454451 - DNA, 14 bp, Homo sapiens
catccctccccagt

SEQ ID NO: 2454452 - DNA, 23 bp, Homo sapiens
catccctggccccctccctggat

SEQ ID NO: 2454453 - DNA, 11 bp, Homo sapiens
catccctgggc

SEQ ID NO: 2454454 - DNA, 12 bp, Homo sapiens
catccctgggcc

SEQ ID NO: 2454455 - DNA, 14 bp, Homo sapiens
catccctgggcctg

SEQ ID NO: 2454456 - DNA, 16 bp, Homo sapiens
catccctgggcctgct

SEQ ID NO: 2454457 - DNA, 19 bp, Homo sapiens
catccctgggcctgctgct

SEQ ID NO: 2454458 - DNA, 23 bp, Homo sapiens
catccctgggcctgctgctgaga

SEQ ID NO: 2454459 - DNA, 21 bp, Homo sapiens
catccctgggccttgggctcc

SEQ ID NO: 2454460 - DNA, 12 bp, Homo sapiens
catccctgtggt

SEQ ID NO: 2454461 - DNA, 13 bp, Homo sapiens
catccgcaggtgc

SEQ ID NO: 2454462 - DNA, 20 bp, Homo sapiens
catccgcaggtgctggtccc

SEQ ID NO: 2454463 - DNA, 20 bp, Homo sapiens
catcctcaaagaaagtgtat

SEQ ID NO: 2454464 - DNA, 21 bp, Homo sapiens
catcctccacgttctgctcat

SEQ ID NO: 2454465 - DNA, 12 bp, Homo sapiens
catcctccagcc

SEQ ID NO: 2454466 - DNA, 15 bp, Homo sapiens
catcctccagcccct

SEQ ID NO: 2454467 - DNA, 16 bp, Homo sapiens
catcctcctcccaccc

SEQ ID NO: 2454468 - DNA, 19 bp, Homo sapiens
catcctgaccagctgctcc

SEQ ID NO: 2454469 - DNA, 23 bp, Homo sapiens
catcctgtgtgttaagctctgct

SEQ ID NO: 2454470 - DNA, 16 bp, Homo sapiens
catcgcaccattctga

SEQ ID NO: 2454471 - DNA, 15 bp, Homo sapiens
catcggaaaaataat

SEQ ID NO: 2454472 - DNA, 15 bp, Homo sapiens
catcgttgcccccat

SEQ ID NO: 2454473 - DNA, 19 bp, Homo sapiens
catctcaaaacagagggct

SEQ ID NO: 2454474 - DNA, 20 bp, Homo sapiens
catctcaaaacagagggctg

SEQ ID NO: 2454475 - DNA, 22 bp, Homo sapiens
catctcagtgaagaatacttct

SEQ ID NO: 2454476 - DNA, 19 bp, Homo sapiens
catctcatttaatcctccc

SEQ ID NO: 2454477 - DNA, 13 bp, Homo sapiens
catctccaagcag

SEQ ID NO: 2454478 - DNA, 17 bp, Homo sapiens
catctcccagataatgt

SEQ ID NO: 2454479 - DNA, 22 bp, Homo sapiens
catctcccagataatgtgaaaa

SEQ ID NO: 2454480 - DNA, 14 bp, Homo sapiens
catctccctggtgc

SEQ ID NO: 2454481 - DNA, 17 bp, Homo sapiens
catctcccttttccatg

SEQ ID NO: 2454482 - DNA, 19 bp, Homo sapiens
catctcctgccttcctcct

SEQ ID NO: 2454483 - DNA, 13 bp, Homo sapiens
catctctaccttc

SEQ ID NO: 2454484 - DNA, 21 bp, Homo sapiens
catctctaccttctccccagc

SEQ ID NO: 2454485 - DNA, 23 bp, Homo sapiens
catctctccctcccctgccattt

SEQ ID NO: 2454486 - DNA, 13 bp, Homo sapiens
catctctctgccc

SEQ ID NO: 2454487 - DNA, 18 bp, Homo sapiens
catctctctgcccaaccc

SEQ ID NO: 2454488 - DNA, 12 bp, Homo sapiens
catctctgggct

SEQ ID NO: 2454489 - DNA, 18 bp, Homo sapiens
catctctgggctggatga

SEQ ID NO: 2454490 - DNA, 19 bp, Homo sapiens
catctctgggctggatgag

SEQ ID NO: 2454491 - DNA, 22 bp, Homo sapiens
catctctgggctggatgagctc

SEQ ID NO: 2454492 - DNA, 10 bp, Homo sapiens
catctcttca

SEQ ID NO: 2454493 - DNA, 15 bp, Homo sapiens
catctgagtcctgga

SEQ ID NO: 2454494 - DNA, 19 bp, Homo sapiens
catctgcattttcacccca

SEQ ID NO: 2454495 - DNA, 22 bp, Homo sapiens
catctgcgtgacaataaaacat

SEQ ID NO: 2454496 - DNA, 22 bp, Homo sapiens
catctgctcctggatctccctg

SEQ ID NO: 2454497 - DNA, 14 bp, Homo sapiens
catctgctggtccg

SEQ ID NO: 2454498 - DNA, 13 bp, Homo sapiens
catctggcctggc

SEQ ID NO: 2454499 - DNA, 17 bp, Homo sapiens
catctggcctggccagt

SEQ ID NO: 2454500 - DNA, 16 bp, Homo sapiens
catctgggctcctcca

SEQ ID NO: 2454501 - DNA, 23 bp, Homo sapiens
catctggggagcaggcagccagc

SEQ ID NO: 2454502 - DNA, 22 bp, Homo sapiens
catctggttgaactctggtggc

SEQ ID NO: 2454503 - DNA, 18 bp, Homo sapiens
catctgtataccctctgt

SEQ ID NO: 2454504 - DNA, 15 bp, Homo sapiens
catctgtcccccttt

SEQ ID NO: 2454505 - DNA, 17 bp, Homo sapiens
catctgtccctccggga

SEQ ID NO: 2454506 - DNA, 11 bp, Homo sapiens
catctgtgtct

SEQ ID NO: 2454507 - DNA, 13 bp, Homo sapiens
catctgtgtcttg

SEQ ID NO: 2454508 - DNA, 20 bp, Homo sapiens
catcttcagttgtctctgat

SEQ ID NO: 2454509 - DNA, 17 bp, Homo sapiens
catcttctgccttagtc

SEQ ID NO: 2454510 - DNA, 19 bp, Homo sapiens
catcttcttcaccatttgg

SEQ ID NO: 2454511 - DNA, 13 bp, Homo sapiens
catcttgcattat

SEQ ID NO: 2454512 - DNA, 17 bp, Homo sapiens
catcttgcattatgcaa

SEQ ID NO: 2454513 - DNA, 12 bp, Homo sapiens
catcttgctacc

SEQ ID NO: 2454514 - DNA, 22 bp, Homo sapiens
catcttgctaccagtatttaga

SEQ ID NO: 2454515 - DNA, 17 bp, Homo sapiens
cacctactcacacaggc

SEQ ID NO: 2454516 - DNA, 18 bp, Homo sapiens
cacctactcacacaggca

SEQ ID NO: 2454517 - DNA, 19 bp, Homo sapiens
cacctagctgaatgttttt

SEQ ID NO: 2454518 - DNA, 21 bp, Homo sapiens
cacctagctgaatgtttttct

SEQ ID NO: 2454519 - DNA, 24 bp, Homo sapiens
cacctaggaagcctcagattcctt

SEQ ID NO: 2454520 - DNA, 15 bp, Homo sapiens
cacctattatcccag

SEQ ID NO: 2454521 - DNA, 18 bp, Homo sapiens
cacctattatcccagctg

SEQ ID NO: 2454522 - DNA, 19 bp, Homo sapiens
cacctattatcccagctgc

SEQ ID NO: 2454523 - DNA, 15 bp, Homo sapiens
cacctccatcccaga

SEQ ID NO: 2454524 - DNA, 23 bp, Homo sapiens
cacctccccccacaagtgccctc

SEQ ID NO: 2454525 - DNA, 20 bp, Homo sapiens
cacctccctatactgcttgg

SEQ ID NO: 2454526 - DNA, 21 bp, Homo sapiens
cacctccctatactgcttgga

SEQ ID NO: 2454527 - DNA, 19 bp, Homo sapiens
cacctcctgacacccttct

SEQ ID NO: 2454528 - DNA, 17 bp, Homo sapiens
cacctccttccctctct

SEQ ID NO: 2454529 - DNA, 22 bp, Homo sapiens
cacctccttccctctctggaga

SEQ ID NO: 2454530 - DNA, 22 bp, Homo sapiens
cacctctaacagcaccaaatca

SEQ ID NO: 2454531 - DNA, 16 bp, Homo sapiens
cacctgacacaccagg

SEQ ID NO: 2454532 - DNA, 11 bp, Homo sapiens
cacctgaggaa

SEQ ID NO: 2454533 - DNA, 21 bp, Homo sapiens
cacctgcactaacagagtggc

SEQ ID NO: 2454534 - DNA, 13 bp, Homo sapiens
cacctgccctacc

SEQ ID NO: 2454535 - DNA, 23 bp, Homo sapiens
cacctgctgagaaaacatgcctc

SEQ ID NO: 2454536 - DNA, 17 bp, Homo sapiens
cacctggacccctgcat

SEQ ID NO: 2454537 - DNA, 23 bp, Homo sapiens
cacctggcatcgcaccattctga

SEQ ID NO: 2454538 - DNA, 15 bp, Homo sapiens
cacctggccctgctt

SEQ ID NO: 2454539 - DNA, 16 bp, Homo sapiens
cacctggctctcacct

SEQ ID NO: 2454540 - DNA, 21 bp, Homo sapiens
cacctgggccctggggcctgt

SEQ ID NO: 2454541 - DNA, 17 bp, Homo sapiens
cacctggtggccatgct

SEQ ID NO: 2454542 - DNA, 20 bp, Homo sapiens
cacctgtaatgtgcgaggga

SEQ ID NO: 2454543 - DNA, 19 bp, Homo sapiens
cacctgtgcttcgggccct

SEQ ID NO: 2454544 - DNA, 14 bp, Homo sapiens
caccttccagctcc

SEQ ID NO: 2454545 - DNA, 16 bp, Homo sapiens
caccttggacatcctc

SEQ ID NO: 2454546 - DNA, 17 bp, Homo sapiens
caccttggacatcctcc

SEQ ID NO: 2454547 - DNA, 22 bp, Homo sapiens
caccttggacatcctcctccca

SEQ ID NO: 2454548 - DNA, 17 bp, Homo sapiens
caccttggcaccagaca

SEQ ID NO: 2454549 - DNA, 14 bp, Homo sapiens
cacctttaggttct

SEQ ID NO: 2454550 - DNA, 17 bp, Homo sapiens
caccttttttcaacagt

SEQ ID NO: 2454551 - DNA, 13 bp, Homo sapiens
cacgaaatgttat

SEQ ID NO: 2454552 - DNA, 15 bp, Homo sapiens
cacgaccgccccagt

SEQ ID NO: 2454553 - DNA, 22 bp, Homo sapiens
cacgaggaatctgtgggtctgg

SEQ ID NO: 2454554 - DNA, 11 bp, Homo sapiens
cacgagggctg

SEQ ID NO: 2454555 - DNA, 15 bp, Homo sapiens
cacgcacctgcctca

SEQ ID NO: 2454556 - DNA, 15 bp, Homo sapiens
cacgcccgtcctgcc

SEQ ID NO: 2454557 - DNA, 19 bp, Homo sapiens
cacgcccgtcctgcctgtg

SEQ ID NO: 2454558 - DNA, 21 bp, Homo sapiens
cacgcccgtcctgcctgtggc

SEQ ID NO: 2454559 - DNA, 16 bp, Homo sapiens
cacgctagggctggct

SEQ ID NO: 2454560 - DNA, 16 bp, Homo sapiens
cacggagccactcctc

SEQ ID NO: 2454561 - DNA, 19 bp, Homo sapiens
cacggagccactcctctga

SEQ ID NO: 2454562 - DNA, 21 bp, Homo sapiens
cacggcacctgggccctgggg

SEQ ID NO: 2454563 - DNA, 18 bp, Homo sapiens
cacggccacacagctgcc

SEQ ID NO: 2454564 - DNA, 14 bp, Homo sapiens
cacggccaggcaga

SEQ ID NO: 2454565 - DNA, 17 bp, Homo sapiens
cacggctctgtccccag

SEQ ID NO: 2454566 - DNA, 18 bp, Homo sapiens
cacggctctgtccccagc

SEQ ID NO: 2454567 - DNA, 18 bp, Homo sapiens
cacgggtgtcacggccag

SEQ ID NO: 2454568 - DNA, 22 bp, Homo sapiens
cacggtcggggcatctggcctg

SEQ ID NO: 2454569 - DNA, 20 bp, Homo sapiens
cacgtcaaatgcatacaagt

SEQ ID NO: 2454570 - DNA, 19 bp, Homo sapiens
cacgtcctgagaaagctca

SEQ ID NO: 2454571 - DNA, 14 bp, Homo sapiens
cacgtgacacaaac

SEQ ID NO: 2454572 - DNA, 13 bp, Homo sapiens
cacgtggcctctt

SEQ ID NO: 2454573 - DNA, 24 bp, Homo sapiens
cacgtgtgctgggatctactttcc

SEQ ID NO: 2454574 - DNA, 19 bp, Homo sapiens
cacgtgtgtttttctatta

SEQ ID NO: 2454575 - DNA, 22 bp, Homo sapiens
cactaaccaagctgagtttcct

SEQ ID NO: 2454576 - DNA, 23 bp, Homo sapiens
cactaaccaagctgagtttccta

SEQ ID NO: 2454577 - DNA, 19 bp, Homo sapiens
cactaatatatttaaaaat

SEQ ID NO: 2454578 - DNA, 11 bp, Homo sapiens
cactaattcat

SEQ ID NO: 2454579 - DNA, 23 bp, Homo sapiens
cactaccgaatgtgtctttagat

SEQ ID NO: 2454580 - DNA, 15 bp, Homo sapiens
cactactgacatgtg

SEQ ID NO: 2454581 - DNA, 14 bp, Homo sapiens
cactagacaagcca

SEQ ID NO: 2454582 - DNA, 17 bp, Homo sapiens
cactagacaagccagaa

SEQ ID NO: 2454583 - DNA, 12 bp, Homo sapiens
cactagccaaac

SEQ ID NO: 2454584 - DNA, 16 bp, Homo sapiens
cactagccaaacctca

SEQ ID NO: 2454585 - DNA, 15 bp, Homo sapiens
cactagcctcagggg

SEQ ID NO: 2454586 - DNA, 19 bp, Homo sapiens
cactcaaggcggtgcttga

SEQ ID NO: 2454587 - DNA, 16 bp, Homo sapiens
cactcactaggccccc

SEQ ID NO: 2454588 - DNA, 18 bp, Homo sapiens
cactcagagacatgcaga

SEQ ID NO: 2454589 - DNA, 15 bp, Homo sapiens
cactccaagcccagc

SEQ ID NO: 2454590 - DNA, 21 bp, Homo sapiens
cactccaagcccagcccatgg

SEQ ID NO: 2454591 - DNA, 23 bp, Homo sapiens
cactcccacctgacacaccaggc

SEQ ID NO: 2454592 - DNA, 19 bp, Homo sapiens
cactccccgaagtcttttg

SEQ ID NO: 2454593 - DNA, 20 bp, Homo sapiens
cactcctctgactcagggct

SEQ ID NO: 2454594 - DNA, 16 bp, Homo sapiens
cactcctctgctgacc

SEQ ID NO: 2454595 - DNA, 21 bp, Homo sapiens
cactccttcctgccccaactc

SEQ ID NO: 2454596 - DNA, 14 bp, Homo sapiens
catgcccctggctg

SEQ ID NO: 2454597 - DNA, 16 bp, Homo sapiens
catgcccctggctggg

SEQ ID NO: 2454598 - DNA, 23 bp, Homo sapiens
catgccctgtgcaacctcttggc

SEQ ID NO: 2454599 - DNA, 16 bp, Homo sapiens
catgcctcagaagtgc

SEQ ID NO: 2454600 - DNA, 14 bp, Homo sapiens
catgcctctgaggc

SEQ ID NO: 2454601 - DNA, 23 bp, Homo sapiens
catgcctctgaggccagcctggc

SEQ ID NO: 2454602 - DNA, 14 bp, Homo sapiens
catgcgctcagggc

SEQ ID NO: 2454603 - DNA, 17 bp, Homo sapiens
catgcggtagccagcac

SEQ ID NO: 2454604 - DNA, 17 bp, Homo sapiens
catgctcatctgctggt

SEQ ID NO: 2454605 - DNA, 19 bp, Homo sapiens
catgctcctcttccccaga

SEQ ID NO: 2454606 - DNA, 18 bp, Homo sapiens
catgctgaggcctgggcc

SEQ ID NO: 2454607 - DNA, 21 bp, Homo sapiens
catgctgctggggaagacagt

SEQ ID NO: 2454608 - DNA, 22 bp, Homo sapiens
catgctgctggggaagacagtg

SEQ ID NO: 2454609 - DNA, 17 bp, Homo sapiens
catgctggaaaataata

SEQ ID NO: 2454610 - DNA, 22 bp, Homo sapiens
catgctggaaaataatactgct

SEQ ID NO: 2454611 - DNA, 23 bp, Homo sapiens
catgctggaaaataatactgctg

SEQ ID NO: 2454612 - DNA, 18 bp, Homo sapiens
catgctggagggaggctg

SEQ ID NO: 2454613 - DNA, 20 bp, Homo sapiens
catgctgtgcgcccagggct

SEQ ID NO: 2454614 - DNA, 17 bp, Homo sapiens
catgcttagcagtcccc

SEQ ID NO: 2454615 - DNA, 21 bp, Homo sapiens
catgcttattccatgactgct

SEQ ID NO: 2454616 - DNA, 21 bp, Homo sapiens
catggaaatttaaagcaggtt

SEQ ID NO: 2454617 - DNA, 14 bp, Homo sapiens
catggacaatggac

SEQ ID NO: 2454618 - DNA, 17 bp, Homo sapiens
catggacaatggaccgg

SEQ ID NO: 2454619 - DNA, 18 bp, Homo sapiens
catggacaatggaccgga

SEQ ID NO: 2454620 - DNA, 14 bp, Homo sapiens
catggacaggctgg

SEQ ID NO: 2454621 - DNA, 19 bp, Homo sapiens
catggactctgtcctgaag

SEQ ID NO: 2454622 - DNA, 23 bp, Homo sapiens
catggactctgtcctgaaggcct

SEQ ID NO: 2454623 - DNA, 13 bp, Homo sapiens
catggagaaagct

SEQ ID NO: 2454624 - DNA, 17 bp, Homo sapiens
catggagaaagctgact

SEQ ID NO: 2454625 - DNA, 18 bp, Homo sapiens
catggagaaagctgactt

SEQ ID NO: 2454626 - DNA, 19 bp, Homo sapiens
catggagaaagctgacttg

SEQ ID NO: 2454627 - DNA, 22 bp, Homo sapiens
catggagaaagctgacttggct

SEQ ID NO: 2454628 - DNA, 18 bp, Homo sapiens
catggagattgacctgga

SEQ ID NO: 2454629 - DNA, 15 bp, Homo sapiens
catggagctgggcta

SEQ ID NO: 2454630 - DNA, 13 bp, Homo sapiens
catggaggttcta

SEQ ID NO: 2454631 - DNA, 15 bp, Homo sapiens
catggaggttctaag

SEQ ID NO: 2454632 - DNA, 17 bp, Homo sapiens
catggaggttctaaggc

SEQ ID NO: 2454633 - DNA, 17 bp, Homo sapiens
catggagtggcagccca

SEQ ID NO: 2454634 - DNA, 12 bp, Homo sapiens
catggatttctt

SEQ ID NO: 2454635 - DNA, 23 bp, Homo sapiens
catggcagatgtaggagggactg

SEQ ID NO: 2454636 - DNA, 20 bp, Homo sapiens
catggcagggggctgctgct

SEQ ID NO: 2454637 - DNA, 22 bp, Homo sapiens
catggccagcagcacctgccct

SEQ ID NO: 2454638 - DNA, 12 bp, Homo sapiens
catggcccctct

SEQ ID NO: 2454639 - DNA, 20 bp, Homo sapiens
catggcctgcaaactgggaa

SEQ ID NO: 2454640 - DNA, 15 bp, Homo sapiens
catgggcagagccca

SEQ ID NO: 2454641 - DNA, 17 bp, Homo sapiens
catgggcagagcccaag

SEQ ID NO: 2454642 - DNA, 15 bp, Homo sapiens
catgggccagagcct

SEQ ID NO: 2454643 - DNA, 23 bp, Homo sapiens
catggggagggattctggttcca

SEQ ID NO: 2454644 - DNA, 19 bp, Homo sapiens
catgggggagggggcagaa

SEQ ID NO: 2454645 - DNA, 21 bp, Homo sapiens
catgggggagggggcagaagt

SEQ ID NO: 2454646 - DNA, 17 bp, Homo sapiens
catggtcacacactgat

SEQ ID NO: 2454647 - DNA, 21 bp, Homo sapiens
catggtcacacactgatgctt

SEQ ID NO: 2454648 - DNA, 16 bp, Homo sapiens
catggtcagccctagg

SEQ ID NO: 2454649 - DNA, 15 bp, Homo sapiens
catggtcccacatcc

SEQ ID NO: 2454650 - DNA, 21 bp, Homo sapiens
catggtcccacatccctgggc

SEQ ID NO: 2454651 - DNA, 23 bp, Homo sapiens
catggtcccacatccctgggcct

SEQ ID NO: 2454652 - DNA, 15 bp, Homo sapiens
catggtgccccagga

SEQ ID NO: 2454653 - DNA, 16 bp, Homo sapiens
catggtgccccaggac

SEQ ID NO: 2454654 - DNA, 13 bp, Homo sapiens
catggtgctagga

SEQ ID NO: 2454655 - DNA, 15 bp, Homo sapiens
catggtgctgggaga

SEQ ID NO: 2454656 - DNA, 22 bp, Homo sapiens
catggtgctgggagaggcagcc

SEQ ID NO: 2454657 - DNA, 16 bp, Homo sapiens
ccacctgtctcagcct

SEQ ID NO: 2454658 - DNA, 16 bp, Homo sapiens
ccacgacactgcagcc

SEQ ID NO: 2454659 - DNA, 17 bp, Homo sapiens
ccacgacactgcagccc

SEQ ID NO: 2454660 - DNA, 15 bp, Homo sapiens
ccacgactggccagg

SEQ ID NO: 2454661 - DNA, 18 bp, Homo sapiens
ccacgactggccagggcc

SEQ ID NO: 2454662 - DNA, 14 bp, Homo sapiens
ccacgactgtctcc

SEQ ID NO: 2454663 - DNA, 17 bp, Homo sapiens
ccacgcccgtcctgcct

SEQ ID NO: 2454664 - DNA, 21 bp, Homo sapiens
ccacgcctcttgaccaggctg

SEQ ID NO: 2454665 - DNA, 20 bp, Homo sapiens
ccacggcacctgggccctgg

SEQ ID NO: 2454666 - DNA, 23 bp, Homo sapiens
ccacgttctgctcatcattctct

SEQ ID NO: 2454667 - DNA, 17 bp, Homo sapiens
ccactaaccttgcctgg

SEQ ID NO: 2454668 - DNA, 15 bp, Homo sapiens
ccactagcctcaggg

SEQ ID NO: 2454669 - DNA, 18 bp, Homo sapiens
ccactcactaggccccca

SEQ ID NO: 2454670 - DNA, 12 bp, Homo sapiens
ccactcagagac

SEQ ID NO: 2454671 - DNA, 13 bp, Homo sapiens
ccactcagagaca

SEQ ID NO: 2454672 - DNA, 12 bp, Homo sapiens
ccactccctcac

SEQ ID NO: 2454673 - DNA, 13 bp, Homo sapiens
ccactccctcaca

SEQ ID NO: 2454674 - DNA, 14 bp, Homo sapiens
ccactccctcacaa

SEQ ID NO: 2454675 - DNA, 16 bp, Homo sapiens
ccactccgagaggtgg

SEQ ID NO: 2454676 - DNA, 14 bp, Homo sapiens
ccactcctctgact

SEQ ID NO: 2454677 - DNA, 14 bp, Homo sapiens
ccactcctctgctg

SEQ ID NO: 2454678 - DNA, 15 bp, Homo sapiens
ccactcctctgctga

SEQ ID NO: 2454679 - DNA, 18 bp, Homo sapiens
ccactccttcctgcccca

SEQ ID NO: 2454680 - DNA, 15 bp, Homo sapiens
ccactctgctctgat

SEQ ID NO: 2454681 - DNA, 18 bp, Homo sapiens
ccactctgctctgatgca

SEQ ID NO: 2454682 - DNA, 23 bp, Homo sapiens
ccactctgctctgatgcatcaga

SEQ ID NO: 2454683 - DNA, 17 bp, Homo sapiens
ccactctgcttctctga

SEQ ID NO: 2454684 - DNA, 20 bp, Homo sapiens
ccactctgcttctctgactt

SEQ ID NO: 2454685 - DNA, 23 bp, Homo sapiens
ccactctggagcatttctcatca

SEQ ID NO: 2454686 - DNA, 21 bp, Homo sapiens
ccactctggcagccacacttc

SEQ ID NO: 2454687 - DNA, 13 bp, Homo sapiens
ccactctgtaatt

SEQ ID NO: 2454688 - DNA, 15 bp, Homo sapiens
ccactgaaaaaatat

SEQ ID NO: 2454689 - DNA, 15 bp, Homo sapiens
ccactgacagcctcc

SEQ ID NO: 2454690 - DNA, 16 bp, Homo sapiens
ccactgacagcctccc

SEQ ID NO: 2454691 - DNA, 19 bp, Homo sapiens
ccactgccccctgctgcca

SEQ ID NO: 2454692 - DNA, 20 bp, Homo sapiens
ccactgccccctgctgccat

SEQ ID NO: 2454693 - DNA, 14 bp, Homo sapiens
ccactgccttcgct

SEQ ID NO: 2454694 - DNA, 22 bp, Homo sapiens
ccactgccttcgcttcttgcct

SEQ ID NO: 2454695 - DNA, 23 bp, Homo sapiens
ccactgccttcgcttcttgcctc

SEQ ID NO: 2454696 - DNA, 11 bp, Homo sapiens
ccactggctcc

SEQ ID NO: 2454697 - DNA, 15 bp, Homo sapiens
ccactggggctcaga

SEQ ID NO: 2454698 - DNA, 18 bp, Homo sapiens
ccactggggctcagagcc

SEQ ID NO: 2454699 - DNA, 19 bp, Homo sapiens
ccactgtcctgggcctgca

SEQ ID NO: 2454700 - DNA, 20 bp, Homo sapiens
ccactgtcctgggcctgcag

SEQ ID NO: 2454701 - DNA, 21 bp, Homo sapiens
ccactgtcctgggcctgcaga

SEQ ID NO: 2454702 - DNA, 18 bp, Homo sapiens
ccactgtgcaggttccca

SEQ ID NO: 2454703 - DNA, 15 bp, Homo sapiens
ccactgtgcctcaga

SEQ ID NO: 2454704 - DNA, 18 bp, Homo sapiens
ccactgtgcctcagagac

SEQ ID NO: 2454705 - DNA, 19 bp, Homo sapiens
ccactgtgcctcagagacc

SEQ ID NO: 2454706 - DNA, 22 bp, Homo sapiens
ccactgtgcctcagagaccagg

SEQ ID NO: 2454707 - DNA, 13 bp, Homo sapiens
ccactgtgtgaat

SEQ ID NO: 2454708 - DNA, 15 bp, Homo sapiens
ccactgtttggaaat

SEQ ID NO: 2454709 - DNA, 13 bp, Homo sapiens
ccacttctgcact

SEQ ID NO: 2454710 - DNA, 19 bp, Homo sapiens
ccacttgcctcttccttga

SEQ ID NO: 2454711 - DNA, 21 bp, Homo sapiens
ccacttgtccgctgggtggta

SEQ ID NO: 2454712 - DNA, 21 bp, Homo sapiens
ccacttgtccttagcctggac

SEQ ID NO: 2454713 - DNA, 22 bp, Homo sapiens
ccacttgtccttagcctggacc

SEQ ID NO: 2454714 - DNA, 12 bp, Homo sapiens
ccactttcagct

SEQ ID NO: 2454715 - DNA, 17 bp, Homo sapiens
ccactttcagctgtctt

SEQ ID NO: 2454716 - DNA, 22 bp, Homo sapiens
ccactttgtttcgtggggaggt

SEQ ID NO: 2454717 - DNA, 14 bp, Homo sapiens
ccactttttagaaa

SEQ ID NO: 2454718 - DNA, 22 bp, Homo sapiens
ccagaaagccccacccaggcca

SEQ ID NO: 2454719 - DNA, 23 bp, Homo sapiens
ccagaaagccccacccaggccag

SEQ ID NO: 2454720 - DNA, 16 bp, Homo sapiens
ccagaaccaattattt

SEQ ID NO: 2454721 - DNA, 21 bp, Homo sapiens
ccagaagatgactgagggtga

SEQ ID NO: 2454722 - DNA, 20 bp, Homo sapiens
ccagaagctcccccagcaaa

SEQ ID NO: 2454723 - DNA, 16 bp, Homo sapiens
ccagaagtaccagact

SEQ ID NO: 2454724 - DNA, 21 bp, Homo sapiens
ccagaatgctgtacatctatt

SEQ ID NO: 2454725 - DNA, 14 bp, Homo sapiens
ccagacatgccaca

SEQ ID NO: 2454726 - DNA, 13 bp, Homo sapiens
ccagacctgaggc

SEQ ID NO: 2454727 - DNA, 14 bp, Homo sapiens
ccagacctgaggcg

SEQ ID NO: 2454728 - DNA, 15 bp, Homo sapiens
ccagacctgatcctg

SEQ ID NO: 2454729 - DNA, 21 bp, Homo sapiens
ccagacctgatcctggaggcc

SEQ ID NO: 2454730 - DNA, 14 bp, Homo sapiens
ccagacgcctggct

SEQ ID NO: 2454731 - DNA, 21 bp, Homo sapiens
ccagactcgttcttctgggaa

SEQ ID NO: 2454732 - DNA, 18 bp, Homo sapiens
ccagactcttgcctgttt

SEQ ID NO: 2454733 - DNA, 13 bp, Homo sapiens
ccagagaacccag

SEQ ID NO: 2454734 - DNA, 23 bp, Homo sapiens
ccagagaacccagcccacccccg

SEQ ID NO: 2454735 - DNA, 20 bp, Homo sapiens
ccagagacatacttgaaggg

SEQ ID NO: 2454736 - DNA, 12 bp, Homo sapiens
ccagagacccag

SEQ ID NO: 2454737 - DNA, 14 bp, Homo sapiens
ccagagacccagcg

SEQ ID NO: 2454738 - DNA, 20 bp, Homo sapiens
ccagagagcccgaggaggtg

SEQ ID NO: 2454739 - DNA, 20 bp, Homo sapiens
ccagagatccaaaagaagcc

SEQ ID NO: 2454740 - DNA, 11 bp, Homo sapiens
ccagagccagg

SEQ ID NO: 2454741 - DNA, 12 bp, Homo sapiens
ccagagccaggg

SEQ ID NO: 2454742 - DNA, 18 bp, Homo sapiens
ccagagcccagctccaag

SEQ ID NO: 2454743 - DNA, 14 bp, Homo sapiens
ccagagcccaggct

SEQ ID NO: 2454744 - DNA, 15 bp, Homo sapiens
ccagagcccaggctc

SEQ ID NO: 2454745 - DNA, 12 bp, Homo sapiens
ccagagcctggg

SEQ ID NO: 2454746 - DNA, 13 bp, Homo sapiens
ccagagcctgggg

SEQ ID NO: 2454747 - DNA, 15 bp, Homo sapiens
ccagagcctggggct

SEQ ID NO: 2454748 - DNA, 18 bp, Homo sapiens
ccagagcctggggctcta

SEQ ID NO: 2454749 - DNA, 19 bp, Homo sapiens
ccagaggaaggggccagag

SEQ ID NO: 2454750 - DNA, 15 bp, Homo sapiens
ccagaggccaaggag

SEQ ID NO: 2454751 - DNA, 19 bp, Homo sapiens
ccagaggccaaggaggcct

SEQ ID NO: 2454752 - DNA, 22 bp, Homo sapiens
ccagaggcccccagcccagggc

SEQ ID NO: 2454753 - DNA, 15 bp, Homo sapiens
ccagaggggcctgcc

SEQ ID NO: 2454754 - DNA, 18 bp, Homo sapiens
ccagaggggcctgccacc

SEQ ID NO: 2454755 - DNA, 14 bp, Homo sapiens
ccagagggtctggg

SEQ ID NO: 2454756 - DNA, 18 bp, Homo sapiens
ccagagggtctgggggca

SEQ ID NO: 2454757 - DNA, 22 bp, Homo sapiens
ccagatacggacagagaccaag

SEQ ID NO: 2454758 - DNA, 20 bp, Homo sapiens
ccagatagtgtagctgagga

SEQ ID NO: 2454759 - DNA, 14 bp, Homo sapiens
ccagatccagcctg

SEQ ID NO: 2454760 - DNA, 16 bp, Homo sapiens
ccagatgcagctcaag

SEQ ID NO: 2454761 - DNA, 15 bp, Homo sapiens
ccagatgcagggcag

SEQ ID NO: 2454762 - DNA, 14 bp, Homo sapiens
ccagatgctttcct

SEQ ID NO: 2454763 - DNA, 21 bp, Homo sapiens
ccagattgacgacaagtgctg

SEQ ID NO: 2454764 - DNA, 16 bp, Homo sapiens
ccagcaaagcccccag

SEQ ID NO: 2454765 - DNA, 24 bp, Homo sapiens
ccagcaaagcccccagagcccagg

SEQ ID NO: 2454766 - DNA, 22 bp, Homo sapiens
ccagcaagcggggatgtccctg

SEQ ID NO: 2454767 - DNA, 22 bp, Homo sapiens
ccagcacagcttagatttcata

SEQ ID NO: 2454768 - DNA, 13 bp, Homo sapiens
ccagcacagcttg

SEQ ID NO: 2454769 - DNA, 22 bp, Homo sapiens
ccagcactgcttgaggaaaaca

SEQ ID NO: 2454770 - DNA, 19 bp, Homo sapiens
ccagcacttgtccagctga

SEQ ID NO: 2454771 - DNA, 12 bp, Homo sapiens
ccagcagacaga

SEQ ID NO: 2454772 - DNA, 13 bp, Homo sapiens
ccagcagacagag

SEQ ID NO: 2454773 - DNA, 22 bp, Homo sapiens
ccagcagacagagccaggagaa

SEQ ID NO: 2454774 - DNA, 21 bp, Homo sapiens
ccagcagccccacaccagggc

SEQ ID NO: 2454775 - DNA, 11 bp, Homo sapiens
ccagcatctgg

SEQ ID NO: 2454776 - DNA, 17 bp, Homo sapiens
ccagcattccagcccct

SEQ ID NO: 2454777 - DNA, 19 bp, Homo sapiens
ccagcattccagcccctct

SEQ ID NO: 2454778 - DNA, 18 bp, Homo sapiens
ccagccaaaccctgtctg

SEQ ID NO: 2454779 - DNA, 14 bp, Homo sapiens
ccagccaggcccag

SEQ ID NO: 2454780 - DNA, 16 bp, Homo sapiens
ccagccaggcccagcc

SEQ ID NO: 2454781 - DNA, 18 bp, Homo sapiens
ccagccaggcccagccga

SEQ ID NO: 2454782 - DNA, 21 bp, Homo sapiens
ccagcccaagtgaggcagccg

SEQ ID NO: 2454783 - DNA, 17 bp, Homo sapiens
ccagcccacccccggca

SEQ ID NO: 2454784 - DNA, 21 bp, Homo sapiens
ccagcccacccccggcagcag

SEQ ID NO: 2454785 - DNA, 13 bp, Homo sapiens
ccagcccagagac

SEQ ID NO: 2454786 - DNA, 16 bp, Homo sapiens
ccagcccagccccact

SEQ ID NO: 2454787 - DNA, 18 bp, Homo sapiens
ccagccccactcctctgc

SEQ ID NO: 2454788 - DNA, 22 bp, Homo sapiens
ccagccccctaagagagcacct

SEQ ID NO: 2454789 - DNA, 13 bp, Homo sapiens
ccagcccctctgg

SEQ ID NO: 2454790 - DNA, 23 bp, Homo sapiens
ccagcccctctggtcgctcctgc

SEQ ID NO: 2454791 - DNA, 20 bp, Homo sapiens
ccagcccctcttggagaagt

SEQ ID NO: 2454792 - DNA, 13 bp, Homo sapiens
ccagcccctggcc

SEQ ID NO: 2454793 - DNA, 14 bp, Homo sapiens
ccagccctgcctgg

SEQ ID NO: 2454794 - DNA, 15 bp, Homo sapiens
ccagccctgcctgga

SEQ ID NO: 2454795 - DNA, 17 bp, Homo sapiens
ccagccctgcctggagg

SEQ ID NO: 2454796 - DNA, 18 bp, Homo sapiens
ccagccctgcctggagga

SEQ ID NO: 2454797 - DNA, 18 bp, Homo sapiens
ccagccgagcaggaggcc

SEQ ID NO: 2454798 - DNA, 23 bp, Homo sapiens
ccagccgccggctgtgcagtcct

SEQ ID NO: 2454799 - DNA, 12 bp, Homo sapiens
ccagcctggccc

SEQ ID NO: 2454800 - DNA, 12 bp, Homo sapiens
ccagcctggcct

SEQ ID NO: 2454801 - DNA, 13 bp, Homo sapiens
ccagcctggcctc

SEQ ID NO: 2454802 - DNA, 17 bp, Homo sapiens
ccagcctggcctcctgc

SEQ ID NO: 2454803 - DNA, 18 bp, Homo sapiens
ccagcctggcctcctgcc

SEQ ID NO: 2454804 - DNA, 20 bp, Homo sapiens
ccagcctggcctcctgcctc

SEQ ID NO: 2454805 - DNA, 14 bp, Homo sapiens
ccagcctgggccta

SEQ ID NO: 2454806 - DNA, 21 bp, Homo sapiens
ccagcctgggcctatggagag

SEQ ID NO: 2454807 - DNA, 13 bp, Homo sapiens
ccagcctggggtc

SEQ ID NO: 2454808 - DNA, 15 bp, Homo sapiens
ccagcctttgttccc

SEQ ID NO: 2454809 - DNA, 21 bp, Homo sapiens
ccagcctttgttccccactgg

SEQ ID NO: 2454810 - DNA, 16 bp, Homo sapiens
cccacctccccttggg

SEQ ID NO: 2454811 - DNA, 15 bp, Homo sapiens
cccacctcctgacac

SEQ ID NO: 2454812 - DNA, 16 bp, Homo sapiens
cccacgacactgcagc

SEQ ID NO: 2454813 - DNA, 14 bp, Homo sapiens
cccacgagggctgg

SEQ ID NO: 2454814 - DNA, 15 bp, Homo sapiens
cccacgctcaccccc

SEQ ID NO: 2454815 - DNA, 14 bp, Homo sapiens
cccactccatctgg

SEQ ID NO: 2454816 - DNA, 19 bp, Homo sapiens
cccactccatctggtagaa

SEQ ID NO: 2454817 - DNA, 16 bp, Homo sapiens
cccactcccaggacca

SEQ ID NO: 2454818 - DNA, 13 bp, Homo sapiens
cccactccctcac

SEQ ID NO: 2454819 - DNA, 14 bp, Homo sapiens
cccactccctcaca

SEQ ID NO: 2454820 - DNA, 12 bp, Homo sapiens
cccactctccta

SEQ ID NO: 2454821 - DNA, 15 bp, Homo sapiens
cccactctcctaggc

SEQ ID NO: 2454822 - DNA, 21 bp, Homo sapiens
cccactctcctaggcattctg

SEQ ID NO: 2454823 - DNA, 14 bp, Homo sapiens
cccactctgctctg

SEQ ID NO: 2454824 - DNA, 15 bp, Homo sapiens
cccactctgctctga

SEQ ID NO: 2454825 - DNA, 19 bp, Homo sapiens
cccagacataaaggaaaag

SEQ ID NO: 2454826 - DNA, 23 bp, Homo sapiens
cccagactagatgtagtattttt

SEQ ID NO: 2454827 - DNA, 12 bp, Homo sapiens
cccagactcaga

SEQ ID NO: 2454828 - DNA, 21 bp, Homo sapiens
cccagagacatacttgaaggg

SEQ ID NO: 2454829 - DNA, 13 bp, Homo sapiens
cccagagagcccg

SEQ ID NO: 2454830 - DNA, 20 bp, Homo sapiens
cccagagcacctgctgtctg

SEQ ID NO: 2454831 - DNA, 15 bp, Homo sapiens
cccagagcccagctc

SEQ ID NO: 2454832 - DNA, 16 bp, Homo sapiens
cccagagcccagctcc

SEQ ID NO: 2454833 - DNA, 17 bp, Homo sapiens
cccagagcccagctcca

SEQ ID NO: 2454834 - DNA, 19 bp, Homo sapiens
cccagagcccaggctcggc

SEQ ID NO: 2454835 - DNA, 21 bp, Homo sapiens
cccagaggaaggggccagagg

SEQ ID NO: 2454836 - DNA, 22 bp, Homo sapiens
cccagaggaaggggccagaggc

SEQ ID NO: 2454837 - DNA, 24 bp, Homo sapiens
cccagaggaaggggccagaggctc

SEQ ID NO: 2454838 - DNA, 16 bp, Homo sapiens
cccagaggattgctgc

SEQ ID NO: 2454839 - DNA, 13 bp, Homo sapiens
cccagaggggcct

SEQ ID NO: 2454840 - DNA, 14 bp, Homo sapiens
cccagaggggcctg

SEQ ID NO: 2454841 - DNA, 17 bp, Homo sapiens
cccagaggggcctgcca

SEQ ID NO: 2454842 - DNA, 23 bp, Homo sapiens
cccagaggggcctgccacctgga

SEQ ID NO: 2454843 - DNA, 15 bp, Homo sapiens
cccagcaaagccccc

SEQ ID NO: 2454844 - DNA, 18 bp, Homo sapiens
cccagcacagcttgacct

SEQ ID NO: 2454845 - DNA, 19 bp, Homo sapiens
cccagcacagcttgacctg

SEQ ID NO: 2454846 - DNA, 21 bp, Homo sapiens
cccagcactgcttgaggaaaa

SEQ ID NO: 2454847 - DNA, 14 bp, Homo sapiens
cccagcagctgcca

SEQ ID NO: 2454848 - DNA, 19 bp, Homo sapiens
cccagcattccagcccctc

SEQ ID NO: 2454849 - DNA, 11 bp, Homo sapiens
cccagccagcg

SEQ ID NO: 2454850 - DNA, 23 bp, Homo sapiens
cccagccagcgtcggtctgtgcc

SEQ ID NO: 2454851 - DNA, 15 bp, Homo sapiens
ccccactgaccagaa

SEQ ID NO: 2454852 - DNA, 21 bp, Homo sapiens
ccccacttgcctcttccttga

SEQ ID NO: 2454853 - DNA, 15 bp, Homo sapiens
ccccactttctttct

SEQ ID NO: 2454854 - DNA, 23 bp, Homo sapiens
ccccagacttgttggcgtaggct

SEQ ID NO: 2454855 - DNA, 11 bp, Homo sapiens
ccccagatatc

SEQ ID NO: 2454856 - DNA, 14 bp, Homo sapiens
ccccagcaaagccc

SEQ ID NO: 2454857 - DNA, 19 bp, Homo sapiens
ccccagcattccagcccct

SEQ ID NO: 2454858 - DNA, 13 bp, Homo sapiens
ccccagcccagag

SEQ ID NO: 2454859 - DNA, 15 bp, Homo sapiens
ccccagcccagagac

SEQ ID NO: 2454860 - DNA, 21 bp, Homo sapiens
ccccagccgcttggcgatgcc

SEQ ID NO: 2454861 - DNA, 11 bp, Homo sapiens
ccccagcctgg

SEQ ID NO: 2454862 - DNA, 15 bp, Homo sapiens
ccccagcctgggcct

SEQ ID NO: 2454863 - DNA, 20 bp, Homo sapiens
ccccagcctgggcctatgga

SEQ ID NO: 2454864 - DNA, 17 bp, Homo sapiens
ccccagctaagaacctg

SEQ ID NO: 2454865 - DNA, 21 bp, Homo sapiens
ccccagctaagaacctggaac

SEQ ID NO: 2454866 - DNA, 14 bp, Homo sapiens
ccccagctcccacc

SEQ ID NO: 2454867 - DNA, 16 bp, Homo sapiens
ccccaggaccagctca

SEQ ID NO: 2454868 - DNA, 18 bp, Homo sapiens
ccccaggaccagctcagg

SEQ ID NO: 2454869 - DNA, 21 bp, Homo sapiens
ccccaggaccagctcaggaca

SEQ ID NO: 2454870 - DNA, 21 bp, Homo sapiens
ccccaggacctggctgccata

SEQ ID NO: 2454871 - DNA, 22 bp, Homo sapiens
ccccagggaagcagcagcctcg

SEQ ID NO: 2454872 - DNA, 19 bp, Homo sapiens
ccccagggcacaggagcta

SEQ ID NO: 2454873 - DNA, 23 bp, Homo sapiens
ccccagggcacaggagctacctg

SEQ ID NO: 2454874 - DNA, 22 bp, Homo sapiens
ccccagggctgtaactgccagg

SEQ ID NO: 2454875 - DNA, 16 bp, Homo sapiens
ccccagggtcctggga

SEQ ID NO: 2454876 - DNA, 18 bp, Homo sapiens
ccccagggtcctgggagg

SEQ ID NO: 2454877 - DNA, 20 bp, Homo sapiens
ccccagggtcctgggaggag

SEQ ID NO: 2454878 - DNA, 23 bp, Homo sapiens
ccccaggtaggggcccctctcag

SEQ ID NO: 2454879 - DNA, 22 bp, Homo sapiens
ccccagttcctgtggctccctc

SEQ ID NO: 2454880 - DNA, 15 bp, Homo sapiens
ccccatactcctatg

SEQ ID NO: 2454881 - DNA, 16 bp, Homo sapiens
ccccatcccacaccct

SEQ ID NO: 2454882 - DNA, 19 bp, Homo sapiens
ccccatcgttgcccccatt

SEQ ID NO: 2454883 - DNA, 16 bp, Homo sapiens
ccccatctctccctcc

SEQ ID NO: 2454884 - DNA, 16 bp, Homo sapiens
ccccatgacctccagc

SEQ ID NO: 2454885 - DNA, 19 bp, Homo sapiens
ccccatggagctgggctaa

SEQ ID NO: 2454886 - DNA, 19 bp, Homo sapiens
ccccatggtcagccctagg

SEQ ID NO: 2454887 - DNA, 21 bp, Homo sapiens
ccccatggtgctaggaagagg

SEQ ID NO: 2454888 - DNA, 16 bp, Homo sapiens
ccccatgtgtcctggt

SEQ ID NO: 2454889 - DNA, 18 bp, Homo sapiens
ccccatgtgtcctggttc

SEQ ID NO: 2454890 - DNA, 16 bp, Homo sapiens
ccccattcccgcagtg

SEQ ID NO: 2454891 - DNA, 14 bp, Homo sapiens
ccccatttctgagg

SEQ ID NO: 2454892 - DNA, 20 bp, Homo sapiens
cccccaaccatttcctcaga

SEQ ID NO: 2454893 - DNA, 20 bp, Homo sapiens
cccccacctctgctgcctcc

SEQ ID NO: 2454894 - DNA, 14 bp, Homo sapiens
cccccactccctca

SEQ ID NO: 2454895 - DNA, 23 bp, Homo sapiens
cccccagagcccaggctcggcct

SEQ ID NO: 2454896 - DNA, 22 bp, Homo sapiens
cccccagccccctcctggtgcc

SEQ ID NO: 2454897 - DNA, 15 bp, Homo sapiens
cccccagcctctggc

SEQ ID NO: 2454898 - DNA, 12 bp, Homo sapiens
cccccagcctgt

SEQ ID NO: 2454899 - DNA, 13 bp, Homo sapiens
cccccagctaaga

SEQ ID NO: 2454900 - DNA, 18 bp, Homo sapiens
cccccagctaagaacctg

SEQ ID NO: 2454901 - DNA, 21 bp, Homo sapiens
cccccagctaagaacctggaa

SEQ ID NO: 2454902 - DNA, 15 bp, Homo sapiens
cccccaggaccagaa

SEQ ID NO: 2454903 - DNA, 16 bp, Homo sapiens
cccccatcatcctctg

SEQ ID NO: 2454904 - DNA, 14 bp, Homo sapiens
ccccccagatatca

SEQ ID NO: 2454905 - DNA, 21 bp, Homo sapiens
ccccccagatatcatctacct

SEQ ID NO: 2454906 - DNA, 12 bp, Homo sapiens
ccccccagcctc

SEQ ID NO: 2454907 - DNA, 12 bp, Homo sapiens
cccccctggcct

SEQ ID NO: 2454908 - DNA, 13 bp, Homo sapiens
cccccctgtacac

SEQ ID NO: 2454909 - DNA, 16 bp, Homo sapiens
ccccctccctggatga

SEQ ID NO: 2454910 - DNA, 19 bp, Homo sapiens
ccccctccgccctgccact

SEQ ID NO: 2454911 - DNA, 15 bp, Homo sapiens
ccccctctccctgca

SEQ ID NO: 2454912 - DNA, 23 bp, Homo sapiens
ccccctgcagcttgtagccagcc

SEQ ID NO: 2454913 - DNA, 16 bp, Homo sapiens
ccccctgccccccagc

SEQ ID NO: 2454914 - DNA, 18 bp, Homo sapiens
ccccctgtacacaactca

SEQ ID NO: 2454915 - DNA, 21 bp, Homo sapiens
ccatctcatgcccctggctgg

SEQ ID NO: 2454916 - DNA, 12 bp, Homo sapiens
ccatctccctgg

SEQ ID NO: 2454917 - DNA, 19 bp, Homo sapiens
ccatctccctggtgcttat

SEQ ID NO: 2454918 - DNA, 17 bp, Homo sapiens
ccatctctccctcccct

SEQ ID NO: 2454919 - DNA, 22 bp, Homo sapiens
ccatctgcgtgacaataaaaca

SEQ ID NO: 2454920 - DNA, 23 bp, Homo sapiens
ccatctgcgtgacaataaaacat

SEQ ID NO: 2454921 - DNA, 22 bp, Homo sapiens
ccatcttgagatggtgaggctg

SEQ ID NO: 2454922 - DNA, 17 bp, Homo sapiens
ccatgaccctgcctctc

SEQ ID NO: 2454923 - DNA, 18 bp, Homo sapiens
ccatgaccctgcctctcc

SEQ ID NO: 2454924 - DNA, 19 bp, Homo sapiens
ccatgaccctgcctctccc

SEQ ID NO: 2454925 - DNA, 22 bp, Homo sapiens
ccatgacctccagctttcctgt

SEQ ID NO: 2454926 - DNA, 22 bp, Homo sapiens
ccatgactgcttgccctaagca

SEQ ID NO: 2454927 - DNA, 16 bp, Homo sapiens
ccatgatccctgtgtt

SEQ ID NO: 2454928 - DNA, 17 bp, Homo sapiens
ccatgatccctgtgttg

SEQ ID NO: 2454929 - DNA, 22 bp, Homo sapiens
ccatgatccctgtgttgtctct

SEQ ID NO: 2454930 - DNA, 21 bp, Homo sapiens
ccatgatggcaacagatctgg

SEQ ID NO: 2454931 - DNA, 15 bp, Homo sapiens
ccatgcactgtgaag

SEQ ID NO: 2454932 - DNA, 13 bp, Homo sapiens
ccatgctcatctg

SEQ ID NO: 2454933 - DNA, 16 bp, Homo sapiens
ccatggacaggctggc

SEQ ID NO: 2454934 - DNA, 18 bp, Homo sapiens
ccatggactctgtcctga

SEQ ID NO: 2454935 - DNA, 19 bp, Homo sapiens
ccatggagggagggagtgg

SEQ ID NO: 2454936 - DNA, 15 bp, Homo sapiens
ccatggagtggcagc

SEQ ID NO: 2454937 - DNA, 21 bp, Homo sapiens
ccatggagtggcagcccagcc

SEQ ID NO: 2454938 - DNA, 22 bp, Homo sapiens
ccatggagtggcagcccagcca

SEQ ID NO: 2454939 - DNA, 23 bp, Homo sapiens
ccatggagtggcagcccagccag

SEQ ID NO: 2454940 - DNA, 14 bp, Homo sapiens
ccatggcaggaagg

SEQ ID NO: 2454941 - DNA, 21 bp, Homo sapiens
ccatggcctgcaaactgggaa

SEQ ID NO: 2454942 - DNA, 15 bp, Homo sapiens
ccatgggaccacaac

SEQ ID NO: 2454943 - DNA, 14 bp, Homo sapiens
ccatgggcagagcc

SEQ ID NO: 2454944 - DNA, 17 bp, Homo sapiens
ccatgggcagagcccaa

SEQ ID NO: 2454945 - DNA, 14 bp, Homo sapiens
ccatgggcagagga

SEQ ID NO: 2454946 - DNA, 22 bp, Homo sapiens
ccatggtgctaggaagaggagt

SEQ ID NO: 2454947 - DNA, 11 bp, Homo sapiens
ccatgtaactg

SEQ ID NO: 2454948 - DNA, 20 bp, Homo sapiens
ccatgtaatggcagttatat

SEQ ID NO: 2454949 - DNA, 13 bp, Homo sapiens
ccatgtccaaaga

SEQ ID NO: 2454950 - DNA, 14 bp, Homo sapiens
ccatgtccaaagag

SEQ ID NO: 2454951 - DNA, 19 bp, Homo sapiens
ccatgtccaaagaggctgc

SEQ ID NO: 2454952 - DNA, 23 bp, Homo sapiens
ccatgtccaaagaggctgcccct

SEQ ID NO: 2454953 - DNA, 15 bp, Homo sapiens
ccatgtcttctccct

SEQ ID NO: 2454954 - DNA, 13 bp, Homo sapiens
ccatgtctttctc

SEQ ID NO: 2454955 - DNA, 18 bp, Homo sapiens
ccatgtggtggcacaggc

SEQ ID NO: 2454956 - DNA, 14 bp, Homo sapiens
ccatgtgtcctggt

SEQ ID NO: 2454957 - DNA, 16 bp, Homo sapiens
ccatgtgttatgtttt

SEQ ID NO: 2454958 - DNA, 14 bp, Homo sapiens
cctgacacaccagg

SEQ ID NO: 2454959 - DNA, 17 bp, Homo sapiens
cctgacacaccaggcgc

SEQ ID NO: 2454960 - DNA, 23 bp, Homo sapiens
cctgacacactaaccaagctgag

SEQ ID NO: 2454961 - DNA, 14 bp, Homo sapiens
cctgacacccttct

SEQ ID NO: 2454962 - DNA, 23 bp, Homo sapiens
cctgacacccttctcccactctc

SEQ ID NO: 2454963 - DNA, 13 bp, Homo sapiens
cctgacactccct

SEQ ID NO: 2454964 - DNA, 18 bp, Homo sapiens
cctgacatcaaaaaaggc

SEQ ID NO: 2454965 - DNA, 21 bp, Homo sapiens
cctgacatcaaaaaaggcagt

SEQ ID NO: 2454966 - DNA, 15 bp, Homo sapiens
cctgaccactcagag

SEQ ID NO: 2454967 - DNA, 16 bp, Homo sapiens
cctgaccactcagaga

SEQ ID NO: 2454968 - DNA, 20 bp, Homo sapiens
cctgaccactcagagacatg

SEQ ID NO: 2454969 - DNA, 21 bp, Homo sapiens
cctgaccagctgctccgagga

SEQ ID NO: 2454970 - DNA, 22 bp, Homo sapiens
cctgaccagctgctccgaggac

SEQ ID NO: 2454971 - DNA, 13 bp, Homo sapiens
cctgaccagttgc

SEQ ID NO: 2454972 - DNA, 21 bp, Homo sapiens
cctgaccagttgcagtcactc

SEQ ID NO: 2454973 - DNA, 20 bp, Homo sapiens
cctgacctgtgagcccagct

SEQ ID NO: 2454974 - DNA, 22 bp, Homo sapiens
cctgacctgtgagcccagctgg

SEQ ID NO: 2454975 - DNA, 14 bp, Homo sapiens
cctgagaaagctca

SEQ ID NO: 2454976 - DNA, 18 bp, Homo sapiens
cctgagagatttaacatt

SEQ ID NO: 2454977 - DNA, 17 bp, Homo sapiens
cctgagattcagatgtc

SEQ ID NO: 2454978 - DNA, 14 bp, Homo sapiens
cctgagatttatta

SEQ ID NO: 2454979 - DNA, 15 bp, Homo sapiens
cctgagatttattaa

SEQ ID NO: 2454980 - DNA, 23 bp, Homo sapiens
cctgagatttattaaagaaaaaa

SEQ ID NO: 2454981 - DNA, 15 bp, Homo sapiens
cctgagcactgccag

SEQ ID NO: 2454982 - DNA, 16 bp, Homo sapiens
cctgagcactgccagg

SEQ ID NO: 2454983 - DNA, 18 bp, Homo sapiens
cctgagcactgccaggag

SEQ ID NO: 2454984 - DNA, 19 bp, Homo sapiens
cctgagcactgccaggagg

SEQ ID NO: 2454985 - DNA, 14 bp, Homo sapiens
cctgagcagtcctt

SEQ ID NO: 2454986 - DNA, 19 bp, Homo sapiens
cctgagcagtccttggcct

SEQ ID NO: 2454987 - DNA, 13 bp, Homo sapiens
cctgagccagggt

SEQ ID NO: 2454988 - DNA, 19 bp, Homo sapiens
cctgagccagggtctccag

SEQ ID NO: 2454989 - DNA, 23 bp, Homo sapiens
cctgagccagggtctccagaaag

SEQ ID NO: 2454990 - DNA, 12 bp, Homo sapiens
cctgagcccagg

SEQ ID NO: 2454991 - DNA, 13 bp, Homo sapiens
cctgagcccaggg

SEQ ID NO: 2454992 - DNA, 14 bp, Homo sapiens
cctgagcccaggga

SEQ ID NO: 2454993 - DNA, 16 bp, Homo sapiens
cctgagcccagggagg

SEQ ID NO: 2454994 - DNA, 15 bp, Homo sapiens
cctgagccccaggga

SEQ ID NO: 2454995 - DNA, 14 bp, Homo sapiens
cctgagcctgccga

SEQ ID NO: 2454996 - DNA, 15 bp, Homo sapiens
cctgagcctgccgag

SEQ ID NO: 2454997 - DNA, 21 bp, Homo sapiens
cctgagcgagtggagtctgcc

SEQ ID NO: 2454998 - DNA, 12 bp, Homo sapiens
cctgagctcagc

SEQ ID NO: 2454999 - DNA, 17 bp, Homo sapiens
cctgagctgaccagccg

SEQ ID NO: 2455000 - DNA, 13 bp, Homo sapiens
cctgaggagtctg

SEQ ID NO: 2455001 - DNA, 14 bp, Homo sapiens
cctgaggagtctga

SEQ ID NO: 2455002 - DNA, 18 bp, Homo sapiens
cctgaggagtctgaggtc

SEQ ID NO: 2455003 - DNA, 14 bp, Homo sapiens
cctgaggctgtggt

SEQ ID NO: 2455004 - DNA, 13 bp, Homo sapiens
cctgagggaaagg

SEQ ID NO: 2455005 - DNA, 18 bp, Homo sapiens
cctgagggaaaggccagc

SEQ ID NO: 2455006 - DNA, 21 bp, Homo sapiens
cctgagggaaaggccagcact

SEQ ID NO: 2455007 - DNA, 14 bp, Homo sapiens
cctgaggttactgg

SEQ ID NO: 2455008 - DNA, 17 bp, Homo sapiens
cctgagtactccacact

SEQ ID NO: 2455009 - DNA, 21 bp, Homo sapiens
cctgagtactccacactgcac

SEQ ID NO: 2455010 - DNA, 21 bp, Homo sapiens
cctgagtcgtgacctgctagg

SEQ ID NO: 2455011 - DNA, 19 bp, Homo sapiens
cctgagtgcttgcttttca

SEQ ID NO: 2455012 - DNA, 20 bp, Homo sapiens
cctgagttgcttttcagctg

SEQ ID NO: 2455013 - DNA, 16 bp, Homo sapiens
cctgagttggagctca

SEQ ID NO: 2455014 - DNA, 14 bp, Homo sapiens
cctgatcagaccac

SEQ ID NO: 2455015 - DNA, 18 bp, Homo sapiens
cctgatcagaccacggct

SEQ ID NO: 2455016 - DNA, 13 bp, Homo sapiens
cctgatcctggag

SEQ ID NO: 2455017 - DNA, 18 bp, Homo sapiens
cctgatcctggaggccca

SEQ ID NO: 2455018 - DNA, 20 bp, Homo sapiens
cctgatcctggaggcccagt

SEQ ID NO: 2455019 - DNA, 15 bp, Homo sapiens
cctgattgtttacag

SEQ ID NO: 2455020 - DNA, 12 bp, Homo sapiens
cctgcaaactgg

SEQ ID NO: 2455021 - DNA, 18 bp, Homo sapiens
cctgcaactcaaggactt

SEQ ID NO: 2455022 - DNA, 20 bp, Homo sapiens
cctgcaactcaaggactttg

SEQ ID NO: 2455023 - DNA, 20 bp, Homo sapiens
cctgcacagtgacttctgag

SEQ ID NO: 2455024 - DNA, 11 bp, Homo sapiens
cctgcactgta

SEQ ID NO: 2455025 - DNA, 16 bp, Homo sapiens
cctgcactgtaaaatg

SEQ ID NO: 2455026 - DNA, 17 bp, Homo sapiens
cctgcacttacttgctt

SEQ ID NO: 2455027 - DNA, 14 bp, Homo sapiens
cctgcagaccctgc

SEQ ID NO: 2455028 - DNA, 17 bp, Homo sapiens
cctgcagaccctgccct

SEQ ID NO: 2455029 - DNA, 18 bp, Homo sapiens
cctgcagaccctgccctt

SEQ ID NO: 2455030 - DNA, 16 bp, Homo sapiens
cctgcagcttgtagcc

SEQ ID NO: 2455031 - DNA, 20 bp, Homo sapiens
cctgcagcttgtagccagcc

SEQ ID NO: 2455032 - DNA, 17 bp, Homo sapiens
cctgcaggaaggagctg

SEQ ID NO: 2455033 - DNA, 20 bp, Homo sapiens
cctgcaggaaggagctgcct

SEQ ID NO: 2455034 - DNA, 21 bp, Homo sapiens
cctgcaggaaggagctgcctg

SEQ ID NO: 2455035 - DNA, 19 bp, Homo sapiens
cctgcagggcctctgtcaa

SEQ ID NO: 2455036 - DNA, 14 bp, Homo sapiens
cctgcaggggagca

SEQ ID NO: 2455037 - DNA, 16 bp, Homo sapiens
cctgcatggcatcctc

SEQ ID NO: 2455038 - DNA, 23 bp, Homo sapiens
cctgcattggaactggaggcagg

SEQ ID NO: 2455039 - DNA, 14 bp, Homo sapiens
cctgccaccaggcc

SEQ ID NO: 2455040 - DNA, 19 bp, Homo sapiens
cctgccaccaggccacctc

SEQ ID NO: 2455041 - DNA, 14 bp, Homo sapiens
cctgccacccagcc

SEQ ID NO: 2455042 - DNA, 13 bp, Homo sapiens
cctatcccacctc

SEQ ID NO: 2455043 - DNA, 16 bp, Homo sapiens
cctatctgggcttcct

SEQ ID NO: 2455044 - DNA, 22 bp, Homo sapiens
cctatctgggcttcctggagca

SEQ ID NO: 2455045 - DNA, 17 bp, Homo sapiens
cctatgacttgggcacc

SEQ ID NO: 2455046 - DNA, 20 bp, Homo sapiens
cctatgcatggtttcagcac

SEQ ID NO: 2455047 - DNA, 21 bp, Homo sapiens
cctatgcatggtttcagcact

SEQ ID NO: 2455048 - DNA, 12 bp, Homo sapiens
cctatgctttga

SEQ ID NO: 2455049 - DNA, 16 bp, Homo sapiens
cctatggagagccctg

SEQ ID NO: 2455050 - DNA, 16 bp, Homo sapiens
cctattatcccagctg

SEQ ID NO: 2455051 - DNA, 18 bp, Homo sapiens
cctattatcccagctgcc

SEQ ID NO: 2455052 - DNA, 19 bp, Homo sapiens
cctattgtgcaatgtaaat

SEQ ID NO: 2455053 - DNA, 17 bp, Homo sapiens
cctatttattgactttg

SEQ ID NO: 2455054 - DNA, 18 bp, Homo sapiens
cctatttccattcaacaa

SEQ ID NO: 2455055 - DNA, 23 bp, Homo sapiens
cctcaaaatttaacagttacctg

SEQ ID NO: 2455056 - DNA, 14 bp, Homo sapiens
cctcaaagaaagtg

SEQ ID NO: 2455057 - DNA, 16 bp, Homo sapiens
cctcaaagaaagtgta

SEQ ID NO: 2455058 - DNA, 18 bp, Homo sapiens
cctcaaataaaaagtgct

SEQ ID NO: 2455059 - DNA, 17 bp, Homo sapiens
cctcaaattactttgtg

SEQ ID NO: 2455060 - DNA, 20 bp, Homo sapiens
cctcaaggttttaggttcta

SEQ ID NO: 2455061 - DNA, 22 bp, Homo sapiens
cctcaaggttttaggttctaaa

SEQ ID NO: 2455062 - DNA, 18 bp, Homo sapiens
cctcaatccagctatgtt

SEQ ID NO: 2455063 - DNA, 22 bp, Homo sapiens
cctcacaagtgggtacccccag

SEQ ID NO: 2455064 - DNA, 17 bp, Homo sapiens
cctcacagtattgctca

SEQ ID NO: 2455065 - DNA, 13 bp, Homo sapiens
cctcacagtgaac

SEQ ID NO: 2455066 - DNA, 16 bp, Homo sapiens
cctcacccacccctgc

SEQ ID NO: 2455067 - DNA, 19 bp, Homo sapiens
cctcacccacccctgcaca

SEQ ID NO: 2455068 - DNA, 15 bp, Homo sapiens
cctcaccctgcctta

SEQ ID NO: 2455069 - DNA, 13 bp, Homo sapiens
cctcacctcctct

SEQ ID NO: 2455070 - DNA, 19 bp, Homo sapiens
cctcactcgtctcccccaa

SEQ ID NO: 2455071 - DNA, 13 bp, Homo sapiens
cctcactggctct

SEQ ID NO: 2455072 - DNA, 16 bp, Homo sapiens
cctcactggctctcct

SEQ ID NO: 2455073 - DNA, 16 bp, Homo sapiens
cctcactgttgaattt

SEQ ID NO: 2455074 - DNA, 20 bp, Homo sapiens
cctcagactctaagaaagaa

SEQ ID NO: 2455075 - DNA, 16 bp, Homo sapiens
cctcagagacatcagc

SEQ ID NO: 2455076 - DNA, 16 bp, Homo sapiens
cctcagagaccagggc

SEQ ID NO: 2455077 - DNA, 19 bp, Homo sapiens
cctcagagaccagggctcc

SEQ ID NO: 2455078 - DNA, 14 bp, Homo sapiens
cctcagatggcagc

SEQ ID NO: 2455079 - DNA, 12 bp, Homo sapiens
cctcagcctccg

SEQ ID NO: 2455080 - DNA, 19 bp, Homo sapiens
cctcagcctgaaccccagg

SEQ ID NO: 2455081 - DNA, 11 bp, Homo sapiens
cctcagcctgg

SEQ ID NO: 2455082 - DNA, 16 bp, Homo sapiens
cctcagcctggccaga

SEQ ID NO: 2455083 - DNA, 17 bp, Homo sapiens
cctcagcctggccagac

SEQ ID NO: 2455084 - DNA, 19 bp, Homo sapiens
cctcagcctggccagacac

SEQ ID NO: 2455085 - DNA, 13 bp, Homo sapiens
cctcagcctgggc

SEQ ID NO: 2455086 - DNA, 14 bp, Homo sapiens
cctcagcctgggcg

SEQ ID NO: 2455087 - DNA, 17 bp, Homo sapiens
cctcagcctgggcgctg

SEQ ID NO: 2455088 - DNA, 20 bp, Homo sapiens
cctcagcctgggcgctggtc

SEQ ID NO: 2455089 - DNA, 17 bp, Homo sapiens
cctcaggactgggagcc

SEQ ID NO: 2455090 - DNA, 16 bp, Homo sapiens
cctcaggcacacagct

SEQ ID NO: 2455091 - DNA, 13 bp, Homo sapiens
cctcaggcagctc

SEQ ID NO: 2455092 - DNA, 14 bp, Homo sapiens
cctcaggcagctca

SEQ ID NO: 2455093 - DNA, 15 bp, Homo sapiens
cctcaggcagctcaa

SEQ ID NO: 2455094 - DNA, 15 bp, Homo sapiens
cctcagggactcagg

SEQ ID NO: 2455095 - DNA, 16 bp, Homo sapiens
cctcagggcaaagcca

SEQ ID NO: 2455096 - DNA, 18 bp, Homo sapiens
cctcaggggtctgagctc

SEQ ID NO: 2455097 - DNA, 22 bp, Homo sapiens
cctcaggggtctgagctccagc

SEQ ID NO: 2455098 - DNA, 19 bp, Homo sapiens
cctcagtagtccctgcaca

SEQ ID NO: 2455099 - DNA, 20 bp, Homo sapiens
cctcatcccgtgttctcctt

SEQ ID NO: 2455100 - DNA, 17 bp, Homo sapiens
cctcatcctccttcttc

SEQ ID NO: 2455101 - DNA, 20 bp, Homo sapiens
cctcatctctctgcccaacc

SEQ ID NO: 2455102 - DNA, 15 bp, Homo sapiens
cctcatcttcttcac

SEQ ID NO: 2455103 - DNA, 17 bp, Homo sapiens
cctcatcttcttcacca

SEQ ID NO: 2455104 - DNA, 19 bp, Homo sapiens
cctcatgaatgtaaatttg

SEQ ID NO: 2455105 - DNA, 22 bp, Homo sapiens
cctcatgaatgtaaatttgtac

SEQ ID NO: 2455106 - DNA, 22 bp, Homo sapiens
cctcatggcccctctgacctgc

SEQ ID NO: 2455107 - DNA, 17 bp, Homo sapiens
cctcatgtggctggaag

SEQ ID NO: 2455108 - DNA, 17 bp, Homo sapiens
cctccaaaatgtgccta

SEQ ID NO: 2455109 - DNA, 22 bp, Homo sapiens
cctccaaaatgtgcctattgct

SEQ ID NO: 2455110 - DNA, 15 bp, Homo sapiens
cctccaagtggtcca

SEQ ID NO: 2455111 - DNA, 15 bp, Homo sapiens
cctccacacctgcgg

SEQ ID NO: 2455112 - DNA, 16 bp, Homo sapiens
cctccacacctgcggc

SEQ ID NO: 2455113 - DNA, 17 bp, Homo sapiens
cctccacacctgcggcc

SEQ ID NO: 2455114 - DNA, 14 bp, Homo sapiens
cctccacatcctcc

SEQ ID NO: 2455115 - DNA, 13 bp, Homo sapiens
cctccacctcctg

SEQ ID NO: 2455116 - DNA, 19 bp, Homo sapiens
cctccagccgccggctgtg

SEQ ID NO: 2455117 - DNA, 23 bp, Homo sapiens
cctccagccgccggctgtgcagt

SEQ ID NO: 2455118 - DNA, 13 bp, Homo sapiens
cctccagctttcc

SEQ ID NO: 2455119 - DNA, 19 bp, Homo sapiens
ccaggaatttcccaggacc

SEQ ID NO: 2455120 - DNA, 13 bp, Homo sapiens
ccaggaccacagg

SEQ ID NO: 2455121 - DNA, 17 bp, Homo sapiens
ccaggaccacaggctca

SEQ ID NO: 2455122 - DNA, 19 bp, Homo sapiens
ccaggaccacaggctcagg

SEQ ID NO: 2455123 - DNA, 13 bp, Homo sapiens
ccaggaccagctc

SEQ ID NO: 2455124 - DNA, 15 bp, Homo sapiens
ccaggaccagctcag

SEQ ID NO: 2455125 - DNA, 23 bp, Homo sapiens
ccaggaccagtcaacctgggcaa

SEQ ID NO: 2455126 - DNA, 20 bp, Homo sapiens
ccaggactatatttgggcct

SEQ ID NO: 2455127 - DNA, 21 bp, Homo sapiens
ccaggactatatttgggcctg

SEQ ID NO: 2455128 - DNA, 12 bp, Homo sapiens
ccaggactctgc

SEQ ID NO: 2455129 - DNA, 14 bp, Homo sapiens
ccaggactctgcag

SEQ ID NO: 2455130 - DNA, 15 bp, Homo sapiens
ccaggactctgcagc

SEQ ID NO: 2455131 - DNA, 18 bp, Homo sapiens
ccaggactctgcagcctc

SEQ ID NO: 2455132 - DNA, 19 bp, Homo sapiens
ccaggactctgcagcctca

SEQ ID NO: 2455133 - DNA, 20 bp, Homo sapiens
ccaggactctgcagcctcag

SEQ ID NO: 2455134 - DNA, 21 bp, Homo sapiens
ccaggactctgcagcctcaga

SEQ ID NO: 2455135 - DNA, 21 bp, Homo sapiens
ccaggacttatttaaactctg

SEQ ID NO: 2455136 - DNA, 14 bp, Homo sapiens
ccaggagaagctca

SEQ ID NO: 2455137 - DNA, 16 bp, Homo sapiens
ccaggagcacggctct

SEQ ID NO: 2455138 - DNA, 12 bp, Homo sapiens
ccaggagctcca

SEQ ID NO: 2455139 - DNA, 14 bp, Homo sapiens
ccaggagctcccct

SEQ ID NO: 2455140 - DNA, 19 bp, Homo sapiens
ccaggagctcccctcccca

SEQ ID NO: 2455141 - DNA, 19 bp, Homo sapiens
ccaggaggacccagggctc

SEQ ID NO: 2455142 - DNA, 20 bp, Homo sapiens
ccaggaggacccagggctct

SEQ ID NO: 2455143 - DNA, 21 bp, Homo sapiens
ccaggaggacccagggctctg

SEQ ID NO: 2455144 - DNA, 16 bp, Homo sapiens
ccaggagggacaaagg

SEQ ID NO: 2455145 - DNA, 17 bp, Homo sapiens
ccaggagggacaaagga

SEQ ID NO: 2455146 - DNA, 21 bp, Homo sapiens
ccaggagggacaaaggagcct

SEQ ID NO: 2455147 - DNA, 23 bp, Homo sapiens
ccaggagggacaaaggagcctgt

SEQ ID NO: 2455148 - DNA, 18 bp, Homo sapiens
ccaggaggtgccactgga

SEQ ID NO: 2455149 - DNA, 19 bp, Homo sapiens
ccaggagtgggtggggagt

SEQ ID NO: 2455150 - DNA, 21 bp, Homo sapiens
ccaggatggaacacggccaca

SEQ ID NO: 2455151 - DNA, 14 bp, Homo sapiens
ccaggcaaggctgt

SEQ ID NO: 2455152 - DNA, 15 bp, Homo sapiens
ccaggcaccaggcag

SEQ ID NO: 2455153 - DNA, 15 bp, Homo sapiens
ccaggcactgtctta

SEQ ID NO: 2455154 - DNA, 16 bp, Homo sapiens
ccaggcagatgacctc

SEQ ID NO: 2455155 - DNA, 12 bp, Homo sapiens
ccaggcagcctc

SEQ ID NO: 2455156 - DNA, 22 bp, Homo sapiens
ccaggccaaaggggacctggaa

SEQ ID NO: 2455157 - DNA, 16 bp, Homo sapiens
ccaggccacctcccca

SEQ ID NO: 2455158 - DNA, 19 bp, Homo sapiens
ccaggccaggactctgcag

SEQ ID NO: 2455159 - DNA, 23 bp, Homo sapiens
ccaggccaggactctgcagcctc

SEQ ID NO: 2455160 - DNA, 17 bp, Homo sapiens
ccaggcccaaggctccc

SEQ ID NO: 2455161 - DNA, 17 bp, Homo sapiens
ccaggcccactgtgcct

SEQ ID NO: 2455162 - DNA, 18 bp, Homo sapiens
ccaggcccagccgacccc

SEQ ID NO: 2455163 - DNA, 13 bp, Homo sapiens
ccaggccccatga

SEQ ID NO: 2455164 - DNA, 16 bp, Homo sapiens
ccaggccccatgacct

SEQ ID NO: 2455165 - DNA, 19 bp, Homo sapiens
ccaggcccggatgcagagg

SEQ ID NO: 2455166 - DNA, 20 bp, Homo sapiens
ccaggcccggatgcagaggc

SEQ ID NO: 2455167 - DNA, 22 bp, Homo sapiens
ccaggcccggatgcagaggcct

SEQ ID NO: 2455168 - DNA, 18 bp, Homo sapiens
ccaggcgaggcccttggc

SEQ ID NO: 2455169 - DNA, 20 bp, Homo sapiens
ccaggctctctttgcccagt

SEQ ID NO: 2455170 - DNA, 15 bp, Homo sapiens
ccaggctgaccacag

SEQ ID NO: 2455171 - DNA, 19 bp, Homo sapiens
ccccttctcccctgcactg

SEQ ID NO: 2455172 - DNA, 14 bp, Homo sapiens
ccccttctgctcag

SEQ ID NO: 2455173 - DNA, 19 bp, Homo sapiens
ccccttctgctcagctctg

SEQ ID NO: 2455174 - DNA, 21 bp, Homo sapiens
ccccttctgctcagctctggg

SEQ ID NO: 2455175 - DNA, 18 bp, Homo sapiens
ccccttgacaactggcag

SEQ ID NO: 2455176 - DNA, 23 bp, Homo sapiens
ccccttgacaactggcaggcagg

SEQ ID NO: 2455177 - DNA, 15 bp, Homo sapiens
ccccttgtcctttcc

SEQ ID NO: 2455178 - DNA, 20 bp, Homo sapiens
cccctttagatctctgaagc

SEQ ID NO: 2455179 - DNA, 15 bp, Homo sapiens
cccctttcacaggca

SEQ ID NO: 2455180 - DNA, 12 bp, Homo sapiens
cccgagcagctg

SEQ ID NO: 2455181 - DNA, 13 bp, Homo sapiens
cccgagcagctga

SEQ ID NO: 2455182 - DNA, 16 bp, Homo sapiens
cccgagcagctgagca

SEQ ID NO: 2455183 - DNA, 19 bp, Homo sapiens
cccgagcagctgagcaggg

SEQ ID NO: 2455184 - DNA, 19 bp, Homo sapiens
cccgaggaggtgtctcagg

SEQ ID NO: 2455185 - DNA, 20 bp, Homo sapiens
cccgatatattttagcattt

SEQ ID NO: 2455186 - DNA, 13 bp, Homo sapiens
cccgcctgccctc

SEQ ID NO: 2455187 - DNA, 14 bp, Homo sapiens
cccgcctgccctca

SEQ ID NO: 2455188 - DNA, 12 bp, Homo sapiens
cccgccttggcc

SEQ ID NO: 2455189 - DNA, 13 bp, Homo sapiens
cccgccttggcct

SEQ ID NO: 2455190 - DNA, 19 bp, Homo sapiens
cccggaattccgtcaccac

SEQ ID NO: 2455191 - DNA, 18 bp, Homo sapiens
cccggaggttgggtgggc

SEQ ID NO: 2455192 - DNA, 11 bp, Homo sapiens
cccggcacccc

SEQ ID NO: 2455193 - DNA, 17 bp, Homo sapiens
cccggcaccccctgcag

SEQ ID NO: 2455194 - DNA, 19 bp, Homo sapiens
cccggcaccccctgcagct

SEQ ID NO: 2455195 - DNA, 15 bp, Homo sapiens
cccggctcctggtca

SEQ ID NO: 2455196 - DNA, 14 bp, Homo sapiens
cccggggccagcac

SEQ ID NO: 2455197 - DNA, 13 bp, Homo sapiens
cccgtcctgcctg

SEQ ID NO: 2455198 - DNA, 14 bp, Homo sapiens
cccgtcctgcctgt

SEQ ID NO: 2455199 - DNA, 16 bp, Homo sapiens
cccgtcctgcctgtgg

SEQ ID NO: 2455200 - DNA, 13 bp, Homo sapiens
ccctaaagcctca

SEQ ID NO: 2455201 - DNA, 14 bp, Homo sapiens
ccctaaccctttgt

SEQ ID NO: 2455202 - DNA, 16 bp, Homo sapiens
ccctaagcagaaagtg

SEQ ID NO: 2455203 - DNA, 21 bp, Homo sapiens
ccctaagcagaaagtgccttt

SEQ ID NO: 2455204 - DNA, 22 bp, Homo sapiens
ccctaatctatggtcgggagac

SEQ ID NO: 2455205 - DNA, 14 bp, Homo sapiens
ccctaccctctaga

SEQ ID NO: 2455206 - DNA, 16 bp, Homo sapiens
ccctacctgccccact

SEQ ID NO: 2455207 - DNA, 17 bp, Homo sapiens
ccctagaaacttccaaa

SEQ ID NO: 2455208 - DNA, 22 bp, Homo sapiens
ccctaggtgttttgttcaccat

SEQ ID NO: 2455209 - DNA, 16 bp, Homo sapiens
ccctatccaatcaatc

SEQ ID NO: 2455210 - DNA, 13 bp, Homo sapiens
ccctattaaccta

SEQ ID NO: 2455211 - DNA, 20 bp, Homo sapiens
ccctatttagatgataaaga

SEQ ID NO: 2455212 - DNA, 17 bp, Homo sapiens
ccctatttattgacttt

SEQ ID NO: 2455213 - DNA, 14 bp, Homo sapiens
ccctcacacaccct

SEQ ID NO: 2455214 - DNA, 15 bp, Homo sapiens
ccctcacacaccctg

SEQ ID NO: 2455215 - DNA, 13 bp, Homo sapiens
ccctcaccctgcc

SEQ ID NO: 2455216 - DNA, 23 bp, Homo sapiens
ccctcagcctctcccctgcctgc

SEQ ID NO: 2455217 - DNA, 18 bp, Homo sapiens
ccctcagggcaaagccag

SEQ ID NO: 2455218 - DNA, 16 bp, Homo sapiens
ccctcatcaaggacac

SEQ ID NO: 2455219 - DNA, 13 bp, Homo sapiens
ccctcatctgtcc

SEQ ID NO: 2455220 - DNA, 15 bp, Homo sapiens
ccctccagctccctg

SEQ ID NO: 2455221 - DNA, 12 bp, Homo sapiens
ccctccatccct

SEQ ID NO: 2455222 - DNA, 13 bp, Homo sapiens
ccctccatccctg

SEQ ID NO: 2455223 - DNA, 14 bp, Homo sapiens
ccctccatccctgg

SEQ ID NO: 2455224 - DNA, 17 bp, Homo sapiens
ccctccatccctggccc

SEQ ID NO: 2455225 - DNA, 20 bp, Homo sapiens
ccctcccccccatgcactgt

SEQ ID NO: 2455226 - DNA, 13 bp, Homo sapiens
ccctcccccttgt

SEQ ID NO: 2455227 - DNA, 15 bp, Homo sapiens
ccctcccccttgtcc

SEQ ID NO: 2455228 - DNA, 14 bp, Homo sapiens
ccctccccttgcct

SEQ ID NO: 2455229 - DNA, 23 bp, Homo sapiens
ccctccccttgcctgtgccaggt

SEQ ID NO: 2455230 - DNA, 19 bp, Homo sapiens
ccctccctgttccccagag

SEQ ID NO: 2455231 - DNA, 13 bp, Homo sapiens
ccctccgccctgc

SEQ ID NO: 2455232 - DNA, 14 bp, Homo sapiens
ccctccgccctgcc

SEQ ID NO: 2455233 - DNA, 16 bp, Homo sapiens
ccctccgccctgccac

SEQ ID NO: 2455234 - DNA, 13 bp, Homo sapiens
ccctcctaaccta

SEQ ID NO: 2455235 - DNA, 11 bp, Homo sapiens
ccctccttcct

SEQ ID NO: 2455236 - DNA, 14 bp, Homo sapiens
ccctcgctgccagc

SEQ ID NO: 2455237 - DNA, 17 bp, Homo sapiens
ccctcggggatgtgtcc

SEQ ID NO: 2455238 - DNA, 20 bp, Homo sapiens
ccctcggggatgtgtcctga

SEQ ID NO: 2455239 - DNA, 15 bp, Homo sapiens
ccctctacagagctt

SEQ ID NO: 2455240 - DNA, 15 bp, Homo sapiens
ctgactaaacttttt

SEQ ID NO: 2455241 - DNA, 22 bp, Homo sapiens
ctgactaaactttttttctgta

SEQ ID NO: 2455242 - DNA, 19 bp, Homo sapiens
ctgactattcttgatgtaa

SEQ ID NO: 2455243 - DNA, 14 bp, Homo sapiens
ctgactcagggctc

SEQ ID NO: 2455244 - DNA, 16 bp, Homo sapiens
ctgactcggtttctcc

SEQ ID NO: 2455245 - DNA, 13 bp, Homo sapiens
ctgacttctgcct

SEQ ID NO: 2455246 - DNA, 17 bp, Homo sapiens
ctgacttggctggtgtg

SEQ ID NO: 2455247 - DNA, 19 bp, Homo sapiens
ctgactttcttttttgata

SEQ ID NO: 2455248 - DNA, 14 bp, Homo sapiens
ctgactttgcttgc

SEQ ID NO: 2455249 - DNA, 16 bp, Homo sapiens
ctgactttgcttgctt

SEQ ID NO: 2455250 - DNA, 17 bp, Homo sapiens
ctgactttgcttgcttt

SEQ ID NO: 2455251 - DNA, 16 bp, Homo sapiens
ctgagaaagctcaaag

SEQ ID NO: 2455252 - DNA, 13 bp, Homo sapiens
ctgagaacctggc

SEQ ID NO: 2455253 - DNA, 15 bp, Homo sapiens
ctgagaacctggcct

SEQ ID NO: 2455254 - DNA, 19 bp, Homo sapiens
ctgagaacctggccttcag

SEQ ID NO: 2455255 - DNA, 13 bp, Homo sapiens
ctgagacctgaag

SEQ ID NO: 2455256 - DNA, 16 bp, Homo sapiens
ctgagacgtcatgagg

SEQ ID NO: 2455257 - DNA, 18 bp, Homo sapiens
ctgagacgtcatgaggag

SEQ ID NO: 2455258 - DNA, 20 bp, Homo sapiens
ctgagaggacagagagaaat

SEQ ID NO: 2455259 - DNA, 14 bp, Homo sapiens
ctgagagtctagat

SEQ ID NO: 2455260 - DNA, 19 bp, Homo sapiens
ctgagatacatacagaatt

SEQ ID NO: 2455261 - DNA, 16 bp, Homo sapiens
ctgagatggctcccag

SEQ ID NO: 2455262 - DNA, 17 bp, Homo sapiens
ctgagatggctcccagg

SEQ ID NO: 2455263 - DNA, 18 bp, Homo sapiens
ctgagatggctcccaggg

SEQ ID NO: 2455264 - DNA, 14 bp, Homo sapiens
ctgagatttattaa

SEQ ID NO: 2455265 - DNA, 23 bp, Homo sapiens
ctgagcaacgctattccagctgt

SEQ ID NO: 2455266 - DNA, 20 bp, Homo sapiens
ctgagcaactcttgattatc

SEQ ID NO: 2455267 - DNA, 13 bp, Homo sapiens
ctgagcactgcca

SEQ ID NO: 2455268 - DNA, 16 bp, Homo sapiens
ctgagcactgccagga

SEQ ID NO: 2455269 - DNA, 16 bp, Homo sapiens
ctgagcactgtttata

SEQ ID NO: 2455270 - DNA, 13 bp, Homo sapiens
ctgagcaggccac

SEQ ID NO: 2455271 - DNA, 17 bp, Homo sapiens
ctgagcagggccgggga

SEQ ID NO: 2455272 - DNA, 23 bp, Homo sapiens
ctgagcagggccggggaactggc

SEQ ID NO: 2455273 - DNA, 20 bp, Homo sapiens
ctgagccagggtctccagaa

SEQ ID NO: 2455274 - DNA, 12 bp, Homo sapiens
ctgagcccaggg

SEQ ID NO: 2455275 - DNA, 13 bp, Homo sapiens
ctgagcccaggga

SEQ ID NO: 2455276 - DNA, 16 bp, Homo sapiens
ctgagcccagggaggc

SEQ ID NO: 2455277 - DNA, 12 bp, Homo sapiens
ctgagccccagg

SEQ ID NO: 2455278 - DNA, 18 bp, Homo sapiens
ctgagccccagggagagg

SEQ ID NO: 2455279 - DNA, 19 bp, Homo sapiens
ctgagccggccccaggctc

SEQ ID NO: 2455280 - DNA, 12 bp, Homo sapiens
ctgagcctgccg

SEQ ID NO: 2455281 - DNA, 16 bp, Homo sapiens
ctgagcctgccgagca

SEQ ID NO: 2455282 - DNA, 15 bp, Homo sapiens
ctgagccttgtaatt

SEQ ID NO: 2455283 - DNA, 21 bp, Homo sapiens
ctgagcgagtggagtctgcca

SEQ ID NO: 2455284 - DNA, 13 bp, Homo sapiens
ctgagcgcctcca

SEQ ID NO: 2455285 - DNA, 15 bp, Homo sapiens
ctgagctagaaccct

SEQ ID NO: 2455286 - DNA, 18 bp, Homo sapiens
ctgagctcacaaggcagc

SEQ ID NO: 2455287 - DNA, 20 bp, Homo sapiens
ctgagctcacaaggcagcaa

SEQ ID NO: 2455288 - DNA, 22 bp, Homo sapiens
ctgagctcacaaggcagcaagg

SEQ ID NO: 2455289 - DNA, 23 bp, Homo sapiens
ctgagctcacaaggcagcaaggc

SEQ ID NO: 2455290 - DNA, 16 bp, Homo sapiens
ctgagctcagcgtgga

SEQ ID NO: 2455291 - DNA, 17 bp, Homo sapiens
ctgagctccagctcctt

SEQ ID NO: 2455292 - DNA, 22 bp, Homo sapiens
ctgagctccagctcctttgggc

SEQ ID NO: 2455293 - DNA, 17 bp, Homo sapiens
ctgagctcctgtcccct

SEQ ID NO: 2455294 - DNA, 12 bp, Homo sapiens
ctgagctctgag

SEQ ID NO: 2455295 - DNA, 13 bp, Homo sapiens
ctgagctctgaga

SEQ ID NO: 2455296 - DNA, 15 bp, Homo sapiens
ctgagctctgagagg

SEQ ID NO: 2455297 - DNA, 18 bp, Homo sapiens
ctgagctctgagaggccc

SEQ ID NO: 2455298 - DNA, 19 bp, Homo sapiens
ctgagctctgagaggccct

SEQ ID NO: 2455299 - DNA, 20 bp, Homo sapiens
ctgagctctgagaggccctg

SEQ ID NO: 2455300 - DNA, 22 bp, Homo sapiens
ctgagctctgagaggccctgga

SEQ ID NO: 2455301 - DNA, 13 bp, Homo sapiens
ctgagctgaggca

SEQ ID NO: 2455302 - DNA, 18 bp, Homo sapiens
ctgagctgaggcagcagt

SEQ ID NO: 2455303 - DNA, 13 bp, Homo sapiens
ctgagctgtgcag

SEQ ID NO: 2455304 - DNA, 22 bp, Homo sapiens
ctgaggaacccttacagtagga

SEQ ID NO: 2455305 - DNA, 20 bp, Homo sapiens
ctgaggacagatgcctcctt

SEQ ID NO: 2455306 - DNA, 19 bp, Homo sapiens
ctgaggagtctgaggtcct

SEQ ID NO: 2455307 - DNA, 24 bp, Homo sapiens
ctgaggcagcagtgtgaggccagg

SEQ ID NO: 2455308 - DNA, 12 bp, Homo sapiens
ctgaggccacac

SEQ ID NO: 2455309 - DNA, 15 bp, Homo sapiens
ctgaggccagcctgg

SEQ ID NO: 2455310 - DNA, 16 bp, Homo sapiens
ctgaggccagcctggc

SEQ ID NO: 2455311 - DNA, 15 bp, Homo sapiens
ctgaggcctggactt

SEQ ID NO: 2455312 - DNA, 19 bp, Homo sapiens
ctgaggcctggactttcct

SEQ ID NO: 2455313 - DNA, 20 bp, Homo sapiens
ctgaggcctggactttcctg

SEQ ID NO: 2455314 - DNA, 22 bp, Homo sapiens
ctgaggcctggactttcctgca

SEQ ID NO: 2455315 - DNA, 22 bp, Homo sapiens
ctgaggcctgggccgctgccac

SEQ ID NO: 2455316 - DNA, 13 bp, Homo sapiens
ctgaggctggcac

SEQ ID NO: 2455317 - DNA, 17 bp, Homo sapiens
ctgaggctggcacagga

SEQ ID NO: 2455318 - DNA, 20 bp, Homo sapiens
ctgagggaaaggccagcact

SEQ ID NO: 2455319 - DNA, 17 bp, Homo sapiens
ctgagggagcctggccc

SEQ ID NO: 2455320 - DNA, 16 bp, Homo sapiens
ctgagggcagtcgata

SEQ ID NO: 2455321 - DNA, 22 bp, Homo sapiens
ctgagggcagttcgcagccacc

SEQ ID NO: 2455322 - DNA, 16 bp, Homo sapiens
ctgaggggggatccag

SEQ ID NO: 2455323 - DNA, 19 bp, Homo sapiens
ctgaggtcctgagcactgc

SEQ ID NO: 2455324 - DNA, 24 bp, Homo sapiens
ctgaggtcctgagcactgccagga

SEQ ID NO: 2455325 - DNA, 14 bp, Homo sapiens
ctgaggtgcccagg

SEQ ID NO: 2455326 - DNA, 13 bp, Homo sapiens
ctctcaggatcca

SEQ ID NO: 2455327 - DNA, 14 bp, Homo sapiens
ctctcaggatccaa

SEQ ID NO: 2455328 - DNA, 16 bp, Homo sapiens
ctctcaggatccaagc

SEQ ID NO: 2455329 - DNA, 13 bp, Homo sapiens
ctctcagtctctg

SEQ ID NO: 2455330 - DNA, 15 bp, Homo sapiens
ctctcagtctctgag

SEQ ID NO: 2455331 - DNA, 16 bp, Homo sapiens
ctctcagtctctgagc

SEQ ID NO: 2455332 - DNA, 22 bp, Homo sapiens
ctctccacacagtgctcaaggc

SEQ ID NO: 2455333 - DNA, 23 bp, Homo sapiens
ctctccacacagtgctcaaggcc

SEQ ID NO: 2455334 - DNA, 16 bp, Homo sapiens
ctctccactttcagct

SEQ ID NO: 2455335 - DNA, 17 bp, Homo sapiens
ctctccactttcagctg

SEQ ID NO: 2455336 - DNA, 19 bp, Homo sapiens
ctctccactttcagctgtc

SEQ ID NO: 2455337 - DNA, 16 bp, Homo sapiens
ctctccagctgactaa

SEQ ID NO: 2455338 - DNA, 23 bp, Homo sapiens
ctattttccaggcttctgctggg

SEQ ID NO: 2455339 - DNA, 12 bp, Homo sapiens
ctatttttctaa

SEQ ID NO: 2455340 - DNA, 13 bp, Homo sapiens
ctatttttggagg

SEQ ID NO: 2455341 - DNA, 14 bp, Homo sapiens
ctcaaaacaaaggc

SEQ ID NO: 2455342 - DNA, 17 bp, Homo sapiens
ctcaaagaaagtgtatt

SEQ ID NO: 2455343 - DNA, 19 bp, Homo sapiens
ctcaaataaaaagtgcttt

SEQ ID NO: 2455344 - DNA, 22 bp, Homo sapiens
ctcaaatgagtaacatttgctg

SEQ ID NO: 2455345 - DNA, 17 bp, Homo sapiens
ctcaaatgatgggaagt

SEQ ID NO: 2455346 - DNA, 21 bp, Homo sapiens
ctcaaatggggccagatccag

SEQ ID NO: 2455347 - DNA, 15 bp, Homo sapiens
ctcaaatgttctaag

SEQ ID NO: 2455348 - DNA, 19 bp, Homo sapiens
ctcaaatgttctaagtttc

SEQ ID NO: 2455349 - DNA, 21 bp, Homo sapiens
ctcaaatgttctaagtttcta

SEQ ID NO: 2455350 - DNA, 22 bp, Homo sapiens
ctcaaatgttctaagtttctaa

SEQ ID NO: 2455351 - DNA, 23 bp, Homo sapiens
ctcaacaccatgattcctttaac

SEQ ID NO: 2455352 - DNA, 19 bp, Homo sapiens
ctcaacccctcccctccat

SEQ ID NO: 2455353 - DNA, 23 bp, Homo sapiens
ctcaacccctcccctccatccct

SEQ ID NO: 2455354 - DNA, 23 bp, Homo sapiens
ctcaagaaataaaaggaagccaa

SEQ ID NO: 2455355 - DNA, 23 bp, Homo sapiens
ctcaagcagcgaccgccccctcc

SEQ ID NO: 2455356 - DNA, 20 bp, Homo sapiens
ctcaagttctaagattctaa

SEQ ID NO: 2455357 - DNA, 14 bp, Homo sapiens
ctcaatgagcatgt

SEQ ID NO: 2455358 - DNA, 15 bp, Homo sapiens
ctcaatgagcatgtt

SEQ ID NO: 2455359 - DNA, 14 bp, Homo sapiens
ctcaattagtgtgg

SEQ ID NO: 2455360 - DNA, 16 bp, Homo sapiens
ctcaattccaacagtt

SEQ ID NO: 2455361 - DNA, 17 bp, Homo sapiens
ctcacaaggcagcaagg

SEQ ID NO: 2455362 - DNA, 21 bp, Homo sapiens
ctcacaaggcagcaaggcccg

SEQ ID NO: 2455363 - DNA, 23 bp, Homo sapiens
ctcacacaccctgtctgccccgc

SEQ ID NO: 2455364 - DNA, 12 bp, Homo sapiens
ctcacacaggca

SEQ ID NO: 2455365 - DNA, 15 bp, Homo sapiens
ctcacacctgaactg

SEQ ID NO: 2455366 - DNA, 18 bp, Homo sapiens
ctcacactggtctgctgt

SEQ ID NO: 2455367 - DNA, 13 bp, Homo sapiens
ctcaccaactcct

SEQ ID NO: 2455368 - DNA, 19 bp, Homo sapiens
ctcaccaggcagcctctgg

SEQ ID NO: 2455369 - DNA, 20 bp, Homo sapiens
ctcaccaggcagcctctggg

SEQ ID NO: 2455370 - DNA, 22 bp, Homo sapiens
ctcaccattccaagtctccacc

SEQ ID NO: 2455371 - DNA, 17 bp, Homo sapiens
ctcacccacccctgcac

SEQ ID NO: 2455372 - DNA, 13 bp, Homo sapiens
ctcacccagtgcc

SEQ ID NO: 2455373 - DNA, 14 bp, Homo sapiens
ctcacccagtgccc

SEQ ID NO: 2455374 - DNA, 22 bp, Homo sapiens
ctcacccagtgccctctcccct

SEQ ID NO: 2455375 - DNA, 19 bp, Homo sapiens
ctcaccccatcccacaccc

SEQ ID NO: 2455376 - DNA, 21 bp, Homo sapiens
ctcaccccatcccacaccctg

SEQ ID NO: 2455377 - DNA, 22 bp, Homo sapiens
ctcaccccatcccacaccctgg

SEQ ID NO: 2455378 - DNA, 15 bp, Homo sapiens
ctcacccccttctcc

SEQ ID NO: 2455379 - DNA, 16 bp, Homo sapiens
ctcacccccttctcca

SEQ ID NO: 2455380 - DNA, 19 bp, Homo sapiens
ctcacccccttctccatcc

SEQ ID NO: 2455381 - DNA, 13 bp, Homo sapiens
ctcaccggctctc

SEQ ID NO: 2455382 - DNA, 21 bp, Homo sapiens
ctcaccggctctcacctggcc

SEQ ID NO: 2455383 - DNA, 14 bp, Homo sapiens
ctcaccttctgagt

SEQ ID NO: 2455384 - DNA, 17 bp, Homo sapiens
ctcaccttggcaccaga

SEQ ID NO: 2455385 - DNA, 15 bp, Homo sapiens
ctcactaattcatta

SEQ ID NO: 2455386 - DNA, 23 bp, Homo sapiens
ctcactaggcccccacttgcctc

SEQ ID NO: 2455387 - DNA, 17 bp, Homo sapiens
ctcactataccagtata

SEQ ID NO: 2455388 - DNA, 18 bp, Homo sapiens
ctcactcagccaccctga

SEQ ID NO: 2455389 - DNA, 21 bp, Homo sapiens
ctcactcagccaccctgagtt

SEQ ID NO: 2455390 - DNA, 14 bp, Homo sapiens
ctcactcgtctccc

SEQ ID NO: 2455391 - DNA, 19 bp, Homo sapiens
ctcactggctctcctggcc

SEQ ID NO: 2455392 - DNA, 19 bp, Homo sapiens
ctcactgtgtcacccaggc

SEQ ID NO: 2455393 - DNA, 17 bp, Homo sapiens
ctcacttttcccactcc

SEQ ID NO: 2455394 - DNA, 16 bp, Homo sapiens
ctcagaaagtgcctga

SEQ ID NO: 2455395 - DNA, 17 bp, Homo sapiens
ctcagaaagtgcctgac

SEQ ID NO: 2455396 - DNA, 22 bp, Homo sapiens
ctcagaaagtgcctgacacact

SEQ ID NO: 2455397 - DNA, 13 bp, Homo sapiens
ctcagaagcctgg

SEQ ID NO: 2455398 - DNA, 14 bp, Homo sapiens
ctcagaagcctggg

SEQ ID NO: 2455399 - DNA, 15 bp, Homo sapiens
ctcagaagcctgggg

SEQ ID NO: 2455400 - DNA, 16 bp, Homo sapiens
ctcagaagcctggggg

SEQ ID NO: 2455401 - DNA, 20 bp, Homo sapiens
ctcagaagcctgggggcctg

SEQ ID NO: 2455402 - DNA, 21 bp, Homo sapiens
ctcagaagtgcatctggagag

SEQ ID NO: 2455403 - DNA, 13 bp, Homo sapiens
ctcagacattggc

SEQ ID NO: 2455404 - DNA, 13 bp, Homo sapiens
ctcagagacatgc

SEQ ID NO: 2455405 - DNA, 16 bp, Homo sapiens
ctcagagacatgcaga

SEQ ID NO: 2455406 - DNA, 17 bp, Homo sapiens
ctcagagacatgcagag

SEQ ID NO: 2455407 - DNA, 19 bp, Homo sapiens
ctcagagacatgcagagat

SEQ ID NO: 2455408 - DNA, 18 bp, Homo sapiens
ctcagaggcgcactgtga

SEQ ID NO: 2455409 - DNA, 21 bp, Homo sapiens
ctcagataaggtaaaatgcca

SEQ ID NO: 2455410 - DNA, 23 bp, Homo sapiens
ctcagataaggtaaaatgccatg

SEQ ID NO: 2455411 - DNA, 13 bp, Homo sapiens
ctcagatccaggg

SEQ ID NO: 2455412 - DNA, 14 bp, Homo sapiens
ctcagatccaggga

SEQ ID NO: 2455413 - DNA, 16 bp, Homo sapiens
ctcagatccagggaca

SEQ ID NO: 2455414 - DNA, 18 bp, Homo sapiens
ctcagatccagggacaga

SEQ ID NO: 2455415 - DNA, 12 bp, Homo sapiens
ctcagatggcag

SEQ ID NO: 2455416 - DNA, 15 bp, Homo sapiens
ctcagatggcagctt

SEQ ID NO: 2455417 - DNA, 16 bp, Homo sapiens
ctcagattccttccca

SEQ ID NO: 2455418 - DNA, 15 bp, Homo sapiens
ctcagattgtaatat

SEQ ID NO: 2455419 - DNA, 14 bp, Homo sapiens
ctcagcacaaggcc

SEQ ID NO: 2455420 - DNA, 15 bp, Homo sapiens
ctcagcactgcctgc

SEQ ID NO: 2455421 - DNA, 16 bp, Homo sapiens
ctcagcactgcctgct

SEQ ID NO: 2455422 - DNA, 13 bp, Homo sapiens
ctcagcacttggc

SEQ ID NO: 2455423 - DNA, 16 bp, Homo sapiens
ctcagcacttggccct

SEQ ID NO: 2455424 - DNA, 15 bp, Homo sapiens
ctcagccaccctgag

SEQ ID NO: 2455425 - DNA, 16 bp, Homo sapiens
ctcagccaccctgagt

SEQ ID NO: 2455426 - DNA, 17 bp, Homo sapiens
ctcagccaccctgagtt

SEQ ID NO: 2455427 - DNA, 14 bp, Homo sapiens
ctcagccagcctcg

SEQ ID NO: 2455428 - DNA, 18 bp, Homo sapiens
ctcagccctcacacaccc

SEQ ID NO: 2455429 - DNA, 13 bp, Homo sapiens
ctcagcctcccag

SEQ ID NO: 2455430 - DNA, 20 bp, Homo sapiens
ctcagcctccggagtagctg

SEQ ID NO: 2455431 - DNA, 19 bp, Homo sapiens
ctcagcctgaaccccaggg

SEQ ID NO: 2455432 - DNA, 14 bp, Homo sapiens
ctcagcctggccag

SEQ ID NO: 2455433 - DNA, 17 bp, Homo sapiens
ctcagcctggccagaca

SEQ ID NO: 2455434 - DNA, 19 bp, Homo sapiens
ctcagcctggccagacaca

SEQ ID NO: 2455435 - DNA, 11 bp, Homo sapiens
ctcagcctggg

SEQ ID NO: 2455436 - DNA, 15 bp, Homo sapiens
ctcagcctgggcgct

SEQ ID NO: 2455437 - DNA, 16 bp, Homo sapiens
ctcagccttcagacag

SEQ ID NO: 2455438 - DNA, 15 bp, Homo sapiens
ctccagcggccctgt

SEQ ID NO: 2455439 - DNA, 15 bp, Homo sapiens
ctccagctccctgtg

SEQ ID NO: 2455440 - DNA, 17 bp, Homo sapiens
ctccagctccctgtgcc

SEQ ID NO: 2455441 - DNA, 22 bp, Homo sapiens
ctccagctccctgtgcccccag

SEQ ID NO: 2455442 - DNA, 20 bp, Homo sapiens
ctccagctgactaaactttt

SEQ ID NO: 2455443 - DNA, 15 bp, Homo sapiens
ctccagctgggctct

SEQ ID NO: 2455444 - DNA, 20 bp, Homo sapiens
ctccagctgggctctgcaat

SEQ ID NO: 2455445 - DNA, 11 bp, Homo sapiens
ctccaggccca

SEQ ID NO: 2455446 - DNA, 23 bp, Homo sapiens
ctagacacatgaaggtaaataaa

SEQ ID NO: 2455447 - DNA, 21 bp, Homo sapiens
ctagacaccaaagttctaata

SEQ ID NO: 2455448 - DNA, 19 bp, Homo sapiens
ctagacatggaggttctaa

SEQ ID NO: 2455449 - DNA, 11 bp, Homo sapiens
ctagaccaata

SEQ ID NO: 2455450 - DNA, 22 bp, Homo sapiens
ctagaccagcagacagagccag

SEQ ID NO: 2455451 - DNA, 16 bp, Homo sapiens
ctagacctccagctgt

SEQ ID NO: 2455452 - DNA, 21 bp, Homo sapiens
ctagagaaataagatcttttt

SEQ ID NO: 2455453 - DNA, 18 bp, Homo sapiens
ctagagaagacaggctgg

SEQ ID NO: 2455454 - DNA, 22 bp, Homo sapiens
ctagagaagacaggctggaaga

SEQ ID NO: 2455455 - DNA, 14 bp, Homo sapiens
ctagagcagggatt

SEQ ID NO: 2455456 - DNA, 19 bp, Homo sapiens
ctagaggtgagaaatttaa

SEQ ID NO: 2455457 - DNA, 21 bp, Homo sapiens
ctagagtcccaggttggctct

SEQ ID NO: 2455458 - DNA, 20 bp, Homo sapiens
ctagagtctgaacagctgta

SEQ ID NO: 2455459 - DNA, 15 bp, Homo sapiens
ctagatcataaggct

SEQ ID NO: 2455460 - DNA, 21 bp, Homo sapiens
ctagatgattaaataagattc

SEQ ID NO: 2455461 - DNA, 23 bp, Homo sapiens
ctagatgtagtattttttgtata

SEQ ID NO: 2455462 - DNA, 21 bp, Homo sapiens
ctagatgtttattcttctaga

SEQ ID NO: 2455463 - DNA, 14 bp, Homo sapiens
ctagattcaaaggt

SEQ ID NO: 2455464 - DNA, 12 bp, Homo sapiens
ctagatttaata

SEQ ID NO: 2455465 - DNA, 13 bp, Homo sapiens
ctagcagtggcag

SEQ ID NO: 2455466 - DNA, 20 bp, Homo sapiens
ctagccaaacctcaccaact

SEQ ID NO: 2455467 - DNA, 13 bp, Homo sapiens
ctagccttgcttg

SEQ ID NO: 2455468 - DNA, 14 bp, Homo sapiens
ctagcgcagttttt

SEQ ID NO: 2455469 - DNA, 22 bp, Homo sapiens
ctagcgcagttttttttttctt

SEQ ID NO: 2455470 - DNA, 16 bp, Homo sapiens
ctagcgggatggggct

SEQ ID NO: 2455471 - DNA, 19 bp, Homo sapiens
ctagctgaatgtttttcta

SEQ ID NO: 2455472 - DNA, 16 bp, Homo sapiens
ctaggaagcctcagat

SEQ ID NO: 2455473 - DNA, 23 bp, Homo sapiens
ctaggagaaccaaatctggaagc

SEQ ID NO: 2455474 - DNA, 20 bp, Homo sapiens
ctaggagctttgactcagga

SEQ ID NO: 2455475 - DNA, 22 bp, Homo sapiens
ctaggagctttgactcaggagc

SEQ ID NO: 2455476 - DNA, 13 bp, Homo sapiens
ctaggagggagac

SEQ ID NO: 2455477 - DNA, 15 bp, Homo sapiens
ctaggagggtcctct

SEQ ID NO: 2455478 - DNA, 20 bp, Homo sapiens
ctaggagggtcctctgagac

SEQ ID NO: 2455479 - DNA, 22 bp, Homo sapiens
ctaggcattctggacctctggg

SEQ ID NO: 2455480 - DNA, 22 bp, Homo sapiens
ctaggccagcaggggctgcccg

SEQ ID NO: 2455481 - DNA, 20 bp, Homo sapiens
ctaggcccccacttgcctct

SEQ ID NO: 2455482 - DNA, 22 bp, Homo sapiens
ctaggcccccacttgcctcttc

SEQ ID NO: 2455483 - DNA, 21 bp, Homo sapiens
ctaggccttgcggctcctcag

SEQ ID NO: 2455484 - DNA, 14 bp, Homo sapiens
ctaggtacgatgac

SEQ ID NO: 2455485 - DNA, 12 bp, Homo sapiens
ctaggtggaaaa

SEQ ID NO: 2455486 - DNA, 13 bp, Homo sapiens
ctaggtttcaaag

SEQ ID NO: 2455487 - DNA, 18 bp, Homo sapiens
ctagtcaatgacatgaat

SEQ ID NO: 2455488 - DNA, 17 bp, Homo sapiens
ctagtcttttgcttttg

SEQ ID NO: 2455489 - DNA, 20 bp, Homo sapiens
ctagtgacttgtgtcccatg

SEQ ID NO: 2455490 - DNA, 14 bp, Homo sapiens
ctagtgtgaattaa

SEQ ID NO: 2455491 - DNA, 16 bp, Homo sapiens
ctagttatacttattt

SEQ ID NO: 2455492 - DNA, 17 bp, Homo sapiens
ctataagaactttgagc

SEQ ID NO: 2455493 - DNA, 21 bp, Homo sapiens
ctataaggtgctctctttctg

SEQ ID NO: 2455494 - DNA, 23 bp, Homo sapiens
ctatacctgtgtttcttgcctca

SEQ ID NO: 2455495 - DNA, 23 bp, Homo sapiens
ctatactgcttggagctgagcaa

SEQ ID NO: 2455496 - DNA, 15 bp, Homo sapiens
ctatagatgtctttt

SEQ ID NO: 2455497 - DNA, 16 bp, Homo sapiens
ctatagatgtcttttc

SEQ ID NO: 2455498 - DNA, 14 bp, Homo sapiens
ctatagccaaaaat

SEQ ID NO: 2455499 - DNA, 19 bp, Homo sapiens
ctatagccaaaaatagcta

SEQ ID NO: 2455500 - DNA, 10 bp, Homo sapiens
ctatatgtat

SEQ ID NO: 2455501 - DNA, 16 bp, Homo sapiens
ctatattgttcagcat

SEQ ID NO: 2455502 - DNA, 18 bp, Homo sapiens
ctatcagactaagccagc

SEQ ID NO: 2455503 - DNA, 13 bp, Homo sapiens
ctatcctctgtaa

SEQ ID NO: 2455504 - DNA, 19 bp, Homo sapiens
ctatctccagcggccctgt

SEQ ID NO: 2455505 - DNA, 21 bp, Homo sapiens
ctatctccagcggccctgtca

SEQ ID NO: 2455506 - DNA, 15 bp, Homo sapiens
ctatctccctgcctc

SEQ ID NO: 2455507 - DNA, 17 bp, Homo sapiens
ctatctccctgcctcct

SEQ ID NO: 2455508 - DNA, 18 bp, Homo sapiens
ctatctccctgcctcctg

SEQ ID NO: 2455509 - DNA, 17 bp, Homo sapiens
ctatctgggcttcctgg

SEQ ID NO: 2455510 - DNA, 12 bp, Homo sapiens
ctatctgtattc

SEQ ID NO: 2455511 - DNA, 17 bp, Homo sapiens
ctatctgtattcccaaa

SEQ ID NO: 2455512 - DNA, 16 bp, Homo sapiens
ctatctgtctggtggc

SEQ ID NO: 2455513 - DNA, 21 bp, Homo sapiens
ctatctgtctggtggccccgt

SEQ ID NO: 2455514 - DNA, 15 bp, Homo sapiens
ctatcttaatactaa

SEQ ID NO: 2455515 - DNA, 17 bp, Homo sapiens
ctatgaaaatgctggct

SEQ ID NO: 2455516 - DNA, 13 bp, Homo sapiens
ctatgagtctaga

SEQ ID NO: 2455517 - DNA, 19 bp, Homo sapiens
ctatgatttaatttgaaat

SEQ ID NO: 2455518 - DNA, 18 bp, Homo sapiens
ctatgcatggtttcagca

SEQ ID NO: 2455519 - DNA, 23 bp, Homo sapiens
ctatgcatggtttcagcactagc

SEQ ID NO: 2455520 - DNA, 19 bp, Homo sapiens
ctatgctttgaaacagaaa

SEQ ID NO: 2455521 - DNA, 14 bp, Homo sapiens
ctatggagagccct

SEQ ID NO: 2455522 - DNA, 19 bp, Homo sapiens
ctatggagagccctgggac

SEQ ID NO: 2455523 - DNA, 13 bp, Homo sapiens
ctatgggaacaat

SEQ ID NO: 2455524 - DNA, 20 bp, Homo sapiens
ctatgggtgttatcacctag

SEQ ID NO: 2455525 - DNA, 17 bp, Homo sapiens
ctatggtcgggagacag

SEQ ID NO: 2455526 - DNA, 15 bp, Homo sapiens
ctatgtttttaatgt

SEQ ID NO: 2455527 - DNA, 14 bp, Homo sapiens
ctattaaaagactc

SEQ ID NO: 2455528 - DNA, 15 bp, Homo sapiens
ctattaaaagactca

SEQ ID NO: 2455529 - DNA, 22 bp, Homo sapiens
ctattaaagtgctaaggttcta

SEQ ID NO: 2455530 - DNA, 23 bp, Homo sapiens
ctattaaagtgctaaggttctaa

SEQ ID NO: 2455531 - DNA, 22 bp, Homo sapiens
ctattatgaatgtgaagccttc

SEQ ID NO: 2455532 - DNA, 17 bp, Homo sapiens
ctattccgagcccttag

SEQ ID NO: 2455533 - DNA, 20 bp, Homo sapiens
ctattctgtccctaggtgtt

SEQ ID NO: 2455534 - DNA, 14 bp, Homo sapiens
ctattcttgatgta

SEQ ID NO: 2455535 - DNA, 16 bp, Homo sapiens
ctattcttgatgtaaa

SEQ ID NO: 2455536 - DNA, 22 bp, Homo sapiens
ctattctttaactcccattacc

SEQ ID NO: 2455537 - DNA, 16 bp, Homo sapiens
ctatttaaaacttgta

SEQ ID NO: 2455538 - DNA, 17 bp, Homo sapiens
ctatttaaaacttgtaa

SEQ ID NO: 2455539 - DNA, 14 bp, Homo sapiens
ctatttaactgact

SEQ ID NO: 2455540 - DNA, 17 bp, Homo sapiens
ctatttatatgtacatg

SEQ ID NO: 2455541 - DNA, 18 bp, Homo sapiens
ctatttattgactttgac

SEQ ID NO: 2455542 - DNA, 22 bp, Homo sapiens
ctatttattgactttgacaatt

SEQ ID NO: 2455543 - DNA, 15 bp, Homo sapiens
ctatttcactggagc

SEQ ID NO: 2455544 - DNA, 17 bp, Homo sapiens
ctatttcactggagcac

SEQ ID NO: 2455545 - DNA, 15 bp, Homo sapiens
ctatttctcctccat

SEQ ID NO: 2455546 - DNA, 16 bp, Homo sapiens
ctatttcttaaacact

SEQ ID NO: 2455547 - DNA, 14 bp, Homo sapiens
ctatttgtaaatct

SEQ ID NO: 2455548 - DNA, 23 bp, Homo sapiens
cgtgctctttgttttgtgtctct

SEQ ID NO: 2455549 - DNA, 14 bp, Homo sapiens
cgtggaggctgctc

SEQ ID NO: 2455550 - DNA, 19 bp, Homo sapiens
cgtggaggggtaggggctg

SEQ ID NO: 2455551 - DNA, 23 bp, Homo sapiens
cgtggaggggtaggggctgggaa

SEQ ID NO: 2455552 - DNA, 20 bp, Homo sapiens
cgtggcccttcctggacagc

SEQ ID NO: 2455553 - DNA, 22 bp, Homo sapiens
cgtggcccttcctggacagctg

SEQ ID NO: 2455554 - DNA, 15 bp, Homo sapiens
cgtggcctcttgagc

SEQ ID NO: 2455555 - DNA, 18 bp, Homo sapiens
cgtggctcagccagcact

SEQ ID NO: 2455556 - DNA, 19 bp, Homo sapiens
cgtgggacggtgcccaagc

SEQ ID NO: 2455557 - DNA, 20 bp, Homo sapiens
cgtgggacggtgcccaagcc

SEQ ID NO: 2455558 - DNA, 13 bp, Homo sapiens
cgtgggctccctg

SEQ ID NO: 2455559 - DNA, 17 bp, Homo sapiens
cgtgggctccctgactg

SEQ ID NO: 2455560 - DNA, 19 bp, Homo sapiens
cgtgtaaatatgtacattt

SEQ ID NO: 2455561 - DNA, 20 bp, Homo sapiens
cgtgtaaatatgtacatttc

SEQ ID NO: 2455562 - DNA, 13 bp, Homo sapiens
cgtgtgcaggagc

SEQ ID NO: 2455563 - DNA, 23 bp, Homo sapiens
cgtgtgggagaccggcctgccag

SEQ ID NO: 2455564 - DNA, 17 bp, Homo sapiens
cgtgtgtttttctatta

SEQ ID NO: 2455565 - DNA, 21 bp, Homo sapiens
cgtgtgtttttctattaaaag

SEQ ID NO: 2455566 - DNA, 23 bp, Homo sapiens
cgtgtgtttttctattaaaagac

SEQ ID NO: 2455567 - DNA, 15 bp, Homo sapiens
cgtgttcaatatttt

SEQ ID NO: 2455568 - DNA, 13 bp, Homo sapiens
cgttagctcctgt

SEQ ID NO: 2455569 - DNA, 17 bp, Homo sapiens
cgttagctcctgtggcc

SEQ ID NO: 2455570 - DNA, 16 bp, Homo sapiens
cgttcctttcttttcc

SEQ ID NO: 2455571 - DNA, 17 bp, Homo sapiens
cgtttaagccaaaacaa

SEQ ID NO: 2455572 - DNA, 18 bp, Homo sapiens
cgtttaagccaaaacaat

SEQ ID NO: 2455573 - DNA, 14 bp, Homo sapiens
cgtttcctttgttg

SEQ ID NO: 2455574 - DNA, 13 bp, Homo sapiens
cgtttcttcctgc

SEQ ID NO: 2455575 - DNA, 16 bp, Homo sapiens
cgttttataagcatca

SEQ ID NO: 2455576 - DNA, 14 bp, Homo sapiens
cgttttcttaaagt

SEQ ID NO: 2455577 - DNA, 13 bp, Homo sapiens
cgttttgaagcta

SEQ ID NO: 2455578 - DNA, 14 bp, Homo sapiens
ctaaaaaaaagatg

SEQ ID NO: 2455579 - DNA, 17 bp, Homo sapiens
ctaaaactctttcggta

SEQ ID NO: 2455580 - DNA, 15 bp, Homo sapiens
ctaaaataattttgt

SEQ ID NO: 2455581 - DNA, 21 bp, Homo sapiens
ctaaaatcttatagttctagg

SEQ ID NO: 2455582 - DNA, 18 bp, Homo sapiens
ctaaaatgtgatgttcta

SEQ ID NO: 2455583 - DNA, 20 bp, Homo sapiens
ctaaaatgtgatgttctaag

SEQ ID NO: 2455584 - DNA, 13 bp, Homo sapiens
ctaaacatcattc

SEQ ID NO: 2455585 - DNA, 15 bp, Homo sapiens
ctaaacccaatccaa

SEQ ID NO: 2455586 - DNA, 19 bp, Homo sapiens
ctaaacccaatccaaatgg

SEQ ID NO: 2455587 - DNA, 17 bp, Homo sapiens
ctaaagaaaaacaaact

SEQ ID NO: 2455588 - DNA, 13 bp, Homo sapiens
ctaaagcaggcct

SEQ ID NO: 2455589 - DNA, 12 bp, Homo sapiens
ctaaagccttta

SEQ ID NO: 2455590 - DNA, 12 bp, Homo sapiens
ctaaagctctga

SEQ ID NO: 2455591 - DNA, 14 bp, Homo sapiens
ctaaagctctgaca

SEQ ID NO: 2455592 - DNA, 17 bp, Homo sapiens
ctaaagctggtttaatg

SEQ ID NO: 2455593 - DNA, 19 bp, Homo sapiens
ctaaaggaaatcaaatgaa

SEQ ID NO: 2455594 - DNA, 19 bp, Homo sapiens
ctaaaggtccacaggtcta

SEQ ID NO: 2455595 - DNA, 23 bp, Homo sapiens
ctaaaggtccacaggtctagact

SEQ ID NO: 2455596 - DNA, 15 bp, Homo sapiens
ctaaataaaatgcta

SEQ ID NO: 2455597 - DNA, 19 bp, Homo sapiens
ctaaataaaatgctaggtt

SEQ ID NO: 2455598 - DNA, 17 bp, Homo sapiens
ctaaatcctttactgtt

SEQ ID NO: 2455599 - DNA, 12 bp, Homo sapiens
ctaaatggcctc

SEQ ID NO: 2455600 - DNA, 19 bp, Homo sapiens
ctaaatggcctcatgtggc

SEQ ID NO: 2455601 - DNA, 22 bp, Homo sapiens
ctaaatgtagttctgctccaga

SEQ ID NO: 2455602 - DNA, 23 bp, Homo sapiens
ctaaattatttactgcaaaaaga

SEQ ID NO: 2455603 - DNA, 16 bp, Homo sapiens
ctaaattttcctgtcc

SEQ ID NO: 2455604 - DNA, 22 bp, Homo sapiens
ctaacaatcagctccttcctgg

SEQ ID NO: 2455605 - DNA, 13 bp, Homo sapiens
ctaacaatgacat

SEQ ID NO: 2455606 - DNA, 23 bp, Homo sapiens
ctaacacggtgctcattttttct

SEQ ID NO: 2455607 - DNA, 16 bp, Homo sapiens
ctaacactcagaagcc

SEQ ID NO: 2455608 - DNA, 19 bp, Homo sapiens
ctaacactcagaagcctgg

SEQ ID NO: 2455609 - DNA, 22 bp, Homo sapiens
ctaacactcagaagcctggggg

SEQ ID NO: 2455610 - DNA, 23 bp, Homo sapiens
ctaacactcagaagcctgggggc

SEQ ID NO: 2455611 - DNA, 14 bp, Homo sapiens
ctaacagggaaggc

SEQ ID NO: 2455612 - DNA, 12 bp, Homo sapiens
ctaacctcatct

SEQ ID NO: 2455613 - DNA, 17 bp, Homo sapiens
ctaacctcgggcctgct

SEQ ID NO: 2455614 - DNA, 21 bp, Homo sapiens
ctaaccttgcctggtacagta

SEQ ID NO: 2455615 - DNA, 17 bp, Homo sapiens
ctaacgcctgagcccag

SEQ ID NO: 2455616 - DNA, 22 bp, Homo sapiens
ctaacggtctgttctgtttcaa

SEQ ID NO: 2455617 - DNA, 22 bp, Homo sapiens
ctaacgttgagcccctggaggc

SEQ ID NO: 2455618 - DNA, 21 bp, Homo sapiens
ctaactagacaccaaagttct

SEQ ID NO: 2455619 - DNA, 23 bp, Homo sapiens
ctaactagacaccaaagttctaa

SEQ ID NO: 2455620 - DNA, 17 bp, Homo sapiens
ctaactcttctttcatt

SEQ ID NO: 2455621 - DNA, 15 bp, Homo sapiens
ctaactgcatacact

SEQ ID NO: 2455622 - DNA, 19 bp, Homo sapiens
ctaagaaacatttatattg

SEQ ID NO: 2455623 - DNA, 14 bp, Homo sapiens
ctaagaacctggaa

SEQ ID NO: 2455624 - DNA, 19 bp, Homo sapiens
ctaagactcaaatgttcta

SEQ ID NO: 2455625 - DNA, 17 bp, Homo sapiens
ctaagacttactctaag

SEQ ID NO: 2455626 - DNA, 18 bp, Homo sapiens
ctaagacttactctaaga

SEQ ID NO: 2455627 - DNA, 16 bp, Homo sapiens
ctaagagagcacctgg

SEQ ID NO: 2455628 - DNA, 16 bp, Homo sapiens
ctaagaggctgccctc

SEQ ID NO: 2455629 - DNA, 16 bp, Homo sapiens
ctaagatcttagattc

SEQ ID NO: 2455630 - DNA, 17 bp, Homo sapiens
ctaagatcttagattct

SEQ ID NO: 2455631 - DNA, 18 bp, Homo sapiens
ctaagatgtgatattcta

SEQ ID NO: 2455632 - DNA, 20 bp, Homo sapiens
ctaagatgtgatattctaag

SEQ ID NO: 2455633 - DNA, 19 bp, Homo sapiens
ctaagattacaaatcagaa

SEQ ID NO: 2455634 - DNA, 21 bp, Homo sapiens
ctaagattacaaatcagaagt

SEQ ID NO: 2455635 - DNA, 22 bp, Homo sapiens
ctaagattacaaatcagaagtc

SEQ ID NO: 2455636 - DNA, 11 bp, Homo sapiens
ctaagattcta

SEQ ID NO: 2455637 - DNA, 16 bp, Homo sapiens
ctaagattctaaaggt

SEQ ID NO: 2455638 - DNA, 18 bp, Homo sapiens
ctaagattctaaaggtcc

SEQ ID NO: 2455639 - DNA, 13 bp, Homo sapiens
ctaagattctaat

SEQ ID NO: 2455640 - DNA, 21 bp, Homo sapiens
ctaagattctaatgatgatca

SEQ ID NO: 2455641 - DNA, 14 bp, Homo sapiens
ctaagattctagat

SEQ ID NO: 2455642 - DNA, 15 bp, Homo sapiens
ctaagattctagatc

SEQ ID NO: 2455643 - DNA, 12 bp, Homo sapiens
ctaagattctga

SEQ ID NO: 2455644 - DNA, 16 bp, Homo sapiens
ctaagcaactaggcct

SEQ ID NO: 2455645 - DNA, 14 bp, Homo sapiens
ctaagcagaaagtg

SEQ ID NO: 2455646 - DNA, 15 bp, Homo sapiens
ctaagcagaaagtgc

SEQ ID NO: 2455647 - DNA, 16 bp, Homo sapiens
ctaagctcacgtcctg

SEQ ID NO: 2455648 - DNA, 20 bp, Homo sapiens
ctaaggacctgaaattccaa

SEQ ID NO: 2455649 - DNA, 21 bp, Homo sapiens
ctaaggcctaggattctaaaa

SEQ ID NO: 2455650 - DNA, 12 bp, Homo sapiens
cctgcctcagga

SEQ ID NO: 2455651 - DNA, 16 bp, Homo sapiens
cctgcctgccctggtg

SEQ ID NO: 2455652 - DNA, 18 bp, Homo sapiens
cctgcctgctcgctccct

SEQ ID NO: 2455653 - DNA, 19 bp, Homo sapiens
cctgcctggaggacctgag

SEQ ID NO: 2455654 - DNA, 22 bp, Homo sapiens
cctgcctggaggacctgagcct

SEQ ID NO: 2455655 - DNA, 23 bp, Homo sapiens
cctgcctgtggcgccgtctccag

SEQ ID NO: 2455656 - DNA, 22 bp, Homo sapiens
cctgccttcctcctgggccctc

SEQ ID NO: 2455657 - DNA, 19 bp, Homo sapiens
cctgccttgaaaaagacat

SEQ ID NO: 2455658 - DNA, 19 bp, Homo sapiens
cctgccttggcctcccaag

SEQ ID NO: 2455659 - DNA, 13 bp, Homo sapiens
cctgcctttccat

SEQ ID NO: 2455660 - DNA, 16 bp, Homo sapiens
cctgcctttccatcca

SEQ ID NO: 2455661 - DNA, 15 bp, Homo sapiens
cctgcgaaaaccccc

SEQ ID NO: 2455662 - DNA, 20 bp, Homo sapiens
cctgcggcccaatccaaggt

SEQ ID NO: 2455663 - DNA, 21 bp, Homo sapiens
cctgcgggtggggcttggggc

SEQ ID NO: 2455664 - DNA, 14 bp, Homo sapiens
cctgctaggccaga

SEQ ID NO: 2455665 - DNA, 17 bp, Homo sapiens
cctgctaggccagagcc

SEQ ID NO: 2455666 - DNA, 19 bp, Homo sapiens
cctgctcagccctgcacca

SEQ ID NO: 2455667 - DNA, 22 bp, Homo sapiens
cctgctccagacctgatcctgg

SEQ ID NO: 2455668 - DNA, 15 bp, Homo sapiens
cctgctcccatcctg

SEQ ID NO: 2455669 - DNA, 20 bp, Homo sapiens
cctgctcccatcctgtgtgt

SEQ ID NO: 2455670 - DNA, 16 bp, Homo sapiens
cctgctgagctctgag

SEQ ID NO: 2455671 - DNA, 18 bp, Homo sapiens
cctgctgagctctgagag

SEQ ID NO: 2455672 - DNA, 24 bp, Homo sapiens
cctgctgagctctgagaggccctg

SEQ ID NO: 2455673 - DNA, 22 bp, Homo sapiens
cctgctgccatgtggactggtg

SEQ ID NO: 2455674 - DNA, 13 bp, Homo sapiens
cctgctgctccct

SEQ ID NO: 2455675 - DNA, 14 bp, Homo sapiens
cctgctgctccctc

SEQ ID NO: 2455676 - DNA, 16 bp, Homo sapiens
cctgctgctccctcag

SEQ ID NO: 2455677 - DNA, 22 bp, Homo sapiens
cctgctgctgagaacctggcct

SEQ ID NO: 2455678 - DNA, 14 bp, Homo sapiens
cctgcttcctgctt

SEQ ID NO: 2455679 - DNA, 21 bp, Homo sapiens
cctgcttgatgggattctgga

SEQ ID NO: 2455680 - DNA, 23 bp, Homo sapiens
cctgcttggggggtgatgagggc

SEQ ID NO: 2455681 - DNA, 16 bp, Homo sapiens
cctgctttttgtgttt

SEQ ID NO: 2455682 - DNA, 17 bp, Homo sapiens
cctggaagggaggtggg

SEQ ID NO: 2455683 - DNA, 13 bp, Homo sapiens
cctggacagctgt

SEQ ID NO: 2455684 - DNA, 21 bp, Homo sapiens
cctggacagctgtgcctcgct

SEQ ID NO: 2455685 - DNA, 18 bp, Homo sapiens
cctggacccccctttcac

SEQ ID NO: 2455686 - DNA, 24 bp, Homo sapiens
cctggacccccctttcacaggcag

SEQ ID NO: 2455687 - DNA, 20 bp, Homo sapiens
cctggacttaagcatctggc

SEQ ID NO: 2455688 - DNA, 13 bp, Homo sapiens
cctggactttcct

SEQ ID NO: 2455689 - DNA, 15 bp, Homo sapiens
cctggactttcctgc

SEQ ID NO: 2455690 - DNA, 23 bp, Homo sapiens
cctggagacttagggcaccaggg

SEQ ID NO: 2455691 - DNA, 13 bp, Homo sapiens
cctggagatcctc

SEQ ID NO: 2455692 - DNA, 15 bp, Homo sapiens
cctggagcagaagca

SEQ ID NO: 2455693 - DNA, 17 bp, Homo sapiens
cctggagcagaagcagc

SEQ ID NO: 2455694 - DNA, 18 bp, Homo sapiens
cctggaggacctgagcct

SEQ ID NO: 2455695 - DNA, 19 bp, Homo sapiens
cctggaggacctgagcctg

SEQ ID NO: 2455696 - DNA, 14 bp, Homo sapiens
cctggaggcactga

SEQ ID NO: 2455697 - DNA, 12 bp, Homo sapiens
cctggaggccca

SEQ ID NO: 2455698 - DNA, 16 bp, Homo sapiens
cctggaggcccagttc

SEQ ID NO: 2455699 - DNA, 23 bp, Homo sapiens
cctggaggccccaaccctgtcct

SEQ ID NO: 2455700 - DNA, 22 bp, Homo sapiens
cctggagtgtatgactgcacat

SEQ ID NO: 2455701 - DNA, 17 bp, Homo sapiens
cctggatcagaacagga

SEQ ID NO: 2455702 - DNA, 20 bp, Homo sapiens
cctggatcagcgtggccttg

SEQ ID NO: 2455703 - DNA, 14 bp, Homo sapiens
cctggatctccctg

SEQ ID NO: 2455704 - DNA, 12 bp, Homo sapiens
cctggcagagat

SEQ ID NO: 2455705 - DNA, 15 bp, Homo sapiens
cctggcagctctgga

SEQ ID NO: 2455706 - DNA, 21 bp, Homo sapiens
cctggcagctctggacagccc

SEQ ID NO: 2455707 - DNA, 21 bp, Homo sapiens
cctggcatcgcaccattctga

SEQ ID NO: 2455708 - DNA, 13 bp, Homo sapiens
cctggccagacac

SEQ ID NO: 2455709 - DNA, 18 bp, Homo sapiens
cctggccagacacaggcc

SEQ ID NO: 2455710 - DNA, 23 bp, Homo sapiens
cctggccagacacaggccctccc

SEQ ID NO: 2455711 - DNA, 16 bp, Homo sapiens
cctggccagtgccctg

SEQ ID NO: 2455712 - DNA, 12 bp, Homo sapiens
cctggcccagcc

SEQ ID NO: 2455713 - DNA, 13 bp, Homo sapiens
cctggccccagga

SEQ ID NO: 2455714 - DNA, 18 bp, Homo sapiens
cctggccccatggtcagc

SEQ ID NO: 2455715 - DNA, 14 bp, Homo sapiens
cctggcccctctcc

SEQ ID NO: 2455716 - DNA, 17 bp, Homo sapiens
cctggcccctctccctt

SEQ ID NO: 2455717 - DNA, 21 bp, Homo sapiens
cctggccctgcttcctgcttg

SEQ ID NO: 2455718 - DNA, 23 bp, Homo sapiens
cctggccctgcttcctgcttgcc

SEQ ID NO: 2455719 - DNA, 16 bp, Homo sapiens
cctggccgcctgggtc

SEQ ID NO: 2455720 - DNA, 15 bp, Homo sapiens
cctggcctcccctgc

SEQ ID NO: 2455721 - DNA, 17 bp, Homo sapiens
cctggcctcccctgcca

SEQ ID NO: 2455722 - DNA, 14 bp, Homo sapiens
cctggcctcctgcc

SEQ ID NO: 2455723 - DNA, 15 bp, Homo sapiens
cctggcctcctgcct

SEQ ID NO: 2455724 - DNA, 21 bp, Homo sapiens
cctggcctcctgcctctactg

SEQ ID NO: 2455725 - DNA, 11 bp, Homo sapiens
cctggccttca

SEQ ID NO: 2455726 - DNA, 14 bp, Homo sapiens
cctggctctcacct

SEQ ID NO: 2455727 - DNA, 19 bp, Homo sapiens
cctggctctcacctctagg

SEQ ID NO: 2455728 - DNA, 21 bp, Homo sapiens
cctggctctcacctctaggtc

SEQ ID NO: 2455729 - DNA, 20 bp, Homo sapiens
cctggctgctgatcgccttc

SEQ ID NO: 2455730 - DNA, 21 bp, Homo sapiens
cctggctgctgatcgccttcc

SEQ ID NO: 2455731 - DNA, 13 bp, Homo sapiens
cctggctggctga

SEQ ID NO: 2455732 - DNA, 17 bp, Homo sapiens
cctggctggctgagggc

SEQ ID NO: 2455733 - DNA, 20 bp, Homo sapiens
cctggctggctgagggcagt

SEQ ID NO: 2455734 - DNA, 20 bp, Homo sapiens
cctggcttcccatccccagc

SEQ ID NO: 2455735 - DNA, 21 bp, Homo sapiens
cctggcttcccatccccagcg

SEQ ID NO: 2455736 - DNA, 23 bp, Homo sapiens
cctggcttcccatccccagcgat

SEQ ID NO: 2455737 - DNA, 23 bp, Homo sapiens
cctgggaccgctacaccactctg

SEQ ID NO: 2455738 - DNA, 16 bp, Homo sapiens
cgactctgtgctggcc

SEQ ID NO: 2455739 - DNA, 20 bp, Homo sapiens
cgactctgtgctggccagcg

SEQ ID NO: 2455740 - DNA, 22 bp, Homo sapiens
cgactctgtgctggccagcgag

SEQ ID NO: 2455741 - DNA, 14 bp, Homo sapiens
cgactgcaacagga

SEQ ID NO: 2455742 - DNA, 19 bp, Homo sapiens
cgacttgtttttgcacatg

SEQ ID NO: 2455743 - DNA, 21 bp, Homo sapiens
cgagaaagaggcaccaggaag

SEQ ID NO: 2455744 - DNA, 16 bp, Homo sapiens
cgagaagggctgcttc

SEQ ID NO: 2455745 - DNA, 16 bp, Homo sapiens
cgagagatcaaagatg

SEQ ID NO: 2455746 - DNA, 17 bp, Homo sapiens
cgagagatgtgtgttga

SEQ ID NO: 2455747 - DNA, 20 bp, Homo sapiens
cgagaggtgggccagtctgt

SEQ ID NO: 2455748 - DNA, 14 bp, Homo sapiens
cgagcaaccgtggc

SEQ ID NO: 2455749 - DNA, 15 bp, Homo sapiens
cgagcaaccgtggcc

SEQ ID NO: 2455750 - DNA, 11 bp, Homo sapiens
cgagcagctga

SEQ ID NO: 2455751 - DNA, 12 bp, Homo sapiens
cgagcagctgag

SEQ ID NO: 2455752 - DNA, 15 bp, Homo sapiens
cgagcgccctgcaga

SEQ ID NO: 2455753 - DNA, 16 bp, Homo sapiens
cgagcgccctgcagac

SEQ ID NO: 2455754 - DNA, 20 bp, Homo sapiens
cgagcgccctgcagaccctg

SEQ ID NO: 2455755 - DNA, 16 bp, Homo sapiens
cgaggaatctgtgggt

SEQ ID NO: 2455756 - DNA, 19 bp, Homo sapiens
cgaggaggctccagagggc

SEQ ID NO: 2455757 - DNA, 20 bp, Homo sapiens
cgaggaggctccagagggca

SEQ ID NO: 2455758 - DNA, 18 bp, Homo sapiens
cgaggaggtgtctcaggc

SEQ ID NO: 2455759 - DNA, 21 bp, Homo sapiens
cgaggaggtgtctcaggctgc

SEQ ID NO: 2455760 - DNA, 13 bp, Homo sapiens
cgaggcccttggc

SEQ ID NO: 2455761 - DNA, 16 bp, Homo sapiens
cgaggtccctgctgcc

SEQ ID NO: 2455762 - DNA, 19 bp, Homo sapiens
cgagtcattcgttctgtgg

SEQ ID NO: 2455763 - DNA, 20 bp, Homo sapiens
cgagtcattcgttctgtgga

SEQ ID NO: 2455764 - DNA, 14 bp, Homo sapiens
cgagtccaagctgg

SEQ ID NO: 2455765 - DNA, 23 bp, Homo sapiens
cgatactgcgactttctgcctgg

SEQ ID NO: 2455766 - DNA, 12 bp, Homo sapiens
cgatagagtctc

SEQ ID NO: 2455767 - DNA, 15 bp, Homo sapiens
cgatccacctgtctc

SEQ ID NO: 2455768 - DNA, 17 bp, Homo sapiens
cgatctcttattttaca

SEQ ID NO: 2455769 - DNA, 18 bp, Homo sapiens
cgatctgtacctgagagg

SEQ ID NO: 2455770 - DNA, 13 bp, Homo sapiens
cgatgccagccaa

SEQ ID NO: 2455771 - DNA, 12 bp, Homo sapiens
cgatgcccagag

SEQ ID NO: 2455772 - DNA, 13 bp, Homo sapiens
cgatgcccagaga

SEQ ID NO: 2455773 - DNA, 15 bp, Homo sapiens
cgatgtggaactgct

SEQ ID NO: 2455774 - DNA, 19 bp, Homo sapiens
cgatgtggtcacagctgta

SEQ ID NO: 2455775 - DNA, 18 bp, Homo sapiens
cgattccctctcccaggc

SEQ ID NO: 2455776 - DNA, 16 bp, Homo sapiens
cgattctcttgcctca

SEQ ID NO: 2455777 - DNA, 22 bp, Homo sapiens
cgcaacccgtgccaagtccagg

SEQ ID NO: 2455778 - DNA, 22 bp, Homo sapiens
cgcactgtgacccccagctccg

SEQ ID NO: 2455779 - DNA, 14 bp, Homo sapiens
cgcagccaccctga

SEQ ID NO: 2455780 - DNA, 16 bp, Homo sapiens
cgcagccaccctgagg

SEQ ID NO: 2455781 - DNA, 23 bp, Homo sapiens
cgcagtccacttctgacagcctc

SEQ ID NO: 2455782 - DNA, 22 bp, Homo sapiens
cgcagtgggagcaaactgcatg

SEQ ID NO: 2455783 - DNA, 20 bp, Homo sapiens
cgcagttttttttttcttgt

SEQ ID NO: 2455784 - DNA, 20 bp, Homo sapiens
cgcatctcaaaacagagggc

SEQ ID NO: 2455785 - DNA, 16 bp, Homo sapiens
cgcatggtcacacact

SEQ ID NO: 2455786 - DNA, 19 bp, Homo sapiens
cgcatggtcacacactgat

SEQ ID NO: 2455787 - DNA, 12 bp, Homo sapiens
cgccagctctgt

SEQ ID NO: 2455788 - DNA, 14 bp, Homo sapiens
cgccagctctgttc

SEQ ID NO: 2455789 - DNA, 23 bp, Homo sapiens
cgccaggatggaacacggccaca

SEQ ID NO: 2455790 - DNA, 13 bp, Homo sapiens
cgcccagctcctg

SEQ ID NO: 2455791 - DNA, 16 bp, Homo sapiens
cgcccagctcctgaca

SEQ ID NO: 2455792 - DNA, 22 bp, Homo sapiens
cgcccagctcctgacactgctg

SEQ ID NO: 2455793 - DNA, 14 bp, Homo sapiens
cgccccctcctcta

SEQ ID NO: 2455794 - DNA, 12 bp, Homo sapiens
cgcccgtcctgc

SEQ ID NO: 2455795 - DNA, 17 bp, Homo sapiens
cgcccgtcctgcctgtg

SEQ ID NO: 2455796 - DNA, 12 bp, Homo sapiens
cgccctgccact

SEQ ID NO: 2455797 - DNA, 14 bp, Homo sapiens
cgccctgccactca

SEQ ID NO: 2455798 - DNA, 19 bp, Homo sapiens
cgccctttcctcctcaggc

SEQ ID NO: 2455799 - DNA, 16 bp, Homo sapiens
cgccggctgtgcagtc

SEQ ID NO: 2455800 - DNA, 20 bp, Homo sapiens
cgcctgacaaccactggtct

SEQ ID NO: 2455801 - DNA, 23 bp, Homo sapiens
cgcctgacaaccactggtctgta

SEQ ID NO: 2455802 - DNA, 13 bp, Homo sapiens
cgcctgagcccag

SEQ ID NO: 2455803 - DNA, 18 bp, Homo sapiens
cgcctgagcccagggagg

SEQ ID NO: 2455804 - DNA, 19 bp, Homo sapiens
cgcctggctgcagcctgcg

SEQ ID NO: 2455805 - DNA, 20 bp, Homo sapiens
cgcctgggtccaatgctcag

SEQ ID NO: 2455806 - DNA, 14 bp, Homo sapiens
cgccttccccaccc

SEQ ID NO: 2455807 - DNA, 22 bp, Homo sapiens
cgcgatgtggaactgctgccac

SEQ ID NO: 2455808 - DNA, 18 bp, Homo sapiens
cgcgccaccgagtgcctt

SEQ ID NO: 2455809 - DNA, 21 bp, Homo sapiens
cgcggccctcagtagtccctg

SEQ ID NO: 2455810 - DNA, 23 bp, Homo sapiens
cgcgggagccatgcgccccctcc

SEQ ID NO: 2455811 - DNA, 14 bp, Homo sapiens
cgcgtctaccctgg

SEQ ID NO: 2455812 - DNA, 15 bp, Homo sapiens
cgcgtctaccctggg

SEQ ID NO: 2455813 - DNA, 16 bp, Homo sapiens
cgcgtctaccctggga

SEQ ID NO: 2455814 - DNA, 13 bp, Homo sapiens
cgcgtcttcctga

SEQ ID NO: 2455815 - DNA, 21 bp, Homo sapiens
cgctcagggccatgctgaggc

SEQ ID NO: 2455816 - DNA, 22 bp, Homo sapiens
cgctcctgctaacggtgctcag

SEQ ID NO: 2455817 - DNA, 14 bp, Homo sapiens
cgctctcagttctc

SEQ ID NO: 2455818 - DNA, 13 bp, Homo sapiens
cgctgagtggcag

SEQ ID NO: 2455819 - DNA, 14 bp, Homo sapiens
cgctgagtggcagg

SEQ ID NO: 2455820 - DNA, 20 bp, Homo sapiens
cgctgagtggcaggggacag

SEQ ID NO: 2455821 - DNA, 13 bp, Homo sapiens
cgctgctgtcaca

SEQ ID NO: 2455822 - DNA, 13 bp, Homo sapiens
cgctgtcacaggc

SEQ ID NO: 2455823 - DNA, 15 bp, Homo sapiens
cgcttcttgcctctg

SEQ ID NO: 2455824 - DNA, 18 bp, Homo sapiens
cgcttcttgcctctgtgc

SEQ ID NO: 2455825 - DNA, 19 bp, Homo sapiens
cgcttcttgcctctgtgct

SEQ ID NO: 2455826 - DNA, 11 bp, Homo sapiens
cgctttttgaa

SEQ ID NO: 2455827 - DNA, 17 bp, Homo sapiens
cggaagggtaaacaata

SEQ ID NO: 2455828 - DNA, 22 bp, Homo sapiens
cggacaaaaccccccagatatc

SEQ ID NO: 2455829 - DNA, 18 bp, Homo sapiens
cggacaagacccccagca

SEQ ID NO: 2455830 - DNA, 21 bp, Homo sapiens
cggacagttccagaagtgtga

SEQ ID NO: 2455831 - DNA, 17 bp, Homo sapiens
cggaccagcctggccca

SEQ ID NO: 2455832 - DNA, 22 bp, Homo sapiens
cggacttagaaaaccagctcag

SEQ ID NO: 2455833 - DNA, 15 bp, Homo sapiens
cggacttttctgcaa

SEQ ID NO: 2455834 - DNA, 22 bp, Homo sapiens
cggaggaggagggaggccaggc

SEQ ID NO: 2455835 - DNA, 18 bp, Homo sapiens
gacttttctgtaattcag

SEQ ID NO: 2455836 - DNA, 12 bp, Homo sapiens
gacttttgtgaa

SEQ ID NO: 2455837 - DNA, 18 bp, Homo sapiens
gagaaacagttggtaact

SEQ ID NO: 2455838 - DNA, 21 bp, Homo sapiens
gagaaacagttggtaactttt

SEQ ID NO: 2455839 - DNA, 24 bp, Homo sapiens
gagaaacttaaatgttattatctg

SEQ ID NO: 2455840 - DNA, 15 bp, Homo sapiens
gagaaagctgacttg

SEQ ID NO: 2455841 - DNA, 20 bp, Homo sapiens
gagaaagctgacttggctgg

SEQ ID NO: 2455842 - DNA, 22 bp, Homo sapiens
gagaaagctgacttggctggtg

SEQ ID NO: 2455843 - DNA, 18 bp, Homo sapiens
gagaaaggggagcccact

SEQ ID NO: 2455844 - DNA, 23 bp, Homo sapiens
gagaaatctggcttctggccagg

SEQ ID NO: 2455845 - DNA, 17 bp, Homo sapiens
gagaacaaacagatcga

SEQ ID NO: 2455846 - DNA, 12 bp, Homo sapiens
gagaacctggcc

SEQ ID NO: 2455847 - DNA, 22 bp, Homo sapiens
gagaagaaagaggtgaccccag

SEQ ID NO: 2455848 - DNA, 18 bp, Homo sapiens
gagaagcattctcattgg

SEQ ID NO: 2455849 - DNA, 14 bp, Homo sapiens
gagaagccagcttg

SEQ ID NO: 2455850 - DNA, 16 bp, Homo sapiens
gagaagccagcttgtt

SEQ ID NO: 2455851 - DNA, 22 bp, Homo sapiens
gagaagccaggaatttcccagg

SEQ ID NO: 2455852 - DNA, 17 bp, Homo sapiens
gagaagccatcacctca

SEQ ID NO: 2455853 - DNA, 19 bp, Homo sapiens
gagaagccatcacctcaga

SEQ ID NO: 2455854 - DNA, 14 bp, Homo sapiens
gagaagcccgtgtg

SEQ ID NO: 2455855 - DNA, 16 bp, Homo sapiens
gagaagcccgtgtgag

SEQ ID NO: 2455856 - DNA, 12 bp, Homo sapiens
gagaagccttca

SEQ ID NO: 2455857 - DNA, 19 bp, Homo sapiens
gagaagccttcaagctctg

SEQ ID NO: 2455858 - DNA, 16 bp, Homo sapiens
gagaagtatacataag

SEQ ID NO: 2455859 - DNA, 16 bp, Homo sapiens
gagaagttgtaaagta

SEQ ID NO: 2455860 - DNA, 14 bp, Homo sapiens
gagaatcagactga

SEQ ID NO: 2455861 - DNA, 19 bp, Homo sapiens
gagacataaccactgcttc

SEQ ID NO: 2455862 - DNA, 22 bp, Homo sapiens
gagaccaagatggcccatcctg

SEQ ID NO: 2455863 - DNA, 12 bp, Homo sapiens
gagaccagggct

SEQ ID NO: 2455864 - DNA, 18 bp, Homo sapiens
gagacccagccctcatcc

SEQ ID NO: 2455865 - DNA, 20 bp, Homo sapiens
gagaccggcctgccaggagg

SEQ ID NO: 2455866 - DNA, 18 bp, Homo sapiens
gagacctcagaagtaaag

SEQ ID NO: 2455867 - DNA, 14 bp, Homo sapiens
gagactgggctgag

SEQ ID NO: 2455868 - DNA, 22 bp, Homo sapiens
gagactgtgtgtgccctctggg

SEQ ID NO: 2455869 - DNA, 14 bp, Homo sapiens
gagagaaaggactc

SEQ ID NO: 2455870 - DNA, 21 bp, Homo sapiens
gagagagttgttttaataact

SEQ ID NO: 2455871 - DNA, 12 bp, Homo sapiens
gagagatgtgtg

SEQ ID NO: 2455872 - DNA, 22 bp, Homo sapiens
gagagatgtgtgttgatactgt

SEQ ID NO: 2455873 - DNA, 16 bp, Homo sapiens
gagagcagtgcttttg

SEQ ID NO: 2455874 - DNA, 14 bp, Homo sapiens
gagagcccaggagc

SEQ ID NO: 2455875 - DNA, 16 bp, Homo sapiens
gagagcccaggagctc

SEQ ID NO: 2455876 - DNA, 20 bp, Homo sapiens
gagagcccaggagctcccct

SEQ ID NO: 2455877 - DNA, 15 bp, Homo sapiens
gagagccctgggacc

SEQ ID NO: 2455878 - DNA, 14 bp, Homo sapiens
gagagcctgcagga

SEQ ID NO: 2455879 - DNA, 22 bp, Homo sapiens
gagagctaggagcaaagcctgt

SEQ ID NO: 2455880 - DNA, 17 bp, Homo sapiens
gagaggacaagatgggt

SEQ ID NO: 2455881 - DNA, 15 bp, Homo sapiens
gagagggcgcaggcc

SEQ ID NO: 2455882 - DNA, 17 bp, Homo sapiens
gagagggcgcaggccgt

SEQ ID NO: 2455883 - DNA, 17 bp, Homo sapiens
gagagtaatgaggcttg

SEQ ID NO: 2455884 - DNA, 16 bp, Homo sapiens
gagagtctagattctc

SEQ ID NO: 2455885 - DNA, 12 bp, Homo sapiens
gagagtgggggt

SEQ ID NO: 2455886 - DNA, 14 bp, Homo sapiens
gagagtttcctgaa

SEQ ID NO: 2455887 - DNA, 15 bp, Homo sapiens
gagatagttttcatc

SEQ ID NO: 2455888 - DNA, 19 bp, Homo sapiens
gagatattaatgcccagac

SEQ ID NO: 2455889 - DNA, 20 bp, Homo sapiens
gagatcaaagatgaaaagta

SEQ ID NO: 2455890 - DNA, 18 bp, Homo sapiens
gagatgcaccaccaagcc

SEQ ID NO: 2455891 - DNA, 14 bp, Homo sapiens
gagatgcctccctg

SEQ ID NO: 2455892 - DNA, 15 bp, Homo sapiens
gagatgcctccctga

SEQ ID NO: 2455893 - DNA, 14 bp, Homo sapiens
gagatggctcccag

SEQ ID NO: 2455894 - DNA, 15 bp, Homo sapiens
gagatggctcccagg

SEQ ID NO: 2455895 - DNA, 18 bp, Homo sapiens
gagatgtgtgttgatact

SEQ ID NO: 2455896 - DNA, 21 bp, Homo sapiens
gagatgtgtgttgatactgtt

SEQ ID NO: 2455897 - DNA, 14 bp, Homo sapiens
gagattctgccttt

SEQ ID NO: 2455898 - DNA, 22 bp, Homo sapiens
gagattgaatttcactgtcttt

SEQ ID NO: 2455899 - DNA, 20 bp, Homo sapiens
gagcaaactgcatgcccaga

SEQ ID NO: 2455900 - DNA, 22 bp, Homo sapiens
gagcaaactgcatgcccagaga

SEQ ID NO: 2455901 - DNA, 13 bp, Homo sapiens
gagcaaagcctgt

SEQ ID NO: 2455902 - DNA, 15 bp, Homo sapiens
gagcaaccgtggccc

SEQ ID NO: 2455903 - DNA, 20 bp, Homo sapiens
gagcaaccgtggcccttcct

SEQ ID NO: 2455904 - DNA, 15 bp, Homo sapiens
gacagccccaccctg

SEQ ID NO: 2455905 - DNA, 15 bp, Homo sapiens
gacagccgcctggag

SEQ ID NO: 2455906 - DNA, 19 bp, Homo sapiens
gacagcctcagtgaccctg

SEQ ID NO: 2455907 - DNA, 12 bp, Homo sapiens
gacagctccacc

SEQ ID NO: 2455908 - DNA, 19 bp, Homo sapiens
gacagctgtgcctcgctcc

SEQ ID NO: 2455909 - DNA, 21 bp, Homo sapiens
gacaggactaacactcagaag

SEQ ID NO: 2455910 - DNA, 22 bp, Homo sapiens
gacaggactaacactcagaagc

SEQ ID NO: 2455911 - DNA, 23 bp, Homo sapiens
gacaggactaacactcagaagcc

SEQ ID NO: 2455912 - DNA, 24 bp, Homo sapiens
gacaggactaacactcagaagcct

SEQ ID NO: 2455913 - DNA, 18 bp, Homo sapiens
gacaggatgtgtttgctt

SEQ ID NO: 2455914 - DNA, 20 bp, Homo sapiens
gacaggatgtgtttgctttc

SEQ ID NO: 2455915 - DNA, 21 bp, Homo sapiens
gacaggctggctccagatgca

SEQ ID NO: 2455916 - DNA, 17 bp, Homo sapiens
gacagggcgggggtggc

SEQ ID NO: 2455917 - DNA, 18 bp, Homo sapiens
gacagggcgggggtggcg

SEQ ID NO: 2455918 - DNA, 17 bp, Homo sapiens
gacagggtttcaccatg

SEQ ID NO: 2455919 - DNA, 16 bp, Homo sapiens
gacaggtccctcccct

SEQ ID NO: 2455920 - DNA, 17 bp, Homo sapiens
gacagtcgttcccagtg

SEQ ID NO: 2455921 - DNA, 13 bp, Homo sapiens
gacagtctcactt

SEQ ID NO: 2455922 - DNA, 20 bp, Homo sapiens
gacagtgttccccgatacca

SEQ ID NO: 2455923 - DNA, 15 bp, Homo sapiens
gacagttcatatgta

SEQ ID NO: 2455924 - DNA, 17 bp, Homo sapiens
gacagttcatatgtacc

SEQ ID NO: 2455925 - DNA, 21 bp, Homo sapiens
gacagttccagaagtgtgact

SEQ ID NO: 2455926 - DNA, 21 bp, Homo sapiens
gacagtttaccagttgccttt

SEQ ID NO: 2455927 - DNA, 14 bp, Homo sapiens
gacataaaggaaaa

SEQ ID NO: 2455928 - DNA, 15 bp, Homo sapiens
gacataaaggaaaag

SEQ ID NO: 2455929 - DNA, 17 bp, Homo sapiens
gacataaagttgataaa

SEQ ID NO: 2455930 - DNA, 19 bp, Homo sapiens
gacataaagttgataaaga

SEQ ID NO: 2455931 - DNA, 17 bp, Homo sapiens
gacataccccctccccc

SEQ ID NO: 2455932 - DNA, 15 bp, Homo sapiens
gacatacttgaaggg

SEQ ID NO: 2455933 - DNA, 18 bp, Homo sapiens
gacatcaaaaaaggcagt

SEQ ID NO: 2455934 - DNA, 22 bp, Homo sapiens
gacatgaagccacgggtgccag

SEQ ID NO: 2455935 - DNA, 14 bp, Homo sapiens
gacatgatttcctt

SEQ ID NO: 2455936 - DNA, 16 bp, Homo sapiens
gacatgcggtagccag

SEQ ID NO: 2455937 - DNA, 15 bp, Homo sapiens
gacatggaggttcta

SEQ ID NO: 2455938 - DNA, 12 bp, Homo sapiens
gacatgtgacat

SEQ ID NO: 2455939 - DNA, 20 bp, Homo sapiens
gacatgtgacatttatatat

SEQ ID NO: 2455940 - DNA, 16 bp, Homo sapiens
gacattcacctgcccc

SEQ ID NO: 2455941 - DNA, 15 bp, Homo sapiens
gacattctgaatgct

SEQ ID NO: 2455942 - DNA, 22 bp, Homo sapiens
gacatttgggagacatgtgaca

SEQ ID NO: 2455943 - DNA, 20 bp, Homo sapiens
gaccaagatggcccatcctg

SEQ ID NO: 2455944 - DNA, 15 bp, Homo sapiens
gaccaagcatcttgg

SEQ ID NO: 2455945 - DNA, 12 bp, Homo sapiens
gaccaataaaga

SEQ ID NO: 2455946 - DNA, 14 bp, Homo sapiens
gaccacagcacagc

SEQ ID NO: 2455947 - DNA, 16 bp, Homo sapiens
gaccacaggctcaggc

SEQ ID NO: 2455948 - DNA, 13 bp, Homo sapiens
gaccacatgcccc

SEQ ID NO: 2455949 - DNA, 19 bp, Homo sapiens
gaccaccccgcctgccctc

SEQ ID NO: 2455950 - DNA, 14 bp, Homo sapiens
gaccaccctcactg

SEQ ID NO: 2455951 - DNA, 22 bp, Homo sapiens
gaccacctttgtttctccccca

SEQ ID NO: 2455952 - DNA, 21 bp, Homo sapiens
gaccacgcccgtcctgcctgt

SEQ ID NO: 2455953 - DNA, 13 bp, Homo sapiens
gaccactcagaga

SEQ ID NO: 2455954 - DNA, 14 bp, Homo sapiens
gaccactcagagac

SEQ ID NO: 2455955 - DNA, 23 bp, Homo sapiens
gaccagcagacagagccaggaga

SEQ ID NO: 2455956 - DNA, 12 bp, Homo sapiens
gaccagcagccc

SEQ ID NO: 2455957 - DNA, 16 bp, Homo sapiens
gaccagcagccccaca

SEQ ID NO: 2455958 - DNA, 20 bp, Homo sapiens
gaccagctccccctccctcc

SEQ ID NO: 2455959 - DNA, 13 bp, Homo sapiens
gaccagctgctcc

SEQ ID NO: 2455960 - DNA, 15 bp, Homo sapiens
gaccagctgctccga

SEQ ID NO: 2455961 - DNA, 11 bp, Homo sapiens
gaccaggagtg

SEQ ID NO: 2455962 - DNA, 18 bp, Homo sapiens
gaccaggagtgggtgggg

SEQ ID NO: 2455963 - DNA, 16 bp, Homo sapiens
gaccaggcaccaggca

SEQ ID NO: 2455964 - DNA, 13 bp, Homo sapiens
gaccaggctgtag

SEQ ID NO: 2455965 - DNA, 15 bp, Homo sapiens
gaccaggctgtagga

SEQ ID NO: 2455966 - DNA, 17 bp, Homo sapiens
gaccagtcccagagcag

SEQ ID NO: 2455967 - DNA, 22 bp, Homo sapiens
gagcatgtttagactttaacat

SEQ ID NO: 2455968 - DNA, 20 bp, Homo sapiens
gagcatttctcatcagtagt

SEQ ID NO: 2455969 - DNA, 14 bp, Homo sapiens
gagccaccagttct

SEQ ID NO: 2455970 - DNA, 14 bp, Homo sapiens
gagccagccgagca

SEQ ID NO: 2455971 - DNA, 20 bp, Homo sapiens
gagccagccgagcaggaggc

SEQ ID NO: 2455972 - DNA, 18 bp, Homo sapiens
gagccagctaaggggtgg

SEQ ID NO: 2455973 - DNA, 22 bp, Homo sapiens
gagccagctaaggggtggggct

SEQ ID NO: 2455974 - DNA, 22 bp, Homo sapiens
gagccagggtctccagaaagcc

SEQ ID NO: 2455975 - DNA, 18 bp, Homo sapiens
gagccatgtcttctccct

SEQ ID NO: 2455976 - DNA, 11 bp, Homo sapiens
gagcccactgt

SEQ ID NO: 2455977 - DNA, 24 bp, Homo sapiens
gagcccactgtcctgggcctgcag

SEQ ID NO: 2455978 - DNA, 12 bp, Homo sapiens
gagcccagctcc

SEQ ID NO: 2455979 - DNA, 14 bp, Homo sapiens
gagcccagctccaa

SEQ ID NO: 2455980 - DNA, 12 bp, Homo sapiens
gagcccagctct

SEQ ID NO: 2455981 - DNA, 19 bp, Homo sapiens
gagcccagctgggtcaggc

SEQ ID NO: 2455982 - DNA, 22 bp, Homo sapiens
gagcccaggccaggactctgca

SEQ ID NO: 2455983 - DNA, 24 bp, Homo sapiens
gagcccaggccaggactctgcagc

SEQ ID NO: 2455984 - DNA, 15 bp, Homo sapiens
gagcccagggaggcc

SEQ ID NO: 2455985 - DNA, 16 bp, Homo sapiens
gagccccagctaccct

SEQ ID NO: 2455986 - DNA, 17 bp, Homo sapiens
gagccccattcctggga

SEQ ID NO: 2455987 - DNA, 18 bp, Homo sapiens
gagccccattcctgggaa

SEQ ID NO: 2455988 - DNA, 14 bp, Homo sapiens
gagcccccaccctg

SEQ ID NO: 2455989 - DNA, 17 bp, Homo sapiens
gagcccccagcctgtca

SEQ ID NO: 2455990 - DNA, 15 bp, Homo sapiens
gagcccgaggaggtg

SEQ ID NO: 2455991 - DNA, 16 bp, Homo sapiens
gagccggccccaggct

SEQ ID NO: 2455992 - DNA, 20 bp, Homo sapiens
gagccggggtggggtggctg

SEQ ID NO: 2455993 - DNA, 22 bp, Homo sapiens
gagccggggtggggtggctgca

SEQ ID NO: 2455994 - DNA, 21 bp, Homo sapiens
gagccgggtctgcctcttctg

SEQ ID NO: 2455995 - DNA, 13 bp, Homo sapiens
gagccgtggtcct

SEQ ID NO: 2455996 - DNA, 10 bp, Homo sapiens
gagcctgagg

SEQ ID NO: 2455997 - DNA, 15 bp, Homo sapiens
gagcctgagggatct

SEQ ID NO: 2455998 - DNA, 15 bp, Homo sapiens
gagcctgcaggatct

SEQ ID NO: 2455999 - DNA, 18 bp, Homo sapiens
gagcctgccgagcaaccg

SEQ ID NO: 2456000 - DNA, 22 bp, Homo sapiens
gagcctgccgagcaaccgtggc

SEQ ID NO: 2456001 - DNA, 15 bp, Homo sapiens
gagcctggggctcta

SEQ ID NO: 2456002 - DNA, 11 bp, Homo sapiens
gagcctgtcct

SEQ ID NO: 2456003 - DNA, 21 bp, Homo sapiens
gagcctgtcctgcctgtggcc

SEQ ID NO: 2456004 - DNA, 16 bp, Homo sapiens
gagcctgtgaacccag

SEQ ID NO: 2456005 - DNA, 19 bp, Homo sapiens
gagcctgtgaacccaggac

SEQ ID NO: 2456006 - DNA, 21 bp, Homo sapiens
gagcctgtgaacccaggacaa

SEQ ID NO: 2456007 - DNA, 14 bp, Homo sapiens
gagccttccaccca

SEQ ID NO: 2456008 - DNA, 15 bp, Homo sapiens
gagccttccacccag

SEQ ID NO: 2456009 - DNA, 20 bp, Homo sapiens
gagcgagagatcaaagatga

SEQ ID NO: 2456010 - DNA, 16 bp, Homo sapiens
gagcgagtggagtctg

SEQ ID NO: 2456011 - DNA, 23 bp, Homo sapiens
gagcgccctgcagaccctgccct

SEQ ID NO: 2456012 - DNA, 17 bp, Homo sapiens
gagcgggtctgctccca

SEQ ID NO: 2456013 - DNA, 16 bp, Homo sapiens
gagcgtgagctgagca

SEQ ID NO: 2456014 - DNA, 14 bp, Homo sapiens
gagctacctgtgtg

SEQ ID NO: 2456015 - DNA, 19 bp, Homo sapiens
gagctacctgtgtggacag

SEQ ID NO: 2456016 - DNA, 22 bp, Homo sapiens
gagctacctgtgtggacaggac

SEQ ID NO: 2456017 - DNA, 11 bp, Homo sapiens
gagctactgcc

SEQ ID NO: 2456018 - DNA, 17 bp, Homo sapiens
gagctagaaccctctgt

SEQ ID NO: 2456019 - DNA, 12 bp, Homo sapiens
gagctaggagca

SEQ ID NO: 2456020 - DNA, 18 bp, Homo sapiens
gagctaggagcaaagcct

SEQ ID NO: 2456021 - DNA, 19 bp, Homo sapiens
gagctaggagcaaagcctg

SEQ ID NO: 2456022 - DNA, 22 bp, Homo sapiens
gagctcacaaggcagcaaggcc

SEQ ID NO: 2456023 - DNA, 19 bp, Homo sapiens
gagctcagaaaatatccct

SEQ ID NO: 2456024 - DNA, 23 bp, Homo sapiens
gagctcaggatgagggaaaagaa

SEQ ID NO: 2456025 - DNA, 12 bp, Homo sapiens
gagctcattctg

SEQ ID NO: 2456026 - DNA, 14 bp, Homo sapiens
gagctcattctgtc

SEQ ID NO: 2456027 - DNA, 14 bp, Homo sapiens
gagctccagctcct

SEQ ID NO: 2456028 - DNA, 18 bp, Homo sapiens
gagctccagtgtcctgag

SEQ ID NO: 2456029 - DNA, 23 bp, Homo sapiens
gagctccagtgtcctgagctcag

SEQ ID NO: 2456030 - DNA, 15 bp, Homo sapiens
gagctcccctcccca

SEQ ID NO: 2456031 - DNA, 19 bp, Homo sapiens
gagctcccctccccaactg

SEQ ID NO: 2456032 - DNA, 12 bp, Homo sapiens
gagctcctccct

SEQ ID NO: 2456033 - DNA, 14 bp, Homo sapiens
gagctcctcttcca

SEQ ID NO: 2456034 - DNA, 19 bp, Homo sapiens
gagctcctgtcccctgcta

SEQ ID NO: 2456035 - DNA, 19 bp, Homo sapiens
gagctctattatgaatgtg

SEQ ID NO: 2456036 - DNA, 17 bp, Homo sapiens
gagctctctgcccttga

SEQ ID NO: 2456037 - DNA, 11 bp, Homo sapiens
gagctctgaga

SEQ ID NO: 2456038 - DNA, 21 bp, Homo sapiens
gagctctgagaggccctggat

SEQ ID NO: 2456039 - DNA, 16 bp, Homo sapiens
gagctgaggcagcagt

SEQ ID NO: 2456040 - DNA, 13 bp, Homo sapiens
gaggagtctgagg

SEQ ID NO: 2456041 - DNA, 15 bp, Homo sapiens
gaggagtctgaggtc

SEQ ID NO: 2456042 - DNA, 19 bp, Homo sapiens
gaggagtctgaggtcctga

SEQ ID NO: 2456043 - DNA, 23 bp, Homo sapiens
gaggagtctgaggtcctgagcac

SEQ ID NO: 2456044 - DNA, 13 bp, Homo sapiens
gaggcaaaagaag

SEQ ID NO: 2456045 - DNA, 22 bp, Homo sapiens
gaggcaatgggagctgaggcca

SEQ ID NO: 2456046 - DNA, 17 bp, Homo sapiens
gaggcaccaggaagccg

SEQ ID NO: 2456047 - DNA, 15 bp, Homo sapiens
gaggcagcctggacc

SEQ ID NO: 2456048 - DNA, 23 bp, Homo sapiens
gaggcagggaacatggggaggag

SEQ ID NO: 2456049 - DNA, 20 bp, Homo sapiens
gaggcaggggcttcctggtg

SEQ ID NO: 2456050 - DNA, 21 bp, Homo sapiens
gaggcaggggcttcctggtgc

SEQ ID NO: 2456051 - DNA, 15 bp, Homo sapiens
gaggcaggtaggggg

SEQ ID NO: 2456052 - DNA, 22 bp, Homo sapiens
gaggcagtacctgggcaagctg

SEQ ID NO: 2456053 - DNA, 21 bp, Homo sapiens
gaggccacactcagcacaagg

SEQ ID NO: 2456054 - DNA, 14 bp, Homo sapiens
gaggccagcctggc

SEQ ID NO: 2456055 - DNA, 17 bp, Homo sapiens
gaggccagcctggcctc

SEQ ID NO: 2456056 - DNA, 20 bp, Homo sapiens
gaggccagcctggcctcctg

SEQ ID NO: 2456057 - DNA, 13 bp, Homo sapiens
gaggcccaggctg

SEQ ID NO: 2456058 - DNA, 18 bp, Homo sapiens
gaggcccagttcaccctg

SEQ ID NO: 2456059 - DNA, 12 bp, Homo sapiens
gaggccccagcc

SEQ ID NO: 2456060 - DNA, 13 bp, Homo sapiens
gaggccccagcct

SEQ ID NO: 2456061 - DNA, 16 bp, Homo sapiens
gaggcccccagcccag

SEQ ID NO: 2456062 - DNA, 17 bp, Homo sapiens
gaggcccccagcccagg

SEQ ID NO: 2456063 - DNA, 18 bp, Homo sapiens
gaggccctccacacctgc

SEQ ID NO: 2456064 - DNA, 22 bp, Homo sapiens
gaggccctgtgccccttgacaa

SEQ ID NO: 2456065 - DNA, 12 bp, Homo sapiens
gaggcctgcagg

SEQ ID NO: 2456066 - DNA, 20 bp, Homo sapiens
gaggcctggactttcctgca

SEQ ID NO: 2456067 - DNA, 21 bp, Homo sapiens
gaggccttacttaaacccagc

SEQ ID NO: 2456068 - DNA, 17 bp, Homo sapiens
gaggcgccccaacccgt

SEQ ID NO: 2456069 - DNA, 20 bp, Homo sapiens
gaggcgccccaacccgtgga

SEQ ID NO: 2456070 - DNA, 21 bp, Homo sapiens
gaggcgccccaacccgtggag

SEQ ID NO: 2456071 - DNA, 14 bp, Homo sapiens
gaggctcagattgt

SEQ ID NO: 2456072 - DNA, 10 bp, Homo sapiens
gaggctcagg

SEQ ID NO: 2456073 - DNA, 12 bp, Homo sapiens
gaggctcaggtc

SEQ ID NO: 2456074 - DNA, 14 bp, Homo sapiens
gaggctgaggcctg

SEQ ID NO: 2456075 - DNA, 19 bp, Homo sapiens
gaggctgaggctggcacag

SEQ ID NO: 2456076 - DNA, 14 bp, Homo sapiens
gaggctgcccctct

SEQ ID NO: 2456077 - DNA, 19 bp, Homo sapiens
gaggctgcccctctcacca

SEQ ID NO: 2456078 - DNA, 15 bp, Homo sapiens
gaggctgccctcctg

SEQ ID NO: 2456079 - DNA, 23 bp, Homo sapiens
gaggctgccctcctgtgctcagc

SEQ ID NO: 2456080 - DNA, 18 bp, Homo sapiens
gaggctgctcggggtgca

SEQ ID NO: 2456081 - DNA, 23 bp, Homo sapiens
gaggctgtcagtgtatggggcag

SEQ ID NO: 2456082 - DNA, 23 bp, Homo sapiens
gaggctttatgataatagattct

SEQ ID NO: 2456083 - DNA, 19 bp, Homo sapiens
gagggacaaaggagcctgt

SEQ ID NO: 2456084 - DNA, 21 bp, Homo sapiens
gagggacaaaggagcctgtga

SEQ ID NO: 2456085 - DNA, 23 bp, Homo sapiens
gagggacgcctgggggtgccagg

SEQ ID NO: 2456086 - DNA, 15 bp, Homo sapiens
gagggactgtcgctg

SEQ ID NO: 2456087 - DNA, 14 bp, Homo sapiens
gagggaggccaggc

SEQ ID NO: 2456088 - DNA, 18 bp, Homo sapiens
gagggagtgagtggccct

SEQ ID NO: 2456089 - DNA, 16 bp, Homo sapiens
gagggatgatgaagag

SEQ ID NO: 2456090 - DNA, 15 bp, Homo sapiens
gagggcagcagccag

SEQ ID NO: 2456091 - DNA, 17 bp, Homo sapiens
gagggcagcagccagcc

SEQ ID NO: 2456092 - DNA, 22 bp, Homo sapiens
gagggcagcagccagccctgcc

SEQ ID NO: 2456093 - DNA, 16 bp, Homo sapiens
gagggccacatgggag

SEQ ID NO: 2456094 - DNA, 14 bp, Homo sapiens
gagggctcactcag

SEQ ID NO: 2456095 - DNA, 19 bp, Homo sapiens
gagggctcgaggggtgggc

SEQ ID NO: 2456096 - DNA, 13 bp, Homo sapiens
gagggctctgagg

SEQ ID NO: 2456097 - DNA, 15 bp, Homo sapiens
gagggctctgaggcg

SEQ ID NO: 2456098 - DNA, 16 bp, Homo sapiens
gagggctggaggccca

SEQ ID NO: 2456099 - DNA, 19 bp, Homo sapiens
gagggctggaggcccaggc

SEQ ID NO: 2456100 - DNA, 23 bp, Homo sapiens
gagggctggaggcccaggctggg

SEQ ID NO: 2456101 - DNA, 12 bp, Homo sapiens
gaggggaccagg

SEQ ID NO: 2456102 - DNA, 15 bp, Homo sapiens
gaggggaccaggagt

SEQ ID NO: 2456103 - DNA, 21 bp, Homo sapiens
gaggggaccaggagtgggtgg

SEQ ID NO: 2456104 - DNA, 22 bp, Homo sapiens
gaggggcctgccacctggaccc

SEQ ID NO: 2456105 - DNA, 15 bp, Homo sapiens
gaggggtaggggctg

SEQ ID NO: 2456106 - DNA, 17 bp, Homo sapiens
gaggggtaggggctggg

SEQ ID NO: 2456107 - DNA, 15 bp, Homo sapiens
gaggggtgggctggt

SEQ ID NO: 2456108 - DNA, 21 bp, Homo sapiens
gaggggtgtggctccttccca

SEQ ID NO: 2456109 - DNA, 15 bp, Homo sapiens
gaggggttcctcccc

SEQ ID NO: 2456110 - DNA, 21 bp, Homo sapiens
gagggtaggagggtgggaagg

SEQ ID NO: 2456111 - DNA, 15 bp, Homo sapiens
gagggtaggcaggat

SEQ ID NO: 2456112 - DNA, 15 bp, Homo sapiens
gagggtcggtgcctt

SEQ ID NO: 2456113 - DNA, 17 bp, Homo sapiens
gagggtctgggggcaca

SEQ ID NO: 2456114 - DNA, 14 bp, Homo sapiens
gaggtcaggcccca

SEQ ID NO: 2456115 - DNA, 16 bp, Homo sapiens
gaggtccctgctgcca

SEQ ID NO: 2456116 - DNA, 15 bp, Homo sapiens
gaacaaagcagccac

SEQ ID NO: 2456117 - DNA, 16 bp, Homo sapiens
gaacaagagaagcatt

SEQ ID NO: 2456118 - DNA, 21 bp, Homo sapiens
gaacaatgtgctatgtgaaga

SEQ ID NO: 2456119 - DNA, 15 bp, Homo sapiens
gaacaatttggcaat

SEQ ID NO: 2456120 - DNA, 20 bp, Homo sapiens
gaacaatttggcaattttgt

SEQ ID NO: 2456121 - DNA, 20 bp, Homo sapiens
gaacacagcagttctgcaga

SEQ ID NO: 2456122 - DNA, 20 bp, Homo sapiens
gaacaccattgaaggcttaa

SEQ ID NO: 2456123 - DNA, 21 bp, Homo sapiens
gaacacctatgcaaagatgaa

SEQ ID NO: 2456124 - DNA, 18 bp, Homo sapiens
gaacactaattcataatc

SEQ ID NO: 2456125 - DNA, 15 bp, Homo sapiens
gaacactagacaagc

SEQ ID NO: 2456126 - DNA, 17 bp, Homo sapiens
gaacactagacaagcca

SEQ ID NO: 2456127 - DNA, 19 bp, Homo sapiens
gaacactagacaagccaga

SEQ ID NO: 2456128 - DNA, 16 bp, Homo sapiens
gaacactcttttgctt

SEQ ID NO: 2456129 - DNA, 22 bp, Homo sapiens
gaacactggggacttggcctct

SEQ ID NO: 2456130 - DNA, 23 bp, Homo sapiens
gaacactggggacttggcctctc

SEQ ID NO: 2456131 - DNA, 23 bp, Homo sapiens
gaacagaacatagacagaagaaa

SEQ ID NO: 2456132 - DNA, 22 bp, Homo sapiens
gaacagctggtgtagctacaga

SEQ ID NO: 2456133 - DNA, 24 bp, Homo sapiens
gaacagctggtgtagctacagaga

SEQ ID NO: 2456134 - DNA, 19 bp, Homo sapiens
gaacatccaaaatcttgat

SEQ ID NO: 2456135 - DNA, 18 bp, Homo sapiens
gaacatctgagtcctgga

SEQ ID NO: 2456136 - DNA, 21 bp, Homo sapiens
gaacatctgagtcctggatga

SEQ ID NO: 2456137 - DNA, 19 bp, Homo sapiens
gaacatgtgagaggtttga

SEQ ID NO: 2456138 - DNA, 12 bp, Homo sapiens
gaacattggaat

SEQ ID NO: 2456139 - DNA, 19 bp, Homo sapiens
gaaccaacaagtaaatatt

SEQ ID NO: 2456140 - DNA, 15 bp, Homo sapiens
gaaccactttcttat

SEQ ID NO: 2456141 - DNA, 20 bp, Homo sapiens
gaaccactttcttatttttt

SEQ ID NO: 2456142 - DNA, 18 bp, Homo sapiens
gaacccagcccacccccg

SEQ ID NO: 2456143 - DNA, 11 bp, Homo sapiens
gaacccaggac

SEQ ID NO: 2456144 - DNA, 16 bp, Homo sapiens
gaaccctgcccactcc

SEQ ID NO: 2456145 - DNA, 17 bp, Homo sapiens
gaaccggagagccagct

SEQ ID NO: 2456146 - DNA, 19 bp, Homo sapiens
gaacctaattcaattcaaa

SEQ ID NO: 2456147 - DNA, 23 bp, Homo sapiens
gaacctacagttttaactgtgga

SEQ ID NO: 2456148 - DNA, 15 bp, Homo sapiens
gaacctcagcctggc

SEQ ID NO: 2456149 - DNA, 17 bp, Homo sapiens
gaacctcagcctggcca

SEQ ID NO: 2456150 - DNA, 16 bp, Homo sapiens
gaacctggaacttggg

SEQ ID NO: 2456151 - DNA, 18 bp, Homo sapiens
gaacgttttctaattgct

SEQ ID NO: 2456152 - DNA, 21 bp, Homo sapiens
gaactaaagtgctgcactcaa

SEQ ID NO: 2456153 - DNA, 20 bp, Homo sapiens
gaactaccttggttccccca

SEQ ID NO: 2456154 - DNA, 22 bp, Homo sapiens
gaactattttcaaagacttaag

SEQ ID NO: 2456155 - DNA, 15 bp, Homo sapiens
gaactcaactttgac

SEQ ID NO: 2456156 - DNA, 15 bp, Homo sapiens
gaactcagatccagg

SEQ ID NO: 2456157 - DNA, 19 bp, Homo sapiens
gaactcagatccagggaca

SEQ ID NO: 2456158 - DNA, 17 bp, Homo sapiens
gaactcctgccatagtc

SEQ ID NO: 2456159 - DNA, 19 bp, Homo sapiens
gaactctggtggcacagga

SEQ ID NO: 2456160 - DNA, 20 bp, Homo sapiens
gaactcttaatcaaatagca

SEQ ID NO: 2456161 - DNA, 18 bp, Homo sapiens
gaatagccatatttgtaa

SEQ ID NO: 2456162 - DNA, 22 bp, Homo sapiens
gaatatacagcaggtgctcaat

SEQ ID NO: 2456163 - DNA, 21 bp, Homo sapiens
gaatatgtcagtgctgatgta

SEQ ID NO: 2456164 - DNA, 17 bp, Homo sapiens
gaatcaacatttctcaa

SEQ ID NO: 2456165 - DNA, 16 bp, Homo sapiens
gaatcaagggtcaggc

SEQ ID NO: 2456166 - DNA, 20 bp, Homo sapiens
gaatcattgtatgtggtcat

SEQ ID NO: 2456167 - DNA, 16 bp, Homo sapiens
gaatccacatttctaa

SEQ ID NO: 2456168 - DNA, 17 bp, Homo sapiens
gaatcccaaatttgatt

SEQ ID NO: 2456169 - DNA, 19 bp, Homo sapiens
gaatcccaaatttgattga

SEQ ID NO: 2456170 - DNA, 12 bp, Homo sapiens
gaatcctttcag

SEQ ID NO: 2456171 - DNA, 23 bp, Homo sapiens
gaatctcagttgattttctggat

SEQ ID NO: 2456172 - DNA, 13 bp, Homo sapiens
gaatctctgtgcc

SEQ ID NO: 2456173 - DNA, 18 bp, Homo sapiens
gaatctctttttgctttc

SEQ ID NO: 2456174 - DNA, 15 bp, Homo sapiens
gaatcttggtttgcc

SEQ ID NO: 2456175 - DNA, 23 bp, Homo sapiens
gaatcttggtttgccttccagaa

SEQ ID NO: 2456176 - DNA, 20 bp, Homo sapiens
gaatgaacactcttttgctt

SEQ ID NO: 2456177 - DNA, 11 bp, Homo sapiens
gaatgactttt

SEQ ID NO: 2456178 - DNA, 16 bp, Homo sapiens
gaatgagttgaggcca

SEQ ID NO: 2456179 - DNA, 14 bp, Homo sapiens
gaatgatttttctt

SEQ ID NO: 2456180 - DNA, 18 bp, Homo sapiens
gaatgatttttctttaca

SEQ ID NO: 2456181 - DNA, 22 bp, Homo sapiens
gaatgccactgccttcgcttct

SEQ ID NO: 2456182 - DNA, 13 bp, Homo sapiens
gaatgctgggact

SEQ ID NO: 2456183 - DNA, 14 bp, Homo sapiens
gaatgctgggactc

SEQ ID NO: 2456184 - DNA, 16 bp, Homo sapiens
gaatgctgggactcag

SEQ ID NO: 2456185 - DNA, 17 bp, Homo sapiens
gaatgctgggactcagc

SEQ ID NO: 2456186 - DNA, 17 bp, Homo sapiens
gaatgctgtacatctat

SEQ ID NO: 2456187 - DNA, 22 bp, Homo sapiens
gaatgcttctaagtaaatacaa

SEQ ID NO: 2456188 - DNA, 17 bp, Homo sapiens
gaatggatcacaagatg

SEQ ID NO: 2456189 - DNA, 21 bp, Homo sapiens
gaatggatttttctttaactg

SEQ ID NO: 2456190 - DNA, 11 bp, Homo sapiens
gaatggcagca

SEQ ID NO: 2456191 - DNA, 17 bp, Homo sapiens
gaatggctatgttttta

SEQ ID NO: 2456192 - DNA, 19 bp, Homo sapiens
gaatggctatgtttttaat

SEQ ID NO: 2456193 - DNA, 13 bp, Homo sapiens
gaatgtaatcaat

SEQ ID NO: 2456194 - DNA, 16 bp, Homo sapiens
gaatgtaatcaatgtt

SEQ ID NO: 2456195 - DNA, 14 bp, Homo sapiens
gaatgtgtttcaca

SEQ ID NO: 2456196 - DNA, 14 bp, Homo sapiens
gaatgttctcagat

SEQ ID NO: 2456197 - DNA, 14 bp, Homo sapiens
gaatgtttttctaa

SEQ ID NO: 2456198 - DNA, 13 bp, Homo sapiens
gaattaaactttt

SEQ ID NO: 2456199 - DNA, 22 bp, Homo sapiens
gaattaatatccctacatgtat

SEQ ID NO: 2456200 - DNA, 19 bp, Homo sapiens
gaattaggctgtaactact

SEQ ID NO: 2456201 - DNA, 19 bp, Homo sapiens
gaattataactggaaagaa

SEQ ID NO: 2456202 - DNA, 21 bp, Homo sapiens
gaattataactgtaaagatgt

SEQ ID NO: 2456203 - DNA, 16 bp, Homo sapiens
gaattattcaatttat

SEQ ID NO: 2456204 - DNA, 20 bp, Homo sapiens
gaattattcaatttatttga

SEQ ID NO: 2456205 - DNA, 13 bp, Homo sapiens
gaattcagacatc

SEQ ID NO: 2456206 - DNA, 13 bp, Homo sapiens
gaattgatttgca

SEQ ID NO: 2456207 - DNA, 14 bp, Homo sapiens
gaattgatttgcat

SEQ ID NO: 2456208 - DNA, 13 bp, Homo sapiens
gaattgcattgac

SEQ ID NO: 2456209 - DNA, 16 bp, Homo sapiens
gaatttcactgtcttt

SEQ ID NO: 2456210 - DNA, 15 bp, Homo sapiens
gaatttcttaacttc

SEQ ID NO: 2456211 - DNA, 21 bp, Homo sapiens
gaatttcttaacttcttgctt

SEQ ID NO: 2456212 - DNA, 20 bp, Homo sapiens
gaatttgcctgctgggattc

SEQ ID NO: 2456213 - DNA, 18 bp, Homo sapiens
gaatttggggcttccaag

SEQ ID NO: 2456214 - DNA, 18 bp, Homo sapiens
gaatttttaaacaagtat

SEQ ID NO: 2456215 - DNA, 16 bp, Homo sapiens
gaattttttttaacat

SEQ ID NO: 2456216 - DNA, 17 bp, Homo sapiens
gaattttttttaacatt

SEQ ID NO: 2456217 - DNA, 15 bp, Homo sapiens
gacaaaggagcctgt

SEQ ID NO: 2456218 - DNA, 16 bp, Homo sapiens
gacaaaggagcctgtg

SEQ ID NO: 2456219 - DNA, 17 bp, Homo sapiens
gacaaaggagcctgtga

SEQ ID NO: 2456220 - DNA, 18 bp, Homo sapiens
gacaaatagaaaatggtc

SEQ ID NO: 2456221 - DNA, 12 bp, Homo sapiens
gaaacttggctc

SEQ ID NO: 2456222 - DNA, 16 bp, Homo sapiens
gaaactttctttctca

SEQ ID NO: 2456223 - DNA, 16 bp, Homo sapiens
gaaagaagaaaaggtt

SEQ ID NO: 2456224 - DNA, 20 bp, Homo sapiens
gaaagaagtgtggggatttt

SEQ ID NO: 2456225 - DNA, 13 bp, Homo sapiens
gaaagaatagaac

SEQ ID NO: 2456226 - DNA, 16 bp, Homo sapiens
gaaagaggcaccagga

SEQ ID NO: 2456227 - DNA, 14 bp, Homo sapiens
gaaagaggtgaccc

SEQ ID NO: 2456228 - DNA, 20 bp, Homo sapiens
gaaagaggtgaccccagggc

SEQ ID NO: 2456229 - DNA, 16 bp, Homo sapiens
gaaagcaaagcacaga

SEQ ID NO: 2456230 - DNA, 13 bp, Homo sapiens
gaaagccccaccc

SEQ ID NO: 2456231 - DNA, 14 bp, Homo sapiens
gaaagccttctttt

SEQ ID NO: 2456232 - DNA, 18 bp, Homo sapiens
gaaagctgacttggctgg

SEQ ID NO: 2456233 - DNA, 22 bp, Homo sapiens
gaaagctgacttggctggtgtg

SEQ ID NO: 2456234 - DNA, 14 bp, Homo sapiens
gaaaggccagcact

SEQ ID NO: 2456235 - DNA, 20 bp, Homo sapiens
gaaagggccctccttcctaa

SEQ ID NO: 2456236 - DNA, 21 bp, Homo sapiens
gaaagggccctgggcctgcct

SEQ ID NO: 2456237 - DNA, 16 bp, Homo sapiens
gaaaggggagcccact

SEQ ID NO: 2456238 - DNA, 17 bp, Homo sapiens
gaaaggggtcggctgac

SEQ ID NO: 2456239 - DNA, 14 bp, Homo sapiens
gaaaggtggtgttt

SEQ ID NO: 2456240 - DNA, 22 bp, Homo sapiens
gaaaggtggtgtttctgtaaga

SEQ ID NO: 2456241 - DNA, 20 bp, Homo sapiens
gaaaggttagagaataaatt

SEQ ID NO: 2456242 - DNA, 18 bp, Homo sapiens
gaaagtacactctgctgt

SEQ ID NO: 2456243 - DNA, 20 bp, Homo sapiens
gaaagtacactctgctgttt

SEQ ID NO: 2456244 - DNA, 22 bp, Homo sapiens
gaaagtacactctgctgtttga

SEQ ID NO: 2456245 - DNA, 15 bp, Homo sapiens
gaaagtctgtccttg

SEQ ID NO: 2456246 - DNA, 13 bp, Homo sapiens
gaaagtgcctgac

SEQ ID NO: 2456247 - DNA, 17 bp, Homo sapiens
gaaagtgcctttcagga

SEQ ID NO: 2456248 - DNA, 22 bp, Homo sapiens
gaaagtgcctttcaggatctat

SEQ ID NO: 2456249 - DNA, 17 bp, Homo sapiens
gaaagtgggcaaaagct

SEQ ID NO: 2456250 - DNA, 18 bp, Homo sapiens
gaaataaaaggaagccaa

SEQ ID NO: 2456251 - DNA, 19 bp, Homo sapiens
gaaataaagtcagatggaa

SEQ ID NO: 2456252 - DNA, 18 bp, Homo sapiens
gaaataagctatttgatg

SEQ ID NO: 2456253 - DNA, 19 bp, Homo sapiens
gaaataagctatttgatgt

SEQ ID NO: 2456254 - DNA, 21 bp, Homo sapiens
gaaataagtttttgtttcaca

SEQ ID NO: 2456255 - DNA, 13 bp, Homo sapiens
gaaataattgttg

SEQ ID NO: 2456256 - DNA, 20 bp, Homo sapiens
gaaataattgttgttctgtt

SEQ ID NO: 2456257 - DNA, 21 bp, Homo sapiens
gaaataattgttgttctgtta

SEQ ID NO: 2456258 - DNA, 18 bp, Homo sapiens
gaaatacaaaaatactca

SEQ ID NO: 2456259 - DNA, 17 bp, Homo sapiens
gaaatacagttctgctc

SEQ ID NO: 2456260 - DNA, 15 bp, Homo sapiens
gaaatatcctgcttg

SEQ ID NO: 2456261 - DNA, 19 bp, Homo sapiens
gaaatatcttcacttgtca

SEQ ID NO: 2456262 - DNA, 20 bp, Homo sapiens
gaaatattttaaaatcagct

SEQ ID NO: 2456263 - DNA, 20 bp, Homo sapiens
gaaatctggcttctggccag

SEQ ID NO: 2456264 - DNA, 21 bp, Homo sapiens
gaaatgttattttttaattat

SEQ ID NO: 2456265 - DNA, 23 bp, Homo sapiens
gaaattaagactttatgtagttt

SEQ ID NO: 2456266 - DNA, 12 bp, Homo sapiens
gaaattccaaag

SEQ ID NO: 2456267 - DNA, 19 bp, Homo sapiens
gaaattcgtgtgttttttt

SEQ ID NO: 2456268 - DNA, 15 bp, Homo sapiens
gaaattctcctggag

SEQ ID NO: 2456269 - DNA, 23 bp, Homo sapiens
gaaattctttcccagtctgtcga

SEQ ID NO: 2456270 - DNA, 14 bp, Homo sapiens
gaaattgaaccttt

SEQ ID NO: 2456271 - DNA, 17 bp, Homo sapiens
gaaattgaatactttga

SEQ ID NO: 2456272 - DNA, 22 bp, Homo sapiens
gaaattgaatactttgaatgtg

SEQ ID NO: 2456273 - DNA, 20 bp, Homo sapiens
gaaatttaaactataagcaa

SEQ ID NO: 2456274 - DNA, 14 bp, Homo sapiens
gaaatttaaagcag

SEQ ID NO: 2456275 - DNA, 22 bp, Homo sapiens
gaaatttaaagcaggttcttgt

SEQ ID NO: 2456276 - DNA, 14 bp, Homo sapiens
gaacaaagcagcca

SEQ ID NO: 2456277 - DNA, 19 bp, Homo sapiens
gaggtccctgctgccagct

SEQ ID NO: 2456278 - DNA, 14 bp, Homo sapiens
gaggtcctgagcac

SEQ ID NO: 2456279 - DNA, 19 bp, Homo sapiens
gaggtcctgagcactgcca

SEQ ID NO: 2456280 - DNA, 21 bp, Homo sapiens
gaggtcctgagcactgccagg

SEQ ID NO: 2456281 - DNA, 22 bp, Homo sapiens
gaggtcctgagcactgccagga

SEQ ID NO: 2456282 - DNA, 23 bp, Homo sapiens
gaggtcggtaggttcagccaagg

SEQ ID NO: 2456283 - DNA, 13 bp, Homo sapiens
gaggtctcagccc

SEQ ID NO: 2456284 - DNA, 21 bp, Homo sapiens
gaggtctcagcccctttccct

SEQ ID NO: 2456285 - DNA, 16 bp, Homo sapiens
gaggtctgttcctttt

SEQ ID NO: 2456286 - DNA, 17 bp, Homo sapiens
gaggtgaccccagggca

SEQ ID NO: 2456287 - DNA, 14 bp, Homo sapiens
gaggtgccactgga

SEQ ID NO: 2456288 - DNA, 14 bp, Homo sapiens
gaggtgggccgtgg

SEQ ID NO: 2456289 - DNA, 15 bp, Homo sapiens
gaggtgtccaactgg

SEQ ID NO: 2456290 - DNA, 14 bp, Homo sapiens
gaggtgtctcaggc

SEQ ID NO: 2456291 - DNA, 15 bp, Homo sapiens
gaggtgtctcaggct

SEQ ID NO: 2456292 - DNA, 19 bp, Homo sapiens
gaggtgtctcaggctgcct

SEQ ID NO: 2456293 - DNA, 14 bp, Homo sapiens
gaggttctaaggcc

SEQ ID NO: 2456294 - DNA, 22 bp, Homo sapiens
gaggtttgcagtcccaagcggt

SEQ ID NO: 2456295 - DNA, 16 bp, Homo sapiens
gaggttttatttcatt

SEQ ID NO: 2456296 - DNA, 18 bp, Homo sapiens
gagtaaagaattattttg

SEQ ID NO: 2456297 - DNA, 19 bp, Homo sapiens
gagtaacaatacaaatgga

SEQ ID NO: 2456298 - DNA, 20 bp, Homo sapiens
gagtaacaatacaaatggat

SEQ ID NO: 2456299 - DNA, 21 bp, Homo sapiens
gagtactccacactgcacaat

SEQ ID NO: 2456300 - DNA, 17 bp, Homo sapiens
gagtagaattgcattga

SEQ ID NO: 2456301 - DNA, 14 bp, Homo sapiens
gagtagctgagctc

SEQ ID NO: 2456302 - DNA, 19 bp, Homo sapiens
gagtagctgggactacagg

SEQ ID NO: 2456303 - DNA, 14 bp, Homo sapiens
gcaggactccaggc

SEQ ID NO: 2456304 - DNA, 15 bp, Homo sapiens
gcaggaggggggagg

SEQ ID NO: 2456305 - DNA, 19 bp, Homo sapiens
gcaggagtagctgagctca

SEQ ID NO: 2456306 - DNA, 21 bp, Homo sapiens
gcaggagtagctgagctcaca

SEQ ID NO: 2456307 - DNA, 21 bp, Homo sapiens
gcaggatctcaccaggcagcc

SEQ ID NO: 2456308 - DNA, 15 bp, Homo sapiens
gcaggcagaggccca

SEQ ID NO: 2456309 - DNA, 19 bp, Homo sapiens
gcaggcagaggcccaggct

SEQ ID NO: 2456310 - DNA, 14 bp, Homo sapiens
gcaggcagccagca

SEQ ID NO: 2456311 - DNA, 21 bp, Homo sapiens
gcaggcagccagcatctgggc

SEQ ID NO: 2456312 - DNA, 12 bp, Homo sapiens
gcaggccctggc

SEQ ID NO: 2456313 - DNA, 14 bp, Homo sapiens
gcaggctggccagt

SEQ ID NO: 2456314 - DNA, 21 bp, Homo sapiens
gcagggaaaattatttgcata

SEQ ID NO: 2456315 - DNA, 17 bp, Homo sapiens
gcagggaacatggggag

SEQ ID NO: 2456316 - DNA, 18 bp, Homo sapiens
gcagggaacatggggagg

SEQ ID NO: 2456317 - DNA, 13 bp, Homo sapiens
gcagggatgtggg

SEQ ID NO: 2456318 - DNA, 22 bp, Homo sapiens
gcagggatgtgggttccacaga

SEQ ID NO: 2456319 - DNA, 23 bp, Homo sapiens
gcagggatgtgggttccacagac

SEQ ID NO: 2456320 - DNA, 19 bp, Homo sapiens
gcagggattaacctctgca

SEQ ID NO: 2456321 - DNA, 22 bp, Homo sapiens
gcagggattaacctctgcacta

SEQ ID NO: 2456322 - DNA, 13 bp, Homo sapiens
gcagggccgggga

SEQ ID NO: 2456323 - DNA, 23 bp, Homo sapiens
gcagggccggggaactggccaag

SEQ ID NO: 2456324 - DNA, 12 bp, Homo sapiens
gcagggcctctg

SEQ ID NO: 2456325 - DNA, 20 bp, Homo sapiens
gcagggcgggcagagggctg

SEQ ID NO: 2456326 - DNA, 22 bp, Homo sapiens
gcagggcgggcagagggctgga

SEQ ID NO: 2456327 - DNA, 17 bp, Homo sapiens
gcagggctaccctgagc

SEQ ID NO: 2456328 - DNA, 20 bp, Homo sapiens
gcagggctaccctgagctga

SEQ ID NO: 2456329 - DNA, 22 bp, Homo sapiens
gcagggctaccctgagctgagg

SEQ ID NO: 2456330 - DNA, 12 bp, Homo sapiens
gcagggctctcc

SEQ ID NO: 2456331 - DNA, 16 bp, Homo sapiens
gcagggctctcctggc

SEQ ID NO: 2456332 - DNA, 20 bp, Homo sapiens
gcaggggcctggagatcctc

SEQ ID NO: 2456333 - DNA, 18 bp, Homo sapiens
gcaggggcttcctggtgc

SEQ ID NO: 2456334 - DNA, 22 bp, Homo sapiens
gcaggggcttcctggtgctgga

SEQ ID NO: 2456335 - DNA, 14 bp, Homo sapiens
gcagggggctgctg

SEQ ID NO: 2456336 - DNA, 17 bp, Homo sapiens
gcagggggctgctgctg

SEQ ID NO: 2456337 - DNA, 21 bp, Homo sapiens
gcagggtcctcttctgggcct

SEQ ID NO: 2456338 - DNA, 17 bp, Homo sapiens
gcagggtctagaaggct

SEQ ID NO: 2456339 - DNA, 22 bp, Homo sapiens
gcaggtatgatcggcaggacac

SEQ ID NO: 2456340 - DNA, 13 bp, Homo sapiens
gcaggtggatcta

SEQ ID NO: 2456341 - DNA, 21 bp, Homo sapiens
gcaggtggggagactgggctg

SEQ ID NO: 2456342 - DNA, 12 bp, Homo sapiens
gcaggttcccac

SEQ ID NO: 2456343 - DNA, 23 bp, Homo sapiens
gcaggttcccacttaaaaattaa

SEQ ID NO: 2456344 - DNA, 13 bp, Homo sapiens
gcaggttcttgtt

SEQ ID NO: 2456345 - DNA, 22 bp, Homo sapiens
gcaggttcttgttggtgcacag

SEQ ID NO: 2456346 - DNA, 14 bp, Homo sapiens
gcagtacctgaggg

SEQ ID NO: 2456347 - DNA, 21 bp, Homo sapiens
gcagtatcatgccctgtgcaa

SEQ ID NO: 2456348 - DNA, 21 bp, Homo sapiens
gcagtccacttctgacagcct

SEQ ID NO: 2456349 - DNA, 23 bp, Homo sapiens
gcagtccacttctgacagcctca

SEQ ID NO: 2456350 - DNA, 16 bp, Homo sapiens
gcagtcccaagcggtg

SEQ ID NO: 2456351 - DNA, 19 bp, Homo sapiens
gcagtcctgatcagagccg

SEQ ID NO: 2456352 - DNA, 14 bp, Homo sapiens
gcagtccttggcct

SEQ ID NO: 2456353 - DNA, 15 bp, Homo sapiens
gcagtccttggcctg

SEQ ID NO: 2456354 - DNA, 15 bp, Homo sapiens
gcagtcgtgcctgtg

SEQ ID NO: 2456355 - DNA, 18 bp, Homo sapiens
gcagtcgtgcctgtgtcc

SEQ ID NO: 2456356 - DNA, 20 bp, Homo sapiens
gcagtgaatgattcagtgtt

SEQ ID NO: 2456357 - DNA, 14 bp, Homo sapiens
gcagtggctggtcc

SEQ ID NO: 2456358 - DNA, 15 bp, Homo sapiens
gcagtggctggtcca

SEQ ID NO: 2456359 - DNA, 20 bp, Homo sapiens
gcagtggctggtccagggct

SEQ ID NO: 2456360 - DNA, 19 bp, Homo sapiens
gcagttaccattaaaccat

SEQ ID NO: 2456361 - DNA, 13 bp, Homo sapiens
gcagttatatttt

SEQ ID NO: 2456362 - DNA, 16 bp, Homo sapiens
gcagttatattttgca

SEQ ID NO: 2456363 - DNA, 19 bp, Homo sapiens
gcagttcccacattaaaga

SEQ ID NO: 2456364 - DNA, 15 bp, Homo sapiens
gcagttcgcagccac

SEQ ID NO: 2456365 - DNA, 13 bp, Homo sapiens
gcagttgtctctg

SEQ ID NO: 2456366 - DNA, 16 bp, Homo sapiens
gcagttgtctctgttt

SEQ ID NO: 2456367 - DNA, 15 bp, Homo sapiens
gcagtttatcattca

SEQ ID NO: 2456368 - DNA, 20 bp, Homo sapiens
gcagtttatcattcaagtgt

SEQ ID NO: 2456369 - DNA, 12 bp, Homo sapiens
gcagtttgcaaa

SEQ ID NO: 2456370 - DNA, 18 bp, Homo sapiens
gcagttttttgaaaatgg

SEQ ID NO: 2456371 - DNA, 17 bp, Homo sapiens
gcagttttttttttctt

SEQ ID NO: 2456372 - DNA, 23 bp, Homo sapiens
gcagttttttttttcttgtctat

SEQ ID NO: 2456373 - DNA, 15 bp, Homo sapiens
gcataaaagatgaaa

SEQ ID NO: 2456374 - DNA, 20 bp, Homo sapiens
gcatacgagagcagaggtct

SEQ ID NO: 2456375 - DNA, 14 bp, Homo sapiens
gcatagctctgggg

SEQ ID NO: 2456376 - DNA, 20 bp, Homo sapiens
gcataggtgatccatgtaac

SEQ ID NO: 2456377 - DNA, 20 bp, Homo sapiens
gcatagtaccaatcatttta

SEQ ID NO: 2456378 - DNA, 23 bp, Homo sapiens
gcatatgagtaagggcactgacg

SEQ ID NO: 2456379 - DNA, 12 bp, Homo sapiens
gcatatgttgaa

SEQ ID NO: 2456380 - DNA, 16 bp, Homo sapiens
gcatcagaaagggagg

SEQ ID NO: 2456381 - DNA, 13 bp, Homo sapiens
gcatcatgcctct

SEQ ID NO: 2456382 - DNA, 14 bp, Homo sapiens
gcatcatgcctctg

SEQ ID NO: 2456383 - DNA, 21 bp, Homo sapiens
gcatcatgcctctgaggccag

SEQ ID NO: 2456384 - DNA, 16 bp, Homo sapiens
gcatccattctcctga

SEQ ID NO: 2456385 - DNA, 17 bp, Homo sapiens
gcatccattctcctgag

SEQ ID NO: 2456386 - DNA, 19 bp, Homo sapiens
gcatccattctcctgagga

SEQ ID NO: 2456387 - DNA, 15 bp, Homo sapiens
gcatccctgggcctt

SEQ ID NO: 2456388 - DNA, 20 bp, Homo sapiens
gcatccctgggccttgggct

SEQ ID NO: 2456389 - DNA, 15 bp, Homo sapiens
gcatccgcaggtgct

SEQ ID NO: 2456390 - DNA, 16 bp, Homo sapiens
gcatccgcaggtgctg

SEQ ID NO: 2456391 - DNA, 17 bp, Homo sapiens
gcatcctccagcccctg

SEQ ID NO: 2456392 - DNA, 14 bp, Homo sapiens
gcatcctctggagc

SEQ ID NO: 2456393 - DNA, 20 bp, Homo sapiens
gcatcctctggagccagccg

SEQ ID NO: 2456394 - DNA, 22 bp, Homo sapiens
gcatcggacaagacccccagca

SEQ ID NO: 2456395 - DNA, 19 bp, Homo sapiens
gcatctccaagcagcttag

SEQ ID NO: 2456396 - DNA, 20 bp, Homo sapiens
gcatctccaagcagcttaga

SEQ ID NO: 2456397 - DNA, 17 bp, Homo sapiens
gcatctggcctggccag

SEQ ID NO: 2456398 - DNA, 12 bp, Homo sapiens
gcatcttttgta

SEQ ID NO: 2456399 - DNA, 16 bp, Homo sapiens
gcatcttttgtattaa

SEQ ID NO: 2456400 - DNA, 19 bp, Homo sapiens
gcatcttttgtattaagaa

SEQ ID NO: 2456401 - DNA, 15 bp, Homo sapiens
gcatgaatttgtaat

SEQ ID NO: 2456402 - DNA, 17 bp, Homo sapiens
gcatgagaaatacaaaa

SEQ ID NO: 2456403 - DNA, 15 bp, Homo sapiens
gcatgatatcttcaa

SEQ ID NO: 2456404 - DNA, 17 bp, Homo sapiens
gcatgcactgttccccc

SEQ ID NO: 2456405 - DNA, 12 bp, Homo sapiens
gcatgcagtgtt

SEQ ID NO: 2456406 - DNA, 11 bp, Homo sapiens
gcatggaaatt

SEQ ID NO: 2456407 - DNA, 23 bp, Homo sapiens
gcatggaaatttaaagcaggttc

SEQ ID NO: 2456408 - DNA, 14 bp, Homo sapiens
gcatggacaatgga

SEQ ID NO: 2456409 - DNA, 21 bp, Homo sapiens
gcatggacaatggaccggaga

SEQ ID NO: 2456410 - DNA, 15 bp, Homo sapiens
gcatggatttctttg

SEQ ID NO: 2456411 - DNA, 21 bp, Homo sapiens
gcatggcagggggctgctgct

SEQ ID NO: 2456412 - DNA, 15 bp, Homo sapiens
gcatggctattttat

SEQ ID NO: 2456413 - DNA, 23 bp, Homo sapiens
gcatggtcccacatccctgggcc

SEQ ID NO: 2456414 - DNA, 17 bp, Homo sapiens
gcatggtgccccaggac

SEQ ID NO: 2456415 - DNA, 17 bp, Homo sapiens
gcatggtgttctcctgc

SEQ ID NO: 2456416 - DNA, 20 bp, Homo sapiens
gcatggtgttctcctgctgc

SEQ ID NO: 2456417 - DNA, 13 bp, Homo sapiens
gcatggtttcagc

SEQ ID NO: 2456418 - DNA, 16 bp, Homo sapiens
gcatggtttcagcact

SEQ ID NO: 2456419 - DNA, 17 bp, Homo sapiens
gcatgtaacgcaagttc

SEQ ID NO: 2456420 - DNA, 17 bp, Homo sapiens
gcatgtagtaacactaa

SEQ ID NO: 2456421 - DNA, 21 bp, Homo sapiens
gcatgtagtaacactaatata

SEQ ID NO: 2456422 - DNA, 16 bp, Homo sapiens
gcatgtttagacttta

SEQ ID NO: 2456423 - DNA, 18 bp, Homo sapiens
gcattaaattcacaaact

SEQ ID NO: 2456424 - DNA, 17 bp, Homo sapiens
gcattagaattatttaa

SEQ ID NO: 2456425 - DNA, 13 bp, Homo sapiens
gcattatgcaatt

SEQ ID NO: 2456426 - DNA, 20 bp, Homo sapiens
gcattatgcaatttttatat

SEQ ID NO: 2456427 - DNA, 19 bp, Homo sapiens
gcattcgaagaaacccttg

SEQ ID NO: 2456428 - DNA, 13 bp, Homo sapiens
gcattctagtact

SEQ ID NO: 2456429 - DNA, 18 bp, Homo sapiens
gcattctcattggaaatt

SEQ ID NO: 2456430 - DNA, 20 bp, Homo sapiens
gcattctcattggaaattta

SEQ ID NO: 2456431 - DNA, 14 bp, Homo sapiens
gcattcttctctgt

SEQ ID NO: 2456432 - DNA, 16 bp, Homo sapiens
gcattgaacacaaact

SEQ ID NO: 2456433 - DNA, 18 bp, Homo sapiens
gcattgaacacaaactgt

SEQ ID NO: 2456434 - DNA, 19 bp, Homo sapiens
gcattgaacacaaactgta

SEQ ID NO: 2456435 - DNA, 23 bp, Homo sapiens
gcattgaccgcgactaatttcaa

SEQ ID NO: 2456436 - DNA, 14 bp, Homo sapiens
gcattgccaagggc

SEQ ID NO: 2456437 - DNA, 19 bp, Homo sapiens
gcattggaactggaggcag

SEQ ID NO: 2456438 - DNA, 12 bp, Homo sapiens
gcattggatatt

SEQ ID NO: 2456439 - DNA, 10 bp, Homo sapiens
gcattgtaaa

SEQ ID NO: 2456440 - DNA, 20 bp, Homo sapiens
gcatttaacccccctgtaca

SEQ ID NO: 2456441 - DNA, 22 bp, Homo sapiens
gcatttcactttcccggtgttc

SEQ ID NO: 2456442 - DNA, 14 bp, Homo sapiens
gcatttcctgggtg

SEQ ID NO: 2456443 - DNA, 21 bp, Homo sapiens
gcatttcctgggtggctactc

SEQ ID NO: 2456444 - DNA, 16 bp, Homo sapiens
gcatttgggtccagga

SEQ ID NO: 2456445 - DNA, 18 bp, Homo sapiens
gcatttgggtccaggagg

SEQ ID NO: 2456446 - DNA, 22 bp, Homo sapiens
gcattttgtaagttgaagcaaa

SEQ ID NO: 2456447 - DNA, 17 bp, Homo sapiens
gccaaaaagtgaaataa

SEQ ID NO: 2456448 - DNA, 13 bp, Homo sapiens
gccaaaaatagct

SEQ ID NO: 2456449 - DNA, 23 bp, Homo sapiens
gccaaaacaatgtttaaaccttt

SEQ ID NO: 2456450 - DNA, 14 bp, Homo sapiens
gccaaattaaaaaa

SEQ ID NO: 2456451 - DNA, 21 bp, Homo sapiens
gccaaatttaaaactgttgga

SEQ ID NO: 2456452 - DNA, 20 bp, Homo sapiens
gccaacacgcacctgcctca

SEQ ID NO: 2456453 - DNA, 21 bp, Homo sapiens
gccaacacgcacctgcctcag

SEQ ID NO: 2456454 - DNA, 23 bp, Homo sapiens
gccaacacgcacctgcctcagga

SEQ ID NO: 2456455 - DNA, 21 bp, Homo sapiens
gccaactttccccacgttaaa

SEQ ID NO: 2456456 - DNA, 22 bp, Homo sapiens
gccaagaaacgtcttctaaact

SEQ ID NO: 2456457 - DNA, 15 bp, Homo sapiens
gccaagactgctgtg

SEQ ID NO: 2456458 - DNA, 20 bp, Homo sapiens
gccaagactgctgtggccag

SEQ ID NO: 2456459 - DNA, 21 bp, Homo sapiens
gccaagactgctgtggccagg

SEQ ID NO: 2456460 - DNA, 21 bp, Homo sapiens
gccaagctgaggtgcccagga

SEQ ID NO: 2456461 - DNA, 21 bp, Homo sapiens
gccaagggatggacatcttgt

SEQ ID NO: 2456462 - DNA, 19 bp, Homo sapiens
gccaagggcataaattatt

SEQ ID NO: 2456463 - DNA, 18 bp, Homo sapiens
gccaaggggcttcaggtc

SEQ ID NO: 2456464 - DNA, 16 bp, Homo sapiens
gccaagtccaggtcct

SEQ ID NO: 2456465 - DNA, 17 bp, Homo sapiens
gccaagtccaggtcctg

SEQ ID NO: 2456466 - DNA, 21 bp, Homo sapiens
gccaagtccaggtcctggtgg

SEQ ID NO: 2456467 - DNA, 22 bp, Homo sapiens
gccaagtccaggtcctggtggg

SEQ ID NO: 2456468 - DNA, 12 bp, Homo sapiens
gccaagttcctc

SEQ ID NO: 2456469 - DNA, 21 bp, Homo sapiens
gccaatccctcaccttctgag

SEQ ID NO: 2456470 - DNA, 21 bp, Homo sapiens
gccacaaggacttcctgtcca

SEQ ID NO: 2456471 - DNA, 15 bp, Homo sapiens
gccacacagctgccg

SEQ ID NO: 2456472 - DNA, 15 bp, Homo sapiens
gccacacagtatttt

SEQ ID NO: 2456473 - DNA, 13 bp, Homo sapiens
gccacaccaggat

SEQ ID NO: 2456474 - DNA, 13 bp, Homo sapiens
gccacactcagca

SEQ ID NO: 2456475 - DNA, 17 bp, Homo sapiens
gccacactcagcacaag

SEQ ID NO: 2456476 - DNA, 19 bp, Homo sapiens
gccacacttcaaactactt

SEQ ID NO: 2456477 - DNA, 14 bp, Homo sapiens
gccacagccagggg

SEQ ID NO: 2456478 - DNA, 21 bp, Homo sapiens
gccacagccctgtcagcatga

SEQ ID NO: 2456479 - DNA, 21 bp, Homo sapiens
gccacagcctcccctgccagg

SEQ ID NO: 2456480 - DNA, 12 bp, Homo sapiens
gccacagctttt

SEQ ID NO: 2456481 - DNA, 16 bp, Homo sapiens
gccacagcttttgcaa

SEQ ID NO: 2456482 - DNA, 15 bp, Homo sapiens
gccacatgggaggct

SEQ ID NO: 2456483 - DNA, 15 bp, Homo sapiens
gccaccacgtccagc

SEQ ID NO: 2456484 - DNA, 18 bp, Homo sapiens
gccaccaggccacctccc

SEQ ID NO: 2456485 - DNA, 20 bp, Homo sapiens
gccaccaggccacctcccca

SEQ ID NO: 2456486 - DNA, 11 bp, Homo sapiens
gccaccagttc

SEQ ID NO: 2456487 - DNA, 17 bp, Homo sapiens
gccaccatggccagcca

SEQ ID NO: 2456488 - DNA, 23 bp, Homo sapiens
gccacccagccccagccagggct

SEQ ID NO: 2456489 - DNA, 13 bp, Homo sapiens
gccacccaggatc

SEQ ID NO: 2456490 - DNA, 12 bp, Homo sapiens
gccaccctgagg

SEQ ID NO: 2456491 - DNA, 19 bp, Homo sapiens
gccaccctgaggagtctga

SEQ ID NO: 2456492 - DNA, 23 bp, Homo sapiens
gccaccctgaggagtctgaggtc

SEQ ID NO: 2456493 - DNA, 15 bp, Homo sapiens
gccaccgtttcttcc

SEQ ID NO: 2456494 - DNA, 17 bp, Homo sapiens
gccacctctaacagcac

SEQ ID NO: 2456495 - DNA, 18 bp, Homo sapiens
gccacctctaacagcacc

SEQ ID NO: 2456496 - DNA, 19 bp, Homo sapiens
gccacctctaacagcacca

SEQ ID NO: 2456497 - DNA, 17 bp, Homo sapiens
gctaattcaaggaattt

SEQ ID NO: 2456498 - DNA, 22 bp, Homo sapiens
gctaattcaaggaatttcttaa

SEQ ID NO: 2456499 - DNA, 16 bp, Homo sapiens
gctaattctactcaca

SEQ ID NO: 2456500 - DNA, 12 bp, Homo sapiens
gctaatttgcat

SEQ ID NO: 2456501 - DNA, 13 bp, Homo sapiens
gctaatttgcatt

SEQ ID NO: 2456502 - DNA, 15 bp, Homo sapiens
gctaatttgcattaa

SEQ ID NO: 2456503 - DNA, 20 bp, Homo sapiens
gctaatttgttttggatata

SEQ ID NO: 2456504 - DNA, 18 bp, Homo sapiens
gctaatttttattaattt

SEQ ID NO: 2456505 - DNA, 20 bp, Homo sapiens
gctaatttttgtatttttag

SEQ ID NO: 2456506 - DNA, 21 bp, Homo sapiens
gctaatttttttgtattttag

SEQ ID NO: 2456507 - DNA, 16 bp, Homo sapiens
gctacaccactctggc

SEQ ID NO: 2456508 - DNA, 22 bp, Homo sapiens
gctacaccactctggcagccac

SEQ ID NO: 2456509 - DNA, 12 bp, Homo sapiens
gctacagagaaa

SEQ ID NO: 2456510 - DNA, 22 bp, Homo sapiens
gctacagagaaaccagcttcct

SEQ ID NO: 2456511 - DNA, 15 bp, Homo sapiens
gctacagagaagcct

SEQ ID NO: 2456512 - DNA, 17 bp, Homo sapiens
gctacagagaagccttc

SEQ ID NO: 2456513 - DNA, 18 bp, Homo sapiens
gctacagagaagccttca

SEQ ID NO: 2456514 - DNA, 13 bp, Homo sapiens
gctacataattta

SEQ ID NO: 2456515 - DNA, 14 bp, Homo sapiens
gctaccaaaacagt

SEQ ID NO: 2456516 - DNA, 12 bp, Homo sapiens
gctaccaccagc

SEQ ID NO: 2456517 - DNA, 13 bp, Homo sapiens
gctaccaccagct

SEQ ID NO: 2456518 - DNA, 14 bp, Homo sapiens
gctaccaccagctg

SEQ ID NO: 2456519 - DNA, 14 bp, Homo sapiens
gctaccagtattta

SEQ ID NO: 2456520 - DNA, 18 bp, Homo sapiens
gctaccagtatttagaag

SEQ ID NO: 2456521 - DNA, 16 bp, Homo sapiens
gctaccctgagctgag

SEQ ID NO: 2456522 - DNA, 16 bp, Homo sapiens
gctaccctttttctcc

SEQ ID NO: 2456523 - DNA, 20 bp, Homo sapiens
gctaccctttttctccagct

SEQ ID NO: 2456524 - DNA, 22 bp, Homo sapiens
gctaccctttttctccagctgg

SEQ ID NO: 2456525 - DNA, 22 bp, Homo sapiens
gctacctgtgtggacaggacta

SEQ ID NO: 2456526 - DNA, 14 bp, Homo sapiens
gctacgtatttaat

SEQ ID NO: 2456527 - DNA, 22 bp, Homo sapiens
gctactatgatttaatttgaaa

SEQ ID NO: 2456528 - DNA, 14 bp, Homo sapiens
gctactctgtgcca

SEQ ID NO: 2456529 - DNA, 18 bp, Homo sapiens
gctactctgtgccagagc

SEQ ID NO: 2456530 - DNA, 19 bp, Homo sapiens
gctactctgtgccagagcc

SEQ ID NO: 2456531 - DNA, 20 bp, Homo sapiens
gctactggggaaactggcca

SEQ ID NO: 2456532 - DNA, 18 bp, Homo sapiens
gctactgtgtgtgtgaat

SEQ ID NO: 2456533 - DNA, 22 bp, Homo sapiens
gctagacacatgaaggtaaata

SEQ ID NO: 2456534 - DNA, 19 bp, Homo sapiens
gctagagctcctccctctc

SEQ ID NO: 2456535 - DNA, 20 bp, Homo sapiens
gctagcagtggcaggcagag

SEQ ID NO: 2456536 - DNA, 17 bp, Homo sapiens
gctaggaagaggagtgg

SEQ ID NO: 2456537 - DNA, 15 bp, Homo sapiens
gctaggagcaaagcc

SEQ ID NO: 2456538 - DNA, 16 bp, Homo sapiens
gctaggagcaaagcct

SEQ ID NO: 2456539 - DNA, 14 bp, Homo sapiens
gctaggccagcagg

SEQ ID NO: 2456540 - DNA, 12 bp, Homo sapiens
gctagtcttttg

SEQ ID NO: 2456541 - DNA, 15 bp, Homo sapiens
gctagtcttttgctt

SEQ ID NO: 2456542 - DNA, 21 bp, Homo sapiens
gctataaagcagtatttttct

SEQ ID NO: 2456543 - DNA, 18 bp, Homo sapiens
gctatgtcccaggaatca

SEQ ID NO: 2456544 - DNA, 16 bp, Homo sapiens
gctattctgtccctag

SEQ ID NO: 2456545 - DNA, 13 bp, Homo sapiens
gctatttaaaact

SEQ ID NO: 2456546 - DNA, 14 bp, Homo sapiens
gctatttaaaactt

SEQ ID NO: 2456547 - DNA, 17 bp, Homo sapiens
gctatttgatgtaatac

SEQ ID NO: 2456548 - DNA, 18 bp, Homo sapiens
gctattttatattacact

SEQ ID NO: 2456549 - DNA, 15 bp, Homo sapiens
gctattttccaggct

SEQ ID NO: 2456550 - DNA, 20 bp, Homo sapiens
gctcaaacaatgacaaagca

SEQ ID NO: 2456551 - DNA, 13 bp, Homo sapiens
gctcacaaggcag

SEQ ID NO: 2456552 - DNA, 14 bp, Homo sapiens
gctcactcagcact

SEQ ID NO: 2456553 - DNA, 20 bp, Homo sapiens
gctcactcagccaccctgag

SEQ ID NO: 2456554 - DNA, 17 bp, Homo sapiens
gctcagaaaatatccct

SEQ ID NO: 2456555 - DNA, 15 bp, Homo sapiens
gctcagccccacccc

SEQ ID NO: 2456556 - DNA, 22 bp, Homo sapiens
gctcagccccaccccagggcag

SEQ ID NO: 2456557 - DNA, 12 bp, Homo sapiens
gctcagccctga

SEQ ID NO: 2456558 - DNA, 19 bp, Homo sapiens
gctcagctgtcaaggctca

SEQ ID NO: 2456559 - DNA, 19 bp, Homo sapiens
gctcaggcaggggcctcca

SEQ ID NO: 2456560 - DNA, 24 bp, Homo sapiens
gctcaggcaggggcctccatgggc

SEQ ID NO: 2456561 - DNA, 22 bp, Homo sapiens
gctcaggcgatccacctgtctc

SEQ ID NO: 2456562 - DNA, 19 bp, Homo sapiens
gctcagggccatgctgagg

SEQ ID NO: 2456563 - DNA, 23 bp, Homo sapiens
gctcagggccatgctgaggcctg

SEQ ID NO: 2456564 - DNA, 16 bp, Homo sapiens
gctcaggtacttgtaa

SEQ ID NO: 2456565 - DNA, 21 bp, Homo sapiens
gctcaggtgctggggcctggt

SEQ ID NO: 2456566 - DNA, 19 bp, Homo sapiens
gctcagtgaagttgctgct

SEQ ID NO: 2456567 - DNA, 19 bp, Homo sapiens
gctcatatggggctgggag

SEQ ID NO: 2456568 - DNA, 18 bp, Homo sapiens
gctcatcattctctgtct

SEQ ID NO: 2456569 - DNA, 21 bp, Homo sapiens
gctcatctgctggtccgtggg

SEQ ID NO: 2456570 - DNA, 17 bp, Homo sapiens
gctccaaagtcataatt

SEQ ID NO: 2456571 - DNA, 20 bp, Homo sapiens
gctccaaagtcataattgca

SEQ ID NO: 2456572 - DNA, 16 bp, Homo sapiens
gctccaagattctaga

SEQ ID NO: 2456573 - DNA, 19 bp, Homo sapiens
gctccaagccccatcttct

SEQ ID NO: 2456574 - DNA, 21 bp, Homo sapiens
gctccaaggggaatcagaact

SEQ ID NO: 2456575 - DNA, 23 bp, Homo sapiens
gctccaaggggaatcagaactca

SEQ ID NO: 2456576 - DNA, 16 bp, Homo sapiens
gctccactctgcttct

SEQ ID NO: 2456577 - DNA, 13 bp, Homo sapiens
gctccagacctga

SEQ ID NO: 2456578 - DNA, 20 bp, Homo sapiens
gctccagacctgatcctgga

SEQ ID NO: 2456579 - DNA, 12 bp, Homo sapiens
gctccagagggc

SEQ ID NO: 2456580 - DNA, 17 bp, Homo sapiens
gctccagatgcagggca

SEQ ID NO: 2456581 - DNA, 22 bp, Homo sapiens
gctccagatgcagggcagtcat

SEQ ID NO: 2456582 - DNA, 12 bp, Homo sapiens
gctccagcctga

SEQ ID NO: 2456583 - DNA, 13 bp, Homo sapiens
gctccagcctgac

SEQ ID NO: 2456584 - DNA, 15 bp, Homo sapiens
gctccaggtggctct

SEQ ID NO: 2456585 - DNA, 16 bp, Homo sapiens
gctccaggtggctctg

SEQ ID NO: 2456586 - DNA, 18 bp, Homo sapiens
gctccaggtggctctgag

SEQ ID NO: 2456587 - DNA, 16 bp, Homo sapiens
gctccagtgtcctgag

SEQ ID NO: 2456588 - DNA, 19 bp, Homo sapiens
gctccagtgtcctgagctc

SEQ ID NO: 2456589 - DNA, 17 bp, Homo sapiens
gctcccaaggggcctga

SEQ ID NO: 2456590 - DNA, 22 bp, Homo sapiens
gctcccacagtcccatctgctt

SEQ ID NO: 2456591 - DNA, 15 bp, Homo sapiens
gctcccacctcctga

SEQ ID NO: 2456592 - DNA, 17 bp, Homo sapiens
gctcccatcctgtgtgt

SEQ ID NO: 2456593 - DNA, 16 bp, Homo sapiens
gctccccactctgctc

SEQ ID NO: 2456594 - DNA, 19 bp, Homo sapiens
gctccccactctgctctga

SEQ ID NO: 2456595 - DNA, 14 bp, Homo sapiens
gctccccatgtgtc

SEQ ID NO: 2456596 - DNA, 18 bp, Homo sapiens
gcccctcaccctgcctta

SEQ ID NO: 2456597 - DNA, 16 bp, Homo sapiens
gcccctcccctccaaa

SEQ ID NO: 2456598 - DNA, 20 bp, Homo sapiens
gcccctctcagccctcacac

SEQ ID NO: 2456599 - DNA, 22 bp, Homo sapiens
gccactggagtgtgcgtggtgg

SEQ ID NO: 2456600 - DNA, 15 bp, Homo sapiens
gccactggggctcag

SEQ ID NO: 2456601 - DNA, 18 bp, Homo sapiens
gccactggggctcagagc

SEQ ID NO: 2456602 - DNA, 16 bp, Homo sapiens
gccactgttgttttgg

SEQ ID NO: 2456603 - DNA, 16 bp, Homo sapiens
gccacttaatgtatgt

SEQ ID NO: 2456604 - DNA, 14 bp, Homo sapiens
gccagaagtaccag

SEQ ID NO: 2456605 - DNA, 21 bp, Homo sapiens
gccagaagtaccagactagat

SEQ ID NO: 2456606 - DNA, 17 bp, Homo sapiens
gccagacacaggccctc

SEQ ID NO: 2456607 - DNA, 18 bp, Homo sapiens
gccagagaacccagccca

SEQ ID NO: 2456608 - DNA, 13 bp, Homo sapiens
gccagagatccaa

SEQ ID NO: 2456609 - DNA, 22 bp, Homo sapiens
gccagagatccaaaagaagccc

SEQ ID NO: 2456610 - DNA, 23 bp, Homo sapiens
gccagagatccaaaagaagcccc

SEQ ID NO: 2456611 - DNA, 24 bp, Homo sapiens
gccagagcccactccatctggtag

SEQ ID NO: 2456612 - DNA, 17 bp, Homo sapiens
gccagagcctggggctc

SEQ ID NO: 2456613 - DNA, 15 bp, Homo sapiens
gccagaggcccccag

SEQ ID NO: 2456614 - DNA, 18 bp, Homo sapiens
gccagaggcccccagccc

SEQ ID NO: 2456615 - DNA, 12 bp, Homo sapiens
gccagaggctgg

SEQ ID NO: 2456616 - DNA, 13 bp, Homo sapiens
gccagaggctggg

SEQ ID NO: 2456617 - DNA, 11 bp, Homo sapiens
gccagatccag

SEQ ID NO: 2456618 - DNA, 14 bp, Homo sapiens
gccagatccagcct

SEQ ID NO: 2456619 - DNA, 15 bp, Homo sapiens
gccagatccagcctg

SEQ ID NO: 2456620 - DNA, 16 bp, Homo sapiens
gccagatccagcctgg

SEQ ID NO: 2456621 - DNA, 18 bp, Homo sapiens
gccagcacacagggcagt

SEQ ID NO: 2456622 - DNA, 18 bp, Homo sapiens
gccagcaccggaccagcc

SEQ ID NO: 2456623 - DNA, 18 bp, Homo sapiens
gccagcactcgctagcag

SEQ ID NO: 2456624 - DNA, 23 bp, Homo sapiens
gccagcactcgctagcagtggca

SEQ ID NO: 2456625 - DNA, 14 bp, Homo sapiens
gccagcacttgtcc

SEQ ID NO: 2456626 - DNA, 19 bp, Homo sapiens
gccagcagcacctgcccta

SEQ ID NO: 2456627 - DNA, 15 bp, Homo sapiens
gccagcatctgggcc

SEQ ID NO: 2456628 - DNA, 20 bp, Homo sapiens
gccagccaagctctgcagtc

SEQ ID NO: 2456629 - DNA, 21 bp, Homo sapiens
gccagccaagctctgcagtcc

SEQ ID NO: 2456630 - DNA, 19 bp, Homo sapiens
gccagcccctggccccagg

SEQ ID NO: 2456631 - DNA, 20 bp, Homo sapiens
gccagcccctggccccagga

SEQ ID NO: 2456632 - DNA, 18 bp, Homo sapiens
gccagccctgcctggagg

SEQ ID NO: 2456633 - DNA, 19 bp, Homo sapiens
gccagccctgcctggagga

SEQ ID NO: 2456634 - DNA, 14 bp, Homo sapiens
gccagcctcgccca

SEQ ID NO: 2456635 - DNA, 13 bp, Homo sapiens
gccagcctggcct

SEQ ID NO: 2456636 - DNA, 19 bp, Homo sapiens
gccagcctggcctcctgcc

SEQ ID NO: 2456637 - DNA, 22 bp, Homo sapiens
gccagcctggcctcctgcctct

SEQ ID NO: 2456638 - DNA, 23 bp, Homo sapiens
gccagcctggcctcctgcctcta

SEQ ID NO: 2456639 - DNA, 20 bp, Homo sapiens
gccagcgagcgcccagctcc

SEQ ID NO: 2456640 - DNA, 22 bp, Homo sapiens
gccagcgagcgcccagctcctg

SEQ ID NO: 2456641 - DNA, 18 bp, Homo sapiens
gccagcgtcggtctgtgc

SEQ ID NO: 2456642 - DNA, 21 bp, Homo sapiens
gccagcgtcggtctgtgcccc

SEQ ID NO: 2456643 - DNA, 22 bp, Homo sapiens
gccagcgtcggtctgtgcccct

SEQ ID NO: 2456644 - DNA, 15 bp, Homo sapiens
gccagctctgtatca

SEQ ID NO: 2456645 - DNA, 18 bp, Homo sapiens
gccagctctgttcttcct

SEQ ID NO: 2456646 - DNA, 20 bp, Homo sapiens
gccagctgcactgatgctgc

SEQ ID NO: 2456647 - DNA, 14 bp, Homo sapiens
gccagcttgtttac

SEQ ID NO: 2456648 - DNA, 20 bp, Homo sapiens
gccagcttgtttacatgctt

SEQ ID NO: 2456649 - DNA, 17 bp, Homo sapiens
gccaggaatttcccagg

SEQ ID NO: 2456650 - DNA, 18 bp, Homo sapiens
gccaggaatttcccagga

SEQ ID NO: 2456651 - DNA, 19 bp, Homo sapiens
gccaggaatttcccaggac

SEQ ID NO: 2456652 - DNA, 20 bp, Homo sapiens
gccaggaatttcccaggacc

SEQ ID NO: 2456653 - DNA, 22 bp, Homo sapiens
gccaggaatttcccaggaccct

SEQ ID NO: 2456654 - DNA, 23 bp, Homo sapiens
gccaggaccagtcccagagcagg

SEQ ID NO: 2456655 - DNA, 19 bp, Homo sapiens
gccaggactctgcagcctc

SEQ ID NO: 2456656 - DNA, 21 bp, Homo sapiens
gccaggactctgcagcctcag

SEQ ID NO: 2456657 - DNA, 14 bp, Homo sapiens
gccaggagaagctc

SEQ ID NO: 2456658 - DNA, 15 bp, Homo sapiens
gccaggagaagctca

SEQ ID NO: 2456659 - DNA, 17 bp, Homo sapiens
gccaggagaagctcagc

SEQ ID NO: 2456660 - DNA, 22 bp, Homo sapiens
gccaggagaagctcagctgcat

SEQ ID NO: 2456661 - DNA, 15 bp, Homo sapiens
gccaggaggacccag

SEQ ID NO: 2456662 - DNA, 16 bp, Homo sapiens
gccaggaggacccagg

SEQ ID NO: 2456663 - DNA, 17 bp, Homo sapiens
gccaggaggacccaggg

SEQ ID NO: 2456664 - DNA, 19 bp, Homo sapiens
gccaggagggacaaaggag

SEQ ID NO: 2456665 - DNA, 23 bp, Homo sapiens
gccaggagggacaaaggagcctg

SEQ ID NO: 2456666 - DNA, 14 bp, Homo sapiens
gccaggcccagccg

SEQ ID NO: 2456667 - DNA, 18 bp, Homo sapiens
gccaggctgaccacagca

SEQ ID NO: 2456668 - DNA, 17 bp, Homo sapiens
gccaggctggtctaaaa

SEQ ID NO: 2456669 - DNA, 20 bp, Homo sapiens
gccagggagagcccaggagc

SEQ ID NO: 2456670 - DNA, 20 bp, Homo sapiens
gccagggcaatgatgaatga

SEQ ID NO: 2456671 - DNA, 19 bp, Homo sapiens
gccagggcagggccccagg

SEQ ID NO: 2456672 - DNA, 22 bp, Homo sapiens
gccagggccacgctccagctgc

SEQ ID NO: 2456673 - DNA, 13 bp, Homo sapiens
gccagggcccctc

SEQ ID NO: 2456674 - DNA, 18 bp, Homo sapiens
gccagggcccctctcccc

SEQ ID NO: 2456675 - DNA, 19 bp, Homo sapiens
gccagggcccctctcccca

SEQ ID NO: 2456676 - DNA, 14 bp, Homo sapiens
gccaggggagcaga

SEQ ID NO: 2456677 - DNA, 21 bp, Homo sapiens
gccaggggagcagaggggcag

SEQ ID NO: 2456678 - DNA, 20 bp, Homo sapiens
gccagggggagctgggcctg

SEQ ID NO: 2456679 - DNA, 21 bp, Homo sapiens
gccaggtcaccctttgctgtg

SEQ ID NO: 2456680 - DNA, 14 bp, Homo sapiens
gccaggtccctctc

SEQ ID NO: 2456681 - DNA, 15 bp, Homo sapiens
gccagtaacaggctc

SEQ ID NO: 2456682 - DNA, 16 bp, Homo sapiens
gccagtaacaggctca

SEQ ID NO: 2456683 - DNA, 19 bp, Homo sapiens
gccagtaacgcgtcttcct

SEQ ID NO: 2456684 - DNA, 12 bp, Homo sapiens
gccagtatttta

SEQ ID NO: 2456685 - DNA, 17 bp, Homo sapiens
gccagtattttaaaata

SEQ ID NO: 2456686 - DNA, 20 bp, Homo sapiens
gccagtccaggctgccgtgg

SEQ ID NO: 2456687 - DNA, 21 bp, Homo sapiens
gccagtccaggctgccgtggg

SEQ ID NO: 2456688 - DNA, 13 bp, Homo sapiens
gccagtgccctga

SEQ ID NO: 2456689 - DNA, 14 bp, Homo sapiens
gccagtgccctgag

SEQ ID NO: 2456690 - DNA, 18 bp, Homo sapiens
gccagtgccctgatccca

SEQ ID NO: 2456691 - DNA, 16 bp, Homo sapiens
gccatattaaattttt

SEQ ID NO: 2456692 - DNA, 17 bp, Homo sapiens
gccatatttacctcagc

SEQ ID NO: 2456693 - DNA, 18 bp, Homo sapiens
gccatatttacctcagcc

SEQ ID NO: 2456694 - DNA, 21 bp, Homo sapiens
ggcttcctggagcagaagcag

SEQ ID NO: 2456695 - DNA, 11 bp, Homo sapiens
ggcttcctggt

SEQ ID NO: 2456696 - DNA, 12 bp, Homo sapiens
ggcttcctggtg

SEQ ID NO: 2456697 - DNA, 14 bp, Homo sapiens
ggcttctctctgtg

SEQ ID NO: 2456698 - DNA, 22 bp, Homo sapiens
ggcttctgagcagcgagcctgc

SEQ ID NO: 2456699 - DNA, 12 bp, Homo sapiens
ggcttctgctgg

SEQ ID NO: 2456700 - DNA, 15 bp, Homo sapiens
ggcttctgctggggc

SEQ ID NO: 2456701 - DNA, 19 bp, Homo sapiens
ggcttctgctggggcctgg

SEQ ID NO: 2456702 - DNA, 17 bp, Homo sapiens
ggcttgggatttgctgt

SEQ ID NO: 2456703 - DNA, 18 bp, Homo sapiens
ggcttgggcctaggctgc

SEQ ID NO: 2456704 - DNA, 16 bp, Homo sapiens
ggcttgtggggcctgg

SEQ ID NO: 2456705 - DNA, 17 bp, Homo sapiens
gggaaaattatttgcat

SEQ ID NO: 2456706 - DNA, 14 bp, Homo sapiens
gggaaactggccat

SEQ ID NO: 2456707 - DNA, 21 bp, Homo sapiens
gggaacaatttggcaattttg

SEQ ID NO: 2456708 - DNA, 15 bp, Homo sapiens
gggaacactggggac

SEQ ID NO: 2456709 - DNA, 14 bp, Homo sapiens
gggaacatggggag

SEQ ID NO: 2456710 - DNA, 17 bp, Homo sapiens
gggaacccctttcccac

SEQ ID NO: 2456711 - DNA, 15 bp, Homo sapiens
gggaacctgtgtccg

SEQ ID NO: 2456712 - DNA, 22 bp, Homo sapiens
gggaagactcctagctgtcctt

SEQ ID NO: 2456713 - DNA, 22 bp, Homo sapiens
gggaagagagcctgcaggatct

SEQ ID NO: 2456714 - DNA, 22 bp, Homo sapiens
gggaagagtttttgtgatgggg

SEQ ID NO: 2456715 - DNA, 22 bp, Homo sapiens
gggaaggattctgctggcctct

SEQ ID NO: 2456716 - DNA, 21 bp, Homo sapiens
gggaaggcaggcagggctctc

SEQ ID NO: 2456717 - DNA, 22 bp, Homo sapiens
gggaagggagccaagggatgga

SEQ ID NO: 2456718 - DNA, 23 bp, Homo sapiens
gggaagtgaagactggaagctaa

SEQ ID NO: 2456719 - DNA, 11 bp, Homo sapiens
gggaatgtgaa

SEQ ID NO: 2456720 - DNA, 17 bp, Homo sapiens
gggacaaaggagcctgt

SEQ ID NO: 2456721 - DNA, 17 bp, Homo sapiens
gggacagaggccccagc

SEQ ID NO: 2456722 - DNA, 20 bp, Homo sapiens
gggacagaggccccagcctc

SEQ ID NO: 2456723 - DNA, 20 bp, Homo sapiens
gggacattccaaagaacagc

SEQ ID NO: 2456724 - DNA, 19 bp, Homo sapiens
gggaccaggagtgggtggg

SEQ ID NO: 2456725 - DNA, 14 bp, Homo sapiens
gggaccaggcacca

SEQ ID NO: 2456726 - DNA, 13 bp, Homo sapiens
gggacctggaagg

SEQ ID NO: 2456727 - DNA, 19 bp, Homo sapiens
gggacgtggctcagccagc

SEQ ID NO: 2456728 - DNA, 21 bp, Homo sapiens
gcctaagaggctgccctcctg

SEQ ID NO: 2456729 - DNA, 15 bp, Homo sapiens
gctaataactgatct

SEQ ID NO: 2456730 - DNA, 23 bp, Homo sapiens
gctaatattttcctcctgagtgc

SEQ ID NO: 2456731 - DNA, 22 bp, Homo sapiens
ggcccgagcagctgagcagggc

SEQ ID NO: 2456732 - DNA, 18 bp, Homo sapiens
ggcccggcagggcgggca

SEQ ID NO: 2456733 - DNA, 21 bp, Homo sapiens
ggcccgtgtaaatatgtacat

SEQ ID NO: 2456734 - DNA, 14 bp, Homo sapiens
ggccctccacacct

SEQ ID NO: 2456735 - DNA, 19 bp, Homo sapiens
ggccctccctgttccccag

SEQ ID NO: 2456736 - DNA, 20 bp, Homo sapiens
ggccctccctgttccccaga

SEQ ID NO: 2456737 - DNA, 16 bp, Homo sapiens
ggccctcgctgccagc

SEQ ID NO: 2456738 - DNA, 21 bp, Homo sapiens
ggccctcgctgccagctctgt

SEQ ID NO: 2456739 - DNA, 22 bp, Homo sapiens
ggccctcgctgccagctctgta

SEQ ID NO: 2456740 - DNA, 15 bp, Homo sapiens
ggccctctcccctgc

SEQ ID NO: 2456741 - DNA, 23 bp, Homo sapiens
ggccctctcccctgccccctgca

SEQ ID NO: 2456742 - DNA, 11 bp, Homo sapiens
ggccctgagcg

SEQ ID NO: 2456743 - DNA, 20 bp, Homo sapiens
ggccctggatcagcgtggcc

SEQ ID NO: 2456744 - DNA, 16 bp, Homo sapiens
ggccctggggcctgta

SEQ ID NO: 2456745 - DNA, 12 bp, Homo sapiens
ggcccttcctgg

SEQ ID NO: 2456746 - DNA, 14 bp, Homo sapiens
ggcccttcctggac

SEQ ID NO: 2456747 - DNA, 15 bp, Homo sapiens
ggcccttcctggaca

SEQ ID NO: 2456748 - DNA, 16 bp, Homo sapiens
ggcccttcctggacag

SEQ ID NO: 2456749 - DNA, 19 bp, Homo sapiens
ggcccttgagtccccattg

SEQ ID NO: 2456750 - DNA, 16 bp, Homo sapiens
ggccgagtccaagctg

SEQ ID NO: 2456751 - DNA, 23 bp, Homo sapiens
ggccgcccccagccccctcctgg

SEQ ID NO: 2456752 - DNA, 16 bp, Homo sapiens
ggccgccccctgcccc

SEQ ID NO: 2456753 - DNA, 15 bp, Homo sapiens
ggccgcctgggtcca

SEQ ID NO: 2456754 - DNA, 18 bp, Homo sapiens
ggccggggaactggccaa

SEQ ID NO: 2456755 - DNA, 20 bp, Homo sapiens
ggccggggaactggccaagc

SEQ ID NO: 2456756 - DNA, 21 bp, Homo sapiens
ggccggggaactggccaagct

SEQ ID NO: 2456757 - DNA, 13 bp, Homo sapiens
ggccgtggctgct

SEQ ID NO: 2456758 - DNA, 22 bp, Homo sapiens
ggcctaagaggctgccctcctg

SEQ ID NO: 2456759 - DNA, 23 bp, Homo sapiens
ggcctaccccgcagacaccttgg

SEQ ID NO: 2456760 - DNA, 12 bp, Homo sapiens
ggtccagctctg

SEQ ID NO: 2456761 - DNA, 13 bp, Homo sapiens
ggtccagctctgg

SEQ ID NO: 2456762 - DNA, 14 bp, Homo sapiens
ggtccagctctgga

SEQ ID NO: 2456763 - DNA, 12 bp, Homo sapiens
ggtccagggcta

SEQ ID NO: 2456764 - DNA, 16 bp, Homo sapiens
ggtcccacatccctgg

SEQ ID NO: 2456765 - DNA, 21 bp, Homo sapiens
ggtcccacatccctgggcctg

SEQ ID NO: 2456766 - DNA, 15 bp, Homo sapiens
ggtcccagcagctgc

SEQ ID NO: 2456767 - DNA, 13 bp, Homo sapiens
ggtcccctccttc

SEQ ID NO: 2456768 - DNA, 11 bp, Homo sapiens
ggtccctgggt

SEQ ID NO: 2456769 - DNA, 20 bp, Homo sapiens
ggtccctgggtagcggggga

SEQ ID NO: 2456770 - DNA, 16 bp, Homo sapiens
ggtccggtgttctaag

SEQ ID NO: 2456771 - DNA, 19 bp, Homo sapiens
ggtcctcttctgggcctga

SEQ ID NO: 2456772 - DNA, 16 bp, Homo sapiens
ggtcctgagcactgcc

SEQ ID NO: 2456773 - DNA, 18 bp, Homo sapiens
ggtcctgagcactgccag

SEQ ID NO: 2456774 - DNA, 22 bp, Homo sapiens
ggtcctgagcactgccaggagg

SEQ ID NO: 2456775 - DNA, 17 bp, Homo sapiens
ggtcctggagcagacca

SEQ ID NO: 2456776 - DNA, 15 bp, Homo sapiens
ggtcctttggggtga

SEQ ID NO: 2456777 - DNA, 12 bp, Homo sapiens
ggtcgctcctgc

SEQ ID NO: 2456778 - DNA, 18 bp, Homo sapiens
ggtcgcttgggaatttta

SEQ ID NO: 2456779 - DNA, 15 bp, Homo sapiens
ggtcgtggagagcta

SEQ ID NO: 2456780 - DNA, 21 bp, Homo sapiens
ggtctcaaactcctgggctca

SEQ ID NO: 2456781 - DNA, 19 bp, Homo sapiens
ggtctcacagtgttgccca

SEQ ID NO: 2456782 - DNA, 21 bp, Homo sapiens
ggtctcacagtgttgcccagg

SEQ ID NO: 2456783 - DNA, 21 bp, Homo sapiens
ggtctcaccggctctcacctg

SEQ ID NO: 2456784 - DNA, 11 bp, Homo sapiens
ggtctcagccc

SEQ ID NO: 2456785 - DNA, 15 bp, Homo sapiens
ggtctcatctcttca

SEQ ID NO: 2456786 - DNA, 19 bp, Homo sapiens
ggtctcgctttgttgccca

SEQ ID NO: 2456787 - DNA, 21 bp, Homo sapiens
ggtctcgctttgttgcccagg

SEQ ID NO: 2456788 - DNA, 23 bp, Homo sapiens
ggtctgccctctgcatcctctgg

SEQ ID NO: 2456789 - DNA, 22 bp, Homo sapiens
ggtctggcagcctcccatccag

SEQ ID NO: 2456790 - DNA, 15 bp, Homo sapiens
ggtctggctggtgtt

SEQ ID NO: 2456791 - DNA, 21 bp, Homo sapiens
ggtctgggggcacaagactga

SEQ ID NO: 2456792 - DNA, 19 bp, Homo sapiens
ggtctgttggcaggctggc

SEQ ID NO: 2456793 - DNA, 16 bp, Homo sapiens
ggtcttttataattct

SEQ ID NO: 2456794 - DNA, 13 bp, Homo sapiens
ggtgaaaggaaat

SEQ ID NO: 2456795 - DNA, 19 bp, Homo sapiens
ggtgaacaaagcagccacg

SEQ ID NO: 2456796 - DNA, 16 bp, Homo sapiens
ggtgaccccagggcac

SEQ ID NO: 2456797 - DNA, 22 bp, Homo sapiens
ggtgaccccagggcacaggagc

SEQ ID NO: 2456798 - DNA, 23 bp, Homo sapiens
ggtgaccccagggcacaggagct

SEQ ID NO: 2456799 - DNA, 14 bp, Homo sapiens
ggtgactgtctggg

SEQ ID NO: 2456800 - DNA, 13 bp, Homo sapiens
ggtgagaaattta

SEQ ID NO: 2456801 - DNA, 15 bp, Homo sapiens
ggtgagaaatttaaa

SEQ ID NO: 2456802 - DNA, 21 bp, Homo sapiens
ggtgagaacctgggttgcaga

SEQ ID NO: 2456803 - DNA, 23 bp, Homo sapiens
ggtgagttggcttacctggccca

SEQ ID NO: 2456804 - DNA, 21 bp, Homo sapiens
ggtgatccatgtaactgccta

SEQ ID NO: 2456805 - DNA, 17 bp, Homo sapiens
ggtgatctgggattagg

SEQ ID NO: 2456806 - DNA, 15 bp, Homo sapiens
ggtgatgagggcagc

SEQ ID NO: 2456807 - DNA, 13 bp, Homo sapiens
gggccctccttcc

SEQ ID NO: 2456808 - DNA, 16 bp, Homo sapiens
gggccctctctgctct

SEQ ID NO: 2456809 - DNA, 15 bp, Homo sapiens
gggccctgggctgga

SEQ ID NO: 2456810 - DNA, 16 bp, Homo sapiens
gggccgatgcccagag

SEQ ID NO: 2456811 - DNA, 17 bp, Homo sapiens
gggccgatgcccagaga

SEQ ID NO: 2456812 - DNA, 16 bp, Homo sapiens
gggccggggaactggc

SEQ ID NO: 2456813 - DNA, 17 bp, Homo sapiens
gggccggggaactggcc

SEQ ID NO: 2456814 - DNA, 17 bp, Homo sapiens
gggcctactagagtctg

SEQ ID NO: 2456815 - DNA, 15 bp, Homo sapiens
gggcctaggctgcat

SEQ ID NO: 2456816 - DNA, 19 bp, Homo sapiens
gggcctatggagagccctg

SEQ ID NO: 2456817 - DNA, 20 bp, Homo sapiens
gggcctatggagagccctgg

SEQ ID NO: 2456818 - DNA, 21 bp, Homo sapiens
gggcctatggagagccctggg

SEQ ID NO: 2456819 - DNA, 22 bp, Homo sapiens
gggcctatggagagccctggga

SEQ ID NO: 2456820 - DNA, 21 bp, Homo sapiens
gggcctgagcagtccttggcc

SEQ ID NO: 2456821 - DNA, 18 bp, Homo sapiens
gggcctgccacctggacc

SEQ ID NO: 2456822 - DNA, 23 bp, Homo sapiens
gggcctgccacctggacccctgc

SEQ ID NO: 2456823 - DNA, 14 bp, Homo sapiens
gggcctgctccaga

SEQ ID NO: 2456824 - DNA, 18 bp, Homo sapiens
gggcctgctccagacctg

SEQ ID NO: 2456825 - DNA, 11 bp, Homo sapiens
gggcctgctgc

SEQ ID NO: 2456826 - DNA, 12 bp, Homo sapiens
gggcctgctgct

SEQ ID NO: 2456827 - DNA, 18 bp, Homo sapiens
gggcctgctgctgagaac

SEQ ID NO: 2456828 - DNA, 19 bp, Homo sapiens
gggcctgctgctgagaacc

SEQ ID NO: 2456829 - DNA, 22 bp, Homo sapiens
gggcctgctgctgagaacctgg

SEQ ID NO: 2456830 - DNA, 17 bp, Homo sapiens
gggcctggctggctgag

SEQ ID NO: 2456831 - DNA, 20 bp, Homo sapiens
gggcctggctggctgagggc

SEQ ID NO: 2456832 - DNA, 15 bp, Homo sapiens
gggcctgggctcctg

SEQ ID NO: 2456833 - DNA, 18 bp, Homo sapiens
gggcctgggctcctggac

SEQ ID NO: 2456834 - DNA, 20 bp, Homo sapiens
gggcctggtctcaccctgga

SEQ ID NO: 2456835 - DNA, 22 bp, Homo sapiens
gggcctggttaaataaggcagg

SEQ ID NO: 2456836 - DNA, 16 bp, Homo sapiens
gggcctgtactgcctg

SEQ ID NO: 2456837 - DNA, 18 bp, Homo sapiens
gggcctgtactgcctgct

SEQ ID NO: 2456838 - DNA, 20 bp, Homo sapiens
gggcctgtactgcctgcttg

SEQ ID NO: 2456839 - DNA, 23 bp, Homo sapiens
gggcctgtccacaggcttctgag

SEQ ID NO: 2456840 - DNA, 20 bp, Homo sapiens
gggccttaggaagagccttc

SEQ ID NO: 2456841 - DNA, 14 bp, Homo sapiens
gggccttggcctgg

SEQ ID NO: 2456842 - DNA, 17 bp, Homo sapiens
gggccttggcctggagc

SEQ ID NO: 2456843 - DNA, 18 bp, Homo sapiens
gggccttggcctggagca

SEQ ID NO: 2456844 - DNA, 21 bp, Homo sapiens
gtaacaattgtgtagcctttt

SEQ ID NO: 2456845 - DNA, 15 bp, Homo sapiens
gtaacactaatatat

SEQ ID NO: 2456846 - DNA, 19 bp, Homo sapiens
gtaacactaatatatttaa

SEQ ID NO: 2456847 - DNA, 22 bp, Homo sapiens
gtaacactaatatatttaaaaa

SEQ ID NO: 2456848 - DNA, 19 bp, Homo sapiens
gtaacatttgctgttttaa

SEQ ID NO: 2456849 - DNA, 12 bp, Homo sapiens
gtaactgccagg

SEQ ID NO: 2456850 - DNA, 14 bp, Homo sapiens
gtaactgctttctg

SEQ ID NO: 2456851 - DNA, 17 bp, Homo sapiens
gtaactgctttctgttc

SEQ ID NO: 2456852 - DNA, 19 bp, Homo sapiens
gtaactgctttctgttcca

SEQ ID NO: 2456853 - DNA, 22 bp, Homo sapiens
gtaactgctttctgttccaaat

SEQ ID NO: 2456854 - DNA, 13 bp, Homo sapiens
gtaactgttcttg

SEQ ID NO: 2456855 - DNA, 21 bp, Homo sapiens
gtaacttgatccatttctaat

SEQ ID NO: 2456856 - DNA, 20 bp, Homo sapiens
gtaagaaacctactgcccag

SEQ ID NO: 2456857 - DNA, 20 bp, Homo sapiens
gtaagattatagattctaaa

SEQ ID NO: 2456858 - DNA, 22 bp, Homo sapiens
gtaagattatagattctaaaga

SEQ ID NO: 2456859 - DNA, 23 bp, Homo sapiens
gtaagattatagattctaaagat

SEQ ID NO: 2456860 - DNA, 16 bp, Homo sapiens
gtaagatttgttttta

SEQ ID NO: 2456861 - DNA, 18 bp, Homo sapiens
gtaaggatccggaaagaa

SEQ ID NO: 2456862 - DNA, 16 bp, Homo sapiens
gtaaggctctagatca

SEQ ID NO: 2456863 - DNA, 14 bp, Homo sapiens
gtaaggctgtgtaa

SEQ ID NO: 2456864 - DNA, 19 bp, Homo sapiens
gtaaggctgtgtaagattt

SEQ ID NO: 2456865 - DNA, 17 bp, Homo sapiens
gtaagtacagagaagcc

SEQ ID NO: 2456866 - DNA, 23 bp, Homo sapiens
gtaagttgggcttgctattctgt

SEQ ID NO: 2456867 - DNA, 17 bp, Homo sapiens
gtaatacttcttgtgtg

SEQ ID NO: 2456868 - DNA, 20 bp, Homo sapiens
gtaatattgacttgtatatt

SEQ ID NO: 2456869 - DNA, 22 bp, Homo sapiens
gtaatctgaataaagtgtaaca

SEQ ID NO: 2456870 - DNA, 19 bp, Homo sapiens
gtaatggtactgactttgc

SEQ ID NO: 2456871 - DNA, 14 bp, Homo sapiens
gtaatggtgtagaa

SEQ ID NO: 2456872 - DNA, 17 bp, Homo sapiens
gtaatgtcttgagctct

SEQ ID NO: 2456873 - DNA, 23 bp, Homo sapiens
gtaattagtaacatgtgttaagt

SEQ ID NO: 2456874 - DNA, 21 bp, Homo sapiens
gtaattagtgccacttaatgt

SEQ ID NO: 2456875 - DNA, 13 bp, Homo sapiens
gtaattatggagt

SEQ ID NO: 2456876 - DNA, 19 bp, Homo sapiens
gtaattatttatgtatggt

SEQ ID NO: 2456877 - DNA, 21 bp, Homo sapiens
gtaatttaaaataattatata

SEQ ID NO: 2456878 - DNA, 16 bp, Homo sapiens
gtaattttgtgtaaga

SEQ ID NO: 2456879 - DNA, 21 bp, Homo sapiens
gtacaagaagcattttgtaag

SEQ ID NO: 2456880 - DNA, 22 bp, Homo sapiens
gtacaattaattatcttttcaa

SEQ ID NO: 2456881 - DNA, 23 bp, Homo sapiens
gtacaattaattatcttttcaaa

SEQ ID NO: 2456882 - DNA, 13 bp, Homo sapiens
gtacactctgctg

SEQ ID NO: 2456883 - DNA, 18 bp, Homo sapiens
gtacactctgctgtttga

SEQ ID NO: 2456884 - DNA, 11 bp, Homo sapiens
gtacagagaag

SEQ ID NO: 2456885 - DNA, 13 bp, Homo sapiens
gtacagagaagcc

SEQ ID NO: 2456886 - DNA, 14 bp, Homo sapiens
gtacagagaagcca

SEQ ID NO: 2456887 - DNA, 15 bp, Homo sapiens
gtacagagaagccag

SEQ ID NO: 2456888 - DNA, 21 bp, Homo sapiens
gtacagagaagccagcttgtt

SEQ ID NO: 2456889 - DNA, 16 bp, Homo sapiens
gtacagagaagccatc

SEQ ID NO: 2456890 - DNA, 12 bp, Homo sapiens
gtacagctggct

SEQ ID NO: 2456891 - DNA, 15 bp, Homo sapiens
gtacagctggctcta

SEQ ID NO: 2456892 - DNA, 23 bp, Homo sapiens
gtacagtatgggggttgtaaatt

SEQ ID NO: 2456893 - DNA, 13 bp, Homo sapiens
gtacagtgtcttt

SEQ ID NO: 2456894 - DNA, 15 bp, Homo sapiens
gtacagtgtcttttt

SEQ ID NO: 2456895 - DNA, 14 bp, Homo sapiens
gttctgtttcaagg

SEQ ID NO: 2456896 - DNA, 14 bp, Homo sapiens
gttcttactgcttg

SEQ ID NO: 2456897 - DNA, 19 bp, Homo sapiens
gttcttagctcaatgagca

SEQ ID NO: 2456898 - DNA, 15 bp, Homo sapiens
gttcttcctcagcca

SEQ ID NO: 2456899 - DNA, 13 bp, Homo sapiens
gttcttgttggtg

SEQ ID NO: 2456900 - DNA, 22 bp, Homo sapiens
gttctttcatttgctttggaag

SEQ ID NO: 2456901 - DNA, 23 bp, Homo sapiens
gttctttgctgcattctgcctct

SEQ ID NO: 2456902 - DNA, 11 bp, Homo sapiens
gttctttggaa

SEQ ID NO: 2456903 - DNA, 22 bp, Homo sapiens
gttctttgggccagacatgcca

SEQ ID NO: 2456904 - DNA, 19 bp, Homo sapiens
gttctttttgaagtattta

SEQ ID NO: 2456905 - DNA, 19 bp, Homo sapiens
gttgaaaaagtttgttttt

SEQ ID NO: 2456906 - DNA, 13 bp, Homo sapiens
gttgaaaggtttt

SEQ ID NO: 2456907 - DNA, 23 bp, Homo sapiens
gttgaaaggttttttttcagttg

SEQ ID NO: 2456908 - DNA, 18 bp, Homo sapiens
gttgaagcaaatcgaatg

SEQ ID NO: 2456909 - DNA, 17 bp, Homo sapiens
gttgaatactttttaca

SEQ ID NO: 2456910 - DNA, 16 bp, Homo sapiens
gttgagaatcccaaat

SEQ ID NO: 2456911 - DNA, 17 bp, Homo sapiens
gttgagatagttttcat

SEQ ID NO: 2456912 - DNA, 18 bp, Homo sapiens
gttgagatagttttcatc

SEQ ID NO: 2456913 - DNA, 21 bp, Homo sapiens
gttgaggccactgtgttcctt

SEQ ID NO: 2456914 - DNA, 17 bp, Homo sapiens
gttgatactgttgcacg

SEQ ID NO: 2456915 - DNA, 17 bp, Homo sapiens
gttgatctggaacccag

SEQ ID NO: 2456916 - DNA, 19 bp, Homo sapiens
gttgatctggaacccagac

SEQ ID NO: 2456917 - DNA, 14 bp, Homo sapiens
gttgattaaagatg

SEQ ID NO: 2456918 - DNA, 15 bp, Homo sapiens
gttgcacactttggt

SEQ ID NO: 2456919 - DNA, 17 bp, Homo sapiens
gttgcacgtgtgttttt

SEQ ID NO: 2456920 - DNA, 21 bp, Homo sapiens
gttgcacgtgtgtttttctat

SEQ ID NO: 2456921 - DNA, 14 bp, Homo sapiens
gttgcagacaggaa

SEQ ID NO: 2456922 - DNA, 20 bp, Homo sapiens
gttgcagacaggaatcttaa

SEQ ID NO: 2456923 - DNA, 20 bp, Homo sapiens
gttgccaaatatgtcctggg

SEQ ID NO: 2456924 - DNA, 12 bp, Homo sapiens
gttgccttttat

SEQ ID NO: 2456925 - DNA, 17 bp, Homo sapiens
gttgcgttcctttcttt

SEQ ID NO: 2456926 - DNA, 23 bp, Homo sapiens
gttgctgatgaactcttaatcaa

SEQ ID NO: 2456927 - DNA, 23 bp, Homo sapiens
gttgctgcttctcccaggcaagg

SEQ ID NO: 2456928 - DNA, 17 bp, Homo sapiens
gttggaatggatttttc

SEQ ID NO: 2456929 - DNA, 17 bp, Homo sapiens
gttggagctccagcctg

SEQ ID NO: 2456930 - DNA, 13 bp, Homo sapiens
gttggcaggctgg

SEQ ID NO: 2456931 - DNA, 15 bp, Homo sapiens
gttggcaggctggcc

SEQ ID NO: 2456932 - DNA, 16 bp, Homo sapiens
gttggcaggctggcca

SEQ ID NO: 2456933 - DNA, 17 bp, Homo sapiens
gttggcaggctggccag

SEQ ID NO: 2456934 - DNA, 20 bp, Homo sapiens
gttggcaggctggccagtcc

SEQ ID NO: 2456935 - DNA, 18 bp, Homo sapiens
gttggcatagctctgggg

SEQ ID NO: 2456936 - DNA, 19 bp, Homo sapiens
gttggcatagctctggggt

SEQ ID NO: 2456937 - DNA, 18 bp, Homo sapiens
gttggccaggctggtcta

SEQ ID NO: 2456938 - DNA, 20 bp, Homo sapiens
gttggcgtaggctacagaga

SEQ ID NO: 2456939 - DNA, 23 bp, Homo sapiens
gttggctctgccagtcctgtcct

SEQ ID NO: 2456940 - DNA, 17 bp, Homo sapiens
gttggcttacctggccc

SEQ ID NO: 2456941 - DNA, 13 bp, Homo sapiens
gttggtagtttct

SEQ ID NO: 2456942 - DNA, 17 bp, Homo sapiens
gttggtgcacagcacaa

SEQ ID NO: 2456943 - DNA, 21 bp, Homo sapiens
gttgtaaagtatgtattattt

SEQ ID NO: 2456944 - DNA, 16 bp, Homo sapiens
gttgtaaattggcatg

SEQ ID NO: 2456945 - DNA, 16 bp, Homo sapiens
gttgtatttaacagaa

SEQ ID NO: 2456946 - DNA, 14 bp, Homo sapiens
gttgtcaagaatag

SEQ ID NO: 2456947 - DNA, 17 bp, Homo sapiens
gttgtcgtaaagatttg

SEQ ID NO: 2456948 - DNA, 18 bp, Homo sapiens
gttgtctctagagcaggg

SEQ ID NO: 2456949 - DNA, 18 bp, Homo sapiens
gttgtctctgatgcagct

SEQ ID NO: 2456950 - DNA, 13 bp, Homo sapiens
gttgtggcctttg

SEQ ID NO: 2456951 - DNA, 16 bp, Homo sapiens
gttgttcgggccaagg

SEQ ID NO: 2456952 - DNA, 14 bp, Homo sapiens
gttgttctgttaac

SEQ ID NO: 2456953 - DNA, 10 bp, Homo sapiens
gttgttcttt

SEQ ID NO: 2456954 - DNA, 13 bp, Homo sapiens
gttgtttctgttc

SEQ ID NO: 2456955 - DNA, 14 bp, Homo sapiens
gttgtttctgttcc

SEQ ID NO: 2456956 - DNA, 17 bp, Homo sapiens
gttgtttctgttccaaa

SEQ ID NO: 2456957 - DNA, 14 bp, Homo sapiens
gtttaaagaaagtg

SEQ ID NO: 2456958 - DNA, 17 bp, Homo sapiens
gtttaaagaaagtgtat

SEQ ID NO: 2456959 - DNA, 18 bp, Homo sapiens
gtttaaagaaagtgtatt

SEQ ID NO: 2456960 - DNA, 18 bp, Homo sapiens
gtttaaagagtctagatt

SEQ ID NO: 2456961 - DNA, 19 bp, Homo sapiens
gtttacatgcttattccat

SEQ ID NO: 2456962 - DNA, 18 bp, Homo sapiens
gtttaccagttgcctttt

SEQ ID NO: 2456963 - DNA, 22 bp, Homo sapiens
gtttactagggatccctcatct

SEQ ID NO: 2456964 - DNA, 20 bp, Homo sapiens
gtttagatttatggttgtta

SEQ ID NO: 2456965 - DNA, 14 bp, Homo sapiens
gtttatcagtaaat

SEQ ID NO: 2456966 - DNA, 16 bp, Homo sapiens
gtttatcattcaagtg

SEQ ID NO: 2456967 - DNA, 17 bp, Homo sapiens
gtttatcattcaagtgt

SEQ ID NO: 2456968 - DNA, 20 bp, Homo sapiens
gtttatcattcaagtgtaaa

SEQ ID NO: 2456969 - DNA, 22 bp, Homo sapiens
gtttattaatcttagtgtatga

SEQ ID NO: 2456970 - DNA, 15 bp, Homo sapiens
gtttattcttctaga

SEQ ID NO: 2456971 - DNA, 16 bp, Homo sapiens
gtttattcttctagag

SEQ ID NO: 2456972 - DNA, 16 bp, Homo sapiens
gtttcaattgcatctc

SEQ ID NO: 2456973 - DNA, 17 bp, Homo sapiens
gtttcaattgcatctcc

SEQ ID NO: 2456974 - DNA, 22 bp, Homo sapiens
gtttcaattgcatctcccagat

SEQ ID NO: 2456975 - DNA, 19 bp, Homo sapiens
gtttcacaaggtctttaaa

SEQ ID NO: 2456976 - DNA, 12 bp, Homo sapiens
gtgacctgctga

SEQ ID NO: 2456977 - DNA, 16 bp, Homo sapiens
gtgacctgctgagctc

SEQ ID NO: 2456978 - DNA, 20 bp, Homo sapiens
gtgacctgctgagctctgag

SEQ ID NO: 2456979 - DNA, 15 bp, Homo sapiens
gtgacgtctgggtgg

SEQ ID NO: 2456980 - DNA, 15 bp, Homo sapiens
gtgactgtctgggga

SEQ ID NO: 2456981 - DNA, 20 bp, Homo sapiens
gtgagaagtgaatgctggga

SEQ ID NO: 2456982 - DNA, 12 bp, Homo sapiens
gtgagacagact

SEQ ID NO: 2456983 - DNA, 23 bp, Homo sapiens
gtgagactgggaaggcttgggat

SEQ ID NO: 2456984 - DNA, 18 bp, Homo sapiens
gtgagcccagctgggtca

SEQ ID NO: 2456985 - DNA, 14 bp, Homo sapiens
gtgagctgagcagg

SEQ ID NO: 2456986 - DNA, 15 bp, Homo sapiens
gtgaggccagggcag

SEQ ID NO: 2456987 - DNA, 17 bp, Homo sapiens
gtgaggccagggcagag

SEQ ID NO: 2456988 - DNA, 18 bp, Homo sapiens
gtgagggtaagtattttc

SEQ ID NO: 2456989 - DNA, 16 bp, Homo sapiens
gtgagggtcccatgtg

SEQ ID NO: 2456990 - DNA, 18 bp, Homo sapiens
gtgagtaattttggattt

SEQ ID NO: 2456991 - DNA, 16 bp, Homo sapiens
gtgagtcgtttcccct

SEQ ID NO: 2456992 - DNA, 17 bp, Homo sapiens
gtgagtctttggttcta

SEQ ID NO: 2456993 - DNA, 17 bp, Homo sapiens
gtgagtggagttgaggt

SEQ ID NO: 2456994 - DNA, 17 bp, Homo sapiens
gtgagtgtttttatctt

SEQ ID NO: 2456995 - DNA, 12 bp, Homo sapiens
gtgagttggctt

SEQ ID NO: 2456996 - DNA, 21 bp, Homo sapiens
gtgatatataagtgtacatat

SEQ ID NO: 2456997 - DNA, 19 bp, Homo sapiens
gtgatatgcacaatgtaga

SEQ ID NO: 2456998 - DNA, 14 bp, Homo sapiens
gtgatctcagatca

SEQ ID NO: 2456999 - DNA, 22 bp, Homo sapiens
gtgatcttggcttactgcagcc

SEQ ID NO: 2457000 - DNA, 14 bp, Homo sapiens
gtgatgaatactgt

SEQ ID NO: 2457001 - DNA, 22 bp, Homo sapiens
gtgatgagggcagcagccagcc

SEQ ID NO: 2457002 - DNA, 23 bp, Homo sapiens
gtgatgagggcagcagccagccc

SEQ ID NO: 2457003 - DNA, 18 bp, Homo sapiens
gtgatggagtgctgtttt

SEQ ID NO: 2457004 - DNA, 17 bp, Homo sapiens
gtgatgggggagagggt

SEQ ID NO: 2457005 - DNA, 14 bp, Homo sapiens
gtgtgtttttctat

SEQ ID NO: 2457006 - DNA, 15 bp, Homo sapiens
gtgtgtttttctatt

SEQ ID NO: 2457007 - DNA, 20 bp, Homo sapiens
gtgtgtttttctattaaaag

SEQ ID NO: 2457008 - DNA, 21 bp, Homo sapiens
gtgttaaatgtgatgaatact

SEQ ID NO: 2457009 - DNA, 14 bp, Homo sapiens
gtgttaagctctgc

SEQ ID NO: 2457010 - DNA, 15 bp, Homo sapiens
gtgttaagctctgct

SEQ ID NO: 2457011 - DNA, 16 bp, Homo sapiens
gtgttacctgaaaaca

SEQ ID NO: 2457012 - DNA, 20 bp, Homo sapiens
gtgttactaaaaaaaagatg

SEQ ID NO: 2457013 - DNA, 21 bp, Homo sapiens
gtgttactaaaaaaaagatga

SEQ ID NO: 2457014 - DNA, 14 bp, Homo sapiens
gtgttcattgtttc

SEQ ID NO: 2457015 - DNA, 22 bp, Homo sapiens
gtgttccccttccactgagggc

SEQ ID NO: 2457016 - DNA, 14 bp, Homo sapiens
gtgttccttccgct

SEQ ID NO: 2457017 - DNA, 15 bp, Homo sapiens
gtgttctcctgctgc

SEQ ID NO: 2457018 - DNA, 20 bp, Homo sapiens
gtgttctcctgctgctccct

SEQ ID NO: 2457019 - DNA, 16 bp, Homo sapiens
gtgttctccttttcct

SEQ ID NO: 2457020 - DNA, 16 bp, Homo sapiens
gtgttgatactgttgc

SEQ ID NO: 2457021 - DNA, 20 bp, Homo sapiens
gtgttgatactgttgcacgt

SEQ ID NO: 2457022 - DNA, 23 bp, Homo sapiens
gtgttgatactgttgcacgtgtg

SEQ ID NO: 2457023 - DNA, 19 bp, Homo sapiens
gtgttgccaaatatgtcct

SEQ ID NO: 2457024 - DNA, 18 bp, Homo sapiens
gtgttgccaagctccaag

SEQ ID NO: 2457025 - DNA, 20 bp, Homo sapiens
gtgttgcccaggctggtctc

SEQ ID NO: 2457026 - DNA, 12 bp, Homo sapiens
gtgtttaaaact

SEQ ID NO: 2457027 - DNA, 21 bp, Homo sapiens
gtgtttcacagtttgaaataa

SEQ ID NO: 2457028 - DNA, 18 bp, Homo sapiens
gtgtttctgtaagaaacc

SEQ ID NO: 2457029 - DNA, 14 bp, Homo sapiens
gtgtttggctttca

SEQ ID NO: 2457030 - DNA, 14 bp, Homo sapiens
gtgttttaattgta

SEQ ID NO: 2457031 - DNA, 14 bp, Homo sapiens
gtgtttttctatta

SEQ ID NO: 2457032 - DNA, 17 bp, Homo sapiens
gtgtttttctattaaaa

SEQ ID NO: 2457033 - DNA, 12 bp, Homo sapiens
gttaaaatgtgt

SEQ ID NO: 2457034 - DNA, 21 bp, Homo sapiens
gttaacacactaccgaatgtg

SEQ ID NO: 2457035 - DNA, 20 bp, Homo sapiens
gttaactgaataccactctg

SEQ ID NO: 2457036 - DNA, 23 bp, Homo sapiens
gttaactgaataccactctgtaa

SEQ ID NO: 2457037 - DNA, 19 bp, Homo sapiens
gttaagacatgatttcctt

SEQ ID NO: 2457038 - DNA, 22 bp, Homo sapiens
gttaatttagtggaaaaggcac

SEQ ID NO: 2457039 - DNA, 12 bp, Homo sapiens
gttaatttttga

SEQ ID NO: 2457040 - DNA, 22 bp, Homo sapiens
gttacactttttggaagtgaaa

SEQ ID NO: 2457041 - DNA, 13 bp, Homo sapiens
gttacagaagctg

SEQ ID NO: 2457042 - DNA, 15 bp, Homo sapiens
gttaccatgtctttc

SEQ ID NO: 2457043 - DNA, 19 bp, Homo sapiens
gttaccattaaaccatctc

SEQ ID NO: 2457044 - DNA, 13 bp, Homo sapiens
gttacctgtagat

SEQ ID NO: 2457045 - DNA, 18 bp, Homo sapiens
gttacgtagcctaaggct

SEQ ID NO: 2457046 - DNA, 13 bp, Homo sapiens
gttactgtgtaat

SEQ ID NO: 2457047 - DNA, 16 bp, Homo sapiens
gttagattaagaaata

SEQ ID NO: 2457048 - DNA, 18 bp, Homo sapiens
gttagccttttttcccca

SEQ ID NO: 2457049 - DNA, 21 bp, Homo sapiens
gttagctaataaaaagctttt

SEQ ID NO: 2457050 - DNA, 20 bp, Homo sapiens
gttagctcctgtggccccac

SEQ ID NO: 2457051 - DNA, 18 bp, Homo sapiens
gttaggtagagggagttg

SEQ ID NO: 2457052 - DNA, 21 bp, Homo sapiens
gttaggtagagggagttgtca

SEQ ID NO: 2457053 - DNA, 17 bp, Homo sapiens
gttagtatcttttgata

SEQ ID NO: 2457054 - DNA, 23 bp, Homo sapiens
gttagttaccttatagttactgt

SEQ ID NO: 2457055 - DNA, 15 bp, Homo sapiens
gttataaaaaatggt

SEQ ID NO: 2457056 - DNA, 15 bp, Homo sapiens
gttataaagatacag

SEQ ID NO: 2457057 - DNA, 20 bp, Homo sapiens
gttatagacagtcgttccca

SEQ ID NO: 2457058 - DNA, 13 bp, Homo sapiens
gttatataatcat

SEQ ID NO: 2457059 - DNA, 22 bp, Homo sapiens
gttatcaccgtgggctccctga

SEQ ID NO: 2457060 - DNA, 16 bp, Homo sapiens
gttatcagtgcttccc

SEQ ID NO: 2457061 - DNA, 12 bp, Homo sapiens
gttatctctgtg

SEQ ID NO: 2457062 - DNA, 23 bp, Homo sapiens
gttatcttctcaagttctaagat

SEQ ID NO: 2457063 - DNA, 20 bp, Homo sapiens
gttatgaaattcaccccctt

SEQ ID NO: 2457064 - DNA, 21 bp, Homo sapiens
gttattaactttaatgttttt

SEQ ID NO: 2457065 - DNA, 22 bp, Homo sapiens
gttattggtgtaaggtactttc

SEQ ID NO: 2457066 - DNA, 22 bp, Homo sapiens
gttatttgaaaacatgtttatt

SEQ ID NO: 2457067 - DNA, 18 bp, Homo sapiens
gttattttgatgtaaaga

SEQ ID NO: 2457068 - DNA, 22 bp, Homo sapiens
gttcaacaaagaaacaaagatg

SEQ ID NO: 2457069 - DNA, 16 bp, Homo sapiens
gttcaagaaataagtt

SEQ ID NO: 2457070 - DNA, 17 bp, Homo sapiens
gttcaagcgattctctt

SEQ ID NO: 2457071 - DNA, 16 bp, Homo sapiens
gttcacaccagagaac

SEQ ID NO: 2457072 - DNA, 17 bp, Homo sapiens
gttcaccattataatga

SEQ ID NO: 2457073 - DNA, 12 bp, Homo sapiens
gttcagaattta

SEQ ID NO: 2457074 - DNA, 22 bp, Homo sapiens
gttcagcactgtcccttgcctc

SEQ ID NO: 2457075 - DNA, 15 bp, Homo sapiens
gttcagccaaggttt

SEQ ID NO: 2457076 - DNA, 13 bp, Homo sapiens
gttcatagcccag

SEQ ID NO: 2457077 - DNA, 14 bp, Homo sapiens
gttcatagcccagt

SEQ ID NO: 2457078 - DNA, 16 bp, Homo sapiens
gttcatgccaccatgg

SEQ ID NO: 2457079 - DNA, 16 bp, Homo sapiens
gttcattagaaatatt

SEQ ID NO: 2457080 - DNA, 18 bp, Homo sapiens
gttcattagaaatatttt

SEQ ID NO: 2457081 - DNA, 15 bp, Homo sapiens
gttccaaattcagtt

SEQ ID NO: 2457082 - DNA, 14 bp, Homo sapiens
gttccaagagtcta

SEQ ID NO: 2457083 - DNA, 18 bp, Homo sapiens
gttccaagagtctaaaga

SEQ ID NO: 2457084 - DNA, 12 bp, Homo sapiens
gttccacagacg

SEQ ID NO: 2457085 - DNA, 13 bp, Homo sapiens
gttccactgagac

SEQ ID NO: 2457086 - DNA, 19 bp, Homo sapiens
gttccacttatagcctctg

SEQ ID NO: 2457087 - DNA, 20 bp, Homo sapiens
gttcccagttggagctccag

SEQ ID NO: 2457088 - DNA, 12 bp, Homo sapiens
gttccccagaga

SEQ ID NO: 2457089 - DNA, 13 bp, Homo sapiens
gttccccttccac

SEQ ID NO: 2457090 - DNA, 16 bp, Homo sapiens
gttcccgtttctccac

SEQ ID NO: 2457091 - DNA, 18 bp, Homo sapiens
gttcccgtttctccacct

SEQ ID NO: 2457092 - DNA, 14 bp, Homo sapiens
gttccggcatggac

SEQ ID NO: 2457093 - DNA, 16 bp, Homo sapiens
gttcctcccctccagc

SEQ ID NO: 2457094 - DNA, 11 bp, Homo sapiens
gttcctgctgc

SEQ ID NO: 2457095 - DNA, 20 bp, Homo sapiens
gttccttccctgtgcctcct

SEQ ID NO: 2457096 - DNA, 13 bp, Homo sapiens
gttcgcagccacc

SEQ ID NO: 2457097 - DNA, 20 bp, Homo sapiens
gttcgcatggtcacacactg

SEQ ID NO: 2457098 - DNA, 16 bp, Homo sapiens
gttctaaaaggtgtga

SEQ ID NO: 2457099 - DNA, 10 bp, Homo sapiens
gttctaaagc

SEQ ID NO: 2457100 - DNA, 13 bp, Homo sapiens
gttctaaagttct

SEQ ID NO: 2457101 - DNA, 15 bp, Homo sapiens
gttctaaagttctaa

SEQ ID NO: 2457102 - DNA, 16 bp, Homo sapiens
gttctaaagttctaag

SEQ ID NO: 2457103 - DNA, 11 bp, Homo sapiens
gttctaaggcc

SEQ ID NO: 2457104 - DNA, 23 bp, Homo sapiens
gttctaaggcctaggattctaaa

SEQ ID NO: 2457105 - DNA, 11 bp, Homo sapiens
gttctaaggct

SEQ ID NO: 2457106 - DNA, 14 bp, Homo sapiens
gttctaaggctctg

SEQ ID NO: 2457107 - DNA, 17 bp, Homo sapiens
gttctaagtctttccat

SEQ ID NO: 2457108 - DNA, 16 bp, Homo sapiens
gttctaagtttctaag

SEQ ID NO: 2457109 - DNA, 21 bp, Homo sapiens
gttctaagtttctaagattct

SEQ ID NO: 2457110 - DNA, 21 bp, Homo sapiens
gtcgccctttgctgcatggca

SEQ ID NO: 2457111 - DNA, 12 bp, Homo sapiens
gtcgtaaagatt

SEQ ID NO: 2457112 - DNA, 17 bp, Homo sapiens
gtcgtccttactcctgt

SEQ ID NO: 2457113 - DNA, 12 bp, Homo sapiens
gtcgtgcctgtg

SEQ ID NO: 2457114 - DNA, 14 bp, Homo sapiens
gtcgtgcctgtgtc

SEQ ID NO: 2457115 - DNA, 15 bp, Homo sapiens
gtcgtgcctgtgtcc

SEQ ID NO: 2457116 - DNA, 20 bp, Homo sapiens
gtcgtggagagctaggagca

SEQ ID NO: 2457117 - DNA, 19 bp, Homo sapiens
gtcgtggggtgtgctggga

SEQ ID NO: 2457118 - DNA, 21 bp, Homo sapiens
gtcgttttttttttgtttgtt

SEQ ID NO: 2457119 - DNA, 20 bp, Homo sapiens
gtctaaagatggagtttcta

SEQ ID NO: 2457120 - DNA, 21 bp, Homo sapiens
gtctaaagctggtttaatgtt

SEQ ID NO: 2457121 - DNA, 12 bp, Homo sapiens
gtctaagattct

SEQ ID NO: 2457122 - DNA, 15 bp, Homo sapiens
gtctaagattctaga

SEQ ID NO: 2457123 - DNA, 11 bp, Homo sapiens
gtctagattca

SEQ ID NO: 2457124 - DNA, 20 bp, Homo sapiens
gtctagattcaaaggttcta

SEQ ID NO: 2457125 - DNA, 22 bp, Homo sapiens
gtctagattcaaaggttctagg

SEQ ID NO: 2457126 - DNA, 20 bp, Homo sapiens
gtctataaagcatttaaccc

SEQ ID NO: 2457127 - DNA, 22 bp, Homo sapiens
gtctcacttgtgcagtgttgac

SEQ ID NO: 2457128 - DNA, 14 bp, Homo sapiens
gtctcaggctgcct

SEQ ID NO: 2457129 - DNA, 15 bp, Homo sapiens
gtctcaggctgcctg

SEQ ID NO: 2457130 - DNA, 15 bp, Homo sapiens
gtctcagtgaagact

SEQ ID NO: 2457131 - DNA, 13 bp, Homo sapiens
gtctcatctgggg

SEQ ID NO: 2457132 - DNA, 22 bp, Homo sapiens
gtctcatgccagtaacaggctc

SEQ ID NO: 2457133 - DNA, 13 bp, Homo sapiens
gtctccagaaagc

SEQ ID NO: 2457134 - DNA, 15 bp, Homo sapiens
gtctccagaaagccc

SEQ ID NO: 2457135 - DNA, 23 bp, Homo sapiens
gtctccagaaagccccacccagg

SEQ ID NO: 2457136 - DNA, 22 bp, Homo sapiens
gtctccaggggctgcttcctcc

SEQ ID NO: 2457137 - DNA, 18 bp, Homo sapiens
gtctcccccaacagctgg

SEQ ID NO: 2457138 - DNA, 23 bp, Homo sapiens
gtctcccccaacagctggaccct

SEQ ID NO: 2457139 - DNA, 14 bp, Homo sapiens
gtctcgagcgccct

SEQ ID NO: 2457140 - DNA, 18 bp, Homo sapiens
gtctcgagcgccctgcag

SEQ ID NO: 2457141 - DNA, 20 bp, Homo sapiens
gtctcgagcgccctgcagac

SEQ ID NO: 2457142 - DNA, 20 bp, Homo sapiens
gtatctcagaaagtgcctga

SEQ ID NO: 2457143 - DNA, 22 bp, Homo sapiens
gtatctcagaaagtgcctgaca

SEQ ID NO: 2457144 - DNA, 17 bp, Homo sapiens
gtatgaaactaaagcct

SEQ ID NO: 2457145 - DNA, 16 bp, Homo sapiens
gtatgaagagtgttat

SEQ ID NO: 2457146 - DNA, 18 bp, Homo sapiens
gtatgaattattcaattt

SEQ ID NO: 2457147 - DNA, 19 bp, Homo sapiens
gtatgatcggcaggacacc

SEQ ID NO: 2457148 - DNA, 15 bp, Homo sapiens
gtatgcagggagctg

SEQ ID NO: 2457149 - DNA, 24 bp, Homo sapiens
gtatggcgtaagtacagagaagcc

SEQ ID NO: 2457150 - DNA, 16 bp, Homo sapiens
gtattaagaaaggaag

SEQ ID NO: 2457151 - DNA, 18 bp, Homo sapiens
gtattataccaaaatgtt

SEQ ID NO: 2457152 - DNA, 18 bp, Homo sapiens
gtattcaacaatttcaat

SEQ ID NO: 2457153 - DNA, 20 bp, Homo sapiens
gtattcaacaatttcaataa

SEQ ID NO: 2457154 - DNA, 18 bp, Homo sapiens
gtattctggggtatggcg

SEQ ID NO: 2457155 - DNA, 18 bp, Homo sapiens
gtattgcacattgtaaaa

SEQ ID NO: 2457156 - DNA, 20 bp, Homo sapiens
gtattggggttattttctgg

SEQ ID NO: 2457157 - DNA, 17 bp, Homo sapiens
gtattgtctgaacttgc

SEQ ID NO: 2457158 - DNA, 23 bp, Homo sapiens
gtattgtgcaatgtgtataaaca

SEQ ID NO: 2457159 - DNA, 13 bp, Homo sapiens
gtattgttgtcct

SEQ ID NO: 2457160 - DNA, 21 bp, Homo sapiens
gtatttaacagaaattgtata

SEQ ID NO: 2457161 - DNA, 14 bp, Homo sapiens
gtatttagaagcca

SEQ ID NO: 2457162 - DNA, 19 bp, Homo sapiens
gtatttattttttcttttc

SEQ ID NO: 2457163 - DNA, 12 bp, Homo sapiens
gtatttgctaat

SEQ ID NO: 2457164 - DNA, 20 bp, Homo sapiens
gtatttgggaagtgaagact

SEQ ID NO: 2457165 - DNA, 13 bp, Homo sapiens
gtatttgtaatta

SEQ ID NO: 2457166 - DNA, 17 bp, Homo sapiens
gtatttgttaatttaga

SEQ ID NO: 2457167 - DNA, 23 bp, Homo sapiens
gtattttaaaatagcgttcttgt

SEQ ID NO: 2457168 - DNA, 17 bp, Homo sapiens
gtattttcaatagccac

SEQ ID NO: 2457169 - DNA, 18 bp, Homo sapiens
gtattttgtattgtttca

SEQ ID NO: 2457170 - DNA, 19 bp, Homo sapiens
gtcaaaaagaaccacttgt

SEQ ID NO: 2457171 - DNA, 13 bp, Homo sapiens
gtcaaacttggat

SEQ ID NO: 2457172 - DNA, 17 bp, Homo sapiens
gtcaaacttggatactt

SEQ ID NO: 2457173 - DNA, 21 bp, Homo sapiens
gtcaaacttggatacttggat

SEQ ID NO: 2457174 - DNA, 22 bp, Homo sapiens
gtcaaatggtaggcatttccta

SEQ ID NO: 2457175 - DNA, 22 bp, Homo sapiens
gtcaacagttttcctatgcttt

SEQ ID NO: 2457176 - DNA, 17 bp, Homo sapiens
gtcaagtctctgctggc

SEQ ID NO: 2457177 - DNA, 11 bp, Homo sapiens
gtcaagttatt

SEQ ID NO: 2457178 - DNA, 20 bp, Homo sapiens
gtcaagttattaatttcttc

SEQ ID NO: 2457179 - DNA, 16 bp, Homo sapiens
gtcaatgcagttgtct

SEQ ID NO: 2457180 - DNA, 13 bp, Homo sapiens
gtcacacactgat

SEQ ID NO: 2457181 - DNA, 14 bp, Homo sapiens
gtcacataaaactt

SEQ ID NO: 2457182 - DNA, 22 bp, Homo sapiens
gtcaccaatgtacccaccgggc

SEQ ID NO: 2457183 - DNA, 13 bp, Homo sapiens
gtcacctgtgctt

SEQ ID NO: 2457184 - DNA, 15 bp, Homo sapiens
gtcacggccaggcag

SEQ ID NO: 2457185 - DNA, 13 bp, Homo sapiens
gtcactcaaggcg

SEQ ID NO: 2457186 - DNA, 17 bp, Homo sapiens
gtcactttttgaggcaa

SEQ ID NO: 2457187 - DNA, 19 bp, Homo sapiens
gtcactttttgaggcaaaa

SEQ ID NO: 2457188 - DNA, 16 bp, Homo sapiens
gtcagacgcctgagga

SEQ ID NO: 2457189 - DNA, 15 bp, Homo sapiens
gtcagcatgaatttg

SEQ ID NO: 2457190 - DNA, 23 bp, Homo sapiens
gtcaggattgcgagagatgtgtg

SEQ ID NO: 2457191 - DNA, 18 bp, Homo sapiens
gtcaggcactgggcatga

SEQ ID NO: 2457192 - DNA, 17 bp, Homo sapiens
gtcagggagtgttccct

SEQ ID NO: 2457193 - DNA, 16 bp, Homo sapiens
gtcagtaccttcaaac

SEQ ID NO: 2457194 - DNA, 22 bp, Homo sapiens
gtcagtaccttcaaactagggc

SEQ ID NO: 2457195 - DNA, 13 bp, Homo sapiens
gtcagtcacagcc

SEQ ID NO: 2457196 - DNA, 14 bp, Homo sapiens
gtcataattgcatt

SEQ ID NO: 2457197 - DNA, 16 bp, Homo sapiens
gtcataattgcattga

SEQ ID NO: 2457198 - DNA, 13 bp, Homo sapiens
gtcatacagagaa

SEQ ID NO: 2457199 - DNA, 16 bp, Homo sapiens
gtcataccaatgaaaa

SEQ ID NO: 2457200 - DNA, 15 bp, Homo sapiens
gtcataggttaatat

SEQ ID NO: 2457201 - DNA, 20 bp, Homo sapiens
gtcatcatcatggccagctg

SEQ ID NO: 2457202 - DNA, 15 bp, Homo sapiens
gtcatcttgctacca

SEQ ID NO: 2457203 - DNA, 22 bp, Homo sapiens
gtcatgaggagattctgccttt

SEQ ID NO: 2457204 - DNA, 24 bp, Homo sapiens
gtcatgcacagtatttgtaattaa

SEQ ID NO: 2457205 - DNA, 13 bp, Homo sapiens
gtcatgtgtataa

SEQ ID NO: 2457206 - DNA, 14 bp, Homo sapiens
gtcatgtgtataaa

SEQ ID NO: 2457207 - DNA, 21 bp, Homo sapiens
gtcattcgctactatgattta

SEQ ID NO: 2457208 - DNA, 18 bp, Homo sapiens
gtcattttggtactttgg

SEQ ID NO: 2457209 - DNA, 22 bp, Homo sapiens
tctggttgtttctgttccaaat

SEQ ID NO: 2457210 - DNA, 20 bp, Homo sapiens
tctgtaagaaacctactgcc

SEQ ID NO: 2457211 - DNA, 13 bp, Homo sapiens
tctgtaattgcaa

SEQ ID NO: 2457212 - DNA, 19 bp, Homo sapiens
tctgtaggttgcacacttt

SEQ ID NO: 2457213 - DNA, 23 bp, Homo sapiens
tctgtaggttgcacactttggta

SEQ ID NO: 2457214 - DNA, 15 bp, Homo sapiens
tctgtataaatgtct

SEQ ID NO: 2457215 - DNA, 20 bp, Homo sapiens
tctgtatcaggacccagagg

SEQ ID NO: 2457216 - DNA, 13 bp, Homo sapiens
tctgtcagctgca

SEQ ID NO: 2457217 - DNA, 14 bp, Homo sapiens
tctgtcagctgcaa

SEQ ID NO: 2457218 - DNA, 15 bp, Homo sapiens
tctgtccccagcctg

SEQ ID NO: 2457219 - DNA, 16 bp, Homo sapiens
tctgtccccagcctgg

SEQ ID NO: 2457220 - DNA, 23 bp, Homo sapiens
tctgtccctaggtgttttgttca

SEQ ID NO: 2457221 - DNA, 19 bp, Homo sapiens
tctgtcctcagccttgcca

SEQ ID NO: 2457222 - DNA, 15 bp, Homo sapiens
tctgtcctgccccca

SEQ ID NO: 2457223 - DNA, 17 bp, Homo sapiens
tctgtcgcccatgctgg

SEQ ID NO: 2457224 - DNA, 15 bp, Homo sapiens
tctgtctacttgctc

SEQ ID NO: 2457225 - DNA, 17 bp, Homo sapiens
tctgtctcatccatcat

SEQ ID NO: 2457226 - DNA, 18 bp, Homo sapiens
tctgtctgccaacctaaa

SEQ ID NO: 2457227 - DNA, 17 bp, Homo sapiens
tctgtgaaatgctggca

SEQ ID NO: 2457228 - DNA, 13 bp, Homo sapiens
tctgtgccagagc

SEQ ID NO: 2457229 - DNA, 18 bp, Homo sapiens
tctgtgccagagcctggg

SEQ ID NO: 2457230 - DNA, 23 bp, Homo sapiens
tctgtgccagagcctggggctct

SEQ ID NO: 2457231 - DNA, 23 bp, Homo sapiens
tctgtgggatgggatggtggagg

SEQ ID NO: 2457232 - DNA, 14 bp, Homo sapiens
tctgtgtctaagat

SEQ ID NO: 2457233 - DNA, 12 bp, Homo sapiens
tctgtgtcttgt

SEQ ID NO: 2457234 - DNA, 21 bp, Homo sapiens
tctgtgtctttcacagctcct

SEQ ID NO: 2457235 - DNA, 16 bp, Homo sapiens
tctgtgtgaaactttc

SEQ ID NO: 2457236 - DNA, 19 bp, Homo sapiens
tctgtgtgaaactttcatt

SEQ ID NO: 2457237 - DNA, 21 bp, Homo sapiens
tctgttaactgaataccactc

SEQ ID NO: 2457238 - DNA, 19 bp, Homo sapiens
tctgttacactttttggaa

SEQ ID NO: 2457239 - DNA, 20 bp, Homo sapiens
tctgttcaaagctgcctgtc

SEQ ID NO: 2457240 - DNA, 13 bp, Homo sapiens
tctgttctagttt

SEQ ID NO: 2457241 - DNA, 16 bp, Homo sapiens
tctgttgcaagtgcaa

SEQ ID NO: 2457242 - DNA, 23 bp, Homo sapiens
tctgttgtcgtaaagatttgggt

SEQ ID NO: 2457243 - DNA, 23 bp, Homo sapiens
tctgtttcaaggcactctagatt

SEQ ID NO: 2457244 - DNA, 20 bp, Homo sapiens
tctgtttcttaagggcacac

SEQ ID NO: 2457245 - DNA, 17 bp, Homo sapiens
tctgttttgaaggcaaa

SEQ ID NO: 2457246 - DNA, 21 bp, Homo sapiens
tctgttttgtttcgctctttg

SEQ ID NO: 2457247 - DNA, 18 bp, Homo sapiens
tcttaaagtattcttctc

SEQ ID NO: 2457248 - DNA, 15 bp, Homo sapiens
tcttaaataagaaac

SEQ ID NO: 2457249 - DNA, 16 bp, Homo sapiens
tcttaacttcttgctt

SEQ ID NO: 2457250 - DNA, 20 bp, Homo sapiens
tcttaattattatttgtgtt

SEQ ID NO: 2457251 - DNA, 12 bp, Homo sapiens
tcttagattctc

SEQ ID NO: 2457252 - DNA, 18 bp, Homo sapiens
tcttagctcaatgagcat

SEQ ID NO: 2457253 - DNA, 21 bp, Homo sapiens
tcttagctcaatgagcatgtt

SEQ ID NO: 2457254 - DNA, 21 bp, Homo sapiens
tcttataattgttctcagaat

SEQ ID NO: 2457255 - DNA, 18 bp, Homo sapiens
tcttatggatgtccccag

SEQ ID NO: 2457256 - DNA, 19 bp, Homo sapiens
tcttatggatgtccccagc

SEQ ID NO: 2457257 - DNA, 16 bp, Homo sapiens
tcttatttttttctat

SEQ ID NO: 2457258 - DNA, 17 bp, Homo sapiens
tcttcaagcctgggcgt

SEQ ID NO: 2457259 - DNA, 14 bp, Homo sapiens
tcttcagaggccct

SEQ ID NO: 2457260 - DNA, 15 bp, Homo sapiens
tcttcagaggccctc

SEQ ID NO: 2457261 - DNA, 17 bp, Homo sapiens
tcttcagttgtctctga

SEQ ID NO: 2457262 - DNA, 19 bp, Homo sapiens
tcttccccagacgcctggc

SEQ ID NO: 2457263 - DNA, 14 bp, Homo sapiens
tcttcccccaccac

SEQ ID NO: 2457264 - DNA, 17 bp, Homo sapiens
tcttcctacctatccca

SEQ ID NO: 2457265 - DNA, 13 bp, Homo sapiens
tcttcctcagcca

SEQ ID NO: 2457266 - DNA, 14 bp, Homo sapiens
tcttcctgagtggt

SEQ ID NO: 2457267 - DNA, 22 bp, Homo sapiens
tcttcctggccgcctgggtcca

SEQ ID NO: 2457268 - DNA, 22 bp, Homo sapiens
tcttccttgaagaactgcaggc

SEQ ID NO: 2457269 - DNA, 23 bp, Homo sapiens
tcttccttgaagaactgcaggcc

SEQ ID NO: 2457270 - DNA, 14 bp, Homo sapiens
tcttctagagttca

SEQ ID NO: 2457271 - DNA, 11 bp, Homo sapiens
tcttctcaagt

SEQ ID NO: 2457272 - DNA, 21 bp, Homo sapiens
tcttctcaagttctaagattc

SEQ ID NO: 2457273 - DNA, 23 bp, Homo sapiens
tcttctcaagttctaagattcta

SEQ ID NO: 2457274 - DNA, 21 bp, Homo sapiens
tcttctcttccttttatcagt

SEQ ID NO: 2457275 - DNA, 20 bp, Homo sapiens
tcttctgggagggcagcagg

SEQ ID NO: 2457276 - DNA, 23 bp, Homo sapiens
tcttctgggagggcagcagggct

SEQ ID NO: 2457277 - DNA, 18 bp, Homo sapiens
tcttctggggcaggctgg

SEQ ID NO: 2457278 - DNA, 14 bp, Homo sapiens
tcttcttcaccatt

SEQ ID NO: 2457279 - DNA, 21 bp, Homo sapiens
tcttgaaattaagaaggcaaa

SEQ ID NO: 2457280 - DNA, 22 bp, Homo sapiens
tcttgaaattaagaaggcaaaa

SEQ ID NO: 2457281 - DNA, 13 bp, Homo sapiens
tcttgaaggtgct

SEQ ID NO: 2457282 - DNA, 13 bp, Homo sapiens
tcttgaatttaat

SEQ ID NO: 2457283 - DNA, 16 bp, Homo sapiens
tcttgactacagtcag

SEQ ID NO: 2457284 - DNA, 22 bp, Homo sapiens
tcttgagcagtggctggtccag

SEQ ID NO: 2457285 - DNA, 15 bp, Homo sapiens
tcttgaggggaccag

SEQ ID NO: 2457286 - DNA, 17 bp, Homo sapiens
tcttgaggggaccagga

SEQ ID NO: 2457287 - DNA, 23 bp, Homo sapiens
tcttgattatccatattgagtca

SEQ ID NO: 2457288 - DNA, 23 bp, Homo sapiens
tcttgcaggaaggactatgaaaa

SEQ ID NO: 2457289 - DNA, 12 bp, Homo sapiens
tcttgcatgtaa

SEQ ID NO: 2457290 - DNA, 15 bp, Homo sapiens
tcttgcattatgcaa

SEQ ID NO: 2457291 - DNA, 18 bp, Homo sapiens
tcttgcctgccactgtgt

SEQ ID NO: 2457292 - DNA, 14 bp, Homo sapiens
tcttgctaccagta

SEQ ID NO: 2457293 - DNA, 20 bp, Homo sapiens
tcttgctaccagtatttaga

SEQ ID NO: 2457294 - DNA, 18 bp, Homo sapiens
tcttgcttctttctagaa

SEQ ID NO: 2457295 - DNA, 20 bp, Homo sapiens
tcttgcttggggaacttgtg

SEQ ID NO: 2457296 - DNA, 16 bp, Homo sapiens
tcttggagaagtctca

SEQ ID NO: 2457297 - DNA, 21 bp, Homo sapiens
tcttgggcagagctggctctg

SEQ ID NO: 2457298 - DNA, 20 bp, Homo sapiens
tcttggttttccctttgcct

SEQ ID NO: 2457299 - DNA, 19 bp, Homo sapiens
tcttgtaattttacacgct

SEQ ID NO: 2457300 - DNA, 16 bp, Homo sapiens
tcttgtctataaagca

SEQ ID NO: 2457301 - DNA, 12 bp, Homo sapiens
tcttgtctttat

SEQ ID NO: 2457302 - DNA, 14 bp, Homo sapiens
tcttgtgcactggc

SEQ ID NO: 2457303 - DNA, 15 bp, Homo sapiens
tcttgtgtgtatgca

SEQ ID NO: 2457304 - DNA, 22 bp, Homo sapiens
tcttgtgtttccacagcctgca

SEQ ID NO: 2457305 - DNA, 14 bp, Homo sapiens
tctttaaagttctt

SEQ ID NO: 2457306 - DNA, 23 bp, Homo sapiens
tctttaactcccattaccatgta

SEQ ID NO: 2457307 - DNA, 22 bp, Homo sapiens
tctttaactgccgtaatttaac

SEQ ID NO: 2457308 - DNA, 20 bp, Homo sapiens
tctttagatagccctgtcct

SEQ ID NO: 2457309 - DNA, 12 bp, Homo sapiens
tctttataagaa

SEQ ID NO: 2457310 - DNA, 15 bp, Homo sapiens
tctttataagaaagc

SEQ ID NO: 2457311 - DNA, 19 bp, Homo sapiens
tctttataagaaagcctga

SEQ ID NO: 2457312 - DNA, 11 bp, Homo sapiens
tctttcaaaac

SEQ ID NO: 2457313 - DNA, 20 bp, Homo sapiens
tctgagtcagagccatgtct

SEQ ID NO: 2457314 - DNA, 13 bp, Homo sapiens
tctgagtcctgga

SEQ ID NO: 2457315 - DNA, 19 bp, Homo sapiens
tctgataagagaatcaaca

SEQ ID NO: 2457316 - DNA, 21 bp, Homo sapiens
tctgatagggtttgtgacagg

SEQ ID NO: 2457317 - DNA, 17 bp, Homo sapiens
tctgatcagaacaaatg

SEQ ID NO: 2457318 - DNA, 13 bp, Homo sapiens
tctgattttagga

SEQ ID NO: 2457319 - DNA, 22 bp, Homo sapiens
tctgattttaggagctaaggct

SEQ ID NO: 2457320 - DNA, 22 bp, Homo sapiens
tctgcaagtatactagggagcc

SEQ ID NO: 2457321 - DNA, 14 bp, Homo sapiens
tctgcaattcaaaa

SEQ ID NO: 2457322 - DNA, 16 bp, Homo sapiens
tctgcaattcccctct

SEQ ID NO: 2457323 - DNA, 21 bp, Homo sapiens
tctgcactactgacatgtggg

SEQ ID NO: 2457324 - DNA, 19 bp, Homo sapiens
tctgcagacttcccagcta

SEQ ID NO: 2457325 - DNA, 11 bp, Homo sapiens
tctgcagcctc

SEQ ID NO: 2457326 - DNA, 15 bp, Homo sapiens
tctgcagtaaatctt

SEQ ID NO: 2457327 - DNA, 15 bp, Homo sapiens
tctgcatatgttgaa

SEQ ID NO: 2457328 - DNA, 14 bp, Homo sapiens
tctgcatcctctgg

SEQ ID NO: 2457329 - DNA, 19 bp, Homo sapiens
tctgcatcctctggagcca

SEQ ID NO: 2457330 - DNA, 23 bp, Homo sapiens
tctgccagggcccctctccccag

SEQ ID NO: 2457331 - DNA, 13 bp, Homo sapiens
tctgccagtgaca

SEQ ID NO: 2457332 - DNA, 15 bp, Homo sapiens
tctgccccctgcaga

SEQ ID NO: 2457333 - DNA, 21 bp, Homo sapiens
tctgccctctgcatcctctgg

SEQ ID NO: 2457334 - DNA, 14 bp, Homo sapiens
tctgccctgcccac

SEQ ID NO: 2457335 - DNA, 19 bp, Homo sapiens
tctgcctcttctgggaggg

SEQ ID NO: 2457336 - DNA, 17 bp, Homo sapiens
tctgcctgccagctgca

SEQ ID NO: 2457337 - DNA, 21 bp, Homo sapiens
tctgcctgccagctgcactga

SEQ ID NO: 2457338 - DNA, 22 bp, Homo sapiens
tctgcctgccagctgcactgat

SEQ ID NO: 2457339 - DNA, 19 bp, Homo sapiens
tctgcgtgtcacctgtgct

SEQ ID NO: 2457340 - DNA, 14 bp, Homo sapiens
tctgctcatcattc

SEQ ID NO: 2457341 - DNA, 22 bp, Homo sapiens
tctgctcccctaaagcctcaaa

SEQ ID NO: 2457342 - DNA, 12 bp, Homo sapiens
tctgctcctgga

SEQ ID NO: 2457343 - DNA, 12 bp, Homo sapiens
tctgctccttcc

SEQ ID NO: 2457344 - DNA, 15 bp, Homo sapiens
tctgctccttcccca

SEQ ID NO: 2457345 - DNA, 13 bp, Homo sapiens
tctgctctgatgc

SEQ ID NO: 2457346 - DNA, 21 bp, Homo sapiens
tctgctctgcgtgtcacctgt

SEQ ID NO: 2457347 - DNA, 15 bp, Homo sapiens
tctgctctttctctg

SEQ ID NO: 2457348 - DNA, 16 bp, Homo sapiens
tctgctctttctctgc

SEQ ID NO: 2457349 - DNA, 18 bp, Homo sapiens
tctgctctttctctgcca

SEQ ID NO: 2457350 - DNA, 18 bp, Homo sapiens
tctgctgacctgctgacc

SEQ ID NO: 2457351 - DNA, 19 bp, Homo sapiens
tctgctgacctgctgacct

SEQ ID NO: 2457352 - DNA, 18 bp, Homo sapiens
tctgctgctgtccctccc

SEQ ID NO: 2457353 - DNA, 12 bp, Homo sapiens
tctgctggccca

SEQ ID NO: 2457354 - DNA, 14 bp, Homo sapiens
tctgctggcctctg

SEQ ID NO: 2457355 - DNA, 17 bp, Homo sapiens
tctgctggcctctgcga

SEQ ID NO: 2457356 - DNA, 16 bp, Homo sapiens
tctgctggggcctggg

SEQ ID NO: 2457357 - DNA, 23 bp, Homo sapiens
tctgctggggcctgggacaactg

SEQ ID NO: 2457358 - DNA, 12 bp, Homo sapiens
tctgctgtagaa

SEQ ID NO: 2457359 - DNA, 14 bp, Homo sapiens
tctgctgttccagt

SEQ ID NO: 2457360 - DNA, 15 bp, Homo sapiens
tctgctgttccagtg

SEQ ID NO: 2457361 - DNA, 15 bp, Homo sapiens
tctggaacccagact

SEQ ID NO: 2457362 - DNA, 23 bp, Homo sapiens
tctggaacccagactcagacatt

SEQ ID NO: 2457363 - DNA, 19 bp, Homo sapiens
tctggaacctcagcctggc

SEQ ID NO: 2457364 - DNA, 21 bp, Homo sapiens
tctggaacctcagcctggcca

SEQ ID NO: 2457365 - DNA, 23 bp, Homo sapiens
tctggaacctcagcctggccaga

SEQ ID NO: 2457366 - DNA, 15 bp, Homo sapiens
tctggaagatgggga

SEQ ID NO: 2457367 - DNA, 16 bp, Homo sapiens
tctggaatgtaatcaa

SEQ ID NO: 2457368 - DNA, 18 bp, Homo sapiens
tctggacagccccaccct

SEQ ID NO: 2457369 - DNA, 15 bp, Homo sapiens
tctggacctctgggt

SEQ ID NO: 2457370 - DNA, 20 bp, Homo sapiens
tctggagaccaccagggcat

SEQ ID NO: 2457371 - DNA, 14 bp, Homo sapiens
tctggagagaacag

SEQ ID NO: 2457372 - DNA, 14 bp, Homo sapiens
tctggaggggaggg

SEQ ID NO: 2457373 - DNA, 18 bp, Homo sapiens
tctggataacttccacag

SEQ ID NO: 2457374 - DNA, 19 bp, Homo sapiens
tctggattattctgggggc

SEQ ID NO: 2457375 - DNA, 20 bp, Homo sapiens
tctggattccccatctcagg

SEQ ID NO: 2457376 - DNA, 15 bp, Homo sapiens
tctggcaatgccaca

SEQ ID NO: 2457377 - DNA, 22 bp, Homo sapiens
tctggcaatgccacagccctgt

SEQ ID NO: 2457378 - DNA, 23 bp, Homo sapiens
tctggcaatgccacagccctgtc

SEQ ID NO: 2457379 - DNA, 23 bp, Homo sapiens
tctggcagccacacttctcagga

SEQ ID NO: 2457380 - DNA, 21 bp, Homo sapiens
tctggcagcctcccatccagg

SEQ ID NO: 2457381 - DNA, 16 bp, Homo sapiens
tctggccaggaagctt

SEQ ID NO: 2457382 - DNA, 21 bp, Homo sapiens
tctggccagtgtttaaaactt

SEQ ID NO: 2457383 - DNA, 15 bp, Homo sapiens
tctggctctaattca

SEQ ID NO: 2457384 - DNA, 16 bp, Homo sapiens
tctggctctaattcac

SEQ ID NO: 2457385 - DNA, 22 bp, Homo sapiens
tctggctctaattcacagtgct

SEQ ID NO: 2457386 - DNA, 23 bp, Homo sapiens
tctcccaggccccatgacctcca

SEQ ID NO: 2457387 - DNA, 23 bp, Homo sapiens
tctcccattttggaatttgcctg

SEQ ID NO: 2457388 - DNA, 14 bp, Homo sapiens
tctccccagcccag

SEQ ID NO: 2457389 - DNA, 18 bp, Homo sapiens
tctccccagcccagagac

SEQ ID NO: 2457390 - DNA, 19 bp, Homo sapiens
tctccccaggtccagctct

SEQ ID NO: 2457391 - DNA, 20 bp, Homo sapiens
tctccccaggtccagctctg

SEQ ID NO: 2457392 - DNA, 22 bp, Homo sapiens
tctccccaggtccagctctgga

SEQ ID NO: 2457393 - DNA, 17 bp, Homo sapiens
tctcccccaacagctgg

SEQ ID NO: 2457394 - DNA, 21 bp, Homo sapiens
tctcccccaacagctggaccc

SEQ ID NO: 2457395 - DNA, 13 bp, Homo sapiens
tctcccctgcact

SEQ ID NO: 2457396 - DNA, 14 bp, Homo sapiens
tctcccctgcactg

SEQ ID NO: 2457397 - DNA, 15 bp, Homo sapiens
tctcccctgcactgt

SEQ ID NO: 2457398 - DNA, 21 bp, Homo sapiens
tctcccctgccccctgcagga

SEQ ID NO: 2457399 - DNA, 18 bp, Homo sapiens
tctccctcccctgccatt

SEQ ID NO: 2457400 - DNA, 15 bp, Homo sapiens
tctccctgcctcctg

SEQ ID NO: 2457401 - DNA, 16 bp, Homo sapiens
tctccctggtgcttat

SEQ ID NO: 2457402 - DNA, 16 bp, Homo sapiens
tctcccttgggctctg

SEQ ID NO: 2457403 - DNA, 18 bp, Homo sapiens
tctcccttgggctctgat

SEQ ID NO: 2457404 - DNA, 16 bp, Homo sapiens
tctccgttagctcctg

SEQ ID NO: 2457405 - DNA, 20 bp, Homo sapiens
tctccgttagctcctgtggc

SEQ ID NO: 2457406 - DNA, 23 bp, Homo sapiens
tctccgttagctcctgtggcccc

SEQ ID NO: 2457407 - DNA, 23 bp, Homo sapiens
tctcctaagcacctgtaatgtgc

SEQ ID NO: 2457408 - DNA, 21 bp, Homo sapiens
tctcctaggcattctggacct

SEQ ID NO: 2457409 - DNA, 16 bp, Homo sapiens
tctcctgccttcctcc

SEQ ID NO: 2457410 - DNA, 17 bp, Homo sapiens
tctcctgccttcctcct

SEQ ID NO: 2457411 - DNA, 20 bp, Homo sapiens
tctcctgccttcctcctggg

SEQ ID NO: 2457412 - DNA, 14 bp, Homo sapiens
tctcctgctgctcc

SEQ ID NO: 2457413 - DNA, 19 bp, Homo sapiens
tctcctgctgctccctcag

SEQ ID NO: 2457414 - DNA, 21 bp, Homo sapiens
tctcctgctgctccctcagac

SEQ ID NO: 2457415 - DNA, 12 bp, Homo sapiens
tctcctggcttc

SEQ ID NO: 2457416 - DNA, 15 bp, Homo sapiens
tctcctggcttccca

SEQ ID NO: 2457417 - DNA, 18 bp, Homo sapiens
tctcgagcgccctgcaga

SEQ ID NO: 2457418 - DNA, 17 bp, Homo sapiens
tctcgatgcaatgaaca

SEQ ID NO: 2457419 - DNA, 23 bp, Homo sapiens
tctcgcataggacctttccacca

SEQ ID NO: 2457420 - DNA, 18 bp, Homo sapiens
tctcggccttcacaatct

SEQ ID NO: 2457421 - DNA, 21 bp, Homo sapiens
tctctacagtctcgtctcttt

SEQ ID NO: 2457422 - DNA, 16 bp, Homo sapiens
tctctaccttctcccc

SEQ ID NO: 2457423 - DNA, 18 bp, Homo sapiens
tctctaccttctccccag

SEQ ID NO: 2457424 - DNA, 13 bp, Homo sapiens
tctctatgcctct

SEQ ID NO: 2457425 - DNA, 23 bp, Homo sapiens
tctctcactccctccctttctat

SEQ ID NO: 2457426 - DNA, 21 bp, Homo sapiens
tctctccctcccctgccattt

SEQ ID NO: 2457427 - DNA, 16 bp, Homo sapiens
tctctctgcccaaccc

SEQ ID NO: 2457428 - DNA, 16 bp, Homo sapiens
tctctctttatacagc

SEQ ID NO: 2457429 - DNA, 19 bp, Homo sapiens
tctctgacttctgcctgga

SEQ ID NO: 2457430 - DNA, 14 bp, Homo sapiens
tctctgagcagtga

SEQ ID NO: 2457431 - DNA, 15 bp, Homo sapiens
tctctgagctgtgca

SEQ ID NO: 2457432 - DNA, 16 bp, Homo sapiens
tctctgagctgtgcag

SEQ ID NO: 2457433 - DNA, 15 bp, Homo sapiens
tctctgcagacttcc

SEQ ID NO: 2457434 - DNA, 21 bp, Homo sapiens
tctctgccagtgacagacagg

SEQ ID NO: 2457435 - DNA, 22 bp, Homo sapiens
tctctgctctgcgtgtcacctg

SEQ ID NO: 2457436 - DNA, 12 bp, Homo sapiens
tctctgctggcc

SEQ ID NO: 2457437 - DNA, 16 bp, Homo sapiens
tctctgggctggatga

SEQ ID NO: 2457438 - DNA, 20 bp, Homo sapiens
tctctgggctggatgagctc

SEQ ID NO: 2457439 - DNA, 16 bp, Homo sapiens
tctctgggggctgagg

SEQ ID NO: 2457440 - DNA, 14 bp, Homo sapiens
tctctgtctcatcc

SEQ ID NO: 2457441 - DNA, 20 bp, Homo sapiens
tctctgtgtctaagattcta

SEQ ID NO: 2457442 - DNA, 22 bp, Homo sapiens
tctctgtgtctaagattctaga

SEQ ID NO: 2457443 - DNA, 23 bp, Homo sapiens
tctctgtgtctaagattctagat

SEQ ID NO: 2457444 - DNA, 19 bp, Homo sapiens
tctcttcatttttttttca

SEQ ID NO: 2457445 - DNA, 20 bp, Homo sapiens
tctcttccttttatcagtag

SEQ ID NO: 2457446 - DNA, 14 bp, Homo sapiens
tctcttctctccag

SEQ ID NO: 2457447 - DNA, 15 bp, Homo sapiens
tctcttctctccagc

SEQ ID NO: 2457448 - DNA, 23 bp, Homo sapiens
tctcttctctccagctgactaaa

SEQ ID NO: 2457449 - DNA, 13 bp, Homo sapiens
tctcttgcctcaa

SEQ ID NO: 2457450 - DNA, 21 bp, Homo sapiens
tctcttgcctcaacctcccaa

SEQ ID NO: 2457451 - DNA, 19 bp, Homo sapiens
tctctttatgtctgtggat

SEQ ID NO: 2457452 - DNA, 14 bp, Homo sapiens
tctctttccctggt

SEQ ID NO: 2457453 - DNA, 18 bp, Homo sapiens
tctcttttgctttctgtt

SEQ ID NO: 2457454 - DNA, 20 bp, Homo sapiens
tctgaaaagtgaagacagaa

SEQ ID NO: 2457455 - DNA, 13 bp, Homo sapiens
tctgaaatgaaga

SEQ ID NO: 2457456 - DNA, 14 bp, Homo sapiens
tctgaaatttttct

SEQ ID NO: 2457457 - DNA, 17 bp, Homo sapiens
tctgaaatttttcttct

SEQ ID NO: 2457458 - DNA, 16 bp, Homo sapiens
tctgaacagctggtgt

SEQ ID NO: 2457459 - DNA, 17 bp, Homo sapiens
tctgaacagctggtgta

SEQ ID NO: 2457460 - DNA, 13 bp, Homo sapiens
tctgaactaaagt

SEQ ID NO: 2457461 - DNA, 19 bp, Homo sapiens
tctgaatgcttctaagtaa

SEQ ID NO: 2457462 - DNA, 16 bp, Homo sapiens
tctgaatttttaaaca

SEQ ID NO: 2457463 - DNA, 13 bp, Homo sapiens
tctgacagcagca

SEQ ID NO: 2457464 - DNA, 17 bp, Homo sapiens
tctgacagcagcatctc

SEQ ID NO: 2457465 - DNA, 12 bp, Homo sapiens
tctgacagcctc

SEQ ID NO: 2457466 - DNA, 11 bp, Homo sapiens
tctgacccagt

SEQ ID NO: 2457467 - DNA, 14 bp, Homo sapiens
tctgacccagtgcc

SEQ ID NO: 2457468 - DNA, 14 bp, Homo sapiens
tctgactcagggct

SEQ ID NO: 2457469 - DNA, 15 bp, Homo sapiens
tctgactcagggctc

SEQ ID NO: 2457470 - DNA, 19 bp, Homo sapiens
tctgactcggtttctccaa

SEQ ID NO: 2457471 - DNA, 12 bp, Homo sapiens
tctgacttctgc

SEQ ID NO: 2457472 - DNA, 14 bp, Homo sapiens
tctgacttctgcct

SEQ ID NO: 2457473 - DNA, 20 bp, Homo sapiens
tctgacttctgcctggagac

SEQ ID NO: 2457474 - DNA, 16 bp, Homo sapiens
tctgagaggccctgga

SEQ ID NO: 2457475 - DNA, 17 bp, Homo sapiens
tctgagaggccctggat

SEQ ID NO: 2457476 - DNA, 16 bp, Homo sapiens
tctgagagtctagatt

SEQ ID NO: 2457477 - DNA, 17 bp, Homo sapiens
tctgagagtctagattc

SEQ ID NO: 2457478 - DNA, 22 bp, Homo sapiens
tctgagatctgttgattgatga

SEQ ID NO: 2457479 - DNA, 18 bp, Homo sapiens
tctgagatggctcccagg

SEQ ID NO: 2457480 - DNA, 22 bp, Homo sapiens
tctgagcactgtttatacactg

SEQ ID NO: 2457481 - DNA, 21 bp, Homo sapiens
tctgagcagcgagcctgctag

SEQ ID NO: 2457482 - DNA, 13 bp, Homo sapiens
tctgagctccagc

SEQ ID NO: 2457483 - DNA, 20 bp, Homo sapiens
tctgagctcctgtcccctgc

SEQ ID NO: 2457484 - DNA, 10 bp, Homo sapiens
tctgagctgt

SEQ ID NO: 2457485 - DNA, 19 bp, Homo sapiens
tctgagctgtcaacgagac

SEQ ID NO: 2457486 - DNA, 14 bp, Homo sapiens
tctgaggacaagag

SEQ ID NO: 2457487 - DNA, 15 bp, Homo sapiens
tctgaggccagcctg

SEQ ID NO: 2457488 - DNA, 18 bp, Homo sapiens
tctgaggccagcctggcc

SEQ ID NO: 2457489 - DNA, 21 bp, Homo sapiens
tctgaggcgccccaacccgtg

SEQ ID NO: 2457490 - DNA, 16 bp, Homo sapiens
tctgaggtgcactggg

SEQ ID NO: 2457491 - DNA, 13 bp, Homo sapiens
tccatttctaatt

SEQ ID NO: 2457492 - DNA, 12 bp, Homo sapiens
tccatttgcatt

SEQ ID NO: 2457493 - DNA, 15 bp, Homo sapiens
tccatttgcatttgt

SEQ ID NO: 2457494 - DNA, 16 bp, Homo sapiens
tccatttgcatttgtt

SEQ ID NO: 2457495 - DNA, 13 bp, Homo sapiens
tcccaaagtgctg

SEQ ID NO: 2457496 - DNA, 18 bp, Homo sapiens
tcccaaagtgctgagatt

SEQ ID NO: 2457497 - DNA, 22 bp, Homo sapiens
tcccaaatttgattgatttgaa

SEQ ID NO: 2457498 - DNA, 17 bp, Homo sapiens
tcccaagcggtgtctct

SEQ ID NO: 2457499 - DNA, 17 bp, Homo sapiens
tcccaaggggcctgagc

SEQ ID NO: 2457500 - DNA, 17 bp, Homo sapiens
tcccaagtagaatctca

SEQ ID NO: 2457501 - DNA, 19 bp, Homo sapiens
tcccaagtagaatctcagt

SEQ ID NO: 2457502 - DNA, 21 bp, Homo sapiens
tcccaagtgagtctctctggg

SEQ ID NO: 2457503 - DNA, 14 bp, Homo sapiens
tcccacaagcctct

SEQ ID NO: 2457504 - DNA, 21 bp, Homo sapiens
tcccacaagcctgagggaaag

SEQ ID NO: 2457505 - DNA, 18 bp, Homo sapiens
tcccacaggacatttctc

SEQ ID NO: 2457506 - DNA, 21 bp, Homo sapiens
tcccacaggacatttctctaa

SEQ ID NO: 2457507 - DNA, 23 bp, Homo sapiens
tcccacatccctgggcctgctgc

SEQ ID NO: 2457508 - DNA, 15 bp, Homo sapiens
tcccacattaaagaa

SEQ ID NO: 2457509 - DNA, 22 bp, Homo sapiens
tcccacattaaagaagacctga

SEQ ID NO: 2457510 - DNA, 20 bp, Homo sapiens
tcccaccccaacctgctctc

SEQ ID NO: 2457511 - DNA, 20 bp, Homo sapiens
tcccacccccacccccagct

SEQ ID NO: 2457512 - DNA, 12 bp, Homo sapiens
tcccaccctctt

SEQ ID NO: 2457513 - DNA, 21 bp, Homo sapiens
tcccaccctcttcctactggt

SEQ ID NO: 2457514 - DNA, 17 bp, Homo sapiens
tcccacctagcagcacc

SEQ ID NO: 2457515 - DNA, 15 bp, Homo sapiens
tcccagagcacctgc

SEQ ID NO: 2457516 - DNA, 20 bp, Homo sapiens
tcccagaggagccaccagtt

SEQ ID NO: 2457517 - DNA, 15 bp, Homo sapiens
tcccagccccctgac

SEQ ID NO: 2457518 - DNA, 20 bp, Homo sapiens
tcccagctaggaagagcagg

SEQ ID NO: 2457519 - DNA, 12 bp, Homo sapiens
tcccagctgcct

SEQ ID NO: 2457520 - DNA, 17 bp, Homo sapiens
tcccaggaccacaggct

SEQ ID NO: 2457521 - DNA, 13 bp, Homo sapiens
tcccaggaccctg

SEQ ID NO: 2457522 - DNA, 13 bp, Homo sapiens
tcccaggcaaggc

SEQ ID NO: 2457523 - DNA, 19 bp, Homo sapiens
tcccaggcccactgtgcct

SEQ ID NO: 2457524 - DNA, 11 bp, Homo sapiens
tcccaggcccc

SEQ ID NO: 2457525 - DNA, 23 bp, Homo sapiens
tcccaggccccatgacctccagc

SEQ ID NO: 2457526 - DNA, 18 bp, Homo sapiens
tcccaggggctccctccg

SEQ ID NO: 2457527 - DNA, 19 bp, Homo sapiens
tcccagggttttaactttg

SEQ ID NO: 2457528 - DNA, 15 bp, Homo sapiens
tcccatccccagcga

SEQ ID NO: 2457529 - DNA, 16 bp, Homo sapiens
tcccatcctgtgtgtt

SEQ ID NO: 2457530 - DNA, 13 bp, Homo sapiens
tcccatctgcttc

SEQ ID NO: 2457531 - DNA, 19 bp, Homo sapiens
tcccatgatccctgtgttg

SEQ ID NO: 2457532 - DNA, 10 bp, Homo sapiens
tcccatgtgg

SEQ ID NO: 2457533 - DNA, 17 bp, Homo sapiens
tcccattcctgaagaac

SEQ ID NO: 2457534 - DNA, 18 bp, Homo sapiens
tcccattttggaatttgc

SEQ ID NO: 2457535 - DNA, 15 bp, Homo sapiens
tccccaacagcgccc

SEQ ID NO: 2457536 - DNA, 16 bp, Homo sapiens
tccccaccagatgctg

SEQ ID NO: 2457537 - DNA, 15 bp, Homo sapiens
tccccacgagggctg

SEQ ID NO: 2457538 - DNA, 17 bp, Homo sapiens
tccccacgagggctggc

SEQ ID NO: 2457539 - DNA, 16 bp, Homo sapiens
tccccactctgctctg

SEQ ID NO: 2457540 - DNA, 18 bp, Homo sapiens
tccccactctgctctgat

SEQ ID NO: 2457541 - DNA, 15 bp, Homo sapiens
tccccagacttgttg

SEQ ID NO: 2457542 - DNA, 10 bp, Homo sapiens
tccccagaga

SEQ ID NO: 2457543 - DNA, 20 bp, Homo sapiens
tccccagcattccagcccct

SEQ ID NO: 2457544 - DNA, 12 bp, Homo sapiens
tccccagcccag

SEQ ID NO: 2457545 - DNA, 14 bp, Homo sapiens
tccccagcctggga

SEQ ID NO: 2457546 - DNA, 15 bp, Homo sapiens
tccccagctcccagg

SEQ ID NO: 2457547 - DNA, 16 bp, Homo sapiens
tccccaggcacctcac

SEQ ID NO: 2457548 - DNA, 17 bp, Homo sapiens
tccccagggaagcagca

SEQ ID NO: 2457549 - DNA, 21 bp, Homo sapiens
tccccagggaagcagcagcct

SEQ ID NO: 2457550 - DNA, 16 bp, Homo sapiens
tccccaggtccagctc

SEQ ID NO: 2457551 - DNA, 13 bp, Homo sapiens
tccccatctcagg

SEQ ID NO: 2457552 - DNA, 12 bp, Homo sapiens
tcccccactttc

SEQ ID NO: 2457553 - DNA, 22 bp, Homo sapiens
tccccccaagggaggctgctgc

SEQ ID NO: 2457554 - DNA, 17 bp, Homo sapiens
tccccccacaagtgccc

SEQ ID NO: 2457555 - DNA, 20 bp, Homo sapiens
tccccctatttattgacttt

SEQ ID NO: 2457556 - DNA, 15 bp, Homo sapiens
tccccctctgtccag

SEQ ID NO: 2457557 - DNA, 14 bp, Homo sapiens
tccccgagtgccta

SEQ ID NO: 2457558 - DNA, 22 bp, Homo sapiens
tcccctaaagcctcaaaacaaa

SEQ ID NO: 2457559 - DNA, 16 bp, Homo sapiens
tcccctagagtcccag

SEQ ID NO: 2457560 - DNA, 15 bp, Homo sapiens
tcccctcacctcctc

SEQ ID NO: 2457561 - DNA, 14 bp, Homo sapiens
tcccctccatccct

SEQ ID NO: 2457562 - DNA, 15 bp, Homo sapiens
tcccctccttcccaa

SEQ ID NO: 2457563 - DNA, 16 bp, Homo sapiens
tcccctctccttcctg

SEQ ID NO: 2457564 - DNA, 17 bp, Homo sapiens
tcccctctgctgctgtc

SEQ ID NO: 2457565 - DNA, 18 bp, Homo sapiens
tcccctgcaggctgagtg

SEQ ID NO: 2457566 - DNA, 13 bp, Homo sapiens
tcccctgccacca

SEQ ID NO: 2457567 - DNA, 14 bp, Homo sapiens
tcccctgccaccag

SEQ ID NO: 2457568 - DNA, 16 bp, Homo sapiens
tcccctgccaccaggc

SEQ ID NO: 2457569 - DNA, 19 bp, Homo sapiens
tcccctgccaccaggccac

SEQ ID NO: 2457570 - DNA, 12 bp, Homo sapiens
tcccctgccagg

SEQ ID NO: 2457571 - DNA, 20 bp, Homo sapiens
tcccctgccagggcagggcc

SEQ ID NO: 2457572 - DNA, 21 bp, Homo sapiens
tcccctgcccatgctgggagc

SEQ ID NO: 2457573 - DNA, 18 bp, Homo sapiens
tccccttccactgagggc

SEQ ID NO: 2457574 - DNA, 18 bp, Homo sapiens
tccccttgaactcttcac

SEQ ID NO: 2457575 - DNA, 19 bp, Homo sapiens
tccccttgaggtctcagcc

SEQ ID NO: 2457576 - DNA, 20 bp, Homo sapiens
tccccttgaggtctcagccc

SEQ ID NO: 2457577 - DNA, 23 bp, Homo sapiens
tccccttgcctgtgccaggtgag

SEQ ID NO: 2457578 - DNA, 22 bp, Homo sapiens
tccccttgggcccacacctcct

SEQ ID NO: 2457579 - DNA, 15 bp, Homo sapiens
tcccgagctcctctt

SEQ ID NO: 2457580 - DNA, 16 bp, Homo sapiens
tcccggggccagcact

SEQ ID NO: 2457581 - DNA, 22 bp, Homo sapiens
tctaaggcctaggattctaaaa

SEQ ID NO: 2457582 - DNA, 13 bp, Homo sapiens
tctaaggctctga

SEQ ID NO: 2457583 - DNA, 14 bp, Homo sapiens
tctaaggctctgag

SEQ ID NO: 2457584 - DNA, 20 bp, Homo sapiens
tctaaggctctgagagtcta

SEQ ID NO: 2457585 - DNA, 16 bp, Homo sapiens
tctaagtaaatacaat

SEQ ID NO: 2457586 - DNA, 14 bp, Homo sapiens
tctaagttataaga

SEQ ID NO: 2457587 - DNA, 16 bp, Homo sapiens
tctaagttataagact

SEQ ID NO: 2457588 - DNA, 16 bp, Homo sapiens
tctaattcacagtgct

SEQ ID NO: 2457589 - DNA, 19 bp, Homo sapiens
tctaattctattaaagtgc

SEQ ID NO: 2457590 - DNA, 13 bp, Homo sapiens
tctaatttataaa

SEQ ID NO: 2457591 - DNA, 21 bp, Homo sapiens
tctacaactcatacactcgta

SEQ ID NO: 2457592 - DNA, 18 bp, Homo sapiens
tctacagatgagtcacac

SEQ ID NO: 2457593 - DNA, 16 bp, Homo sapiens
tctaccccagactaga

SEQ ID NO: 2457594 - DNA, 18 bp, Homo sapiens
tctaccccagactagatg

SEQ ID NO: 2457595 - DNA, 12 bp, Homo sapiens
tctaccctggga

SEQ ID NO: 2457596 - DNA, 19 bp, Homo sapiens
tctacctcaggcagctcaa

SEQ ID NO: 2457597 - DNA, 15 bp, Homo sapiens
tctaccttctcccca

SEQ ID NO: 2457598 - DNA, 23 bp, Homo sapiens
tctaccttctccccagctcccag

SEQ ID NO: 2457599 - DNA, 18 bp, Homo sapiens
tctactaattccacacct

SEQ ID NO: 2457600 - DNA, 14 bp, Homo sapiens
tctacttccccatg

SEQ ID NO: 2457601 - DNA, 18 bp, Homo sapiens
tctagaaaaacaggcact

SEQ ID NO: 2457602 - DNA, 23 bp, Homo sapiens
tctagaatctgcaattcaaaagt

SEQ ID NO: 2457603 - DNA, 18 bp, Homo sapiens
tctagacatggaggttct

SEQ ID NO: 2457604 - DNA, 15 bp, Homo sapiens
tctagagcagggatt

SEQ ID NO: 2457605 - DNA, 20 bp, Homo sapiens
tctagagtccaaggtttaaa

SEQ ID NO: 2457606 - DNA, 14 bp, Homo sapiens
tctagagttcagag

SEQ ID NO: 2457607 - DNA, 18 bp, Homo sapiens
tctagagttcagagtcct

SEQ ID NO: 2457608 - DNA, 20 bp, Homo sapiens
tctagatcagatgctccaag

SEQ ID NO: 2457609 - DNA, 21 bp, Homo sapiens
tctagatcagatgctccaaga

SEQ ID NO: 2457610 - DNA, 19 bp, Homo sapiens
tctagatgaagttttacat

SEQ ID NO: 2457611 - DNA, 21 bp, Homo sapiens
tctagatgaagttttacattg

SEQ ID NO: 2457612 - DNA, 22 bp, Homo sapiens
tctagatgaagttttacattgt

SEQ ID NO: 2457613 - DNA, 22 bp, Homo sapiens
tctagatgattaaataagattc

SEQ ID NO: 2457614 - DNA, 22 bp, Homo sapiens
tctagatgtttattcttctaga

SEQ ID NO: 2457615 - DNA, 23 bp, Homo sapiens
tctagatgtttattcttctagag

SEQ ID NO: 2457616 - DNA, 18 bp, Homo sapiens
tctagattcaaaggttct

SEQ ID NO: 2457617 - DNA, 19 bp, Homo sapiens
tctagattcaaaggttcta

SEQ ID NO: 2457618 - DNA, 20 bp, Homo sapiens
tctagattcaaaggttctag

SEQ ID NO: 2457619 - DNA, 23 bp, Homo sapiens
tctagattcaaaggttctaggtt

SEQ ID NO: 2457620 - DNA, 21 bp, Homo sapiens
tctagattccattggtccaag

SEQ ID NO: 2457621 - DNA, 11 bp, Homo sapiens
tctagattctc

SEQ ID NO: 2457622 - DNA, 21 bp, Homo sapiens
tctagattctctggctgtaag

SEQ ID NO: 2457623 - DNA, 23 bp, Homo sapiens
tctaggaccatggttaagagtcc

SEQ ID NO: 2457624 - DNA, 19 bp, Homo sapiens
tctaggagggagacactgg

SEQ ID NO: 2457625 - DNA, 21 bp, Homo sapiens
tctaggcactgtagttctaag

SEQ ID NO: 2457626 - DNA, 22 bp, Homo sapiens
tctaggcactgtagttctaaga

SEQ ID NO: 2457627 - DNA, 15 bp, Homo sapiens
tctaggtccccatac

SEQ ID NO: 2457628 - DNA, 17 bp, Homo sapiens
tctaggtccccatactc

SEQ ID NO: 2457629 - DNA, 17 bp, Homo sapiens
tctaggtttcaaagatg

SEQ ID NO: 2457630 - DNA, 22 bp, Homo sapiens
tctagttttttacttttgttta

SEQ ID NO: 2457631 - DNA, 19 bp, Homo sapiens
tctataaagcatttaaccc

SEQ ID NO: 2457632 - DNA, 20 bp, Homo sapiens
tctataaagcatttaacccc

SEQ ID NO: 2457633 - DNA, 14 bp, Homo sapiens
tctataaggccata

SEQ ID NO: 2457634 - DNA, 12 bp, Homo sapiens
tctataatttac

SEQ ID NO: 2457635 - DNA, 16 bp, Homo sapiens
tctataatttacctaa

SEQ ID NO: 2457636 - DNA, 15 bp, Homo sapiens
tctataattttgcct

SEQ ID NO: 2457637 - DNA, 12 bp, Homo sapiens
tctatagttcta

SEQ ID NO: 2457638 - DNA, 15 bp, Homo sapiens
tctatgagtctagat

SEQ ID NO: 2457639 - DNA, 15 bp, Homo sapiens
tctattaaaagactc

SEQ ID NO: 2457640 - DNA, 20 bp, Homo sapiens
tctattaaaagactcatccg

SEQ ID NO: 2457641 - DNA, 22 bp, Homo sapiens
tctattcgccacacagtatttt

SEQ ID NO: 2457642 - DNA, 18 bp, Homo sapiens
tctatttatatgtacatg

SEQ ID NO: 2457643 - DNA, 17 bp, Homo sapiens
tctatttcactggagca

SEQ ID NO: 2457644 - DNA, 14 bp, Homo sapiens
tctatttcatgttt

SEQ ID NO: 2457645 - DNA, 15 bp, Homo sapiens
tctatttctcctcca

SEQ ID NO: 2457646 - DNA, 16 bp, Homo sapiens
tctatttctcctccat

SEQ ID NO: 2457647 - DNA, 18 bp, Homo sapiens
tctattttattatgaaga

SEQ ID NO: 2457648 - DNA, 20 bp, Homo sapiens
tctattttattatgaagaag

SEQ ID NO: 2457649 - DNA, 21 bp, Homo sapiens
tctatttttggaggtttatta

SEQ ID NO: 2457650 - DNA, 22 bp, Homo sapiens
tctatttttggaggtttattac

SEQ ID NO: 2457651 - DNA, 17 bp, Homo sapiens
tctcaaaacagagggct

SEQ ID NO: 2457652 - DNA, 23 bp, Homo sapiens
tctcaacacccagtttccttggg

SEQ ID NO: 2457653 - DNA, 16 bp, Homo sapiens
tctcaacaggcctcag

SEQ ID NO: 2457654 - DNA, 19 bp, Homo sapiens
tctcaacaggcctcagggc

SEQ ID NO: 2457655 - DNA, 20 bp, Homo sapiens
tctcaacaggcctcagggct

SEQ ID NO: 2457656 - DNA, 23 bp, Homo sapiens
tctcaacaggcctcagggctcct

SEQ ID NO: 2457657 - DNA, 12 bp, Homo sapiens
tctcaagttcta

SEQ ID NO: 2457658 - DNA, 18 bp, Homo sapiens
tctcaagttctaagattc

SEQ ID NO: 2457659 - DNA, 20 bp, Homo sapiens
tctcaagttctaagattcta

SEQ ID NO: 2457660 - DNA, 22 bp, Homo sapiens
tctcaattccaacagtttaatg

SEQ ID NO: 2457661 - DNA, 14 bp, Homo sapiens
tctcaccaggcagc

SEQ ID NO: 2457662 - DNA, 16 bp, Homo sapiens
tctcaccaggcagcct

SEQ ID NO: 2457663 - DNA, 17 bp, Homo sapiens
tctcaccccatcccaca

SEQ ID NO: 2457664 - DNA, 16 bp, Homo sapiens
tctcaccctggaggca

SEQ ID NO: 2457665 - DNA, 21 bp, Homo sapiens
tctcacctctaggtccccata

SEQ ID NO: 2457666 - DNA, 13 bp, Homo sapiens
tctcacctggact

SEQ ID NO: 2457667 - DNA, 24 bp, Homo sapiens
tctcacctggacttaagcatctgg

SEQ ID NO: 2457668 - DNA, 16 bp, Homo sapiens
tctcacctggccctgc

SEQ ID NO: 2457669 - DNA, 19 bp, Homo sapiens
tctcacctggccctgcttc

SEQ ID NO: 2457670 - DNA, 22 bp, Homo sapiens
tctcacggccacacagctgccg

SEQ ID NO: 2457671 - DNA, 21 bp, Homo sapiens
tctcagaaagtgcctgacaca

SEQ ID NO: 2457672 - DNA, 18 bp, Homo sapiens
tctcagaatgtcattttg

SEQ ID NO: 2457673 - DNA, 12 bp, Homo sapiens
tctcagcccctt

SEQ ID NO: 2457674 - DNA, 17 bp, Homo sapiens
tctcagcccctttccct

SEQ ID NO: 2457675 - DNA, 17 bp, Homo sapiens
tctcaggacacaggcct

SEQ ID NO: 2457676 - DNA, 18 bp, Homo sapiens
tctcaggacacaggcctg

SEQ ID NO: 2457677 - DNA, 19 bp, Homo sapiens
tctcaggacacaggcctgt

SEQ ID NO: 2457678 - DNA, 23 bp, Homo sapiens
tctcaggaccaaagctttcatgt

SEQ ID NO: 2457679 - DNA, 14 bp, Homo sapiens
tctcaggatccaag

SEQ ID NO: 2457680 - DNA, 16 bp, Homo sapiens
tctcaggatccaagct

SEQ ID NO: 2457681 - DNA, 22 bp, Homo sapiens
tctcaggctaggccagcagggg

SEQ ID NO: 2457682 - DNA, 16 bp, Homo sapiens
tctcagtgaagaatac

SEQ ID NO: 2457683 - DNA, 16 bp, Homo sapiens
tctcagtgaagactat

SEQ ID NO: 2457684 - DNA, 16 bp, Homo sapiens
tccacagggtcccaca

SEQ ID NO: 2457685 - DNA, 20 bp, Homo sapiens
tccacagggtcccacagcca

SEQ ID NO: 2457686 - DNA, 21 bp, Homo sapiens
tccacagggtcccacagccac

SEQ ID NO: 2457687 - DNA, 14 bp, Homo sapiens
tccacaggtctaga

SEQ ID NO: 2457688 - DNA, 13 bp, Homo sapiens
tccacatcctcca

SEQ ID NO: 2457689 - DNA, 20 bp, Homo sapiens
tccaccccatccctccccag

SEQ ID NO: 2457690 - DNA, 23 bp, Homo sapiens
tccaccgtctttcttttatactg

SEQ ID NO: 2457691 - DNA, 21 bp, Homo sapiens
tccacctggtactccctctca

SEQ ID NO: 2457692 - DNA, 13 bp, Homo sapiens
tccacctgtctca

SEQ ID NO: 2457693 - DNA, 16 bp, Homo sapiens
tccacctgtctcagcc

SEQ ID NO: 2457694 - DNA, 20 bp, Homo sapiens
tccacctgtctcagcctccc

SEQ ID NO: 2457695 - DNA, 15 bp, Homo sapiens
tccaccttcccactt

SEQ ID NO: 2457696 - DNA, 16 bp, Homo sapiens
tccacgactgtctcca

SEQ ID NO: 2457697 - DNA, 17 bp, Homo sapiens
tccacgactgtctccat

SEQ ID NO: 2457698 - DNA, 20 bp, Homo sapiens
tccacggagccactcctctg

SEQ ID NO: 2457699 - DNA, 22 bp, Homo sapiens
tccacggagccactcctctgac

SEQ ID NO: 2457700 - DNA, 19 bp, Homo sapiens
tccacgttctgctcatcat

SEQ ID NO: 2457701 - DNA, 12 bp, Homo sapiens
tccactctgctt

SEQ ID NO: 2457702 - DNA, 23 bp, Homo sapiens
tccactctgcttctctgacttct

SEQ ID NO: 2457703 - DNA, 24 bp, Homo sapiens
tccactctgcttctctgacttctg

SEQ ID NO: 2457704 - DNA, 15 bp, Homo sapiens
tccactgagggcagt

SEQ ID NO: 2457705 - DNA, 16 bp, Homo sapiens
tccacttatagcctct

SEQ ID NO: 2457706 - DNA, 15 bp, Homo sapiens
tccacttctgacagc

SEQ ID NO: 2457707 - DNA, 16 bp, Homo sapiens
tccactttcagctgtc

SEQ ID NO: 2457708 - DNA, 17 bp, Homo sapiens
tccactttcagctgtct

SEQ ID NO: 2457709 - DNA, 15 bp, Homo sapiens
tccactttgtttcgt

SEQ ID NO: 2457710 - DNA, 22 bp, Homo sapiens
tccactttgtttcgtggggagg

SEQ ID NO: 2457711 - DNA, 14 bp, Homo sapiens
tccagaaaacaaaa

SEQ ID NO: 2457712 - DNA, 14 bp, Homo sapiens
tccagaaagcccca

SEQ ID NO: 2457713 - DNA, 15 bp, Homo sapiens
tccagaagtgtgact

SEQ ID NO: 2457714 - DNA, 12 bp, Homo sapiens
tccagagggcac

SEQ ID NO: 2457715 - DNA, 15 bp, Homo sapiens
tccagatgcagggca

SEQ ID NO: 2457716 - DNA, 17 bp, Homo sapiens
tccagatgcagggcagt

SEQ ID NO: 2457717 - DNA, 15 bp, Homo sapiens
tccagatgccacaat

SEQ ID NO: 2457718 - DNA, 17 bp, Homo sapiens
tccagattagagcctgt

SEQ ID NO: 2457719 - DNA, 16 bp, Homo sapiens
tccagcattcccaggt

SEQ ID NO: 2457720 - DNA, 14 bp, Homo sapiens
tccagcccctctgg

SEQ ID NO: 2457721 - DNA, 16 bp, Homo sapiens
tccagcccctctggtc

SEQ ID NO: 2457722 - DNA, 11 bp, Homo sapiens
tccagcctgac

SEQ ID NO: 2457723 - DNA, 14 bp, Homo sapiens
tccagcggccctgt

SEQ ID NO: 2457724 - DNA, 20 bp, Homo sapiens
tccagctagtgacccacatg

SEQ ID NO: 2457725 - DNA, 12 bp, Homo sapiens
tccagctccaac

SEQ ID NO: 2457726 - DNA, 18 bp, Homo sapiens
tccagctccaacctgcaa

SEQ ID NO: 2457727 - DNA, 17 bp, Homo sapiens
tccagctccctgtgccc

SEQ ID NO: 2457728 - DNA, 23 bp, Homo sapiens
tccagctccctgtgcccccaggg

SEQ ID NO: 2457729 - DNA, 19 bp, Homo sapiens
tccagctcctttgggcttc

SEQ ID NO: 2457730 - DNA, 13 bp, Homo sapiens
tccagctctggag

SEQ ID NO: 2457731 - DNA, 14 bp, Homo sapiens
tccagctgactaaa

SEQ ID NO: 2457732 - DNA, 14 bp, Homo sapiens
tccagctgtccccc

SEQ ID NO: 2457733 - DNA, 21 bp, Homo sapiens
tccagctgtccccccactccc

SEQ ID NO: 2457734 - DNA, 23 bp, Homo sapiens
tccaggactatatttgggcctgc

SEQ ID NO: 2457735 - DNA, 15 bp, Homo sapiens
tccaggagctccagt

SEQ ID NO: 2457736 - DNA, 22 bp, Homo sapiens
tccaggagctccagtgtcctga

SEQ ID NO: 2457737 - DNA, 19 bp, Homo sapiens
tccaggatgctaacatcta

SEQ ID NO: 2457738 - DNA, 15 bp, Homo sapiens
tccaggcagatccag

SEQ ID NO: 2457739 - DNA, 16 bp, Homo sapiens
tccaggcagatccagg

SEQ ID NO: 2457740 - DNA, 17 bp, Homo sapiens
tccaggcagatccagga

SEQ ID NO: 2457741 - DNA, 21 bp, Homo sapiens
tccaggcaggtctgaagctca

SEQ ID NO: 2457742 - DNA, 11 bp, Homo sapiens
tccaggcccaa

SEQ ID NO: 2457743 - DNA, 15 bp, Homo sapiens
tccaggcccaaggct

SEQ ID NO: 2457744 - DNA, 17 bp, Homo sapiens
tccaggcccaaggctcc

SEQ ID NO: 2457745 - DNA, 18 bp, Homo sapiens
tccaggcccaaggctccc

SEQ ID NO: 2457746 - DNA, 19 bp, Homo sapiens
tccaggcccaaggctcccg

SEQ ID NO: 2457747 - DNA, 20 bp, Homo sapiens
tccaggcccaaggctcccgg

SEQ ID NO: 2457748 - DNA, 15 bp, Homo sapiens
tccaggctgtgtttg

SEQ ID NO: 2457749 - DNA, 12 bp, Homo sapiens
tccagggacagc

SEQ ID NO: 2457750 - DNA, 14 bp, Homo sapiens
tccagggaggctgg

SEQ ID NO: 2457751 - DNA, 15 bp, Homo sapiens
tccaggtcctggtgg

SEQ ID NO: 2457752 - DNA, 21 bp, Homo sapiens
tccaggtcctggtggggcagc

SEQ ID NO: 2457753 - DNA, 16 bp, Homo sapiens
tccaggtgttactgta

SEQ ID NO: 2457754 - DNA, 17 bp, Homo sapiens
tccaggttccctcccag

SEQ ID NO: 2457755 - DNA, 15 bp, Homo sapiens
tccagtaatctaata

SEQ ID NO: 2457756 - DNA, 19 bp, Homo sapiens
tccagtaatctaatatggc

SEQ ID NO: 2457757 - DNA, 19 bp, Homo sapiens
tccagtcctatctgggctt

SEQ ID NO: 2457758 - DNA, 22 bp, Homo sapiens
tccagtcctatctgggcttcct

SEQ ID NO: 2457759 - DNA, 23 bp, Homo sapiens
tccagtcctatctgggcttcctg

SEQ ID NO: 2457760 - DNA, 17 bp, Homo sapiens
tccagtgtcctgagctc

SEQ ID NO: 2457761 - DNA, 20 bp, Homo sapiens
tccagtgtcctgagctcagc

SEQ ID NO: 2457762 - DNA, 13 bp, Homo sapiens
tccataaagaccc

SEQ ID NO: 2457763 - DNA, 17 bp, Homo sapiens
tccataaatccttgatg

SEQ ID NO: 2457764 - DNA, 14 bp, Homo sapiens
tccataactgaaca

SEQ ID NO: 2457765 - DNA, 22 bp, Homo sapiens
tccataatgcattcttctctgt

SEQ ID NO: 2457766 - DNA, 15 bp, Homo sapiens
tccatatcacacaca

SEQ ID NO: 2457767 - DNA, 15 bp, Homo sapiens
tccatccacatggga

SEQ ID NO: 2457768 - DNA, 17 bp, Homo sapiens
tccatccatggccagca

SEQ ID NO: 2457769 - DNA, 19 bp, Homo sapiens
tccatccatggccagcagc

SEQ ID NO: 2457770 - DNA, 13 bp, Homo sapiens
tccatccctggcc

SEQ ID NO: 2457771 - DNA, 23 bp, Homo sapiens
tccatccctggccccctccctgg

SEQ ID NO: 2457772 - DNA, 13 bp, Homo sapiens
tccatctttacaa

SEQ ID NO: 2457773 - DNA, 13 bp, Homo sapiens
tccatgactgctt

SEQ ID NO: 2457774 - DNA, 15 bp, Homo sapiens
tccatgactgcttgc

SEQ ID NO: 2457775 - DNA, 23 bp, Homo sapiens
tccatgactgcttgccctaagca

SEQ ID NO: 2457776 - DNA, 18 bp, Homo sapiens
tcatcctcaaagaaagtg

SEQ ID NO: 2457777 - DNA, 21 bp, Homo sapiens
tcatcctcaaagaaagtgtat

SEQ ID NO: 2457778 - DNA, 22 bp, Homo sapiens
tcatcctcaaagaaagtgtatt

SEQ ID NO: 2457779 - DNA, 20 bp, Homo sapiens
tcatctacctagatttaata

SEQ ID NO: 2457780 - DNA, 22 bp, Homo sapiens
tcatctcagtgaagaatacttc

SEQ ID NO: 2457781 - DNA, 21 bp, Homo sapiens
tcatctcatttaatcctccct

SEQ ID NO: 2457782 - DNA, 12 bp, Homo sapiens
tcatctcccacc

SEQ ID NO: 2457783 - DNA, 22 bp, Homo sapiens
tcatctcctgccttcctcctgg

SEQ ID NO: 2457784 - DNA, 14 bp, Homo sapiens
tcatctctctgccc

SEQ ID NO: 2457785 - DNA, 16 bp, Homo sapiens
tcatctctctgcccaa

SEQ ID NO: 2457786 - DNA, 16 bp, Homo sapiens
tcatctcttcaggttc

SEQ ID NO: 2457787 - DNA, 13 bp, Homo sapiens
tcatctgctggtc

SEQ ID NO: 2457788 - DNA, 16 bp, Homo sapiens
tcatctggggagcagg

SEQ ID NO: 2457789 - DNA, 21 bp, Homo sapiens
tcatctggggagcaggcagcc

SEQ ID NO: 2457790 - DNA, 18 bp, Homo sapiens
tcatctgtccctccggga

SEQ ID NO: 2457791 - DNA, 20 bp, Homo sapiens
tcatcttcagttgtctctga

SEQ ID NO: 2457792 - DNA, 18 bp, Homo sapiens
tcatcttgctaccagtat

SEQ ID NO: 2457793 - DNA, 22 bp, Homo sapiens
tcatcttgctaccagtatttag

SEQ ID NO: 2457794 - DNA, 14 bp, Homo sapiens
tcatgaatgtaaat

SEQ ID NO: 2457795 - DNA, 20 bp, Homo sapiens
tcatgaatgtaaatttgtac

SEQ ID NO: 2457796 - DNA, 23 bp, Homo sapiens
tcatgaggagattctgcctttgc

SEQ ID NO: 2457797 - DNA, 21 bp, Homo sapiens
tcatgataccacctttactgt

SEQ ID NO: 2457798 - DNA, 22 bp, Homo sapiens
tcatgataccacctttactgtg

SEQ ID NO: 2457799 - DNA, 20 bp, Homo sapiens
tcatgcacagtatttgtaat

SEQ ID NO: 2457800 - DNA, 14 bp, Homo sapiens
tcatgcagctgtgg

SEQ ID NO: 2457801 - DNA, 22 bp, Homo sapiens
tcatgcctctgaggccagcctg

SEQ ID NO: 2457802 - DNA, 17 bp, Homo sapiens
tcatgctggagggaggc

SEQ ID NO: 2457803 - DNA, 21 bp, Homo sapiens
tcatggcagatgtaggaggga

SEQ ID NO: 2457804 - DNA, 13 bp, Homo sapiens
tcatggcccctct

SEQ ID NO: 2457805 - DNA, 14 bp, Homo sapiens
tcatggcccctctg

SEQ ID NO: 2457806 - DNA, 19 bp, Homo sapiens
tcatgtaaataatacatta

SEQ ID NO: 2457807 - DNA, 21 bp, Homo sapiens
tcatgtggctggaagatcctg

SEQ ID NO: 2457808 - DNA, 13 bp, Homo sapiens
tcatgtgtcccag

SEQ ID NO: 2457809 - DNA, 22 bp, Homo sapiens
tcatgtgtcccagaagatgact

SEQ ID NO: 2457810 - DNA, 23 bp, Homo sapiens
tcatgttagttaccttatagtta

SEQ ID NO: 2457811 - DNA, 17 bp, Homo sapiens
tcatgttgaagccactg

SEQ ID NO: 2457812 - DNA, 14 bp, Homo sapiens
tcattaaataaatt

SEQ ID NO: 2457813 - DNA, 14 bp, Homo sapiens
tcattaattctata

SEQ ID NO: 2457814 - DNA, 22 bp, Homo sapiens
tcattatttatgtattgtgcaa

SEQ ID NO: 2457815 - DNA, 20 bp, Homo sapiens
tcattcacatcgcagattct

SEQ ID NO: 2457816 - DNA, 18 bp, Homo sapiens
tcattcattagtcatgtt

SEQ ID NO: 2457817 - DNA, 19 bp, Homo sapiens
tcattccatgtgcccagtt

SEQ ID NO: 2457818 - DNA, 23 bp, Homo sapiens
tcattcgctactatgatttaatt

SEQ ID NO: 2457819 - DNA, 14 bp, Homo sapiens
tcattctctgtctc

SEQ ID NO: 2457820 - DNA, 18 bp, Homo sapiens
tcatttagtcatgtgacc

SEQ ID NO: 2457821 - DNA, 19 bp, Homo sapiens
tcatttagtttgattattc

SEQ ID NO: 2457822 - DNA, 21 bp, Homo sapiens
tcatttatctataatttacct

SEQ ID NO: 2457823 - DNA, 12 bp, Homo sapiens
tcatttcatcta

SEQ ID NO: 2457824 - DNA, 21 bp, Homo sapiens
tcatttctatttctcctccat

SEQ ID NO: 2457825 - DNA, 22 bp, Homo sapiens
tcatttctttttgggagagact

SEQ ID NO: 2457826 - DNA, 16 bp, Homo sapiens
tcatttgctttggaag

SEQ ID NO: 2457827 - DNA, 13 bp, Homo sapiens
tcatttgtttaaa

SEQ ID NO: 2457828 - DNA, 17 bp, Homo sapiens
tcatttgtttaaaaagg

SEQ ID NO: 2457829 - DNA, 15 bp, Homo sapiens
tcattttctctcagg

SEQ ID NO: 2457830 - DNA, 22 bp, Homo sapiens
tcattttggtaaaatacttctt

SEQ ID NO: 2457831 - DNA, 21 bp, Homo sapiens
tcatttttacaatgtaattat

SEQ ID NO: 2457832 - DNA, 16 bp, Homo sapiens
tcattttttaaaaaag

SEQ ID NO: 2457833 - DNA, 22 bp, Homo sapiens
tcattttttttctttgaataaa

SEQ ID NO: 2457834 - DNA, 18 bp, Homo sapiens
tccaaaaccgccagctct

SEQ ID NO: 2457835 - DNA, 19 bp, Homo sapiens
tccaaaaccgccagctctg

SEQ ID NO: 2457836 - DNA, 15 bp, Homo sapiens
tccaaaagaagcccc

SEQ ID NO: 2457837 - DNA, 15 bp, Homo sapiens
tccaaaatgtgccta

SEQ ID NO: 2457838 - DNA, 19 bp, Homo sapiens
tccaaactgaagcagcctc

SEQ ID NO: 2457839 - DNA, 13 bp, Homo sapiens
tccaaagaggctg

SEQ ID NO: 2457840 - DNA, 15 bp, Homo sapiens
tccaaagcagacagc

SEQ ID NO: 2457841 - DNA, 15 bp, Homo sapiens
tccaaagtcataatt

SEQ ID NO: 2457842 - DNA, 18 bp, Homo sapiens
tccaaagtcataattgca

SEQ ID NO: 2457843 - DNA, 20 bp, Homo sapiens
tccaacatcacagcccagcc

SEQ ID NO: 2457844 - DNA, 23 bp, Homo sapiens
tccaacccgtctggcccaccagg

SEQ ID NO: 2457845 - DNA, 20 bp, Homo sapiens
tccaactactaatagaataa

SEQ ID NO: 2457846 - DNA, 23 bp, Homo sapiens
tccaacttggctgcaggaatctt

SEQ ID NO: 2457847 - DNA, 14 bp, Homo sapiens
tccaagaatccaca

SEQ ID NO: 2457848 - DNA, 16 bp, Homo sapiens
tccaagaatccacatt

SEQ ID NO: 2457849 - DNA, 20 bp, Homo sapiens
tccaagactctagagtccaa

SEQ ID NO: 2457850 - DNA, 15 bp, Homo sapiens
tccaagagtctaaag

SEQ ID NO: 2457851 - DNA, 16 bp, Homo sapiens
tccaagagtctaaaga

SEQ ID NO: 2457852 - DNA, 18 bp, Homo sapiens
tccaagagtctaaagatg

SEQ ID NO: 2457853 - DNA, 12 bp, Homo sapiens
tccaagattcta

SEQ ID NO: 2457854 - DNA, 17 bp, Homo sapiens
tccaagattctagatga

SEQ ID NO: 2457855 - DNA, 15 bp, Homo sapiens
tccaagccccatctt

SEQ ID NO: 2457856 - DNA, 22 bp, Homo sapiens
tccaagctaagcactgccactg

SEQ ID NO: 2457857 - DNA, 17 bp, Homo sapiens
tccaagctcactcccca

SEQ ID NO: 2457858 - DNA, 16 bp, Homo sapiens
tccaaggtggggtgga

SEQ ID NO: 2457859 - DNA, 13 bp, Homo sapiens
tccaaggtttaaa

SEQ ID NO: 2457860 - DNA, 14 bp, Homo sapiens
tccaaggtttaaag

SEQ ID NO: 2457861 - DNA, 15 bp, Homo sapiens
tccaaggtttaaaga

SEQ ID NO: 2457862 - DNA, 14 bp, Homo sapiens
tccaagtggtccac

SEQ ID NO: 2457863 - DNA, 17 bp, Homo sapiens
tccaagttgttcgggcc

SEQ ID NO: 2457864 - DNA, 21 bp, Homo sapiens
tccaatcaatcttgcatgtaa

SEQ ID NO: 2457865 - DNA, 15 bp, Homo sapiens
tccaatgagctttct

SEQ ID NO: 2457866 - DNA, 17 bp, Homo sapiens
tccaatgagctttctga

SEQ ID NO: 2457867 - DNA, 20 bp, Homo sapiens
tccaatgagctttctgaaca

SEQ ID NO: 2457868 - DNA, 16 bp, Homo sapiens
tccaatgtctggagac

SEQ ID NO: 2457869 - DNA, 20 bp, Homo sapiens
tcacaagtgggtacccccag

SEQ ID NO: 2457870 - DNA, 12 bp, Homo sapiens
tcacacactgat

SEQ ID NO: 2457871 - DNA, 12 bp, Homo sapiens
tcacacaggcat

SEQ ID NO: 2457872 - DNA, 22 bp, Homo sapiens
tcacactgggtggtggcctggt

SEQ ID NO: 2457873 - DNA, 18 bp, Homo sapiens
tcacactggtctgctgtc

SEQ ID NO: 2457874 - DNA, 16 bp, Homo sapiens
tcacagccacccctga

SEQ ID NO: 2457875 - DNA, 15 bp, Homo sapiens
tcacagcccagcccg

SEQ ID NO: 2457876 - DNA, 11 bp, Homo sapiens
tcacagctcct

SEQ ID NO: 2457877 - DNA, 12 bp, Homo sapiens
tcacaggcagcc

SEQ ID NO: 2457878 - DNA, 15 bp, Homo sapiens
tcacaggcagccagt

SEQ ID NO: 2457879 - DNA, 19 bp, Homo sapiens
tcacaggcagccagtgccc

SEQ ID NO: 2457880 - DNA, 12 bp, Homo sapiens
tcacagggcagt

SEQ ID NO: 2457881 - DNA, 22 bp, Homo sapiens
tcacagggcagtacctgagggt

SEQ ID NO: 2457882 - DNA, 15 bp, Homo sapiens
tcacagtattgctca

SEQ ID NO: 2457883 - DNA, 16 bp, Homo sapiens
tcacagtgcttttaag

SEQ ID NO: 2457884 - DNA, 18 bp, Homo sapiens
tcacagtgcttttaagtg

SEQ ID NO: 2457885 - DNA, 22 bp, Homo sapiens
tcacagttctttgggccagaca

SEQ ID NO: 2457886 - DNA, 17 bp, Homo sapiens
tcacagtttgaaataag

SEQ ID NO: 2457887 - DNA, 20 bp, Homo sapiens
tcacatagcccacttacatt

SEQ ID NO: 2457888 - DNA, 14 bp, Homo sapiens
tcacatattttaaa

SEQ ID NO: 2457889 - DNA, 20 bp, Homo sapiens
tcacatcagagtgacatcca

SEQ ID NO: 2457890 - DNA, 17 bp, Homo sapiens
tcacatgaattattaca

SEQ ID NO: 2457891 - DNA, 18 bp, Homo sapiens
tcaccacgactggccagg

SEQ ID NO: 2457892 - DNA, 16 bp, Homo sapiens
tcaccactgccccctg

SEQ ID NO: 2457893 - DNA, 20 bp, Homo sapiens
tcaccaggcagcctctgggg

SEQ ID NO: 2457894 - DNA, 15 bp, Homo sapiens
tcaccattataatga

SEQ ID NO: 2457895 - DNA, 13 bp, Homo sapiens
tcacccaacgctc

SEQ ID NO: 2457896 - DNA, 14 bp, Homo sapiens
tcacccacccctgc

SEQ ID NO: 2457897 - DNA, 13 bp, Homo sapiens
tcaccccaccctt

SEQ ID NO: 2457898 - DNA, 13 bp, Homo sapiens
tcacccccttctc

SEQ ID NO: 2457899 - DNA, 16 bp, Homo sapiens
tcacccccttctccat

SEQ ID NO: 2457900 - DNA, 18 bp, Homo sapiens
tcacccccttctccatcc

SEQ ID NO: 2457901 - DNA, 15 bp, Homo sapiens
tcaccctgccttatc

SEQ ID NO: 2457902 - DNA, 15 bp, Homo sapiens
tcaccggctctcacc

SEQ ID NO: 2457903 - DNA, 13 bp, Homo sapiens
tcaccgtgggctc

SEQ ID NO: 2457904 - DNA, 22 bp, Homo sapiens
tcacctagctgaatgtttttct

SEQ ID NO: 2457905 - DNA, 14 bp, Homo sapiens
tcacctaggaagcc

SEQ ID NO: 2457906 - DNA, 17 bp, Homo sapiens
tcacctcagatggcagc

SEQ ID NO: 2457907 - DNA, 20 bp, Homo sapiens
tcacctcagatggcagcttt

SEQ ID NO: 2457908 - DNA, 21 bp, Homo sapiens
tcacctcagatggcagctttt

SEQ ID NO: 2457909 - DNA, 22 bp, Homo sapiens
tcacctctaggtccccatactc

SEQ ID NO: 2457910 - DNA, 22 bp, Homo sapiens
tcacctggacttaagcatctgg

SEQ ID NO: 2457911 - DNA, 12 bp, Homo sapiens
tcacctggccct

SEQ ID NO: 2457912 - DNA, 14 bp, Homo sapiens
tcacctggccctgc

SEQ ID NO: 2457913 - DNA, 19 bp, Homo sapiens
tcacctggccctgcttcct

SEQ ID NO: 2457914 - DNA, 18 bp, Homo sapiens
tcaccttcaccttcatcc

SEQ ID NO: 2457915 - DNA, 18 bp, Homo sapiens
tcaccttggcaccagaca

SEQ ID NO: 2457916 - DNA, 19 bp, Homo sapiens
tcacggccacacagctgcc

SEQ ID NO: 2457917 - DNA, 12 bp, Homo sapiens
tcacggccaggc

SEQ ID NO: 2457918 - DNA, 14 bp, Homo sapiens
tcacggccaggcag

SEQ ID NO: 2457919 - DNA, 20 bp, Homo sapiens
tcacgtcctgagaaagctca

SEQ ID NO: 2457920 - DNA, 20 bp, Homo sapiens
tcacgttaccatttacatgt

SEQ ID NO: 2457921 - DNA, 22 bp, Homo sapiens
tcacgtttcatgtaatcctcaa

SEQ ID NO: 2457922 - DNA, 12 bp, Homo sapiens
tcactaaatctt

SEQ ID NO: 2457923 - DNA, 14 bp, Homo sapiens
tcactaattcatta

SEQ ID NO: 2457924 - DNA, 20 bp, Homo sapiens
tcactcagccaccctgagtt

SEQ ID NO: 2457925 - DNA, 21 bp, Homo sapiens
tcactcatcaatggggccagt

SEQ ID NO: 2457926 - DNA, 20 bp, Homo sapiens
tcactccccaacccccaact

SEQ ID NO: 2457927 - DNA, 13 bp, Homo sapiens
tcactccttttaa

SEQ ID NO: 2457928 - DNA, 18 bp, Homo sapiens
tcactccttttaaagaaa

SEQ ID NO: 2457929 - DNA, 17 bp, Homo sapiens
tcactctgagtgtttta

SEQ ID NO: 2457930 - DNA, 15 bp, Homo sapiens
tcactcttatgctgt

SEQ ID NO: 2457931 - DNA, 16 bp, Homo sapiens
tcactgaagcttttta

SEQ ID NO: 2457932 - DNA, 21 bp, Homo sapiens
tcactgagttttccatggcag

SEQ ID NO: 2457933 - DNA, 16 bp, Homo sapiens
tcactgcaaccttcac

SEQ ID NO: 2457934 - DNA, 13 bp, Homo sapiens
tcactggagcaca

SEQ ID NO: 2457935 - DNA, 19 bp, Homo sapiens
tcactgtctttaattctgt

SEQ ID NO: 2457936 - DNA, 17 bp, Homo sapiens
tcactgtgtcacccagg

SEQ ID NO: 2457937 - DNA, 22 bp, Homo sapiens
tcacttaagttagttccactga

SEQ ID NO: 2457938 - DNA, 18 bp, Homo sapiens
tcacttttgacaaaggca

SEQ ID NO: 2457939 - DNA, 23 bp, Homo sapiens
tcagaaaatgttctgtttgctgt

SEQ ID NO: 2457940 - DNA, 13 bp, Homo sapiens
tcagaaagacttg

SEQ ID NO: 2457941 - DNA, 14 bp, Homo sapiens
tcagaaagggaggg

SEQ ID NO: 2457942 - DNA, 21 bp, Homo sapiens
tcagaaagggagggctctgag

SEQ ID NO: 2457943 - DNA, 21 bp, Homo sapiens
tcagaactcaaatggggccag

SEQ ID NO: 2457944 - DNA, 16 bp, Homo sapiens
tcagaagaaaaagaag

SEQ ID NO: 2457945 - DNA, 18 bp, Homo sapiens
tcagaagaaaaagaagca

SEQ ID NO: 2457946 - DNA, 12 bp, Homo sapiens
tcagaagcctgg

SEQ ID NO: 2457947 - DNA, 22 bp, Homo sapiens
tcagaagcctgggggcctggct

SEQ ID NO: 2457948 - DNA, 20 bp, Homo sapiens
tcagaattttatactttccc

SEQ ID NO: 2457949 - DNA, 21 bp, Homo sapiens
tcagaattttatactttccct

SEQ ID NO: 2457950 - DNA, 23 bp, Homo sapiens
tcagaattttatactttccctac

SEQ ID NO: 2457951 - DNA, 17 bp, Homo sapiens
tcagacagagaggactg

SEQ ID NO: 2457952 - DNA, 22 bp, Homo sapiens
tcagacatctgaggttttattt

SEQ ID NO: 2457953 - DNA, 14 bp, Homo sapiens
tcagaccacatgcc

SEQ ID NO: 2457954 - DNA, 16 bp, Homo sapiens
tcagacgcctgaggaa

SEQ ID NO: 2457955 - DNA, 19 bp, Homo sapiens
tcagactctaagaaagaac

SEQ ID NO: 2457956 - DNA, 13 bp, Homo sapiens
tcagactggggca

SEQ ID NO: 2457957 - DNA, 12 bp, Homo sapiens
tcagagaccagg

SEQ ID NO: 2457958 - DNA, 14 bp, Homo sapiens
tcagagaccagggc

SEQ ID NO: 2457959 - DNA, 15 bp, Homo sapiens
tcagagaccagggct

SEQ ID NO: 2457960 - DNA, 19 bp, Homo sapiens
tcagagagaatggctttgg

SEQ ID NO: 2457961 - DNA, 12 bp, Homo sapiens
tcagagagcagt

SEQ ID NO: 2457962 - DNA, 20 bp, Homo sapiens
tcagagagcagtgcttttgg

SEQ ID NO: 2457963 - DNA, 16 bp, Homo sapiens
tcagagatgcaccacc

SEQ ID NO: 2457964 - DNA, 16 bp, Homo sapiens
tcagagccgtggtcct

SEQ ID NO: 2457965 - DNA, 18 bp, Homo sapiens
tcagaggccctcgctgcc

SEQ ID NO: 2457966 - DNA, 20 bp, Homo sapiens
tattttggattgtatattgt

SEQ ID NO: 2457967 - DNA, 13 bp, Homo sapiens
tatttttctaact

SEQ ID NO: 2457968 - DNA, 12 bp, Homo sapiens
tatttttcttga

SEQ ID NO: 2457969 - DNA, 16 bp, Homo sapiens
tatttttggaggttta

SEQ ID NO: 2457970 - DNA, 17 bp, Homo sapiens
tattttttgtataattg

SEQ ID NO: 2457971 - DNA, 13 bp, Homo sapiens
tcaaaaactattt

SEQ ID NO: 2457972 - DNA, 12 bp, Homo sapiens
tcaaaaagaacc

SEQ ID NO: 2457973 - DNA, 16 bp, Homo sapiens
tcaaaacaaaggccta

SEQ ID NO: 2457974 - DNA, 13 bp, Homo sapiens
tcaaaagttccaa

SEQ ID NO: 2457975 - DNA, 14 bp, Homo sapiens
tcaaaagtttgttt

SEQ ID NO: 2457976 - DNA, 14 bp, Homo sapiens
tcaaaatctctcca

SEQ ID NO: 2457977 - DNA, 23 bp, Homo sapiens
tcaaaatctctccactttcagct

SEQ ID NO: 2457978 - DNA, 12 bp, Homo sapiens
tcaaaatgcttt

SEQ ID NO: 2457979 - DNA, 19 bp, Homo sapiens
tcaaaatgctttttatttc

SEQ ID NO: 2457980 - DNA, 19 bp, Homo sapiens
tcaaacaatgacaaagcag

SEQ ID NO: 2457981 - DNA, 20 bp, Homo sapiens
tcaaacaatgacaaagcaga

SEQ ID NO: 2457982 - DNA, 21 bp, Homo sapiens
tcaaacaatgacaaagcagat

SEQ ID NO: 2457983 - DNA, 17 bp, Homo sapiens
tcaaacattttgaaagt

SEQ ID NO: 2457984 - DNA, 12 bp, Homo sapiens
tcaaagatgctg

SEQ ID NO: 2457985 - DNA, 13 bp, Homo sapiens
tcaaagcaagcat

SEQ ID NO: 2457986 - DNA, 21 bp, Homo sapiens
tcaaagcaagcattcagaaga

SEQ ID NO: 2457987 - DNA, 16 bp, Homo sapiens
tcaaagcaaggaaact

SEQ ID NO: 2457988 - DNA, 21 bp, Homo sapiens
tcaaagcatgggattattaga

SEQ ID NO: 2457989 - DNA, 23 bp, Homo sapiens
tcaaagccagcgtcctcctctgt

SEQ ID NO: 2457990 - DNA, 20 bp, Homo sapiens
tcaaaggagcgagcatgtcg

SEQ ID NO: 2457991 - DNA, 20 bp, Homo sapiens
tcaaaggttctaggtttcaa

SEQ ID NO: 2457992 - DNA, 21 bp, Homo sapiens
tcaaaggttctaggtttcaaa

SEQ ID NO: 2457993 - DNA, 23 bp, Homo sapiens
tcaaaggttctaggtttcaaaga

SEQ ID NO: 2457994 - DNA, 13 bp, Homo sapiens
tcaaagtttaata

SEQ ID NO: 2457995 - DNA, 14 bp, Homo sapiens
tcaaagtttaataa

SEQ ID NO: 2457996 - DNA, 16 bp, Homo sapiens
tcaaatgagtaacatt

SEQ ID NO: 2457997 - DNA, 22 bp, Homo sapiens
tcaaatgagtaacatttgctgt

SEQ ID NO: 2457998 - DNA, 20 bp, Homo sapiens
tcaaatggggccagatccag

SEQ ID NO: 2457999 - DNA, 20 bp, Homo sapiens
tcaaatggtaggcatttcct

SEQ ID NO: 2458000 - DNA, 13 bp, Homo sapiens
tcaaatgttctaa

SEQ ID NO: 2458001 - DNA, 15 bp, Homo sapiens
tcaaatgttctaagt

SEQ ID NO: 2458002 - DNA, 19 bp, Homo sapiens
tcaaatgttctaagtttct

SEQ ID NO: 2458003 - DNA, 22 bp, Homo sapiens
tcaaatgttctaagtttctaag

SEQ ID NO: 2458004 - DNA, 20 bp, Homo sapiens
tcaaatttgtagggtttcta

SEQ ID NO: 2458005 - DNA, 23 bp, Homo sapiens
tcaaatttgtagggtttctaggt

SEQ ID NO: 2458006 - DNA, 18 bp, Homo sapiens
tcaacaaaaattgtccct

SEQ ID NO: 2458007 - DNA, 18 bp, Homo sapiens
tcaacaatttcaataaaa

SEQ ID NO: 2458008 - DNA, 22 bp, Homo sapiens
tcaacacccagtttccttggga

SEQ ID NO: 2458009 - DNA, 17 bp, Homo sapiens
tcaacaggcctcagggc

SEQ ID NO: 2458010 - DNA, 13 bp, Homo sapiens
tcaacagtaaacc

SEQ ID NO: 2458011 - DNA, 22 bp, Homo sapiens
tcaacagtaaaccactgaaaaa

SEQ ID NO: 2458012 - DNA, 17 bp, Homo sapiens
tcaacagtgaagacaga

SEQ ID NO: 2458013 - DNA, 14 bp, Homo sapiens
tcaacagttttcct

SEQ ID NO: 2458014 - DNA, 17 bp, Homo sapiens
tcaacagttttcctatg

SEQ ID NO: 2458015 - DNA, 14 bp, Homo sapiens
tcaacatttctcaa

SEQ ID NO: 2458016 - DNA, 13 bp, Homo sapiens
tcaacctgcctga

SEQ ID NO: 2458017 - DNA, 23 bp, Homo sapiens
tcaactctcttattgcctcactt

SEQ ID NO: 2458018 - DNA, 14 bp, Homo sapiens
tcaacttgcttatc

SEQ ID NO: 2458019 - DNA, 18 bp, Homo sapiens
tcaactttactgtaatat

SEQ ID NO: 2458020 - DNA, 22 bp, Homo sapiens
tcaagacccttttgggtttctg

SEQ ID NO: 2458021 - DNA, 13 bp, Homo sapiens
tcaagaggagccc

SEQ ID NO: 2458022 - DNA, 19 bp, Homo sapiens
tcaagagtgaattccctca

SEQ ID NO: 2458023 - DNA, 18 bp, Homo sapiens
tcaagcagcgaccgcccc

SEQ ID NO: 2458024 - DNA, 21 bp, Homo sapiens
tcaagcagcgaccgccccctc

SEQ ID NO: 2458025 - DNA, 18 bp, Homo sapiens
tcaagcagtcgtgcctgt

SEQ ID NO: 2458026 - DNA, 19 bp, Homo sapiens
tcaagcagtcgtgcctgtg

SEQ ID NO: 2458027 - DNA, 20 bp, Homo sapiens
tcaagcagtcgtgcctgtgt

SEQ ID NO: 2458028 - DNA, 21 bp, Homo sapiens
tcaagcagtcgtgcctgtgtc

SEQ ID NO: 2458029 - DNA, 22 bp, Homo sapiens
tcaagcagtcgtgcctgtgtcc

SEQ ID NO: 2458030 - DNA, 11 bp, Homo sapiens
tcaagctctga

SEQ ID NO: 2458031 - DNA, 20 bp, Homo sapiens
tcaaggaagtagaaacaaaa

SEQ ID NO: 2458032 - DNA, 16 bp, Homo sapiens
tcaaggaatttcttaa

SEQ ID NO: 2458033 - DNA, 21 bp, Homo sapiens
tcaaggacacgggcctgtcca

SEQ ID NO: 2458034 - DNA, 16 bp, Homo sapiens
tcaaggcactctagat

SEQ ID NO: 2458035 - DNA, 16 bp, Homo sapiens
tcaaggcggtgcttga

SEQ ID NO: 2458036 - DNA, 15 bp, Homo sapiens
tcaagggtcaggcct

SEQ ID NO: 2458037 - DNA, 16 bp, Homo sapiens
tcaagggtcaggcctt

SEQ ID NO: 2458038 - DNA, 11 bp, Homo sapiens
tcaaggttcta

SEQ ID NO: 2458039 - DNA, 18 bp, Homo sapiens
tcaaggttttaggttcta

SEQ ID NO: 2458040 - DNA, 22 bp, Homo sapiens
tcaaggttttaggttctaaagt

SEQ ID NO: 2458041 - DNA, 14 bp, Homo sapiens
tcaagtctctgctg

SEQ ID NO: 2458042 - DNA, 18 bp, Homo sapiens
tcaagtctttctctttcc

SEQ ID NO: 2458043 - DNA, 21 bp, Homo sapiens
tcaagtctttctctttccctg

SEQ ID NO: 2458044 - DNA, 22 bp, Homo sapiens
tcaagtctttctctttccctgg

SEQ ID NO: 2458045 - DNA, 13 bp, Homo sapiens
tcaagttctaaga

SEQ ID NO: 2458046 - DNA, 16 bp, Homo sapiens
tcaagttgattagaaa

SEQ ID NO: 2458047 - DNA, 21 bp, Homo sapiens
tcaagttgattagaaagacca

SEQ ID NO: 2458048 - DNA, 19 bp, Homo sapiens
tcaatacagatatattttc

SEQ ID NO: 2458049 - DNA, 13 bp, Homo sapiens
tcaatagccacta

SEQ ID NO: 2458050 - DNA, 18 bp, Homo sapiens
tcaatataagcttttctt

SEQ ID NO: 2458051 - DNA, 18 bp, Homo sapiens
tcaatcaactttactgta

SEQ ID NO: 2458052 - DNA, 21 bp, Homo sapiens
tcaatcagtctcagaatgtca

SEQ ID NO: 2458053 - DNA, 21 bp, Homo sapiens
tcaatgaattttataatctgc

SEQ ID NO: 2458054 - DNA, 14 bp, Homo sapiens
tcaatgacatgaat

SEQ ID NO: 2458055 - DNA, 16 bp, Homo sapiens
tcaatgacatgaattt

SEQ ID NO: 2458056 - DNA, 19 bp, Homo sapiens
tcaatgagcatgtttagac

SEQ ID NO: 2458057 - DNA, 17 bp, Homo sapiens
tcaatgaggtgtccaac

SEQ ID NO: 2458058 - DNA, 14 bp, Homo sapiens
tcaattatagtttc

SEQ ID NO: 2458059 - DNA, 18 bp, Homo sapiens
tcaattatagtttctgag

SEQ ID NO: 2458060 - DNA, 21 bp, Homo sapiens
tcaattccaacagtttaatga

SEQ ID NO: 2458061 - DNA, 16 bp, Homo sapiens
tcaattgcatctccca

SEQ ID NO: 2458062 - DNA, 18 bp, Homo sapiens
tcaattgcatctcccaga

SEQ ID NO: 2458063 - DNA, 22 bp, Homo sapiens
tcaattgcatctcccagataat

SEQ ID NO: 2458064 - DNA, 14 bp, Homo sapiens
tcaatttatttgaa

SEQ ID NO: 2458065 - DNA, 20 bp, Homo sapiens
tcaatttatttgaatgattt

SEQ ID NO: 2458066 - DNA, 15 bp, Homo sapiens
tcaatttctgtgttg

SEQ ID NO: 2458067 - DNA, 19 bp, Homo sapiens
tcacaaacttcatttcaga

SEQ ID NO: 2458068 - DNA, 17 bp, Homo sapiens
tcacaaagtggaacgaa

SEQ ID NO: 2458069 - DNA, 22 bp, Homo sapiens
tcacaaggcagcaaggcccgag

SEQ ID NO: 2458070 - DNA, 17 bp, Homo sapiens
tatgtctggttctcaat

SEQ ID NO: 2458071 - DNA, 23 bp, Homo sapiens
tgcatcagaaagggagggctctg

SEQ ID NO: 2458072 - DNA, 17 bp, Homo sapiens
tgcatctggagagaaca

SEQ ID NO: 2458073 - DNA, 20 bp, Homo sapiens
tgcatgaaaaatcatgggcc

SEQ ID NO: 2458074 - DNA, 14 bp, Homo sapiens
tgcatgcccagaga

SEQ ID NO: 2458075 - DNA, 19 bp, Homo sapiens
tgcatggcagggggctgct

SEQ ID NO: 2458076 - DNA, 20 bp, Homo sapiens
tgcatggcagggggctgctg

SEQ ID NO: 2458077 - DNA, 21 bp, Homo sapiens
tgcatggcagggggctgctgc

SEQ ID NO: 2458078 - DNA, 11 bp, Homo sapiens
tgcatggcatc

SEQ ID NO: 2458079 - DNA, 19 bp, Homo sapiens
tgcatggtgccccaggacc

SEQ ID NO: 2458080 - DNA, 21 bp, Homo sapiens
tgcatggtgccccaggaccag

SEQ ID NO: 2458081 - DNA, 23 bp, Homo sapiens
tgcatgtaacgcaagttcccagt

SEQ ID NO: 2458082 - DNA, 14 bp, Homo sapiens
tgcatgtagtaaca

SEQ ID NO: 2458083 - DNA, 19 bp, Homo sapiens
tgcatgttgtctaagaaat

SEQ ID NO: 2458084 - DNA, 14 bp, Homo sapiens
tgcattaaattcac

SEQ ID NO: 2458085 - DNA, 22 bp, Homo sapiens
tgcattagggatgcctcctttc

SEQ ID NO: 2458086 - DNA, 22 bp, Homo sapiens
tgcattatatcaaatctaccac

SEQ ID NO: 2458087 - DNA, 19 bp, Homo sapiens
tgcattctgcctctctagg

SEQ ID NO: 2458088 - DNA, 20 bp, Homo sapiens
tgcattctgcctctctagga

SEQ ID NO: 2458089 - DNA, 16 bp, Homo sapiens
tgcattcttctctgtt

SEQ ID NO: 2458090 - DNA, 18 bp, Homo sapiens
tgcattgaacacaaactg

SEQ ID NO: 2458091 - DNA, 22 bp, Homo sapiens
tgcattgaacacaaactgtaaa

SEQ ID NO: 2458092 - DNA, 18 bp, Homo sapiens
tgcattgactttccccac

SEQ ID NO: 2458093 - DNA, 19 bp, Homo sapiens
tgcattgcttttttttcct

SEQ ID NO: 2458094 - DNA, 20 bp, Homo sapiens
tgcatttggagggagtgagt

SEQ ID NO: 2458095 - DNA, 14 bp, Homo sapiens
tgcatttgggtcca

SEQ ID NO: 2458096 - DNA, 19 bp, Homo sapiens
tgcatttgggtccaggagg

SEQ ID NO: 2458097 - DNA, 22 bp, Homo sapiens
tgcatttgtttatgtaatttca

SEQ ID NO: 2458098 - DNA, 21 bp, Homo sapiens
tgccaaaaagtgaaataatgt

SEQ ID NO: 2458099 - DNA, 17 bp, Homo sapiens
tgccaaacaaaaaggtt

SEQ ID NO: 2458100 - DNA, 16 bp, Homo sapiens
tgccaaatatgtcctg

SEQ ID NO: 2458101 - DNA, 13 bp, Homo sapiens
tgccaaattaaaa

SEQ ID NO: 2458102 - DNA, 18 bp, Homo sapiens
tgccaaattaaaaaagat

SEQ ID NO: 2458103 - DNA, 15 bp, Homo sapiens
tgccaagctccaagc

SEQ ID NO: 2458104 - DNA, 23 bp, Homo sapiens
tgccaagctccaagccccatctt

SEQ ID NO: 2458105 - DNA, 16 bp, Homo sapiens
tgccaaggcagaggcc

SEQ ID NO: 2458106 - DNA, 17 bp, Homo sapiens
tgccaaggcagaggcct

SEQ ID NO: 2458107 - DNA, 22 bp, Homo sapiens
tgccaaggcagaggcctgggct

SEQ ID NO: 2458108 - DNA, 21 bp, Homo sapiens
tgccaagggctttgttttgca

SEQ ID NO: 2458109 - DNA, 15 bp, Homo sapiens
tgccaagtccaggtc

SEQ ID NO: 2458110 - DNA, 12 bp, Homo sapiens
tgccacagccct

SEQ ID NO: 2458111 - DNA, 21 bp, Homo sapiens
tgccacagccctgtcagcatg

SEQ ID NO: 2458112 - DNA, 15 bp, Homo sapiens
tgccacctcccccca

SEQ ID NO: 2458113 - DNA, 17 bp, Homo sapiens
tgccacctccccccaca

SEQ ID NO: 2458114 - DNA, 18 bp, Homo sapiens
tgccacctctaacagcac

SEQ ID NO: 2458115 - DNA, 19 bp, Homo sapiens
tgccacctctaacagcacc

SEQ ID NO: 2458116 - DNA, 20 bp, Homo sapiens
tgccacctctaacagcacca

SEQ ID NO: 2458117 - DNA, 18 bp, Homo sapiens
tgccacctggacccctgc

SEQ ID NO: 2458118 - DNA, 19 bp, Homo sapiens
tgccacctggacccctgca

SEQ ID NO: 2458119 - DNA, 20 bp, Homo sapiens
tgccacctggacccctgcat

SEQ ID NO: 2458120 - DNA, 17 bp, Homo sapiens
tgccactcactaggccc

SEQ ID NO: 2458121 - DNA, 18 bp, Homo sapiens
tgccactcactaggcccc

SEQ ID NO: 2458122 - DNA, 19 bp, Homo sapiens
tgccactgccttcgcttct

SEQ ID NO: 2458123 - DNA, 15 bp, Homo sapiens
tgccactgtgtgaat

SEQ ID NO: 2458124 - DNA, 18 bp, Homo sapiens
tgccacttaatgtatgtt

SEQ ID NO: 2458125 - DNA, 14 bp, Homo sapiens
tgccagagatccaa

SEQ ID NO: 2458126 - DNA, 11 bp, Homo sapiens
tgccagagcct

SEQ ID NO: 2458127 - DNA, 19 bp, Homo sapiens
tgccagctacttcctcctc

SEQ ID NO: 2458128 - DNA, 23 bp, Homo sapiens
tgccagctctgtatcaggaccca

SEQ ID NO: 2458129 - DNA, 14 bp, Homo sapiens
tgccagcttcaggt

SEQ ID NO: 2458130 - DNA, 13 bp, Homo sapiens
tgccaggagggac

SEQ ID NO: 2458131 - DNA, 23 bp, Homo sapiens
tgccaggagggacaaaggagcct

SEQ ID NO: 2458132 - DNA, 17 bp, Homo sapiens
tgccagggcccctctcc

SEQ ID NO: 2458133 - DNA, 21 bp, Homo sapiens
tgccagtattttaaaatagcg

SEQ ID NO: 2458134 - DNA, 14 bp, Homo sapiens
tgccagtcctgtcc

SEQ ID NO: 2458135 - DNA, 15 bp, Homo sapiens
tgccagtcctgtcct

SEQ ID NO: 2458136 - DNA, 17 bp, Homo sapiens
tgccatagtcttaactg

SEQ ID NO: 2458137 - DNA, 18 bp, Homo sapiens
tgccatatgatttacatt

SEQ ID NO: 2458138 - DNA, 17 bp, Homo sapiens
tgccatattttcaccat

SEQ ID NO: 2458139 - DNA, 13 bp, Homo sapiens
tgccatcatctcc

SEQ ID NO: 2458140 - DNA, 15 bp, Homo sapiens
tgccatcatctcctg

SEQ ID NO: 2458141 - DNA, 18 bp, Homo sapiens
tgccatgtacagtatgtt

SEQ ID NO: 2458142 - DNA, 14 bp, Homo sapiens
tgccattaaagaat

SEQ ID NO: 2458143 - DNA, 15 bp, Homo sapiens
tgccatttgtactga

SEQ ID NO: 2458144 - DNA, 23 bp, Homo sapiens
tgccatttgtactgaccccatca

SEQ ID NO: 2458145 - DNA, 19 bp, Homo sapiens
tgcccaaagattgatttgt

SEQ ID NO: 2458146 - DNA, 23 bp, Homo sapiens
tgcccaaagcagcacttataaat

SEQ ID NO: 2458147 - DNA, 22 bp, Homo sapiens
tgcccaacccttccctcacctt

SEQ ID NO: 2458148 - DNA, 19 bp, Homo sapiens
tgcccacggagtcgtgggg

SEQ ID NO: 2458149 - DNA, 15 bp, Homo sapiens
tgcccacgtacccag

SEQ ID NO: 2458150 - DNA, 21 bp, Homo sapiens
tgcccacgtacccaggtctgg

SEQ ID NO: 2458151 - DNA, 17 bp, Homo sapiens
tgcccagaataagttat

SEQ ID NO: 2458152 - DNA, 17 bp, Homo sapiens
tgcccagagacccagcg

SEQ ID NO: 2458153 - DNA, 18 bp, Homo sapiens
tgcccagagacccagcgg

SEQ ID NO: 2458154 - DNA, 20 bp, Homo sapiens
tgcccagttaatcttgcttt

SEQ ID NO: 2458155 - DNA, 22 bp, Homo sapiens
tgcccagttaatcttgctttct

SEQ ID NO: 2458156 - DNA, 18 bp, Homo sapiens
tgccccaactccttccag

SEQ ID NO: 2458157 - DNA, 19 bp, Homo sapiens
tgccccaactccttccagc

SEQ ID NO: 2458158 - DNA, 15 bp, Homo sapiens
tgccccaagtcctca

SEQ ID NO: 2458159 - DNA, 19 bp, Homo sapiens
tgccccaggaccagctcag

SEQ ID NO: 2458160 - DNA, 14 bp, Homo sapiens
tgccccaggcctga

SEQ ID NO: 2458161 - DNA, 18 bp, Homo sapiens
tgccccatcagtgctccc

SEQ ID NO: 2458162 - DNA, 21 bp, Homo sapiens
tgccccatcagtgctccctca

SEQ ID NO: 2458163 - DNA, 21 bp, Homo sapiens
tgcccccagggtcctgggagg

SEQ ID NO: 2458164 - DNA, 22 bp, Homo sapiens
tgcccccagggtcctgggagga

SEQ ID NO: 2458165 - DNA, 19 bp, Homo sapiens
tgccccccagcctctggca

SEQ ID NO: 2458166 - DNA, 21 bp, Homo sapiens
tgccccctaatccccttctcc

SEQ ID NO: 2458167 - DNA, 23 bp, Homo sapiens
tgccccctaatccccttctcccc

SEQ ID NO: 2458168 - DNA, 12 bp, Homo sapiens
tgccccctgcag

SEQ ID NO: 2458169 - DNA, 13 bp, Homo sapiens
tgccccctgcaga

SEQ ID NO: 2458170 - DNA, 14 bp, Homo sapiens
tgccccctgcagaa

SEQ ID NO: 2458171 - DNA, 16 bp, Homo sapiens
tgccccctgcaggaag

SEQ ID NO: 2458172 - DNA, 20 bp, Homo sapiens
tgcccctctccttcttagct

SEQ ID NO: 2458173 - DNA, 19 bp, Homo sapiens
tgcccctttataaatccaa

SEQ ID NO: 2458174 - DNA, 21 bp, Homo sapiens
tgcccggggaaaggcaaggtc

SEQ ID NO: 2458175 - DNA, 14 bp, Homo sapiens
tgaggagccccagc

SEQ ID NO: 2458176 - DNA, 12 bp, Homo sapiens
tgaggagctggg

SEQ ID NO: 2458177 - DNA, 21 bp, Homo sapiens
tgaggcagcagtgtgaggcca

SEQ ID NO: 2458178 - DNA, 23 bp, Homo sapiens
tgaggcagccgaggtccctgctg

SEQ ID NO: 2458179 - DNA, 19 bp, Homo sapiens
tgaggccacactcagcaca

SEQ ID NO: 2458180 - DNA, 16 bp, Homo sapiens
tgaggccacccagagg

SEQ ID NO: 2458181 - DNA, 15 bp, Homo sapiens
tgaggccactgtgtt

SEQ ID NO: 2458182 - DNA, 12 bp, Homo sapiens
tgaggccagcct

SEQ ID NO: 2458183 - DNA, 13 bp, Homo sapiens
tgaggccagcctg

SEQ ID NO: 2458184 - DNA, 21 bp, Homo sapiens
tgaggccagcctggcctcctg

SEQ ID NO: 2458185 - DNA, 13 bp, Homo sapiens
tgaggccagggca

SEQ ID NO: 2458186 - DNA, 14 bp, Homo sapiens
tgaggccatggact

SEQ ID NO: 2458187 - DNA, 20 bp, Homo sapiens
tgaggccatggactctgtcc

SEQ ID NO: 2458188 - DNA, 21 bp, Homo sapiens
tgaggccctccacacctgcgg

SEQ ID NO: 2458189 - DNA, 23 bp, Homo sapiens
tgaggccctccacacctgcggcc

SEQ ID NO: 2458190 - DNA, 13 bp, Homo sapiens
tgaggcctgggcc

SEQ ID NO: 2458191 - DNA, 21 bp, Homo sapiens
tgaggctgtggtcacagcgga

SEQ ID NO: 2458192 - DNA, 13 bp, Homo sapiens
tgaggctttggat

SEQ ID NO: 2458193 - DNA, 18 bp, Homo sapiens
tgaggctttggatttgac

SEQ ID NO: 2458194 - DNA, 17 bp, Homo sapiens
tgagggaaaagaaaaag

SEQ ID NO: 2458195 - DNA, 12 bp, Homo sapiens
tgagggcagcag

SEQ ID NO: 2458196 - DNA, 17 bp, Homo sapiens
tgagggcagcagccagc

SEQ ID NO: 2458197 - DNA, 18 bp, Homo sapiens
tgagggcagcagccagcc

SEQ ID NO: 2458198 - DNA, 21 bp, Homo sapiens
tgagggcagcagccagccctg

SEQ ID NO: 2458199 - DNA, 18 bp, Homo sapiens
tgagggcagttcgcagcc

SEQ ID NO: 2458200 - DNA, 19 bp, Homo sapiens
tgagggcagttcgcagcca

SEQ ID NO: 2458201 - DNA, 15 bp, Homo sapiens
tgaggggaccaggag

SEQ ID NO: 2458202 - DNA, 20 bp, Homo sapiens
tgagggggggctccctgggg

SEQ ID NO: 2458203 - DNA, 16 bp, Homo sapiens
tgaggggttcctcccc

SEQ ID NO: 2458204 - DNA, 22 bp, Homo sapiens
tgagggtctgtaggttgcacac

SEQ ID NO: 2458205 - DNA, 23 bp, Homo sapiens
tgagggtctgtaggttgcacact

SEQ ID NO: 2458206 - DNA, 14 bp, Homo sapiens
tgaggtcctgagca

SEQ ID NO: 2458207 - DNA, 17 bp, Homo sapiens
tgaggtcctgagcactg

SEQ ID NO: 2458208 - DNA, 19 bp, Homo sapiens
tgaggtcctgagcactgcc

SEQ ID NO: 2458209 - DNA, 22 bp, Homo sapiens
tgaggtcctgagcactgccagg

SEQ ID NO: 2458210 - DNA, 14 bp, Homo sapiens
tgaggtctcagccc

SEQ ID NO: 2458211 - DNA, 15 bp, Homo sapiens
tgaggtctcagcccc

SEQ ID NO: 2458212 - DNA, 13 bp, Homo sapiens
tgaggtctgttcc

SEQ ID NO: 2458213 - DNA, 13 bp, Homo sapiens
tgaggtgcccagg

SEQ ID NO: 2458214 - DNA, 15 bp, Homo sapiens
tgaggtgcctgtccc

SEQ ID NO: 2458215 - DNA, 16 bp, Homo sapiens
tgaggtgcctgtccca

SEQ ID NO: 2458216 - DNA, 15 bp, Homo sapiens
tgaggtgtgtcacaa

SEQ ID NO: 2458217 - DNA, 10 bp, Homo sapiens
tgagtaacat

SEQ ID NO: 2458218 - DNA, 23 bp, Homo sapiens
tgagtacagagtgtggactctgg

SEQ ID NO: 2458219 - DNA, 18 bp, Homo sapiens
tgagtattaaaatgtatg

SEQ ID NO: 2458220 - DNA, 21 bp, Homo sapiens
tgagtcagagccatgtcttct

SEQ ID NO: 2458221 - DNA, 21 bp, Homo sapiens
tgagtcctggatgatactaat

SEQ ID NO: 2458222 - DNA, 16 bp, Homo sapiens
tgagtctttggttcta

SEQ ID NO: 2458223 - DNA, 13 bp, Homo sapiens
tgagtgctctgat

SEQ ID NO: 2458224 - DNA, 19 bp, Homo sapiens
tgagtgctctgatccctct

SEQ ID NO: 2458225 - DNA, 19 bp, Homo sapiens
tgagtgcttgcttttcatg

SEQ ID NO: 2458226 - DNA, 21 bp, Homo sapiens
tgagtggcaggggacaggagt

SEQ ID NO: 2458227 - DNA, 12 bp, Homo sapiens
tgagtggccctt

SEQ ID NO: 2458228 - DNA, 12 bp, Homo sapiens
tgagtgggaagc

SEQ ID NO: 2458229 - DNA, 22 bp, Homo sapiens
tgagtgtattttttaaaattga

SEQ ID NO: 2458230 - DNA, 19 bp, Homo sapiens
tgagtgtgcggctgtgtgt

SEQ ID NO: 2458231 - DNA, 19 bp, Homo sapiens
tgagtgttttatgagaaag

SEQ ID NO: 2458232 - DNA, 17 bp, Homo sapiens
tgagttccagaaagtaa

SEQ ID NO: 2458233 - DNA, 22 bp, Homo sapiens
tgagttggcttacctggcccat

SEQ ID NO: 2458234 - DNA, 16 bp, Homo sapiens
tgagtttaccttgtat

SEQ ID NO: 2458235 - DNA, 21 bp, Homo sapiens
tgagttttgtgtttgttgtag

SEQ ID NO: 2458236 - DNA, 16 bp, Homo sapiens
tgataaaaccatgtag

SEQ ID NO: 2458237 - DNA, 18 bp, Homo sapiens
tgataaagattttttaat

SEQ ID NO: 2458238 - DNA, 20 bp, Homo sapiens
tgataaagcctcaaggtttt

SEQ ID NO: 2458239 - DNA, 17 bp, Homo sapiens
tgataagagaatcaaca

SEQ ID NO: 2458240 - DNA, 12 bp, Homo sapiens
tgataagatctt

SEQ ID NO: 2458241 - DNA, 22 bp, Homo sapiens
tgataagatcttttattttgcc

SEQ ID NO: 2458242 - DNA, 15 bp, Homo sapiens
tgataatgaacagaa

SEQ ID NO: 2458243 - DNA, 20 bp, Homo sapiens
tgataatgaacagaacatag

SEQ ID NO: 2458244 - DNA, 14 bp, Homo sapiens
tgataattttaaat

SEQ ID NO: 2458245 - DNA, 14 bp, Homo sapiens
tgataccagctgga

SEQ ID NO: 2458246 - DNA, 14 bp, Homo sapiens
tgatactaagcatt

SEQ ID NO: 2458247 - DNA, 16 bp, Homo sapiens
tgatactaagcattga

SEQ ID NO: 2458248 - DNA, 20 bp, Homo sapiens
tgatacttcgacactgttct

SEQ ID NO: 2458249 - DNA, 21 bp, Homo sapiens
tgatacttcgacactgttctt

SEQ ID NO: 2458250 - DNA, 19 bp, Homo sapiens
tgatagaaatgccaagcac

SEQ ID NO: 2458251 - DNA, 18 bp, Homo sapiens
tgatagcaaatggcctca

SEQ ID NO: 2458252 - DNA, 18 bp, Homo sapiens
tgatcaattatagtttct

SEQ ID NO: 2458253 - DNA, 22 bp, Homo sapiens
tgatcaattatagtttctgagg

SEQ ID NO: 2458254 - DNA, 18 bp, Homo sapiens
tgatcagaccataatgtt

SEQ ID NO: 2458255 - DNA, 16 bp, Homo sapiens
tgatcagccccaccct

SEQ ID NO: 2458256 - DNA, 19 bp, Homo sapiens
tgatccatgtaactgccta

SEQ ID NO: 2458257 - DNA, 20 bp, Homo sapiens
tgatccatgtaactgcctag

SEQ ID NO: 2458258 - DNA, 15 bp, Homo sapiens
tgatccatttctaat

SEQ ID NO: 2458259 - DNA, 20 bp, Homo sapiens
tgatccctgtgttgtctcta

SEQ ID NO: 2458260 - DNA, 15 bp, Homo sapiens
tgatcctggaggccc

SEQ ID NO: 2458261 - DNA, 13 bp, Homo sapiens
tgatcgccttccc

SEQ ID NO: 2458262 - DNA, 15 bp, Homo sapiens
tgatcgccttcccca

SEQ ID NO: 2458263 - DNA, 18 bp, Homo sapiens
tgatctacttctgtaatt

SEQ ID NO: 2458264 - DNA, 15 bp, Homo sapiens
tgatctccgtggctt

SEQ ID NO: 2458265 - DNA, 22 bp, Homo sapiens
tgatctgatagggtttgtgaca

SEQ ID NO: 2458266 - DNA, 14 bp, Homo sapiens
tgatctggaaccca

SEQ ID NO: 2458267 - DNA, 15 bp, Homo sapiens
tgatctggaacccag

SEQ ID NO: 2458268 - DNA, 19 bp, Homo sapiens
tgatctgtctgtggcaaaa

SEQ ID NO: 2458269 - DNA, 21 bp, Homo sapiens
tgatgaaaaattgctgactgt

SEQ ID NO: 2458270 - DNA, 18 bp, Homo sapiens
tgatgaactcttaatcaa

SEQ ID NO: 2458271 - DNA, 14 bp, Homo sapiens
tgatgaagagagag

SEQ ID NO: 2458272 - DNA, 21 bp, Homo sapiens
tgatgaggccctccacacctg

SEQ ID NO: 2458273 - DNA, 23 bp, Homo sapiens
tgatgaggccctccacacctgcg

SEQ ID NO: 2458274 - DNA, 15 bp, Homo sapiens
tgatgagggcagcag

SEQ ID NO: 2458275 - DNA, 22 bp, Homo sapiens
tgatgagggcagcagccagccc

SEQ ID NO: 2458276 - DNA, 24 bp, Homo sapiens
tgatgagggcagcagccagccctg

SEQ ID NO: 2458277 - DNA, 13 bp, Homo sapiens
tgatgagttgtga

SEQ ID NO: 2458278 - DNA, 21 bp, Homo sapiens
tgatgcatcagaaagggaggg

SEQ ID NO: 2458279 - DNA, 16 bp, Homo sapiens
tgctacttatataatt

SEQ ID NO: 2458280 - DNA, 14 bp, Homo sapiens
tgctaggccagagc

SEQ ID NO: 2458281 - DNA, 18 bp, Homo sapiens
tgctaggccagagcccac

SEQ ID NO: 2458282 - DNA, 19 bp, Homo sapiens
tgctaggccagagcccact

SEQ ID NO: 2458283 - DNA, 17 bp, Homo sapiens
tgctatcattattcgta

SEQ ID NO: 2458284 - DNA, 12 bp, Homo sapiens
tgctattctgtc

SEQ ID NO: 2458285 - DNA, 20 bp, Homo sapiens
tgctattctgtccctaggtg

SEQ ID NO: 2458286 - DNA, 21 bp, Homo sapiens
tgctcaataaatgattcttag

SEQ ID NO: 2458287 - DNA, 17 bp, Homo sapiens
tgctcagccctgaggac

SEQ ID NO: 2458288 - DNA, 17 bp, Homo sapiens
tgctcagctctgggcca

SEQ ID NO: 2458289 - DNA, 18 bp, Homo sapiens
tgctcagctctgggccat

SEQ ID NO: 2458290 - DNA, 17 bp, Homo sapiens
tgctcatcattctctgt

SEQ ID NO: 2458291 - DNA, 15 bp, Homo sapiens
tgctcatctgctggt

SEQ ID NO: 2458292 - DNA, 16 bp, Homo sapiens
tgctcatctgctggtc

SEQ ID NO: 2458293 - DNA, 19 bp, Homo sapiens
tgctccaagattctagatg

SEQ ID NO: 2458294 - DNA, 17 bp, Homo sapiens
tgctccagacagggaat

SEQ ID NO: 2458295 - DNA, 14 bp, Homo sapiens
tgctcccacctcct

SEQ ID NO: 2458296 - DNA, 18 bp, Homo sapiens
tgctcccacctcctgaca

SEQ ID NO: 2458297 - DNA, 15 bp, Homo sapiens
tgctccctcacatgt

SEQ ID NO: 2458298 - DNA, 12 bp, Homo sapiens
tgctccctcaga

SEQ ID NO: 2458299 - DNA, 13 bp, Homo sapiens
tgctcctcttccc

SEQ ID NO: 2458300 - DNA, 16 bp, Homo sapiens
tgctcctcttccccag

SEQ ID NO: 2458301 - DNA, 21 bp, Homo sapiens
tgctcctggatctccctgaga

SEQ ID NO: 2458302 - DNA, 12 bp, Homo sapiens
tgctccttgggc

SEQ ID NO: 2458303 - DNA, 14 bp, Homo sapiens
tgctcgccccagca

SEQ ID NO: 2458304 - DNA, 13 bp, Homo sapiens
tgctcgccctgcg

SEQ ID NO: 2458305 - DNA, 21 bp, Homo sapiens
tgctcggggtgcacaggaggg

SEQ ID NO: 2458306 - DNA, 22 bp, Homo sapiens
tgctcggggtgcacaggagggg

SEQ ID NO: 2458307 - DNA, 16 bp, Homo sapiens
tgctctaacagccctc

SEQ ID NO: 2458308 - DNA, 11 bp, Homo sapiens
tgctctcctct

SEQ ID NO: 2458309 - DNA, 13 bp, Homo sapiens
tgctctcctcttc

SEQ ID NO: 2458310 - DNA, 18 bp, Homo sapiens
tgctctgaacacgaagct

SEQ ID NO: 2458311 - DNA, 16 bp, Homo sapiens
tgctctgatgcatcag

SEQ ID NO: 2458312 - DNA, 22 bp, Homo sapiens
tgctctgcgtgtcacctgtgct

SEQ ID NO: 2458313 - DNA, 20 bp, Homo sapiens
tgctcttggctggacccagc

SEQ ID NO: 2458314 - DNA, 17 bp, Homo sapiens
tgctctttctctgccag

SEQ ID NO: 2458315 - DNA, 21 bp, Homo sapiens
tgctctttctctgccagtgac

SEQ ID NO: 2458316 - DNA, 20 bp, Homo sapiens
tgctctttgttttgtgtctc

SEQ ID NO: 2458317 - DNA, 18 bp, Homo sapiens
tgctgaatgttgggactg

SEQ ID NO: 2458318 - DNA, 15 bp, Homo sapiens
tgctgagaaaacatg

SEQ ID NO: 2458319 - DNA, 17 bp, Homo sapiens
tgctgagaacctggcct

SEQ ID NO: 2458320 - DNA, 18 bp, Homo sapiens
tgctgagaacctggcctt

SEQ ID NO: 2458321 - DNA, 22 bp, Homo sapiens
tgctgagagggctcgaggggtg

SEQ ID NO: 2458322 - DNA, 15 bp, Homo sapiens
tgctgagctctgaga

SEQ ID NO: 2458323 - DNA, 21 bp, Homo sapiens
tgctgagctctgagaggccct

SEQ ID NO: 2458324 - DNA, 22 bp, Homo sapiens
tgctgagctctgagaggccctg

SEQ ID NO: 2458325 - DNA, 15 bp, Homo sapiens
tgctgaggcctgggc

SEQ ID NO: 2458326 - DNA, 14 bp, Homo sapiens
tgctgccactgagg

SEQ ID NO: 2458327 - DNA, 16 bp, Homo sapiens
tgctgcccatgtttca

SEQ ID NO: 2458328 - DNA, 19 bp, Homo sapiens
tgctgccccatcagtgctc

SEQ ID NO: 2458329 - DNA, 20 bp, Homo sapiens
tgctgccttattcagggaag

SEQ ID NO: 2458330 - DNA, 14 bp, Homo sapiens
tgctgctccctcag

SEQ ID NO: 2458331 - DNA, 17 bp, Homo sapiens
tgctgctcttggctgga

SEQ ID NO: 2458332 - DNA, 19 bp, Homo sapiens
tgctgctcttggctggacc

SEQ ID NO: 2458333 - DNA, 22 bp, Homo sapiens
tgcttgccaaggcagaggcctg

SEQ ID NO: 2458334 - DNA, 21 bp, Homo sapiens
tgcttgccctaagcagaaagt

SEQ ID NO: 2458335 - DNA, 18 bp, Homo sapiens
tgctttaatataaatgca

SEQ ID NO: 2458336 - DNA, 22 bp, Homo sapiens
tgctttaatataaatgcaaata

SEQ ID NO: 2458337 - DNA, 17 bp, Homo sapiens
tgctttattccagaatg

SEQ ID NO: 2458338 - DNA, 18 bp, Homo sapiens
tgctttccattcgtgaaa

SEQ ID NO: 2458339 - DNA, 20 bp, Homo sapiens
tgctttccattcgtgaaaac

SEQ ID NO: 2458340 - DNA, 16 bp, Homo sapiens
tgctttgaagtagctc

SEQ ID NO: 2458341 - DNA, 18 bp, Homo sapiens
tgctttggacctaaatgg

SEQ ID NO: 2458342 - DNA, 24 bp, Homo sapiens
tgcttttagtattttagtgaactt

SEQ ID NO: 2458343 - DNA, 17 bp, Homo sapiens
tgcttttcatgcaaact

SEQ ID NO: 2458344 - DNA, 20 bp, Homo sapiens
tgcttttcatgcaaactctt

SEQ ID NO: 2458345 - DNA, 21 bp, Homo sapiens
tgcttttccctttgtgagtca

SEQ ID NO: 2458346 - DNA, 19 bp, Homo sapiens
tgcttttggcaaaactcta

SEQ ID NO: 2458347 - DNA, 17 bp, Homo sapiens
tgcttttggcggggagg

SEQ ID NO: 2458348 - DNA, 15 bp, Homo sapiens
tgctttttatttctg

SEQ ID NO: 2458349 - DNA, 18 bp, Homo sapiens
tgctttttatttctgcat

SEQ ID NO: 2458350 - DNA, 23 bp, Homo sapiens
tgctttttttgtgtgtatttgct

SEQ ID NO: 2458351 - DNA, 19 bp, Homo sapiens
tggaaaacagaacacttat

SEQ ID NO: 2458352 - DNA, 22 bp, Homo sapiens
tggaaacttttcttaaaaagtt

SEQ ID NO: 2458353 - DNA, 18 bp, Homo sapiens
tggaaataaatcttccta

SEQ ID NO: 2458354 - DNA, 14 bp, Homo sapiens
tggaaatttaaagc

SEQ ID NO: 2458355 - DNA, 16 bp, Homo sapiens
tggaaatttaaagcag

SEQ ID NO: 2458356 - DNA, 22 bp, Homo sapiens
tggaaatttaaagcaggttctt

SEQ ID NO: 2458357 - DNA, 15 bp, Homo sapiens
tggaaatttagcatt

SEQ ID NO: 2458358 - DNA, 17 bp, Homo sapiens
tggaaatttagcattgt

SEQ ID NO: 2458359 - DNA, 20 bp, Homo sapiens
tggaacactagacaagccag

SEQ ID NO: 2458360 - DNA, 20 bp, Homo sapiens
tggaacattggaatgttctc

SEQ ID NO: 2458361 - DNA, 13 bp, Homo sapiens
tggaaccagactc

SEQ ID NO: 2458362 - DNA, 18 bp, Homo sapiens
tggaacctcagcctggcc

SEQ ID NO: 2458363 - DNA, 13 bp, Homo sapiens
tggaactgctgcc

SEQ ID NO: 2458364 - DNA, 20 bp, Homo sapiens
tggaactggaatcctttcag

SEQ ID NO: 2458365 - DNA, 15 bp, Homo sapiens
tggaacttgcctgcc

SEQ ID NO: 2458366 - DNA, 21 bp, Homo sapiens
tggaacttgcctgcctttcca

SEQ ID NO: 2458367 - DNA, 22 bp, Homo sapiens
tggaagagcagcacctcctcag

SEQ ID NO: 2458368 - DNA, 14 bp, Homo sapiens
tggaagatagctgt

SEQ ID NO: 2458369 - DNA, 21 bp, Homo sapiens
tggaagatggggaccagcagc

SEQ ID NO: 2458370 - DNA, 17 bp, Homo sapiens
tggaagctaatttgcat

SEQ ID NO: 2458371 - DNA, 12 bp, Homo sapiens
tggaaggagcag

SEQ ID NO: 2458372 - DNA, 18 bp, Homo sapiens
tggaagttattaacttta

SEQ ID NO: 2458373 - DNA, 18 bp, Homo sapiens
tggaataaggcatggctc

SEQ ID NO: 2458374 - DNA, 22 bp, Homo sapiens
tggaatataattgttttatctg

SEQ ID NO: 2458375 - DNA, 20 bp, Homo sapiens
tggaatattgtccattgtcc

SEQ ID NO: 2458376 - DNA, 15 bp, Homo sapiens
ttaactctctttatg

SEQ ID NO: 2458377 - DNA, 17 bp, Homo sapiens
ttaactctctttatgtc

SEQ ID NO: 2458378 - DNA, 22 bp, Homo sapiens
ttaactgaataccactctgtaa

SEQ ID NO: 2458379 - DNA, 15 bp, Homo sapiens
ttaactgtggatatt

SEQ ID NO: 2458380 - DNA, 15 bp, Homo sapiens
ttaacttaaatagta

SEQ ID NO: 2458381 - DNA, 11 bp, Homo sapiens
ttaactttgtt

SEQ ID NO: 2458382 - DNA, 14 bp, Homo sapiens
ttaagaaggcaaaa

SEQ ID NO: 2458383 - DNA, 20 bp, Homo sapiens
ttaagaatatctgtaatggt

SEQ ID NO: 2458384 - DNA, 19 bp, Homo sapiens
ttaagaattgagtaatggt

SEQ ID NO: 2458385 - DNA, 22 bp, Homo sapiens
ttaagacctactgttctaaagc

SEQ ID NO: 2458386 - DNA, 11 bp, Homo sapiens
ttaagacctgg

SEQ ID NO: 2458387 - DNA, 14 bp, Homo sapiens
ttaagacctggcag

SEQ ID NO: 2458388 - DNA, 16 bp, Homo sapiens
ttaagataattataat

SEQ ID NO: 2458389 - DNA, 14 bp, Homo sapiens
ttaagctctgagct

SEQ ID NO: 2458390 - DNA, 17 bp, Homo sapiens
ttaagtttctctgcaga

SEQ ID NO: 2458391 - DNA, 12 bp, Homo sapiens
ttaataaaagaa

SEQ ID NO: 2458392 - DNA, 20 bp, Homo sapiens
ttaataaaagaaaattacaa

SEQ ID NO: 2458393 - DNA, 15 bp, Homo sapiens
ttaatactaccttga

SEQ ID NO: 2458394 - DNA, 15 bp, Homo sapiens
ttaatagcaaagaat

SEQ ID NO: 2458395 - DNA, 16 bp, Homo sapiens
ttaatagcagcctttc

SEQ ID NO: 2458396 - DNA, 15 bp, Homo sapiens
ttaatataaatgcaa

SEQ ID NO: 2458397 - DNA, 20 bp, Homo sapiens
ttaatatatattatcttttc

SEQ ID NO: 2458398 - DNA, 19 bp, Homo sapiens
ttaatatcctaaacatcat

SEQ ID NO: 2458399 - DNA, 16 bp, Homo sapiens
ttaatcatcaagagaa

SEQ ID NO: 2458400 - DNA, 12 bp, Homo sapiens
ttaatccaatgg

SEQ ID NO: 2458401 - DNA, 14 bp, Homo sapiens
ttaatcttagtgta

SEQ ID NO: 2458402 - DNA, 19 bp, Homo sapiens
ttaatcttagtgtatgatt

SEQ ID NO: 2458403 - DNA, 23 bp, Homo sapiens
ttaatgaagaaagtggaaaacaa

SEQ ID NO: 2458404 - DNA, 15 bp, Homo sapiens
ttaatgaagatctaa

SEQ ID NO: 2458405 - DNA, 16 bp, Homo sapiens
ttaatgcaatatactg

SEQ ID NO: 2458406 - DNA, 11 bp, Homo sapiens
ttaatgcactt

SEQ ID NO: 2458407 - DNA, 23 bp, Homo sapiens
ttaatgccgatatactctagatg

SEQ ID NO: 2458408 - DNA, 18 bp, Homo sapiens
ttaatggctgataatttt

SEQ ID NO: 2458409 - DNA, 15 bp, Homo sapiens
ttaatgtatgttacc

SEQ ID NO: 2458410 - DNA, 18 bp, Homo sapiens
ttaatgtatgttaccaaa

SEQ ID NO: 2458411 - DNA, 14 bp, Homo sapiens
ttaattattattct

SEQ ID NO: 2458412 - DNA, 14 bp, Homo sapiens
ttaattattatttg

SEQ ID NO: 2458413 - DNA, 18 bp, Homo sapiens
ttaatttaaacacctcct

SEQ ID NO: 2458414 - DNA, 22 bp, Homo sapiens
ttaatttacaaaaatataaaat

SEQ ID NO: 2458415 - DNA, 23 bp, Homo sapiens
ttaatttacaaaaatataaaata

SEQ ID NO: 2458416 - DNA, 13 bp, Homo sapiens
ttaatttgaaata

SEQ ID NO: 2458417 - DNA, 23 bp, Homo sapiens
ttaattttattttttataaaata

SEQ ID NO: 2458418 - DNA, 19 bp, Homo sapiens
ttaattttgaagtgctgtt

SEQ ID NO: 2458419 - DNA, 13 bp, Homo sapiens
ttaatttttccaa

SEQ ID NO: 2458420 - DNA, 18 bp, Homo sapiens
ttacaaaaatataaaata

SEQ ID NO: 2458421 - DNA, 13 bp, Homo sapiens
ttacaaactgaag

SEQ ID NO: 2458422 - DNA, 17 bp, Homo sapiens
ttacaaatcagaagtca

SEQ ID NO: 2458423 - DNA, 22 bp, Homo sapiens
ttacaaatcagaagtcatcttg

SEQ ID NO: 2458424 - DNA, 21 bp, Homo sapiens
ttacaaatgttaaaatgtgtt

SEQ ID NO: 2458425 - DNA, 23 bp, Homo sapiens
ttacaactgcctcgaaacacaga

SEQ ID NO: 2458426 - DNA, 14 bp, Homo sapiens
ttacaatgtaatta

SEQ ID NO: 2458427 - DNA, 16 bp, Homo sapiens
ttacaatgtaattatt

SEQ ID NO: 2458428 - DNA, 17 bp, Homo sapiens
ttacacgcttttgtgat

SEQ ID NO: 2458429 - DNA, 14 bp, Homo sapiens
ttacactctttgta

SEQ ID NO: 2458430 - DNA, 15 bp, Homo sapiens
ttacaggaacttcat

SEQ ID NO: 2458431 - DNA, 17 bp, Homo sapiens
ttacagtaggagcccag

SEQ ID NO: 2458432 - DNA, 22 bp, Homo sapiens
ttacagtcattggaataaggca

SEQ ID NO: 2458433 - DNA, 14 bp, Homo sapiens
ttacagtgcagtgc

SEQ ID NO: 2458434 - DNA, 15 bp, Homo sapiens
ttacatgaagtattt

SEQ ID NO: 2458435 - DNA, 16 bp, Homo sapiens
ttacatgaagtatttt

SEQ ID NO: 2458436 - DNA, 20 bp, Homo sapiens
ttacatgaagtattttttca

SEQ ID NO: 2458437 - DNA, 19 bp, Homo sapiens
ttacatgcttattccatga

SEQ ID NO: 2458438 - DNA, 16 bp, Homo sapiens
ttacatgttttaaaga

SEQ ID NO: 2458439 - DNA, 19 bp, Homo sapiens
ttacattattatcaacaat

SEQ ID NO: 2458440 - DNA, 18 bp, Homo sapiens
ttacatttacaaactgaa

SEQ ID NO: 2458441 - DNA, 12 bp, Homo sapiens
ttacattttcag

SEQ ID NO: 2458442 - DNA, 23 bp, Homo sapiens
ttaccaaagatgaatgaagcaaa

SEQ ID NO: 2458443 - DNA, 14 bp, Homo sapiens
ttaccatgtaatgg

SEQ ID NO: 2458444 - DNA, 23 bp, Homo sapiens
ttaccattaaaccatctccctgg

SEQ ID NO: 2458445 - DNA, 13 bp, Homo sapiens
ttaccctggcccc

SEQ ID NO: 2458446 - DNA, 17 bp, Homo sapiens
ttaccctggcccctctc

SEQ ID NO: 2458447 - DNA, 18 bp, Homo sapiens
ttacctaagattacaaat

SEQ ID NO: 2458448 - DNA, 13 bp, Homo sapiens
ttacctcagcctg

SEQ ID NO: 2458449 - DNA, 18 bp, Homo sapiens
ttacctgaaaacactgtg

SEQ ID NO: 2458450 - DNA, 13 bp, Homo sapiens
ttacctgtggata

SEQ ID NO: 2458451 - DNA, 18 bp, Homo sapiens
ttaccttatagttactgt

SEQ ID NO: 2458452 - DNA, 13 bp, Homo sapiens
ttacctttcatac

SEQ ID NO: 2458453 - DNA, 12 bp, Homo sapiens
ttactcaggttt

SEQ ID NO: 2458454 - DNA, 22 bp, Homo sapiens
ttactctaagatcttagattct

SEQ ID NO: 2458455 - DNA, 12 bp, Homo sapiens
ttactgtaatat

SEQ ID NO: 2458456 - DNA, 20 bp, Homo sapiens
ttactgtaatataaagtatt

SEQ ID NO: 2458457 - DNA, 16 bp, Homo sapiens
ttagaaaactttaaag

SEQ ID NO: 2458458 - DNA, 13 bp, Homo sapiens
ttagaaatcattt

SEQ ID NO: 2458459 - DNA, 23 bp, Homo sapiens
ttagaaattacctgtggatattt

SEQ ID NO: 2458460 - DNA, 13 bp, Homo sapiens
ttagaagcctgca

SEQ ID NO: 2458461 - DNA, 13 bp, Homo sapiens
ttagaattattta

SEQ ID NO: 2458462 - DNA, 16 bp, Homo sapiens
ttagaattatttaaac

SEQ ID NO: 2458463 - DNA, 15 bp, Homo sapiens
ttagactttaacata

SEQ ID NO: 2458464 - DNA, 16 bp, Homo sapiens
ttagagtgtctttcca

SEQ ID NO: 2458465 - DNA, 15 bp, Homo sapiens
ttagataaatattga

SEQ ID NO: 2458466 - DNA, 17 bp, Homo sapiens
ttagatagccctgtcct

SEQ ID NO: 2458467 - DNA, 18 bp, Homo sapiens
ttagatagccctgtcctg

SEQ ID NO: 2458468 - DNA, 16 bp, Homo sapiens
ttagatgtaattttgt

SEQ ID NO: 2458469 - DNA, 21 bp, Homo sapiens
ttagatgttccagtaatctaa

SEQ ID NO: 2458470 - DNA, 20 bp, Homo sapiens
ttagatgttctaagtctttc

SEQ ID NO: 2458471 - DNA, 20 bp, Homo sapiens
ttagatttcatagttcagaa

SEQ ID NO: 2458472 - DNA, 13 bp, Homo sapiens
ttagattttaatc

SEQ ID NO: 2458473 - DNA, 20 bp, Homo sapiens
ttagattttacatgaagtat

SEQ ID NO: 2458474 - DNA, 20 bp, Homo sapiens
ttagattttctggttctaac

SEQ ID NO: 2458475 - DNA, 12 bp, Homo sapiens
ttagcagacagg

SEQ ID NO: 2458476 - DNA, 17 bp, Homo sapiens
ttagcctggacctctga

SEQ ID NO: 2458477 - DNA, 18 bp, Homo sapiens
ttagcctggacctctgac

SEQ ID NO: 2458478 - DNA, 18 bp, Homo sapiens
ttagccttttttccccag

SEQ ID NO: 2458479 - DNA, 21 bp, Homo sapiens
ttagccttttttccccagact

SEQ ID NO: 2458480 - DNA, 23 bp, Homo sapiens
ttagccttttttccccagacttg

SEQ ID NO: 2458481 - DNA, 23 bp, Homo sapiens
tgtctttttttgtatagttaaca

SEQ ID NO: 2458482 - DNA, 15 bp, Homo sapiens
tgtgaaactttcatt

SEQ ID NO: 2458483 - DNA, 14 bp, Homo sapiens
tgtgaaatgctggc

SEQ ID NO: 2458484 - DNA, 15 bp, Homo sapiens
tgtgaacccaggaca

SEQ ID NO: 2458485 - DNA, 21 bp, Homo sapiens
tgtgaaccccacgaaggagcc

SEQ ID NO: 2458486 - DNA, 20 bp, Homo sapiens
tgtgaagcaaactctaaaat

SEQ ID NO: 2458487 - DNA, 13 bp, Homo sapiens
tgtgaagccttcc

SEQ ID NO: 2458488 - DNA, 21 bp, Homo sapiens
tgtgaatacctgctcacgtca

SEQ ID NO: 2458489 - DNA, 16 bp, Homo sapiens
tgtgaccaatgtcttg

SEQ ID NO: 2458490 - DNA, 16 bp, Homo sapiens
tgtgacccccagctcc

SEQ ID NO: 2458491 - DNA, 13 bp, Homo sapiens
tgtgacctgctga

SEQ ID NO: 2458492 - DNA, 14 bp, Homo sapiens
tgtgacctgctgag

SEQ ID NO: 2458493 - DNA, 22 bp, Homo sapiens
tgtgacctgctgagctctgaga

SEQ ID NO: 2458494 - DNA, 18 bp, Homo sapiens
tgtgactggctaaagctc

SEQ ID NO: 2458495 - DNA, 22 bp, Homo sapiens
tgtgagaagtgaatgctgggac

SEQ ID NO: 2458496 - DNA, 24 bp, Homo sapiens
tgtgagaagtgaatgctgggactc

SEQ ID NO: 2458497 - DNA, 18 bp, Homo sapiens
tgtgagtctttggttcta

SEQ ID NO: 2458498 - DNA, 20 bp, Homo sapiens
tgtgagtctttggttctaag

SEQ ID NO: 2458499 - DNA, 22 bp, Homo sapiens
tgtgagtggagttgaggtgtca

SEQ ID NO: 2458500 - DNA, 22 bp, Homo sapiens
tgtgagtgtttttatcttttta

SEQ ID NO: 2458501 - DNA, 16 bp, Homo sapiens
tgtgagttctccctgt

SEQ ID NO: 2458502 - DNA, 23 bp, Homo sapiens
tgtgagtttaccttgtatactgt

SEQ ID NO: 2458503 - DNA, 13 bp, Homo sapiens
tgtgataaggaaa

SEQ ID NO: 2458504 - DNA, 14 bp, Homo sapiens
tgtgatatataagt

SEQ ID NO: 2458505 - DNA, 19 bp, Homo sapiens
tgtgatattctaagactta

SEQ ID NO: 2458506 - DNA, 15 bp, Homo sapiens
tgtgatcagaccata

SEQ ID NO: 2458507 - DNA, 19 bp, Homo sapiens
tgattttaagtttctctgc

SEQ ID NO: 2458508 - DNA, 20 bp, Homo sapiens
tgattttaggagctaaggct

SEQ ID NO: 2458509 - DNA, 23 bp, Homo sapiens
tgatttttataaatactgcaaat

SEQ ID NO: 2458510 - DNA, 16 bp, Homo sapiens
tgatttttctcttcat

SEQ ID NO: 2458511 - DNA, 17 bp, Homo sapiens
tgattttttttaattac

SEQ ID NO: 2458512 - DNA, 22 bp, Homo sapiens
tgcaaaaggactctcaggacca

SEQ ID NO: 2458513 - DNA, 11 bp, Homo sapiens
tgcaaactggg

SEQ ID NO: 2458514 - DNA, 13 bp, Homo sapiens
tgcaaactgggaa

SEQ ID NO: 2458515 - DNA, 12 bp, Homo sapiens
tgcaaagatctg

SEQ ID NO: 2458516 - DNA, 13 bp, Homo sapiens
tgcaaataacaaa

SEQ ID NO: 2458517 - DNA, 18 bp, Homo sapiens
tgcaacctccacctcctg

SEQ ID NO: 2458518 - DNA, 19 bp, Homo sapiens
tgcaacctcgctggactct

SEQ ID NO: 2458519 - DNA, 14 bp, Homo sapiens
tgcaaccttcacct

SEQ ID NO: 2458520 - DNA, 11 bp, Homo sapiens
tgcaagggaaa

SEQ ID NO: 2458521 - DNA, 16 bp, Homo sapiens
tgcaaggtactctggt

SEQ ID NO: 2458522 - DNA, 20 bp, Homo sapiens
tgcaataaatctgacccagt

SEQ ID NO: 2458523 - DNA, 21 bp, Homo sapiens
tgcaataaatctgacccagtg

SEQ ID NO: 2458524 - DNA, 15 bp, Homo sapiens
tgcaatatactggaa

SEQ ID NO: 2458525 - DNA, 16 bp, Homo sapiens
tgcaatatactggaaa

SEQ ID NO: 2458526 - DNA, 15 bp, Homo sapiens
tgcaatatctgaagc

SEQ ID NO: 2458527 - DNA, 22 bp, Homo sapiens
tgcaatgtaaatattttaaaga

SEQ ID NO: 2458528 - DNA, 14 bp, Homo sapiens
tgcaatgtgtataa

SEQ ID NO: 2458529 - DNA, 15 bp, Homo sapiens
tgcaatgtgtataaa

SEQ ID NO: 2458530 - DNA, 16 bp, Homo sapiens
tgcaatgtgtataaac

SEQ ID NO: 2458531 - DNA, 20 bp, Homo sapiens
tgcaatgtgtataaacaaga

SEQ ID NO: 2458532 - DNA, 21 bp, Homo sapiens
tgcaattcaaaagttccaaga

SEQ ID NO: 2458533 - DNA, 22 bp, Homo sapiens
tgcaattggcaccgaagcccag

SEQ ID NO: 2458534 - DNA, 18 bp, Homo sapiens
tgcaatttcaaggttcta

SEQ ID NO: 2458535 - DNA, 18 bp, Homo sapiens
tgcacaaaacccagacct

SEQ ID NO: 2458536 - DNA, 15 bp, Homo sapiens
tgcacaagaatggat

SEQ ID NO: 2458537 - DNA, 19 bp, Homo sapiens
tgcacaataactcctccca

SEQ ID NO: 2458538 - DNA, 21 bp, Homo sapiens
tgcacaataactcctcccagg

SEQ ID NO: 2458539 - DNA, 13 bp, Homo sapiens
tgcacaatgtaga

SEQ ID NO: 2458540 - DNA, 19 bp, Homo sapiens
tgcacaccccactcccaca

SEQ ID NO: 2458541 - DNA, 14 bp, Homo sapiens
tgcacactttgcca

SEQ ID NO: 2458542 - DNA, 23 bp, Homo sapiens
tgcacagcacaaattagttatat

SEQ ID NO: 2458543 - DNA, 18 bp, Homo sapiens
tgcacagtatttgtaatt

SEQ ID NO: 2458544 - DNA, 19 bp, Homo sapiens
tgcacagtgacttctgaga

SEQ ID NO: 2458545 - DNA, 16 bp, Homo sapiens
tgcacagtgtgtgact

SEQ ID NO: 2458546 - DNA, 19 bp, Homo sapiens
tgcacatctgtgtcttgtt

SEQ ID NO: 2458547 - DNA, 17 bp, Homo sapiens
tgcacatgaacttagat

SEQ ID NO: 2458548 - DNA, 13 bp, Homo sapiens
tgcacatgtttcc

SEQ ID NO: 2458549 - DNA, 16 bp, Homo sapiens
tgcacatgtttcctct

SEQ ID NO: 2458550 - DNA, 14 bp, Homo sapiens
tgcaccaccaagcc

SEQ ID NO: 2458551 - DNA, 19 bp, Homo sapiens
tgcaccatgctgctgggga

SEQ ID NO: 2458552 - DNA, 20 bp, Homo sapiens
tgcaccccaaagctttcctg

SEQ ID NO: 2458553 - DNA, 14 bp, Homo sapiens
tgcacctgcctcca

SEQ ID NO: 2458554 - DNA, 15 bp, Homo sapiens
tgcacctgcctccag

SEQ ID NO: 2458555 - DNA, 18 bp, Homo sapiens
tgcacgtaaagtacttgt

SEQ ID NO: 2458556 - DNA, 16 bp, Homo sapiens
tgcacgtggcctcttg

SEQ ID NO: 2458557 - DNA, 12 bp, Homo sapiens
tgcacgtgtgtt

SEQ ID NO: 2458558 - DNA, 13 bp, Homo sapiens
tgcacgtgtgttt

SEQ ID NO: 2458559 - DNA, 19 bp, Homo sapiens
tgcacgtgtgtttttctat

SEQ ID NO: 2458560 - DNA, 17 bp, Homo sapiens
tgcactcccacctgaca

SEQ ID NO: 2458561 - DNA, 22 bp, Homo sapiens
tgcactgatatatcatgagtga

SEQ ID NO: 2458562 - DNA, 14 bp, Homo sapiens
tgcactgatgctgc

SEQ ID NO: 2458563 - DNA, 13 bp, Homo sapiens
tgcactgatgttg

SEQ ID NO: 2458564 - DNA, 15 bp, Homo sapiens
tgcactgatgttgtg

SEQ ID NO: 2458565 - DNA, 16 bp, Homo sapiens
tgcactggggagcccg

SEQ ID NO: 2458566 - DNA, 20 bp, Homo sapiens
tgcactggggagcccgtctc

SEQ ID NO: 2458567 - DNA, 12 bp, Homo sapiens
tgcactgtaaaa

SEQ ID NO: 2458568 - DNA, 16 bp, Homo sapiens
tgtaaatataaagacg

SEQ ID NO: 2458569 - DNA, 15 bp, Homo sapiens
tgtaaatctgccaca

SEQ ID NO: 2458570 - DNA, 14 bp, Homo sapiens
tgtaaattatcagg

SEQ ID NO: 2458571 - DNA, 12 bp, Homo sapiens
tgtaaattggca

SEQ ID NO: 2458572 - DNA, 18 bp, Homo sapiens
tgtaaatttgtactattt

SEQ ID NO: 2458573 - DNA, 21 bp, Homo sapiens
tgtaacaattgtgtagccttt

SEQ ID NO: 2458574 - DNA, 22 bp, Homo sapiens
tgtaacaattgtgtagcctttt

SEQ ID NO: 2458575 - DNA, 23 bp, Homo sapiens
tgtaacgcaagttcccagttgga

SEQ ID NO: 2458576 - DNA, 14 bp, Homo sapiens
tgtaactaaaataa

SEQ ID NO: 2458577 - DNA, 13 bp, Homo sapiens
tgtaactgccagg

SEQ ID NO: 2458578 - DNA, 18 bp, Homo sapiens
tgtaactgccaggctctc

SEQ ID NO: 2458579 - DNA, 11 bp, Homo sapiens
tgtaactgccc

SEQ ID NO: 2458580 - DNA, 20 bp, Homo sapiens
tgtaaggctgtgtaagattt

SEQ ID NO: 2458581 - DNA, 21 bp, Homo sapiens
tgtaagttgggcttgctattc

SEQ ID NO: 2458582 - DNA, 11 bp, Homo sapiens
tgtaatacaat

SEQ ID NO: 2458583 - DNA, 18 bp, Homo sapiens
tgtaatacttcttgtgtg

SEQ ID NO: 2458584 - DNA, 18 bp, Homo sapiens
tgtaatgttaatattgat

SEQ ID NO: 2458585 - DNA, 14 bp, Homo sapiens
tgtaattaaaagca

SEQ ID NO: 2458586 - DNA, 20 bp, Homo sapiens
tgtaattaaaagcaaatcat

SEQ ID NO: 2458587 - DNA, 20 bp, Homo sapiens
tgtaattatttatgtatggt

SEQ ID NO: 2458588 - DNA, 15 bp, Homo sapiens
tgtaattctaaatga

SEQ ID NO: 2458589 - DNA, 23 bp, Homo sapiens
tgtaatttcaggaggaatactga

SEQ ID NO: 2458590 - DNA, 23 bp, Homo sapiens
tgtaattttacacgcttttgtga

SEQ ID NO: 2458591 - DNA, 20 bp, Homo sapiens
tgtaattttgtgtaagaaat

SEQ ID NO: 2458592 - DNA, 16 bp, Homo sapiens
tgtacaagatgaagga

SEQ ID NO: 2458593 - DNA, 21 bp, Homo sapiens
tgtacacaactcactcctttt

SEQ ID NO: 2458594 - DNA, 20 bp, Homo sapiens
tgtacagtagattttccaaa

SEQ ID NO: 2458595 - DNA, 14 bp, Homo sapiens
tgtacagtgtcttt

SEQ ID NO: 2458596 - DNA, 15 bp, Homo sapiens
tgtacagtgtctttt

SEQ ID NO: 2458597 - DNA, 23 bp, Homo sapiens
tgtacagtgtctttttttgtata

SEQ ID NO: 2458598 - DNA, 14 bp, Homo sapiens
tgtacagtgttacc

SEQ ID NO: 2458599 - DNA, 21 bp, Homo sapiens
tgtacataccctggccgcccc

SEQ ID NO: 2458600 - DNA, 20 bp, Homo sapiens
tggaggggtaggggctggga

SEQ ID NO: 2458601 - DNA, 13 bp, Homo sapiens
tggaggttctaag

SEQ ID NO: 2458602 - DNA, 16 bp, Homo sapiens
tggaggttctaaggcc

SEQ ID NO: 2458603 - DNA, 17 bp, Homo sapiens
tggagtctgccacccag

SEQ ID NO: 2458604 - DNA, 22 bp, Homo sapiens
tggagtctgccacccaggatcc

SEQ ID NO: 2458605 - DNA, 17 bp, Homo sapiens
tggagtgctgttttgtt

SEQ ID NO: 2458606 - DNA, 17 bp, Homo sapiens
tggagtggcagcccagc

SEQ ID NO: 2458607 - DNA, 16 bp, Homo sapiens
tggagtttctaaggtc

SEQ ID NO: 2458608 - DNA, 16 bp, Homo sapiens
tggagttttgtttcct

SEQ ID NO: 2458609 - DNA, 21 bp, Homo sapiens
tggataacttccacagggtcc

SEQ ID NO: 2458610 - DNA, 13 bp, Homo sapiens
tggataccattat

SEQ ID NO: 2458611 - DNA, 21 bp, Homo sapiens
tggatatgtaaaacatttatt

SEQ ID NO: 2458612 - DNA, 14 bp, Homo sapiens
tggatcacaaagtg

SEQ ID NO: 2458613 - DNA, 16 bp, Homo sapiens
tggatcacaagatgga

SEQ ID NO: 2458614 - DNA, 17 bp, Homo sapiens
tggatcagcgtggcctt

SEQ ID NO: 2458615 - DNA, 17 bp, Homo sapiens
tggatcctgtgtggaga

SEQ ID NO: 2458616 - DNA, 14 bp, Homo sapiens
tggattctttccat

SEQ ID NO: 2458617 - DNA, 19 bp, Homo sapiens
tggattgcaatatctgaag

SEQ ID NO: 2458618 - DNA, 21 bp, Homo sapiens
tggattgcacgtggcctcttg

SEQ ID NO: 2458619 - DNA, 15 bp, Homo sapiens
tggatttagtttcag

SEQ ID NO: 2458620 - DNA, 16 bp, Homo sapiens
tggatttagtttcagt

SEQ ID NO: 2458621 - DNA, 23 bp, Homo sapiens
tggattttttccttcaaagttta

SEQ ID NO: 2458622 - DNA, 13 bp, Homo sapiens
tggcaacacagag

SEQ ID NO: 2458623 - DNA, 15 bp, Homo sapiens
tggcaacagatctgg

SEQ ID NO: 2458624 - DNA, 20 bp, Homo sapiens
tggcaaggactttgtacatt

SEQ ID NO: 2458625 - DNA, 21 bp, Homo sapiens
tggcaaggactttgtacattt

SEQ ID NO: 2458626 - DNA, 20 bp, Homo sapiens
tggcaatcaaacattttctg

SEQ ID NO: 2458627 - DNA, 17 bp, Homo sapiens
tggcaccagacacccag

SEQ ID NO: 2458628 - DNA, 24 bp, Homo sapiens
tggcaccgaagcccagagggtctg

SEQ ID NO: 2458629 - DNA, 20 bp, Homo sapiens
tggcacctaatccaggcaga

SEQ ID NO: 2458630 - DNA, 11 bp, Homo sapiens
tggcactttga

SEQ ID NO: 2458631 - DNA, 18 bp, Homo sapiens
tggcagagatgcctccct

SEQ ID NO: 2458632 - DNA, 19 bp, Homo sapiens
tggcagagatgcctccctg

SEQ ID NO: 2458633 - DNA, 12 bp, Homo sapiens
tggcagagttac

SEQ ID NO: 2458634 - DNA, 20 bp, Homo sapiens
tggcagagttacagttctgt

SEQ ID NO: 2458635 - DNA, 18 bp, Homo sapiens
tggcagccacacttctca

SEQ ID NO: 2458636 - DNA, 19 bp, Homo sapiens
tggcagccacacttctcag

SEQ ID NO: 2458637 - DNA, 12 bp, Homo sapiens
tggcagcccagc

SEQ ID NO: 2458638 - DNA, 16 bp, Homo sapiens
tggcagcccagccagc

SEQ ID NO: 2458639 - DNA, 17 bp, Homo sapiens
tggcagcccagccagcg

SEQ ID NO: 2458640 - DNA, 18 bp, Homo sapiens
tggcagcccagccagcgt

SEQ ID NO: 2458641 - DNA, 13 bp, Homo sapiens
tggtattttcaat

SEQ ID NO: 2458642 - DNA, 20 bp, Homo sapiens
tggtattttcaatagccact

SEQ ID NO: 2458643 - DNA, 15 bp, Homo sapiens
tggtcacacactgat

SEQ ID NO: 2458644 - DNA, 21 bp, Homo sapiens
tggtcacagcggaggtgtgga

SEQ ID NO: 2458645 - DNA, 23 bp, Homo sapiens
tggtcacctaggaagcctcagat

SEQ ID NO: 2458646 - DNA, 13 bp, Homo sapiens
tggtccagggcta

SEQ ID NO: 2458647 - DNA, 17 bp, Homo sapiens
tggtcccacatccctgg

SEQ ID NO: 2458648 - DNA, 23 bp, Homo sapiens
tggtcccacatccctgggcctgc

SEQ ID NO: 2458649 - DNA, 18 bp, Homo sapiens
tggtcccctccttcccaa

SEQ ID NO: 2458650 - DNA, 22 bp, Homo sapiens
tggtccctgttttcccacgagg

SEQ ID NO: 2458651 - DNA, 16 bp, Homo sapiens
tggtcctatggcctca

SEQ ID NO: 2458652 - DNA, 19 bp, Homo sapiens
tggtcctatggcctcatgt

SEQ ID NO: 2458653 - DNA, 15 bp, Homo sapiens
tggtcctttcttccg

SEQ ID NO: 2458654 - DNA, 13 bp, Homo sapiens
tggtcgctcctgc

SEQ ID NO: 2458655 - DNA, 13 bp, Homo sapiens
tggtcgttttttt

SEQ ID NO: 2458656 - DNA, 15 bp, Homo sapiens
tggtcttacagcagg

SEQ ID NO: 2458657 - DNA, 14 bp, Homo sapiens
tggtcttttggtta

SEQ ID NO: 2458658 - DNA, 22 bp, Homo sapiens
tggtgacatcaggtttttcccg

SEQ ID NO: 2458659 - DNA, 17 bp, Homo sapiens
tggtgagggaagacgcc

SEQ ID NO: 2458660 - DNA, 19 bp, Homo sapiens
tggtgcaagttgaggactt

SEQ ID NO: 2458661 - DNA, 22 bp, Homo sapiens
tggtgcaatgtgtgtatatgga

SEQ ID NO: 2458662 - DNA, 17 bp, Homo sapiens
tggtgccccaggaccag

SEQ ID NO: 2458663 - DNA, 20 bp, Homo sapiens
tggtgccccaggaccagctc

SEQ ID NO: 2458664 - DNA, 21 bp, Homo sapiens
tggtgccccaggaccagctca

SEQ ID NO: 2458665 - DNA, 13 bp, Homo sapiens
tggtgcctccaga

SEQ ID NO: 2458666 - DNA, 22 bp, Homo sapiens
tggtgcggctggccatggagaa

SEQ ID NO: 2458667 - DNA, 13 bp, Homo sapiens
tggtgctgggaga

SEQ ID NO: 2458668 - DNA, 14 bp, Homo sapiens
tggtggccatgctc

SEQ ID NO: 2458669 - DNA, 15 bp, Homo sapiens
tggtggccatgctcc

SEQ ID NO: 2458670 - DNA, 15 bp, Homo sapiens
tggtggtccctgggt

SEQ ID NO: 2458671 - DNA, 18 bp, Homo sapiens
tggtgtaaggtactttca

SEQ ID NO: 2458672 - DNA, 16 bp, Homo sapiens
tggtgtggtacagaga

SEQ ID NO: 2458673 - DNA, 19 bp, Homo sapiens
tggtgtggtacagagaagc

SEQ ID NO: 2458674 - DNA, 21 bp, Homo sapiens
tggtgtggtacagagaagcca

SEQ ID NO: 2458675 - DNA, 11 bp, Homo sapiens
tggtgttaaca

SEQ ID NO: 2458676 - DNA, 14 bp, Homo sapiens
tggtgttaacagaa

SEQ ID NO: 2458677 - DNA, 22 bp, Homo sapiens
tggtgttctcctgctgctccct

SEQ ID NO: 2458678 - DNA, 19 bp, Homo sapiens
tggttaaataaggcagggt

SEQ ID NO: 2458679 - DNA, 14 bp, Homo sapiens
tggttaagagtcca

SEQ ID NO: 2458680 - DNA, 17 bp, Homo sapiens
tggttaagagtccaaga

SEQ ID NO: 2458681 - DNA, 12 bp, Homo sapiens
tggttccagggt

SEQ ID NO: 2458682 - DNA, 18 bp, Homo sapiens
tggttctcaattccaaca

SEQ ID NO: 2458683 - DNA, 15 bp, Homo sapiens
tggttcttgagggga

SEQ ID NO: 2458684 - DNA, 19 bp, Homo sapiens
tggttcttgtgttggctgt

SEQ ID NO: 2458685 - DNA, 16 bp, Homo sapiens
tggttggttttcttct

SEQ ID NO: 2458686 - DNA, 15 bp, Homo sapiens
tggtttaaagaaagt

SEQ ID NO: 2458687 - DNA, 17 bp, Homo sapiens
tggtttaaagaaagtgt

SEQ ID NO: 2458688 - DNA, 17 bp, Homo sapiens
tggtttatatatttaaa

SEQ ID NO: 2458689 - DNA, 23 bp, Homo sapiens
tggtttcagcactagccaaacct

SEQ ID NO: 2458690 - DNA, 17 bp, Homo sapiens
tggtttcccaagagcta

SEQ ID NO: 2458691 - DNA, 18 bp, Homo sapiens
tggtttcccaagagctac

SEQ ID NO: 2458692 - DNA, 19 bp, Homo sapiens
tggtttgcagcgactggca

SEQ ID NO: 2458693 - DNA, 21 bp, Homo sapiens
tggttttcttcttctcgtcct

SEQ ID NO: 2458694 - DNA, 18 bp, Homo sapiens
tggtttttactgctctga

SEQ ID NO: 2458695 - DNA, 20 bp, Homo sapiens
tggtttttactgctctgaga

SEQ ID NO: 2458696 - DNA, 21 bp, Homo sapiens
tggtttttactgctctgagaa

SEQ ID NO: 2458697 - DNA, 19 bp, Homo sapiens
tgtaaaagcattttgtaat

SEQ ID NO: 2458698 - DNA, 20 bp, Homo sapiens
tgtaaaatattttgaatcaa

SEQ ID NO: 2458699 - DNA, 21 bp, Homo sapiens
tgtaaaatattttgaatcaat

SEQ ID NO: 2458700 - DNA, 15 bp, Homo sapiens
tgtaaaatcttgtca

SEQ ID NO: 2458701 - DNA, 19 bp, Homo sapiens
tgtaaaatcttgtcatgtg

SEQ ID NO: 2458702 - DNA, 12 bp, Homo sapiens
tgtaaaatgaca

SEQ ID NO: 2458703 - DNA, 16 bp, Homo sapiens
tgtaaaatgacaatca

SEQ ID NO: 2458704 - DNA, 14 bp, Homo sapiens
tgtaaactgtgcac

SEQ ID NO: 2458705 - DNA, 19 bp, Homo sapiens
tgtaaactttatcacttaa

SEQ ID NO: 2458706 - DNA, 19 bp, Homo sapiens
tgtaaagtatgtattattt

SEQ ID NO: 2458707 - DNA, 22 bp, Homo sapiens
tgtaaataatacattatatttc

SEQ ID NO: 2458708 - DNA, 23 bp, Homo sapiens
tgtaaataatacattatatttct

SEQ ID NO: 2458709 - DNA, 13 bp, Homo sapiens
tgtaaatataaag

SEQ ID NO: 2458710 - DNA, 18 bp, Homo sapiens
ttccaaaatctcccattt

SEQ ID NO: 2458711 - DNA, 15 bp, Homo sapiens
ttccaaattcagttt

SEQ ID NO: 2458712 - DNA, 18 bp, Homo sapiens
ttccaaattcagtttcat

SEQ ID NO: 2458713 - DNA, 20 bp, Homo sapiens
ttccaaattcagtttcataa

SEQ ID NO: 2458714 - DNA, 18 bp, Homo sapiens
ttccaactactaatagaa

SEQ ID NO: 2458715 - DNA, 17 bp, Homo sapiens
ttccaacttggctgcag

SEQ ID NO: 2458716 - DNA, 21 bp, Homo sapiens
ttccaagactctagagtccaa

SEQ ID NO: 2458717 - DNA, 12 bp, Homo sapiens
ttccaagagtct

SEQ ID NO: 2458718 - DNA, 15 bp, Homo sapiens
ttccaagagtctaaa

SEQ ID NO: 2458719 - DNA, 18 bp, Homo sapiens
ttccaatgtctggagacc

SEQ ID NO: 2458720 - DNA, 22 bp, Homo sapiens
ttccacagaggacacagagaag

SEQ ID NO: 2458721 - DNA, 22 bp, Homo sapiens
ttccacagggtcccacagccac

SEQ ID NO: 2458722 - DNA, 17 bp, Homo sapiens
ttccaccaaatgtgctt

SEQ ID NO: 2458723 - DNA, 15 bp, Homo sapiens
ttccaccacagccag

SEQ ID NO: 2458724 - DNA, 22 bp, Homo sapiens
ttccaccacagccagcacctgg

SEQ ID NO: 2458725 - DNA, 19 bp, Homo sapiens
ttccacccaggggcagccc

SEQ ID NO: 2458726 - DNA, 15 bp, Homo sapiens
ttccacggagccact

SEQ ID NO: 2458727 - DNA, 24 bp, Homo sapiens
ttccacggagccactcctctgact

SEQ ID NO: 2458728 - DNA, 13 bp, Homo sapiens
ttccactgagacc

SEQ ID NO: 2458729 - DNA, 15 bp, Homo sapiens
ttccactgagggcag

SEQ ID NO: 2458730 - DNA, 20 bp, Homo sapiens
ttccagaagtgtgactggct

SEQ ID NO: 2458731 - DNA, 15 bp, Homo sapiens
ttccagcattcccag

SEQ ID NO: 2458732 - DNA, 20 bp, Homo sapiens
ttccagcccctctggtcgct

SEQ ID NO: 2458733 - DNA, 16 bp, Homo sapiens
ttccaggcttctgctg

SEQ ID NO: 2458734 - DNA, 17 bp, Homo sapiens
ttccatccatggccagc

SEQ ID NO: 2458735 - DNA, 18 bp, Homo sapiens
ttccatccatggccagca

SEQ ID NO: 2458736 - DNA, 20 bp, Homo sapiens
ttccatccatggccagcagc

SEQ ID NO: 2458737 - DNA, 18 bp, Homo sapiens
ttccatctttacaaaact

SEQ ID NO: 2458738 - DNA, 16 bp, Homo sapiens
ttccatgacatcaaga

SEQ ID NO: 2458739 - DNA, 19 bp, Homo sapiens
ttccatgactgcttgccct

SEQ ID NO: 2458740 - DNA, 22 bp, Homo sapiens
ttccatgggaccacaactattt

SEQ ID NO: 2458741 - DNA, 23 bp, Homo sapiens
ttccattacaagtatttttaatt

SEQ ID NO: 2458742 - DNA, 17 bp, Homo sapiens
ttccattggtccaagat

SEQ ID NO: 2458743 - DNA, 17 bp, Homo sapiens
ttccatttgcaagggaa

SEQ ID NO: 2458744 - DNA, 18 bp, Homo sapiens
ttccatttgcatttgttt

SEQ ID NO: 2458745 - DNA, 19 bp, Homo sapiens
ttcccaaaatgttgaaata

SEQ ID NO: 2458746 - DNA, 15 bp, Homo sapiens
ttcccaacacaaaga

SEQ ID NO: 2458747 - DNA, 22 bp, Homo sapiens
ttcccaagagcatcatgcctct

SEQ ID NO: 2458748 - DNA, 11 bp, Homo sapiens
ttcccaagctc

SEQ ID NO: 2458749 - DNA, 14 bp, Homo sapiens
ttcccactccaagc

SEQ ID NO: 2458750 - DNA, 21 bp, Homo sapiens
ttcccactccaagcccagccc

SEQ ID NO: 2458751 - DNA, 11 bp, Homo sapiens
ttcccaggacc

SEQ ID NO: 2458752 - DNA, 13 bp, Homo sapiens
ttcccaggaccct

SEQ ID NO: 2458753 - DNA, 19 bp, Homo sapiens
ttcccaggaccctgaaggg

SEQ ID NO: 2458754 - DNA, 19 bp, Homo sapiens
ttcccaggcccactgtgcc

SEQ ID NO: 2458755 - DNA, 14 bp, Homo sapiens
ttcccatccccagc

SEQ ID NO: 2458756 - DNA, 15 bp, Homo sapiens
ttcccatggggaggg

SEQ ID NO: 2458757 - DNA, 15 bp, Homo sapiens
ttccccaccagatgc

SEQ ID NO: 2458758 - DNA, 20 bp, Homo sapiens
ttccccaccagatgctgaaa

SEQ ID NO: 2458759 - DNA, 13 bp, Homo sapiens
ttccccactggag

SEQ ID NO: 2458760 - DNA, 20 bp, Homo sapiens
ttccccatcgttgcccccat

SEQ ID NO: 2458761 - DNA, 15 bp, Homo sapiens
ttcccccactgatca

SEQ ID NO: 2458762 - DNA, 18 bp, Homo sapiens
ttccccctctcccagttg

SEQ ID NO: 2458763 - DNA, 22 bp, Homo sapiens
ttccccctgtttcagaggctca

SEQ ID NO: 2458764 - DNA, 15 bp, Homo sapiens
ttcccctctgctgct

SEQ ID NO: 2458765 - DNA, 18 bp, Homo sapiens
ttcccctctgctgctgtc

SEQ ID NO: 2458766 - DNA, 16 bp, Homo sapiens
ttccccttatcctccc

SEQ ID NO: 2458767 - DNA, 17 bp, Homo sapiens
ttccccttatcctccct

SEQ ID NO: 2458768 - DNA, 19 bp, Homo sapiens
ttccccttatcctccctgt

SEQ ID NO: 2458769 - DNA, 17 bp, Homo sapiens
ttcccgtttctccacct

SEQ ID NO: 2458770 - DNA, 14 bp, Homo sapiens
ttccctaccctcta

SEQ ID NO: 2458771 - DNA, 20 bp, Homo sapiens
ttccctaccctctagagaaa

SEQ ID NO: 2458772 - DNA, 22 bp, Homo sapiens
ttccctagaaacttccaaatcc

SEQ ID NO: 2458773 - DNA, 12 bp, Homo sapiens
ttccctatcact

SEQ ID NO: 2458774 - DNA, 21 bp, Homo sapiens
ttccctcaccttggcaccaga

SEQ ID NO: 2458775 - DNA, 19 bp, Homo sapiens
ttccctcccagaggagcca

SEQ ID NO: 2458776 - DNA, 15 bp, Homo sapiens
ttccctctcccaggc

SEQ ID NO: 2458777 - DNA, 16 bp, Homo sapiens
ttccctctcccaggcc

SEQ ID NO: 2458778 - DNA, 17 bp, Homo sapiens
ttccctctcccaggccc

SEQ ID NO: 2458779 - DNA, 14 bp, Homo sapiens
ttccctctccctgt

SEQ ID NO: 2458780 - DNA, 14 bp, Homo sapiens
ttccctctctcact

SEQ ID NO: 2458781 - DNA, 12 bp, Homo sapiens
ttccctctggga

SEQ ID NO: 2458782 - DNA, 13 bp, Homo sapiens
ttccctgactcat

SEQ ID NO: 2458783 - DNA, 23 bp, Homo sapiens
ttccctggtcccttgtatcccct

SEQ ID NO: 2458784 - DNA, 14 bp, Homo sapiens
ttcccttcctgcca

SEQ ID NO: 2458785 - DNA, 12 bp, Homo sapiens
ttccctttgtga

SEQ ID NO: 2458786 - DNA, 22 bp, Homo sapiens
ttccggcatggacaatggaccg

SEQ ID NO: 2458787 - DNA, 16 bp, Homo sapiens
ttcctaaatattatga

SEQ ID NO: 2458788 - DNA, 18 bp, Homo sapiens
ttcctaaatattatgaga

SEQ ID NO: 2458789 - DNA, 18 bp, Homo sapiens
ttcctagctgtgtgaata

SEQ ID NO: 2458790 - DNA, 13 bp, Homo sapiens
ttcctatacgcag

SEQ ID NO: 2458791 - DNA, 14 bp, Homo sapiens
ttcctcagactcta

SEQ ID NO: 2458792 - DNA, 14 bp, Homo sapiens
ttcctcagccagcc

SEQ ID NO: 2458793 - DNA, 21 bp, Homo sapiens
ttcctcctgggccctctctgc

SEQ ID NO: 2458794 - DNA, 23 bp, Homo sapiens
ttcctcctgggccctctctgctc

SEQ ID NO: 2458795 - DNA, 19 bp, Homo sapiens
ttcctcttttccttcccaa

SEQ ID NO: 2458796 - DNA, 17 bp, Homo sapiens
ttcctgattgtttacag

SEQ ID NO: 2458797 - DNA, 13 bp, Homo sapiens
ttcctgccccagg

SEQ ID NO: 2458798 - DNA, 13 bp, Homo sapiens
ttcctgctgctgt

SEQ ID NO: 2458799 - DNA, 14 bp, Homo sapiens
ttcctgctgctgtc

SEQ ID NO: 2458800 - DNA, 21 bp, Homo sapiens
ttcctgctgctgtctgggtgc

SEQ ID NO: 2458801 - DNA, 22 bp, Homo sapiens
aaagcatcttgcattatgcaat

SEQ ID NO: 2458802 - DNA, 13 bp, Homo sapiens
aaagcattttgta

SEQ ID NO: 2458803 - DNA, 15 bp, Homo sapiens
aaagcattttgtaat

SEQ ID NO: 2458804 - DNA, 21 bp, Homo sapiens
aaagcccccagagcccaggct

SEQ ID NO: 2458805 - DNA, 12 bp, Homo sapiens
aaagcctgctca

SEQ ID NO: 2458806 - DNA, 17 bp, Homo sapiens
aaagcctgggtgacatt

SEQ ID NO: 2458807 - DNA, 11 bp, Homo sapiens
aaagccttctt

SEQ ID NO: 2458808 - DNA, 16 bp, Homo sapiens
aaagcctttatttgtt

SEQ ID NO: 2458809 - DNA, 23 bp, Homo sapiens
aaagcgtgagcttaaaatacaag

SEQ ID NO: 2458810 - DNA, 14 bp, Homo sapiens
aaagcgtttgcaca

SEQ ID NO: 2458811 - DNA, 14 bp, Homo sapiens
aaagctctagaatc

SEQ ID NO: 2458812 - DNA, 14 bp, Homo sapiens
aaagctgatttttt

SEQ ID NO: 2458813 - DNA, 18 bp, Homo sapiens
aaagctggtttaatgttt

SEQ ID NO: 2458814 - DNA, 16 bp, Homo sapiens
aaagcttcacagtacc

SEQ ID NO: 2458815 - DNA, 18 bp, Homo sapiens
aaagcttccatgattcta

SEQ ID NO: 2458816 - DNA, 19 bp, Homo sapiens
aaagcttgcaacaaaattc

SEQ ID NO: 2458817 - DNA, 12 bp, Homo sapiens
aaagctttcctg

SEQ ID NO: 2458818 - DNA, 20 bp, Homo sapiens
aaaggaaaaaaaaacagcca

SEQ ID NO: 2458819 - DNA, 13 bp, Homo sapiens
aaaggaaaagaca

SEQ ID NO: 2458820 - DNA, 15 bp, Homo sapiens
aaaggaaatcaaatg

SEQ ID NO: 2458821 - DNA, 23 bp, Homo sapiens
aaaggaaatctcaccccatccca

SEQ ID NO: 2458822 - DNA, 22 bp, Homo sapiens
aaaggaagcattgtaaaataat

SEQ ID NO: 2458823 - DNA, 13 bp, Homo sapiens
aaaggcaaggtcc

SEQ ID NO: 2458824 - DNA, 15 bp, Homo sapiens
aaaggcagttaccat

SEQ ID NO: 2458825 - DNA, 18 bp, Homo sapiens
aaaggctgttaaatacag

SEQ ID NO: 2458826 - DNA, 17 bp, Homo sapiens
aaagggagggctctgag

SEQ ID NO: 2458827 - DNA, 22 bp, Homo sapiens
aaagggagggctctgaggcgcc

SEQ ID NO: 2458828 - DNA, 17 bp, Homo sapiens
aaagggccctccttcct

SEQ ID NO: 2458829 - DNA, 21 bp, Homo sapiens
aaaggtccacaggtctagact

SEQ ID NO: 2458830 - DNA, 23 bp, Homo sapiens
aaaggtgacatcggaaaaataat

SEQ ID NO: 2458831 - DNA, 17 bp, Homo sapiens
aaaggtgtgagactggg

SEQ ID NO: 2458832 - DNA, 19 bp, Homo sapiens
aaaggtgtgagactgggaa

SEQ ID NO: 2458833 - DNA, 22 bp, Homo sapiens
aaaggtttaaatgaacaagaga

SEQ ID NO: 2458834 - DNA, 16 bp, Homo sapiens
aaaggtttatgaaaaa

SEQ ID NO: 2458835 - DNA, 15 bp, Homo sapiens
aaagtacactctgct

SEQ ID NO: 2458836 - DNA, 14 bp, Homo sapiens
aaagtacttgtagt

SEQ ID NO: 2458837 - DNA, 17 bp, Homo sapiens
aaagtattcaacaattt

SEQ ID NO: 2458838 - DNA, 22 bp, Homo sapiens
aaagtattcttctcttcctttt

SEQ ID NO: 2458839 - DNA, 14 bp, Homo sapiens
aaagtctgtccttg

SEQ ID NO: 2458840 - DNA, 22 bp, Homo sapiens
aaagtctgtccttgaaggacta

SEQ ID NO: 2458841 - DNA, 18 bp, Homo sapiens
aaagtctgttgattaaag

SEQ ID NO: 2458842 - DNA, 19 bp, Homo sapiens
aaagtgactaatggcatga

SEQ ID NO: 2458843 - DNA, 19 bp, Homo sapiens
aaagtgccagtattttaaa

SEQ ID NO: 2458844 - DNA, 17 bp, Homo sapiens
aaagtgcctttcaggat

SEQ ID NO: 2458845 - DNA, 22 bp, Homo sapiens
aaagtgcctttcaggatctatt

SEQ ID NO: 2458846 - DNA, 23 bp, Homo sapiens
aaagtgcctttcaggatctattt

SEQ ID NO: 2458847 - DNA, 13 bp, Homo sapiens
aaagtgctaaggt

SEQ ID NO: 2458848 - DNA, 18 bp, Homo sapiens
aaagtgctaaggttctaa

SEQ ID NO: 2458849 - DNA, 19 bp, Homo sapiens
aaagtggaaaacaaggaag

SEQ ID NO: 2458850 - DNA, 17 bp, Homo sapiens
aaagtgggcttgattct

SEQ ID NO: 2458851 - DNA, 17 bp, Homo sapiens
aaagtgggttttttagt

SEQ ID NO: 2458852 - DNA, 15 bp, Homo sapiens
aaagtgtatttggaa

SEQ ID NO: 2458853 - DNA, 18 bp, Homo sapiens
aaagtgtcaactctttgt

SEQ ID NO: 2458854 - DNA, 21 bp, Homo sapiens
aaagtgtgaaataaatttttt

SEQ ID NO: 2458855 - DNA, 13 bp, Homo sapiens
aaagttaagttga

SEQ ID NO: 2458856 - DNA, 22 bp, Homo sapiens
aaagttaccagtgccttaaact

SEQ ID NO: 2458857 - DNA, 21 bp, Homo sapiens
aaagttctgtactcaaatgta

SEQ ID NO: 2458858 - DNA, 20 bp, Homo sapiens
aaagttgataaagatttttt

SEQ ID NO: 2458859 - DNA, 13 bp, Homo sapiens
aaagttgttgtaa

SEQ ID NO: 2458860 - DNA, 20 bp, Homo sapiens
aaagtttaaaacagaagcct

SEQ ID NO: 2458861 - DNA, 12 bp, Homo sapiens
aaagtttaataa

SEQ ID NO: 2458862 - DNA, 14 bp, Homo sapiens
aaagtttgtttgct

SEQ ID NO: 2458863 - DNA, 23 bp, Homo sapiens
aaagttttatatattatatggaa

SEQ ID NO: 2458864 - DNA, 22 bp, Homo sapiens
aaagttttttattatgcattat

SEQ ID NO: 2458865 - DNA, 16 bp, Homo sapiens
aaataaaaaagatccc

SEQ ID NO: 2458866 - DNA, 15 bp, Homo sapiens
aaataaagcatctca

SEQ ID NO: 2458867 - DNA, 20 bp, Homo sapiens
aaataacaaatgccaaatta

SEQ ID NO: 2458868 - DNA, 19 bp, Homo sapiens
aaataaccaatcctggaca

SEQ ID NO: 2458869 - DNA, 14 bp, Homo sapiens
aaataagaagaatg

SEQ ID NO: 2458870 - DNA, 20 bp, Homo sapiens
aaataagaagaatgcttaat

SEQ ID NO: 2458871 - DNA, 14 bp, Homo sapiens
aaataagaatagaa

SEQ ID NO: 2458872 - DNA, 17 bp, Homo sapiens
aaataagaatagaaata

SEQ ID NO: 2458873 - DNA, 12 bp, Homo sapiens
aaataagattct

SEQ ID NO: 2458874 - DNA, 22 bp, Homo sapiens
aaataagctatttgatgtaata

SEQ ID NO: 2458875 - DNA, 16 bp, Homo sapiens
aaataaggaaaagctt

SEQ ID NO: 2458876 - DNA, 14 bp, Homo sapiens
aaataagtcaacag

SEQ ID NO: 2458877 - DNA, 19 bp, Homo sapiens
aaataagtgccctctccca

SEQ ID NO: 2458878 - DNA, 13 bp, Homo sapiens
aaataatgctttg

SEQ ID NO: 2458879 - DNA, 16 bp, Homo sapiens
aaataatgctttgaaa

SEQ ID NO: 2458880 - DNA, 20 bp, Homo sapiens
aaataatgtgtagttcatgt

SEQ ID NO: 2458881 - DNA, 21 bp, Homo sapiens
aaataatgtgtagttcatgta

SEQ ID NO: 2458882 - DNA, 13 bp, Homo sapiens
aaataattgttgt

SEQ ID NO: 2458883 - DNA, 17 bp, Homo sapiens
aaataattgttgttctg

SEQ ID NO: 2458884 - DNA, 11 bp, Homo sapiens
aaatacaaaaa

SEQ ID NO: 2458885 - DNA, 14 bp, Homo sapiens
aaatacaagactgc

SEQ ID NO: 2458886 - DNA, 19 bp, Homo sapiens
aaaatcttatagttctagg

SEQ ID NO: 2458887 - DNA, 16 bp, Homo sapiens
aaaatgaattttttcc

SEQ ID NO: 2458888 - DNA, 18 bp, Homo sapiens
aaaatgctttttatttct

SEQ ID NO: 2458889 - DNA, 22 bp, Homo sapiens
aaaatgctttttatttctgcat

SEQ ID NO: 2458890 - DNA, 14 bp, Homo sapiens
aaaatgtatatgca

SEQ ID NO: 2458891 - DNA, 17 bp, Homo sapiens
aaaatgtatatgcactt

SEQ ID NO: 2458892 - DNA, 20 bp, Homo sapiens
aaaatgtatgcatgttgtct

SEQ ID NO: 2458893 - DNA, 16 bp, Homo sapiens
aaaatgtattttatgt

SEQ ID NO: 2458894 - DNA, 21 bp, Homo sapiens
aaaatgtgatgttctaaggct

SEQ ID NO: 2458895 - DNA, 15 bp, Homo sapiens
aaaatgttctgtttg

SEQ ID NO: 2458896 - DNA, 14 bp, Homo sapiens
aaaatgttgagaat

SEQ ID NO: 2458897 - DNA, 17 bp, Homo sapiens
aaaatgttgctgaaaaa

SEQ ID NO: 2458898 - DNA, 19 bp, Homo sapiens
aaaattcagcaaagtggtt

SEQ ID NO: 2458899 - DNA, 12 bp, Homo sapiens
aaaattcatttt

SEQ ID NO: 2458900 - DNA, 14 bp, Homo sapiens
aaaattccactcaa

SEQ ID NO: 2458901 - DNA, 17 bp, Homo sapiens
aaaattgaaatgtaagg

SEQ ID NO: 2458902 - DNA, 18 bp, Homo sapiens
aaaattgaaatgtaaggc

SEQ ID NO: 2458903 - DNA, 14 bp, Homo sapiens
aaaattgaatgcaa

SEQ ID NO: 2458904 - DNA, 20 bp, Homo sapiens
aaaattgatttttctcttca

SEQ ID NO: 2458905 - DNA, 21 bp, Homo sapiens
aaaattgatttttctcttcat

SEQ ID NO: 2458906 - DNA, 20 bp, Homo sapiens
aaaattgctgactgtagctt

SEQ ID NO: 2458907 - DNA, 19 bp, Homo sapiens
aaaatttgttcttgtattt

SEQ ID NO: 2458908 - DNA, 19 bp, Homo sapiens
aaacaaaaattaaaatcct

SEQ ID NO: 2458909 - DNA, 12 bp, Homo sapiens
aaacaaagatgt

SEQ ID NO: 2458910 - DNA, 17 bp, Homo sapiens
aaacaaccatgtcattt

SEQ ID NO: 2458911 - DNA, 17 bp, Homo sapiens
aaacaactctttgagaa

SEQ ID NO: 2458912 - DNA, 16 bp, Homo sapiens
aaacaaggttttcagt

SEQ ID NO: 2458913 - DNA, 13 bp, Homo sapiens
aaacaagtatttg

SEQ ID NO: 2458914 - DNA, 14 bp, Homo sapiens
aaacaatatagtct

SEQ ID NO: 2458915 - DNA, 22 bp, Homo sapiens
aaacactcaagttgattagaaa

SEQ ID NO: 2458916 - DNA, 12 bp, Homo sapiens
aaacagaagcct

SEQ ID NO: 2458917 - DNA, 16 bp, Homo sapiens
aaacaggcactgccct

SEQ ID NO: 2458918 - DNA, 21 bp, Homo sapiens
aaacatgtttatttttcttgt

SEQ ID NO: 2458919 - DNA, 14 bp, Homo sapiens
aaacattaaaatat

SEQ ID NO: 2458920 - DNA, 14 bp, Homo sapiens
aaacatttattttg

SEQ ID NO: 2458921 - DNA, 12 bp, Homo sapiens
aaacattttctg

SEQ ID NO: 2458922 - DNA, 17 bp, Homo sapiens
aaaccaatcctatgcat

SEQ ID NO: 2458923 - DNA, 12 bp, Homo sapiens
aaaccactgaaa

SEQ ID NO: 2458924 - DNA, 16 bp, Homo sapiens
aaaccactgaaaaaat

SEQ ID NO: 2458925 - DNA, 19 bp, Homo sapiens
aaaccagcttccttcagag

SEQ ID NO: 2458926 - DNA, 20 bp, Homo sapiens
aaaccagcttccttcagaga

SEQ ID NO: 2458927 - DNA, 20 bp, Homo sapiens
aaaccaggtccaatgagctt

SEQ ID NO: 2458928 - DNA, 22 bp, Homo sapiens
aaaccatcaagttgtgccaaat

SEQ ID NO: 2458929 - DNA, 15 bp, Homo sapiens
aaaccatctccctgg

SEQ ID NO: 2458930 - DNA, 19 bp, Homo sapiens
aaaccatctccctggtgct

SEQ ID NO: 2458931 - DNA, 17 bp, Homo sapiens
aaacccagttgccatct

SEQ ID NO: 2458932 - DNA, 22 bp, Homo sapiens
aaacccatattgtaaaacaggt

SEQ ID NO: 2458933 - DNA, 16 bp, Homo sapiens
aaactactttgctgct

SEQ ID NO: 2458934 - DNA, 22 bp, Homo sapiens
aaactagaggtgagaaatttaa

SEQ ID NO: 2458935 - DNA, 15 bp, Homo sapiens
aaactccaccttccc

SEQ ID NO: 2458936 - DNA, 20 bp, Homo sapiens
aaactctgttgcaagtgcaa

SEQ ID NO: 2458937 - DNA, 18 bp, Homo sapiens
aaactggccatggcctgc

SEQ ID NO: 2458938 - DNA, 20 bp, Homo sapiens
aaactgtgtaactgcccaaa

SEQ ID NO: 2458939 - DNA, 16 bp, Homo sapiens
aaacttaaatgttatt

SEQ ID NO: 2458940 - DNA, 22 bp, Homo sapiens
aaacttcagtttcacagaaaat

SEQ ID NO: 2458941 - DNA, 17 bp, Homo sapiens
aaacttccccatcttct

SEQ ID NO: 2458942 - DNA, 22 bp, Homo sapiens
aaactttaaagcgtttgcacag

SEQ ID NO: 2458943 - DNA, 12 bp, Homo sapiens
aaactttgtagt

SEQ ID NO: 2458944 - DNA, 16 bp, Homo sapiens
aaacttttaattcatt

SEQ ID NO: 2458945 - DNA, 20 bp, Homo sapiens
aaacttttcttaaaaagtta

SEQ ID NO: 2458946 - DNA, 19 bp, Homo sapiens
aaactttttttctgtacca

SEQ ID NO: 2458947 - DNA, 16 bp, Homo sapiens
aaagaaaaaaattgaa

SEQ ID NO: 2458948 - DNA, 15 bp, Homo sapiens
aaagaaaagatgcac

SEQ ID NO: 2458949 - DNA, 10 bp, Homo sapiens
aaagaaagtg

SEQ ID NO: 2458950 - DNA, 12 bp, Homo sapiens
aaagaaagtgta

SEQ ID NO: 2458951 - DNA, 17 bp, Homo sapiens
aaagaaatatacctaaa

SEQ ID NO: 2458952 - DNA, 18 bp, Homo sapiens
aaagaacgctgatttaaa

SEQ ID NO: 2458953 - DNA, 22 bp, Homo sapiens
aaagaagacctgagaatgtatc

SEQ ID NO: 2458954 - DNA, 22 bp, Homo sapiens
aaagaagagcgagagatcaaag

SEQ ID NO: 2458955 - DNA, 21 bp, Homo sapiens
aaagaagggctggtattgttc

SEQ ID NO: 2458956 - DNA, 22 bp, Homo sapiens
aaagaattgttgggggtttttt

SEQ ID NO: 2458957 - DNA, 14 bp, Homo sapiens
aaagaccctggctt

SEQ ID NO: 2458958 - DNA, 23 bp, Homo sapiens
aaagactggcttttattaatgca

SEQ ID NO: 2458959 - DNA, 12 bp, Homo sapiens
aaagaggctgag

SEQ ID NO: 2458960 - DNA, 19 bp, Homo sapiens
aaagaggctgaggcctgga

SEQ ID NO: 2458961 - DNA, 20 bp, Homo sapiens
aaagaggctgaggcctggac

SEQ ID NO: 2458962 - DNA, 21 bp, Homo sapiens
aaagaggctgaggcctggact

SEQ ID NO: 2458963 - DNA, 19 bp, Homo sapiens
aaagaggctgaggctggca

SEQ ID NO: 2458964 - DNA, 18 bp, Homo sapiens
aaagaggctgcccctctc

SEQ ID NO: 2458965 - DNA, 20 bp, Homo sapiens
aaagaggctgcccctctcac

SEQ ID NO: 2458966 - DNA, 18 bp, Homo sapiens
aaagaggtcgcttgggaa

SEQ ID NO: 2458967 - DNA, 18 bp, Homo sapiens
aaagaggtgaccccaggg

SEQ ID NO: 2458968 - DNA, 13 bp, Homo sapiens
aaagagtctagat

SEQ ID NO: 2458969 - DNA, 13 bp, Homo sapiens
aaatttagcattg

SEQ ID NO: 2458970 - DNA, 18 bp, Homo sapiens
aaatttctgtaaaacagg

SEQ ID NO: 2458971 - DNA, 18 bp, Homo sapiens
aaatttgacttttctgta

SEQ ID NO: 2458972 - DNA, 11 bp, Homo sapiens
aaatttgtact

SEQ ID NO: 2458973 - DNA, 20 bp, Homo sapiens
aaatttgtactatttaactg

SEQ ID NO: 2458974 - DNA, 19 bp, Homo sapiens
aaatttgttattttgcaac

SEQ ID NO: 2458975 - DNA, 14 bp, Homo sapiens
aacaaaatgtatgt

SEQ ID NO: 2458976 - DNA, 11 bp, Homo sapiens
aacaaagaaac

SEQ ID NO: 2458977 - DNA, 15 bp, Homo sapiens
aacaaagcagccacg

SEQ ID NO: 2458978 - DNA, 22 bp, Homo sapiens
aacaaaggcctaattctatgcc

SEQ ID NO: 2458979 - DNA, 17 bp, Homo sapiens
aacaaatgccaaattaa

SEQ ID NO: 2458980 - DNA, 15 bp, Homo sapiens
aacaactctttgaga

SEQ ID NO: 2458981 - DNA, 21 bp, Homo sapiens
aacaagagaagcattctcatt

SEQ ID NO: 2458982 - DNA, 19 bp, Homo sapiens
aacaagagcactacattca

SEQ ID NO: 2458983 - DNA, 13 bp, Homo sapiens
aacaatacaaatg

SEQ ID NO: 2458984 - DNA, 18 bp, Homo sapiens
agttggcttacctggccc

SEQ ID NO: 2458985 - DNA, 18 bp, Homo sapiens
agttgggactacaggcgt

SEQ ID NO: 2458986 - DNA, 15 bp, Homo sapiens
agttggtaacttttg

SEQ ID NO: 2458987 - DNA, 12 bp, Homo sapiens
agttgtaaagta

SEQ ID NO: 2458988 - DNA, 19 bp, Homo sapiens
agttgtatttaacagaaat

SEQ ID NO: 2458989 - DNA, 19 bp, Homo sapiens
agttgtcccgattgtaact

SEQ ID NO: 2458990 - DNA, 23 bp, Homo sapiens
agttgtgtttcaacggaaagtgc

SEQ ID NO: 2458991 - DNA, 20 bp, Homo sapiens
agttgttagattaagaaata

SEQ ID NO: 2458992 - DNA, 12 bp, Homo sapiens
agttgttgtaac

SEQ ID NO: 2458993 - DNA, 21 bp, Homo sapiens
agtttaaaagcacgacagtgg

SEQ ID NO: 2458994 - DNA, 16 bp, Homo sapiens
agtttaatcagaggaa

SEQ ID NO: 2458995 - DNA, 20 bp, Homo sapiens
agtttaccttgtatactgta

SEQ ID NO: 2458996 - DNA, 19 bp, Homo sapiens
agtttatcagtaaataact

SEQ ID NO: 2458997 - DNA, 15 bp, Homo sapiens
agtttcatgtacaag

SEQ ID NO: 2458998 - DNA, 12 bp, Homo sapiens
agtttcctgaaa

SEQ ID NO: 2458999 - DNA, 12 bp, Homo sapiens
agtttccttttt

SEQ ID NO: 2459000 - DNA, 16 bp, Homo sapiens
agtttcctttttaata

SEQ ID NO: 2459001 - DNA, 20 bp, Homo sapiens
agtttctaagattctaaagg

SEQ ID NO: 2459002 - DNA, 23 bp, Homo sapiens
agtttctctgcagaaactactga

SEQ ID NO: 2459003 - DNA, 20 bp, Homo sapiens
agtttctgtcgttaaaaaca

SEQ ID NO: 2459004 - DNA, 23 bp, Homo sapiens
agtttctgtcgttaaaaacagat

SEQ ID NO: 2459005 - DNA, 23 bp, Homo sapiens
agtttgattattcagtgtcactg

SEQ ID NO: 2459006 - DNA, 17 bp, Homo sapiens
agtttgcaaaaaatgtt

SEQ ID NO: 2459007 - DNA, 15 bp, Homo sapiens
agtttgctttgccct

SEQ ID NO: 2459008 - DNA, 22 bp, Homo sapiens
agtttggagagagcagactggc

SEQ ID NO: 2459009 - DNA, 12 bp, Homo sapiens
agtttggaggaa

SEQ ID NO: 2459010 - DNA, 14 bp, Homo sapiens
agtttggatatgta

SEQ ID NO: 2459011 - DNA, 20 bp, Homo sapiens
agtttggatatgtaaaacat

SEQ ID NO: 2459012 - DNA, 20 bp, Homo sapiens
agtttgggtaaaatactttt

SEQ ID NO: 2459013 - DNA, 19 bp, Homo sapiens
agtttgtcgctcatgtgtg

SEQ ID NO: 2459014 - DNA, 21 bp, Homo sapiens
agtttgtcgctcatgtgtgca

SEQ ID NO: 2459015 - DNA, 22 bp, Homo sapiens
agtttgtgtgtcttaattatta

SEQ ID NO: 2459016 - DNA, 22 bp, Homo sapiens
agttttaaaaagccagtttggg

SEQ ID NO: 2459017 - DNA, 13 bp, Homo sapiens
agttttatatatt

SEQ ID NO: 2459018 - DNA, 14 bp, Homo sapiens
agttttatatatta

SEQ ID NO: 2459019 - DNA, 13 bp, Homo sapiens
agttttatcattt

SEQ ID NO: 2459020 - DNA, 14 bp, Homo sapiens
agttttatcatttt

SEQ ID NO: 2459021 - DNA, 20 bp, Homo sapiens
agttttcatccataactgaa

SEQ ID NO: 2459022 - DNA, 19 bp, Homo sapiens
agttttgtgtttgttgtag

SEQ ID NO: 2459023 - DNA, 15 bp, Homo sapiens
agtttttaaacatca

SEQ ID NO: 2459024 - DNA, 17 bp, Homo sapiens
agtttttatatgttgta

SEQ ID NO: 2459025 - DNA, 19 bp, Homo sapiens
agtttttattaaacccctt

SEQ ID NO: 2459026 - DNA, 18 bp, Homo sapiens
agtttttcattaaataaa

SEQ ID NO: 2459027 - DNA, 20 bp, Homo sapiens
agtttttcattaaataaatt

SEQ ID NO: 2459028 - DNA, 21 bp, Homo sapiens
agttttttacttttgtttatt

SEQ ID NO: 2459029 - DNA, 13 bp, Homo sapiens
agttttttcatct

SEQ ID NO: 2459030 - DNA, 14 bp, Homo sapiens
agttttttcatctt

SEQ ID NO: 2459031 - DNA, 13 bp, Homo sapiens
ataaaaaatggtt

SEQ ID NO: 2459032 - DNA, 21 bp, Homo sapiens
ataaaaagcttccatgattct

SEQ ID NO: 2459033 - DNA, 12 bp, Homo sapiens
ataaaaaggtgt

SEQ ID NO: 2459034 - DNA, 21 bp, Homo sapiens
ataaaactgtttttgaacctg

SEQ ID NO: 2459035 - DNA, 17 bp, Homo sapiens
ataaaactttgctgcca

SEQ ID NO: 2459036 - DNA, 14 bp, Homo sapiens
ataaaagaaaatta

SEQ ID NO: 2459037 - DNA, 16 bp, Homo sapiens
ataaaagaaaattaca

SEQ ID NO: 2459038 - DNA, 15 bp, Homo sapiens
ataaaaggaagccaa

SEQ ID NO: 2459039 - DNA, 17 bp, Homo sapiens
ataaaaggaagccaaag

SEQ ID NO: 2459040 - DNA, 21 bp, Homo sapiens
ataaaatatgaagacataaac

SEQ ID NO: 2459041 - DNA, 13 bp, Homo sapiens
ataaaatttgttg

SEQ ID NO: 2459042 - DNA, 13 bp, Homo sapiens
ataaacaagaaaa

SEQ ID NO: 2459043 - DNA, 16 bp, Homo sapiens
ataaacaagaaaaata

SEQ ID NO: 2459044 - DNA, 21 bp, Homo sapiens
ataaacaagaaaaataaagaa

SEQ ID NO: 2459045 - DNA, 22 bp, Homo sapiens
ataaacaagaaaaataaagaaa

SEQ ID NO: 2459046 - DNA, 14 bp, Homo sapiens
ataaactaataatt

SEQ ID NO: 2459047 - DNA, 14 bp, Homo sapiens
ataaagaaaagatg

SEQ ID NO: 2459048 - DNA, 13 bp, Homo sapiens
ataaagaaaatga

SEQ ID NO: 2459049 - DNA, 16 bp, Homo sapiens
ataaagacgttttata

SEQ ID NO: 2459050 - DNA, 17 bp, Homo sapiens
ataaagattttttaata

SEQ ID NO: 2459051 - DNA, 12 bp, Homo sapiens
ataaagcattta

SEQ ID NO: 2459052 - DNA, 18 bp, Homo sapiens
ataaagcctcaaggtttt

SEQ ID NO: 2459053 - DNA, 16 bp, Homo sapiens
ataaaggaaaagacac

SEQ ID NO: 2459054 - DNA, 13 bp, Homo sapiens
ataaaggatgtga

SEQ ID NO: 2459055 - DNA, 22 bp, Homo sapiens
ataaaggatgtgattgtggaat

SEQ ID NO: 2459056 - DNA, 18 bp, Homo sapiens
ataaaggcagttttctaa

SEQ ID NO: 2459057 - DNA, 20 bp, Homo sapiens
ataaagtattcaacaatttc

SEQ ID NO: 2459058 - DNA, 14 bp, Homo sapiens
ataaagtgtaacaa

SEQ ID NO: 2459059 - DNA, 18 bp, Homo sapiens
ataaagttttatatatta

SEQ ID NO: 2459060 - DNA, 20 bp, Homo sapiens
ataaagttttatatattata

SEQ ID NO: 2459061 - DNA, 21 bp, Homo sapiens
ataaatatatctaccccagac

SEQ ID NO: 2459062 - DNA, 14 bp, Homo sapiens
ataaatatccttta

SEQ ID NO: 2459063 - DNA, 21 bp, Homo sapiens
ataaatatcctttaattgatc

SEQ ID NO: 2459064 - DNA, 19 bp, Homo sapiens
ataaatctgacccagtgcc

SEQ ID NO: 2459065 - DNA, 18 bp, Homo sapiens
ataaatgattcttagtga

SEQ ID NO: 2459066 - DNA, 12 bp, Homo sapiens
ataaatgtcact

SEQ ID NO: 2459067 - DNA, 19 bp, Homo sapiens
ataaatgtcactttttgag

SEQ ID NO: 2459068 - DNA, 23 bp, Homo sapiens
ataaatgtcactttttgaggcaa

SEQ ID NO: 2459069 - DNA, 13 bp, Homo sapiens
ataaattattgtt

SEQ ID NO: 2459070 - DNA, 17 bp, Homo sapiens
ataaattgtacagccgg

SEQ ID NO: 2459071 - DNA, 14 bp, Homo sapiens
ataaccactgcttc

SEQ ID NO: 2459072 - DNA, 20 bp, Homo sapiens
ataacgtttaagccaaaaca

SEQ ID NO: 2459073 - DNA, 15 bp, Homo sapiens
ataactcctcattgt

SEQ ID NO: 2459074 - DNA, 12 bp, Homo sapiens
ataactcctccc

SEQ ID NO: 2459075 - DNA, 22 bp, Homo sapiens
ataactcctcccagggttttaa

SEQ ID NO: 2459076 - DNA, 15 bp, Homo sapiens
ataactggaaaacag

SEQ ID NO: 2459077 - DNA, 22 bp, Homo sapiens
ataactggaaaacagaacactt

SEQ ID NO: 2459078 - DNA, 20 bp, Homo sapiens
ataactgtaaatgtgacatt

SEQ ID NO: 2459079 - DNA, 13 bp, Homo sapiens
ataagaaactttt

SEQ ID NO: 2459080 - DNA, 15 bp, Homo sapiens
ataagaaagcctgag

SEQ ID NO: 2459081 - DNA, 16 bp, Homo sapiens
ataagaactttgagct

SEQ ID NO: 2459082 - DNA, 15 bp, Homo sapiens
ataagaagaatgctt

SEQ ID NO: 2459083 - DNA, 16 bp, Homo sapiens
ataagaattcagacat

SEQ ID NO: 2459084 - DNA, 15 bp, Homo sapiens
ataagagctcaggat

SEQ ID NO: 2459085 - DNA, 23 bp, Homo sapiens
ataagcaagaaggcaaaaatagt

SEQ ID NO: 2459086 - DNA, 16 bp, Homo sapiens
ataagcaggtggatct

SEQ ID NO: 2459087 - DNA, 14 bp, Homo sapiens
ataagcatcattat

SEQ ID NO: 2459088 - DNA, 13 bp, Homo sapiens
ataagctatttga

SEQ ID NO: 2459089 - DNA, 13 bp, Homo sapiens
ataagcttttctt

SEQ ID NO: 2459090 - DNA, 20 bp, Homo sapiens
ataaggaaatcaacttgctt

SEQ ID NO: 2459091 - DNA, 11 bp, Homo sapiens
ataaggcaggg

SEQ ID NO: 2459092 - DNA, 11 bp, Homo sapiens
ataaggcttca

SEQ ID NO: 2459093 - DNA, 23 bp, Homo sapiens
ataagggtcccccactctaaagc

SEQ ID NO: 2459094 - DNA, 19 bp, Homo sapiens
ataagtatttcaaattgga

SEQ ID NO: 2459095 - DNA, 15 bp, Homo sapiens
ataagtcaacagtaa

SEQ ID NO: 2459096 - DNA, 17 bp, Homo sapiens
ataagtcaacagtaaac

SEQ ID NO: 2459097 - DNA, 12 bp, Homo sapiens
ataagtgccctc

SEQ ID NO: 2459098 - DNA, 13 bp, Homo sapiens
ataagtgtacata

SEQ ID NO: 2459099 - DNA, 13 bp, Homo sapiens
ataagttattgca

SEQ ID NO: 2459100 - DNA, 20 bp, Homo sapiens
ataagttattgcagtttatc

SEQ ID NO: 2459101 - DNA, 22 bp, Homo sapiens
ataatactgctgagatacatac

SEQ ID NO: 2459102 - DNA, 12 bp, Homo sapiens
ataatagattct

SEQ ID NO: 2459103 - DNA, 22 bp, Homo sapiens
ataatcattattacttttgctg

SEQ ID NO: 2459104 - DNA, 13 bp, Homo sapiens
ataatgaacagaa

SEQ ID NO: 2459105 - DNA, 16 bp, Homo sapiens
ataattataatatact

SEQ ID NO: 2459106 - DNA, 15 bp, Homo sapiens
ataattatataactg

SEQ ID NO: 2459107 - DNA, 17 bp, Homo sapiens
ataattatataactgta

SEQ ID NO: 2459108 - DNA, 13 bp, Homo sapiens
ataattatatgtt

SEQ ID NO: 2459109 - DNA, 23 bp, Homo sapiens
ataattctttcaatacagatata

SEQ ID NO: 2459110 - DNA, 19 bp, Homo sapiens
ataattgagttttcagtgg

SEQ ID NO: 2459111 - DNA, 14 bp, Homo sapiens
ataattgcattgac

SEQ ID NO: 2459112 - DNA, 21 bp, Homo sapiens
ataattgccaaaaagtgaaat

SEQ ID NO: 2459113 - DNA, 20 bp, Homo sapiens
ataattggatttcctaatac

SEQ ID NO: 2459114 - DNA, 21 bp, Homo sapiens
ataattgtgattagacagaac

SEQ ID NO: 2459115 - DNA, 23 bp, Homo sapiens
ataattgttctcagaatccctta

SEQ ID NO: 2459116 - DNA, 17 bp, Homo sapiens
ataattgttgttctgtt

SEQ ID NO: 2459117 - DNA, 21 bp, Homo sapiens
ataattgttgttctgttaact

SEQ ID NO: 2459118 - DNA, 16 bp, Homo sapiens
ataatttacctaagat

SEQ ID NO: 2459119 - DNA, 20 bp, Homo sapiens
ataatttagtttcatataaa

SEQ ID NO: 2459120 - DNA, 17 bp, Homo sapiens
atacaaatggattttgg

SEQ ID NO: 2459121 - DNA, 12 bp, Homo sapiens
atacaagactgc

SEQ ID NO: 2459122 - DNA, 14 bp, Homo sapiens
atacagaactcttt

SEQ ID NO: 2459123 - DNA, 15 bp, Homo sapiens
atacagaactctttc

SEQ ID NO: 2459124 - DNA, 20 bp, Homo sapiens
atacagaactctttcaaaac

SEQ ID NO: 2459125 - DNA, 23 bp, Homo sapiens
atacagaactctttcaaaacctt

SEQ ID NO: 2459126 - DNA, 14 bp, Homo sapiens
atacagagaagtca

SEQ ID NO: 2459127 - DNA, 15 bp, Homo sapiens
atacagagaagtcac

SEQ ID NO: 2459128 - DNA, 12 bp, Homo sapiens
atacagctgtat

SEQ ID NO: 2459129 - DNA, 20 bp, Homo sapiens
atacagctgtattgtctgaa

SEQ ID NO: 2459130 - DNA, 13 bp, Homo sapiens
atacaggaaacag

SEQ ID NO: 2459131 - DNA, 15 bp, Homo sapiens
atacaggaaacagtt

SEQ ID NO: 2459132 - DNA, 22 bp, Homo sapiens
atacattatatttctattttat

SEQ ID NO: 2459133 - DNA, 16 bp, Homo sapiens
atacatttaaaacatt

SEQ ID NO: 2459134 - DNA, 21 bp, Homo sapiens
atacatttaaaacattaaaat

SEQ ID NO: 2459135 - DNA, 16 bp, Homo sapiens
atacattttctaagaa

SEQ ID NO: 2459136 - DNA, 15 bp, Homo sapiens
ataccactctgtaat

SEQ ID NO: 2459137 - DNA, 17 bp, Homo sapiens
ataccactctgtaattg

SEQ ID NO: 2459138 - DNA, 16 bp, Homo sapiens
ataccagcgaggaggc

SEQ ID NO: 2459139 - DNA, 23 bp, Homo sapiens
ataccattatatgttccccctgt

SEQ ID NO: 2459140 - DNA, 13 bp, Homo sapiens
atacccccctctg

SEQ ID NO: 2459141 - DNA, 18 bp, Homo sapiens
ataccccttacaaatgaa

SEQ ID NO: 2459142 - DNA, 21 bp, Homo sapiens
atacctgtgtttcttgcctca

SEQ ID NO: 2459143 - DNA, 16 bp, Homo sapiens
atacgagagcagaggt

SEQ ID NO: 2459144 - DNA, 14 bp, Homo sapiens
atacgctcagctca

SEQ ID NO: 2459145 - DNA, 21 bp, Homo sapiens
atacgctcagctcatccatgc

SEQ ID NO: 2459146 - DNA, 21 bp, Homo sapiens
atacgctggcaacacagaggc

SEQ ID NO: 2459147 - DNA, 19 bp, Homo sapiens
atactaaaaagaagtgctg

SEQ ID NO: 2459148 - DNA, 18 bp, Homo sapiens
atactaataaactaataa

SEQ ID NO: 2459149 - DNA, 22 bp, Homo sapiens
atactaataaactaataattgc

SEQ ID NO: 2459150 - DNA, 14 bp, Homo sapiens
atactaccttgaaa

SEQ ID NO: 2459151 - DNA, 16 bp, Homo sapiens
atactagggagccatt

SEQ ID NO: 2459152 - DNA, 16 bp, Homo sapiens
atactctttctgtata

SEQ ID NO: 2459153 - DNA, 17 bp, Homo sapiens
atactctttctgtatat

SEQ ID NO: 2459154 - DNA, 23 bp, Homo sapiens
atactctttctgtatatactttt

SEQ ID NO: 2459155 - DNA, 15 bp, Homo sapiens
atactgaacatctga

SEQ ID NO: 2459156 - DNA, 20 bp, Homo sapiens
atactgaacatctgagtcct

SEQ ID NO: 2459157 - DNA, 23 bp, Homo sapiens
atactgaacatctgagtcctgga

SEQ ID NO: 2459158 - DNA, 15 bp, Homo sapiens
atactgctacagcaa

SEQ ID NO: 2459159 - DNA, 12 bp, Homo sapiens
atactgctgaga

SEQ ID NO: 2459160 - DNA, 18 bp, Homo sapiens
atactgctgagatacata

SEQ ID NO: 2459161 - DNA, 22 bp, Homo sapiens
atactgctgagatacatacaga

SEQ ID NO: 2459162 - DNA, 10 bp, Homo sapiens
atactgcttg

SEQ ID NO: 2459163 - DNA, 20 bp, Homo sapiens
atactgcttggagctgagca

SEQ ID NO: 2459164 - DNA, 14 bp, Homo sapiens
atactggaaagctt

SEQ ID NO: 2459165 - DNA, 13 bp, Homo sapiens
atactgttgcacg

SEQ ID NO: 2459166 - DNA, 18 bp, Homo sapiens
atacttatttgtatatgg

SEQ ID NO: 2459167 - DNA, 21 bp, Homo sapiens
atacttgaacgttttctaatt

SEQ ID NO: 2459168 - DNA, 16 bp, Homo sapiens
atacttgaagggccag

SEQ ID NO: 2459169 - DNA, 19 bp, Homo sapiens
atacttgaagggccagagc

SEQ ID NO: 2459170 - DNA, 21 bp, Homo sapiens
atacttgaagggccagagcca

SEQ ID NO: 2459171 - DNA, 18 bp, Homo sapiens
atacttggagggcccagc

SEQ ID NO: 2459172 - DNA, 13 bp, Homo sapiens
atacttgtaatta

SEQ ID NO: 2459173 - DNA, 14 bp, Homo sapiens
atacttgtaattat

SEQ ID NO: 2459174 - DNA, 21 bp, Homo sapiens
atactttccctaccctctaga

SEQ ID NO: 2459175 - DNA, 24 bp, Homo sapiens
atactttccctaccctctagagaa

SEQ ID NO: 2459176 - DNA, 22 bp, Homo sapiens
atactttgaaaggagatgtctt

SEQ ID NO: 2459177 - DNA, 15 bp, Homo sapiens
atactttgaatgtgt

SEQ ID NO: 2459178 - DNA, 22 bp, Homo sapiens
atactttgcagcacagctgaga

SEQ ID NO: 2459179 - DNA, 15 bp, Homo sapiens
atacttttactctgc

SEQ ID NO: 2459180 - DNA, 16 bp, Homo sapiens
atacttttgccctttg

SEQ ID NO: 2459181 - DNA, 17 bp, Homo sapiens
atagaaatgccaagcac

SEQ ID NO: 2459182 - DNA, 18 bp, Homo sapiens
atagaactctgaaatgaa

SEQ ID NO: 2459183 - DNA, 14 bp, Homo sapiens
atagaactgaatga

SEQ ID NO: 2459184 - DNA, 13 bp, Homo sapiens
atagaaggtgatg

SEQ ID NO: 2459185 - DNA, 14 bp, Homo sapiens
atagaagtttagat

SEQ ID NO: 2459186 - DNA, 18 bp, Homo sapiens
atagaataaaggcagttt

SEQ ID NO: 2459187 - DNA, 22 bp, Homo sapiens
atagaattataactggaaagaa

SEQ ID NO: 2459188 - DNA, 17 bp, Homo sapiens
atagacaaatagaaaat

SEQ ID NO: 2459189 - DNA, 16 bp, Homo sapiens
atagatgctggcccag

SEQ ID NO: 2459190 - DNA, 23 bp, Homo sapiens
atagatgctggcccagggcccag

SEQ ID NO: 2459191 - DNA, 17 bp, Homo sapiens
atagatgtcttttccca

SEQ ID NO: 2459192 - DNA, 13 bp, Homo sapiens
atagattctaaag

SEQ ID NO: 2459193 - DNA, 21 bp, Homo sapiens
atagattgtccttttgcaaag

SEQ ID NO: 2459194 - DNA, 14 bp, Homo sapiens
aggcccccagccca

SEQ ID NO: 2459195 - DNA, 19 bp, Homo sapiens
aggcccccagcccagggct

SEQ ID NO: 2459196 - DNA, 23 bp, Homo sapiens
aggcccccagcccagggctcctg

SEQ ID NO: 2459197 - DNA, 18 bp, Homo sapiens
aggcccccatcatcctct

SEQ ID NO: 2459198 - DNA, 18 bp, Homo sapiens
aggcccccgccttggcct

SEQ ID NO: 2459199 - DNA, 18 bp, Homo sapiens
aggcccggatgcagaggc

SEQ ID NO: 2459200 - DNA, 17 bp, Homo sapiens
aggccctccacacctgc

SEQ ID NO: 2459201 - DNA, 19 bp, Homo sapiens
aggccctccacacctgcgg

SEQ ID NO: 2459202 - DNA, 23 bp, Homo sapiens
aggccctccacacctgcggccca

SEQ ID NO: 2459203 - DNA, 23 bp, Homo sapiens
aggccctccctgttccccagaga

SEQ ID NO: 2459204 - DNA, 23 bp, Homo sapiens
aggccctggatcagcgtggcctt

SEQ ID NO: 2459205 - DNA, 17 bp, Homo sapiens
aggccgtgacgtctggg

SEQ ID NO: 2459206 - DNA, 22 bp, Homo sapiens
aggccgtgacgtctgggtggcc

SEQ ID NO: 2459207 - DNA, 20 bp, Homo sapiens
aggccgtggctgctgtggga

SEQ ID NO: 2459208 - DNA, 22 bp, Homo sapiens
aggcctaattctatgcctgtct

SEQ ID NO: 2459209 - DNA, 17 bp, Homo sapiens
aggcctaggagggtcct

SEQ ID NO: 2459210 - DNA, 18 bp, Homo sapiens
aggcctaggagggtcctc

SEQ ID NO: 2459211 - DNA, 17 bp, Homo sapiens
aggcctaggattctaaa

SEQ ID NO: 2459212 - DNA, 15 bp, Homo sapiens
aggcctagtcctgcg

SEQ ID NO: 2459213 - DNA, 17 bp, Homo sapiens
aggcctgaaagaggctg

SEQ ID NO: 2459214 - DNA, 17 bp, Homo sapiens
aggcctgcagggcctct

SEQ ID NO: 2459215 - DNA, 20 bp, Homo sapiens
aggcctgcagggcctctgtc

SEQ ID NO: 2459216 - DNA, 18 bp, Homo sapiens
aggcctggactttcctgc

SEQ ID NO: 2459217 - DNA, 22 bp, Homo sapiens
aggcctggactttcctgcaact

SEQ ID NO: 2459218 - DNA, 22 bp, Homo sapiens
aggcctgtgtagctgtgacctg

SEQ ID NO: 2459219 - DNA, 23 bp, Homo sapiens
aggcctgtgtagctgtgacctgc

SEQ ID NO: 2459220 - DNA, 19 bp, Homo sapiens
aggccttgcggctcctcag

SEQ ID NO: 2459221 - DNA, 22 bp, Homo sapiens
aggccttgcggctcctcaggga

SEQ ID NO: 2459222 - DNA, 23 bp, Homo sapiens
aggccttgcggctcctcagggac

SEQ ID NO: 2459223 - DNA, 18 bp, Homo sapiens
aggcgagaagggctgctt

SEQ ID NO: 2459224 - DNA, 19 bp, Homo sapiens
aggcgagaagggctgcttc

SEQ ID NO: 2459225 - DNA, 21 bp, Homo sapiens
aggcgcactgtgacccccagc

SEQ ID NO: 2459226 - DNA, 22 bp, Homo sapiens
aggcgcactgtgacccccagct

SEQ ID NO: 2459227 - DNA, 21 bp, Homo sapiens
aggcgccccaacccgtggagg

SEQ ID NO: 2459228 - DNA, 22 bp, Homo sapiens
aggcgccccaacccgtggaggc

SEQ ID NO: 2459229 - DNA, 19 bp, Homo sapiens
aggcggggcttgccttctg

SEQ ID NO: 2459230 - DNA, 17 bp, Homo sapiens
aggcgtgagccacctcg

SEQ ID NO: 2459231 - DNA, 14 bp, Homo sapiens
aggctacagagaag

SEQ ID NO: 2459232 - DNA, 15 bp, Homo sapiens
aggctacagagaagc

SEQ ID NO: 2459233 - DNA, 22 bp, Homo sapiens
aggctacagagaagccttcaag

SEQ ID NO: 2459234 - DNA, 14 bp, Homo sapiens
aggctaggccagca

SEQ ID NO: 2459235 - DNA, 16 bp, Homo sapiens
aggctaggccagcagg

SEQ ID NO: 2459236 - DNA, 16 bp, Homo sapiens
aggctatttgtaaatc

SEQ ID NO: 2459237 - DNA, 16 bp, Homo sapiens
aggctcacccccttct

SEQ ID NO: 2459238 - DNA, 19 bp, Homo sapiens
aggctcacccccttctcca

SEQ ID NO: 2459239 - DNA, 14 bp, Homo sapiens
aggctcactggtca

SEQ ID NO: 2459240 - DNA, 21 bp, Homo sapiens
aggctcaggcaggggcctcca

SEQ ID NO: 2459241 - DNA, 17 bp, Homo sapiens
aggctcggcctgccccc

SEQ ID NO: 2459242 - DNA, 19 bp, Homo sapiens
aggctctatgagtctagat

SEQ ID NO: 2459243 - DNA, 21 bp, Homo sapiens
aggctctatgagtctagatgt

SEQ ID NO: 2459244 - DNA, 13 bp, Homo sapiens
aggctctgagagt

SEQ ID NO: 2459245 - DNA, 19 bp, Homo sapiens
aggctctgagagtctagat

SEQ ID NO: 2459246 - DNA, 22 bp, Homo sapiens
aggctctgagagtctagattct

SEQ ID NO: 2459247 - DNA, 23 bp, Homo sapiens
aggctctgagagtctagattctc

SEQ ID NO: 2459248 - DNA, 13 bp, Homo sapiens
aggctgaccacag

SEQ ID NO: 2459249 - DNA, 14 bp, Homo sapiens
aggctgaccacagc

SEQ ID NO: 2459250 - DNA, 21 bp, Homo sapiens
aggctgaccacagcacagcca

SEQ ID NO: 2459251 - DNA, 13 bp, Homo sapiens
aggctgaggcctg

SEQ ID NO: 2459252 - DNA, 14 bp, Homo sapiens
aggctgaggcctgg

SEQ ID NO: 2459253 - DNA, 16 bp, Homo sapiens
aggctgaggcctggac

SEQ ID NO: 2459254 - DNA, 17 bp, Homo sapiens
aggctgaggcctggact

SEQ ID NO: 2459255 - DNA, 20 bp, Homo sapiens
aggctgcattgaaaagagct

SEQ ID NO: 2459256 - DNA, 13 bp, Homo sapiens
aggctgccctcct

SEQ ID NO: 2459257 - DNA, 16 bp, Homo sapiens
aggctgccgtccccta

SEQ ID NO: 2459258 - DNA, 20 bp, Homo sapiens
aggctgctcggggtgcacag

SEQ ID NO: 2459259 - DNA, 18 bp, Homo sapiens
aggctggaagctgggagg

SEQ ID NO: 2459260 - DNA, 14 bp, Homo sapiens
aggctggcacagga

SEQ ID NO: 2459261 - DNA, 19 bp, Homo sapiens
aggctggccagtccaggct

SEQ ID NO: 2459262 - DNA, 18 bp, Homo sapiens
aggctgggaactcatctg

SEQ ID NO: 2459263 - DNA, 12 bp, Homo sapiens
aggctgggccat

SEQ ID NO: 2459264 - DNA, 23 bp, Homo sapiens
aggctggtcctatggcctcatgt

SEQ ID NO: 2459265 - DNA, 17 bp, Homo sapiens
aggctgtgtaagatttg

SEQ ID NO: 2459266 - DNA, 20 bp, Homo sapiens
aggctgtgtttggctttcag

SEQ ID NO: 2459267 - DNA, 21 bp, Homo sapiens
aggctgtgtttggctttcagg

SEQ ID NO: 2459268 - DNA, 19 bp, Homo sapiens
agtgctgggattacaggct

SEQ ID NO: 2459269 - DNA, 15 bp, Homo sapiens
agtgctgttttgtta

SEQ ID NO: 2459270 - DNA, 16 bp, Homo sapiens
agtgctgttttgttat

SEQ ID NO: 2459271 - DNA, 13 bp, Homo sapiens
agtgcttgctttt

SEQ ID NO: 2459272 - DNA, 24 bp, Homo sapiens
agtggaacgaaaatgaaagctact

SEQ ID NO: 2459273 - DNA, 13 bp, Homo sapiens
agtggactcaggg

SEQ ID NO: 2459274 - DNA, 15 bp, Homo sapiens
agtggatcacaaagt

SEQ ID NO: 2459275 - DNA, 14 bp, Homo sapiens
agtggcagcccagc

SEQ ID NO: 2459276 - DNA, 11 bp, Homo sapiens
agtggcagggg

SEQ ID NO: 2459277 - DNA, 18 bp, Homo sapiens
agtggctggtccagggct

SEQ ID NO: 2459278 - DNA, 12 bp, Homo sapiens
agtgggaagccc

SEQ ID NO: 2459279 - DNA, 17 bp, Homo sapiens
agtgggaagcccatcct

SEQ ID NO: 2459280 - DNA, 22 bp, Homo sapiens
agtgggcttgattctgcagtaa

SEQ ID NO: 2459281 - DNA, 16 bp, Homo sapiens
agtgggggtggggggt

SEQ ID NO: 2459282 - DNA, 19 bp, Homo sapiens
agtgggggtgggggtaggg

SEQ ID NO: 2459283 - DNA, 18 bp, Homo sapiens
agtggggttatctctgtg

SEQ ID NO: 2459284 - DNA, 20 bp, Homo sapiens
agtggggttatctctgtgtt

SEQ ID NO: 2459285 - DNA, 11 bp, Homo sapiens
agtgggtgggg

SEQ ID NO: 2459286 - DNA, 14 bp, Homo sapiens
agtgggtggggagt

SEQ ID NO: 2459287 - DNA, 12 bp, Homo sapiens
agtgggtttttt

SEQ ID NO: 2459288 - DNA, 23 bp, Homo sapiens
agtgggttttttagttgaatttt

SEQ ID NO: 2459289 - DNA, 14 bp, Homo sapiens
agtgtaaaatattt

SEQ ID NO: 2459290 - DNA, 21 bp, Homo sapiens
agtgtaaaatattttgaatca

SEQ ID NO: 2459291 - DNA, 15 bp, Homo sapiens
agtgtaacaattgtg

SEQ ID NO: 2459292 - DNA, 18 bp, Homo sapiens
agtgtatgactgcacatg

SEQ ID NO: 2459293 - DNA, 15 bp, Homo sapiens
agtgtatgattactg

SEQ ID NO: 2459294 - DNA, 19 bp, Homo sapiens
agtgtatgattactggcct

SEQ ID NO: 2459295 - DNA, 16 bp, Homo sapiens
agtgtatggggcagct

SEQ ID NO: 2459296 - DNA, 14 bp, Homo sapiens
agtgtatttggaaa

SEQ ID NO: 2459297 - DNA, 13 bp, Homo sapiens
agtgtcctgagct

SEQ ID NO: 2459298 - DNA, 16 bp, Homo sapiens
agtgtctgtgttttga

SEQ ID NO: 2459299 - DNA, 13 bp, Homo sapiens
agtgtctttccac

SEQ ID NO: 2459300 - DNA, 15 bp, Homo sapiens
agtgtctttttttgt

SEQ ID NO: 2459301 - DNA, 16 bp, Homo sapiens
agtgtctttttttgta

SEQ ID NO: 2459302 - DNA, 17 bp, Homo sapiens
agtgtgcggctgtgtgt

SEQ ID NO: 2459303 - DNA, 22 bp, Homo sapiens
agtgtgcttctgttatcaaaca

SEQ ID NO: 2459304 - DNA, 14 bp, Homo sapiens
agtgtgtgacttac

SEQ ID NO: 2459305 - DNA, 15 bp, Homo sapiens
agtgttagggaaggg

SEQ ID NO: 2459306 - DNA, 19 bp, Homo sapiens
agtgttagggaagggcctg

SEQ ID NO: 2459307 - DNA, 16 bp, Homo sapiens
agtgttatcagtcata

SEQ ID NO: 2459308 - DNA, 17 bp, Homo sapiens
agtgttattttcattca

SEQ ID NO: 2459309 - DNA, 21 bp, Homo sapiens
agtgttccccttccactgagg

SEQ ID NO: 2459310 - DNA, 19 bp, Homo sapiens
agtgttctgtctgactttc

SEQ ID NO: 2459311 - DNA, 17 bp, Homo sapiens
agtgttgagccttttcc

SEQ ID NO: 2459312 - DNA, 14 bp, Homo sapiens
agtgtttaaaactt

SEQ ID NO: 2459313 - DNA, 16 bp, Homo sapiens
agtgtttatcctttca

SEQ ID NO: 2459314 - DNA, 15 bp, Homo sapiens
agtgttttctgggat

SEQ ID NO: 2459315 - DNA, 12 bp, Homo sapiens
agttaacacact

SEQ ID NO: 2459316 - DNA, 13 bp, Homo sapiens
agttaacacacta

SEQ ID NO: 2459317 - DNA, 16 bp, Homo sapiens
agttaacacactaccg

SEQ ID NO: 2459318 - DNA, 22 bp, Homo sapiens
agttaacacactaccgaatgtg

SEQ ID NO: 2459319 - DNA, 13 bp, Homo sapiens
agttaagacctgg

SEQ ID NO: 2459320 - DNA, 16 bp, Homo sapiens
agttaagacctggcag

SEQ ID NO: 2459321 - DNA, 18 bp, Homo sapiens
agttaatcatcaagagaa

SEQ ID NO: 2459322 - DNA, 13 bp, Homo sapiens
agttacagttctg

SEQ ID NO: 2459323 - DNA, 23 bp, Homo sapiens
agttacctgagagatttaacatt

SEQ ID NO: 2459324 - DNA, 22 bp, Homo sapiens
agttaccttatagttactgtgt

SEQ ID NO: 2459325 - DNA, 14 bp, Homo sapiens
agttactgtgtaat

SEQ ID NO: 2459326 - DNA, 11 bp, Homo sapiens
agttagcacca

SEQ ID NO: 2459327 - DNA, 15 bp, Homo sapiens
agttagctttaactt

SEQ ID NO: 2459328 - DNA, 15 bp, Homo sapiens
agttagtttgtatat

SEQ ID NO: 2459329 - DNA, 20 bp, Homo sapiens
agttatacttatttgtatat

SEQ ID NO: 2459330 - DNA, 14 bp, Homo sapiens
agttatagtgaata

SEQ ID NO: 2459331 - DNA, 15 bp, Homo sapiens
agttatagtgaatac

SEQ ID NO: 2459332 - DNA, 23 bp, Homo sapiens
agttatagtgaatactgctacag

SEQ ID NO: 2459333 - DNA, 20 bp, Homo sapiens
agttattaactttaatgttt

SEQ ID NO: 2459334 - DNA, 19 bp, Homo sapiens
agttattgcagtttatcat

SEQ ID NO: 2459335 - DNA, 13 bp, Homo sapiens
agttcaacatgtt

SEQ ID NO: 2459336 - DNA, 20 bp, Homo sapiens
agttcagagtccttaaaatg

SEQ ID NO: 2459337 - DNA, 21 bp, Homo sapiens
agttcagcatccgcaggtgct

SEQ ID NO: 2459338 - DNA, 18 bp, Homo sapiens
agttcatatgtaccatgt

SEQ ID NO: 2459339 - DNA, 17 bp, Homo sapiens
agttcatgtctgctatc

SEQ ID NO: 2459340 - DNA, 15 bp, Homo sapiens
agttcattagaaata

SEQ ID NO: 2459341 - DNA, 16 bp, Homo sapiens
agttcattagaaatat

SEQ ID NO: 2459342 - DNA, 19 bp, Homo sapiens
agttccaagagtctaaaga

SEQ ID NO: 2459343 - DNA, 19 bp, Homo sapiens
agttcccacattaaagaag

SEQ ID NO: 2459344 - DNA, 18 bp, Homo sapiens
agttcccagttggagctc

SEQ ID NO: 2459345 - DNA, 21 bp, Homo sapiens
agttcctctaacttggctcac

SEQ ID NO: 2459346 - DNA, 13 bp, Homo sapiens
agttctaagattc

SEQ ID NO: 2459347 - DNA, 16 bp, Homo sapiens
agttctaagattctaa

SEQ ID NO: 2459348 - DNA, 19 bp, Homo sapiens
agttctaagattctaatga

SEQ ID NO: 2459349 - DNA, 20 bp, Homo sapiens
agttctaataatttctaatg

SEQ ID NO: 2459350 - DNA, 10 bp, Homo sapiens
agttctagac

SEQ ID NO: 2459351 - DNA, 23 bp, Homo sapiens
agttctagacatggaggttctaa

SEQ ID NO: 2459352 - DNA, 14 bp, Homo sapiens
agttctaggcactg

SEQ ID NO: 2459353 - DNA, 22 bp, Homo sapiens
agttctccctgtacagtgttac

SEQ ID NO: 2459354 - DNA, 15 bp, Homo sapiens
agttctgctccagac

SEQ ID NO: 2459355 - DNA, 17 bp, Homo sapiens
agttctgctccagacag

SEQ ID NO: 2459356 - DNA, 16 bp, Homo sapiens
agttctttgggccaga

SEQ ID NO: 2459357 - DNA, 19 bp, Homo sapiens
agttctttgttcatagccc

SEQ ID NO: 2459358 - DNA, 13 bp, Homo sapiens
agttgaatttttt

SEQ ID NO: 2459359 - DNA, 18 bp, Homo sapiens
agttgaattttttttaac

SEQ ID NO: 2459360 - DNA, 21 bp, Homo sapiens
agttgatcgcctttcccaggt

SEQ ID NO: 2459361 - DNA, 17 bp, Homo sapiens
agttgatctggaaccca

SEQ ID NO: 2459362 - DNA, 19 bp, Homo sapiens
agttgatctggaacccaga

SEQ ID NO: 2459363 - DNA, 16 bp, Homo sapiens
agttgattttctggat

SEQ ID NO: 2459364 - DNA, 14 bp, Homo sapiens
agttgcagctgttt

SEQ ID NO: 2459365 - DNA, 22 bp, Homo sapiens
agttgcagctgttttgttgaca

SEQ ID NO: 2459366 - DNA, 13 bp, Homo sapiens
agttgcatgtagt

SEQ ID NO: 2459367 - DNA, 22 bp, Homo sapiens
agttgcatgtagtaacactaat

SEQ ID NO: 2459368 - DNA, 13 bp, Homo sapiens
agttgccttttat

SEQ ID NO: 2459369 - DNA, 15 bp, Homo sapiens
agttgctatttgaac

SEQ ID NO: 2459370 - DNA, 18 bp, Homo sapiens
agttgctgcttctcccag

SEQ ID NO: 2459371 - DNA, 19 bp, Homo sapiens
agttggagctccagcctga

SEQ ID NO: 2459372 - DNA, 19 bp, Homo sapiens
agttggagttttttgtacc

SEQ ID NO: 2459373 - DNA, 17 bp, Homo sapiens
agttggcttacctggcc

SEQ ID NO: 2459374 - DNA, 16 bp, Homo sapiens
atagcaaaagaagaag

SEQ ID NO: 2459375 - DNA, 17 bp, Homo sapiens
atagcaaaagaagaagt

SEQ ID NO: 2459376 - DNA, 18 bp, Homo sapiens
atagcaaaagaagaagtt

SEQ ID NO: 2459377 - DNA, 15 bp, Homo sapiens
atagcaaagaattga

SEQ ID NO: 2459378 - DNA, 16 bp, Homo sapiens
atagcagacagtgttt

SEQ ID NO: 2459379 - DNA, 13 bp, Homo sapiens
atagcatgcatct

SEQ ID NO: 2459380 - DNA, 13 bp, Homo sapiens
atagccaaaaata

SEQ ID NO: 2459381 - DNA, 14 bp, Homo sapiens
atagccaaaaatag

SEQ ID NO: 2459382 - DNA, 18 bp, Homo sapiens
atagccaaaaatagctaa

SEQ ID NO: 2459383 - DNA, 22 bp, Homo sapiens
atagccactaaccttgcctggt

SEQ ID NO: 2459384 - DNA, 23 bp, Homo sapiens
atagccactaaccttgcctggta

SEQ ID NO: 2459385 - DNA, 16 bp, Homo sapiens
atagccctgtcctggt

SEQ ID NO: 2459386 - DNA, 13 bp, Homo sapiens
atagctctggggt

SEQ ID NO: 2459387 - DNA, 12 bp, Homo sapiens
ataggccagccg

SEQ ID NO: 2459388 - DNA, 14 bp, Homo sapiens
ataggtctcatctc

SEQ ID NO: 2459389 - DNA, 13 bp, Homo sapiens
ataggtctgaaat

SEQ ID NO: 2459390 - DNA, 15 bp, Homo sapiens
ataggtctgaaattt

SEQ ID NO: 2459391 - DNA, 18 bp, Homo sapiens
atagtatttttatattta

SEQ ID NO: 2459392 - DNA, 14 bp, Homo sapiens
atagtcttttgctt

SEQ ID NO: 2459393 - DNA, 16 bp, Homo sapiens
atagtcttttgctttt

SEQ ID NO: 2459394 - DNA, 17 bp, Homo sapiens
atagtcttttgcttttg

SEQ ID NO: 2459395 - DNA, 17 bp, Homo sapiens
atagttactgtgtaatt

SEQ ID NO: 2459396 - DNA, 16 bp, Homo sapiens
atagttagctaataaa

SEQ ID NO: 2459397 - DNA, 18 bp, Homo sapiens
atagttcagaatttagtg

SEQ ID NO: 2459398 - DNA, 12 bp, Homo sapiens
atagttctagac

SEQ ID NO: 2459399 - DNA, 13 bp, Homo sapiens
atagttctagaca

SEQ ID NO: 2459400 - DNA, 12 bp, Homo sapiens
atagttctaggc

SEQ ID NO: 2459401 - DNA, 14 bp, Homo sapiens
atagtttctgaggc

SEQ ID NO: 2459402 - DNA, 19 bp, Homo sapiens
atagtttggatatgtaaaa

SEQ ID NO: 2459403 - DNA, 17 bp, Homo sapiens
atataaagtattcaaca

SEQ ID NO: 2459404 - DNA, 19 bp, Homo sapiens
atataaagttttatatatt

SEQ ID NO: 2459405 - DNA, 15 bp, Homo sapiens
atataaatgcaaata

SEQ ID NO: 2459406 - DNA, 14 bp, Homo sapiens
atataagtgtacat

SEQ ID NO: 2459407 - DNA, 15 bp, Homo sapiens
atataattgccaaaa

SEQ ID NO: 2459408 - DNA, 22 bp, Homo sapiens
atatagttagctaataaaaagc

SEQ ID NO: 2459409 - DNA, 10 bp, Homo sapiens
atatataaat

SEQ ID NO: 2459410 - DNA, 13 bp, Homo sapiens
atatataaatata

SEQ ID NO: 2459411 - DNA, 14 bp, Homo sapiens
atatataaatatat

SEQ ID NO: 2459412 - DNA, 19 bp, Homo sapiens
atatataaatatattatta

SEQ ID NO: 2459413 - DNA, 14 bp, Homo sapiens
atatatattatact

SEQ ID NO: 2459414 - DNA, 20 bp, Homo sapiens
atatatattatcttttcata

SEQ ID NO: 2459415 - DNA, 20 bp, Homo sapiens
atatatggggatggtagttt

SEQ ID NO: 2459416 - DNA, 14 bp, Homo sapiens
atatattattactt

SEQ ID NO: 2459417 - DNA, 14 bp, Homo sapiens
atatattattataa

SEQ ID NO: 2459418 - DNA, 15 bp, Homo sapiens
atatattttctgttt

SEQ ID NO: 2459419 - DNA, 21 bp, Homo sapiens
atatcacccagacataaagga

SEQ ID NO: 2459420 - DNA, 24 bp, Homo sapiens
atatcatccacacatgaatctgca

SEQ ID NO: 2459421 - DNA, 16 bp, Homo sapiens
atatcatctacctaga

SEQ ID NO: 2459422 - DNA, 17 bp, Homo sapiens
atatcgacttgtttttg

SEQ ID NO: 2459423 - DNA, 23 bp, Homo sapiens
atatctaccccagactagatgta

SEQ ID NO: 2459424 - DNA, 15 bp, Homo sapiens
atatctcctgaaaag

SEQ ID NO: 2459425 - DNA, 23 bp, Homo sapiens
atatctcctgaaaaggtttatga

SEQ ID NO: 2459426 - DNA, 13 bp, Homo sapiens
atatctggcctct

SEQ ID NO: 2459427 - DNA, 20 bp, Homo sapiens
atatcttcaagcctgggcgt

SEQ ID NO: 2459428 - DNA, 15 bp, Homo sapiens
atatgaagacataaa

SEQ ID NO: 2459429 - DNA, 15 bp, Homo sapiens
atatgatctgtctgt

SEQ ID NO: 2459430 - DNA, 17 bp, Homo sapiens
atatgatctgtctgtgg

SEQ ID NO: 2459431 - DNA, 14 bp, Homo sapiens
atatgcatatttgt

SEQ ID NO: 2459432 - DNA, 19 bp, Homo sapiens
atatgctaccaccagctgt

SEQ ID NO: 2459433 - DNA, 19 bp, Homo sapiens
atatgcttgtaactaaaat

SEQ ID NO: 2459434 - DNA, 16 bp, Homo sapiens
atatggaaatatatat

SEQ ID NO: 2459435 - DNA, 18 bp, Homo sapiens
atatggaaatatatatta

SEQ ID NO: 2459436 - DNA, 15 bp, Homo sapiens
atatggaattttgca

SEQ ID NO: 2459437 - DNA, 20 bp, Homo sapiens
atatggacacttaatactac

SEQ ID NO: 2459438 - DNA, 13 bp, Homo sapiens
atatggccacagt

SEQ ID NO: 2459439 - DNA, 19 bp, Homo sapiens
atatggggatggtagtttt

SEQ ID NO: 2459440 - DNA, 20 bp, Homo sapiens
atatggggatggtagttttt

SEQ ID NO: 2459441 - DNA, 16 bp, Homo sapiens
atatgtaaaacattta

SEQ ID NO: 2459442 - DNA, 11 bp, Homo sapiens
atatgtacatt

SEQ ID NO: 2459443 - DNA, 15 bp, Homo sapiens
atatgtacatttctc

SEQ ID NO: 2459444 - DNA, 19 bp, Homo sapiens
atatgtacatttctcaggc

SEQ ID NO: 2459445 - DNA, 11 bp, Homo sapiens
atatgtaccaa

SEQ ID NO: 2459446 - DNA, 19 bp, Homo sapiens
atatgtaccatgtacatga

SEQ ID NO: 2459447 - DNA, 19 bp, Homo sapiens
atatgtaccctctgaaata

SEQ ID NO: 2459448 - DNA, 20 bp, Homo sapiens
atatgtaccctctgaaatac

SEQ ID NO: 2459449 - DNA, 14 bp, Homo sapiens
atatgtatggtttt

SEQ ID NO: 2459450 - DNA, 14 bp, Homo sapiens
atatgtcagtgctg

SEQ ID NO: 2459451 - DNA, 14 bp, Homo sapiens
atatgttgaatact

SEQ ID NO: 2459452 - DNA, 17 bp, Homo sapiens
atatgttgaatactttt

SEQ ID NO: 2459453 - DNA, 18 bp, Homo sapiens
atatgttgaatacttttt

SEQ ID NO: 2459454 - DNA, 18 bp, Homo sapiens
atattaaattttttgttg

SEQ ID NO: 2459455 - DNA, 17 bp, Homo sapiens
atattacggtttgcccc

SEQ ID NO: 2459456 - DNA, 19 bp, Homo sapiens
atattatatggaaatatat

SEQ ID NO: 2459457 - DNA, 14 bp, Homo sapiens
atattatgagatgc

SEQ ID NO: 2459458 - DNA, 16 bp, Homo sapiens
atattatgagatgctg

SEQ ID NO: 2459459 - DNA, 17 bp, Homo sapiens
atattattacttgtaaa

SEQ ID NO: 2459460 - DNA, 19 bp, Homo sapiens
atattattagttttgattt

SEQ ID NO: 2459461 - DNA, 18 bp, Homo sapiens
atattattataatcttat

SEQ ID NO: 2459462 - DNA, 19 bp, Homo sapiens
atattattataatcttata

SEQ ID NO: 2459463 - DNA, 23 bp, Homo sapiens
atattctaagacttactctaaga

SEQ ID NO: 2459464 - DNA, 16 bp, Homo sapiens
atattgacttgtatat

SEQ ID NO: 2459465 - DNA, 19 bp, Homo sapiens
atattgataagatctttta

SEQ ID NO: 2459466 - DNA, 17 bp, Homo sapiens
atattgccattatgctt

SEQ ID NO: 2459467 - DNA, 16 bp, Homo sapiens
atattgtaaaacaggt

SEQ ID NO: 2459468 - DNA, 17 bp, Homo sapiens
atattgtaaaacaggta

SEQ ID NO: 2459469 - DNA, 16 bp, Homo sapiens
atattgttgcattgct

SEQ ID NO: 2459470 - DNA, 13 bp, Homo sapiens
atatttaaaaata

SEQ ID NO: 2459471 - DNA, 16 bp, Homo sapiens
atatttaaaaataagt

SEQ ID NO: 2459472 - DNA, 16 bp, Homo sapiens
atatttacctcagcct

SEQ ID NO: 2459473 - DNA, 22 bp, Homo sapiens
atatttagatgtaattttgtgt

SEQ ID NO: 2459474 - DNA, 21 bp, Homo sapiens
atatttgtcatgctgggattt

SEQ ID NO: 2459475 - DNA, 16 bp, Homo sapiens
atatttgtttatggta

SEQ ID NO: 2459476 - DNA, 17 bp, Homo sapiens
atattttaaaatttgtt

SEQ ID NO: 2459477 - DNA, 16 bp, Homo sapiens
atattttaaagaattg

SEQ ID NO: 2459478 - DNA, 14 bp, Homo sapiens
atattttagcattt

SEQ ID NO: 2459479 - DNA, 21 bp, Homo sapiens
atattttcaccatttgattat

SEQ ID NO: 2459480 - DNA, 13 bp, Homo sapiens
atattttcctata

SEQ ID NO: 2459481 - DNA, 19 bp, Homo sapiens
atattttcctatattacgg

SEQ ID NO: 2459482 - DNA, 13 bp, Homo sapiens
atattttctgttt

SEQ ID NO: 2459483 - DNA, 12 bp, Homo sapiens
atattttgaatc

SEQ ID NO: 2459484 - DNA, 13 bp, Homo sapiens
atattttgaatca

SEQ ID NO: 2459485 - DNA, 13 bp, Homo sapiens
atatttttagata

SEQ ID NO: 2459486 - DNA, 19 bp, Homo sapiens
atcaaaaaaggcagttacc

SEQ ID NO: 2459487 - DNA, 15 bp, Homo sapiens
atcaaaatctctcca

SEQ ID NO: 2459488 - DNA, 17 bp, Homo sapiens
atcaaaatctctccact

SEQ ID NO: 2459489 - DNA, 23 bp, Homo sapiens
atcaaaatctctccactttcagc

SEQ ID NO: 2459490 - DNA, 17 bp, Homo sapiens
atcaaaccctagccttg

SEQ ID NO: 2459491 - DNA, 12 bp, Homo sapiens
atcaaagatgaa

SEQ ID NO: 2459492 - DNA, 13 bp, Homo sapiens
atcaaatacattt

SEQ ID NO: 2459493 - DNA, 16 bp, Homo sapiens
atcaacaaaaattgtc

SEQ ID NO: 2459494 - DNA, 21 bp, Homo sapiens
atcaacttaccaggcaccaaa

SEQ ID NO: 2459495 - DNA, 16 bp, Homo sapiens
atcaagggtcaggcct

SEQ ID NO: 2459496 - DNA, 17 bp, Homo sapiens
atcaagggtcaggcctt

SEQ ID NO: 2459497 - DNA, 14 bp, Homo sapiens
atcaagtaatacaa

SEQ ID NO: 2459498 - DNA, 23 bp, Homo sapiens
atcaagtctgtttactgcaaggt

SEQ ID NO: 2459499 - DNA, 21 bp, Homo sapiens
atcaataatatattttctgtt

SEQ ID NO: 2459500 - DNA, 19 bp, Homo sapiens
atcaatgtttcttctaggt

SEQ ID NO: 2459501 - DNA, 14 bp, Homo sapiens
atcacaaagtggaa

SEQ ID NO: 2459502 - DNA, 13 bp, Homo sapiens
atcacacaaagca

SEQ ID NO: 2459503 - DNA, 13 bp, Homo sapiens
atcacagcccagc

SEQ ID NO: 2459504 - DNA, 20 bp, Homo sapiens
atcacatgaattattacagt

SEQ ID NO: 2459505 - DNA, 22 bp, Homo sapiens
atcacatgaattattacagtgt

SEQ ID NO: 2459506 - DNA, 16 bp, Homo sapiens
atcacccaacgctcca

SEQ ID NO: 2459507 - DNA, 21 bp, Homo sapiens
atcacctagctgaatgttttt

SEQ ID NO: 2459508 - DNA, 23 bp, Homo sapiens
atcacctagctgaatgtttttct

SEQ ID NO: 2459509 - DNA, 16 bp, Homo sapiens
atcactgagttttcca

SEQ ID NO: 2459510 - DNA, 14 bp, Homo sapiens
atcacttaaacttg

SEQ ID NO: 2459511 - DNA, 14 bp, Homo sapiens
atcagaaagaggca

SEQ ID NO: 2459512 - DNA, 20 bp, Homo sapiens
atcagaaaggaaaaacaaac

SEQ ID NO: 2459513 - DNA, 17 bp, Homo sapiens
atcagaaagggagggct

SEQ ID NO: 2459514 - DNA, 20 bp, Homo sapiens
atcagaaagggagggctctg

SEQ ID NO: 2459515 - DNA, 21 bp, Homo sapiens
atcagaaagggagggctctga

SEQ ID NO: 2459516 - DNA, 22 bp, Homo sapiens
atcagaactcaaatggggccag

SEQ ID NO: 2459517 - DNA, 23 bp, Homo sapiens
atcagaactcaaatggggccaga

SEQ ID NO: 2459518 - DNA, 19 bp, Homo sapiens
atcagaatatcacagaaaa

SEQ ID NO: 2459519 - DNA, 20 bp, Homo sapiens
atcagaccataatgttacat

SEQ ID NO: 2459520 - DNA, 21 bp, Homo sapiens
atcagatgctccaagattcta

SEQ ID NO: 2459521 - DNA, 23 bp, Homo sapiens
atcagatgctccaagattctaga

SEQ ID NO: 2459522 - DNA, 15 bp, Homo sapiens
atcagccacattcta

SEQ ID NO: 2459523 - DNA, 13 bp, Homo sapiens
atcagcgtggcct

SEQ ID NO: 2459524 - DNA, 21 bp, Homo sapiens
atcagcgtggccttgttctgt

SEQ ID NO: 2459525 - DNA, 17 bp, Homo sapiens
atcagctattttgtgaa

SEQ ID NO: 2459526 - DNA, 18 bp, Homo sapiens
atcaggacccagaggaag

SEQ ID NO: 2459527 - DNA, 18 bp, Homo sapiens
atcagtaaataactggaa

SEQ ID NO: 2459528 - DNA, 23 bp, Homo sapiens
atcagtagttcacatacaaatca

SEQ ID NO: 2459529 - DNA, 13 bp, Homo sapiens
atcagtcaatatt

SEQ ID NO: 2459530 - DNA, 15 bp, Homo sapiens
atcagtgctccctca

SEQ ID NO: 2459531 - DNA, 16 bp, Homo sapiens
atcagtttaaaagcac

SEQ ID NO: 2459532 - DNA, 20 bp, Homo sapiens
atcatataataaatgtacat

SEQ ID NO: 2459533 - DNA, 18 bp, Homo sapiens
atcatcaagtaatacaaa

SEQ ID NO: 2459534 - DNA, 21 bp, Homo sapiens
atcatcaagtaatacaaacta

SEQ ID NO: 2459535 - DNA, 15 bp, Homo sapiens
atcatcagtgtagaa

SEQ ID NO: 2459536 - DNA, 16 bp, Homo sapiens
atcatcagtgtagaac

SEQ ID NO: 2459537 - DNA, 14 bp, Homo sapiens
atcatcatggccag

SEQ ID NO: 2459538 - DNA, 18 bp, Homo sapiens
atcatcatgtgtgtccac

SEQ ID NO: 2459539 - DNA, 15 bp, Homo sapiens
atcatcctctggctt

SEQ ID NO: 2459540 - DNA, 21 bp, Homo sapiens
atcatcctttaggtaagaagt

SEQ ID NO: 2459541 - DNA, 21 bp, Homo sapiens
atcatctacctagatttaata

SEQ ID NO: 2459542 - DNA, 18 bp, Homo sapiens
atcatcttggaactgcat

SEQ ID NO: 2459543 - DNA, 23 bp, Homo sapiens
atcatgagtgaataaatgtcttg

SEQ ID NO: 2459544 - DNA, 19 bp, Homo sapiens
atcatgcctctgaggccag

SEQ ID NO: 2459545 - DNA, 17 bp, Homo sapiens
atcatggccagctggag

SEQ ID NO: 2459546 - DNA, 13 bp, Homo sapiens
atcattactataa

SEQ ID NO: 2459547 - DNA, 14 bp, Homo sapiens
atcattatttatgt

SEQ ID NO: 2459548 - DNA, 15 bp, Homo sapiens
atcattatttatgta

SEQ ID NO: 2459549 - DNA, 19 bp, Homo sapiens
atcattgcttcctcctccc

SEQ ID NO: 2459550 - DNA, 14 bp, Homo sapiens
atcatttgtttaaa

SEQ ID NO: 2459551 - DNA, 15 bp, Homo sapiens
atcatttgtttaaaa

SEQ ID NO: 2459552 - DNA, 14 bp, Homo sapiens
atcattttaattat

SEQ ID NO: 2459553 - DNA, 14 bp, Homo sapiens
atcattttttactt

SEQ ID NO: 2459554 - DNA, 18 bp, Homo sapiens
atccaaaagaagccccca

SEQ ID NO: 2459555 - DNA, 22 bp, Homo sapiens
atccaaaagaagcccccagcta

SEQ ID NO: 2459556 - DNA, 19 bp, Homo sapiens
atccaaaatcttgatcagt

SEQ ID NO: 2459557 - DNA, 15 bp, Homo sapiens
atccaagttaaatgt

SEQ ID NO: 2459558 - DNA, 21 bp, Homo sapiens
atccaagttaaatgtagagtt

SEQ ID NO: 2459559 - DNA, 20 bp, Homo sapiens
atccaatgggtttttccctg

SEQ ID NO: 2459560 - DNA, 16 bp, Homo sapiens
atccacatttctaaaa

SEQ ID NO: 2459561 - DNA, 18 bp, Homo sapiens
atccacctgtctcagcct

SEQ ID NO: 2459562 - DNA, 17 bp, Homo sapiens
atccagcctggggtctg

SEQ ID NO: 2459563 - DNA, 14 bp, Homo sapiens
atccagctcactca

SEQ ID NO: 2459564 - DNA, 22 bp, Homo sapiens
atccaggactatatttgggcct

SEQ ID NO: 2459565 - DNA, 14 bp, Homo sapiens
atccaggagctcca

SEQ ID NO: 2459566 - DNA, 16 bp, Homo sapiens
atccaggcagatccag

SEQ ID NO: 2459567 - DNA, 22 bp, Homo sapiens
atccaggcagatccaggactat

SEQ ID NO: 2459568 - DNA, 20 bp, Homo sapiens
atccagggacagaggcccca

SEQ ID NO: 2459569 - DNA, 21 bp, Homo sapiens
atccagggacagaggccccag

SEQ ID NO: 2459570 - DNA, 11 bp, Homo sapiens
atccataaaga

SEQ ID NO: 2459571 - DNA, 18 bp, Homo sapiens
atccatattgagtcaaat

SEQ ID NO: 2459572 - DNA, 12 bp, Homo sapiens
atccatggccag

SEQ ID NO: 2459573 - DNA, 13 bp, Homo sapiens
atccatggccagc

SEQ ID NO: 2459574 - DNA, 16 bp, Homo sapiens
atccatggccagcagc

SEQ ID NO: 2459575 - DNA, 21 bp, Homo sapiens
atccatggccagcagcacctg

SEQ ID NO: 2459576 - DNA, 13 bp, Homo sapiens
atccatgtaactg

SEQ ID NO: 2459577 - DNA, 16 bp, Homo sapiens
atccatgtaactgcct

SEQ ID NO: 2459578 - DNA, 20 bp, Homo sapiens
atcccaaaggacagccgcct

SEQ ID NO: 2459579 - DNA, 20 bp, Homo sapiens
atcccaagtagaatctcagt

SEQ ID NO: 2459580 - DNA, 16 bp, Homo sapiens
atcccagccccctgac

SEQ ID NO: 2459581 - DNA, 21 bp, Homo sapiens
atcccatcgtctcggccttca

SEQ ID NO: 2459582 - DNA, 17 bp, Homo sapiens
atccccaaggcacttga

SEQ ID NO: 2459583 - DNA, 23 bp, Homo sapiens
atccccttctcccctgcactgta

SEQ ID NO: 2459584 - DNA, 16 bp, Homo sapiens
atccccttgaactctt

SEQ ID NO: 2459585 - DNA, 22 bp, Homo sapiens
atccccttgaggtctcagcccc

SEQ ID NO: 2459586 - DNA, 15 bp, Homo sapiens
atccctacatgtatt

SEQ ID NO: 2459587 - DNA, 16 bp, Homo sapiens
atccctcaccttctga

SEQ ID NO: 2459588 - DNA, 18 bp, Homo sapiens
atccctcccccccatgca

SEQ ID NO: 2459589 - DNA, 22 bp, Homo sapiens
atccctcccccccatgcactgt

SEQ ID NO: 2459590 - DNA, 20 bp, Homo sapiens
atccctctacagagcttccc

SEQ ID NO: 2459591 - DNA, 21 bp, Homo sapiens
atccctctacagagcttccct

SEQ ID NO: 2459592 - DNA, 23 bp, Homo sapiens
atccctctacagagcttccctga

SEQ ID NO: 2459593 - DNA, 16 bp, Homo sapiens
atccctgggcctgctg

SEQ ID NO: 2459594 - DNA, 15 bp, Homo sapiens
atccctttttcaatg

SEQ ID NO: 2459595 - DNA, 17 bp, Homo sapiens
atccgactgctttggac

SEQ ID NO: 2459596 - DNA, 21 bp, Homo sapiens
atcctaagggtcgaaagctct

SEQ ID NO: 2459597 - DNA, 16 bp, Homo sapiens
atcctagatcctaagg

SEQ ID NO: 2459598 - DNA, 14 bp, Homo sapiens
atcctaggctgaca

SEQ ID NO: 2459599 - DNA, 13 bp, Homo sapiens
atcctatgcatgg

SEQ ID NO: 2459600 - DNA, 23 bp, Homo sapiens
atcctatgcatggtttcagcact

SEQ ID NO: 2459601 - DNA, 20 bp, Homo sapiens
atcctcaaagaaagtgtatt

SEQ ID NO: 2459602 - DNA, 18 bp, Homo sapiens
atcctcaaatgcggggtg

SEQ ID NO: 2459603 - DNA, 16 bp, Homo sapiens
atcctcacagtgaaca

SEQ ID NO: 2459604 - DNA, 13 bp, Homo sapiens
atcctcccagaaa

SEQ ID NO: 2459605 - DNA, 15 bp, Homo sapiens
atcctccctgtaact

SEQ ID NO: 2459606 - DNA, 11 bp, Homo sapiens
atcctcctcat

SEQ ID NO: 2459607 - DNA, 17 bp, Homo sapiens
atcctctcttcctcttc

SEQ ID NO: 2459608 - DNA, 18 bp, Homo sapiens
atcctctgagtgtgacca

SEQ ID NO: 2459609 - DNA, 14 bp, Homo sapiens
atcctggaggccca

SEQ ID NO: 2459610 - DNA, 15 bp, Homo sapiens
atcctggaggcccag

SEQ ID NO: 2459611 - DNA, 19 bp, Homo sapiens
atcctggaggcccagttca

SEQ ID NO: 2459612 - DNA, 16 bp, Homo sapiens
atcctgtattcagaca

SEQ ID NO: 2459613 - DNA, 20 bp, Homo sapiens
atcctgtattcagacagatg

SEQ ID NO: 2459614 - DNA, 21 bp, Homo sapiens
atcctgtattcagacagatga

SEQ ID NO: 2459615 - DNA, 22 bp, Homo sapiens
atcctgtgtggagagggaatgt

SEQ ID NO: 2459616 - DNA, 12 bp, Homo sapiens
atcctgtgtgtt

SEQ ID NO: 2459617 - DNA, 13 bp, Homo sapiens
atcctgtgtgtta

SEQ ID NO: 2459618 - DNA, 21 bp, Homo sapiens
atcctgtgtgttaagctctgc

SEQ ID NO: 2459619 - DNA, 14 bp, Homo sapiens
atccttgtcttatt

SEQ ID NO: 2459620 - DNA, 17 bp, Homo sapiens
atcctttcatatagtta

SEQ ID NO: 2459621 - DNA, 14 bp, Homo sapiens
atcgaatgaaatta

SEQ ID NO: 2459622 - DNA, 18 bp, Homo sapiens
atcgcaccattctgactc

SEQ ID NO: 2459623 - DNA, 20 bp, Homo sapiens
atcgcagaccttttttagga

SEQ ID NO: 2459624 - DNA, 12 bp, Homo sapiens
atcgccttcccc

SEQ ID NO: 2459625 - DNA, 15 bp, Homo sapiens
atcggcatttgtttc

SEQ ID NO: 2459626 - DNA, 24 bp, Homo sapiens
atcggcgacggagcactgcacctg

SEQ ID NO: 2459627 - DNA, 17 bp, Homo sapiens
atcgtcatgcacagtat

SEQ ID NO: 2459628 - DNA, 17 bp, Homo sapiens
atctaaataaaatgcta

SEQ ID NO: 2459629 - DNA, 14 bp, Homo sapiens
atctaacctcatct

SEQ ID NO: 2459630 - DNA, 14 bp, Homo sapiens
atctaatttataaa

SEQ ID NO: 2459631 - DNA, 15 bp, Homo sapiens
atctaatttataaaa

SEQ ID NO: 2459632 - DNA, 19 bp, Homo sapiens
atctaatttataaaaaggt

SEQ ID NO: 2459633 - DNA, 23 bp, Homo sapiens
atctaatttataaaaaggtgttt

SEQ ID NO: 2459634 - DNA, 21 bp, Homo sapiens
atctaccccagactagatgta

SEQ ID NO: 2459635 - DNA, 21 bp, Homo sapiens
atctacctagatttaatataa

SEQ ID NO: 2459636 - DNA, 15 bp, Homo sapiens
atctactaattccac

SEQ ID NO: 2459637 - DNA, 23 bp, Homo sapiens
atctacttctgtaattgtgtgga

SEQ ID NO: 2459638 - DNA, 11 bp, Homo sapiens
atctaggattt

SEQ ID NO: 2459639 - DNA, 15 bp, Homo sapiens
atctataaactataa

SEQ ID NO: 2459640 - DNA, 23 bp, Homo sapiens
atctataaggtgctctctttctg

SEQ ID NO: 2459641 - DNA, 23 bp, Homo sapiens
atctataatttacctaagattac

SEQ ID NO: 2459642 - DNA, 17 bp, Homo sapiens
atctatggtcgggagac

SEQ ID NO: 2459643 - DNA, 22 bp, Homo sapiens
atctattttggattgtatattg

SEQ ID NO: 2459644 - DNA, 19 bp, Homo sapiens
atctcaacaggcctcaggg

SEQ ID NO: 2459645 - DNA, 15 bp, Homo sapiens
atcttagtgtatgat

SEQ ID NO: 2459646 - DNA, 19 bp, Homo sapiens
atcttagtgtatgattact

SEQ ID NO: 2459647 - DNA, 15 bp, Homo sapiens
atcttatagttctag

SEQ ID NO: 2459648 - DNA, 23 bp, Homo sapiens
atcttctcaagttctaagattct

SEQ ID NO: 2459649 - DNA, 21 bp, Homo sapiens
atcttctgccttagtctcagt

SEQ ID NO: 2459650 - DNA, 14 bp, Homo sapiens
atcttcttcaccat

SEQ ID NO: 2459651 - DNA, 21 bp, Homo sapiens
atcttgaaattaagaaggcaa

SEQ ID NO: 2459652 - DNA, 14 bp, Homo sapiens
atcttgctaccagt

SEQ ID NO: 2459653 - DNA, 19 bp, Homo sapiens
atcttgctaccagtattta

SEQ ID NO: 2459654 - DNA, 23 bp, Homo sapiens
atcttgcttccctaatctatggt

SEQ ID NO: 2459655 - DNA, 23 bp, Homo sapiens
atcttgctttctttgtttggctg

SEQ ID NO: 2459656 - DNA, 20 bp, Homo sapiens
atcttggttgatgccaaaaa

SEQ ID NO: 2459657 - DNA, 12 bp, Homo sapiens
atcttgtcatgt

SEQ ID NO: 2459658 - DNA, 16 bp, Homo sapiens
atcttgtcatgtgtat

SEQ ID NO: 2459659 - DNA, 20 bp, Homo sapiens
atctttaaaagatgctttta

SEQ ID NO: 2459660 - DNA, 16 bp, Homo sapiens
atctttgaaattatgt

SEQ ID NO: 2459661 - DNA, 19 bp, Homo sapiens
atctttgaaattatgtaaa

SEQ ID NO: 2459662 - DNA, 22 bp, Homo sapiens
atcttttacaactgcctcgaaa

SEQ ID NO: 2459663 - DNA, 22 bp, Homo sapiens
atcttttcaaaggtacttggat

SEQ ID NO: 2459664 - DNA, 23 bp, Homo sapiens
atcttttgatatgcatatttgtt

SEQ ID NO: 2459665 - DNA, 13 bp, Homo sapiens
atcttttgtatta

SEQ ID NO: 2459666 - DNA, 16 bp, Homo sapiens
atcttttgtattaaga

SEQ ID NO: 2459667 - DNA, 15 bp, Homo sapiens
atgaaaaagaagaat

SEQ ID NO: 2459668 - DNA, 18 bp, Homo sapiens
atgaaaaattgctgactg

SEQ ID NO: 2459669 - DNA, 15 bp, Homo sapiens
atgaaaacagaatgt

SEQ ID NO: 2459670 - DNA, 13 bp, Homo sapiens
atgaaaagctaga

SEQ ID NO: 2459671 - DNA, 16 bp, Homo sapiens
atgaaaagtatattga

SEQ ID NO: 2459672 - DNA, 14 bp, Homo sapiens
atgaaaatgtccat

SEQ ID NO: 2459673 - DNA, 13 bp, Homo sapiens
atgaaaatgtctt

SEQ ID NO: 2459674 - DNA, 16 bp, Homo sapiens
atgaaaatgtcttgtg

SEQ ID NO: 2459675 - DNA, 21 bp, Homo sapiens
atgaaataaaactgtttttga

SEQ ID NO: 2459676 - DNA, 16 bp, Homo sapiens
atgaacacttaataaa

SEQ ID NO: 2459677 - DNA, 12 bp, Homo sapiens
atgaacttagat

SEQ ID NO: 2459678 - DNA, 20 bp, Homo sapiens
atgaacttagattttacatg

SEQ ID NO: 2459679 - DNA, 14 bp, Homo sapiens
atgaagaaagtgga

SEQ ID NO: 2459680 - DNA, 21 bp, Homo sapiens
atgaaggagaggcaacatcca

SEQ ID NO: 2459681 - DNA, 15 bp, Homo sapiens
atgaagggcccgaga

SEQ ID NO: 2459682 - DNA, 18 bp, Homo sapiens
atgaatctgcacatctgt

SEQ ID NO: 2459683 - DNA, 13 bp, Homo sapiens
atgaatgtaaatt

SEQ ID NO: 2459684 - DNA, 15 bp, Homo sapiens
atgaatgtaaatttg

SEQ ID NO: 2459685 - DNA, 17 bp, Homo sapiens
atgaatgtgaagccttc

SEQ ID NO: 2459686 - DNA, 11 bp, Homo sapiens
atgaatgttta

SEQ ID NO: 2459687 - DNA, 12 bp, Homo sapiens
atgaatttagtg

SEQ ID NO: 2459688 - DNA, 14 bp, Homo sapiens
atgaatttgtaatg

SEQ ID NO: 2459689 - DNA, 19 bp, Homo sapiens
atgaatttgtaatgtcttg

SEQ ID NO: 2459690 - DNA, 18 bp, Homo sapiens
atgaattttagcttttgt

SEQ ID NO: 2459691 - DNA, 19 bp, Homo sapiens
atgacaacttctaattgcc

SEQ ID NO: 2459692 - DNA, 19 bp, Homo sapiens
atgacaattttttccactt

SEQ ID NO: 2459693 - DNA, 15 bp, Homo sapiens
atgacacttgtacaa

SEQ ID NO: 2459694 - DNA, 17 bp, Homo sapiens
atgacacttgtacaatt

SEQ ID NO: 2459695 - DNA, 15 bp, Homo sapiens
atgacaggcctgtcc

SEQ ID NO: 2459696 - DNA, 15 bp, Homo sapiens
atgacatgaatttta

SEQ ID NO: 2459697 - DNA, 21 bp, Homo sapiens
atgacatgaattttagctttt

SEQ ID NO: 2459698 - DNA, 22 bp, Homo sapiens
atgacatttatatcacatgttt

SEQ ID NO: 2459699 - DNA, 19 bp, Homo sapiens
atgaccactttttagaaag

SEQ ID NO: 2459700 - DNA, 20 bp, Homo sapiens
atgaccctgcctctcccagg

SEQ ID NO: 2459701 - DNA, 17 bp, Homo sapiens
atgacctcgtactcagg

SEQ ID NO: 2459702 - DNA, 15 bp, Homo sapiens
atgactgccaagact

SEQ ID NO: 2459703 - DNA, 13 bp, Homo sapiens
atgactgcttgcc

SEQ ID NO: 2459704 - DNA, 15 bp, Homo sapiens
atgcacagtatttgt

SEQ ID NO: 2459705 - DNA, 17 bp, Homo sapiens
atgcacatgaacttaga

SEQ ID NO: 2459706 - DNA, 14 bp, Homo sapiens
atgcaccaccaagc

SEQ ID NO: 2459707 - DNA, 18 bp, Homo sapiens
atgcaccaccaagccaag

SEQ ID NO: 2459708 - DNA, 18 bp, Homo sapiens
atgcacctaaagaaaaac

SEQ ID NO: 2459709 - DNA, 16 bp, Homo sapiens
atgcactgatgttgtg

SEQ ID NO: 2459710 - DNA, 13 bp, Homo sapiens
atgcactgtgaag

SEQ ID NO: 2459711 - DNA, 13 bp, Homo sapiens
atgcactttgctt

SEQ ID NO: 2459712 - DNA, 21 bp, Homo sapiens
atgcactttgctttaatataa

SEQ ID NO: 2459713 - DNA, 16 bp, Homo sapiens
atgcagaggcctgcag

SEQ ID NO: 2459714 - DNA, 17 bp, Homo sapiens
atgcagaggcctgcagg

SEQ ID NO: 2459715 - DNA, 15 bp, Homo sapiens
atgcagcttatacga

SEQ ID NO: 2459716 - DNA, 16 bp, Homo sapiens
atgcagcttatacgaa

SEQ ID NO: 2459717 - DNA, 21 bp, Homo sapiens
atgcagcttatacgaaataat

SEQ ID NO: 2459718 - DNA, 15 bp, Homo sapiens
atgcagggcagtcat

SEQ ID NO: 2459719 - DNA, 15 bp, Homo sapiens
atgcagttgtctctg

SEQ ID NO: 2459720 - DNA, 18 bp, Homo sapiens
atgcagttgtctctgttt

SEQ ID NO: 2459721 - DNA, 14 bp, Homo sapiens
atgcatacaagttt

SEQ ID NO: 2459722 - DNA, 20 bp, Homo sapiens
atgcatcagaaagggagggc

SEQ ID NO: 2459723 - DNA, 20 bp, Homo sapiens
atgcatggtttcagcactag

SEQ ID NO: 2459724 - DNA, 19 bp, Homo sapiens
atgcattcttctctgttgt

SEQ ID NO: 2459725 - DNA, 15 bp, Homo sapiens
atgcatttgggtcca

SEQ ID NO: 2459726 - DNA, 22 bp, Homo sapiens
atgcatttgggtccaggaggaa

SEQ ID NO: 2459727 - DNA, 18 bp, Homo sapiens
atgccaaaaaaaaataca

SEQ ID NO: 2459728 - DNA, 17 bp, Homo sapiens
atgccaatattaaatct

SEQ ID NO: 2459729 - DNA, 16 bp, Homo sapiens
atgccacaaggacttc

SEQ ID NO: 2459730 - DNA, 19 bp, Homo sapiens
atgccacaaggacttcctg

SEQ ID NO: 2459731 - DNA, 12 bp, Homo sapiens
atgccacattca

SEQ ID NO: 2459732 - DNA, 15 bp, Homo sapiens
atgccactgccttcg

SEQ ID NO: 2459733 - DNA, 17 bp, Homo sapiens
atgccactgccttcgct

SEQ ID NO: 2459734 - DNA, 18 bp, Homo sapiens
atgccactgccttcgctt

SEQ ID NO: 2459735 - DNA, 18 bp, Homo sapiens
atgccagccaagctctgc

SEQ ID NO: 2459736 - DNA, 22 bp, Homo sapiens
atgccagccaagctctgcagtc

SEQ ID NO: 2459737 - DNA, 16 bp, Homo sapiens
atgccaggaccagtcc

SEQ ID NO: 2459738 - DNA, 16 bp, Homo sapiens
atgccatcatctcctg

SEQ ID NO: 2459739 - DNA, 14 bp, Homo sapiens
atgccatgatgcct

SEQ ID NO: 2459740 - DNA, 18 bp, Homo sapiens
atgcccagagacccagcg

SEQ ID NO: 2459741 - DNA, 16 bp, Homo sapiens
atgcccctggctggga

SEQ ID NO: 2459742 - DNA, 14 bp, Homo sapiens
atgcccctttctgg

SEQ ID NO: 2459743 - DNA, 23 bp, Homo sapiens
atgccctgtgcaacctcttggcc

SEQ ID NO: 2459744 - DNA, 19 bp, Homo sapiens
atgccgatatactctagat

SEQ ID NO: 2459745 - DNA, 16 bp, Homo sapiens
atgcctatggtggatc

SEQ ID NO: 2459746 - DNA, 23 bp, Homo sapiens
atgcctcagccacttgcctgtgc

SEQ ID NO: 2459747 - DNA, 14 bp, Homo sapiens
atgcctccttcctc

SEQ ID NO: 2459748 - DNA, 18 bp, Homo sapiens
atgcctctgaggccagcc

SEQ ID NO: 2459749 - DNA, 20 bp, Homo sapiens
atgcctctgaggccagcctg

SEQ ID NO: 2459750 - DNA, 23 bp, Homo sapiens
atgcctctgaggccagcctggcc

SEQ ID NO: 2459751 - DNA, 22 bp, Homo sapiens
atgcctctgccaaaggatgtga

SEQ ID NO: 2459752 - DNA, 21 bp, Homo sapiens
atgccttttcccaaaatgttg

SEQ ID NO: 2459753 - DNA, 13 bp, Homo sapiens
atgcgccccctcc

SEQ ID NO: 2459754 - DNA, 21 bp, Homo sapiens
atgcgtattataccaaaatgt

SEQ ID NO: 2459755 - DNA, 14 bp, Homo sapiens
atgctaacatctaa

SEQ ID NO: 2459756 - DNA, 16 bp, Homo sapiens
atgctaacatctaaaa

SEQ ID NO: 2459757 - DNA, 18 bp, Homo sapiens
atgctaagagaagtagaa

SEQ ID NO: 2459758 - DNA, 13 bp, Homo sapiens
atgctaccaccag

SEQ ID NO: 2459759 - DNA, 15 bp, Homo sapiens
atgctaccaccagct

SEQ ID NO: 2459760 - DNA, 16 bp, Homo sapiens
atgctcatctgctggt

SEQ ID NO: 2459761 - DNA, 18 bp, Homo sapiens
atgctccaagattctaga

SEQ ID NO: 2459762 - DNA, 14 bp, Homo sapiens
atgctcctcttccc

SEQ ID NO: 2459763 - DNA, 17 bp, Homo sapiens
atggatgtccccagcag

SEQ ID NO: 2459764 - DNA, 18 bp, Homo sapiens
atggattctaaaatgcct

SEQ ID NO: 2459765 - DNA, 17 bp, Homo sapiens
atggatttctttgaaaa

SEQ ID NO: 2459766 - DNA, 15 bp, Homo sapiens
atggattttgggagt

SEQ ID NO: 2459767 - DNA, 19 bp, Homo sapiens
atggatttttctttaactg

SEQ ID NO: 2459768 - DNA, 20 bp, Homo sapiens
atggatttttctttaactgc

SEQ ID NO: 2459769 - DNA, 15 bp, Homo sapiens
atggcaacagatctg

SEQ ID NO: 2459770 - DNA, 16 bp, Homo sapiens
atggcaacagatctgg

SEQ ID NO: 2459771 - DNA, 24 bp, Homo sapiens
atggcaacagatctggaacctcag

SEQ ID NO: 2459772 - DNA, 13 bp, Homo sapiens
atggcagcagggg

SEQ ID NO: 2459773 - DNA, 15 bp, Homo sapiens
atggcagggggctgc

SEQ ID NO: 2459774 - DNA, 16 bp, Homo sapiens
atggcagggggctgct

SEQ ID NO: 2459775 - DNA, 17 bp, Homo sapiens
atggcagggggtggaat

SEQ ID NO: 2459776 - DNA, 16 bp, Homo sapiens
atggcataacctgtct

SEQ ID NO: 2459777 - DNA, 19 bp, Homo sapiens
atggcatgagaaatacaaa

SEQ ID NO: 2459778 - DNA, 22 bp, Homo sapiens
atggccacagtagtcttgatga

SEQ ID NO: 2459779 - DNA, 21 bp, Homo sapiens
atggccagccccttagacaga

SEQ ID NO: 2459780 - DNA, 20 bp, Homo sapiens
atggccagctggaggcaggg

SEQ ID NO: 2459781 - DNA, 11 bp, Homo sapiens
atggcccctct

SEQ ID NO: 2459782 - DNA, 19 bp, Homo sapiens
atggcctcatgtggctgga

SEQ ID NO: 2459783 - DNA, 23 bp, Homo sapiens
atggcgtaagtacagagaagcca

SEQ ID NO: 2459784 - DNA, 13 bp, Homo sapiens
atggctattttat

SEQ ID NO: 2459785 - DNA, 19 bp, Homo sapiens
atggctgcacctttttgca

SEQ ID NO: 2459786 - DNA, 12 bp, Homo sapiens
atgggaccacaa

SEQ ID NO: 2459787 - DNA, 23 bp, Homo sapiens
atggggcaggccacctggctctc

SEQ ID NO: 2459788 - DNA, 21 bp, Homo sapiens
atggggcatcctctttttcca

SEQ ID NO: 2459789 - DNA, 13 bp, Homo sapiens
atggggccagatc

SEQ ID NO: 2459790 - DNA, 15 bp, Homo sapiens
atggggccagatcca

SEQ ID NO: 2459791 - DNA, 22 bp, Homo sapiens
atggggccagatccagcctggg

SEQ ID NO: 2459792 - DNA, 19 bp, Homo sapiens
atgggggaactcagatcca

SEQ ID NO: 2459793 - DNA, 14 bp, Homo sapiens
atgggggtaaagtt

SEQ ID NO: 2459794 - DNA, 16 bp, Homo sapiens
atgggtagggtaaatc

SEQ ID NO: 2459795 - DNA, 13 bp, Homo sapiens
atgggtcacagga

SEQ ID NO: 2459796 - DNA, 13 bp, Homo sapiens
atgggtggaaagg

SEQ ID NO: 2459797 - DNA, 22 bp, Homo sapiens
atgggtttttccctgtacagta

SEQ ID NO: 2459798 - DNA, 16 bp, Homo sapiens
atggtaaaaaatttat

SEQ ID NO: 2459799 - DNA, 23 bp, Homo sapiens
atggtactgtacagctggctcta

SEQ ID NO: 2459800 - DNA, 18 bp, Homo sapiens
atggtagttttttcatct

SEQ ID NO: 2459801 - DNA, 19 bp, Homo sapiens
atggtagttttttcatctt

SEQ ID NO: 2459802 - DNA, 14 bp, Homo sapiens
atggtcacacactg

SEQ ID NO: 2459803 - DNA, 20 bp, Homo sapiens
atggtcacacactgatgctt

SEQ ID NO: 2459804 - DNA, 19 bp, Homo sapiens
atggtccaggagaaggcca

SEQ ID NO: 2459805 - DNA, 17 bp, Homo sapiens
atggtcccacatccctg

SEQ ID NO: 2459806 - DNA, 19 bp, Homo sapiens
atggtcccacatccctggg

SEQ ID NO: 2459807 - DNA, 16 bp, Homo sapiens
atggtctgccctctgc

SEQ ID NO: 2459808 - DNA, 17 bp, Homo sapiens
atggtcttacagcaggc

SEQ ID NO: 2459809 - DNA, 14 bp, Homo sapiens
atggtgccccagga

SEQ ID NO: 2459810 - DNA, 16 bp, Homo sapiens
atggtgccccaggacc

SEQ ID NO: 2459811 - DNA, 17 bp, Homo sapiens
atggtgccccaggacca

SEQ ID NO: 2459812 - DNA, 18 bp, Homo sapiens
atggtgccccaggaccag

SEQ ID NO: 2459813 - DNA, 20 bp, Homo sapiens
atggtgccccaggaccagct

SEQ ID NO: 2459814 - DNA, 13 bp, Homo sapiens
atggtggagggcc

SEQ ID NO: 2459815 - DNA, 18 bp, Homo sapiens
atggtgtctcttctttag

SEQ ID NO: 2459816 - DNA, 20 bp, Homo sapiens
atggttcagaattaaacttt

SEQ ID NO: 2459817 - DNA, 21 bp, Homo sapiens
atggttcagaattaaactttt

SEQ ID NO: 2459818 - DNA, 21 bp, Homo sapiens
atggttttctccaagagctac

SEQ ID NO: 2459819 - DNA, 14 bp, Homo sapiens
atgtaaaacattta

SEQ ID NO: 2459820 - DNA, 17 bp, Homo sapiens
atgtaaataatacatta

SEQ ID NO: 2459821 - DNA, 15 bp, Homo sapiens
atgtaaatattttaa

SEQ ID NO: 2459822 - DNA, 20 bp, Homo sapiens
agctaacagggaaggcaggc

SEQ ID NO: 2459823 - DNA, 23 bp, Homo sapiens
agctaacagggaaggcaggcagg

SEQ ID NO: 2459824 - DNA, 20 bp, Homo sapiens
agctaaggctctatgagtct

SEQ ID NO: 2459825 - DNA, 16 bp, Homo sapiens
agctaataaaaagctt

SEQ ID NO: 2459826 - DNA, 18 bp, Homo sapiens
agctaataaaaagctttt

SEQ ID NO: 2459827 - DNA, 21 bp, Homo sapiens
agctaataaaaagcttttgtc

SEQ ID NO: 2459828 - DNA, 23 bp, Homo sapiens
agctaataaaaagcttttgtcta

SEQ ID NO: 2459829 - DNA, 14 bp, Homo sapiens
agctaatttgcatt

SEQ ID NO: 2459830 - DNA, 20 bp, Homo sapiens
agctaatttgcattaaattc

SEQ ID NO: 2459831 - DNA, 22 bp, Homo sapiens
agctaatttgcattaaattcac

SEQ ID NO: 2459832 - DNA, 14 bp, Homo sapiens
agctacagagaaac

SEQ ID NO: 2459833 - DNA, 15 bp, Homo sapiens
agctacagagaaacc

SEQ ID NO: 2459834 - DNA, 17 bp, Homo sapiens
agctacagagaaaccag

SEQ ID NO: 2459835 - DNA, 19 bp, Homo sapiens
agctacagagaaaccagct

SEQ ID NO: 2459836 - DNA, 20 bp, Homo sapiens
agctacagagaaaccagctt

SEQ ID NO: 2459837 - DNA, 16 bp, Homo sapiens
agctactaaaatcagt

SEQ ID NO: 2459838 - DNA, 23 bp, Homo sapiens
agctactctccccacgagggctg

SEQ ID NO: 2459839 - DNA, 16 bp, Homo sapiens
agctacttcctcctcc

SEQ ID NO: 2459840 - DNA, 16 bp, Homo sapiens
agctagaaccctctgt

SEQ ID NO: 2459841 - DNA, 20 bp, Homo sapiens
agctagaattgagtgtttaa

SEQ ID NO: 2459842 - DNA, 16 bp, Homo sapiens
agctagacacatgaag

SEQ ID NO: 2459843 - DNA, 21 bp, Homo sapiens
agctaggagcaaagcctgttc

SEQ ID NO: 2459844 - DNA, 19 bp, Homo sapiens
agatgtgtgttgatactgt

SEQ ID NO: 2459845 - DNA, 18 bp, Homo sapiens
agatgtttattcttctag

SEQ ID NO: 2459846 - DNA, 20 bp, Homo sapiens
agatgtttattcttctagag

SEQ ID NO: 2459847 - DNA, 21 bp, Homo sapiens
agatgtttattcttctagagt

SEQ ID NO: 2459848 - DNA, 13 bp, Homo sapiens
agattaagaaata

SEQ ID NO: 2459849 - DNA, 14 bp, Homo sapiens
agattaagaaatag

SEQ ID NO: 2459850 - DNA, 20 bp, Homo sapiens
agattacaaatcagaagtca

SEQ ID NO: 2459851 - DNA, 21 bp, Homo sapiens
agattatagattctaaagatt

SEQ ID NO: 2459852 - DNA, 17 bp, Homo sapiens
agattatcgttttctta

SEQ ID NO: 2459853 - DNA, 16 bp, Homo sapiens
agattcaggtaataca

SEQ ID NO: 2459854 - DNA, 22 bp, Homo sapiens
agattccattggtccaagattc

SEQ ID NO: 2459855 - DNA, 18 bp, Homo sapiens
agattccggatcctaagc

SEQ ID NO: 2459856 - DNA, 20 bp, Homo sapiens
agattccggatcctaagcat

SEQ ID NO: 2459857 - DNA, 13 bp, Homo sapiens
agattccttccca

SEQ ID NO: 2459858 - DNA, 12 bp, Homo sapiens
agattctaaaga

SEQ ID NO: 2459859 - DNA, 13 bp, Homo sapiens
agattctaaagat

SEQ ID NO: 2459860 - DNA, 17 bp, Homo sapiens
agattctaaagattcta

SEQ ID NO: 2459861 - DNA, 13 bp, Homo sapiens
agattctaaaggt

SEQ ID NO: 2459862 - DNA, 14 bp, Homo sapiens
agattctaatgatg

SEQ ID NO: 2459863 - DNA, 11 bp, Homo sapiens
agattctagat

SEQ ID NO: 2459864 - DNA, 15 bp, Homo sapiens
agattctatagttct

SEQ ID NO: 2459865 - DNA, 21 bp, Homo sapiens
agattctatagttctagacat

SEQ ID NO: 2459866 - DNA, 13 bp, Homo sapiens
agattctcaaagg

SEQ ID NO: 2459867 - DNA, 17 bp, Homo sapiens
agattctcccttgctct

SEQ ID NO: 2459868 - DNA, 21 bp, Homo sapiens
agattctctggctgtaaggct

SEQ ID NO: 2459869 - DNA, 20 bp, Homo sapiens
agattctctgtgtctaagat

SEQ ID NO: 2459870 - DNA, 14 bp, Homo sapiens
agattctgatttta

SEQ ID NO: 2459871 - DNA, 13 bp, Homo sapiens
agattctgccttt

SEQ ID NO: 2459872 - DNA, 12 bp, Homo sapiens
agattctttccc

SEQ ID NO: 2459873 - DNA, 13 bp, Homo sapiens
agattgagagaat

SEQ ID NO: 2459874 - DNA, 17 bp, Homo sapiens
agattgagctctctgcc

SEQ ID NO: 2459875 - DNA, 16 bp, Homo sapiens
agattgattgtattgt

SEQ ID NO: 2459876 - DNA, 19 bp, Homo sapiens
agattgcagaaaattctgt

SEQ ID NO: 2459877 - DNA, 13 bp, Homo sapiens
agattgtcctttt

SEQ ID NO: 2459878 - DNA, 14 bp, Homo sapiens
agatttattaaaga

SEQ ID NO: 2459879 - DNA, 18 bp, Homo sapiens
agatttattaaagaaaaa

SEQ ID NO: 2459880 - DNA, 19 bp, Homo sapiens
agatttcatagttcagaat

SEQ ID NO: 2459881 - DNA, 16 bp, Homo sapiens
agatttccttcttttt

SEQ ID NO: 2459882 - DNA, 21 bp, Homo sapiens
agatttgtttttaaactgtac

SEQ ID NO: 2459883 - DNA, 23 bp, Homo sapiens
agatttgtttttaaactgtacag

SEQ ID NO: 2459884 - DNA, 12 bp, Homo sapiens
agattttctggt

SEQ ID NO: 2459885 - DNA, 17 bp, Homo sapiens
agattttctggttctaa

SEQ ID NO: 2459886 - DNA, 18 bp, Homo sapiens
agattttctggttctaac

SEQ ID NO: 2459887 - DNA, 14 bp, Homo sapiens
agattttttaataa

SEQ ID NO: 2459888 - DNA, 16 bp, Homo sapiens
agattttttaataatt

SEQ ID NO: 2459889 - DNA, 18 bp, Homo sapiens
agattttttttttttctc

SEQ ID NO: 2459890 - DNA, 18 bp, Homo sapiens
agcaaaccgccctgcagc

SEQ ID NO: 2459891 - DNA, 15 bp, Homo sapiens
agcaaactgcatgcc

SEQ ID NO: 2459892 - DNA, 20 bp, Homo sapiens
agcaaactgcatgcccagag

SEQ ID NO: 2459893 - DNA, 22 bp, Homo sapiens
agcaaactgcatgcccagagac

SEQ ID NO: 2459894 - DNA, 13 bp, Homo sapiens
agcaaagcacaga

SEQ ID NO: 2459895 - DNA, 15 bp, Homo sapiens
agcaaagcacagaga

SEQ ID NO: 2459896 - DNA, 15 bp, Homo sapiens
agcaaagcccccaga

SEQ ID NO: 2459897 - DNA, 21 bp, Homo sapiens
agcaaagcccccagagcccag

SEQ ID NO: 2459898 - DNA, 21 bp, Homo sapiens
agcaaagcctgttcatggcag

SEQ ID NO: 2459899 - DNA, 21 bp, Homo sapiens
agcaaatcaccacaaactgta

SEQ ID NO: 2459900 - DNA, 19 bp, Homo sapiens
agcaaatcatttgtttaaa

SEQ ID NO: 2459901 - DNA, 15 bp, Homo sapiens
agcaaatcgaatgaa

SEQ ID NO: 2459902 - DNA, 20 bp, Homo sapiens
agcaaatcgaatgaaattaa

SEQ ID NO: 2459903 - DNA, 22 bp, Homo sapiens
agcaaatcgaatgaaattaact

SEQ ID NO: 2459904 - DNA, 13 bp, Homo sapiens
agcaaatgcaaaa

SEQ ID NO: 2459905 - DNA, 20 bp, Homo sapiens
agcaaatggcctcatgtcaa

SEQ ID NO: 2459906 - DNA, 19 bp, Homo sapiens
agcaaatgtcatgctgcct

SEQ ID NO: 2459907 - DNA, 21 bp, Homo sapiens
agcaaatgtcatgctgcctta

SEQ ID NO: 2459908 - DNA, 12 bp, Homo sapiens
agcaacatggct

SEQ ID NO: 2459909 - DNA, 15 bp, Homo sapiens
agcaaccgtggccct

SEQ ID NO: 2459910 - DNA, 19 bp, Homo sapiens
agcaaccgtggcccttcct

SEQ ID NO: 2459911 - DNA, 20 bp, Homo sapiens
agcaaccgtggcccttcctg

SEQ ID NO: 2459912 - DNA, 22 bp, Homo sapiens
agcaaccgtggcccttcctgga

SEQ ID NO: 2459913 - DNA, 23 bp, Homo sapiens
agcaaccgtggcccttcctggac

SEQ ID NO: 2459914 - DNA, 15 bp, Homo sapiens
agcaacctgtagagt

SEQ ID NO: 2459915 - DNA, 13 bp, Homo sapiens
agcaacggcacag

SEQ ID NO: 2459916 - DNA, 16 bp, Homo sapiens
agcaactatcagacta

SEQ ID NO: 2459917 - DNA, 16 bp, Homo sapiens
agcaactcttgattat

SEQ ID NO: 2459918 - DNA, 15 bp, Homo sapiens
agcaagcaagaggcc

SEQ ID NO: 2459919 - DNA, 17 bp, Homo sapiens
agcaagctgattaaatg

SEQ ID NO: 2459920 - DNA, 14 bp, Homo sapiens
agcaaggcccgagc

SEQ ID NO: 2459921 - DNA, 19 bp, Homo sapiens
agcaaggcccgagcagctg

SEQ ID NO: 2459922 - DNA, 20 bp, Homo sapiens
agcaaggcccgagcagctga

SEQ ID NO: 2459923 - DNA, 22 bp, Homo sapiens
agcaatacttggagggcccagc

SEQ ID NO: 2459924 - DNA, 19 bp, Homo sapiens
agcacaaattagttatata

SEQ ID NO: 2459925 - DNA, 17 bp, Homo sapiens
agcacaataaatggctg

SEQ ID NO: 2459926 - DNA, 14 bp, Homo sapiens
agcacacagggcag

SEQ ID NO: 2459927 - DNA, 12 bp, Homo sapiens
agcacagcagcc

SEQ ID NO: 2459928 - DNA, 23 bp, Homo sapiens
agcacagcagcctggggctggcc

SEQ ID NO: 2459929 - DNA, 14 bp, Homo sapiens
agcacagcttgacc

SEQ ID NO: 2459930 - DNA, 16 bp, Homo sapiens
agcacatctcaacagg

SEQ ID NO: 2459931 - DNA, 19 bp, Homo sapiens
aggagaagctcagctgcat

SEQ ID NO: 2459932 - DNA, 20 bp, Homo sapiens
aggagaatcacttgaacctg

SEQ ID NO: 2459933 - DNA, 18 bp, Homo sapiens
aggagatgctccttgggc

SEQ ID NO: 2459934 - DNA, 14 bp, Homo sapiens
aggagcaaagcctg

SEQ ID NO: 2459935 - DNA, 23 bp, Homo sapiens
aggagcacggctctgtccccagc

SEQ ID NO: 2459936 - DNA, 20 bp, Homo sapiens
aggagcagcaggagggggga

SEQ ID NO: 2459937 - DNA, 14 bp, Homo sapiens
aggagccaccagtt

SEQ ID NO: 2459938 - DNA, 13 bp, Homo sapiens
aggagcccaggcc

SEQ ID NO: 2459939 - DNA, 14 bp, Homo sapiens
aggagcccaggcca

SEQ ID NO: 2459940 - DNA, 19 bp, Homo sapiens
aggagcccaggccaggact

SEQ ID NO: 2459941 - DNA, 20 bp, Homo sapiens
aggagcccaggccaggactc

SEQ ID NO: 2459942 - DNA, 18 bp, Homo sapiens
aggagccccattcctggg

SEQ ID NO: 2459943 - DNA, 12 bp, Homo sapiens
aggagcccccac

SEQ ID NO: 2459944 - DNA, 19 bp, Homo sapiens
aggagcctgtcctgcctgt

SEQ ID NO: 2459945 - DNA, 21 bp, Homo sapiens
aggagcctgtcctgcctgtgg

SEQ ID NO: 2459946 - DNA, 17 bp, Homo sapiens
aggagcctgtgaaccca

SEQ ID NO: 2459947 - DNA, 18 bp, Homo sapiens
aggagcctgtgaacccag

SEQ ID NO: 2459948 - DNA, 14 bp, Homo sapiens
aggagcgagcatgt

SEQ ID NO: 2459949 - DNA, 14 bp, Homo sapiens
aggagctaaggctc

SEQ ID NO: 2459950 - DNA, 17 bp, Homo sapiens
aggagctaaggctctat

SEQ ID NO: 2459951 - DNA, 20 bp, Homo sapiens
aggagctaaggctctatgag

SEQ ID NO: 2459952 - DNA, 21 bp, Homo sapiens
aggagctaaggctctatgagt

SEQ ID NO: 2459953 - DNA, 12 bp, Homo sapiens
aggagctacctg

SEQ ID NO: 2459954 - DNA, 16 bp, Homo sapiens
aggagctacctgtgtg

SEQ ID NO: 2459955 - DNA, 21 bp, Homo sapiens
aggagctcccctccccaactg

SEQ ID NO: 2459956 - DNA, 15 bp, Homo sapiens
aggagctgcctggac

SEQ ID NO: 2459957 - DNA, 15 bp, Homo sapiens
agccacatttggaat

SEQ ID NO: 2459958 - DNA, 21 bp, Homo sapiens
agccacatttggaatactttt

SEQ ID NO: 2459959 - DNA, 12 bp, Homo sapiens
agccaccagttc

SEQ ID NO: 2459960 - DNA, 19 bp, Homo sapiens
agccactaaccttgcctgg

SEQ ID NO: 2459961 - DNA, 13 bp, Homo sapiens
agccactcctctg

SEQ ID NO: 2459962 - DNA, 14 bp, Homo sapiens
agccactcctctga

SEQ ID NO: 2459963 - DNA, 12 bp, Homo sapiens
agccactgccat

SEQ ID NO: 2459964 - DNA, 17 bp, Homo sapiens
agccacttaaaatgttc

SEQ ID NO: 2459965 - DNA, 19 bp, Homo sapiens
agccacttgcctgtgctac

SEQ ID NO: 2459966 - DNA, 11 bp, Homo sapiens
agccagaggct

SEQ ID NO: 2459967 - DNA, 18 bp, Homo sapiens
agccagcacacagggcag

SEQ ID NO: 2459968 - DNA, 21 bp, Homo sapiens
agccagcaccggaccagcctg

SEQ ID NO: 2459969 - DNA, 22 bp, Homo sapiens
agccagcaccggaccagcctgg

SEQ ID NO: 2459970 - DNA, 23 bp, Homo sapiens
agccagcaccggaccagcctggc

SEQ ID NO: 2459971 - DNA, 15 bp, Homo sapiens
agccagcacctggca

SEQ ID NO: 2459972 - DNA, 20 bp, Homo sapiens
agccagccctgcctggagga

SEQ ID NO: 2459973 - DNA, 21 bp, Homo sapiens
agccagccgagcaggaggcct

SEQ ID NO: 2459974 - DNA, 19 bp, Homo sapiens
agccagccggggcgagtgg

SEQ ID NO: 2459975 - DNA, 16 bp, Homo sapiens
agccagcgtcctcctc

SEQ ID NO: 2459976 - DNA, 15 bp, Homo sapiens
actctattctttaac

SEQ ID NO: 2459977 - DNA, 21 bp, Homo sapiens
actctccccacgagggctggc

SEQ ID NO: 2459978 - DNA, 16 bp, Homo sapiens
actctgaaatgaagat

SEQ ID NO: 2459979 - DNA, 20 bp, Homo sapiens
actctgagtgttttatgaga

SEQ ID NO: 2459980 - DNA, 17 bp, Homo sapiens
actctgcagcctcagag

SEQ ID NO: 2459981 - DNA, 16 bp, Homo sapiens
actctgcattctagta

SEQ ID NO: 2459982 - DNA, 16 bp, Homo sapiens
actctgctctgatgca

SEQ ID NO: 2459983 - DNA, 14 bp, Homo sapiens
actctgcttctctg

SEQ ID NO: 2459984 - DNA, 18 bp, Homo sapiens
actctgcttctctgactt

SEQ ID NO: 2459985 - DNA, 16 bp, Homo sapiens
actctggcagccacac

SEQ ID NO: 2459986 - DNA, 17 bp, Homo sapiens
actctggcagccacact

SEQ ID NO: 2459987 - DNA, 11 bp, Homo sapiens
actctgtcctg

SEQ ID NO: 2459988 - DNA, 13 bp, Homo sapiens
actctgtcctgaa

SEQ ID NO: 2459989 - DNA, 20 bp, Homo sapiens
actctgtcctgaaggcctga

SEQ ID NO: 2459990 - DNA, 14 bp, Homo sapiens
actctgtgccagag

SEQ ID NO: 2459991 - DNA, 15 bp, Homo sapiens
actctgtgccagagc

SEQ ID NO: 2459992 - DNA, 17 bp, Homo sapiens
actctgtgccagagcct

SEQ ID NO: 2459993 - DNA, 15 bp, Homo sapiens
actctgtgctggcca

SEQ ID NO: 2459994 - DNA, 21 bp, Homo sapiens
actcttatgctgtacccagtt

SEQ ID NO: 2459995 - DNA, 16 bp, Homo sapiens
actcttgattatccat

SEQ ID NO: 2459996 - DNA, 18 bp, Homo sapiens
actctttatgatctggcc

SEQ ID NO: 2459997 - DNA, 14 bp, Homo sapiens
actctttctgtata

SEQ ID NO: 2459998 - DNA, 18 bp, Homo sapiens
actctttgttatttgaaa

SEQ ID NO: 2459999 - DNA, 18 bp, Homo sapiens
actcttttccttcccttt

SEQ ID NO: 2460000 - DNA, 12 bp, Homo sapiens
actcttttgctt

SEQ ID NO: 2460001 - DNA, 21 bp, Homo sapiens
actcttttgctttattccaga

SEQ ID NO: 2460002 - DNA, 24 bp, Homo sapiens
actgaacatctgagtcctggatga

SEQ ID NO: 2460003 - DNA, 12 bp, Homo sapiens
actgaagagtaa

SEQ ID NO: 2460004 - DNA, 13 bp, Homo sapiens
actgaataccact

SEQ ID NO: 2460005 - DNA, 20 bp, Homo sapiens
actgaataccactctgtaat

SEQ ID NO: 2460006 - DNA, 22 bp, Homo sapiens
actgaataccactctgtaattg

SEQ ID NO: 2460007 - DNA, 14 bp, Homo sapiens
actgaatgtcattg

SEQ ID NO: 2460008 - DNA, 14 bp, Homo sapiens
actgacagaggggg

SEQ ID NO: 2460009 - DNA, 12 bp, Homo sapiens
actgacatgtgg

SEQ ID NO: 2460010 - DNA, 13 bp, Homo sapiens
actgacggactca

SEQ ID NO: 2460011 - DNA, 16 bp, Homo sapiens
actgacggactcatga

SEQ ID NO: 2460012 - DNA, 24 bp, Homo sapiens
actgactattcttgatgtaaaatc

SEQ ID NO: 2460013 - DNA, 16 bp, Homo sapiens
actgactttgcttgct

SEQ ID NO: 2460014 - DNA, 14 bp, Homo sapiens
actgagccttgtaa

SEQ ID NO: 2460015 - DNA, 23 bp, Homo sapiens
actgagggcagtcgatagagctg

SEQ ID NO: 2460016 - DNA, 24 bp, Homo sapiens
actgagggtgagttggcttacctg

SEQ ID NO: 2460017 - DNA, 16 bp, Homo sapiens
actgagtgggaagccc

SEQ ID NO: 2460018 - DNA, 15 bp, Homo sapiens
actgatcacaaaaac

SEQ ID NO: 2460019 - DNA, 14 bp, Homo sapiens
actgatgctgcccc

SEQ ID NO: 2460020 - DNA, 15 bp, Homo sapiens
actgcaaccttcacc

SEQ ID NO: 2460021 - DNA, 14 bp, Homo sapiens
actgcacaataact

SEQ ID NO: 2460022 - DNA, 20 bp, Homo sapiens
actgcacaataactcctccc

SEQ ID NO: 2460023 - DNA, 14 bp, Homo sapiens
actgcacctgcctc

SEQ ID NO: 2460024 - DNA, 19 bp, Homo sapiens
actgcacctgcctccagcc

SEQ ID NO: 2460025 - DNA, 17 bp, Homo sapiens
actgcaggccctggcct

SEQ ID NO: 2460026 - DNA, 22 bp, Homo sapiens
actgcaggccctggcctcccct

SEQ ID NO: 2460027 - DNA, 13 bp, Homo sapiens
actgccaggctct

SEQ ID NO: 2460028 - DNA, 13 bp, Homo sapiens
actgccatatgat

SEQ ID NO: 2460029 - DNA, 17 bp, Homo sapiens
actgccccctgctgcca

SEQ ID NO: 2460030 - DNA, 16 bp, Homo sapiens
actgccgtaatttaac

SEQ ID NO: 2460031 - DNA, 17 bp, Homo sapiens
actgccgtaatttaact

SEQ ID NO: 2460032 - DNA, 19 bp, Homo sapiens
actgcctgctcccatcctg

SEQ ID NO: 2460033 - DNA, 17 bp, Homo sapiens
actgccttcgcttcttg

SEQ ID NO: 2460034 - DNA, 23 bp, Homo sapiens
actgccttcgcttcttgcctctg

SEQ ID NO: 2460035 - DNA, 19 bp, Homo sapiens
actgcgactttctgcctgg

SEQ ID NO: 2460036 - DNA, 16 bp, Homo sapiens
actgctacagcaattt

SEQ ID NO: 2460037 - DNA, 13 bp, Homo sapiens
actgctgccactg

SEQ ID NO: 2460038 - DNA, 21 bp, Homo sapiens
actgctggagaggccccagcc

SEQ ID NO: 2460039 - DNA, 19 bp, Homo sapiens
actgctgtggccaggaggt

SEQ ID NO: 2460040 - DNA, 14 bp, Homo sapiens
actgcttgaggaaa

SEQ ID NO: 2460041 - DNA, 13 bp, Homo sapiens
actgcttggagct

SEQ ID NO: 2460042 - DNA, 18 bp, Homo sapiens
actgcttggagctgagca

SEQ ID NO: 2460043 - DNA, 17 bp, Homo sapiens
actggaaaacagaacac

SEQ ID NO: 2460044 - DNA, 16 bp, Homo sapiens
actggaagctaatttg

SEQ ID NO: 2460045 - DNA, 16 bp, Homo sapiens
actggaatcctttcag

SEQ ID NO: 2460046 - DNA, 13 bp, Homo sapiens
actggagactgtg

SEQ ID NO: 2460047 - DNA, 21 bp, Homo sapiens
actggagactgtgtgtgccct

SEQ ID NO: 2460048 - DNA, 21 bp, Homo sapiens
actggcaggcaggctcccagg

SEQ ID NO: 2460049 - DNA, 17 bp, Homo sapiens
actggccaagctgaggt

SEQ ID NO: 2460050 - DNA, 18 bp, Homo sapiens
actggccaagctgaggtg

SEQ ID NO: 2460051 - DNA, 11 bp, Homo sapiens
actggccaggg

SEQ ID NO: 2460052 - DNA, 22 bp, Homo sapiens
actggcctcaaagcaagcattc

SEQ ID NO: 2460053 - DNA, 18 bp, Homo sapiens
actggcctttttcattta

SEQ ID NO: 2460054 - DNA, 19 bp, Homo sapiens
actggcgacacgtagcagc

SEQ ID NO: 2460055 - DNA, 15 bp, Homo sapiens
actggcggggggccc

SEQ ID NO: 2460056 - DNA, 19 bp, Homo sapiens
actggcttttattaatgca

SEQ ID NO: 2460057 - DNA, 21 bp, Homo sapiens
actggcttttattaatgcact

SEQ ID NO: 2460058 - DNA, 20 bp, Homo sapiens
actgggaacccctttcccac

SEQ ID NO: 2460059 - DNA, 17 bp, Homo sapiens
actgggaaggctacttc

SEQ ID NO: 2460060 - DNA, 19 bp, Homo sapiens
actgggagcccccagcctg

SEQ ID NO: 2460061 - DNA, 13 bp, Homo sapiens
actgggctgaggg

SEQ ID NO: 2460062 - DNA, 14 bp, Homo sapiens
actgggctgaggga

SEQ ID NO: 2460063 - DNA, 17 bp, Homo sapiens
actgggctgagggagcc

SEQ ID NO: 2460064 - DNA, 19 bp, Homo sapiens
actggggaaaactccacct

SEQ ID NO: 2460065 - DNA, 15 bp, Homo sapiens
actggggaaactggc

SEQ ID NO: 2460066 - DNA, 17 bp, Homo sapiens
actggggacttggcctc

SEQ ID NO: 2460067 - DNA, 21 bp, Homo sapiens
actggggagcccgtctcagtg

SEQ ID NO: 2460068 - DNA, 13 bp, Homo sapiens
actggggctcaga

SEQ ID NO: 2460069 - DNA, 16 bp, Homo sapiens
actggggctcagagcc

SEQ ID NO: 2460070 - DNA, 18 bp, Homo sapiens
actggggctcagagccgg

SEQ ID NO: 2460071 - DNA, 20 bp, Homo sapiens
actgggtaatgaaacaaaga

SEQ ID NO: 2460072 - DNA, 15 bp, Homo sapiens
actggtaggaccaag

SEQ ID NO: 2460073 - DNA, 22 bp, Homo sapiens
actggtcacggatttgtgtctg

SEQ ID NO: 2460074 - DNA, 19 bp, Homo sapiens
agagcaggactgatgtctc

SEQ ID NO: 2460075 - DNA, 20 bp, Homo sapiens
agagcagtgaagactagaaa

SEQ ID NO: 2460076 - DNA, 12 bp, Homo sapiens
agagcagtgctt

SEQ ID NO: 2460077 - DNA, 15 bp, Homo sapiens
agagcagtgcttttg

SEQ ID NO: 2460078 - DNA, 16 bp, Homo sapiens
agagcatcatgcctct

SEQ ID NO: 2460079 - DNA, 12 bp, Homo sapiens
agagccaggaga

SEQ ID NO: 2460080 - DNA, 18 bp, Homo sapiens
agagccaggagaagctca

SEQ ID NO: 2460081 - DNA, 13 bp, Homo sapiens
agagcccagctcc

SEQ ID NO: 2460082 - DNA, 22 bp, Homo sapiens
agagccggggtggggtggctgc

SEQ ID NO: 2460083 - DNA, 11 bp, Homo sapiens
agagcctgagg

SEQ ID NO: 2460084 - DNA, 17 bp, Homo sapiens
agagccttccacccagg

SEQ ID NO: 2460085 - DNA, 16 bp, Homo sapiens
agagcgtgagctgagc

SEQ ID NO: 2460086 - DNA, 14 bp, Homo sapiens
agagctacgtattt

SEQ ID NO: 2460087 - DNA, 19 bp, Homo sapiens
agagctaggagcaaagcct

SEQ ID NO: 2460088 - DNA, 21 bp, Homo sapiens
agagctaggagcaaagcctgt

SEQ ID NO: 2460089 - DNA, 20 bp, Homo sapiens
aagatggagtttctaaggtc

SEQ ID NO: 2460090 - DNA, 20 bp, Homo sapiens
aagatgggcatcttttgtat

SEQ ID NO: 2460091 - DNA, 18 bp, Homo sapiens
aagatggggaccagcagc

SEQ ID NO: 2460092 - DNA, 14 bp, Homo sapiens
aagatgtgatattc

SEQ ID NO: 2460093 - DNA, 19 bp, Homo sapiens
aagatgtgatattctaaga

SEQ ID NO: 2460094 - DNA, 14 bp, Homo sapiens
aagattatagattc

SEQ ID NO: 2460095 - DNA, 15 bp, Homo sapiens
aagattatagattct

SEQ ID NO: 2460096 - DNA, 21 bp, Homo sapiens
aagattatagattctaaagat

SEQ ID NO: 2460097 - DNA, 21 bp, Homo sapiens
aagattccggatcctaagcat

SEQ ID NO: 2460098 - DNA, 11 bp, Homo sapiens
aagattctaaa

SEQ ID NO: 2460099 - DNA, 16 bp, Homo sapiens
aagattctaatgatga

SEQ ID NO: 2460100 - DNA, 13 bp, Homo sapiens
aagctataaagca

SEQ ID NO: 2460101 - DNA, 20 bp, Homo sapiens
aagctataaagcagtatttt

SEQ ID NO: 2460102 - DNA, 14 bp, Homo sapiens
aagctatttgatgt

SEQ ID NO: 2460103 - DNA, 14 bp, Homo sapiens
aagctatttttcta

SEQ ID NO: 2460104 - DNA, 21 bp, Homo sapiens
aagctatttttctaactacaa

SEQ ID NO: 2460105 - DNA, 13 bp, Homo sapiens
aagctccaagccc

SEQ ID NO: 2460106 - DNA, 20 bp, Homo sapiens
aagctcctctccccagccca

SEQ ID NO: 2460107 - DNA, 22 bp, Homo sapiens
aagctcctctccccagcccaga

SEQ ID NO: 2460108 - DNA, 16 bp, Homo sapiens
aagctgacttggctgg

SEQ ID NO: 2460109 - DNA, 17 bp, Homo sapiens
aagctgaggtgcccagg

SEQ ID NO: 2460110 - DNA, 18 bp, Homo sapiens
aagctgaggtgcccagga

SEQ ID NO: 2460111 - DNA, 19 bp, Homo sapiens
aagctgaggtgcccaggag

SEQ ID NO: 2460112 - DNA, 13 bp, Homo sapiens
aagctgagtatta

SEQ ID NO: 2460113 - DNA, 22 bp, Homo sapiens
aagctgagttaggtgtctgtcc

SEQ ID NO: 2460114 - DNA, 23 bp, Homo sapiens
aagctgagttaggtgtctgtcct

SEQ ID NO: 2460115 - DNA, 15 bp, Homo sapiens
aagctgattaaatga

SEQ ID NO: 2460116 - DNA, 16 bp, Homo sapiens
aagctgattaaatgac

SEQ ID NO: 2460117 - DNA, 23 bp, Homo sapiens
aagctgcctcccctctccttcct

SEQ ID NO: 2460118 - DNA, 23 bp, Homo sapiens
aagctggcggctggggtcccagc

SEQ ID NO: 2460119 - DNA, 13 bp, Homo sapiens
aagcttaaaactt

SEQ ID NO: 2460120 - DNA, 15 bp, Homo sapiens
aagcttctgtcctgc

SEQ ID NO: 2460121 - DNA, 12 bp, Homo sapiens
aagcttggggaa

SEQ ID NO: 2460122 - DNA, 21 bp, Homo sapiens
aagctttcagaatatgtcagt

SEQ ID NO: 2460123 - DNA, 19 bp, Homo sapiens
aagctttggtgagaacctg

SEQ ID NO: 2460124 - DNA, 13 bp, Homo sapiens
aagcttttctatt

SEQ ID NO: 2460125 - DNA, 22 bp, Homo sapiens
aagcttttgtctacacaccctg

SEQ ID NO: 2460126 - DNA, 22 bp, Homo sapiens
aaggaaatctcaccccatccca

SEQ ID NO: 2460127 - DNA, 17 bp, Homo sapiens
aaggaaccaacaatctt

SEQ ID NO: 2460128 - DNA, 18 bp, Homo sapiens
aaggaagcattgtaaaat

SEQ ID NO: 2460129 - DNA, 23 bp, Homo sapiens
aaggaagcattgtaaaataattc

SEQ ID NO: 2460130 - DNA, 14 bp, Homo sapiens
aaggaatttcttaa

SEQ ID NO: 2460131 - DNA, 17 bp, Homo sapiens
aaggaatttcttaactt

SEQ ID NO: 2460132 - DNA, 23 bp, Homo sapiens
aaggaatttcttaacttcttgct

SEQ ID NO: 2460133 - DNA, 18 bp, Homo sapiens
aaggactaatagaaaagt

SEQ ID NO: 2460134 - DNA, 19 bp, Homo sapiens
aaggactaatagaaaagta

SEQ ID NO: 2460135 - DNA, 15 bp, Homo sapiens
aaggactttgtacat

SEQ ID NO: 2460136 - DNA, 15 bp, Homo sapiens
aaggagaaccagcac

SEQ ID NO: 2460137 - DNA, 18 bp, Homo sapiens
aaggagatgtcttggaac

SEQ ID NO: 2460138 - DNA, 13 bp, Homo sapiens
aaggagcctgtga

SEQ ID NO: 2460139 - DNA, 17 bp, Homo sapiens
aaggagctgcctggacc

SEQ ID NO: 2460140 - DNA, 15 bp, Homo sapiens
aaggaggagcctgtc

SEQ ID NO: 2460141 - DNA, 16 bp, Homo sapiens
aaggaggagcctgtcc

SEQ ID NO: 2460142 - DNA, 17 bp, Homo sapiens
aaggaggagcctgtcct

SEQ ID NO: 2460143 - DNA, 17 bp, Homo sapiens
aaggatccggaaagaag

SEQ ID NO: 2460144 - DNA, 17 bp, Homo sapiens
aaggatgtgattgtgga

SEQ ID NO: 2460145 - DNA, 13 bp, Homo sapiens
aaggcaaaaatag

SEQ ID NO: 2460146 - DNA, 15 bp, Homo sapiens
aaggcaaaaatgtaa

SEQ ID NO: 2460147 - DNA, 12 bp, Homo sapiens
aaggcaaaattg

SEQ ID NO: 2460148 - DNA, 15 bp, Homo sapiens
aaggcaaacccatca

SEQ ID NO: 2460149 - DNA, 19 bp, Homo sapiens
aaggcacccatctgtctgc

SEQ ID NO: 2460150 - DNA, 14 bp, Homo sapiens
aaggcactctagat

SEQ ID NO: 2460151 - DNA, 16 bp, Homo sapiens
aaggcagaggcctggg

SEQ ID NO: 2460152 - DNA, 19 bp, Homo sapiens
aaggcagaggcctgggctg

SEQ ID NO: 2460153 - DNA, 15 bp, Homo sapiens
aaggcagtttgcaaa

SEQ ID NO: 2460154 - DNA, 17 bp, Homo sapiens
aaggcatacgagagcag

SEQ ID NO: 2460155 - DNA, 21 bp, Homo sapiens
aaggcatacgagagcagaggt

SEQ ID NO: 2460156 - DNA, 22 bp, Homo sapiens
aaggcatacgagagcagaggtc

SEQ ID NO: 2460157 - DNA, 22 bp, Homo sapiens
aaggcatcgtcatgcacagtat

SEQ ID NO: 2460158 - DNA, 13 bp, Homo sapiens
aaggccagcactc

SEQ ID NO: 2460159 - DNA, 17 bp, Homo sapiens
aaggccataaaacaggt

SEQ ID NO: 2460160 - DNA, 17 bp, Homo sapiens
aaggcccgagcagctga

SEQ ID NO: 2460161 - DNA, 21 bp, Homo sapiens
aaggcccgagcagctgagcag

SEQ ID NO: 2460162 - DNA, 16 bp, Homo sapiens
aaggcctaggattcta

SEQ ID NO: 2460163 - DNA, 18 bp, Homo sapiens
aaggcctaggattctaaa

SEQ ID NO: 2460164 - DNA, 11 bp, Homo sapiens
aaggcctgggg

SEQ ID NO: 2460165 - DNA, 20 bp, Homo sapiens
aaggctacttcggggctggg

SEQ ID NO: 2460166 - DNA, 23 bp, Homo sapiens
aaggctacttcggggctgggaag

SEQ ID NO: 2460167 - DNA, 13 bp, Homo sapiens
aaggctctagatc

SEQ ID NO: 2460168 - DNA, 20 bp, Homo sapiens
aaggctctatgagtctagat

SEQ ID NO: 2460169 - DNA, 21 bp, Homo sapiens
aaggctgtgtaagatttgttt

SEQ ID NO: 2460170 - DNA, 19 bp, Homo sapiens
aaggcttgggatttgctgt

SEQ ID NO: 2460171 - DNA, 9 bp, Homo sapiens
aagggagcc

SEQ ID NO: 2460172 - DNA, 18 bp, Homo sapiens
aagggagggcagagctgg

SEQ ID NO: 2460173 - DNA, 19 bp, Homo sapiens
aagggagggcagagctggt

SEQ ID NO: 2460174 - DNA, 20 bp, Homo sapiens
aagggagggcagagctggtg

SEQ ID NO: 2460175 - DNA, 21 bp, Homo sapiens
aagggagggcagagctggtgc

SEQ ID NO: 2460176 - DNA, 14 bp, Homo sapiens
aagggagggctctg

SEQ ID NO: 2460177 - DNA, 16 bp, Homo sapiens
aagggagtctgccagg

SEQ ID NO: 2460178 - DNA, 16 bp, Homo sapiens
aagggatggacatctt

SEQ ID NO: 2460179 - DNA, 17 bp, Homo sapiens
aagggatggacatcttg

SEQ ID NO: 2460180 - DNA, 22 bp, Homo sapiens
aagggcaacagatcagtaaaga

SEQ ID NO: 2460181 - DNA, 11 bp, Homo sapiens
aagggccagag

SEQ ID NO: 2460182 - DNA, 16 bp, Homo sapiens
aagggccagagccagg

SEQ ID NO: 2460183 - DNA, 14 bp, Homo sapiens
aaggggcctgagca

SEQ ID NO: 2460184 - DNA, 13 bp, Homo sapiens
aagggtcaggcct

SEQ ID NO: 2460185 - DNA, 16 bp, Homo sapiens
aagggtcaggcctttg

SEQ ID NO: 2460186 - DNA, 22 bp, Homo sapiens
aaggtaaaatgccatgatgcct

SEQ ID NO: 2460187 - DNA, 16 bp, Homo sapiens
aaggtaaataaaaaga

SEQ ID NO: 2460188 - DNA, 13 bp, Homo sapiens
aaggtggggtgga

SEQ ID NO: 2460189 - DNA, 15 bp, Homo sapiens
aaggtggtgtttctg

SEQ ID NO: 2460190 - DNA, 15 bp, Homo sapiens
aaggttatcagtgct

SEQ ID NO: 2460191 - DNA, 18 bp, Homo sapiens
aaggttatcagtgcttcc

SEQ ID NO: 2460192 - DNA, 17 bp, Homo sapiens
aaggttcccgttgcatt

SEQ ID NO: 2460193 - DNA, 11 bp, Homo sapiens
aaggttctaag

SEQ ID NO: 2460194 - DNA, 20 bp, Homo sapiens
aaggtttaaagagtctagat

SEQ ID NO: 2460195 - DNA, 18 bp, Homo sapiens
acccccctttcacaggca

SEQ ID NO: 2460196 - DNA, 21 bp, Homo sapiens
acccccctttcacaggcagcc

SEQ ID NO: 2460197 - DNA, 18 bp, Homo sapiens
acccccttctccatccac

SEQ ID NO: 2460198 - DNA, 18 bp, Homo sapiens
accccgcagacaccttgg

SEQ ID NO: 2460199 - DNA, 20 bp, Homo sapiens
accccgcagacaccttggac

SEQ ID NO: 2460200 - DNA, 13 bp, Homo sapiens
accccggggtgag

SEQ ID NO: 2460201 - DNA, 14 bp, Homo sapiens
acccctcccctcca

SEQ ID NO: 2460202 - DNA, 20 bp, Homo sapiens
acccctcccctccatccctg

SEQ ID NO: 2460203 - DNA, 10 bp, Homo sapiens
acccctgcat

SEQ ID NO: 2460204 - DNA, 23 bp, Homo sapiens
acccctgcattggaactggaggc

SEQ ID NO: 2460205 - DNA, 17 bp, Homo sapiens
acccctgtaggcctcag

SEQ ID NO: 2460206 - DNA, 13 bp, Homo sapiens
acccctgtttctg

SEQ ID NO: 2460207 - DNA, 19 bp, Homo sapiens
acccctttctagaccaata

SEQ ID NO: 2460208 - DNA, 21 bp, Homo sapiens
acccctttctagaccaataaa

SEQ ID NO: 2460209 - DNA, 21 bp, Homo sapiens
acccgagtcattcgttctgtg

SEQ ID NO: 2460210 - DNA, 23 bp, Homo sapiens
acccgattccaccaaatgtgctt

SEQ ID NO: 2460211 - DNA, 15 bp, Homo sapiens
acccgccccactccc

SEQ ID NO: 2460212 - DNA, 18 bp, Homo sapiens
acccggcaccccctgcag

SEQ ID NO: 2460213 - DNA, 19 bp, Homo sapiens
acccggcaccccctgcagc

SEQ ID NO: 2460214 - DNA, 22 bp, Homo sapiens
acccgtgccaagtccaggtcct

SEQ ID NO: 2460215 - DNA, 17 bp, Homo sapiens
acccgttcatgggggag

SEQ ID NO: 2460216 - DNA, 18 bp, Homo sapiens
acccgttcatgggggagg

SEQ ID NO: 2460217 - DNA, 12 bp, Homo sapiens
accctagccttg

SEQ ID NO: 2460218 - DNA, 15 bp, Homo sapiens
accctagccttgctt

SEQ ID NO: 2460219 - DNA, 21 bp, Homo sapiens
accctagttctacctcaggca

SEQ ID NO: 2460220 - DNA, 19 bp, Homo sapiens
accctcagggcaaagccag

SEQ ID NO: 2460221 - DNA, 17 bp, Homo sapiens
accctcggggatgtgtc

SEQ ID NO: 2460222 - DNA, 23 bp, Homo sapiens
accctcggggatgtgtcctgaca

SEQ ID NO: 2460223 - DNA, 15 bp, Homo sapiens
accctctcagctcca

SEQ ID NO: 2460224 - DNA, 16 bp, Homo sapiens
accctctgaaatacat

SEQ ID NO: 2460225 - DNA, 23 bp, Homo sapiens
accctctggaggggtgtggctcc

SEQ ID NO: 2460226 - DNA, 14 bp, Homo sapiens
accctctgttcctt

SEQ ID NO: 2460227 - DNA, 15 bp, Homo sapiens
accctcttcctactg

SEQ ID NO: 2460228 - DNA, 17 bp, Homo sapiens
accctgaaggggccatg

SEQ ID NO: 2460229 - DNA, 18 bp, Homo sapiens
accctgaaggggccatga

SEQ ID NO: 2460230 - DNA, 17 bp, Homo sapiens
accctgaccagctcccc

SEQ ID NO: 2460231 - DNA, 13 bp, Homo sapiens
accctgacctggc

SEQ ID NO: 2460232 - DNA, 20 bp, Homo sapiens
accctgacctggccccctca

SEQ ID NO: 2460233 - DNA, 22 bp, Homo sapiens
accctgagctgaccagccgtga

SEQ ID NO: 2460234 - DNA, 13 bp, Homo sapiens
accctgaggagtc

SEQ ID NO: 2460235 - DNA, 23 bp, Homo sapiens
accctgaggagtctgaggtcctg

SEQ ID NO: 2460236 - DNA, 19 bp, Homo sapiens
accctgagttgcttttcag

SEQ ID NO: 2460237 - DNA, 23 bp, Homo sapiens
accctgatttaggagaagccagg

SEQ ID NO: 2460238 - DNA, 21 bp, Homo sapiens
accctgcccttgtttggggca

SEQ ID NO: 2460239 - DNA, 13 bp, Homo sapiens
accctgcctctcc

SEQ ID NO: 2460240 - DNA, 20 bp, Homo sapiens
accctgcctctcccaggcag

SEQ ID NO: 2460241 - DNA, 23 bp, Homo sapiens
accctgcctctcccaggcagggg

SEQ ID NO: 2460242 - DNA, 12 bp, Homo sapiens
accctggaggca

SEQ ID NO: 2460243 - DNA, 15 bp, Homo sapiens
accctggcccctctc

SEQ ID NO: 2460244 - DNA, 16 bp, Homo sapiens
accctggcccctctcc

SEQ ID NO: 2460245 - DNA, 17 bp, Homo sapiens
accctggcccctctccc

SEQ ID NO: 2460246 - DNA, 21 bp, Homo sapiens
accctggccgagtccaagctg

SEQ ID NO: 2460247 - DNA, 22 bp, Homo sapiens
accctggccgccccctgccccc

SEQ ID NO: 2460248 - DNA, 14 bp, Homo sapiens
accctgggccctgg

SEQ ID NO: 2460249 - DNA, 17 bp, Homo sapiens
accctgggccctgggct

SEQ ID NO: 2460250 - DNA, 20 bp, Homo sapiens
accctgggccctgggctgga

SEQ ID NO: 2460251 - DNA, 13 bp, Homo sapiens
accctgtctgccc

SEQ ID NO: 2460252 - DNA, 15 bp, Homo sapiens
accctgttcctgctg

SEQ ID NO: 2460253 - DNA, 17 bp, Homo sapiens
accctgttcctgctgct

SEQ ID NO: 2460254 - DNA, 17 bp, Homo sapiens
acccttgggccagaagt

SEQ ID NO: 2460255 - DNA, 19 bp, Homo sapiens
accctttgtgtgctctcca

SEQ ID NO: 2460256 - DNA, 23 bp, Homo sapiens
accctttgtgtgctctccattct

SEQ ID NO: 2460257 - DNA, 11 bp, Homo sapiens
acccttttcat

SEQ ID NO: 2460258 - DNA, 12 bp, Homo sapiens
acccttttccag

SEQ ID NO: 2460259 - DNA, 11 bp, Homo sapiens
accgccccctc

SEQ ID NO: 2460260 - DNA, 14 bp, Homo sapiens
accgccccctcctc

SEQ ID NO: 2460261 - DNA, 19 bp, Homo sapiens
accgccccctgtctctcag

SEQ ID NO: 2460262 - DNA, 19 bp, Homo sapiens
accgcgtctaccctgggat

SEQ ID NO: 2460263 - DNA, 16 bp, Homo sapiens
accgctaaaagaaact

SEQ ID NO: 2460264 - DNA, 19 bp, Homo sapiens
accgctacaccactctggc

SEQ ID NO: 2460265 - DNA, 15 bp, Homo sapiens
accggacttttctgc

SEQ ID NO: 2460266 - DNA, 16 bp, Homo sapiens
accggacttttctgca

SEQ ID NO: 2460267 - DNA, 12 bp, Homo sapiens
accgggccactc

SEQ ID NO: 2460268 - DNA, 12 bp, Homo sapiens
accgtttcttcc

SEQ ID NO: 2460269 - DNA, 18 bp, Homo sapiens
acctaactcttctttcat

SEQ ID NO: 2460270 - DNA, 11 bp, Homo sapiens
acctacagttt

SEQ ID NO: 2460271 - DNA, 15 bp, Homo sapiens
acctacctgttgagc

SEQ ID NO: 2460272 - DNA, 24 bp, Homo sapiens
acctacctgttgagcatcacagaa

SEQ ID NO: 2460273 - DNA, 14 bp, Homo sapiens
acctactcacacag

SEQ ID NO: 2460274 - DNA, 16 bp, Homo sapiens
acctactcacacaggc

SEQ ID NO: 2460275 - DNA, 17 bp, Homo sapiens
acctactcacacaggca

SEQ ID NO: 2460276 - DNA, 15 bp, Homo sapiens
acctactgttctaaa

SEQ ID NO: 2460277 - DNA, 16 bp, Homo sapiens
acctactgttctaaag

SEQ ID NO: 2460278 - DNA, 17 bp, Homo sapiens
acctactgttctaaagc

SEQ ID NO: 2460279 - DNA, 13 bp, Homo sapiens
acctcagaagtaa

SEQ ID NO: 2460280 - DNA, 20 bp, Homo sapiens
acctcagaagtaaaggaatt

SEQ ID NO: 2460281 - DNA, 14 bp, Homo sapiens
acctcagatggcag

SEQ ID NO: 2460282 - DNA, 15 bp, Homo sapiens
acctcagatggcagc

SEQ ID NO: 2460283 - DNA, 20 bp, Homo sapiens
acctcagatggcagctttta

SEQ ID NO: 2460284 - DNA, 20 bp, Homo sapiens
acctcagcctggccagacac

SEQ ID NO: 2460285 - DNA, 17 bp, Homo sapiens
acctcagcctgggcgct

SEQ ID NO: 2460286 - DNA, 16 bp, Homo sapiens
acctcaggcagctcaa

SEQ ID NO: 2460287 - DNA, 14 bp, Homo sapiens
acctccacatcctc

SEQ ID NO: 2460288 - DNA, 16 bp, Homo sapiens
acctccagctttcctg

SEQ ID NO: 2460289 - DNA, 14 bp, Homo sapiens
acctcccttgggca

SEQ ID NO: 2460290 - DNA, 13 bp, Homo sapiens
acctcctgagaaa

SEQ ID NO: 2460291 - DNA, 18 bp, Homo sapiens
acctccttccctctctgg

SEQ ID NO: 2460292 - DNA, 22 bp, Homo sapiens
acctccttccctctctggagaa

SEQ ID NO: 2460293 - DNA, 23 bp, Homo sapiens
acctcgcccagcggcatcaggct

SEQ ID NO: 2460294 - DNA, 16 bp, Homo sapiens
acctcgctggactctc

SEQ ID NO: 2460295 - DNA, 19 bp, Homo sapiens
acctctaggtccccatact

SEQ ID NO: 2460296 - DNA, 15 bp, Homo sapiens
acctctgacagcagc

SEQ ID NO: 2460297 - DNA, 17 bp, Homo sapiens
acctctgacagcagcat

SEQ ID NO: 2460298 - DNA, 11 bp, Homo sapiens
acctgaaaaca

SEQ ID NO: 2460299 - DNA, 16 bp, Homo sapiens
actaaaataattttgt

SEQ ID NO: 2460300 - DNA, 19 bp, Homo sapiens
actaaaataattttgtaat

SEQ ID NO: 2460301 - DNA, 19 bp, Homo sapiens
actaaactttttttctgta

SEQ ID NO: 2460302 - DNA, 20 bp, Homo sapiens
actaaactttttttctgtac

SEQ ID NO: 2460303 - DNA, 17 bp, Homo sapiens
actaaagcaggcctttt

SEQ ID NO: 2460304 - DNA, 12 bp, Homo sapiens
actaaagccttt

SEQ ID NO: 2460305 - DNA, 15 bp, Homo sapiens
actaaatcttttata

SEQ ID NO: 2460306 - DNA, 15 bp, Homo sapiens
actaaatgccctgct

SEQ ID NO: 2460307 - DNA, 15 bp, Homo sapiens
ttccctatccaatca

SEQ ID NO: 2460308 - DNA, 20 bp, Homo sapiens
ttccctcactcgtctccccc

SEQ ID NO: 2460309 - DNA, 21 bp, Homo sapiens
ttccctcactcgtctccccca

SEQ ID NO: 2460310 - DNA, 13 bp, Homo sapiens
ttccctctctgga

SEQ ID NO: 2460311 - DNA, 16 bp, Homo sapiens
ttccctgactcattct

SEQ ID NO: 2460312 - DNA, 18 bp, Homo sapiens
ttccctgttttcccccca

SEQ ID NO: 2460313 - DNA, 23 bp, Homo sapiens
ttcccttcagtaccctctcagct

SEQ ID NO: 2460314 - DNA, 15 bp, Homo sapiens
ttcccttcctgccag

SEQ ID NO: 2460315 - DNA, 20 bp, Homo sapiens
ttcccttgtagctcctcccc

SEQ ID NO: 2460316 - DNA, 14 bp, Homo sapiens
ttcccttttctgtt

SEQ ID NO: 2460317 - DNA, 15 bp, Homo sapiens
ttccgccactggggc

SEQ ID NO: 2460318 - DNA, 13 bp, Homo sapiens
ttccgcttggagc

SEQ ID NO: 2460319 - DNA, 22 bp, Homo sapiens
ttccggatcctaagcatctaag

SEQ ID NO: 2460320 - DNA, 18 bp, Homo sapiens
ttccggcccctcccctcc

SEQ ID NO: 2460321 - DNA, 21 bp, Homo sapiens
ttccgtcaccacgactggcca

SEQ ID NO: 2460322 - DNA, 15 bp, Homo sapiens
ttccgtgtccacccc

SEQ ID NO: 2460323 - DNA, 17 bp, Homo sapiens
ttccgtgtccaccccca

SEQ ID NO: 2460324 - DNA, 15 bp, Homo sapiens
ttcctaataaagttc

SEQ ID NO: 2460325 - DNA, 19 bp, Homo sapiens
ttcctaccaagtcaaactt

SEQ ID NO: 2460326 - DNA, 19 bp, Homo sapiens
ttcctagagaagacaggct

SEQ ID NO: 2460327 - DNA, 19 bp, Homo sapiens
ttcctatacgcagcgtgct

SEQ ID NO: 2460328 - DNA, 14 bp, Homo sapiens
ttcctatgctttga

SEQ ID NO: 2460329 - DNA, 18 bp, Homo sapiens
ttcctcagactctaagaa

SEQ ID NO: 2460330 - DNA, 17 bp, Homo sapiens
ttcctcatgaatgtaaa

SEQ ID NO: 2460331 - DNA, 18 bp, Homo sapiens
ttcctcatgaatgtaaat

SEQ ID NO: 2460332 - DNA, 16 bp, Homo sapiens
ttcctcctccccactt

SEQ ID NO: 2460333 - DNA, 13 bp, Homo sapiens
ttcctcctggaaa

SEQ ID NO: 2460334 - DNA, 11 bp, Homo sapiens
ttcctcctggg

SEQ ID NO: 2460335 - DNA, 17 bp, Homo sapiens
ttcctctagttctttgt

SEQ ID NO: 2460336 - DNA, 16 bp, Homo sapiens
ttcctctcgcggccct

SEQ ID NO: 2460337 - DNA, 21 bp, Homo sapiens
ttcctctcgcggccctcagta

SEQ ID NO: 2460338 - DNA, 22 bp, Homo sapiens
ttcctctgttcaaagctgcctg

SEQ ID NO: 2460339 - DNA, 19 bp, Homo sapiens
ttcctgaagaaccagtccc

SEQ ID NO: 2460340 - DNA, 20 bp, Homo sapiens
ttcctgccagcccctgccat

SEQ ID NO: 2460341 - DNA, 13 bp, Homo sapiens
ttcctgcttgcca

SEQ ID NO: 2460342 - DNA, 15 bp, Homo sapiens
ttcctggacactcag

SEQ ID NO: 2460343 - DNA, 11 bp, Homo sapiens
ttcctggtgct

SEQ ID NO: 2460344 - DNA, 21 bp, Homo sapiens
ttcctgtatttgttcccaaga

SEQ ID NO: 2460345 - DNA, 22 bp, Homo sapiens
ttcctgtatttgttcccaagag

SEQ ID NO: 2460346 - DNA, 16 bp, Homo sapiens
ttcctgtccagctcca

SEQ ID NO: 2460347 - DNA, 13 bp, Homo sapiens
ttcctgtggctcc

SEQ ID NO: 2460348 - DNA, 20 bp, Homo sapiens
ttccttactttttatatata

SEQ ID NO: 2460349 - DNA, 21 bp, Homo sapiens
ttccttcagagagcagtgctt

SEQ ID NO: 2460350 - DNA, 22 bp, Homo sapiens
ttccttcagagagcagtgcttt

SEQ ID NO: 2460351 - DNA, 12 bp, Homo sapiens
ttccttcagatt

SEQ ID NO: 2460352 - DNA, 19 bp, Homo sapiens
ttccttcccttttctgttc

SEQ ID NO: 2460353 - DNA, 22 bp, Homo sapiens
ttcctttaacaacatgtttcca

SEQ ID NO: 2460354 - DNA, 18 bp, Homo sapiens
ttcgcagccaccctgagg

SEQ ID NO: 2460355 - DNA, 19 bp, Homo sapiens
ttcgcagccaccctgagga

SEQ ID NO: 2460356 - DNA, 22 bp, Homo sapiens
ttcgcagtccacttctgacagc

SEQ ID NO: 2460357 - DNA, 14 bp, Homo sapiens
ttcgcatggtcaca

SEQ ID NO: 2460358 - DNA, 18 bp, Homo sapiens
ttcgcatggtcacacact

SEQ ID NO: 2460359 - DNA, 21 bp, Homo sapiens
ttcgcatggtcacacactgat

SEQ ID NO: 2460360 - DNA, 14 bp, Homo sapiens
ttcgctctttgaga

SEQ ID NO: 2460361 - DNA, 12 bp, Homo sapiens
ttcgggctgtgc

SEQ ID NO: 2460362 - DNA, 13 bp, Homo sapiens
ttcgggctgtgcc

SEQ ID NO: 2460363 - DNA, 13 bp, Homo sapiens
ttcggtgtgcacc

SEQ ID NO: 2460364 - DNA, 15 bp, Homo sapiens
ttcgtagatattgga

SEQ ID NO: 2460365 - DNA, 12 bp, Homo sapiens
ttcgttctgtgg

SEQ ID NO: 2460366 - DNA, 18 bp, Homo sapiens
ttctaaaaattgtgatca

SEQ ID NO: 2460367 - DNA, 20 bp, Homo sapiens
ttctaaaatcttatagttct

SEQ ID NO: 2460368 - DNA, 22 bp, Homo sapiens
ttctaaaatcttatagttctag

SEQ ID NO: 2460369 - DNA, 19 bp, Homo sapiens
ttctaaacccaatccaaat

SEQ ID NO: 2460370 - DNA, 23 bp, Homo sapiens
ttctaaagattctatagttctag

SEQ ID NO: 2460371 - DNA, 16 bp, Homo sapiens
ttctaaaggagtttat

SEQ ID NO: 2460372 - DNA, 23 bp, Homo sapiens
ttctaaaggagtttatgttccat

SEQ ID NO: 2460373 - DNA, 12 bp, Homo sapiens
ttctaaagttct

SEQ ID NO: 2460374 - DNA, 13 bp, Homo sapiens
ttctaaagttcta

SEQ ID NO: 2460375 - DNA, 16 bp, Homo sapiens
ttctaaagttctaaga

SEQ ID NO: 2460376 - DNA, 15 bp, Homo sapiens
ttctaaatgaatgtt

SEQ ID NO: 2460377 - DNA, 14 bp, Homo sapiens
ttctaacctttaca

SEQ ID NO: 2460378 - DNA, 23 bp, Homo sapiens
ttctaactacaaaggtttaaatg

SEQ ID NO: 2460379 - DNA, 20 bp, Homo sapiens
ttctaagaaacatttatatt

SEQ ID NO: 2460380 - DNA, 12 bp, Homo sapiens
ttctaagactca

SEQ ID NO: 2460381 - DNA, 21 bp, Homo sapiens
ttctaagacttactctaagat

SEQ ID NO: 2460382 - DNA, 22 bp, Homo sapiens
ttctaagatgtgatattctaag

SEQ ID NO: 2460383 - DNA, 12 bp, Homo sapiens
ttctaagattct

SEQ ID NO: 2460384 - DNA, 13 bp, Homo sapiens
ttctaagattcta

SEQ ID NO: 2460385 - DNA, 16 bp, Homo sapiens
ttctaagattctaaag

SEQ ID NO: 2460386 - DNA, 23 bp, Homo sapiens
ttctaaggacctgaaattccaaa

SEQ ID NO: 2460387 - DNA, 15 bp, Homo sapiens
ttctaaggcctagga

SEQ ID NO: 2460388 - DNA, 13 bp, Homo sapiens
ttctaaggctctg

SEQ ID NO: 2460389 - DNA, 17 bp, Homo sapiens
ttctaaggctctgagag

SEQ ID NO: 2460390 - DNA, 20 bp, Homo sapiens
ttctaaggtccggtgttcta

SEQ ID NO: 2460391 - DNA, 16 bp, Homo sapiens
ttctaagtaaatacaa

SEQ ID NO: 2460392 - DNA, 17 bp, Homo sapiens
ttctaagtaaatacaat

SEQ ID NO: 2460393 - DNA, 13 bp, Homo sapiens
ttctaagtttcta

SEQ ID NO: 2460394 - DNA, 16 bp, Homo sapiens
ttctaagtttctaaga

SEQ ID NO: 2460395 - DNA, 17 bp, Homo sapiens
ttctaagtttctaagat

SEQ ID NO: 2460396 - DNA, 18 bp, Homo sapiens
ttctaagtttctaagatt

SEQ ID NO: 2460397 - DNA, 20 bp, Homo sapiens
ttctaagtttctaagattct

SEQ ID NO: 2460398 - DNA, 15 bp, Homo sapiens
ttctaataatttcta

SEQ ID NO: 2460399 - DNA, 16 bp, Homo sapiens
ttctaataatttctaa

SEQ ID NO: 2460400 - DNA, 19 bp, Homo sapiens
ttctaataatttctaatgt

SEQ ID NO: 2460401 - DNA, 16 bp, Homo sapiens
ttctaattatgtagct

SEQ ID NO: 2460402 - DNA, 12 bp, Homo sapiens
ttctagaaaaac

SEQ ID NO: 2460403 - DNA, 16 bp, Homo sapiens
tgcaagcacagccctt

SEQ ID NO: 2460404 - DNA, 14 bp, Homo sapiens
tgcaaggcagccgt

SEQ ID NO: 2460405 - DNA, 15 bp, Homo sapiens
tgcaaggcagccgtg

SEQ ID NO: 2460406 - DNA, 16 bp, Homo sapiens
tgcaaggcagccgtgg

SEQ ID NO: 2460407 - DNA, 18 bp, Homo sapiens
tgcaaggcagccgtgggc

SEQ ID NO: 2460408 - DNA, 20 bp, Homo sapiens
tgcaagtatactagggagcc

SEQ ID NO: 2460409 - DNA, 16 bp, Homo sapiens
tgcaagtttatcagta

SEQ ID NO: 2460410 - DNA, 14 bp, Homo sapiens
tgcaatacatacca

SEQ ID NO: 2460411 - DNA, 15 bp, Homo sapiens
tgcaatcccttaata

SEQ ID NO: 2460412 - DNA, 13 bp, Homo sapiens
tgcaatgtgtata

SEQ ID NO: 2460413 - DNA, 21 bp, Homo sapiens
tgcaatgtgtataaacaagaa

SEQ ID NO: 2460414 - DNA, 19 bp, Homo sapiens
tgcaatgtgtgtatatgga

SEQ ID NO: 2460415 - DNA, 14 bp, Homo sapiens
tgcaattcaaaagt

SEQ ID NO: 2460416 - DNA, 16 bp, Homo sapiens
tgcaattcaaaagttc

SEQ ID NO: 2460417 - DNA, 14 bp, Homo sapiens
tgcaattcccctct

SEQ ID NO: 2460418 - DNA, 12 bp, Homo sapiens
tgcaatttcaag

SEQ ID NO: 2460419 - DNA, 13 bp, Homo sapiens
tgcaatttcaagg

SEQ ID NO: 2460420 - DNA, 14 bp, Homo sapiens
tgcacaagaatgga

SEQ ID NO: 2460421 - DNA, 16 bp, Homo sapiens
tgcacaagaatggatc

SEQ ID NO: 2460422 - DNA, 20 bp, Homo sapiens
tgcacaagaatggatcacaa

SEQ ID NO: 2460423 - DNA, 16 bp, Homo sapiens
tgcacaccccactccc

SEQ ID NO: 2460424 - DNA, 18 bp, Homo sapiens
tgcacaccccactcccac

SEQ ID NO: 2460425 - DNA, 13 bp, Homo sapiens
tgcacactttggt

SEQ ID NO: 2460426 - DNA, 22 bp, Homo sapiens
tgcacagcacaaattagttata

SEQ ID NO: 2460427 - DNA, 12 bp, Homo sapiens
tgcacaggaggg

SEQ ID NO: 2460428 - DNA, 19 bp, Homo sapiens
tgcacagtatttgtaatta

SEQ ID NO: 2460429 - DNA, 17 bp, Homo sapiens
tgcacagtcactgctct

SEQ ID NO: 2460430 - DNA, 16 bp, Homo sapiens
tgcacagtgacttctg

SEQ ID NO: 2460431 - DNA, 18 bp, Homo sapiens
tgcacatctgtgtcttgt

SEQ ID NO: 2460432 - DNA, 21 bp, Homo sapiens
tgcacatgaacttagatttta

SEQ ID NO: 2460433 - DNA, 14 bp, Homo sapiens
tgcacatgtttcct

SEQ ID NO: 2460434 - DNA, 17 bp, Homo sapiens
tgcacatgtttcctcta

SEQ ID NO: 2460435 - DNA, 18 bp, Homo sapiens
tgcacatgtttcctctag

SEQ ID NO: 2460436 - DNA, 13 bp, Homo sapiens
tgcacatttattt

SEQ ID NO: 2460437 - DNA, 12 bp, Homo sapiens
tgcaccaccaag

SEQ ID NO: 2460438 - DNA, 15 bp, Homo sapiens
tgcaccaccaagcca

SEQ ID NO: 2460439 - DNA, 19 bp, Homo sapiens
tgcaccaccaagccaaggg

SEQ ID NO: 2460440 - DNA, 23 bp, Homo sapiens
tgcaccatgctgctggggaagac

SEQ ID NO: 2460441 - DNA, 13 bp, Homo sapiens
tgcacctaaagaa

SEQ ID NO: 2460442 - DNA, 16 bp, Homo sapiens
tgcacctaaagaaaaa

SEQ ID NO: 2460443 - DNA, 19 bp, Homo sapiens
tgcacctaaagaaaaacaa

SEQ ID NO: 2460444 - DNA, 21 bp, Homo sapiens
tgcacctaaagaaaaacaaac

SEQ ID NO: 2460445 - DNA, 16 bp, Homo sapiens
tgcacgtaaagtactt

SEQ ID NO: 2460446 - DNA, 19 bp, Homo sapiens
tgcacgtaaagtacttgta

SEQ ID NO: 2460447 - DNA, 15 bp, Homo sapiens
tgcacgtgtgttttt

SEQ ID NO: 2460448 - DNA, 18 bp, Homo sapiens
tgcacgtgtgtttttcta

SEQ ID NO: 2460449 - DNA, 14 bp, Homo sapiens
tgcactactgacat

SEQ ID NO: 2460450 - DNA, 15 bp, Homo sapiens
tgcactatctttcag

SEQ ID NO: 2460451 - DNA, 16 bp, Homo sapiens
tgcactatctttcagc

SEQ ID NO: 2460452 - DNA, 14 bp, Homo sapiens
tgcactcaacctta

SEQ ID NO: 2460453 - DNA, 14 bp, Homo sapiens
tgcactcccacctg

SEQ ID NO: 2460454 - DNA, 19 bp, Homo sapiens
tgcactcccacctgacaca

SEQ ID NO: 2460455 - DNA, 17 bp, Homo sapiens
tgcactgatgctgcccc

SEQ ID NO: 2460456 - DNA, 22 bp, Homo sapiens
tgcactgatgctgcccctcatc

SEQ ID NO: 2460457 - DNA, 21 bp, Homo sapiens
tgcactgggaggctccccttc

SEQ ID NO: 2460458 - DNA, 13 bp, Homo sapiens
tgcactgttcccc

SEQ ID NO: 2460459 - DNA, 23 bp, Homo sapiens
tgcactgttccccctgtgcagcc

SEQ ID NO: 2460460 - DNA, 15 bp, Homo sapiens
tgcacttcaaattca

SEQ ID NO: 2460461 - DNA, 22 bp, Homo sapiens
tgcacttgcggttccggcatgg

SEQ ID NO: 2460462 - DNA, 12 bp, Homo sapiens
tgcactttgctt

SEQ ID NO: 2460463 - DNA, 17 bp, Homo sapiens
tgcactttgctttaata

SEQ ID NO: 2460464 - DNA, 17 bp, Homo sapiens
tgcagaaaattctgtgc

SEQ ID NO: 2460465 - DNA, 15 bp, Homo sapiens
tgcagacaggaatct

SEQ ID NO: 2460466 - DNA, 18 bp, Homo sapiens
tgcagacaggaatcttaa

SEQ ID NO: 2460467 - DNA, 20 bp, Homo sapiens
tgcagacaggaatcttaagg

SEQ ID NO: 2460468 - DNA, 12 bp, Homo sapiens
tgcagcctcaga

SEQ ID NO: 2460469 - DNA, 13 bp, Homo sapiens
tgcagcctcagga

SEQ ID NO: 2460470 - DNA, 17 bp, Homo sapiens
tgcagcctcaggactgg

SEQ ID NO: 2460471 - DNA, 19 bp, Homo sapiens
tgcagcctcaggactggga

SEQ ID NO: 2460472 - DNA, 21 bp, Homo sapiens
tgcagcctcaggactgggagc

SEQ ID NO: 2460473 - DNA, 22 bp, Homo sapiens
tgcagcctcaggactgggagcc

SEQ ID NO: 2460474 - DNA, 14 bp, Homo sapiens
tgcagcctgcgcca

SEQ ID NO: 2460475 - DNA, 15 bp, Homo sapiens
tgcagctgttttgtt

SEQ ID NO: 2460476 - DNA, 18 bp, Homo sapiens
tgcagctgttttgttgac

SEQ ID NO: 2460477 - DNA, 21 bp, Homo sapiens
tgcagctgttttgttgacatt

SEQ ID NO: 2460478 - DNA, 14 bp, Homo sapiens
tgcagcttgtagcc

SEQ ID NO: 2460479 - DNA, 18 bp, Homo sapiens
tgcagcttgtagccagcc

SEQ ID NO: 2460480 - DNA, 15 bp, Homo sapiens
tgcccctctccttct

SEQ ID NO: 2460481 - DNA, 17 bp, Homo sapiens
tgccccttccgccactg

SEQ ID NO: 2460482 - DNA, 21 bp, Homo sapiens
tgccccttccgccactggggc

SEQ ID NO: 2460483 - DNA, 20 bp, Homo sapiens
tgccccttgacaactggcag

SEQ ID NO: 2460484 - DNA, 20 bp, Homo sapiens
tgccccttggacacgctcag

SEQ ID NO: 2460485 - DNA, 14 bp, Homo sapiens
tgcccctttctgga

SEQ ID NO: 2460486 - DNA, 18 bp, Homo sapiens
tgcccggggaaaggcaag

SEQ ID NO: 2460487 - DNA, 15 bp, Homo sapiens
tgccctaagcagaaa

SEQ ID NO: 2460488 - DNA, 20 bp, Homo sapiens
tgccctaagcagaaagtgcc

SEQ ID NO: 2460489 - DNA, 19 bp, Homo sapiens
tgccctatcacccaacgct

SEQ ID NO: 2460490 - DNA, 17 bp, Homo sapiens
tgccctcatggcccctc

SEQ ID NO: 2460491 - DNA, 23 bp, Homo sapiens
tgccctcatggcccctctgacct

SEQ ID NO: 2460492 - DNA, 16 bp, Homo sapiens
tgccctctcccaccct

SEQ ID NO: 2460493 - DNA, 20 bp, Homo sapiens
tgccctctgcatcctctgga

SEQ ID NO: 2460494 - DNA, 15 bp, Homo sapiens
tgccctctgggctct

SEQ ID NO: 2460495 - DNA, 22 bp, Homo sapiens
tgccctggtggccctctcccct

SEQ ID NO: 2460496 - DNA, 24 bp, Homo sapiens
tgcccttgtttggggcaggagtag

SEQ ID NO: 2460497 - DNA, 20 bp, Homo sapiens
tgccgagcaaccgtggccct

SEQ ID NO: 2460498 - DNA, 14 bp, Homo sapiens
tgccgtaatttaac

SEQ ID NO: 2460499 - DNA, 18 bp, Homo sapiens
tgcctagaaacaacactg

SEQ ID NO: 2460500 - DNA, 14 bp, Homo sapiens
tgcctaggcctggg

SEQ ID NO: 2460501 - DNA, 17 bp, Homo sapiens
tgcctattgctagagct

SEQ ID NO: 2460502 - DNA, 20 bp, Homo sapiens
tgcctattgctagagctcct

SEQ ID NO: 2460503 - DNA, 12 bp, Homo sapiens
tgcctcaaataa

SEQ ID NO: 2460504 - DNA, 14 bp, Homo sapiens
tgcctcaacctccc

SEQ ID NO: 2460505 - DNA, 14 bp, Homo sapiens
tgcctcagagacca

SEQ ID NO: 2460506 - DNA, 16 bp, Homo sapiens
tgcctcagagaccagg

SEQ ID NO: 2460507 - DNA, 18 bp, Homo sapiens
tgcctcagagaccagggc

SEQ ID NO: 2460508 - DNA, 23 bp, Homo sapiens
tgcctcagccacttgcctgtgct

SEQ ID NO: 2460509 - DNA, 16 bp, Homo sapiens
tgcctcatttttttcc

SEQ ID NO: 2460510 - DNA, 18 bp, Homo sapiens
tgcctccccggctcgagc

SEQ ID NO: 2460511 - DNA, 13 bp, Homo sapiens
tgcctccctgagc

SEQ ID NO: 2460512 - DNA, 14 bp, Homo sapiens
tgcctccctgagct

SEQ ID NO: 2460513 - DNA, 23 bp, Homo sapiens
tgcctccgtcccctgcccatgct

SEQ ID NO: 2460514 - DNA, 23 bp, Homo sapiens
tgcctcgaaacacagaaaccttt

SEQ ID NO: 2460515 - DNA, 23 bp, Homo sapiens
tgcctctacctgacactcccttg

SEQ ID NO: 2460516 - DNA, 16 bp, Homo sapiens
tgcctctcccaggcag

SEQ ID NO: 2460517 - DNA, 12 bp, Homo sapiens
tgcctctctagg

SEQ ID NO: 2460518 - DNA, 12 bp, Homo sapiens
tgcctctgaggc

SEQ ID NO: 2460519 - DNA, 15 bp, Homo sapiens
tgcctctgaggccag

SEQ ID NO: 2460520 - DNA, 16 bp, Homo sapiens
tgcctctgaggccagc

SEQ ID NO: 2460521 - DNA, 23 bp, Homo sapiens
tgcctctgaggccagcctggcct

SEQ ID NO: 2460522 - DNA, 17 bp, Homo sapiens
tgcctctgtgctgtgtg

SEQ ID NO: 2460523 - DNA, 14 bp, Homo sapiens
tgcctcttcattct

SEQ ID NO: 2460524 - DNA, 16 bp, Homo sapiens
tgcctgacacactaac

SEQ ID NO: 2460525 - DNA, 21 bp, Homo sapiens
tgcctgactagggagccatgt

SEQ ID NO: 2460526 - DNA, 23 bp, Homo sapiens
tgcctgagtcgtgacctgctagg

SEQ ID NO: 2460527 - DNA, 12 bp, Homo sapiens
tgcctgccactg

SEQ ID NO: 2460528 - DNA, 13 bp, Homo sapiens
tgcctgccactgt

SEQ ID NO: 2460529 - DNA, 15 bp, Homo sapiens
tgcctgccagctgca

SEQ ID NO: 2460530 - DNA, 16 bp, Homo sapiens
tgcctgccagctgcac

SEQ ID NO: 2460531 - DNA, 13 bp, Homo sapiens
tgcctgccctggt

SEQ ID NO: 2460532 - DNA, 15 bp, Homo sapiens
tgcctgccctggtga

SEQ ID NO: 2460533 - DNA, 13 bp, Homo sapiens
tgcctgcctgctc

SEQ ID NO: 2460534 - DNA, 22 bp, Homo sapiens
tgcctgctcccatcctgtgtgt

SEQ ID NO: 2460535 - DNA, 22 bp, Homo sapiens
tgcctgcttggggggtgatgag

SEQ ID NO: 2460536 - DNA, 11 bp, Homo sapiens
tgcctggaccc

SEQ ID NO: 2460537 - DNA, 16 bp, Homo sapiens
tgcctggaggacctga

SEQ ID NO: 2460538 - DNA, 18 bp, Homo sapiens
tgcctggaggacctgagc

SEQ ID NO: 2460539 - DNA, 21 bp, Homo sapiens
tgcctggaggacctgagcctg

SEQ ID NO: 2460540 - DNA, 23 bp, Homo sapiens
tgcctggagtgtatgactgcaca

SEQ ID NO: 2460541 - DNA, 16 bp, Homo sapiens
tgcctgtcccaccccc

SEQ ID NO: 2460542 - DNA, 19 bp, Homo sapiens
tgcctgtcccacccccacc

SEQ ID NO: 2460543 - DNA, 12 bp, Homo sapiens
tgcctgtgccag

SEQ ID NO: 2460544 - DNA, 16 bp, Homo sapiens
tgcctgtgccaggtga

SEQ ID NO: 2460545 - DNA, 22 bp, Homo sapiens
tgcctgtggcgccgtctccagg

SEQ ID NO: 2460546 - DNA, 14 bp, Homo sapiens
tgcctgtttcccag

SEQ ID NO: 2460547 - DNA, 16 bp, Homo sapiens
tgcctgtttcccaggc

SEQ ID NO: 2460548 - DNA, 20 bp, Homo sapiens
tgccttagtctcagtttgtg

SEQ ID NO: 2460549 - DNA, 20 bp, Homo sapiens
tgctacagggtccaacatag

SEQ ID NO: 2460550 - DNA, 13 bp, Homo sapiens
tgctaccaccagc

SEQ ID NO: 2460551 - DNA, 16 bp, Homo sapiens
tgctaccaccagctgt

SEQ ID NO: 2460552 - DNA, 20 bp, Homo sapiens
tgctaccaccagctgtgtcc

SEQ ID NO: 2460553 - DNA, 18 bp, Homo sapiens
tgctaggaagaggagtgg

SEQ ID NO: 2460554 - DNA, 11 bp, Homo sapiens
tgctagtgtga

SEQ ID NO: 2460555 - DNA, 15 bp, Homo sapiens
tgctatggtgctctg

SEQ ID NO: 2460556 - DNA, 14 bp, Homo sapiens
tgctattctgtccc

SEQ ID NO: 2460557 - DNA, 16 bp, Homo sapiens
tgctcagccctgagga

SEQ ID NO: 2460558 - DNA, 13 bp, Homo sapiens
tgctcaggtactt

SEQ ID NO: 2460559 - DNA, 17 bp, Homo sapiens
tgctcaggtgctggggc

SEQ ID NO: 2460560 - DNA, 15 bp, Homo sapiens
tgctcatcattctct

SEQ ID NO: 2460561 - DNA, 20 bp, Homo sapiens
tgctcatcattctctgtctc

SEQ ID NO: 2460562 - DNA, 17 bp, Homo sapiens
tgctcatccactctact

SEQ ID NO: 2460563 - DNA, 13 bp, Homo sapiens
tgctcatctgctg

SEQ ID NO: 2460564 - DNA, 18 bp, Homo sapiens
tgctcatctgctggtccg

SEQ ID NO: 2460565 - DNA, 14 bp, Homo sapiens
tgctccaagattct

SEQ ID NO: 2460566 - DNA, 15 bp, Homo sapiens
tgctccaagattcta

SEQ ID NO: 2460567 - DNA, 17 bp, Homo sapiens
tgctccaagattctaga

SEQ ID NO: 2460568 - DNA, 12 bp, Homo sapiens
tgctccagacct

SEQ ID NO: 2460569 - DNA, 15 bp, Homo sapiens
tgctcccacctcctg

SEQ ID NO: 2460570 - DNA, 23 bp, Homo sapiens
tgctcccacctcctgacaccctt

SEQ ID NO: 2460571 - DNA, 13 bp, Homo sapiens
tgctccctcagac

SEQ ID NO: 2460572 - DNA, 19 bp, Homo sapiens
tgctccctcagactggggc

SEQ ID NO: 2460573 - DNA, 20 bp, Homo sapiens
tgctccgaggacccaggaaa

SEQ ID NO: 2460574 - DNA, 16 bp, Homo sapiens
tgctccgcctggcctg

SEQ ID NO: 2460575 - DNA, 21 bp, Homo sapiens
tgctcctgttcacaccagaga

SEQ ID NO: 2460576 - DNA, 13 bp, Homo sapiens
tgctccttcccca

SEQ ID NO: 2460577 - DNA, 15 bp, Homo sapiens
tgctccttccccatc

SEQ ID NO: 2460578 - DNA, 14 bp, Homo sapiens
tgctccttgggccc

SEQ ID NO: 2460579 - DNA, 19 bp, Homo sapiens
tgctccttgggccctttga

SEQ ID NO: 2460580 - DNA, 21 bp, Homo sapiens
tgctccttgggccctttgagt

SEQ ID NO: 2460581 - DNA, 16 bp, Homo sapiens
tgctcgccccagcagg

SEQ ID NO: 2460582 - DNA, 20 bp, Homo sapiens
tgctcggggtgcacaggagg

SEQ ID NO: 2460583 - DNA, 21 bp, Homo sapiens
tgctctccattctgctccttc

SEQ ID NO: 2460584 - DNA, 14 bp, Homo sapiens
tgctctcctcttct

SEQ ID NO: 2460585 - DNA, 20 bp, Homo sapiens
tgctctgagaattgttgaga

SEQ ID NO: 2460586 - DNA, 18 bp, Homo sapiens
tgctctgatgcatcagaa

SEQ ID NO: 2460587 - DNA, 18 bp, Homo sapiens
tgctctggttgtttctgt

SEQ ID NO: 2460588 - DNA, 19 bp, Homo sapiens
tgctctggttgtttctgtt

SEQ ID NO: 2460589 - DNA, 23 bp, Homo sapiens
tgctctggttgtttctgttccaa

SEQ ID NO: 2460590 - DNA, 13 bp, Homo sapiens
tgctcttaattgc

SEQ ID NO: 2460591 - DNA, 15 bp, Homo sapiens
tgctcttaattgcca

SEQ ID NO: 2460592 - DNA, 16 bp, Homo sapiens
tgctcttaattgccac

SEQ ID NO: 2460593 - DNA, 14 bp, Homo sapiens
tgctcttcaagaaa

SEQ ID NO: 2460594 - DNA, 15 bp, Homo sapiens
tgctcttggctggac

SEQ ID NO: 2460595 - DNA, 12 bp, Homo sapiens
tgctctttctct

SEQ ID NO: 2460596 - DNA, 18 bp, Homo sapiens
tgctctttctctgccagt

SEQ ID NO: 2460597 - DNA, 22 bp, Homo sapiens
tgctctttctctgccagtgaca

SEQ ID NO: 2460598 - DNA, 21 bp, Homo sapiens
tgctcttttctcctcactgta

SEQ ID NO: 2460599 - DNA, 14 bp, Homo sapiens
tgctgaacagtgga

SEQ ID NO: 2460600 - DNA, 18 bp, Homo sapiens
tgctgaatatacagcagg

SEQ ID NO: 2460601 - DNA, 18 bp, Homo sapiens
tgctgacattcacctgcc

SEQ ID NO: 2460602 - DNA, 14 bp, Homo sapiens
tgctgacctgctga

SEQ ID NO: 2460603 - DNA, 14 bp, Homo sapiens
tgctgacctgtgca

SEQ ID NO: 2460604 - DNA, 15 bp, Homo sapiens
tgctgacggccaggg

SEQ ID NO: 2460605 - DNA, 20 bp, Homo sapiens
tgctgagatacatacagaat

SEQ ID NO: 2460606 - DNA, 13 bp, Homo sapiens
tgctgagctctga

SEQ ID NO: 2460607 - DNA, 17 bp, Homo sapiens
tgctgagctctgagagg

SEQ ID NO: 2460608 - DNA, 17 bp, Homo sapiens
tgctgaggcctgggccg

SEQ ID NO: 2460609 - DNA, 16 bp, Homo sapiens
tgctgatcgccttccc

SEQ ID NO: 2460610 - DNA, 17 bp, Homo sapiens
tgctgatcgccttcccc

SEQ ID NO: 2460611 - DNA, 18 bp, Homo sapiens
tgctgatcgccttcccca

SEQ ID NO: 2460612 - DNA, 21 bp, Homo sapiens
tgctgatgaactcttaatcaa

SEQ ID NO: 2460613 - DNA, 14 bp, Homo sapiens
tgctgcatggcagg

SEQ ID NO: 2460614 - DNA, 21 bp, Homo sapiens
tgctgcatggcagggggctgc

SEQ ID NO: 2460615 - DNA, 20 bp, Homo sapiens
ttacatttacaaactgaaga

SEQ ID NO: 2460616 - DNA, 18 bp, Homo sapiens
ttacattttaaacacatt

SEQ ID NO: 2460617 - DNA, 16 bp, Homo sapiens
ttaccaaagatgaatg

SEQ ID NO: 2460618 - DNA, 23 bp, Homo sapiens
ttaccaggcaccaaaagaagtaa

SEQ ID NO: 2460619 - DNA, 14 bp, Homo sapiens
ttaccagttgcctt

SEQ ID NO: 2460620 - DNA, 19 bp, Homo sapiens
ttaccagttgccttttatc

SEQ ID NO: 2460621 - DNA, 14 bp, Homo sapiens
ttaccatttacatg

SEQ ID NO: 2460622 - DNA, 20 bp, Homo sapiens
ttacctgaaaacactgtgca

SEQ ID NO: 2460623 - DNA, 22 bp, Homo sapiens
ttacctgaaaacactgtgcaca

SEQ ID NO: 2460624 - DNA, 18 bp, Homo sapiens
ttacctgggcattcttgt

SEQ ID NO: 2460625 - DNA, 12 bp, Homo sapiens
ttacctgtggat

SEQ ID NO: 2460626 - DNA, 13 bp, Homo sapiens
ttacgctttgatt

SEQ ID NO: 2460627 - DNA, 15 bp, Homo sapiens
ttacgctttgattca

SEQ ID NO: 2460628 - DNA, 17 bp, Homo sapiens
ttactaaaaaaaagatg

SEQ ID NO: 2460629 - DNA, 20 bp, Homo sapiens
ttactataagaactttgagc

SEQ ID NO: 2460630 - DNA, 23 bp, Homo sapiens
ttactataagaactttgagctac

SEQ ID NO: 2460631 - DNA, 22 bp, Homo sapiens
ttactgcagcctttgcctcccc

SEQ ID NO: 2460632 - DNA, 13 bp, Homo sapiens
ttactggcctttt

SEQ ID NO: 2460633 - DNA, 13 bp, Homo sapiens
ttactgtgtaatt

SEQ ID NO: 2460634 - DNA, 19 bp, Homo sapiens
ttacttgtaaatataaaga

SEQ ID NO: 2460635 - DNA, 21 bp, Homo sapiens
ttacttgtaaatataaagacg

SEQ ID NO: 2460636 - DNA, 22 bp, Homo sapiens
ttacttgtaaatataaagacgt

SEQ ID NO: 2460637 - DNA, 21 bp, Homo sapiens
ttactttggggctaatttaac

SEQ ID NO: 2460638 - DNA, 23 bp, Homo sapiens
ttagaaaaccagctcagcactgc

SEQ ID NO: 2460639 - DNA, 16 bp, Homo sapiens
ttagaaagataattca

SEQ ID NO: 2460640 - DNA, 23 bp, Homo sapiens
ttagaagcctgcataatgtttct

SEQ ID NO: 2460641 - DNA, 20 bp, Homo sapiens
ttagaatcaaacattttgaa

SEQ ID NO: 2460642 - DNA, 23 bp, Homo sapiens
ttagaatcaaacattttgaaagt

SEQ ID NO: 2460643 - DNA, 15 bp, Homo sapiens
ttagaattatttaaa

SEQ ID NO: 2460644 - DNA, 14 bp, Homo sapiens
ttagacagaacacc

SEQ ID NO: 2460645 - DNA, 22 bp, Homo sapiens
ttagacagaacacctatgcaaa

SEQ ID NO: 2460646 - DNA, 12 bp, Homo sapiens
ttagacagaggc

SEQ ID NO: 2460647 - DNA, 23 bp, Homo sapiens
ttagacctacagggggtctggct

SEQ ID NO: 2460648 - DNA, 17 bp, Homo sapiens
ttagactcttttccttc

SEQ ID NO: 2460649 - DNA, 18 bp, Homo sapiens
ttagactgtgattcagaa

SEQ ID NO: 2460650 - DNA, 16 bp, Homo sapiens
ttagactttaacataa

SEQ ID NO: 2460651 - DNA, 12 bp, Homo sapiens
ttagagaataaa

SEQ ID NO: 2460652 - DNA, 15 bp, Homo sapiens
ttagagataagagtt

SEQ ID NO: 2460653 - DNA, 22 bp, Homo sapiens
ttagatgttccagtaatctaat

SEQ ID NO: 2460654 - DNA, 15 bp, Homo sapiens
ttagattaagaaata

SEQ ID NO: 2460655 - DNA, 19 bp, Homo sapiens
ttagattctctgtgtctaa

SEQ ID NO: 2460656 - DNA, 14 bp, Homo sapiens
ttagattttacatg

SEQ ID NO: 2460657 - DNA, 18 bp, Homo sapiens
ttagattttctggttcta

SEQ ID NO: 2460658 - DNA, 21 bp, Homo sapiens
ttagattttctggttctaaca

SEQ ID NO: 2460659 - DNA, 15 bp, Homo sapiens
ttagcagcttccaga

SEQ ID NO: 2460660 - DNA, 19 bp, Homo sapiens
ttagcatgttgttgaaagg

SEQ ID NO: 2460661 - DNA, 22 bp, Homo sapiens
ttagcattgtagtgctttgaga

SEQ ID NO: 2460662 - DNA, 17 bp, Homo sapiens
ttagccttttttcccca

SEQ ID NO: 2460663 - DNA, 18 bp, Homo sapiens
ttagctcaatgagcatgt

SEQ ID NO: 2460664 - DNA, 14 bp, Homo sapiens
ttagctcctgtggc

SEQ ID NO: 2460665 - DNA, 11 bp, Homo sapiens
ttagctctgag

SEQ ID NO: 2460666 - DNA, 13 bp, Homo sapiens
ttagctctgagaa

SEQ ID NO: 2460667 - DNA, 13 bp, Homo sapiens
ttagctttaactt

SEQ ID NO: 2460668 - DNA, 11 bp, Homo sapiens
ttaggaagagc

SEQ ID NO: 2460669 - DNA, 15 bp, Homo sapiens
ttaggagctaaggct

SEQ ID NO: 2460670 - DNA, 16 bp, Homo sapiens
ttaggcagactcttta

SEQ ID NO: 2460671 - DNA, 19 bp, Homo sapiens
ttaggctatttgtaaatct

SEQ ID NO: 2460672 - DNA, 20 bp, Homo sapiens
ttaggctatttgtaaatctg

SEQ ID NO: 2460673 - DNA, 14 bp, Homo sapiens
ttaggctgtaacta

SEQ ID NO: 2460674 - DNA, 20 bp, Homo sapiens
ttaggctgtaactactttat

SEQ ID NO: 2460675 - DNA, 14 bp, Homo sapiens
ttagggaagggcct

SEQ ID NO: 2460676 - DNA, 23 bp, Homo sapiens
ttaggtaagaagttttaaaaagc

SEQ ID NO: 2460677 - DNA, 18 bp, Homo sapiens
ttaggtgcaatttcaagg

SEQ ID NO: 2460678 - DNA, 14 bp, Homo sapiens
ttaggtgtctgtcc

SEQ ID NO: 2460679 - DNA, 14 bp, Homo sapiens
ttaggttaggactt

SEQ ID NO: 2460680 - DNA, 12 bp, Homo sapiens
ttaggttctaaa

SEQ ID NO: 2460681 - DNA, 14 bp, Homo sapiens
ttaggttctaaagt

SEQ ID NO: 2460682 - DNA, 19 bp, Homo sapiens
ttaggttctaaagttctaa

SEQ ID NO: 2460683 - DNA, 20 bp, Homo sapiens
ttaggttctaaagttctaag

SEQ ID NO: 2460684 - DNA, 12 bp, Homo sapiens
ttagtaaaccaa

SEQ ID NO: 2460685 - DNA, 18 bp, Homo sapiens
ttagtaaagtcaaggaga

SEQ ID NO: 2460686 - DNA, 13 bp, Homo sapiens
ttagtatcttttg

SEQ ID NO: 2460687 - DNA, 12 bp, Homo sapiens
ttagtattgttg

SEQ ID NO: 2460688 - DNA, 17 bp, Homo sapiens
ttagtattgttgtcctt

SEQ ID NO: 2460689 - DNA, 22 bp, Homo sapiens
ttagtattgttgtccttttcat

SEQ ID NO: 2460690 - DNA, 13 bp, Homo sapiens
ttagtcatgtgac

SEQ ID NO: 2460691 - DNA, 23 bp, Homo sapiens
ttagtctcagtttgtgtgtctta

SEQ ID NO: 2460692 - DNA, 16 bp, Homo sapiens
ttagttaccttatagt

SEQ ID NO: 2460693 - DNA, 19 bp, Homo sapiens
ttagttaccttatagttac

SEQ ID NO: 2460694 - DNA, 20 bp, Homo sapiens
ttagttaccttatagttact

SEQ ID NO: 2460695 - DNA, 11 bp, Homo sapiens
ttagtttcctt

SEQ ID NO: 2460696 - DNA, 20 bp, Homo sapiens
ttagtttcctttttaatatg

SEQ ID NO: 2460697 - DNA, 16 bp, Homo sapiens
ttagtttgtgtgttgt

SEQ ID NO: 2460698 - DNA, 16 bp, Homo sapiens
ttagttttgatgagtt

SEQ ID NO: 2460699 - DNA, 16 bp, Homo sapiens
ttagtttttcattaaa

SEQ ID NO: 2460700 - DNA, 17 bp, Homo sapiens
ttataaaaaatggttca

SEQ ID NO: 2460701 - DNA, 19 bp, Homo sapiens
ttataaaaaggtgttttga

SEQ ID NO: 2460702 - DNA, 15 bp, Homo sapiens
ttataaatatattta

SEQ ID NO: 2460703 - DNA, 23 bp, Homo sapiens
ttataaatgtaccagagagagtt

SEQ ID NO: 2460704 - DNA, 19 bp, Homo sapiens
ttataactaacatgtcctg

SEQ ID NO: 2460705 - DNA, 16 bp, Homo sapiens
ttataactggaaagaa

SEQ ID NO: 2460706 - DNA, 17 bp, Homo sapiens
ttataactggaaagaag

SEQ ID NO: 2460707 - DNA, 16 bp, Homo sapiens
ttataccaaaatgttg

SEQ ID NO: 2460708 - DNA, 19 bp, Homo sapiens
ttatagattctaaagattc

SEQ ID NO: 2460709 - DNA, 20 bp, Homo sapiens
ttatagattctaaagattct

SEQ ID NO: 2460710 - DNA, 16 bp, Homo sapiens
ttatagcctctgtctg

SEQ ID NO: 2460711 - DNA, 19 bp, Homo sapiens
ttatagcctctgtctggca

SEQ ID NO: 2460712 - DNA, 15 bp, Homo sapiens
ttatagttactgtgt

SEQ ID NO: 2460713 - DNA, 12 bp, Homo sapiens
ttatataactgt

SEQ ID NO: 2460714 - DNA, 18 bp, Homo sapiens
ttatataactgtatttga

SEQ ID NO: 2460715 - DNA, 18 bp, Homo sapiens
ttatatataaatatatta

SEQ ID NO: 2460716 - DNA, 21 bp, Homo sapiens
ttatatatggggatggtagtt

SEQ ID NO: 2460717 - DNA, 17 bp, Homo sapiens
ttatatattatatggaa

SEQ ID NO: 2460718 - DNA, 16 bp, Homo sapiens
ttatatctggcctctg

SEQ ID NO: 2460719 - DNA, 22 bp, Homo sapiens
ttatatggaaatatatattata

SEQ ID NO: 2460720 - DNA, 22 bp, Homo sapiens
ttatatttctattttattatga

SEQ ID NO: 2460721 - DNA, 15 bp, Homo sapiens
ttatcaaaactttct

SEQ ID NO: 2460722 - DNA, 13 bp, Homo sapiens
ttatcacacaaag

SEQ ID NO: 2460723 - DNA, 23 bp, Homo sapiens
ttatcagtcaatatttttagata

SEQ ID NO: 2460724 - DNA, 14 bp, Homo sapiens
ttatcagtgcttcc

SEQ ID NO: 2460725 - DNA, 16 bp, Homo sapiens
ttatcattttcaaaat

SEQ ID NO: 2460726 - DNA, 23 bp, Homo sapiens
ttatcccaaagttgttgtaacct

SEQ ID NO: 2460727 - DNA, 15 bp, Homo sapiens
ttatcccagctgcct

SEQ ID NO: 2460728 - DNA, 16 bp, Homo sapiens
ttatcctccaccgtct

SEQ ID NO: 2460729 - DNA, 15 bp, Homo sapiens
ttatcctttcatata

SEQ ID NO: 2460730 - DNA, 16 bp, Homo sapiens
ttatcgttttcttaaa

SEQ ID NO: 2460731 - DNA, 11 bp, Homo sapiens
ttatctaattt

SEQ ID NO: 2460732 - DNA, 16 bp, Homo sapiens
ttatctaatttataaa

SEQ ID NO: 2460733 - DNA, 14 bp, Homo sapiens
ttatctataattta

SEQ ID NO: 2460734 - DNA, 18 bp, Homo sapiens
ttatctgcaagtgaggtg

SEQ ID NO: 2460735 - DNA, 12 bp, Homo sapiens
ttatctgggctt

SEQ ID NO: 2460736 - DNA, 19 bp, Homo sapiens
ttatcttctcaagttctaa

SEQ ID NO: 2460737 - DNA, 18 bp, Homo sapiens
ttatgaaaaagaagaatc

SEQ ID NO: 2460738 - DNA, 19 bp, Homo sapiens
ttatgaaaaagaagaatct

SEQ ID NO: 2460739 - DNA, 18 bp, Homo sapiens
ttatgataatagattctc

SEQ ID NO: 2460740 - DNA, 22 bp, Homo sapiens
ttatgatagcaaatggcctcat

SEQ ID NO: 2460741 - DNA, 17 bp, Homo sapiens
ttatgccttttttgatc

SEQ ID NO: 2460742 - DNA, 16 bp, Homo sapiens
ttatgcggttaatttt

SEQ ID NO: 2460743 - DNA, 19 bp, Homo sapiens
ttatgcggttaattttgaa

SEQ ID NO: 2460744 - DNA, 17 bp, Homo sapiens
ttatgctcttaattgcc

SEQ ID NO: 2460745 - DNA, 18 bp, Homo sapiens
ttatgctcttaattgcca

SEQ ID NO: 2460746 - DNA, 14 bp, Homo sapiens
ttatggaattgatt

SEQ ID NO: 2460747 - DNA, 21 bp, Homo sapiens
ttatggaattgatttgcattg

SEQ ID NO: 2460748 - DNA, 23 bp, Homo sapiens
ttatggaattgatttgcattgaa

SEQ ID NO: 2460749 - DNA, 19 bp, Homo sapiens
ttatggagtcatttttaca

SEQ ID NO: 2460750 - DNA, 15 bp, Homo sapiens
ttatgggtcacagga

SEQ ID NO: 2460751 - DNA, 22 bp, Homo sapiens
ttatgtaaattatcaggcaaat

SEQ ID NO: 2460752 - DNA, 17 bp, Homo sapiens
ttatgtaaattatgtaa

SEQ ID NO: 2460753 - DNA, 18 bp, Homo sapiens
ttatgtagctctttgtca

SEQ ID NO: 2460754 - DNA, 15 bp, Homo sapiens
ttatgtagtaattga

SEQ ID NO: 2460755 - DNA, 21 bp, Homo sapiens
ttatgtagtttttatatgttg

SEQ ID NO: 2460756 - DNA, 14 bp, Homo sapiens
ttatgtattgtgca

SEQ ID NO: 2460757 - DNA, 17 bp, Homo sapiens
ttatgtctgtggatttt

SEQ ID NO: 2460758 - DNA, 16 bp, Homo sapiens
ttatgtgatcatgtgt

SEQ ID NO: 2460759 - DNA, 16 bp, Homo sapiens
ttatgtggttttagat

SEQ ID NO: 2460760 - DNA, 17 bp, Homo sapiens
ttatgttaaatcaataa

SEQ ID NO: 2460761 - DNA, 13 bp, Homo sapiens
ttatgttatatat

SEQ ID NO: 2460762 - DNA, 15 bp, Homo sapiens
ttatgttatatataa

SEQ ID NO: 2460763 - DNA, 18 bp, Homo sapiens
ttatgttatatataaata

SEQ ID NO: 2460764 - DNA, 13 bp, Homo sapiens
ttattaaagaaaa

SEQ ID NO: 2460765 - DNA, 20 bp, Homo sapiens
ttattaaagaaaaaaatgta

SEQ ID NO: 2460766 - DNA, 16 bp, Homo sapiens
ttattaacaattaggc

SEQ ID NO: 2460767 - DNA, 11 bp, Homo sapiens
ttattaatgca

SEQ ID NO: 2460768 - DNA, 12 bp, Homo sapiens
ttattacagtgt

SEQ ID NO: 2460769 - DNA, 21 bp, Homo sapiens
ttattacgtatgtctggttct

SEQ ID NO: 2460770 - DNA, 23 bp, Homo sapiens
ttattacgtatgtctggttctca

SEQ ID NO: 2460771 - DNA, 14 bp, Homo sapiens
ttattacttttgct

SEQ ID NO: 2460772 - DNA, 21 bp, Homo sapiens
ttattagaatcaaacattttg

SEQ ID NO: 2460773 - DNA, 22 bp, Homo sapiens
ttattataatcttataattgtt

SEQ ID NO: 2460774 - DNA, 14 bp, Homo sapiens
ttattatgcattat

SEQ ID NO: 2460775 - DNA, 20 bp, Homo sapiens
ttattcaatttatttgaatg

SEQ ID NO: 2460776 - DNA, 21 bp, Homo sapiens
ttattcaatttatttgaatga

SEQ ID NO: 2460777 - DNA, 13 bp, Homo sapiens
ttattcagtgtca

SEQ ID NO: 2460778 - DNA, 17 bp, Homo sapiens
ttattccagaatgctgt

SEQ ID NO: 2460779 - DNA, 23 bp, Homo sapiens
ttattcccttcctgccagcccct

SEQ ID NO: 2460780 - DNA, 14 bp, Homo sapiens
ttattgacacagaa

SEQ ID NO: 2460781 - DNA, 23 bp, Homo sapiens
ttattgacacagaaaatgttgag

SEQ ID NO: 2460782 - DNA, 14 bp, Homo sapiens
ttattgtattctgg

SEQ ID NO: 2460783 - DNA, 21 bp, Homo sapiens
ttatttaaaatagcaaaagaa

SEQ ID NO: 2460784 - DNA, 12 bp, Homo sapiens
ttatttatgtat

SEQ ID NO: 2460785 - DNA, 13 bp, Homo sapiens
ttatttatgtatt

SEQ ID NO: 2460786 - DNA, 15 bp, Homo sapiens
ttatttatgtattgt

SEQ ID NO: 2460787 - DNA, 21 bp, Homo sapiens
ttatttatgtattgtgcaatg

SEQ ID NO: 2460788 - DNA, 11 bp, Homo sapiens
ttatttgcata

SEQ ID NO: 2460789 - DNA, 16 bp, Homo sapiens
ttatttgtaatagatg

SEQ ID NO: 2460790 - DNA, 17 bp, Homo sapiens
ttattttcaaaaccagg

SEQ ID NO: 2460791 - DNA, 12 bp, Homo sapiens
ttattttctggt

SEQ ID NO: 2460792 - DNA, 22 bp, Homo sapiens
ttattttgccaagggcataaat

SEQ ID NO: 2460793 - DNA, 14 bp, Homo sapiens
ttcaaaagttccaa

SEQ ID NO: 2460794 - DNA, 16 bp, Homo sapiens
ttcaaaatggagggaa

SEQ ID NO: 2460795 - DNA, 13 bp, Homo sapiens
ttcaaagatgctg

SEQ ID NO: 2460796 - DNA, 18 bp, Homo sapiens
ttcaaagatgctgtgagt

SEQ ID NO: 2460797 - DNA, 13 bp, Homo sapiens
ttcaaagccagcg

SEQ ID NO: 2460798 - DNA, 17 bp, Homo sapiens
ttcaaaggtacttggat

SEQ ID NO: 2460799 - DNA, 14 bp, Homo sapiens
ttcaacaattctaa

SEQ ID NO: 2460800 - DNA, 18 bp, Homo sapiens
ttcaacagtgaagacaga

SEQ ID NO: 2460801 - DNA, 21 bp, Homo sapiens
ttcaacatgttatttgtaata

SEQ ID NO: 2460802 - DNA, 16 bp, Homo sapiens
ttcaacggaaagtgct

SEQ ID NO: 2460803 - DNA, 22 bp, Homo sapiens
ttcaagaggagcccccaccctg

SEQ ID NO: 2460804 - DNA, 17 bp, Homo sapiens
ttcaagcagtcgtgcct

SEQ ID NO: 2460805 - DNA, 12 bp, Homo sapiens
ttcaagctctga

SEQ ID NO: 2460806 - DNA, 17 bp, Homo sapiens
ttcaaggaatttcttaa

SEQ ID NO: 2460807 - DNA, 21 bp, Homo sapiens
ttcaataaaagataaattatt

SEQ ID NO: 2460808 - DNA, 12 bp, Homo sapiens
ttcaatacagat

SEQ ID NO: 2460809 - DNA, 16 bp, Homo sapiens
ttcaatacagatatat

SEQ ID NO: 2460810 - DNA, 11 bp, Homo sapiens
ttcaatatttt

SEQ ID NO: 2460811 - DNA, 19 bp, Homo sapiens
ttcaatcaactttactgta

SEQ ID NO: 2460812 - DNA, 15 bp, Homo sapiens
ttcaattcaaagctg

SEQ ID NO: 2460813 - DNA, 15 bp, Homo sapiens
ttcaattgcatctcc

SEQ ID NO: 2460814 - DNA, 19 bp, Homo sapiens
ttcacagcctataaccaga

SEQ ID NO: 2460815 - DNA, 15 bp, Homo sapiens
ttcacagctcctccc

SEQ ID NO: 2460816 - DNA, 19 bp, Homo sapiens
ttcacaggcagccagtgcc

SEQ ID NO: 2460817 - DNA, 15 bp, Homo sapiens
ttcacagtgctcttt

SEQ ID NO: 2460818 - DNA, 20 bp, Homo sapiens
ttcacagttctttgggccag

SEQ ID NO: 2460819 - DNA, 23 bp, Homo sapiens
ttcacatagcccacttacattta

SEQ ID NO: 2460820 - DNA, 20 bp, Homo sapiens
ttcaccattataatgaattt

SEQ ID NO: 2460821 - DNA, 24 bp, Homo sapiens
ttcaccatttggcaatgccatcat

SEQ ID NO: 2460822 - DNA, 19 bp, Homo sapiens
ttcaccccctttcctggac

SEQ ID NO: 2460823 - DNA, 20 bp, Homo sapiens
ttcactcttcaaatgcctga

SEQ ID NO: 2460824 - DNA, 23 bp, Homo sapiens
ttcactgtcaccaccctgctcat

SEQ ID NO: 2460825 - DNA, 16 bp, Homo sapiens
ttcactgtctttaatt

SEQ ID NO: 2460826 - DNA, 22 bp, Homo sapiens
ttcacttaagttagttccactg

SEQ ID NO: 2460827 - DNA, 17 bp, Homo sapiens
ttcacttttgacaaagg

SEQ ID NO: 2460828 - DNA, 19 bp, Homo sapiens
ttcagaaaatgttctgttt

SEQ ID NO: 2460829 - DNA, 23 bp, Homo sapiens
ttcagaaccccaactactgtgtt

SEQ ID NO: 2460830 - DNA, 20 bp, Homo sapiens
ttcagaagttagtttgtata

SEQ ID NO: 2460831 - DNA, 19 bp, Homo sapiens
ttcagagagcagtgctttt

SEQ ID NO: 2460832 - DNA, 12 bp, Homo sapiens
ttcagaggctca

SEQ ID NO: 2460833 - DNA, 15 bp, Homo sapiens
ttcagatgtgaacca

SEQ ID NO: 2460834 - DNA, 19 bp, Homo sapiens
ttcagcaaagtggttccct

SEQ ID NO: 2460835 - DNA, 13 bp, Homo sapiens
ttcagcactgtcc

SEQ ID NO: 2460836 - DNA, 16 bp, Homo sapiens
ttcagcactgtccctt

SEQ ID NO: 2460837 - DNA, 20 bp, Homo sapiens
ttcagctgtcttttggagga

SEQ ID NO: 2460838 - DNA, 18 bp, Homo sapiens
ttcaggaaaattgaatgc

SEQ ID NO: 2460839 - DNA, 18 bp, Homo sapiens
ttcaggaggaatactgaa

SEQ ID NO: 2460840 - DNA, 20 bp, Homo sapiens
ttcaggaggaatactgaaca

SEQ ID NO: 2460841 - DNA, 22 bp, Homo sapiens
ttcagggaaggaggagcctgtc

SEQ ID NO: 2460842 - DNA, 13 bp, Homo sapiens
ttcaggtttttcc

SEQ ID NO: 2460843 - DNA, 22 bp, Homo sapiens
ttcagtaccctctcagctccag

SEQ ID NO: 2460844 - DNA, 17 bp, Homo sapiens
ttcagttgttcttttta

SEQ ID NO: 2460845 - DNA, 16 bp, Homo sapiens
ttcagtttcataaaag

SEQ ID NO: 2460846 - DNA, 15 bp, Homo sapiens
ttcataatcactcta

SEQ ID NO: 2460847 - DNA, 13 bp, Homo sapiens
ttcatacttgaac

SEQ ID NO: 2460848 - DNA, 15 bp, Homo sapiens
ttcatacttgaacgt

SEQ ID NO: 2460849 - DNA, 13 bp, Homo sapiens
ttcatagcccagt

SEQ ID NO: 2460850 - DNA, 13 bp, Homo sapiens
ttcataggtctga

SEQ ID NO: 2460851 - DNA, 16 bp, Homo sapiens
ttcatagttcagaatt

SEQ ID NO: 2460852 - DNA, 19 bp, Homo sapiens
ttcatagttcagaatttag

SEQ ID NO: 2460853 - DNA, 17 bp, Homo sapiens
ttcatccaagttaaatg

SEQ ID NO: 2460854 - DNA, 20 bp, Homo sapiens
ttcatccaagttaaatgtag

SEQ ID NO: 2460855 - DNA, 15 bp, Homo sapiens
ttcatccataactga

SEQ ID NO: 2460856 - DNA, 24 bp, Homo sapiens
ttcatcccaaaggacagccgcctg

SEQ ID NO: 2460857 - DNA, 21 bp, Homo sapiens
ttcatcccactccaactcttc

SEQ ID NO: 2460858 - DNA, 18 bp, Homo sapiens
ttcatcgaatctactaat

SEQ ID NO: 2460859 - DNA, 15 bp, Homo sapiens
ttcatctaggatttt

SEQ ID NO: 2460860 - DNA, 15 bp, Homo sapiens
ttcatgacagcctcc

SEQ ID NO: 2460861 - DNA, 14 bp, Homo sapiens
ttcatgcagctgtg

SEQ ID NO: 2460862 - DNA, 21 bp, Homo sapiens
ttcatgccagctacttcctcc

SEQ ID NO: 2460863 - DNA, 17 bp, Homo sapiens
ttcatggcagaaggcaa

SEQ ID NO: 2460864 - DNA, 23 bp, Homo sapiens
ttcatggcagatgtaggagggac

SEQ ID NO: 2460865 - DNA, 14 bp, Homo sapiens
ttcatgtaaactgt

SEQ ID NO: 2460866 - DNA, 18 bp, Homo sapiens
ttcatgtaatcctcaaga

SEQ ID NO: 2460867 - DNA, 16 bp, Homo sapiens
ttcatgtctgctatca

SEQ ID NO: 2460868 - DNA, 18 bp, Homo sapiens
ttcatgtgtcccagaaga

SEQ ID NO: 2460869 - DNA, 13 bp, Homo sapiens
ttcatgttagtta

SEQ ID NO: 2460870 - DNA, 13 bp, Homo sapiens
ttcattaaataaa

SEQ ID NO: 2460871 - DNA, 22 bp, Homo sapiens
ttcattccttcagatttggctt

SEQ ID NO: 2460872 - DNA, 13 bp, Homo sapiens
ttcattctgcaag

SEQ ID NO: 2460873 - DNA, 15 bp, Homo sapiens
ttcatttcaactgtt

SEQ ID NO: 2460874 - DNA, 18 bp, Homo sapiens
ttcatttgagaagtaaac

SEQ ID NO: 2460875 - DNA, 22 bp, Homo sapiens
ttccaaagagtagaattgcatt

SEQ ID NO: 2460876 - DNA, 14 bp, Homo sapiens
ttccaaagtctcta

SEQ ID NO: 2460877 - DNA, 16 bp, Homo sapiens
ttccaatgtctggaga

SEQ ID NO: 2460878 - DNA, 15 bp, Homo sapiens
ttccacaccttttat

SEQ ID NO: 2460879 - DNA, 12 bp, Homo sapiens
ttccacagacgg

SEQ ID NO: 2460880 - DNA, 14 bp, Homo sapiens
ttccacagaggaca

SEQ ID NO: 2460881 - DNA, 16 bp, Homo sapiens
ttccaccacagccagc

SEQ ID NO: 2460882 - DNA, 21 bp, Homo sapiens
ttccacggagccactcctctg

SEQ ID NO: 2460883 - DNA, 18 bp, Homo sapiens
ttccacttatagcctctg

SEQ ID NO: 2460884 - DNA, 16 bp, Homo sapiens
ttccagcccctctggt

SEQ ID NO: 2460885 - DNA, 14 bp, Homo sapiens
ttccagctcctgta

SEQ ID NO: 2460886 - DNA, 18 bp, Homo sapiens
ttccagctggatgagaat

SEQ ID NO: 2460887 - DNA, 15 bp, Homo sapiens
ttccaggcttctgct

SEQ ID NO: 2460888 - DNA, 20 bp, Homo sapiens
ttccaggcttctgctggggc

SEQ ID NO: 2460889 - DNA, 16 bp, Homo sapiens
ttccagggtccctctg

SEQ ID NO: 2460890 - DNA, 15 bp, Homo sapiens
ttccatccatggcca

SEQ ID NO: 2460891 - DNA, 13 bp, Homo sapiens
ttccatctttaca

SEQ ID NO: 2460892 - DNA, 17 bp, Homo sapiens
ttccatgattctattta

SEQ ID NO: 2460893 - DNA, 16 bp, Homo sapiens
ttccatgtgcccagtt

SEQ ID NO: 2460894 - DNA, 23 bp, Homo sapiens
ttccattaaacgatttttaaaat

SEQ ID NO: 2460895 - DNA, 16 bp, Homo sapiens
ttccattggatctcat

SEQ ID NO: 2460896 - DNA, 17 bp, Homo sapiens
ttccattggatctcatt

SEQ ID NO: 2460897 - DNA, 15 bp, Homo sapiens
ttccatttgcatttg

SEQ ID NO: 2460898 - DNA, 17 bp, Homo sapiens
ttccatttgcatttgtt

SEQ ID NO: 2460899 - DNA, 13 bp, Homo sapiens
ttcccaagggctg

SEQ ID NO: 2460900 - DNA, 16 bp, Homo sapiens
ttcccaagggctgccg

SEQ ID NO: 2460901 - DNA, 23 bp, Homo sapiens
ttcccaagtgagtctctctgggc

SEQ ID NO: 2460902 - DNA, 14 bp, Homo sapiens
ttcccaattcacat

SEQ ID NO: 2460903 - DNA, 18 bp, Homo sapiens
ttcccacaggacatttct

SEQ ID NO: 2460904 - DNA, 16 bp, Homo sapiens
ttcccacattaaagaa

SEQ ID NO: 2460905 - DNA, 20 bp, Homo sapiens
ttcccaccccaacctgctct

SEQ ID NO: 2460906 - DNA, 14 bp, Homo sapiens
ttcccacgaggaat

SEQ ID NO: 2460907 - DNA, 20 bp, Homo sapiens
ttcccacttaaaaattaaat

SEQ ID NO: 2460908 - DNA, 17 bp, Homo sapiens
ttcccactttcccaccc

SEQ ID NO: 2460909 - DNA, 12 bp, Homo sapiens
ttcccaggaccc

SEQ ID NO: 2460910 - DNA, 12 bp, Homo sapiens
ttcccaggccca

SEQ ID NO: 2460911 - DNA, 22 bp, Homo sapiens
ttcccaggcccactgtgcctca

SEQ ID NO: 2460912 - DNA, 15 bp, Homo sapiens
ttcccagttggagct

SEQ ID NO: 2460913 - DNA, 13 bp, Homo sapiens
ttcccatccccag

SEQ ID NO: 2460914 - DNA, 17 bp, Homo sapiens
ttcccatccccagcgat

SEQ ID NO: 2460915 - DNA, 15 bp, Homo sapiens
ttcccatcgctgtca

SEQ ID NO: 2460916 - DNA, 17 bp, Homo sapiens
ttccccactgacagcct

SEQ ID NO: 2460917 - DNA, 14 bp, Homo sapiens
ttccccactggagc

SEQ ID NO: 2460918 - DNA, 18 bp, Homo sapiens
ttccccagacgcctggct

SEQ ID NO: 2460919 - DNA, 15 bp, Homo sapiens
ttccccagacttgtt

SEQ ID NO: 2460920 - DNA, 18 bp, Homo sapiens
ttctattttattatgaag

SEQ ID NO: 2460921 - DNA, 19 bp, Homo sapiens
ttctattttattatgaaga

SEQ ID NO: 2460922 - DNA, 15 bp, Homo sapiens
ttctattttttgttt

SEQ ID NO: 2460923 - DNA, 23 bp, Homo sapiens
ttctattttttgttttgtttcct

SEQ ID NO: 2460924 - DNA, 17 bp, Homo sapiens
ttctcaagttctaagat

SEQ ID NO: 2460925 - DNA, 20 bp, Homo sapiens
ttctcaagttctaagattct

SEQ ID NO: 2460926 - DNA, 13 bp, Homo sapiens
ttctcaattccaa

SEQ ID NO: 2460927 - DNA, 14 bp, Homo sapiens
ttctcaattccaac

SEQ ID NO: 2460928 - DNA, 20 bp, Homo sapiens
ttctcaattccaacagttta

SEQ ID NO: 2460929 - DNA, 22 bp, Homo sapiens
ttctcaggacacaggcctgtgt

SEQ ID NO: 2460930 - DNA, 23 bp, Homo sapiens
ttctcaggacacaggcctgtgta

SEQ ID NO: 2460931 - DNA, 19 bp, Homo sapiens
ttctcaggtgttgccaaat

SEQ ID NO: 2460932 - DNA, 13 bp, Homo sapiens
ttctcatcagtag

SEQ ID NO: 2460933 - DNA, 23 bp, Homo sapiens
ttctcatgataccacctttactg

SEQ ID NO: 2460934 - DNA, 18 bp, Homo sapiens
ttctcattggaaatttag

SEQ ID NO: 2460935 - DNA, 21 bp, Homo sapiens
ttctcattggaaatttagcat

SEQ ID NO: 2460936 - DNA, 16 bp, Homo sapiens
ttctccaagagctaca

SEQ ID NO: 2460937 - DNA, 21 bp, Homo sapiens
ttctccacctagactgtaaac

SEQ ID NO: 2460938 - DNA, 18 bp, Homo sapiens
ttctcccactctcctagg

SEQ ID NO: 2460939 - DNA, 18 bp, Homo sapiens
ttctccccagctcccagg

SEQ ID NO: 2460940 - DNA, 10 bp, Homo sapiens
ttctccctgt

SEQ ID NO: 2460941 - DNA, 23 bp, Homo sapiens
ttctcctccatgggagaaaatag

SEQ ID NO: 2460942 - DNA, 10 bp, Homo sapiens
ttctcctgga

SEQ ID NO: 2460943 - DNA, 19 bp, Homo sapiens
ttctcgctgtcctttctag

SEQ ID NO: 2460944 - DNA, 19 bp, Homo sapiens
ttctcgtcctcgtttgtgt

SEQ ID NO: 2460945 - DNA, 19 bp, Homo sapiens
ttctctaagagaacaatgt

SEQ ID NO: 2460946 - DNA, 19 bp, Homo sapiens
ttctctccagctgactaaa

SEQ ID NO: 2460947 - DNA, 21 bp, Homo sapiens
ttctctctttatacagctgta

SEQ ID NO: 2460948 - DNA, 11 bp, Homo sapiens
ttctctgactt

SEQ ID NO: 2460949 - DNA, 12 bp, Homo sapiens
ttctctgacttc

SEQ ID NO: 2460950 - DNA, 16 bp, Homo sapiens
ttctctgacttctgcc

SEQ ID NO: 2460951 - DNA, 17 bp, Homo sapiens
ttctctgacttctgcct

SEQ ID NO: 2460952 - DNA, 16 bp, Homo sapiens
ttctctgaggacaaga

SEQ ID NO: 2460953 - DNA, 19 bp, Homo sapiens
ttctctggtaatattgact

SEQ ID NO: 2460954 - DNA, 13 bp, Homo sapiens
ttctctgtctcat

SEQ ID NO: 2460955 - DNA, 21 bp, Homo sapiens
ttctctgtgtctaagattcta

SEQ ID NO: 2460956 - DNA, 17 bp, Homo sapiens
ttctcttgggaactgaa

SEQ ID NO: 2460957 - DNA, 16 bp, Homo sapiens
ttctctttccatgaca

SEQ ID NO: 2460958 - DNA, 21 bp, Homo sapiens
ttctctttccctggtcccttg

SEQ ID NO: 2460959 - DNA, 15 bp, Homo sapiens
ttctctttgcctcaa

SEQ ID NO: 2460960 - DNA, 18 bp, Homo sapiens
ttctgaacagctggtgta

SEQ ID NO: 2460961 - DNA, 22 bp, Homo sapiens
ttctgaacagctggtgtagcta

SEQ ID NO: 2460962 - DNA, 23 bp, Homo sapiens
ttctgaacagctggtgtagctac

SEQ ID NO: 2460963 - DNA, 22 bp, Homo sapiens
ttctgagacgtcatgaggagat

SEQ ID NO: 2460964 - DNA, 16 bp, Homo sapiens
ttctgaggctttatga

SEQ ID NO: 2460965 - DNA, 17 bp, Homo sapiens
ttctgaggtgcactggg

SEQ ID NO: 2460966 - DNA, 18 bp, Homo sapiens
ttctgataaaagatggcc

SEQ ID NO: 2460967 - DNA, 15 bp, Homo sapiens
ttctgatcaaggcct

SEQ ID NO: 2460968 - DNA, 17 bp, Homo sapiens
ttctgattttaggagct

SEQ ID NO: 2460969 - DNA, 24 bp, Homo sapiens
ttctgattttaggagctaaggctc

SEQ ID NO: 2460970 - DNA, 21 bp, Homo sapiens
ttctgcaagcacatctgcatt

SEQ ID NO: 2460971 - DNA, 17 bp, Homo sapiens
ttctgcatatgttgaat

SEQ ID NO: 2460972 - DNA, 23 bp, Homo sapiens
ttctgcatatgttgaatactttt

SEQ ID NO: 2460973 - DNA, 16 bp, Homo sapiens
ttctgcctgccagctg

SEQ ID NO: 2460974 - DNA, 17 bp, Homo sapiens
ttctgcctgccagctgc

SEQ ID NO: 2460975 - DNA, 14 bp, Homo sapiens
ttctgcctttgcca

SEQ ID NO: 2460976 - DNA, 13 bp, Homo sapiens
ttctgctcatcat

SEQ ID NO: 2460977 - DNA, 21 bp, Homo sapiens
ttctgctcatcattctctgtc

SEQ ID NO: 2460978 - DNA, 23 bp, Homo sapiens
ttctgctctggttgtttctgttc

SEQ ID NO: 2460979 - DNA, 16 bp, Homo sapiens
ttctggccagtgttta

SEQ ID NO: 2460980 - DNA, 15 bp, Homo sapiens
ttctgggcctgacca

SEQ ID NO: 2460981 - DNA, 19 bp, Homo sapiens
ttctggggcaggctgggcc

SEQ ID NO: 2460982 - DNA, 14 bp, Homo sapiens
ttctggtccttttt

SEQ ID NO: 2460983 - DNA, 16 bp, Homo sapiens
ttctggtcctttttgg

SEQ ID NO: 2460984 - DNA, 15 bp, Homo sapiens
ttctggttccagggt

SEQ ID NO: 2460985 - DNA, 15 bp, Homo sapiens
ttctgtaagaaacct

SEQ ID NO: 2460986 - DNA, 11 bp, Homo sapiens
ttctgtaattc

SEQ ID NO: 2460987 - DNA, 11 bp, Homo sapiens
ttctgtaccag

SEQ ID NO: 2460988 - DNA, 18 bp, Homo sapiens
ttctgtactcaaatgtag

SEQ ID NO: 2460989 - DNA, 21 bp, Homo sapiens
ttctgtccctaggtgttttgt

SEQ ID NO: 2460990 - DNA, 22 bp, Homo sapiens
ttctgtgtctttcacagctcct

SEQ ID NO: 2460991 - DNA, 13 bp, Homo sapiens
ttctgttaactga

SEQ ID NO: 2460992 - DNA, 14 bp, Homo sapiens
ttctgttaactgaa

SEQ ID NO: 2460993 - DNA, 13 bp, Homo sapiens
ttctgttctagtt

SEQ ID NO: 2460994 - DNA, 18 bp, Homo sapiens
ttcttaaataagaaactt

SEQ ID NO: 2460995 - DNA, 17 bp, Homo sapiens
ttcttaacttcttgctt

SEQ ID NO: 2460996 - DNA, 13 bp, Homo sapiens
ttcttactgcttg

SEQ ID NO: 2460997 - DNA, 13 bp, Homo sapiens
ttcttagtgactt

SEQ ID NO: 2460998 - DNA, 22 bp, Homo sapiens
ttcttatggaattgatttgcat

SEQ ID NO: 2460999 - DNA, 19 bp, Homo sapiens
ttcttatttttttctattt

SEQ ID NO: 2461000 - DNA, 18 bp, Homo sapiens
ttcttcctaccaagtcaa

SEQ ID NO: 2461001 - DNA, 13 bp, Homo sapiens
ttcttcctcagcc

SEQ ID NO: 2461002 - DNA, 14 bp, Homo sapiens
ttcttcctcagcca

SEQ ID NO: 2461003 - DNA, 15 bp, Homo sapiens
ttcttcctgccagca

SEQ ID NO: 2461004 - DNA, 11 bp, Homo sapiens
ttcttctagag

SEQ ID NO: 2461005 - DNA, 14 bp, Homo sapiens
ttcttctagagttc

SEQ ID NO: 2461006 - DNA, 21 bp, Homo sapiens
ttcttgaatttaataatctgt

SEQ ID NO: 2461007 - DNA, 21 bp, Homo sapiens
ttcttgaggggaagctagtct

SEQ ID NO: 2461008 - DNA, 20 bp, Homo sapiens
ttcttgatgtaaaatcttgt

SEQ ID NO: 2461009 - DNA, 12 bp, Homo sapiens
ttcttgtaattt

SEQ ID NO: 2461010 - DNA, 12 bp, Homo sapiens
ttcttgtattta

SEQ ID NO: 2461011 - DNA, 21 bp, Homo sapiens
ttcttgtctataaagcattta

SEQ ID NO: 2461012 - DNA, 14 bp, Homo sapiens
ttcttgtctttatt

SEQ ID NO: 2461013 - DNA, 18 bp, Homo sapiens
ttcttgtgtgtatgcaca

SEQ ID NO: 2461014 - DNA, 23 bp, Homo sapiens
ttctttaaaaaacaactatggat

SEQ ID NO: 2461015 - DNA, 14 bp, Homo sapiens
ttctttataagaaa

SEQ ID NO: 2461016 - DNA, 18 bp, Homo sapiens
ttctttcaatacagatat

SEQ ID NO: 2461017 - DNA, 13 bp, Homo sapiens
ttctttcatttct

SEQ ID NO: 2461018 - DNA, 14 bp, Homo sapiens
ttctttcatttctt

SEQ ID NO: 2461019 - DNA, 12 bp, Homo sapiens
ttctttctagaa

SEQ ID NO: 2461020 - DNA, 20 bp, Homo sapiens
ttctttggaaagtacactct

SEQ ID NO: 2461021 - DNA, 21 bp, Homo sapiens
ttcttttctggaatgtaatca

SEQ ID NO: 2461022 - DNA, 18 bp, Homo sapiens
ttctttttgggagagact

SEQ ID NO: 2461023 - DNA, 19 bp, Homo sapiens
ttctttttgggagagactt

SEQ ID NO: 2461024 - DNA, 21 bp, Homo sapiens
ttctttttgggagagacttgt

SEQ ID NO: 2461025 - DNA, 23 bp, Homo sapiens
ttcttttttggccatctgctcct

SEQ ID NO: 2461026 - DNA, 13 bp, Homo sapiens
ttgaaaaaaaata

SEQ ID NO: 2461027 - DNA, 20 bp, Homo sapiens
ttgaaaaaatagagcctgag

SEQ ID NO: 2461028 - DNA, 22 bp, Homo sapiens
ttgaaaaaatagagcctgaggg

SEQ ID NO: 2461029 - DNA, 16 bp, Homo sapiens
ttgaaaatgtccagga

SEQ ID NO: 2461030 - DNA, 19 bp, Homo sapiens
ttgaaagtgggcaaaagct

SEQ ID NO: 2461031 - DNA, 20 bp, Homo sapiens
ttgaaagtgggcaaaagctt

SEQ ID NO: 2461032 - DNA, 16 bp, Homo sapiens
ttgaaataagaattca

SEQ ID NO: 2461033 - DNA, 15 bp, Homo sapiens
ttgaaataagctatt

SEQ ID NO: 2461034 - DNA, 18 bp, Homo sapiens
ttgaaatatcctgcttga

SEQ ID NO: 2461035 - DNA, 21 bp, Homo sapiens
ttgaacacaaactgtaaataa

SEQ ID NO: 2461036 - DNA, 19 bp, Homo sapiens
ttgaacctttgtgccctat

SEQ ID NO: 2461037 - DNA, 16 bp, Homo sapiens
ttgaacgttttctaat

SEQ ID NO: 2461038 - DNA, 20 bp, Homo sapiens
ttgaacgttttctaattgct

SEQ ID NO: 2461039 - DNA, 21 bp, Homo sapiens
ttgaacgttttctaattgctt

SEQ ID NO: 2461040 - DNA, 15 bp, Homo sapiens
ttgaactctggtggc

SEQ ID NO: 2461041 - DNA, 16 bp, Homo sapiens
ttgaagaactgcaggc

SEQ ID NO: 2461042 - DNA, 21 bp, Homo sapiens
ttgaaggactaatagaaaagt

SEQ ID NO: 2461043 - DNA, 12 bp, Homo sapiens
ttgaaggcttaa

SEQ ID NO: 2461044 - DNA, 15 bp, Homo sapiens
ttgaagggccagagc

SEQ ID NO: 2461045 - DNA, 12 bp, Homo sapiens
ttgaagtattta

SEQ ID NO: 2461046 - DNA, 15 bp, Homo sapiens
ttgaataaggaaatg

SEQ ID NO: 2461047 - DNA, 17 bp, Homo sapiens
ttgaatactttgaatgt

SEQ ID NO: 2461048 - DNA, 20 bp, Homo sapiens
ttgaatactttgaatgtgtt

SEQ ID NO: 2461049 - DNA, 14 bp, Homo sapiens
ttgaatcaataata

SEQ ID NO: 2461050 - DNA, 15 bp, Homo sapiens
ttgaatgcaaaccat

SEQ ID NO: 2461051 - DNA, 16 bp, Homo sapiens
ttgaatgcaaaccata

SEQ ID NO: 2461052 - DNA, 16 bp, Homo sapiens
ttgaatggctatgttt

SEQ ID NO: 2461053 - DNA, 20 bp, Homo sapiens
ttgaatggctatgtttttaa

SEQ ID NO: 2461054 - DNA, 19 bp, Homo sapiens
ttgaatgtggcttgagaaa

SEQ ID NO: 2461055 - DNA, 18 bp, Homo sapiens
ttgaattgtaactgttct

SEQ ID NO: 2461056 - DNA, 22 bp, Homo sapiens
ttgaattttttttaacattcct

SEQ ID NO: 2461057 - DNA, 16 bp, Homo sapiens
ttgacaaccatgagac

SEQ ID NO: 2461058 - DNA, 18 bp, Homo sapiens
ttgacaattactcaggtt

SEQ ID NO: 2461059 - DNA, 15 bp, Homo sapiens
ttgacataaagttga

SEQ ID NO: 2461060 - DNA, 19 bp, Homo sapiens
ttgacataaagttgataaa

SEQ ID NO: 2461061 - DNA, 14 bp, Homo sapiens
ttgacattctgaat

SEQ ID NO: 2461062 - DNA, 18 bp, Homo sapiens
ttgacattctgaatgctt

SEQ ID NO: 2461063 - DNA, 20 bp, Homo sapiens
ttgacattctgaatgcttct

SEQ ID NO: 2461064 - DNA, 14 bp, Homo sapiens
ttgacattgcgttt

SEQ ID NO: 2461065 - DNA, 22 bp, Homo sapiens
ttgacctggatggggcaggcca

SEQ ID NO: 2461066 - DNA, 14 bp, Homo sapiens
ttgactcaggagcc

SEQ ID NO: 2461067 - DNA, 15 bp, Homo sapiens
ttgactcttttgcca

SEQ ID NO: 2461068 - DNA, 22 bp, Homo sapiens
ttgactttccccaccagatgct

SEQ ID NO: 2461069 - DNA, 22 bp, Homo sapiens
ttgagatagttttcatccataa

SEQ ID NO: 2461070 - DNA, 13 bp, Homo sapiens
ttgaggaaaacaa

SEQ ID NO: 2461071 - DNA, 16 bp, Homo sapiens
ttgaggcaaaagaagg

SEQ ID NO: 2461072 - DNA, 22 bp, Homo sapiens
ttgaggcttggttccttcccaa

SEQ ID NO: 2461073 - DNA, 14 bp, Homo sapiens
ttgaggggaccagg

SEQ ID NO: 2461074 - DNA, 15 bp, Homo sapiens
ttgaggggaccagga

SEQ ID NO: 2461075 - DNA, 15 bp, Homo sapiens
ttgaggtctcagccc

SEQ ID NO: 2461076 - DNA, 21 bp, Homo sapiens
ttgagtaatggtgtagaacac

SEQ ID NO: 2461077 - DNA, 20 bp, Homo sapiens
ttgagtagagagcaagggaa

SEQ ID NO: 2461078 - DNA, 14 bp, Homo sapiens
ttgagtgctctgat

SEQ ID NO: 2461079 - DNA, 20 bp, Homo sapiens
ttgagttggttacttcatat

SEQ ID NO: 2461080 - DNA, 22 bp, Homo sapiens
ttgataaagattttttaataat

SEQ ID NO: 2461081 - DNA, 18 bp, Homo sapiens
ttgataaccttgaaaaaa

SEQ ID NO: 2461082 - DNA, 13 bp, Homo sapiens
ttgatacccccct

SEQ ID NO: 2461083 - DNA, 13 bp, Homo sapiens
ttgatactgttgc

SEQ ID NO: 2461084 - DNA, 18 bp, Homo sapiens
ttgatatagaagtataaa

SEQ ID NO: 2461085 - DNA, 22 bp, Homo sapiens
ttgatatagaagtataaagaat

SEQ ID NO: 2461086 - DNA, 12 bp, Homo sapiens
ttgatcagttaa

SEQ ID NO: 2461087 - DNA, 16 bp, Homo sapiens
ttgatctggaacccag

SEQ ID NO: 2461088 - DNA, 19 bp, Homo sapiens
ttgatctggaacccagact

SEQ ID NO: 2461089 - DNA, 20 bp, Homo sapiens
ttgatgaccaaagtcctttt

SEQ ID NO: 2461090 - DNA, 14 bp, Homo sapiens
ttgatgttccttcc

SEQ ID NO: 2461091 - DNA, 14 bp, Homo sapiens
ttgattaaagatga

SEQ ID NO: 2461092 - DNA, 14 bp, Homo sapiens
ttgattacagtgca

SEQ ID NO: 2461093 - DNA, 20 bp, Homo sapiens
ttgattctgcagtaaatctt

SEQ ID NO: 2461094 - DNA, 13 bp, Homo sapiens
ttgatttgcattg

SEQ ID NO: 2461095 - DNA, 14 bp, Homo sapiens
ttgattttctggat

SEQ ID NO: 2461096 - DNA, 17 bp, Homo sapiens
ttgatttttctcttcat

SEQ ID NO: 2461097 - DNA, 15 bp, Homo sapiens
ttgcaaaaactacaa

SEQ ID NO: 2461098 - DNA, 17 bp, Homo sapiens
ttgcacctacctcacag

SEQ ID NO: 2461099 - DNA, 18 bp, Homo sapiens
ttgcacgtgtgtttttct

SEQ ID NO: 2461100 - DNA, 20 bp, Homo sapiens
ttgcacgtgtgtttttctat

SEQ ID NO: 2461101 - DNA, 23 bp, Homo sapiens
ttgcacgtgtgtttttctattaa

SEQ ID NO: 2461102 - DNA, 17 bp, Homo sapiens
ttgcagaaaattctgtg

SEQ ID NO: 2461103 - DNA, 20 bp, Homo sapiens
ttgcagaagggggtctcttc

SEQ ID NO: 2461104 - DNA, 13 bp, Homo sapiens
ttgcagctgtttt

SEQ ID NO: 2461105 - DNA, 21 bp, Homo sapiens
ttgcagctgttttgttgacat

SEQ ID NO: 2461106 - DNA, 14 bp, Homo sapiens
ttgcaggtggccaa

SEQ ID NO: 2461107 - DNA, 21 bp, Homo sapiens
ttgcagtcccaagcggtgtct

SEQ ID NO: 2461108 - DNA, 13 bp, Homo sapiens
ttgcagtttatca

SEQ ID NO: 2461109 - DNA, 19 bp, Homo sapiens
ttgcagtttatcattcaag

SEQ ID NO: 2461110 - DNA, 23 bp, Homo sapiens
ttgcatagtaccaatcattttaa

SEQ ID NO: 2461111 - DNA, 17 bp, Homo sapiens
ttgcatgtagtaacact

SEQ ID NO: 2461112 - DNA, 22 bp, Homo sapiens
ttgcattaaattcacaaacttt

SEQ ID NO: 2461113 - DNA, 15 bp, Homo sapiens
ttgcattgaacacaa

SEQ ID NO: 2461114 - DNA, 18 bp, Homo sapiens
ttgcattgaacacaaact

SEQ ID NO: 2461115 - DNA, 22 bp, Homo sapiens
ttgcattgaacacaaactgtaa

SEQ ID NO: 2461116 - DNA, 23 bp, Homo sapiens
ttgcattgaacacaaactgtaaa

SEQ ID NO: 2461117 - DNA, 21 bp, Homo sapiens
ttgcattgaccgcgactaatt

SEQ ID NO: 2461118 - DNA, 17 bp, Homo sapiens
ttgccaaatatgtcctg

SEQ ID NO: 2461119 - DNA, 18 bp, Homo sapiens
ttgccaatagtgtcatcc

SEQ ID NO: 2461120 - DNA, 12 bp, Homo sapiens
ttgccacagctt

SEQ ID NO: 2461121 - DNA, 18 bp, Homo sapiens
ttgccacagcttttgcaa

SEQ ID NO: 2461122 - DNA, 20 bp, Homo sapiens
ttgccacctctaacagcacc

SEQ ID NO: 2461123 - DNA, 23 bp, Homo sapiens
ttgccatctgcgtgacaataaaa

SEQ ID NO: 2461124 - DNA, 23 bp, Homo sapiens
ttgccatgacaacttctaattgc

SEQ ID NO: 2461125 - DNA, 13 bp, Homo sapiens
ttgcccccatttc

SEQ ID NO: 2461126 - DNA, 15 bp, Homo sapiens
ttgccctaagcagaa

SEQ ID NO: 2461127 - DNA, 19 bp, Homo sapiens
ttgccctaagcagaaagtg

SEQ ID NO: 2461128 - DNA, 23 bp, Homo sapiens
ttgcctcaaataaaaagtgcttt

SEQ ID NO: 2461129 - DNA, 14 bp, Homo sapiens
ttgcctggtacagt

SEQ ID NO: 2461130 - DNA, 17 bp, Homo sapiens
ttgccttctacttttaa

SEQ ID NO: 2461131 - DNA, 19 bp, Homo sapiens
ttgccttttgcaaccagga

SEQ ID NO: 2461132 - DNA, 15 bp, Homo sapiens
ttgcgagagatgtgt

SEQ ID NO: 2461133 - DNA, 19 bp, Homo sapiens
ttgcgagagatgtgtgttg

SEQ ID NO: 2461134 - DNA, 19 bp, Homo sapiens
ttgcgatagagtctcactg

SEQ ID NO: 2461135 - DNA, 15 bp, Homo sapiens
ttgcgctcctggccc

SEQ ID NO: 2461136 - DNA, 19 bp, Homo sapiens
ttgcgctcctggcccagcc

SEQ ID NO: 2461137 - DNA, 15 bp, Homo sapiens
ttgctagagctcctc

SEQ ID NO: 2461138 - DNA, 13 bp, Homo sapiens
ttgctattctgtc

SEQ ID NO: 2461139 - DNA, 14 bp, Homo sapiens
ttgctattctgtcc

SEQ ID NO: 2461140 - DNA, 19 bp, Homo sapiens
ttgctattctgtccctagg

SEQ ID NO: 2461141 - DNA, 13 bp, Homo sapiens
ttgctcacccagt

SEQ ID NO: 2461142 - DNA, 11 bp, Homo sapiens
ttgctcctcct

SEQ ID NO: 2461143 - DNA, 17 bp, Homo sapiens
ttgctgaaaaatgggca

SEQ ID NO: 2461144 - DNA, 21 bp, Homo sapiens
ttgctgactgtagctttggaa

SEQ ID NO: 2461145 - DNA, 15 bp, Homo sapiens
ttgctgcttctccca

SEQ ID NO: 2461146 - DNA, 16 bp, Homo sapiens
ttgctgcttctcccag

SEQ ID NO: 2461147 - DNA, 17 bp, Homo sapiens
ttgctgcttctcccagg

SEQ ID NO: 2461148 - DNA, 16 bp, Homo sapiens
ttgctgtaatgttaat

SEQ ID NO: 2461149 - DNA, 14 bp, Homo sapiens
ttgctgtgaggctg

SEQ ID NO: 2461150 - DNA, 20 bp, Homo sapiens
ttgctgtgaggctgtcctgt

SEQ ID NO: 2461151 - DNA, 13 bp, Homo sapiens
ttgcttcatgtgt

SEQ ID NO: 2461152 - DNA, 20 bp, Homo sapiens
ttgcttcatgtgtcccagaa

SEQ ID NO: 2461153 - DNA, 17 bp, Homo sapiens
ttgcttcctcctcccca

SEQ ID NO: 2461154 - DNA, 19 bp, Homo sapiens
ttgctttaatataaatgca

SEQ ID NO: 2461155 - DNA, 23 bp, Homo sapiens
ttgctttaatataaatgcaaata

SEQ ID NO: 2461156 - DNA, 21 bp, Homo sapiens
ttgctttgaagtagctctttt

SEQ ID NO: 2461157 - DNA, 12 bp, Homo sapiens
ttgcttttcatg

SEQ ID NO: 2461158 - DNA, 18 bp, Homo sapiens
ttgcttttcatgcaaact

SEQ ID NO: 2461159 - DNA, 22 bp, Homo sapiens
ttgcttttcatgcaaactcttt

SEQ ID NO: 2461160 - DNA, 21 bp, Homo sapiens
ttggaaataaagtcagatgga

SEQ ID NO: 2461161 - DNA, 16 bp, Homo sapiens
ttggaaatttagcatt

SEQ ID NO: 2461162 - DNA, 17 bp, Homo sapiens
ttggaaatttagcattg

SEQ ID NO: 2461163 - DNA, 13 bp, Homo sapiens
ttggaaccagact

SEQ ID NO: 2461164 - DNA, 15 bp, Homo sapiens
ttggaaccagactct

SEQ ID NO: 2461165 - DNA, 16 bp, Homo sapiens
ttggaactggaggcag

SEQ ID NO: 2461166 - DNA, 22 bp, Homo sapiens
ttggaacttgcctgcctttcca

SEQ ID NO: 2461167 - DNA, 18 bp, Homo sapiens
ttggaagaaggggcaggt

SEQ ID NO: 2461168 - DNA, 20 bp, Homo sapiens
ttggaagagcagcacctcct

SEQ ID NO: 2461169 - DNA, 21 bp, Homo sapiens
ttggaagagcagcacctcctc

SEQ ID NO: 2461170 - DNA, 22 bp, Homo sapiens
ttggaagagcagcacctcctca

SEQ ID NO: 2461171 - DNA, 13 bp, Homo sapiens
ttggaaggagcag

SEQ ID NO: 2461172 - DNA, 19 bp, Homo sapiens
ttggaagtttagctctgag

SEQ ID NO: 2461173 - DNA, 20 bp, Homo sapiens
ttggaagtttagctctgaga

SEQ ID NO: 2461174 - DNA, 21 bp, Homo sapiens
ttggaagtttagctctgagaa

SEQ ID NO: 2461175 - DNA, 15 bp, Homo sapiens
ttggaatataattgt

SEQ ID NO: 2461176 - DNA, 17 bp, Homo sapiens
ttggaatgttctcagat

SEQ ID NO: 2461177 - DNA, 14 bp, Homo sapiens
ttggacaaatcaca

SEQ ID NO: 2461178 - DNA, 17 bp, Homo sapiens
ttggacaagcttctgag

SEQ ID NO: 2461179 - DNA, 14 bp, Homo sapiens
ttggacatcctcct

SEQ ID NO: 2461180 - DNA, 16 bp, Homo sapiens
ttggagagtttcctga

SEQ ID NO: 2461181 - DNA, 14 bp, Homo sapiens
ttggaggaagttgg

SEQ ID NO: 2461182 - DNA, 19 bp, Homo sapiens
ttggatattttttacttta

SEQ ID NO: 2461183 - DNA, 13 bp, Homo sapiens
ttggatcctgtgt

SEQ ID NO: 2461184 - DNA, 18 bp, Homo sapiens
ttggatcctgtgtggaga

SEQ ID NO: 2461185 - DNA, 14 bp, Homo sapiens
ttggattgtatatt

SEQ ID NO: 2461186 - DNA, 18 bp, Homo sapiens
ttggattgtatattgtgt

SEQ ID NO: 2461187 - DNA, 21 bp, Homo sapiens
ttggatttaaaagcctgctca

SEQ ID NO: 2461188 - DNA, 14 bp, Homo sapiens
ttggatttcctaat

SEQ ID NO: 2461189 - DNA, 14 bp, Homo sapiens
ttggatttgacatt

SEQ ID NO: 2461190 - DNA, 13 bp, Homo sapiens
ttggcaattttgt

SEQ ID NO: 2461191 - DNA, 20 bp, Homo sapiens
ttggcaccagacacccagga

SEQ ID NO: 2461192 - DNA, 17 bp, Homo sapiens
ttggcaccgaagcccag

SEQ ID NO: 2461193 - DNA, 18 bp, Homo sapiens
ttggcaccgaagcccaga

SEQ ID NO: 2461194 - DNA, 21 bp, Homo sapiens
ttggcacctaatccaggcaga

SEQ ID NO: 2461195 - DNA, 20 bp, Homo sapiens
ttggcatggaaatttaaagc

SEQ ID NO: 2461196 - DNA, 14 bp, Homo sapiens
ttggccactccgag

SEQ ID NO: 2461197 - DNA, 21 bp, Homo sapiens
ttggccactccgagaggtggg

SEQ ID NO: 2461198 - DNA, 19 bp, Homo sapiens
ttggccatatttacctcag

SEQ ID NO: 2461199 - DNA, 12 bp, Homo sapiens
ttggccatctgc

SEQ ID NO: 2461200 - DNA, 16 bp, Homo sapiens
ttggcctctctctagg

SEQ ID NO: 2461201 - DNA, 14 bp, Homo sapiens
ttggcctggagcac

SEQ ID NO: 2461202 - DNA, 18 bp, Homo sapiens
ttggcgtaggctacagag

SEQ ID NO: 2461203 - DNA, 22 bp, Homo sapiens
ttggcgtaggctacagagaagc

SEQ ID NO: 2461204 - DNA, 16 bp, Homo sapiens
ttggctatttaaaact

SEQ ID NO: 2461205 - DNA, 17 bp, Homo sapiens
ttggctatttaaaactt

SEQ ID NO: 2461206 - DNA, 17 bp, Homo sapiens
ttggctcgaatctctgt

SEQ ID NO: 2461207 - DNA, 21 bp, Homo sapiens
ttggctcgaatctctgtgcct

SEQ ID NO: 2461208 - DNA, 19 bp, Homo sapiens
ttggctctgccagtcctgt

SEQ ID NO: 2461209 - DNA, 21 bp, Homo sapiens
ttggctgaaattctcctggag

SEQ ID NO: 2461210 - DNA, 17 bp, Homo sapiens
ttggcttactgcagcct

SEQ ID NO: 2461211 - DNA, 14 bp, Homo sapiens
ttggcttataattc

SEQ ID NO: 2461212 - DNA, 18 bp, Homo sapiens
ttggcttataattctttc

SEQ ID NO: 2461213 - DNA, 22 bp, Homo sapiens
ttgggactgctaaataaaattt

SEQ ID NO: 2461214 - DNA, 14 bp, Homo sapiens
ttgggagacatgtg

SEQ ID NO: 2461215 - DNA, 13 bp, Homo sapiens
ttgggagttttta

SEQ ID NO: 2461216 - DNA, 15 bp, Homo sapiens
ttgggatatctcctg

SEQ ID NO: 2461217 - DNA, 13 bp, Homo sapiens
ttgggatttgctg

SEQ ID NO: 2461218 - DNA, 23 bp, Homo sapiens
ttgggcacccccagcctgggcct

SEQ ID NO: 2461219 - DNA, 12 bp, Homo sapiens
ttgggcagagct

SEQ ID NO: 2461220 - DNA, 20 bp, Homo sapiens
ttgggcccacacctccttcc

SEQ ID NO: 2461221 - DNA, 22 bp, Homo sapiens
ttgggcccacacctccttccct

SEQ ID NO: 2461222 - DNA, 17 bp, Homo sapiens
ttgggcctgctccagac

SEQ ID NO: 2461223 - DNA, 19 bp, Homo sapiens
ttgggcctgctccagacct

SEQ ID NO: 2461224 - DNA, 12 bp, Homo sapiens
ttgggctctgat

SEQ ID NO: 2461225 - DNA, 13 bp, Homo sapiens
ttgggctctgatg

SEQ ID NO: 2461226 - DNA, 19 bp, Homo sapiens
ttgggcttcagctgccagt

SEQ ID NO: 2461227 - DNA, 18 bp, Homo sapiens
ttgggcttgctattctgt

SEQ ID NO: 2461228 - DNA, 23 bp, Homo sapiens
ttggggaagagagcctgcaggat

SEQ ID NO: 2461229 - DNA, 23 bp, Homo sapiens
ttggggcaggagtagctgagctc

SEQ ID NO: 2461230 - DNA, 23 bp, Homo sapiens
ttggggggagtaaagaattattt

SEQ ID NO: 2461231 - DNA, 20 bp, Homo sapiens
ttgggggtcctcctccaggg

SEQ ID NO: 2461232 - DNA, 17 bp, Homo sapiens
ttgggggttcaggcccg

SEQ ID NO: 2461233 - DNA, 15 bp, Homo sapiens
ttggggtctgacccc

SEQ ID NO: 2461234 - DNA, 22 bp, Homo sapiens
ttggggtgcccctctccttctt

SEQ ID NO: 2461235 - DNA, 14 bp, Homo sapiens
ttgggtccaggagg

SEQ ID NO: 2461236 - DNA, 16 bp, Homo sapiens
ttggtaaagactggct

SEQ ID NO: 2461237 - DNA, 14 bp, Homo sapiens
ttggtaacttttgt

SEQ ID NO: 2461238 - DNA, 12 bp, Homo sapiens
ttggtaccagat

SEQ ID NO: 2461239 - DNA, 19 bp, Homo sapiens
ttggtaccagataactttt

SEQ ID NO: 2461240 - DNA, 15 bp, Homo sapiens
ttggtccaagattcc

SEQ ID NO: 2461241 - DNA, 14 bp, Homo sapiens
ttggttctaaggac

SEQ ID NO: 2461242 - DNA, 23 bp, Homo sapiens
ttggtttaaagaaagtgtatttg

SEQ ID NO: 2461243 - DNA, 14 bp, Homo sapiens
ttggttttcttctt

SEQ ID NO: 2461244 - DNA, 15 bp, Homo sapiens
ttgtaaaacaggtag

SEQ ID NO: 2461245 - DNA, 13 bp, Homo sapiens
ttgtaaaatgaca

SEQ ID NO: 2461246 - DNA, 22 bp, Homo sapiens
ttgtaaaatgacaatcatgtgt

SEQ ID NO: 2461247 - DNA, 17 bp, Homo sapiens
ttgtaaaattatttcat

SEQ ID NO: 2461248 - DNA, 12 bp, Homo sapiens
ttgtaacctgct

SEQ ID NO: 2461249 - DNA, 17 bp, Homo sapiens
ttgtaactaaaataatt

SEQ ID NO: 2461250 - DNA, 21 bp, Homo sapiens
ttgtaactaaaataattttgt

SEQ ID NO: 2461251 - DNA, 22 bp, Homo sapiens
ttgtaactaaaataattttgta

SEQ ID NO: 2461252 - DNA, 21 bp, Homo sapiens
ttgtaatagatgtttgataga

SEQ ID NO: 2461253 - DNA, 14 bp, Homo sapiens
ttgtaatatgtaaa

SEQ ID NO: 2461254 - DNA, 15 bp, Homo sapiens
ttgtaatgtcttgag

SEQ ID NO: 2461255 - DNA, 19 bp, Homo sapiens
ttgtaatgtcttgagctct

SEQ ID NO: 2461256 - DNA, 20 bp, Homo sapiens
ttgtaatgtcttgagctcta

SEQ ID NO: 2461257 - DNA, 17 bp, Homo sapiens
ttgtaattaaaagcaaa

SEQ ID NO: 2461258 - DNA, 23 bp, Homo sapiens
ttgtaattaaaagcaaatcattt

SEQ ID NO: 2461259 - DNA, 15 bp, Homo sapiens
ttgtaattatggagt

SEQ ID NO: 2461260 - DNA, 17 bp, Homo sapiens
ttgtaattctaaatgaa

SEQ ID NO: 2461261 - DNA, 16 bp, Homo sapiens
ttgtaatttaaaataa

SEQ ID NO: 2461262 - DNA, 13 bp, Homo sapiens
ttgtaattttaca

SEQ ID NO: 2461263 - DNA, 22 bp, Homo sapiens
ttgtaattttacacgcttttgt

SEQ ID NO: 2461264 - DNA, 13 bp, Homo sapiens
ttgtactatttaa

SEQ ID NO: 2461265 - DNA, 19 bp, Homo sapiens
ttgtagattgattgtattg

SEQ ID NO: 2461266 - DNA, 12 bp, Homo sapiens
ttgtagccagcc

SEQ ID NO: 2461267 - DNA, 14 bp, Homo sapiens
ttgtagctggggct

SEQ ID NO: 2461268 - DNA, 14 bp, Homo sapiens
ttgtagggtttcta

SEQ ID NO: 2461269 - DNA, 16 bp, Homo sapiens
ttgtagttgaatattg

SEQ ID NO: 2461270 - DNA, 20 bp, Homo sapiens
ttgtataattggatttccta

SEQ ID NO: 2461271 - DNA, 18 bp, Homo sapiens
ttgtatagttaacacact

SEQ ID NO: 2461272 - DNA, 19 bp, Homo sapiens
ttgtatattgtgtttgtgt

SEQ ID NO: 2461273 - DNA, 22 bp, Homo sapiens
ttgtattctctgagctgtgcag

SEQ ID NO: 2461274 - DNA, 13 bp, Homo sapiens
ttgtattgttgaa

SEQ ID NO: 2461275 - DNA, 13 bp, Homo sapiens
ttgtatttaacag

SEQ ID NO: 2461276 - DNA, 22 bp, Homo sapiens
ttgtatttaacagaaattgtat

SEQ ID NO: 2461277 - DNA, 22 bp, Homo sapiens
ttgtcaatgcagttgtctctgt

SEQ ID NO: 2461278 - DNA, 14 bp, Homo sapiens
ttgtcaccagatct

SEQ ID NO: 2461279 - DNA, 17 bp, Homo sapiens
ttgtcaggagtgtgtgt

SEQ ID NO: 2461280 - DNA, 19 bp, Homo sapiens
ttgtcattttttttctttg

SEQ ID NO: 2461281 - DNA, 15 bp, Homo sapiens
ttgtcctttcccttc

SEQ ID NO: 2461282 - DNA, 17 bp, Homo sapiens
ttgtcgtaaagatttgg

SEQ ID NO: 2461283 - DNA, 13 bp, Homo sapiens
ttgtctaagaaat

SEQ ID NO: 2461284 - DNA, 15 bp, Homo sapiens
ttgtctataaagcat

SEQ ID NO: 2461285 - DNA, 18 bp, Homo sapiens
ttgtctataaagcattta

SEQ ID NO: 2461286 - DNA, 15 bp, Homo sapiens
ttgtctgaacttgca

SEQ ID NO: 2461287 - DNA, 12 bp, Homo sapiens
ttgtctttattt

SEQ ID NO: 2461288 - DNA, 19 bp, Homo sapiens
ttgtctttttagatgccca

SEQ ID NO: 2461289 - DNA, 18 bp, Homo sapiens
ttgtgaattaggctgtaa

SEQ ID NO: 2461290 - DNA, 21 bp, Homo sapiens
ttgtgacagggcgggggtggc

SEQ ID NO: 2461291 - DNA, 20 bp, Homo sapiens
ttgtgatgtcatacagagaa

SEQ ID NO: 2461292 - DNA, 16 bp, Homo sapiens
ttgtgattggcctgta

SEQ ID NO: 2461293 - DNA, 18 bp, Homo sapiens
ttgtgcaatgtaaatatt

SEQ ID NO: 2461294 - DNA, 22 bp, Homo sapiens
ttgtgcaatgtaaatattttaa

SEQ ID NO: 2461295 - DNA, 20 bp, Homo sapiens
ttgtgcaatgtgtataaaca

SEQ ID NO: 2461296 - DNA, 18 bp, Homo sapiens
ttgtgcacatttatttcc

SEQ ID NO: 2461297 - DNA, 22 bp, Homo sapiens
ttgtgcccccaaccatttcctc

SEQ ID NO: 2461298 - DNA, 17 bp, Homo sapiens
ttgtggcctaagaggct

SEQ ID NO: 2461299 - DNA, 18 bp, Homo sapiens
ttgtggcctttgcgctcc

SEQ ID NO: 2461300 - DNA, 13 bp, Homo sapiens
ttgtgggcctggg

SEQ ID NO: 2461301 - DNA, 14 bp, Homo sapiens
ttgtgggcctgggc

SEQ ID NO: 2461302 - DNA, 18 bp, Homo sapiens
ttgtgggcctgggctcct

SEQ ID NO: 2461303 - DNA, 20 bp, Homo sapiens
ttgtgggcctgggctcctgg

SEQ ID NO: 2461304 - DNA, 16 bp, Homo sapiens
ttgtgggggactgtaa

SEQ ID NO: 2461305 - DNA, 19 bp, Homo sapiens
ttgtgggggactgtaagtt

SEQ ID NO: 2461306 - DNA, 20 bp, Homo sapiens
ttgtggtttatatatttaaa

SEQ ID NO: 2461307 - DNA, 14 bp, Homo sapiens
ttgtgtaagaaata

SEQ ID NO: 2461308 - DNA, 15 bp, Homo sapiens
ttgtgtctcttatgg

SEQ ID NO: 2461309 - DNA, 13 bp, Homo sapiens
ttgtgtgctctcc

SEQ ID NO: 2461310 - DNA, 13 bp, Homo sapiens
ttgtgtggattct

SEQ ID NO: 2461311 - DNA, 16 bp, Homo sapiens
ttgtgtgtatttgcta

SEQ ID NO: 2461312 - DNA, 17 bp, Homo sapiens
ttgtgtgttgtctcttg

SEQ ID NO: 2461313 - DNA, 17 bp, Homo sapiens
ttgtgtttgtgtattta

SEQ ID NO: 2461314 - DNA, 16 bp, Homo sapiens
ttgttaatagttcctg

SEQ ID NO: 2461315 - DNA, 21 bp, Homo sapiens
ttgttaatttagaaaacttta

SEQ ID NO: 2461316 - DNA, 12 bp, Homo sapiens
tttcctctccac

SEQ ID NO: 2461317 - DNA, 21 bp, Homo sapiens
tttcctgaaacaacttggaaa

SEQ ID NO: 2461318 - DNA, 20 bp, Homo sapiens
tttcctggacactcagacct

SEQ ID NO: 2461319 - DNA, 20 bp, Homo sapiens
tttcctgtcctctttcagct

SEQ ID NO: 2461320 - DNA, 21 bp, Homo sapiens
tttcctgtcctctttcagctc

SEQ ID NO: 2461321 - DNA, 12 bp, Homo sapiens
tttccttccaat

SEQ ID NO: 2461322 - DNA, 18 bp, Homo sapiens
tttccttcccttttctgt

SEQ ID NO: 2461323 - DNA, 19 bp, Homo sapiens
tttccttcccttttctgtt

SEQ ID NO: 2461324 - DNA, 13 bp, Homo sapiens
tttcctttttaat

SEQ ID NO: 2461325 - DNA, 16 bp, Homo sapiens
tttcgtaacacagcat

SEQ ID NO: 2461326 - DNA, 16 bp, Homo sapiens
tttctaaactggagac

SEQ ID NO: 2461327 - DNA, 20 bp, Homo sapiens
tttctaaactggagactgtg

SEQ ID NO: 2461328 - DNA, 14 bp, Homo sapiens
tttctaaaggagtt

SEQ ID NO: 2461329 - DNA, 16 bp, Homo sapiens
tttctaaaggagttta

SEQ ID NO: 2461330 - DNA, 22 bp, Homo sapiens
tttctaactacaaaggtttaaa

SEQ ID NO: 2461331 - DNA, 14 bp, Homo sapiens
tttctaagaaacat

SEQ ID NO: 2461332 - DNA, 17 bp, Homo sapiens
tttctaagaaacattta

SEQ ID NO: 2461333 - DNA, 13 bp, Homo sapiens
tttctaagattct

SEQ ID NO: 2461334 - DNA, 17 bp, Homo sapiens
tttctaagattctaaag

SEQ ID NO: 2461335 - DNA, 18 bp, Homo sapiens
tttctaattatgtagctc

SEQ ID NO: 2461336 - DNA, 13 bp, Homo sapiens
tttctagaccaat

SEQ ID NO: 2461337 - DNA, 22 bp, Homo sapiens
tttctatagccaaaaatagcta

SEQ ID NO: 2461338 - DNA, 17 bp, Homo sapiens
tttctatcgttctctct

SEQ ID NO: 2461339 - DNA, 19 bp, Homo sapiens
tttctatcgttctctcttt

SEQ ID NO: 2461340 - DNA, 15 bp, Homo sapiens
tttctattaaaagac

SEQ ID NO: 2461341 - DNA, 16 bp, Homo sapiens
tttctattaaaagact

SEQ ID NO: 2461342 - DNA, 18 bp, Homo sapiens
tttctattaaaagactca

SEQ ID NO: 2461343 - DNA, 18 bp, Homo sapiens
tttctcaggctaggccag

SEQ ID NO: 2461344 - DNA, 11 bp, Homo sapiens
tttctccagct

SEQ ID NO: 2461345 - DNA, 14 bp, Homo sapiens
tttctcctccatgg

SEQ ID NO: 2461346 - DNA, 19 bp, Homo sapiens
tttctcctttaattgtaaa

SEQ ID NO: 2461347 - DNA, 16 bp, Homo sapiens
tttctctcaacaccat

SEQ ID NO: 2461348 - DNA, 17 bp, Homo sapiens
tttctcttttgctttct

SEQ ID NO: 2461349 - DNA, 16 bp, Homo sapiens
tttctgaaaatataac

SEQ ID NO: 2461350 - DNA, 16 bp, Homo sapiens
tttctgaacagctggt

SEQ ID NO: 2461351 - DNA, 22 bp, Homo sapiens
tttctgaacagctggtgtagct

SEQ ID NO: 2461352 - DNA, 14 bp, Homo sapiens
tttctgaccaaaga

SEQ ID NO: 2461353 - DNA, 14 bp, Homo sapiens
tttctgagggcccg

SEQ ID NO: 2461354 - DNA, 21 bp, Homo sapiens
tttctgaggtgcactgggagg

SEQ ID NO: 2461355 - DNA, 13 bp, Homo sapiens
tttctgccctgcc

SEQ ID NO: 2461356 - DNA, 14 bp, Homo sapiens
tttctgcctggagt

SEQ ID NO: 2461357 - DNA, 15 bp, Homo sapiens
tttctggtggtctgt

SEQ ID NO: 2461358 - DNA, 20 bp, Homo sapiens
tttctggtggtctgttggca

SEQ ID NO: 2461359 - DNA, 22 bp, Homo sapiens
tttctggttcttgtgttggctg

SEQ ID NO: 2461360 - DNA, 21 bp, Homo sapiens
tttctggttgttatgtgatca

SEQ ID NO: 2461361 - DNA, 19 bp, Homo sapiens
tttctgtaattcaggtttt

SEQ ID NO: 2461362 - DNA, 21 bp, Homo sapiens
tttcttaaagtgccagtattt

SEQ ID NO: 2461363 - DNA, 19 bp, Homo sapiens
tttcttaaataagaaactt

SEQ ID NO: 2461364 - DNA, 17 bp, Homo sapiens
tttcttcactgcaacat

SEQ ID NO: 2461365 - DNA, 22 bp, Homo sapiens
tttcttcctaccaagtcaaact

SEQ ID NO: 2461366 - DNA, 23 bp, Homo sapiens
tttcttcctaccaagtcaaactt

SEQ ID NO: 2461367 - DNA, 12 bp, Homo sapiens
tttcttgcctca

SEQ ID NO: 2461368 - DNA, 12 bp, Homo sapiens
tttctttaactg

SEQ ID NO: 2461369 - DNA, 21 bp, Homo sapiens
tttctttgaaaaaaaataaat

SEQ ID NO: 2461370 - DNA, 13 bp, Homo sapiens
tttcttttctttg

SEQ ID NO: 2461371 - DNA, 20 bp, Homo sapiens
tttgaaaaagcgaaaaaatc

SEQ ID NO: 2461372 - DNA, 19 bp, Homo sapiens
tttgaaagtctgtccttga

SEQ ID NO: 2461373 - DNA, 12 bp, Homo sapiens
tttgaaataagc

SEQ ID NO: 2461374 - DNA, 16 bp, Homo sapiens
tttgaaataagctatt

SEQ ID NO: 2461375 - DNA, 16 bp, Homo sapiens
tttgaaattatgtaaa

SEQ ID NO: 2461376 - DNA, 14 bp, Homo sapiens
tttgaactttttat

SEQ ID NO: 2461377 - DNA, 13 bp, Homo sapiens
tttgaaggcaaaa

SEQ ID NO: 2461378 - DNA, 13 bp, Homo sapiens
tttgaagtattta

SEQ ID NO: 2461379 - DNA, 22 bp, Homo sapiens
tttgaagtcataccaatgaaaa

SEQ ID NO: 2461380 - DNA, 15 bp, Homo sapiens
tttgaagtgctgttt

SEQ ID NO: 2461381 - DNA, 17 bp, Homo sapiens
tttgaagttagctttaa

SEQ ID NO: 2461382 - DNA, 17 bp, Homo sapiens
tttgaatgatttttctt

SEQ ID NO: 2461383 - DNA, 22 bp, Homo sapiens
tttgaatgatttttctttacaa

SEQ ID NO: 2461384 - DNA, 13 bp, Homo sapiens
tttgacagtgttt

SEQ ID NO: 2461385 - DNA, 13 bp, Homo sapiens
tttgaccttttat

SEQ ID NO: 2461386 - DNA, 19 bp, Homo sapiens
tttgactagatgatggatg

SEQ ID NO: 2461387 - DNA, 12 bp, Homo sapiens
tttgactctttt

SEQ ID NO: 2461388 - DNA, 14 bp, Homo sapiens
tttgacttttctgt

SEQ ID NO: 2461389 - DNA, 16 bp, Homo sapiens
tttgacttttctgtaa

SEQ ID NO: 2461390 - DNA, 14 bp, Homo sapiens
tttgaggcaaaaga

SEQ ID NO: 2461391 - DNA, 15 bp, Homo sapiens
tttgaggcaaaagaa

SEQ ID NO: 2461392 - DNA, 18 bp, Homo sapiens
tttgatactaagcattga

SEQ ID NO: 2461393 - DNA, 12 bp, Homo sapiens
tttgatgataaa

SEQ ID NO: 2461394 - DNA, 17 bp, Homo sapiens
tttgatgttccttccag

SEQ ID NO: 2461395 - DNA, 20 bp, Homo sapiens
tttgattcatagtaacttct

SEQ ID NO: 2461396 - DNA, 18 bp, Homo sapiens
tttgcaaaaaatgttttt

SEQ ID NO: 2461397 - DNA, 14 bp, Homo sapiens
tttgcaaccaggaa

SEQ ID NO: 2461398 - DNA, 15 bp, Homo sapiens
tttgcaaccaggaac

SEQ ID NO: 2461399 - DNA, 22 bp, Homo sapiens
tttgcaggtggccaagttcctc

SEQ ID NO: 2461400 - DNA, 10 bp, Homo sapiens
tttgcagtaa

SEQ ID NO: 2461401 - DNA, 18 bp, Homo sapiens
tttgcataacaattcctc

SEQ ID NO: 2461402 - DNA, 20 bp, Homo sapiens
tttgcataacaattcctcta

SEQ ID NO: 2461403 - DNA, 22 bp, Homo sapiens
tttgcataacaattcctctact

SEQ ID NO: 2461404 - DNA, 23 bp, Homo sapiens
tttgcatagtaccaatcatttta

SEQ ID NO: 2461405 - DNA, 15 bp, Homo sapiens
tttgcattaaattac

SEQ ID NO: 2461406 - DNA, 19 bp, Homo sapiens
tttgcattgaacacaaact

SEQ ID NO: 2461407 - DNA, 20 bp, Homo sapiens
tttgcatttgtttatgtaat

SEQ ID NO: 2461408 - DNA, 18 bp, Homo sapiens
tttgccacagcttttgca

SEQ ID NO: 2461409 - DNA, 12 bp, Homo sapiens
tttgccctttga

SEQ ID NO: 2461410 - DNA, 15 bp, Homo sapiens
tttgcgctcctggcc

SEQ ID NO: 2461411 - DNA, 21 bp, Homo sapiens
tttgcgctcctggcccagcct

SEQ ID NO: 2461412 - DNA, 18 bp, Homo sapiens
tttgctcttcaagaaatc

SEQ ID NO: 2461413 - DNA, 19 bp, Homo sapiens
tttgctgagcatgtactga

SEQ ID NO: 2461414 - DNA, 19 bp, Homo sapiens
tttgctgtgaggctgtcct

SEQ ID NO: 2461415 - DNA, 20 bp, Homo sapiens
tttggaaagtacactctgct

SEQ ID NO: 2461416 - DNA, 21 bp, Homo sapiens
tttggaaccagactcttgcct

SEQ ID NO: 2461417 - DNA, 13 bp, Homo sapiens
tttggaaccttgt

SEQ ID NO: 2461418 - DNA, 14 bp, Homo sapiens
tttggaaccttgtt

SEQ ID NO: 2461419 - DNA, 19 bp, Homo sapiens
tttggaagtttagctctga

SEQ ID NO: 2461420 - DNA, 20 bp, Homo sapiens
tttgtgtctcttatggatgt

SEQ ID NO: 2461421 - DNA, 13 bp, Homo sapiens
tttgtgtgtctta

SEQ ID NO: 2461422 - DNA, 13 bp, Homo sapiens
tttgtgttctgtt

SEQ ID NO: 2461423 - DNA, 12 bp, Homo sapiens
tttgttaattta

SEQ ID NO: 2461424 - DNA, 22 bp, Homo sapiens
tttgttaatttagaaaacttta

SEQ ID NO: 2461425 - DNA, 16 bp, Homo sapiens
tttgttattttgcaac

SEQ ID NO: 2461426 - DNA, 15 bp, Homo sapiens
tttgttcccaagagc

SEQ ID NO: 2461427 - DNA, 14 bp, Homo sapiens
tttgttgacattag

SEQ ID NO: 2461428 - DNA, 20 bp, Homo sapiens
tttgttgacattctgaatgc

SEQ ID NO: 2461429 - DNA, 13 bp, Homo sapiens
tttgttggttggt

SEQ ID NO: 2461430 - DNA, 21 bp, Homo sapiens
tttgtttatggtaaaaaattt

SEQ ID NO: 2461431 - DNA, 15 bp, Homo sapiens
tttgtttatgtaatt

SEQ ID NO: 2461432 - DNA, 22 bp, Homo sapiens
tttgtttcaatgaggtgtccaa

SEQ ID NO: 2461433 - DNA, 17 bp, Homo sapiens
tttgtttctttctctga

SEQ ID NO: 2461434 - DNA, 11 bp, Homo sapiens
tttgtttgttt

SEQ ID NO: 2461435 - DNA, 17 bp, Homo sapiens
tttgtttttccttccaa

SEQ ID NO: 2461436 - DNA, 14 bp, Homo sapiens
ttttaaaaaagctt

SEQ ID NO: 2461437 - DNA, 15 bp, Homo sapiens
ttttaaaaaagctta

SEQ ID NO: 2461438 - DNA, 17 bp, Homo sapiens
ttttaaaaaagcttaaa

SEQ ID NO: 2461439 - DNA, 22 bp, Homo sapiens
ttttaaaaaagcttaaaacttt

SEQ ID NO: 2461440 - DNA, 23 bp, Homo sapiens
ttttaaaaaagcttaaaactttg

SEQ ID NO: 2461441 - DNA, 20 bp, Homo sapiens
ttttaaaaattgttaatttt

SEQ ID NO: 2461442 - DNA, 14 bp, Homo sapiens
ttttaaaatgtaca

SEQ ID NO: 2461443 - DNA, 15 bp, Homo sapiens
ttttaaaatttgttc

SEQ ID NO: 2461444 - DNA, 15 bp, Homo sapiens
ttttaaactgtacag

SEQ ID NO: 2461445 - DNA, 17 bp, Homo sapiens
ttttaaactgtacagtg

SEQ ID NO: 2461446 - DNA, 20 bp, Homo sapiens
ttttaaattcccgttttgtc

SEQ ID NO: 2461447 - DNA, 13 bp, Homo sapiens
ttttaacattcct

SEQ ID NO: 2461448 - DNA, 12 bp, Homo sapiens
ttttaactttgt

SEQ ID NO: 2461449 - DNA, 18 bp, Homo sapiens
ttttaactttgttttatt

SEQ ID NO: 2461450 - DNA, 19 bp, Homo sapiens
ttttaagaattgagtaatg

SEQ ID NO: 2461451 - DNA, 15 bp, Homo sapiens
ttttaagctctgagc

SEQ ID NO: 2461452 - DNA, 20 bp, Homo sapiens
ttttaagtttctctgcagaa

SEQ ID NO: 2461453 - DNA, 19 bp, Homo sapiens
ttttaataaaaataatttt

SEQ ID NO: 2461454 - DNA, 20 bp, Homo sapiens
ttttaatccgccaatattag

SEQ ID NO: 2461455 - DNA, 20 bp, Homo sapiens
ttttaattattatttatata

SEQ ID NO: 2461456 - DNA, 11 bp, Homo sapiens
ttttacatgaa

SEQ ID NO: 2461457 - DNA, 12 bp, Homo sapiens
ttttacatgaag

SEQ ID NO: 2461458 - DNA, 14 bp, Homo sapiens
ttttacatgaagta

SEQ ID NO: 2461459 - DNA, 18 bp, Homo sapiens
ttttacatgaagtatttt

SEQ ID NO: 2461460 - DNA, 14 bp, Homo sapiens
ttttacctttcata

SEQ ID NO: 2461461 - DNA, 17 bp, Homo sapiens
ttttactattgttacat

SEQ ID NO: 2461462 - DNA, 14 bp, Homo sapiens
ttttactctgccta

SEQ ID NO: 2461463 - DNA, 13 bp, Homo sapiens
ttttagcttttgt

SEQ ID NO: 2461464 - DNA, 18 bp, Homo sapiens
ttttaggaagcaagctta

SEQ ID NO: 2461465 - DNA, 14 bp, Homo sapiens
ttttaggttctaaa

SEQ ID NO: 2461466 - DNA, 18 bp, Homo sapiens
ttttaggttctaaagttc

SEQ ID NO: 2461467 - DNA, 18 bp, Homo sapiens
ttttagtttttcattaaa

SEQ ID NO: 2461468 - DNA, 13 bp, Homo sapiens
ttttatatcccat

SEQ ID NO: 2461469 - DNA, 21 bp, Homo sapiens
ttttatattaaccagatatat

SEQ ID NO: 2461470 - DNA, 23 bp, Homo sapiens
ttttatctgaatttttaaacaag

SEQ ID NO: 2461471 - DNA, 13 bp, Homo sapiens
ttttattaatgca

SEQ ID NO: 2461472 - DNA, 19 bp, Homo sapiens
ttttattaatgcactttct

SEQ ID NO: 2461473 - DNA, 23 bp, Homo sapiens
ttttattagtattgttgtccttt

SEQ ID NO: 2461474 - DNA, 13 bp, Homo sapiens
ttttatttaaaaa

SEQ ID NO: 2461475 - DNA, 14 bp, Homo sapiens
ttttcaaaatggag

SEQ ID NO: 2461476 - DNA, 18 bp, Homo sapiens
ttttcaacagtgaagaca

SEQ ID NO: 2461477 - DNA, 14 bp, Homo sapiens
ttttcaatagccac

SEQ ID NO: 2461478 - DNA, 20 bp, Homo sapiens
ttttcaccccacccttcccc

SEQ ID NO: 2461479 - DNA, 16 bp, Homo sapiens
ttttcatacattttct

SEQ ID NO: 2461480 - DNA, 18 bp, Homo sapiens
ttttcatacattttctaa

SEQ ID NO: 2461481 - DNA, 21 bp, Homo sapiens
ttttcatacattttctaagaa

SEQ ID NO: 2461482 - DNA, 17 bp, Homo sapiens
ttttcataggtctgaaa

SEQ ID NO: 2461483 - DNA, 18 bp, Homo sapiens
ttttcatccataactgaa

SEQ ID NO: 2461484 - DNA, 21 bp, Homo sapiens
ttttcatcttcagttgtctct

SEQ ID NO: 2461485 - DNA, 18 bp, Homo sapiens
ttttcattaaataaattt

SEQ ID NO: 2461486 - DNA, 20 bp, Homo sapiens
ttttcattaaataaatttga

SEQ ID NO: 2461487 - DNA, 11 bp, Homo sapiens
ttttccaaatg

SEQ ID NO: 2461488 - DNA, 14 bp, Homo sapiens
ttttccaactacta

SEQ ID NO: 2461489 - DNA, 17 bp, Homo sapiens
ttttccaggcttctgct

SEQ ID NO: 2461490 - DNA, 17 bp, Homo sapiens
gtttcatgttagttacc

SEQ ID NO: 2461491 - DNA, 14 bp, Homo sapiens
gtttcccaggccca

SEQ ID NO: 2461492 - DNA, 22 bp, Homo sapiens
gtttcctctgttcaaagctgcc

SEQ ID NO: 2461493 - DNA, 22 bp, Homo sapiens
gtttcctgaaacaacttggaaa

SEQ ID NO: 2461494 - DNA, 19 bp, Homo sapiens
gtttccttgggagttgtca

SEQ ID NO: 2461495 - DNA, 15 bp, Homo sapiens
gtttcgtggggaggt

SEQ ID NO: 2461496 - DNA, 17 bp, Homo sapiens
gtttctaaactggagac

SEQ ID NO: 2461497 - DNA, 22 bp, Homo sapiens
gtttctcccccatgttctgtcc

SEQ ID NO: 2461498 - DNA, 14 bp, Homo sapiens
gtttctggatttca

SEQ ID NO: 2461499 - DNA, 21 bp, Homo sapiens
gtttctggtggtctgttggca

SEQ ID NO: 2461500 - DNA, 22 bp, Homo sapiens
gtttcttaaataagaaactttt

SEQ ID NO: 2461501 - DNA, 23 bp, Homo sapiens
gtttcttgcctcatttttttcct

SEQ ID NO: 2461502 - DNA, 18 bp, Homo sapiens
gtttgactagatgatgga

SEQ ID NO: 2461503 - DNA, 15 bp, Homo sapiens
gtttgagattctcaa

SEQ ID NO: 2461504 - DNA, 16 bp, Homo sapiens
gtttgatagattttct

SEQ ID NO: 2461505 - DNA, 11 bp, Homo sapiens
gtttgatttca

SEQ ID NO: 2461506 - DNA, 17 bp, Homo sapiens
gtttgcactatctttca

SEQ ID NO: 2461507 - DNA, 21 bp, Homo sapiens
gtttgcagaagggggtctctt

SEQ ID NO: 2461508 - DNA, 16 bp, Homo sapiens
gtttgcagtcccaagc

SEQ ID NO: 2461509 - DNA, 15 bp, Homo sapiens
gtttgccttccagaa

SEQ ID NO: 2461510 - DNA, 19 bp, Homo sapiens
gtttgcttcaactgtctcc

SEQ ID NO: 2461511 - DNA, 15 bp, Homo sapiens
gtttgcttcatgtgt

SEQ ID NO: 2461512 - DNA, 11 bp, Homo sapiens
gtttgctttct

SEQ ID NO: 2461513 - DNA, 20 bp, Homo sapiens
gtttggatatgtaaaacatt

SEQ ID NO: 2461514 - DNA, 19 bp, Homo sapiens
gtttgggtaaaatactttt

SEQ ID NO: 2461515 - DNA, 18 bp, Homo sapiens
gtttgtcgctcatgtgtg

SEQ ID NO: 2461516 - DNA, 13 bp, Homo sapiens
gtttgtgtgtctt

SEQ ID NO: 2461517 - DNA, 15 bp, Homo sapiens
gtttgtgtgtcttaa

SEQ ID NO: 2461518 - DNA, 13 bp, Homo sapiens
gtttgtttgttgc

SEQ ID NO: 2461519 - DNA, 16 bp, Homo sapiens
gttttaaaaagccagt

SEQ ID NO: 2461520 - DNA, 15 bp, Homo sapiens
gttttaactgtggat

SEQ ID NO: 2461521 - DNA, 14 bp, Homo sapiens
gttttaactttgtt

SEQ ID NO: 2461522 - DNA, 21 bp, Homo sapiens
gttttagattttctggttcta

SEQ ID NO: 2461523 - DNA, 22 bp, Homo sapiens
gttttataagcatcattattta

SEQ ID NO: 2461524 - DNA, 23 bp, Homo sapiens
gttttataagcatcattatttat

SEQ ID NO: 2461525 - DNA, 11 bp, Homo sapiens
gttttatatat

SEQ ID NO: 2461526 - DNA, 20 bp, Homo sapiens
gttttatatattatatggaa

SEQ ID NO: 2461527 - DNA, 12 bp, Homo sapiens
gttttatttcat

SEQ ID NO: 2461528 - DNA, 18 bp, Homo sapiens
gttttcatccataactga

SEQ ID NO: 2461529 - DNA, 16 bp, Homo sapiens
gttttcatttggttca

SEQ ID NO: 2461530 - DNA, 16 bp, Homo sapiens
gttttcgaaaatcaaa

SEQ ID NO: 2461531 - DNA, 17 bp, Homo sapiens
gttttctgaaaatataa

SEQ ID NO: 2461532 - DNA, 22 bp, Homo sapiens
gttttgcacagccaaatttaaa

SEQ ID NO: 2461533 - DNA, 19 bp, Homo sapiens
gttttggagagtttgcctg

SEQ ID NO: 2461534 - DNA, 16 bp, Homo sapiens
gttttgttgacattct

SEQ ID NO: 2461535 - DNA, 18 bp, Homo sapiens
gttttgttgacattctga

SEQ ID NO: 2461536 - DNA, 22 bp, Homo sapiens
gttttgttgacattctgaatgc

SEQ ID NO: 2461537 - DNA, 17 bp, Homo sapiens
gtttttaaactgtacag

SEQ ID NO: 2461538 - DNA, 17 bp, Homo sapiens
gtttttatgagaaactt

SEQ ID NO: 2461539 - DNA, 18 bp, Homo sapiens
gtttttcattaaataaat

SEQ ID NO: 2461540 - DNA, 22 bp, Homo sapiens
gtttttccttccaatgtctgga

SEQ ID NO: 2461541 - DNA, 20 bp, Homo sapiens
gtttttctaaaggagtttat

SEQ ID NO: 2461542 - DNA, 17 bp, Homo sapiens
gtttttctattaaaaga

SEQ ID NO: 2461543 - DNA, 23 bp, Homo sapiens
gtttttgatcaaaaactatttgg

SEQ ID NO: 2461544 - DNA, 15 bp, Homo sapiens
gttttttatgctaat

SEQ ID NO: 2461545 - DNA, 14 bp, Homo sapiens
gttttttgtaccaa

SEQ ID NO: 2461546 - DNA, 21 bp, Homo sapiens
gttttttttttcttgtctata

SEQ ID NO: 2461547 - DNA, 16 bp, Homo sapiens
gttttttttttgtttg

SEQ ID NO: 2461548 - DNA, 15 bp, Homo sapiens
taaaaaaccacatgg

SEQ ID NO: 2461549 - DNA, 19 bp, Homo sapiens
taaaaaactaaaaactaga

SEQ ID NO: 2461550 - DNA, 22 bp, Homo sapiens
taaaaacagatttggaaagact

SEQ ID NO: 2461551 - DNA, 20 bp, Homo sapiens
taaaaactagaggtgagaaa

SEQ ID NO: 2461552 - DNA, 17 bp, Homo sapiens
taaaaagcttttgtcta

SEQ ID NO: 2461553 - DNA, 19 bp, Homo sapiens
taaaaataaaaaagatccc

SEQ ID NO: 2461554 - DNA, 23 bp, Homo sapiens
taaaaatggcagggggtggaatt

SEQ ID NO: 2461555 - DNA, 13 bp, Homo sapiens
taaaacaatgaat

SEQ ID NO: 2461556 - DNA, 14 bp, Homo sapiens
taaaacagaagcct

SEQ ID NO: 2461557 - DNA, 21 bp, Homo sapiens
taaaacaggttataacagtgt

SEQ ID NO: 2461558 - DNA, 19 bp, Homo sapiens
taaaacatctttgaaatta

SEQ ID NO: 2461559 - DNA, 14 bp, Homo sapiens
taaaacatttattt

SEQ ID NO: 2461560 - DNA, 20 bp, Homo sapiens
taaaactgtttttgaacctg

SEQ ID NO: 2461561 - DNA, 22 bp, Homo sapiens
taaaacttcagtttcacagaaa

SEQ ID NO: 2461562 - DNA, 13 bp, Homo sapiens
taaaactttcctc

SEQ ID NO: 2461563 - DNA, 17 bp, Homo sapiens
taaaactttcctcgcct

SEQ ID NO: 2461564 - DNA, 14 bp, Homo sapiens
taaaactttgaagt

SEQ ID NO: 2461565 - DNA, 15 bp, Homo sapiens
taaaactttgaagtt

SEQ ID NO: 2461566 - DNA, 13 bp, Homo sapiens
taaaagatgaaag

SEQ ID NO: 2461567 - DNA, 17 bp, Homo sapiens
taaaagatgaaagagca

SEQ ID NO: 2461568 - DNA, 16 bp, Homo sapiens
taaaagcaaaaaagaa

SEQ ID NO: 2461569 - DNA, 13 bp, Homo sapiens
taaaagcaaatca

SEQ ID NO: 2461570 - DNA, 13 bp, Homo sapiens
taaaagcacgaca

SEQ ID NO: 2461571 - DNA, 15 bp, Homo sapiens
taaaagcattttgta

SEQ ID NO: 2461572 - DNA, 18 bp, Homo sapiens
taaaagcattttgtaata

SEQ ID NO: 2461573 - DNA, 22 bp, Homo sapiens
taaaagtgggcttgattctgca

SEQ ID NO: 2461574 - DNA, 23 bp, Homo sapiens
taaaagtgggcttgattctgcag

SEQ ID NO: 2461575 - DNA, 21 bp, Homo sapiens
taaaataagcaggtggatcta

SEQ ID NO: 2461576 - DNA, 15 bp, Homo sapiens
taaaataatgggatt

SEQ ID NO: 2461577 - DNA, 19 bp, Homo sapiens
taaaataattatataactg

SEQ ID NO: 2461578 - DNA, 13 bp, Homo sapiens
taaaataattttg

SEQ ID NO: 2461579 - DNA, 14 bp, Homo sapiens
taaaataattttgt

SEQ ID NO: 2461580 - DNA, 16 bp, Homo sapiens
taaaatacagaataca

SEQ ID NO: 2461581 - DNA, 14 bp, Homo sapiens
taaaatacttttac

SEQ ID NO: 2461582 - DNA, 20 bp, Homo sapiens
taaaatacttttactctgcc

SEQ ID NO: 2461583 - DNA, 21 bp, Homo sapiens
taaaatagcgttcttgtaatt

SEQ ID NO: 2461584 - DNA, 14 bp, Homo sapiens
taaaatattttgaa

SEQ ID NO: 2461585 - DNA, 15 bp, Homo sapiens
taaaatcctcaatcc

SEQ ID NO: 2461586 - DNA, 18 bp, Homo sapiens
taaaatcttatagttcta

SEQ ID NO: 2461587 - DNA, 12 bp, Homo sapiens
taaaatcttgtc

SEQ ID NO: 2461588 - DNA, 23 bp, Homo sapiens
taaaatgtaaagccatgctggaa

SEQ ID NO: 2461589 - DNA, 17 bp, Homo sapiens
taaaatgtgatgttcta

SEQ ID NO: 2461590 - DNA, 22 bp, Homo sapiens
taaaatgtgatgttctaaggct

SEQ ID NO: 2461591 - DNA, 20 bp, Homo sapiens
taaaatgtgggattatgggt

SEQ ID NO: 2461592 - DNA, 13 bp, Homo sapiens
taaaatttgttct

SEQ ID NO: 2461593 - DNA, 20 bp, Homo sapiens
taaaatttgttcttgtattt

SEQ ID NO: 2461594 - DNA, 21 bp, Homo sapiens
taaacaagaaaaataaagaaa

SEQ ID NO: 2461595 - DNA, 22 bp, Homo sapiens
taaacaagtatttgttaattta

SEQ ID NO: 2461596 - DNA, 23 bp, Homo sapiens
taaacaagtatttgttaatttag

SEQ ID NO: 2461597 - DNA, 22 bp, Homo sapiens
taaacacaagattggtgttttt

SEQ ID NO: 2461598 - DNA, 22 bp, Homo sapiens
taaacattaatagcagcctttc

SEQ ID NO: 2461599 - DNA, 13 bp, Homo sapiens
taaaccatctccc

SEQ ID NO: 2461600 - DNA, 16 bp, Homo sapiens
taaaccatctccctgg

SEQ ID NO: 2461601 - DNA, 19 bp, Homo sapiens
taaaccatctccctggtgc

SEQ ID NO: 2461602 - DNA, 23 bp, Homo sapiens
taaacccatattgtaaaacaggt

SEQ ID NO: 2461603 - DNA, 13 bp, Homo sapiens
taaactaaatgtg

SEQ ID NO: 2461604 - DNA, 14 bp, Homo sapiens
taaactaaatgtgc

SEQ ID NO: 2461605 - DNA, 15 bp, Homo sapiens
taaactataagcaag

SEQ ID NO: 2461606 - DNA, 13 bp, Homo sapiens
taaactggagact

SEQ ID NO: 2461607 - DNA, 12 bp, Homo sapiens
taaactgtgcac

SEQ ID NO: 2461608 - DNA, 16 bp, Homo sapiens
taaacttataacccac

SEQ ID NO: 2461609 - DNA, 18 bp, Homo sapiens
taaacttccccatcttct

SEQ ID NO: 2461610 - DNA, 15 bp, Homo sapiens
taaactttatcactt

SEQ ID NO: 2461611 - DNA, 16 bp, Homo sapiens
taaactttatcactta

SEQ ID NO: 2461612 - DNA, 12 bp, Homo sapiens
taaactttttgt

SEQ ID NO: 2461613 - DNA, 16 bp, Homo sapiens
taaagaaaaaaatgta

SEQ ID NO: 2461614 - DNA, 17 bp, Homo sapiens
taaagaaaaaaatgtat

SEQ ID NO: 2461615 - DNA, 18 bp, Homo sapiens
taaagaaaaaaattgaaa

SEQ ID NO: 2461616 - DNA, 21 bp, Homo sapiens
taaagaaaaaaattgaaatgt

SEQ ID NO: 2461617 - DNA, 12 bp, Homo sapiens
taaagaaaagat

SEQ ID NO: 2461618 - DNA, 14 bp, Homo sapiens
taaagaaaagatgc

SEQ ID NO: 2461619 - DNA, 23 bp, Homo sapiens
taaagaaagtgtatttggaaata

SEQ ID NO: 2461620 - DNA, 19 bp, Homo sapiens
taaagaacaccctatattt

SEQ ID NO: 2461621 - DNA, 12 bp, Homo sapiens
taaagaagacct

SEQ ID NO: 2461622 - DNA, 16 bp, Homo sapiens
taaagaagacctgaga

SEQ ID NO: 2461623 - DNA, 20 bp, Homo sapiens
taaagaagacctgagaatgt

SEQ ID NO: 2461624 - DNA, 14 bp, Homo sapiens
taaagacaaaaaac

SEQ ID NO: 2461625 - DNA, 13 bp, Homo sapiens
taaagacatgaag

SEQ ID NO: 2461626 - DNA, 16 bp, Homo sapiens
taaagacatgaagcca

SEQ ID NO: 2461627 - DNA, 13 bp, Homo sapiens
taaagagacgaat

SEQ ID NO: 2461628 - DNA, 15 bp, Homo sapiens
taaagagtctagatt

SEQ ID NO: 2461629 - DNA, 17 bp, Homo sapiens
taaagatggagtttcta

SEQ ID NO: 2461630 - DNA, 21 bp, Homo sapiens
taaagattctatagttctaga

SEQ ID NO: 2461631 - DNA, 17 bp, Homo sapiens
taaagattttttaataa

SEQ ID NO: 2461632 - DNA, 20 bp, Homo sapiens
taaagattttttaataattt

SEQ ID NO: 2461633 - DNA, 21 bp, Homo sapiens
taaagattttttaataattta

SEQ ID NO: 2461634 - DNA, 22 bp, Homo sapiens
taaagattttttaataatttag

SEQ ID NO: 2461635 - DNA, 20 bp, Homo sapiens
taaagcaggccttttgatat

SEQ ID NO: 2461636 - DNA, 16 bp, Homo sapiens
taaagcaggttcttgt

SEQ ID NO: 2461637 - DNA, 14 bp, Homo sapiens
taaagcagtatttt

SEQ ID NO: 2461638 - DNA, 11 bp, Homo sapiens
taaagcctcaa

SEQ ID NO: 2461639 - DNA, 21 bp, Homo sapiens
taaagcgtttgcacagatcaa

SEQ ID NO: 2461640 - DNA, 14 bp, Homo sapiens
taaagctctgacat

SEQ ID NO: 2461641 - DNA, 14 bp, Homo sapiens
taaaggaaaagaca

SEQ ID NO: 2461642 - DNA, 16 bp, Homo sapiens
taaaggagtttatgtt

SEQ ID NO: 2461643 - DNA, 19 bp, Homo sapiens
taaaggagtttatgttcca

SEQ ID NO: 2461644 - DNA, 14 bp, Homo sapiens
taaaggcagttttc

SEQ ID NO: 2461645 - DNA, 22 bp, Homo sapiens
taaaggtgacatcggaaaaata

SEQ ID NO: 2461646 - DNA, 18 bp, Homo sapiens
taaagtattcttctcttc

SEQ ID NO: 2461647 - DNA, 13 bp, Homo sapiens
taaagtcagatgg

SEQ ID NO: 2461648 - DNA, 21 bp, Homo sapiens
taaagtctgttgattaaagat

SEQ ID NO: 2461649 - DNA, 22 bp, Homo sapiens
taaagtgccagtattttaaaat

SEQ ID NO: 2461650 - DNA, 17 bp, Homo sapiens
taaagtgctaaggttct

SEQ ID NO: 2461651 - DNA, 19 bp, Homo sapiens
taaagtgctaaggttctaa

SEQ ID NO: 2461652 - DNA, 20 bp, Homo sapiens
taaagtgctaaggttctaag

SEQ ID NO: 2461653 - DNA, 19 bp, Homo sapiens
taaagtgtaacaattgtgt

SEQ ID NO: 2461654 - DNA, 15 bp, Homo sapiens
taaagttctaagatt

SEQ ID NO: 2461655 - DNA, 16 bp, Homo sapiens
taaagttctaagattc

SEQ ID NO: 2461656 - DNA, 18 bp, Homo sapiens
taaagttctaagattctg

SEQ ID NO: 2461657 - DNA, 20 bp, Homo sapiens
taaagttgataaagattttt

SEQ ID NO: 2461658 - DNA, 17 bp, Homo sapiens
taaataaaatgctaggt

SEQ ID NO: 2461659 - DNA, 22 bp, Homo sapiens
taaataaaatgctaggttctac

SEQ ID NO: 2461660 - DNA, 20 bp, Homo sapiens
taaataaaatttgttgcata

SEQ ID NO: 2461661 - DNA, 14 bp, Homo sapiens
taaataaatttgac

SEQ ID NO: 2461662 - DNA, 16 bp, Homo sapiens
taaataaatttgactt

SEQ ID NO: 2461663 - DNA, 15 bp, Homo sapiens
taaataactggaaaa

SEQ ID NO: 2461664 - DNA, 22 bp, Homo sapiens
taaataagaaacaactctttga

SEQ ID NO: 2461665 - DNA, 16 bp, Homo sapiens
taaataagaaactttt

SEQ ID NO: 2461666 - DNA, 13 bp, Homo sapiens
taaataagattct

SEQ ID NO: 2461667 - DNA, 17 bp, Homo sapiens
taaataaggaaaagctt

SEQ ID NO: 2461668 - DNA, 14 bp, Homo sapiens
taaataatacatta

SEQ ID NO: 2461669 - DNA, 18 bp, Homo sapiens
taaatacaggaaacagtt

SEQ ID NO: 2461670 - DNA, 17 bp, Homo sapiens
taaatacagtcttccat

SEQ ID NO: 2461671 - DNA, 16 bp, Homo sapiens
taaatactgcaaatca

SEQ ID NO: 2461672 - DNA, 22 bp, Homo sapiens
taaatactgcaaatcaggcttt

SEQ ID NO: 2461673 - DNA, 13 bp, Homo sapiens
taaatataaagac

SEQ ID NO: 2461674 - DNA, 17 bp, Homo sapiens
taaatatattattactt

SEQ ID NO: 2461675 - DNA, 17 bp, Homo sapiens
taaatatatttaagata

SEQ ID NO: 2461676 - DNA, 21 bp, Homo sapiens
taaatatggactgctcaggaa

SEQ ID NO: 2461677 - DNA, 16 bp, Homo sapiens
taaatatgtacatttc

SEQ ID NO: 2461678 - DNA, 20 bp, Homo sapiens
taaatatgtacatttctcag

SEQ ID NO: 2461679 - DNA, 18 bp, Homo sapiens
taaatattttaaagaatt

SEQ ID NO: 2461680 - DNA, 19 bp, Homo sapiens
taaatcacgctttttgaaa

SEQ ID NO: 2461681 - DNA, 13 bp, Homo sapiens
taaatctacacac

SEQ ID NO: 2461682 - DNA, 15 bp, Homo sapiens
taaatctgacccagt

SEQ ID NO: 2461683 - DNA, 16 bp, Homo sapiens
taaatctgacccagtg

SEQ ID NO: 2461684 - DNA, 17 bp, Homo sapiens
taaatctgacccagtgc

SEQ ID NO: 2461685 - DNA, 15 bp, Homo sapiens
taaatgaacaagaga

SEQ ID NO: 2461686 - DNA, 23 bp, Homo sapiens
taaatgaacaagagaagcattct

SEQ ID NO: 2461687 - DNA, 12 bp, Homo sapiens
taaatgaatgtt

SEQ ID NO: 2461688 - DNA, 13 bp, Homo sapiens
taaatgacactca

SEQ ID NO: 2461689 - DNA, 18 bp, Homo sapiens
taagaggtgttatttgga

SEQ ID NO: 2461690 - DNA, 17 bp, Homo sapiens
taagatctatagcctct

SEQ ID NO: 2461691 - DNA, 16 bp, Homo sapiens
taagatcttagattct

SEQ ID NO: 2461692 - DNA, 18 bp, Homo sapiens
taagatcttttattttgc

SEQ ID NO: 2461693 - DNA, 22 bp, Homo sapiens
taattagtgccacttaatgtat

SEQ ID NO: 2461694 - DNA, 16 bp, Homo sapiens
taattatataactgta

SEQ ID NO: 2461695 - DNA, 14 bp, Homo sapiens
taattatccaggaa

SEQ ID NO: 2461696 - DNA, 21 bp, Homo sapiens
taattatgccttttttgatca

SEQ ID NO: 2461697 - DNA, 16 bp, Homo sapiens
taattatgtagctctt

SEQ ID NO: 2461698 - DNA, 12 bp, Homo sapiens
taattattattt

SEQ ID NO: 2461699 - DNA, 13 bp, Homo sapiens
taattattattta

SEQ ID NO: 2461700 - DNA, 22 bp, Homo sapiens
taattattatttatatatgtat

SEQ ID NO: 2461701 - DNA, 14 bp, Homo sapiens
taattcacagtgct

SEQ ID NO: 2461702 - DNA, 17 bp, Homo sapiens
taattcaggtttttcct

SEQ ID NO: 2461703 - DNA, 11 bp, Homo sapiens
taattctaaat

SEQ ID NO: 2461704 - DNA, 12 bp, Homo sapiens
taattctttcaa

SEQ ID NO: 2461705 - DNA, 17 bp, Homo sapiens
taattgcattgactttc

SEQ ID NO: 2461706 - DNA, 23 bp, Homo sapiens
taattgtactaaagccaaacata

SEQ ID NO: 2461707 - DNA, 22 bp, Homo sapiens
taattgtgattagacagaacac

SEQ ID NO: 2461708 - DNA, 20 bp, Homo sapiens
taattgtgtggattctttaa

SEQ ID NO: 2461709 - DNA, 17 bp, Homo sapiens
taattgttctcagaatc

SEQ ID NO: 2461710 - DNA, 17 bp, Homo sapiens
taattgttgttctgtta

SEQ ID NO: 2461711 - DNA, 23 bp, Homo sapiens
taattgttgttctgttaactgaa

SEQ ID NO: 2461712 - DNA, 14 bp, Homo sapiens
taatttagaaaact

SEQ ID NO: 2461713 - DNA, 17 bp, Homo sapiens
taatttagaaaacttta

SEQ ID NO: 2461714 - DNA, 21 bp, Homo sapiens
taatttagaaaactttaaagc

SEQ ID NO: 2461715 - DNA, 14 bp, Homo sapiens
taatttagaaatca

SEQ ID NO: 2461716 - DNA, 21 bp, Homo sapiens
taatttagacttggattcttt

SEQ ID NO: 2461717 - DNA, 13 bp, Homo sapiens
taatttctaatgt

SEQ ID NO: 2461718 - DNA, 12 bp, Homo sapiens
taatttgcatta

SEQ ID NO: 2461719 - DNA, 17 bp, Homo sapiens
taatttgcattaaattc

SEQ ID NO: 2461720 - DNA, 20 bp, Homo sapiens
taatttgcattaaattcaca

SEQ ID NO: 2461721 - DNA, 19 bp, Homo sapiens
taattttacacgcttttgt

SEQ ID NO: 2461722 - DNA, 21 bp, Homo sapiens
taattttacacgcttttgtga

SEQ ID NO: 2461723 - DNA, 14 bp, Homo sapiens
taattttagttttt

SEQ ID NO: 2461724 - DNA, 13 bp, Homo sapiens
taattttggattt

SEQ ID NO: 2461725 - DNA, 12 bp, Homo sapiens
taattttgtaat

SEQ ID NO: 2461726 - DNA, 14 bp, Homo sapiens
taattttgtatctt

SEQ ID NO: 2461727 - DNA, 22 bp, Homo sapiens
taatttttattaattttagttt

SEQ ID NO: 2461728 - DNA, 17 bp, Homo sapiens
taatttttatttcttcc

SEQ ID NO: 2461729 - DNA, 21 bp, Homo sapiens
taatttttgatactaagcatt

SEQ ID NO: 2461730 - DNA, 14 bp, Homo sapiens
taatttttgtaatt

SEQ ID NO: 2461731 - DNA, 17 bp, Homo sapiens
tacaaaacaaactcatt

SEQ ID NO: 2461732 - DNA, 10 bp, Homo sapiens
tacaaaatca

SEQ ID NO: 2461733 - DNA, 19 bp, Homo sapiens
tacaaactgaagagtaatc

SEQ ID NO: 2461734 - DNA, 14 bp, Homo sapiens
tacaaaggtttaaa

SEQ ID NO: 2461735 - DNA, 15 bp, Homo sapiens
tacaaaggtttaaat

SEQ ID NO: 2461736 - DNA, 18 bp, Homo sapiens
tacaaaggtttaaatgaa

SEQ ID NO: 2461737 - DNA, 19 bp, Homo sapiens
tacaaaggtttaaatgaac

SEQ ID NO: 2461738 - DNA, 16 bp, Homo sapiens
tacaaatcagaagtca

SEQ ID NO: 2461739 - DNA, 21 bp, Homo sapiens
tacaaatcagaagtcatcttg

SEQ ID NO: 2461740 - DNA, 13 bp, Homo sapiens
tacaaatggattt

SEQ ID NO: 2461741 - DNA, 21 bp, Homo sapiens
tacaaatgttaaaatgtgttg

SEQ ID NO: 2461742 - DNA, 16 bp, Homo sapiens
tacaaccaatggaatg

SEQ ID NO: 2461743 - DNA, 14 bp, Homo sapiens
tacaagaagcattt

SEQ ID NO: 2461744 - DNA, 15 bp, Homo sapiens
tacaagaagcatttt

SEQ ID NO: 2461745 - DNA, 19 bp, Homo sapiens
tacaagaagcattttgtaa

SEQ ID NO: 2461746 - DNA, 21 bp, Homo sapiens
tacaagaagcattttgtaagt

SEQ ID NO: 2461747 - DNA, 16 bp, Homo sapiens
tacaagactgccatat

SEQ ID NO: 2461748 - DNA, 23 bp, Homo sapiens
tacaagagaaaaagcagaggcca

SEQ ID NO: 2461749 - DNA, 21 bp, Homo sapiens
tacaataaaactttgctgcca

SEQ ID NO: 2461750 - DNA, 15 bp, Homo sapiens
tacaatgtaattatt

SEQ ID NO: 2461751 - DNA, 22 bp, Homo sapiens
tacaattaaaaaaaaagatctg

SEQ ID NO: 2461752 - DNA, 19 bp, Homo sapiens
tacaattttttttattagt

SEQ ID NO: 2461753 - DNA, 22 bp, Homo sapiens
tacacaactcactccttttaaa

SEQ ID NO: 2461754 - DNA, 12 bp, Homo sapiens
tacaccactctg

SEQ ID NO: 2461755 - DNA, 14 bp, Homo sapiens
tacaccactctggc

SEQ ID NO: 2461756 - DNA, 15 bp, Homo sapiens
tacacccttttccag

SEQ ID NO: 2461757 - DNA, 21 bp, Homo sapiens
tacacgtatttgaatggcctt

SEQ ID NO: 2461758 - DNA, 14 bp, Homo sapiens
tacactctgctgtt

SEQ ID NO: 2461759 - DNA, 23 bp, Homo sapiens
tacactctgctgtttgacacctc

SEQ ID NO: 2461760 - DNA, 15 bp, Homo sapiens
tacagaaaaaccttg

SEQ ID NO: 2461761 - DNA, 16 bp, Homo sapiens
tacagaaaaaccttgg

SEQ ID NO: 2461762 - DNA, 18 bp, Homo sapiens
tacagagaaaccagcttc

SEQ ID NO: 2461763 - DNA, 12 bp, Homo sapiens
tacagagaagcc

SEQ ID NO: 2461764 - DNA, 16 bp, Homo sapiens
tacagagaagccatca

SEQ ID NO: 2461765 - DNA, 23 bp, Homo sapiens
tacagagaagccatcacctcaga

SEQ ID NO: 2461766 - DNA, 13 bp, Homo sapiens
tacagagaagcct

SEQ ID NO: 2461767 - DNA, 22 bp, Homo sapiens
tacagagaagccttcaagctct

SEQ ID NO: 2461768 - DNA, 21 bp, Homo sapiens
tacagagaagtcacagggcag

SEQ ID NO: 2461769 - DNA, 12 bp, Homo sapiens
tacagagcacat

SEQ ID NO: 2461770 - DNA, 15 bp, Homo sapiens
tacagagcttccctg

SEQ ID NO: 2461771 - DNA, 16 bp, Homo sapiens
tacagcgcggaggagg

SEQ ID NO: 2461772 - DNA, 20 bp, Homo sapiens
tacagcgcggaggaggaggg

SEQ ID NO: 2461773 - DNA, 17 bp, Homo sapiens
tacagctggggtgcagg

SEQ ID NO: 2461774 - DNA, 14 bp, Homo sapiens
tacagctgtattgt

SEQ ID NO: 2461775 - DNA, 19 bp, Homo sapiens
tacagctgtattgtctgaa

SEQ ID NO: 2461776 - DNA, 21 bp, Homo sapiens
tacaggaaacagttgcatgta

SEQ ID NO: 2461777 - DNA, 14 bp, Homo sapiens
tacagtaggagccc

SEQ ID NO: 2461778 - DNA, 15 bp, Homo sapiens
tacagtaggagccca

SEQ ID NO: 2461779 - DNA, 15 bp, Homo sapiens
tacagtctcgtctct

SEQ ID NO: 2461780 - DNA, 21 bp, Homo sapiens
tacagtgtctttttttgtata

SEQ ID NO: 2461781 - DNA, 12 bp, Homo sapiens
tacagtgttacc

SEQ ID NO: 2461782 - DNA, 20 bp, Homo sapiens
tacagttctgctctggttgt

SEQ ID NO: 2461783 - DNA, 15 bp, Homo sapiens
tacagttctgtggtt

SEQ ID NO: 2461784 - DNA, 21 bp, Homo sapiens
tacagttctgtggtttcatgt

SEQ ID NO: 2461785 - DNA, 14 bp, Homo sapiens
tataacgtgttcaa

SEQ ID NO: 2461786 - DNA, 19 bp, Homo sapiens
tataacgtgttcaatattt

SEQ ID NO: 2461787 - DNA, 20 bp, Homo sapiens
tataacgtgttcaatatttt

SEQ ID NO: 2461788 - DNA, 13 bp, Homo sapiens
tataactgtattt

SEQ ID NO: 2461789 - DNA, 12 bp, Homo sapiens
tataagaaagcc

SEQ ID NO: 2461790 - DNA, 13 bp, Homo sapiens
tataagaaagcct

SEQ ID NO: 2461791 - DNA, 14 bp, Homo sapiens
tataagaaagcctg

SEQ ID NO: 2461792 - DNA, 14 bp, Homo sapiens
tataagatcctaga

SEQ ID NO: 2461793 - DNA, 19 bp, Homo sapiens
tataagatcctagatccta

SEQ ID NO: 2461794 - DNA, 21 bp, Homo sapiens
tataagatcctagatcctaag

SEQ ID NO: 2461795 - DNA, 22 bp, Homo sapiens
tataagcaagaaggcaaaaata

SEQ ID NO: 2461796 - DNA, 17 bp, Homo sapiens
tataagcatcattattt

SEQ ID NO: 2461797 - DNA, 14 bp, Homo sapiens
tataagcttttctt

SEQ ID NO: 2461798 - DNA, 16 bp, Homo sapiens
tataaggtgctctctt

SEQ ID NO: 2461799 - DNA, 13 bp, Homo sapiens
tataagtgtacat

SEQ ID NO: 2461800 - DNA, 15 bp, Homo sapiens
tataagtgtacatat

SEQ ID NO: 2461801 - DNA, 16 bp, Homo sapiens
tataatcatcaagtaa

SEQ ID NO: 2461802 - DNA, 17 bp, Homo sapiens
tataatcttataattgt

SEQ ID NO: 2461803 - DNA, 18 bp, Homo sapiens
tataatgttgttatttaa

SEQ ID NO: 2461804 - DNA, 19 bp, Homo sapiens
tataatgttgttatttaaa

SEQ ID NO: 2461805 - DNA, 17 bp, Homo sapiens
tataattatatgttgta

SEQ ID NO: 2461806 - DNA, 15 bp, Homo sapiens
tataattctcattaa

SEQ ID NO: 2461807 - DNA, 13 bp, Homo sapiens
tataattctttca

SEQ ID NO: 2461808 - DNA, 17 bp, Homo sapiens
tataattggatttccta

SEQ ID NO: 2461809 - DNA, 20 bp, Homo sapiens
tataattggatttcctaata

SEQ ID NO: 2461810 - DNA, 21 bp, Homo sapiens
tataattgttctcagaatccc

SEQ ID NO: 2461811 - DNA, 22 bp, Homo sapiens
tataattgttttatctgaattt

SEQ ID NO: 2461812 - DNA, 17 bp, Homo sapiens
tataatttacctaagat

SEQ ID NO: 2461813 - DNA, 20 bp, Homo sapiens
tataatttacctaagattac

SEQ ID NO: 2461814 - DNA, 13 bp, Homo sapiens
tataattttgcct

SEQ ID NO: 2461815 - DNA, 12 bp, Homo sapiens
tatacactgtgt

SEQ ID NO: 2461816 - DNA, 16 bp, Homo sapiens
tatacgaaataattgt

SEQ ID NO: 2461817 - DNA, 20 bp, Homo sapiens
tatactagggagccatttga

SEQ ID NO: 2461818 - DNA, 19 bp, Homo sapiens
tatactattaaaaaggttt

SEQ ID NO: 2461819 - DNA, 17 bp, Homo sapiens
tatactctttctgtata

SEQ ID NO: 2461820 - DNA, 13 bp, Homo sapiens
tatacttgtaatt

SEQ ID NO: 2461821 - DNA, 16 bp, Homo sapiens
tatacttgtaattatg

SEQ ID NO: 2461822 - DNA, 18 bp, Homo sapiens
tatacttgtaattatgga

SEQ ID NO: 2461823 - DNA, 17 bp, Homo sapiens
tatactttccctaccct

SEQ ID NO: 2461824 - DNA, 22 bp, Homo sapiens
tatagaagtataaagaattgtg

SEQ ID NO: 2461825 - DNA, 15 bp, Homo sapiens
tatagatgtcttttc

SEQ ID NO: 2461826 - DNA, 17 bp, Homo sapiens
tatagattgtccttttg

SEQ ID NO: 2461827 - DNA, 22 bp, Homo sapiens
tatagccaaaaatagctaaata

SEQ ID NO: 2461828 - DNA, 17 bp, Homo sapiens
tatagccaatataacta

SEQ ID NO: 2461829 - DNA, 19 bp, Homo sapiens
tataggatttatttaaaat

SEQ ID NO: 2461830 - DNA, 16 bp, Homo sapiens
tatagttaacacacta

SEQ ID NO: 2461831 - DNA, 15 bp, Homo sapiens
tatagttactgtgta

SEQ ID NO: 2461832 - DNA, 16 bp, Homo sapiens
tatagttactgtgtaa

SEQ ID NO: 2461833 - DNA, 12 bp, Homo sapiens
tatagttctaga

SEQ ID NO: 2461834 - DNA, 23 bp, Homo sapiens
tatataaagaaaatgatacagca

SEQ ID NO: 2461835 - DNA, 22 bp, Homo sapiens
tatataaatatattattacttg

SEQ ID NO: 2461836 - DNA, 19 bp, Homo sapiens
tatataagtgtacatatgt

SEQ ID NO: 2461837 - DNA, 13 bp, Homo sapiens
tatataattgcca

SEQ ID NO: 2461838 - DNA, 14 bp, Homo sapiens
tatataattgccaa

SEQ ID NO: 2461839 - DNA, 20 bp, Homo sapiens
tatatataatcatcaagtaa

SEQ ID NO: 2461840 - DNA, 13 bp, Homo sapiens
tatatatatatat

SEQ ID NO: 2461841 - DNA, 16 bp, Homo sapiens
tatatattatacttgt

SEQ ID NO: 2461842 - DNA, 16 bp, Homo sapiens
tatatattatatggaa

SEQ ID NO: 2461843 - DNA, 14 bp, Homo sapiens
tatatattatcttt

SEQ ID NO: 2461844 - DNA, 18 bp, Homo sapiens
tatatattatcttttcat

SEQ ID NO: 2461845 - DNA, 14 bp, Homo sapiens
tatatattctatta

SEQ ID NO: 2461846 - DNA, 13 bp, Homo sapiens
tatatcacccaga

SEQ ID NO: 2461847 - DNA, 22 bp, Homo sapiens
tatatcacccagacataaagga

SEQ ID NO: 2461848 - DNA, 21 bp, Homo sapiens
tatatgcacttataattttcc

SEQ ID NO: 2461849 - DNA, 14 bp, Homo sapiens
tatatggaaatata

SEQ ID NO: 2461850 - DNA, 21 bp, Homo sapiens
tatatggggatggtagttttt

SEQ ID NO: 2461851 - DNA, 22 bp, Homo sapiens
tatattacactacacactgtgt

SEQ ID NO: 2461852 - DNA, 18 bp, Homo sapiens
tatattatacttgtaatt

SEQ ID NO: 2461853 - DNA, 16 bp, Homo sapiens
tatattattacttgta

SEQ ID NO: 2461854 - DNA, 20 bp, Homo sapiens
tatattattacttgtaaata

SEQ ID NO: 2461855 - DNA, 17 bp, Homo sapiens
tatatttaaaaataagt

SEQ ID NO: 2461856 - DNA, 13 bp, Homo sapiens
tattagtattgtt

SEQ ID NO: 2461857 - DNA, 21 bp, Homo sapiens
tattatatgtaccctctgaaa

SEQ ID NO: 2461858 - DNA, 14 bp, Homo sapiens
tattatctgggctt

SEQ ID NO: 2461859 - DNA, 14 bp, Homo sapiens
tattatctgtcagc

SEQ ID NO: 2461860 - DNA, 12 bp, Homo sapiens
tattatcttttc

SEQ ID NO: 2461861 - DNA, 14 bp, Homo sapiens
tattatcttttcat

SEQ ID NO: 2461862 - DNA, 13 bp, Homo sapiens
tattatgaatgtg

SEQ ID NO: 2461863 - DNA, 14 bp, Homo sapiens
tattatgaatgtga

SEQ ID NO: 2461864 - DNA, 17 bp, Homo sapiens
tattatgagatgctggc

SEQ ID NO: 2461865 - DNA, 18 bp, Homo sapiens
tattattacttgtaaata

SEQ ID NO: 2461866 - DNA, 19 bp, Homo sapiens
tattattagttttgattta

SEQ ID NO: 2461867 - DNA, 13 bp, Homo sapiens
tattatttatata

SEQ ID NO: 2461868 - DNA, 18 bp, Homo sapiens
tattcaacaatttcaata

SEQ ID NO: 2461869 - DNA, 15 bp, Homo sapiens
tattcagtgtcactg

SEQ ID NO: 2461870 - DNA, 17 bp, Homo sapiens
tattcatccaagttaaa

SEQ ID NO: 2461871 - DNA, 17 bp, Homo sapiens
tattccagaatgctgta

SEQ ID NO: 2461872 - DNA, 17 bp, Homo sapiens
tattccagctgtccccc

SEQ ID NO: 2461873 - DNA, 22 bp, Homo sapiens
tattccagctgtccccccactc

SEQ ID NO: 2461874 - DNA, 12 bp, Homo sapiens
tattccatgact

SEQ ID NO: 2461875 - DNA, 14 bp, Homo sapiens
tattcctattgtgc

SEQ ID NO: 2461876 - DNA, 22 bp, Homo sapiens
tattcgatactgcgactttctg

SEQ ID NO: 2461877 - DNA, 11 bp, Homo sapiens
tattctaagac

SEQ ID NO: 2461878 - DNA, 12 bp, Homo sapiens
tattctaagact

SEQ ID NO: 2461879 - DNA, 12 bp, Homo sapiens
tattctctgagc

SEQ ID NO: 2461880 - DNA, 12 bp, Homo sapiens
tattctgtccct

SEQ ID NO: 2461881 - DNA, 13 bp, Homo sapiens
tattcttctagag

SEQ ID NO: 2461882 - DNA, 14 bp, Homo sapiens
tattcttctagagt

SEQ ID NO: 2461883 - DNA, 17 bp, Homo sapiens
tattcttctagagttca

SEQ ID NO: 2461884 - DNA, 13 bp, Homo sapiens
tattcttctcttc

SEQ ID NO: 2461885 - DNA, 14 bp, Homo sapiens
tattcttgatgtaa

SEQ ID NO: 2461886 - DNA, 16 bp, Homo sapiens
tattcttgatgtaaaa

SEQ ID NO: 2461887 - DNA, 18 bp, Homo sapiens
tattgacacagaaaatgt

SEQ ID NO: 2461888 - DNA, 16 bp, Homo sapiens
tattgactttgacaat

SEQ ID NO: 2461889 - DNA, 17 bp, Homo sapiens
tattgataagatctttt

SEQ ID NO: 2461890 - DNA, 19 bp, Homo sapiens
tattgcagtttatcattca

SEQ ID NO: 2461891 - DNA, 15 bp, Homo sapiens
tattgcattaatttt

SEQ ID NO: 2461892 - DNA, 13 bp, Homo sapiens
tattgcctcactt

SEQ ID NO: 2461893 - DNA, 20 bp, Homo sapiens
tattgctagagctcctccct

SEQ ID NO: 2461894 - DNA, 16 bp, Homo sapiens
tattggaatataattg

SEQ ID NO: 2461895 - DNA, 17 bp, Homo sapiens
tattggacaaagaacct

SEQ ID NO: 2461896 - DNA, 16 bp, Homo sapiens
tattggggtctgaccc

SEQ ID NO: 2461897 - DNA, 17 bp, Homo sapiens
tattggggtctgacccc

SEQ ID NO: 2461898 - DNA, 16 bp, Homo sapiens
tattgtgcaatgtgta

SEQ ID NO: 2461899 - DNA, 18 bp, Homo sapiens
tattgtgcaatgtgtata

SEQ ID NO: 2461900 - DNA, 16 bp, Homo sapiens
tatttaaaaaactaaa

SEQ ID NO: 2461901 - DNA, 13 bp, Homo sapiens
tatttaaaaataa

SEQ ID NO: 2461902 - DNA, 21 bp, Homo sapiens
tatttaaaccgctaaaagaaa

SEQ ID NO: 2461903 - DNA, 19 bp, Homo sapiens
tatttaacagaaattgtat

SEQ ID NO: 2461904 - DNA, 16 bp, Homo sapiens
tatttaactctcttta

SEQ ID NO: 2461905 - DNA, 18 bp, Homo sapiens
tatttaatagcaaagaat

SEQ ID NO: 2461906 - DNA, 14 bp, Homo sapiens
tatttacctcagcc

SEQ ID NO: 2461907 - DNA, 23 bp, Homo sapiens
tatttagatgataaagagacagt

SEQ ID NO: 2461908 - DNA, 19 bp, Homo sapiens
tatttagcttgggaaaggt

SEQ ID NO: 2461909 - DNA, 19 bp, Homo sapiens
tatttataaatatatttaa

SEQ ID NO: 2461910 - DNA, 23 bp, Homo sapiens
tatttatatatgtatttataaat

SEQ ID NO: 2461911 - DNA, 12 bp, Homo sapiens
tatttatgtatt

SEQ ID NO: 2461912 - DNA, 12 bp, Homo sapiens
tatttattgact

SEQ ID NO: 2461913 - DNA, 15 bp, Homo sapiens
tatttcactggagca

SEQ ID NO: 2461914 - DNA, 18 bp, Homo sapiens
tatttccattcaacaaga

SEQ ID NO: 2461915 - DNA, 22 bp, Homo sapiens
tatttcttcctaccaagtcaaa

SEQ ID NO: 2461916 - DNA, 20 bp, Homo sapiens
tatttgaaaacatgtttatt

SEQ ID NO: 2461917 - DNA, 14 bp, Homo sapiens
tatttgaacttttt

SEQ ID NO: 2461918 - DNA, 21 bp, Homo sapiens
tatttgacaacgtttcagcga

SEQ ID NO: 2461919 - DNA, 14 bp, Homo sapiens
tatttgatgtaata

SEQ ID NO: 2461920 - DNA, 19 bp, Homo sapiens
tatttgatgtaatacttct

SEQ ID NO: 2461921 - DNA, 22 bp, Homo sapiens
tatttgcataacaattcctcta

SEQ ID NO: 2461922 - DNA, 17 bp, Homo sapiens
tatttggtgattacatt

SEQ ID NO: 2461923 - DNA, 14 bp, Homo sapiens
tatttgtaaaatga

SEQ ID NO: 2461924 - DNA, 14 bp, Homo sapiens
tatttgtaatagat

SEQ ID NO: 2461925 - DNA, 21 bp, Homo sapiens
tatttgtttatggtaaaaaat

SEQ ID NO: 2461926 - DNA, 14 bp, Homo sapiens
tattttaaaatttg

SEQ ID NO: 2461927 - DNA, 17 bp, Homo sapiens
tattttaaaatttgttc

SEQ ID NO: 2461928 - DNA, 21 bp, Homo sapiens
tattttagtgaacttgaaata

SEQ ID NO: 2461929 - DNA, 14 bp, Homo sapiens
tattttatgttata

SEQ ID NO: 2461930 - DNA, 21 bp, Homo sapiens
tattttatgttatatataaat

SEQ ID NO: 2461931 - DNA, 13 bp, Homo sapiens
tattttattatga

SEQ ID NO: 2461932 - DNA, 14 bp, Homo sapiens
tattttcaaaacca

SEQ ID NO: 2461933 - DNA, 14 bp, Homo sapiens
tattttcaccattt

SEQ ID NO: 2461934 - DNA, 14 bp, Homo sapiens
tattttcattcaaa

SEQ ID NO: 2461935 - DNA, 12 bp, Homo sapiens
tattttctttct

SEQ ID NO: 2461936 - DNA, 22 bp, Homo sapiens
tattttgccaagggcataaatt

SEQ ID NO: 2461937 - DNA, 14 bp, Homo sapiens
tatttttaattaat

SEQ ID NO: 2461938 - DNA, 15 bp, Homo sapiens
tattttttaattatt

SEQ ID NO: 2461939 - DNA, 16 bp, Homo sapiens
tattttttcagtatta

SEQ ID NO: 2461940 - DNA, 14 bp, Homo sapiens
tattttttgtataa

SEQ ID NO: 2461941 - DNA, 16 bp, Homo sapiens
tattttttgtataatt

SEQ ID NO: 2461942 - DNA, 12 bp, Homo sapiens
tcaaaaaaggca

SEQ ID NO: 2461943 - DNA, 14 bp, Homo sapiens
tcaaaacacttgta

SEQ ID NO: 2461944 - DNA, 16 bp, Homo sapiens
tcaaaacagagggctg

SEQ ID NO: 2461945 - DNA, 16 bp, Homo sapiens
tcaaaactacaaatca

SEQ ID NO: 2461946 - DNA, 17 bp, Homo sapiens
tcaaaagctatttaaag

SEQ ID NO: 2461947 - DNA, 16 bp, Homo sapiens
tcaaaagggaagagtt

SEQ ID NO: 2461948 - DNA, 18 bp, Homo sapiens
tcaaaagggaagagtttt

SEQ ID NO: 2461949 - DNA, 17 bp, Homo sapiens
tcaaaagttccaagagt

SEQ ID NO: 2461950 - DNA, 22 bp, Homo sapiens
tcaaaagttccaagagtctaaa

SEQ ID NO: 2461951 - DNA, 17 bp, Homo sapiens
tcaaaatagtgccacta

SEQ ID NO: 2461952 - DNA, 16 bp, Homo sapiens
tcaaaatctctccact

SEQ ID NO: 2461953 - DNA, 17 bp, Homo sapiens
tcaaaatgctttttatt

SEQ ID NO: 2461954 - DNA, 20 bp, Homo sapiens
tcaaaatgttatcttctcaa

SEQ ID NO: 2461955 - DNA, 22 bp, Homo sapiens
tcaaacaacctgcccaaagatt

SEQ ID NO: 2461956 - DNA, 18 bp, Homo sapiens
tcaaaccctagccttgct

SEQ ID NO: 2461957 - DNA, 21 bp, Homo sapiens
tcaaaccctagccttgcttgt

SEQ ID NO: 2461958 - DNA, 20 bp, Homo sapiens
tcaaactactttgctgctaa

SEQ ID NO: 2461959 - DNA, 18 bp, Homo sapiens
tcaaactcctgacctcag

SEQ ID NO: 2461960 - DNA, 22 bp, Homo sapiens
tcaaacttggatacttggattt

SEQ ID NO: 2461961 - DNA, 12 bp, Homo sapiens
tcaaagaaagtg

SEQ ID NO: 2461962 - DNA, 15 bp, Homo sapiens
tcaaagaaagtgtat

SEQ ID NO: 2461963 - DNA, 19 bp, Homo sapiens
tcaaagcaagcattcagaa

SEQ ID NO: 2461964 - DNA, 19 bp, Homo sapiens
tcaaagcatcttgcattat

SEQ ID NO: 2461965 - DNA, 12 bp, Homo sapiens
tcaaagccagcg

SEQ ID NO: 2461966 - DNA, 18 bp, Homo sapiens
tcaaagctgcctgtccct

SEQ ID NO: 2461967 - DNA, 16 bp, Homo sapiens
tcaaaggtacttggat

SEQ ID NO: 2461968 - DNA, 12 bp, Homo sapiens
tcaaaggttcta

SEQ ID NO: 2461969 - DNA, 18 bp, Homo sapiens
tcaaaggtttggaaggag

SEQ ID NO: 2461970 - DNA, 21 bp, Homo sapiens
tcaaatacatttaaaacatta

SEQ ID NO: 2461971 - DNA, 18 bp, Homo sapiens
tcaaatggggccagatcc

SEQ ID NO: 2461972 - DNA, 19 bp, Homo sapiens
tcaaatggggccagatcca

SEQ ID NO: 2461973 - DNA, 16 bp, Homo sapiens
tcaaatggtatctttt

SEQ ID NO: 2461974 - DNA, 21 bp, Homo sapiens
tcaaatgttctaagtttctaa

SEQ ID NO: 2461975 - DNA, 23 bp, Homo sapiens
tcaaatgttctaagtttctaaga

SEQ ID NO: 2461976 - DNA, 22 bp, Homo sapiens
tcaaattgtgcagtactttgtg

SEQ ID NO: 2461977 - DNA, 15 bp, Homo sapiens
tcaacaaaaattgtc

SEQ ID NO: 2461978 - DNA, 14 bp, Homo sapiens
tcaacaaagaaaca

SEQ ID NO: 2461979 - DNA, 20 bp, Homo sapiens
tcaacaaagaaacaaagatg

SEQ ID NO: 2461980 - DNA, 21 bp, Homo sapiens
tcaacaaagaaacaaagatgt

SEQ ID NO: 2461981 - DNA, 14 bp, Homo sapiens
tcaacacccagttt

SEQ ID NO: 2461982 - DNA, 16 bp, Homo sapiens
tcaacaggcctcaggg

SEQ ID NO: 2461983 - DNA, 22 bp, Homo sapiens
tcaacaggcctcagggctcctt

SEQ ID NO: 2461984 - DNA, 18 bp, Homo sapiens
tcaacagtgaagacagaa

SEQ ID NO: 2461985 - DNA, 22 bp, Homo sapiens
tcaacagtgaagacagaagttt

SEQ ID NO: 2461986 - DNA, 22 bp, Homo sapiens
tcaacagttttcctatgctttg

SEQ ID NO: 2461987 - DNA, 16 bp, Homo sapiens
tcaacccctcccctcc

SEQ ID NO: 2461988 - DNA, 21 bp, Homo sapiens
tcaacccctcccctccatccc

SEQ ID NO: 2461989 - DNA, 23 bp, Homo sapiens
tcaaccttaagacctactgttct

SEQ ID NO: 2461990 - DNA, 21 bp, Homo sapiens
tcaactctcttattgcctcac

SEQ ID NO: 2461991 - DNA, 19 bp, Homo sapiens
tcaacttattaacaattag

SEQ ID NO: 2461992 - DNA, 13 bp, Homo sapiens
tcaactttactgt

SEQ ID NO: 2461993 - DNA, 14 bp, Homo sapiens
tcaactttactgta

SEQ ID NO: 2461994 - DNA, 20 bp, Homo sapiens
tcaactttactgtaatataa

SEQ ID NO: 2461995 - DNA, 19 bp, Homo sapiens
tcaagaaaacaggcactgc

SEQ ID NO: 2461996 - DNA, 22 bp, Homo sapiens
tcaagagccctgtcagtagagt

SEQ ID NO: 2461997 - DNA, 21 bp, Homo sapiens
tcaagagtgaattccctcact

SEQ ID NO: 2461998 - DNA, 23 bp, Homo sapiens
tcaagcagcgaccgccccctcct

SEQ ID NO: 2461999 - DNA, 16 bp, Homo sapiens
tcaagcagtcgtgcct

SEQ ID NO: 2462000 - DNA, 17 bp, Homo sapiens
tcaagcagtcgtgcctg

SEQ ID NO: 2462001 - DNA, 15 bp, Homo sapiens
tcaagcgattctcct

SEQ ID NO: 2462002 - DNA, 21 bp, Homo sapiens
tcaagctctgagggaaagggc

SEQ ID NO: 2462003 - DNA, 21 bp, Homo sapiens
tcaagctgagtattaaaatgt

SEQ ID NO: 2462004 - DNA, 23 bp, Homo sapiens
tcaagctgagtattaaaatgtat

SEQ ID NO: 2462005 - DNA, 15 bp, Homo sapiens
tcaaggcactctaga

SEQ ID NO: 2462006 - DNA, 18 bp, Homo sapiens
tcaaggcactctagattc

SEQ ID NO: 2462007 - DNA, 11 bp, Homo sapiens
tcaaggctcag

SEQ ID NO: 2462008 - DNA, 13 bp, Homo sapiens
tcaagggtcaggc

SEQ ID NO: 2462009 - DNA, 14 bp, Homo sapiens
tcaaggttctaacc

SEQ ID NO: 2462010 - DNA, 20 bp, Homo sapiens
tcaaggttttaggttctaaa

SEQ ID NO: 2462011 - DNA, 23 bp, Homo sapiens
tcaaggttttaggttctaaagtt

SEQ ID NO: 2462012 - DNA, 17 bp, Homo sapiens
tcaagtctctgctggcc

SEQ ID NO: 2462013 - DNA, 19 bp, Homo sapiens
tcaagtctctgctggccca

SEQ ID NO: 2462014 - DNA, 20 bp, Homo sapiens
tcaagtctttctctttccct

SEQ ID NO: 2462015 - DNA, 23 bp, Homo sapiens
tcaagtctttctctttccctggt

SEQ ID NO: 2462016 - DNA, 20 bp, Homo sapiens
tcaagtgatctgcccacctc

SEQ ID NO: 2462017 - DNA, 16 bp, Homo sapiens
tcaagttctaagattc

SEQ ID NO: 2462018 - DNA, 17 bp, Homo sapiens
tcaagttgaggggcttc

SEQ ID NO: 2462019 - DNA, 13 bp, Homo sapiens
tcaagttgtgcca

SEQ ID NO: 2462020 - DNA, 19 bp, Homo sapiens
tcaataatatattttctgt

SEQ ID NO: 2462021 - DNA, 22 bp, Homo sapiens
tcaatagccactaaccttgcct

SEQ ID NO: 2462022 - DNA, 15 bp, Homo sapiens
tcaatccagctatgt

SEQ ID NO: 2462023 - DNA, 17 bp, Homo sapiens
tcaatcttgcatgtaac

SEQ ID NO: 2462024 - DNA, 12 bp, Homo sapiens
tcaatgagcatg

SEQ ID NO: 2462025 - DNA, 13 bp, Homo sapiens
tcaatgagcatgt

SEQ ID NO: 2462026 - DNA, 14 bp, Homo sapiens
tcaatgagcatgtt

SEQ ID NO: 2462027 - DNA, 16 bp, Homo sapiens
tcaatgaggtgtccaa

SEQ ID NO: 2462028 - DNA, 15 bp, Homo sapiens
tcaatgcagttgtct

SEQ ID NO: 2462029 - DNA, 19 bp, Homo sapiens
tcaatgcagttgtctctgt

SEQ ID NO: 2462030 - DNA, 14 bp, Homo sapiens
tcaatggggccagt

SEQ ID NO: 2462031 - DNA, 18 bp, Homo sapiens
tcaattccaacagtttaa

SEQ ID NO: 2462032 - DNA, 19 bp, Homo sapiens
tcaattccaacagtttaat

SEQ ID NO: 2462033 - DNA, 20 bp, Homo sapiens
tcaattccaacagtttaatg

SEQ ID NO: 2462034 - DNA, 17 bp, Homo sapiens
tcaattgcatctcccag

SEQ ID NO: 2462035 - DNA, 16 bp, Homo sapiens
tcaattttatccctca

SEQ ID NO: 2462036 - DNA, 15 bp, Homo sapiens
tcacaaacttttata

SEQ ID NO: 2462037 - DNA, 17 bp, Homo sapiens
tcacaaacttttatact

SEQ ID NO: 2462038 - DNA, 22 bp, Homo sapiens
tcacaacagcctgacaacattt

SEQ ID NO: 2462039 - DNA, 13 bp, Homo sapiens
tcacaaccaagaa

SEQ ID NO: 2462040 - DNA, 23 bp, Homo sapiens
tcacaagatggaatttatcaaac

SEQ ID NO: 2462041 - DNA, 12 bp, Homo sapiens
tcacacacctgt

SEQ ID NO: 2462042 - DNA, 21 bp, Homo sapiens
tcacacaggcatttcctgggt

SEQ ID NO: 2462043 - DNA, 22 bp, Homo sapiens
tcacacccaacttggttttgct

SEQ ID NO: 2462044 - DNA, 20 bp, Homo sapiens
tcacacctgaactgaacacc

SEQ ID NO: 2462045 - DNA, 16 bp, Homo sapiens
tcacactgggtggtgg

SEQ ID NO: 2462046 - DNA, 17 bp, Homo sapiens
tcacactggtctgctgt

SEQ ID NO: 2462047 - DNA, 13 bp, Homo sapiens
tcacagcccagcc

SEQ ID NO: 2462048 - DNA, 16 bp, Homo sapiens
tcacagggcagtacct

SEQ ID NO: 2462049 - DNA, 18 bp, Homo sapiens
tcacagggcagtacctga

SEQ ID NO: 2462050 - DNA, 15 bp, Homo sapiens
tcacaggtcccaaat

SEQ ID NO: 2462051 - DNA, 18 bp, Homo sapiens
tcacagtgctcttttctc

SEQ ID NO: 2462052 - DNA, 17 bp, Homo sapiens
tcacagtgttgcccagg

SEQ ID NO: 2462053 - DNA, 20 bp, Homo sapiens
tcacagttctttgggccaga

SEQ ID NO: 2462054 - DNA, 16 bp, Homo sapiens
tcacagtttgaaataa

SEQ ID NO: 2462055 - DNA, 15 bp, Homo sapiens
tccttgtgccagaga

SEQ ID NO: 2462056 - DNA, 16 bp, Homo sapiens
tccttgtgggcctggg

SEQ ID NO: 2462057 - DNA, 19 bp, Homo sapiens
tccttgtgggcctgggctc

SEQ ID NO: 2462058 - DNA, 23 bp, Homo sapiens
tccttgtgggcctgggctcctgg

SEQ ID NO: 2462059 - DNA, 13 bp, Homo sapiens
tcctttaattgta

SEQ ID NO: 2462060 - DNA, 20 bp, Homo sapiens
tcctttctagagcactgcca

SEQ ID NO: 2462061 - DNA, 20 bp, Homo sapiens
tcctttcttccggcccctcc

SEQ ID NO: 2462062 - DNA, 23 bp, Homo sapiens
tccttttaaagaaaaaaattgaa

SEQ ID NO: 2462063 - DNA, 14 bp, Homo sapiens
tccttttgacactg

SEQ ID NO: 2462064 - DNA, 20 bp, Homo sapiens
tccttttgacactgctctaa

SEQ ID NO: 2462065 - DNA, 12 bp, Homo sapiens
tcctttttcctc

SEQ ID NO: 2462066 - DNA, 16 bp, Homo sapiens
tcctttttcctctcca

SEQ ID NO: 2462067 - DNA, 21 bp, Homo sapiens
tcctttttcctctccacacag

SEQ ID NO: 2462068 - DNA, 21 bp, Homo sapiens
tcctttttttccatctttaca

SEQ ID NO: 2462069 - DNA, 18 bp, Homo sapiens
tcgaaccgttttgaagct

SEQ ID NO: 2462070 - DNA, 20 bp, Homo sapiens
tcgaatctactaattccaca

SEQ ID NO: 2462071 - DNA, 20 bp, Homo sapiens
tcgactctgtgctggccagc

SEQ ID NO: 2462072 - DNA, 23 bp, Homo sapiens
tcgactctgtgctggccagcgag

SEQ ID NO: 2462073 - DNA, 19 bp, Homo sapiens
tcgagaaagaggcaccagg

SEQ ID NO: 2462074 - DNA, 21 bp, Homo sapiens
tcgagcagtcctgcctcagcc

SEQ ID NO: 2462075 - DNA, 23 bp, Homo sapiens
tcgagtgagacagactagaagtt

SEQ ID NO: 2462076 - DNA, 15 bp, Homo sapiens
tcgagttcccagggt

SEQ ID NO: 2462077 - DNA, 14 bp, Homo sapiens
tcgatactgcgact

SEQ ID NO: 2462078 - DNA, 23 bp, Homo sapiens
tcgatactgcgactttctgcctg

SEQ ID NO: 2462079 - DNA, 14 bp, Homo sapiens
tcgatgcaatgaac

SEQ ID NO: 2462080 - DNA, 10 bp, Homo sapiens
tcgcagccac

SEQ ID NO: 2462081 - DNA, 17 bp, Homo sapiens
tcgcagccaccctgagg

SEQ ID NO: 2462082 - DNA, 16 bp, Homo sapiens
tcgccacacagtattt

SEQ ID NO: 2462083 - DNA, 21 bp, Homo sapiens
tcgcccagcggcatcaggctt

SEQ ID NO: 2462084 - DNA, 14 bp, Homo sapiens
tcgcccctggcaga

SEQ ID NO: 2462085 - DNA, 16 bp, Homo sapiens
tcgccctttgctgcat

SEQ ID NO: 2462086 - DNA, 23 bp, Homo sapiens
tcgcctttcccaggtgctacacc

SEQ ID NO: 2462087 - DNA, 17 bp, Homo sapiens
tcgcggccctcagtagt

SEQ ID NO: 2462088 - DNA, 21 bp, Homo sapiens
tcgctagcagtggcaggcaga

SEQ ID NO: 2462089 - DNA, 20 bp, Homo sapiens
tcgctccccactctgctctg

SEQ ID NO: 2462090 - DNA, 21 bp, Homo sapiens
tcgctccccactctgctctga

SEQ ID NO: 2462091 - DNA, 14 bp, Homo sapiens
tcgctctcagttct

SEQ ID NO: 2462092 - DNA, 23 bp, Homo sapiens
tcgctggactctcagtctctgag

SEQ ID NO: 2462093 - DNA, 16 bp, Homo sapiens
tcgctgtcacaggcgg

SEQ ID NO: 2462094 - DNA, 11 bp, Homo sapiens
tcgctgtcctt

SEQ ID NO: 2462095 - DNA, 21 bp, Homo sapiens
tcgcttcttgcctctgtgctg

SEQ ID NO: 2462096 - DNA, 19 bp, Homo sapiens
tcggacaagacccccagca

SEQ ID NO: 2462097 - DNA, 19 bp, Homo sapiens
tcggcctcccaaagtgctg

SEQ ID NO: 2462098 - DNA, 15 bp, Homo sapiens
tcggcctgcccccac

SEQ ID NO: 2462099 - DNA, 15 bp, Homo sapiens
tcggctgaccatgct

SEQ ID NO: 2462100 - DNA, 17 bp, Homo sapiens
tcggggatgtgtcctga

SEQ ID NO: 2462101 - DNA, 15 bp, Homo sapiens
tcggggcatctggcc

SEQ ID NO: 2462102 - DNA, 12 bp, Homo sapiens
tcggtgaagaaa

SEQ ID NO: 2462103 - DNA, 13 bp, Homo sapiens
tcgtactcaggag

SEQ ID NO: 2462104 - DNA, 15 bp, Homo sapiens
tcgtactcaggagcc

SEQ ID NO: 2462105 - DNA, 21 bp, Homo sapiens
tcgtatgatacttcgacactg

SEQ ID NO: 2462106 - DNA, 15 bp, Homo sapiens
tcgtctttcccatgg

SEQ ID NO: 2462107 - DNA, 20 bp, Homo sapiens
tcgtctttcccatggggagg

SEQ ID NO: 2462108 - DNA, 13 bp, Homo sapiens
tcgtgcctgtgtc

SEQ ID NO: 2462109 - DNA, 14 bp, Homo sapiens
tcgtgcctgtgtcc

SEQ ID NO: 2462110 - DNA, 15 bp, Homo sapiens
tcgtgcctgtgtcca

SEQ ID NO: 2462111 - DNA, 22 bp, Homo sapiens
tcgtggactgagtgggaagccc

SEQ ID NO: 2462112 - DNA, 12 bp, Homo sapiens
tcgtggagagct

SEQ ID NO: 2462113 - DNA, 14 bp, Homo sapiens
tcgtttgtgttctg

SEQ ID NO: 2462114 - DNA, 18 bp, Homo sapiens
tctaaaatcttatagttc

SEQ ID NO: 2462115 - DNA, 19 bp, Homo sapiens
tctaaaatgtgatgttcta

SEQ ID NO: 2462116 - DNA, 16 bp, Homo sapiens
tctaaagattctatag

SEQ ID NO: 2462117 - DNA, 12 bp, Homo sapiens
tctaaagcaaat

SEQ ID NO: 2462118 - DNA, 13 bp, Homo sapiens
tctaaaggagttt

SEQ ID NO: 2462119 - DNA, 15 bp, Homo sapiens
tctaaaggtccacag

SEQ ID NO: 2462120 - DNA, 23 bp, Homo sapiens
tctaaaggtccacaggtctagac

SEQ ID NO: 2462121 - DNA, 11 bp, Homo sapiens
tctaaagttct

SEQ ID NO: 2462122 - DNA, 13 bp, Homo sapiens
tctaaagttctaa

SEQ ID NO: 2462123 - DNA, 15 bp, Homo sapiens
tctaaataaaatgct

SEQ ID NO: 2462124 - DNA, 17 bp, Homo sapiens
tctaaataaaatgctag

SEQ ID NO: 2462125 - DNA, 21 bp, Homo sapiens
tctaaatgtagttctgctcca

SEQ ID NO: 2462126 - DNA, 14 bp, Homo sapiens
tctaacagcaccaa

SEQ ID NO: 2462127 - DNA, 13 bp, Homo sapiens
tctaacagccctc

SEQ ID NO: 2462128 - DNA, 22 bp, Homo sapiens
tctaacagccctcctctgcact

SEQ ID NO: 2462129 - DNA, 14 bp, Homo sapiens
tctaacctttacat

SEQ ID NO: 2462130 - DNA, 16 bp, Homo sapiens
tctaacctttacatga

SEQ ID NO: 2462131 - DNA, 15 bp, Homo sapiens
tctaactacaaaggt

SEQ ID NO: 2462132 - DNA, 15 bp, Homo sapiens
tctaagaaacattta

SEQ ID NO: 2462133 - DNA, 19 bp, Homo sapiens
tctaagacttactctaaga

SEQ ID NO: 2462134 - DNA, 19 bp, Homo sapiens
tctaagatgtgatattcta

SEQ ID NO: 2462135 - DNA, 22 bp, Homo sapiens
tctaagatgtgatattctaaga

SEQ ID NO: 2462136 - DNA, 17 bp, Homo sapiens
tctaagattctaaaggt

SEQ ID NO: 2462137 - DNA, 18 bp, Homo sapiens
tctaagattctaaaggtc

SEQ ID NO: 2462138 - DNA, 19 bp, Homo sapiens
tctaagattctaatgatga

SEQ ID NO: 2462139 - DNA, 14 bp, Homo sapiens
tctaagattctaga

SEQ ID NO: 2462140 - DNA, 15 bp, Homo sapiens
tctaagattctagat

SEQ ID NO: 2462141 - DNA, 13 bp, Homo sapiens
tctaagattctga

SEQ ID NO: 2462142 - DNA, 18 bp, Homo sapiens
tctaaggcctaggattct

SEQ ID NO: 2462143 - DNA, 19 bp, Homo sapiens
tctaaggcctaggattcta

SEQ ID NO: 2462144 - DNA, 20 bp, Homo sapiens
tctaaggtccggtgttctaa

SEQ ID NO: 2462145 - DNA, 21 bp, Homo sapiens
tctcatgcccctggctgggac

SEQ ID NO: 2462146 - DNA, 22 bp, Homo sapiens
tctcatgttgaagccactgcct

SEQ ID NO: 2462147 - DNA, 15 bp, Homo sapiens
tctcattgcttacaa

SEQ ID NO: 2462148 - DNA, 17 bp, Homo sapiens
tctcattggaaatttag

SEQ ID NO: 2462149 - DNA, 23 bp, Homo sapiens
tctcattggaaatttagcattgt

SEQ ID NO: 2462150 - DNA, 19 bp, Homo sapiens
tctcattggacccttccat

SEQ ID NO: 2462151 - DNA, 21 bp, Homo sapiens
tctgaagctcaactctcttat

SEQ ID NO: 2462152 - DNA, 17 bp, Homo sapiens
tctgaataaagtgtaac

SEQ ID NO: 2462153 - DNA, 14 bp, Homo sapiens
tcttctctccagct

SEQ ID NO: 2462154 - DNA, 20 bp, Homo sapiens
tcttctctctcaattttatc

SEQ ID NO: 2462155 - DNA, 15 bp, Homo sapiens
tcttctgagcactgt

SEQ ID NO: 2462156 - DNA, 13 bp, Homo sapiens
tactttttgttat

SEQ ID NO: 2462157 - DNA, 14 bp, Homo sapiens
tagaaaaacaggca

SEQ ID NO: 2462158 - DNA, 11 bp, Homo sapiens
tagaaaacttt

SEQ ID NO: 2462159 - DNA, 17 bp, Homo sapiens
tagaaaaggactataag

SEQ ID NO: 2462160 - DNA, 12 bp, Homo sapiens
tagaaaatggtc

SEQ ID NO: 2462161 - DNA, 16 bp, Homo sapiens
tagaaaattagactgt

SEQ ID NO: 2462162 - DNA, 22 bp, Homo sapiens
tagaaaatttgttattttgcaa

SEQ ID NO: 2462163 - DNA, 16 bp, Homo sapiens
tagaaacaacactgta

SEQ ID NO: 2462164 - DNA, 17 bp, Homo sapiens
tagaaagaccaggccaa

SEQ ID NO: 2462165 - DNA, 19 bp, Homo sapiens
tagaaataaaggatgtgat

SEQ ID NO: 2462166 - DNA, 15 bp, Homo sapiens
tagaaatattttaaa

SEQ ID NO: 2462167 - DNA, 11 bp, Homo sapiens
tagaaatcata

SEQ ID NO: 2462168 - DNA, 18 bp, Homo sapiens
tagaaattacctgtggat

SEQ ID NO: 2462169 - DNA, 16 bp, Homo sapiens
tagaacactaattcat

SEQ ID NO: 2462170 - DNA, 22 bp, Homo sapiens
tagaacatggttaccatgtctt

SEQ ID NO: 2462171 - DNA, 21 bp, Homo sapiens
tagaaccctctgttccttccc

SEQ ID NO: 2462172 - DNA, 16 bp, Homo sapiens
tagaacttgaccccct

SEQ ID NO: 2462173 - DNA, 20 bp, Homo sapiens
tagaagacaattgacaacag

SEQ ID NO: 2462174 - DNA, 12 bp, Homo sapiens
tagaagcctgca

SEQ ID NO: 2462175 - DNA, 23 bp, Homo sapiens
tagaaggctgtggtgagggaaga

SEQ ID NO: 2462176 - DNA, 12 bp, Homo sapiens
tagaattattta

SEQ ID NO: 2462177 - DNA, 13 bp, Homo sapiens
tagaattgcattg

SEQ ID NO: 2462178 - DNA, 17 bp, Homo sapiens
tagacaaatagaaaatg

SEQ ID NO: 2462179 - DNA, 13 bp, Homo sapiens
tagacacatgaag

SEQ ID NO: 2462180 - DNA, 21 bp, Homo sapiens
tagacacatgaaggtaaataa

SEQ ID NO: 2462181 - DNA, 22 bp, Homo sapiens
tagacacatgaaggtaaataaa

SEQ ID NO: 2462182 - DNA, 20 bp, Homo sapiens
tagacaccaaagttctaata

SEQ ID NO: 2462183 - DNA, 21 bp, Homo sapiens
tagacactccccgaagtcttt

SEQ ID NO: 2462184 - DNA, 12 bp, Homo sapiens
tagacagaagaa

SEQ ID NO: 2462185 - DNA, 14 bp, Homo sapiens
tagacagcatgaga

SEQ ID NO: 2462186 - DNA, 18 bp, Homo sapiens
tagacagtctcactttgt

SEQ ID NO: 2462187 - DNA, 19 bp, Homo sapiens
tagacatggaggttctaag

SEQ ID NO: 2462188 - DNA, 20 bp, Homo sapiens
tagacatggaggttctaagg

SEQ ID NO: 2462189 - DNA, 10 bp, Homo sapiens
tagaccaata

SEQ ID NO: 2462190 - DNA, 19 bp, Homo sapiens
tagaccagcagacagagcc

SEQ ID NO: 2462191 - DNA, 13 bp, Homo sapiens
tagacctacaggg

SEQ ID NO: 2462192 - DNA, 20 bp, Homo sapiens
tagacttggattctttccat

SEQ ID NO: 2462193 - DNA, 13 bp, Homo sapiens
tagagaagacagg

SEQ ID NO: 2462194 - DNA, 18 bp, Homo sapiens
tagagaagacaggctgga

SEQ ID NO: 2462195 - DNA, 16 bp, Homo sapiens
tagagcagactacagc

SEQ ID NO: 2462196 - DNA, 16 bp, Homo sapiens
tagagcaggactgatg

SEQ ID NO: 2462197 - DNA, 23 bp, Homo sapiens
tagagcagggattaacctctgca

SEQ ID NO: 2462198 - DNA, 16 bp, Homo sapiens
tagaggtgagaaattt

SEQ ID NO: 2462199 - DNA, 17 bp, Homo sapiens
tagaggtgagaaattta

SEQ ID NO: 2462200 - DNA, 17 bp, Homo sapiens
tagagtctgaacagctg

SEQ ID NO: 2462201 - DNA, 15 bp, Homo sapiens
tagagtgtctttcca

SEQ ID NO: 2462202 - DNA, 18 bp, Homo sapiens
tagagtttttaaacatca

SEQ ID NO: 2462203 - DNA, 20 bp, Homo sapiens
tagatcagatgctccaagat

SEQ ID NO: 2462204 - DNA, 13 bp, Homo sapiens
tagatctctgaag

SEQ ID NO: 2462205 - DNA, 15 bp, Homo sapiens
tagatctggcatgtt

SEQ ID NO: 2462206 - DNA, 20 bp, Homo sapiens
tagatgcatttgggtccagg

SEQ ID NO: 2462207 - DNA, 15 bp, Homo sapiens
tagatgctggcccag

SEQ ID NO: 2462208 - DNA, 21 bp, Homo sapiens
tagatgggagggaggctcagg

SEQ ID NO: 2462209 - DNA, 16 bp, Homo sapiens
tagatgtaattttgtg

SEQ ID NO: 2462210 - DNA, 13 bp, Homo sapiens
tagatgtcttttc

SEQ ID NO: 2462211 - DNA, 13 bp, Homo sapiens
tagattcaaaggt

SEQ ID NO: 2462212 - DNA, 20 bp, Homo sapiens
tagattccattggtccaaga

SEQ ID NO: 2462213 - DNA, 13 bp, Homo sapiens
tagattctaaaga

SEQ ID NO: 2462214 - DNA, 23 bp, Homo sapiens
tagattctctggctgtaaggctc

SEQ ID NO: 2462215 - DNA, 23 bp, Homo sapiens
tagattctctgtgtctaagattc

SEQ ID NO: 2462216 - DNA, 23 bp, Homo sapiens
tagattctcttgtataagatcct

SEQ ID NO: 2462217 - DNA, 14 bp, Homo sapiens
tagattgattgtat

SEQ ID NO: 2462218 - DNA, 16 bp, Homo sapiens
tagattgattgtattg

SEQ ID NO: 2462219 - DNA, 13 bp, Homo sapiens
tagatttaatata

SEQ ID NO: 2462220 - DNA, 19 bp, Homo sapiens
tagatttcatagttcagaa

SEQ ID NO: 2462221 - DNA, 19 bp, Homo sapiens
tagatttgtgtgcatcagg

SEQ ID NO: 2462222 - DNA, 14 bp, Homo sapiens
tagattttacatga

SEQ ID NO: 2462223 - DNA, 22 bp, Homo sapiens
tagattttacatgaagtatttt

SEQ ID NO: 2462224 - DNA, 13 bp, Homo sapiens
tagattttccaaa

SEQ ID NO: 2462225 - DNA, 14 bp, Homo sapiens
tagattttctggtt

SEQ ID NO: 2462226 - DNA, 17 bp, Homo sapiens
tagattttctggttcta

SEQ ID NO: 2462227 - DNA, 19 bp, Homo sapiens
tagattttctggttctaac

SEQ ID NO: 2462228 - DNA, 12 bp, Homo sapiens
tagcaaagaatt

SEQ ID NO: 2462229 - DNA, 14 bp, Homo sapiens
tagcaaagaattga

SEQ ID NO: 2462230 - DNA, 14 bp, Homo sapiens
tagcaatacttgga

SEQ ID NO: 2462231 - DNA, 17 bp, Homo sapiens
tagcacagatggccagc

SEQ ID NO: 2462232 - DNA, 15 bp, Homo sapiens
tagcagacagtgttt

SEQ ID NO: 2462233 - DNA, 19 bp, Homo sapiens
tagcagcaccgttctgtgc

SEQ ID NO: 2462234 - DNA, 18 bp, Homo sapiens
tagcagtggcaggcagag

SEQ ID NO: 2462235 - DNA, 19 bp, Homo sapiens
tgaaagtcacggctgcgca

SEQ ID NO: 2462236 - DNA, 12 bp, Homo sapiens
tgaaagtctgtc

SEQ ID NO: 2462237 - DNA, 16 bp, Homo sapiens
tgaaagtctgtccttg

SEQ ID NO: 2462238 - DNA, 16 bp, Homo sapiens
tgaaataatgtgtagt

SEQ ID NO: 2462239 - DNA, 19 bp, Homo sapiens
tgaaatgtaaggctgtgta

SEQ ID NO: 2462240 - DNA, 12 bp, Homo sapiens
tgaaattccaaa

SEQ ID NO: 2462241 - DNA, 15 bp, Homo sapiens
tgaaattccaaagtc

SEQ ID NO: 2462242 - DNA, 19 bp, Homo sapiens
tgaaattccaaagtctcta

SEQ ID NO: 2462243 - DNA, 14 bp, Homo sapiens
tgaaattctcctgg

SEQ ID NO: 2462244 - DNA, 16 bp, Homo sapiens
tgaaattctcctggag

SEQ ID NO: 2462245 - DNA, 19 bp, Homo sapiens
tgaaattttaaaaattgtt

SEQ ID NO: 2462246 - DNA, 14 bp, Homo sapiens
tgaacaaagcagcc

SEQ ID NO: 2462247 - DNA, 17 bp, Homo sapiens
tgaacaaagcagccacg

SEQ ID NO: 2462248 - DNA, 14 bp, Homo sapiens
tgaacaagagaagc

SEQ ID NO: 2462249 - DNA, 18 bp, Homo sapiens
tgaacaagagaagcattc

SEQ ID NO: 2462250 - DNA, 20 bp, Homo sapiens
tgaacaccattgaaggctta

SEQ ID NO: 2462251 - DNA, 14 bp, Homo sapiens
tgaacagctggtgt

SEQ ID NO: 2462252 - DNA, 12 bp, Homo sapiens
tgaacagtggag

SEQ ID NO: 2462253 - DNA, 20 bp, Homo sapiens
tgaacatccctttttcaatg

SEQ ID NO: 2462254 - DNA, 12 bp, Homo sapiens
tgaacctgaata

SEQ ID NO: 2462255 - DNA, 17 bp, Homo sapiens
tgaacctttgtgcccta

SEQ ID NO: 2462256 - DNA, 21 bp, Homo sapiens
tgaacctttgtgccctatcac

SEQ ID NO: 2462257 - DNA, 16 bp, Homo sapiens
tgaacgttttctaatt

SEQ ID NO: 2462258 - DNA, 15 bp, Homo sapiens
tgaactaaagtgctg

SEQ ID NO: 2462259 - DNA, 21 bp, Homo sapiens
tgaactaaagtgctgcactca

SEQ ID NO: 2462260 - DNA, 20 bp, Homo sapiens
tgaactcactttcctcctga

SEQ ID NO: 2462261 - DNA, 14 bp, Homo sapiens
tgaactcttaatca

SEQ ID NO: 2462262 - DNA, 12 bp, Homo sapiens
tgaactgaacac

SEQ ID NO: 2462263 - DNA, 20 bp, Homo sapiens
tgaacttagattttacatga

SEQ ID NO: 2462264 - DNA, 21 bp, Homo sapiens
tgaacttagattttacatgaa

SEQ ID NO: 2462265 - DNA, 19 bp, Homo sapiens
tgaagaaccagtcccccca

SEQ ID NO: 2462266 - DNA, 20 bp, Homo sapiens
tgaagaaccagtccccccac

SEQ ID NO: 2462267 - DNA, 16 bp, Homo sapiens
tgaagaactgcaggcc

SEQ ID NO: 2462268 - DNA, 20 bp, Homo sapiens
tgaagaatacttctcatttt

SEQ ID NO: 2462269 - DNA, 20 bp, Homo sapiens
tgaagaattattttttttct

SEQ ID NO: 2462270 - DNA, 21 bp, Homo sapiens
tgaagaattattttttttctt

SEQ ID NO: 2462271 - DNA, 19 bp, Homo sapiens
tgaagacagaaccacaggg

SEQ ID NO: 2462272 - DNA, 13 bp, Homo sapiens
tgaagacagaagt

SEQ ID NO: 2462273 - DNA, 15 bp, Homo sapiens
tgaagactggaagct

SEQ ID NO: 2462274 - DNA, 22 bp, Homo sapiens
tgaagcaaactctaaaattata

SEQ ID NO: 2462275 - DNA, 21 bp, Homo sapiens
tgaagcaaatgtcatgctgcc

SEQ ID NO: 2462276 - DNA, 23 bp, Homo sapiens
tgaagcaaatgtcatgctgcctt

SEQ ID NO: 2462277 - DNA, 13 bp, Homo sapiens
tgaagcagcctct

SEQ ID NO: 2462278 - DNA, 21 bp, Homo sapiens
tgaagccatgagttccagaaa

SEQ ID NO: 2462279 - DNA, 14 bp, Homo sapiens
tgaagctactgtgt

SEQ ID NO: 2462280 - DNA, 15 bp, Homo sapiens
tgaagctgttgtgtg

SEQ ID NO: 2462281 - DNA, 16 bp, Homo sapiens
tgaagctgttgtgtga

SEQ ID NO: 2462282 - DNA, 17 bp, Homo sapiens
tgaagggccagagccag

SEQ ID NO: 2462283 - DNA, 18 bp, Homo sapiens
tgaagggggcggcctatg

SEQ ID NO: 2462284 - DNA, 14 bp, Homo sapiens
tgaaggtaaataaa

SEQ ID NO: 2462285 - DNA, 15 bp, Homo sapiens
tgaaggtgctgacgg

SEQ ID NO: 2462286 - DNA, 19 bp, Homo sapiens
tgaaggtgctgacggccag

SEQ ID NO: 2462287 - DNA, 18 bp, Homo sapiens
tgaaggttgtggcctttg

SEQ ID NO: 2462288 - DNA, 21 bp, Homo sapiens
tgaagtattttttcagtatta

SEQ ID NO: 2462289 - DNA, 18 bp, Homo sapiens
tgaagtgagcacagccta

SEQ ID NO: 2462290 - DNA, 18 bp, Homo sapiens
tgaagtgctgtttattaa

SEQ ID NO: 2462291 - DNA, 23 bp, Homo sapiens
tgaagttagctttaacttaaata

SEQ ID NO: 2462292 - DNA, 13 bp, Homo sapiens
tgaagttgctgct

SEQ ID NO: 2462293 - DNA, 14 bp, Homo sapiens
tgaagttgctgctt

SEQ ID NO: 2462294 - DNA, 15 bp, Homo sapiens
tgaagttgctgcttc

SEQ ID NO: 2462295 - DNA, 16 bp, Homo sapiens
tgaataaaaactcaag

SEQ ID NO: 2462296 - DNA, 12 bp, Homo sapiens
tgaataaatgtc

SEQ ID NO: 2462297 - DNA, 13 bp, Homo sapiens
tgaataaatgtca

SEQ ID NO: 2462298 - DNA, 16 bp, Homo sapiens
tgaataaatgtcactt

SEQ ID NO: 2462299 - DNA, 19 bp, Homo sapiens
tgaataaatgtcacttttt

SEQ ID NO: 2462300 - DNA, 20 bp, Homo sapiens
tgaataaatgtcactttttg

SEQ ID NO: 2462301 - DNA, 16 bp, Homo sapiens
tgaataccactctgta

SEQ ID NO: 2462302 - DNA, 23 bp, Homo sapiens
tgaataccactctgtaattgcaa

SEQ ID NO: 2462303 - DNA, 14 bp, Homo sapiens
tgaatactgctaca

SEQ ID NO: 2462304 - DNA, 16 bp, Homo sapiens
tgaatactgtattttg

SEQ ID NO: 2462305 - DNA, 14 bp, Homo sapiens
tgaatactttgaat

SEQ ID NO: 2462306 - DNA, 20 bp, Homo sapiens
tgaatactttgaatgtgttt

SEQ ID NO: 2462307 - DNA, 18 bp, Homo sapiens
tgaatagatatgaaagct

SEQ ID NO: 2462308 - DNA, 20 bp, Homo sapiens
tgaatagccatatttgtaaa

SEQ ID NO: 2462309 - DNA, 16 bp, Homo sapiens
tgaatattgccattat

SEQ ID NO: 2462310 - DNA, 18 bp, Homo sapiens
tgaatattgccattatgc

SEQ ID NO: 2462311 - DNA, 13 bp, Homo sapiens
tgaatcaataata

SEQ ID NO: 2462312 - DNA, 19 bp, Homo sapiens
tgaatcaataatatatttt

SEQ ID NO: 2462313 - DNA, 14 bp, Homo sapiens
tgaatcacatgaat

SEQ ID NO: 2462314 - DNA, 16 bp, Homo sapiens
tgaatgattcagtgtt

SEQ ID NO: 2462315 - DNA, 20 bp, Homo sapiens
tgaatgatttttctttacaa

SEQ ID NO: 2462316 - DNA, 14 bp, Homo sapiens
tgaatgccgtggat

SEQ ID NO: 2462317 - DNA, 12 bp, Homo sapiens
tgaatgctggga

SEQ ID NO: 2462318 - DNA, 19 bp, Homo sapiens
tgaatgctgggactcagcc

SEQ ID NO: 2462319 - DNA, 23 bp, Homo sapiens
tgaatggccttcatatcatccac

SEQ ID NO: 2462320 - DNA, 18 bp, Homo sapiens
tgaatgggacagagttga

SEQ ID NO: 2462321 - DNA, 20 bp, Homo sapiens
tgaatgtaaatttgtactat

SEQ ID NO: 2462322 - DNA, 14 bp, Homo sapiens
tgaatgtgaagcct

SEQ ID NO: 2462323 - DNA, 15 bp, Homo sapiens
tgaatgtgaagcctt

SEQ ID NO: 2462324 - DNA, 18 bp, Homo sapiens
tgaatgtggcttgagaaa

SEQ ID NO: 2462325 - DNA, 16 bp, Homo sapiens
tgaatgtgtttcacag

SEQ ID NO: 2462326 - DNA, 20 bp, Homo sapiens
tgaatgtgtttcacagtttg

SEQ ID NO: 2462327 - DNA, 22 bp, Homo sapiens
tgaatgtgtttcacagtttgaa

SEQ ID NO: 2462328 - DNA, 21 bp, Homo sapiens
tgaatttgtaatgtcttgagc

SEQ ID NO: 2462329 - DNA, 16 bp, Homo sapiens
tgaattttagcttttg

SEQ ID NO: 2462330 - DNA, 19 bp, Homo sapiens
tgaattttagcttttgtgg

SEQ ID NO: 2462331 - DNA, 17 bp, Homo sapiens
tgaatttttaaacaagt

SEQ ID NO: 2462332 - DNA, 19 bp, Homo sapiens
tgaatttttaaacaagtat

SEQ ID NO: 2462333 - DNA, 17 bp, Homo sapiens
tgaattttttttaacat

SEQ ID NO: 2462334 - DNA, 16 bp, Homo sapiens
tgacaacatttctata

SEQ ID NO: 2462335 - DNA, 19 bp, Homo sapiens
tgacaaccatgagaccact

SEQ ID NO: 2462336 - DNA, 21 bp, Homo sapiens
tgacaacgtttcagcgactcc

SEQ ID NO: 2462337 - DNA, 14 bp, Homo sapiens
tgacaactggcagg

SEQ ID NO: 2462338 - DNA, 18 bp, Homo sapiens
tgacaactggcaggcagg

SEQ ID NO: 2462339 - DNA, 14 bp, Homo sapiens
tgacaacttctaat

SEQ ID NO: 2462340 - DNA, 16 bp, Homo sapiens
tgacaataaaacatta

SEQ ID NO: 2462341 - DNA, 13 bp, Homo sapiens
tgacaatcatgtg

SEQ ID NO: 2462342 - DNA, 18 bp, Homo sapiens
tgacaatcatgtgtgtta

SEQ ID NO: 2462343 - DNA, 18 bp, Homo sapiens
tgacaattactcaggttt

SEQ ID NO: 2462344 - DNA, 12 bp, Homo sapiens
tgacacactaac

SEQ ID NO: 2462345 - DNA, 23 bp, Homo sapiens
tgacacagaaaatgttgagaatc

SEQ ID NO: 2462346 - DNA, 15 bp, Homo sapiens
tgacacccttctccc

SEQ ID NO: 2462347 - DNA, 15 bp, Homo sapiens
tgacacctgctgaga

SEQ ID NO: 2462348 - DNA, 22 bp, Homo sapiens
tgacactcatataattatatgt

SEQ ID NO: 2462349 - DNA, 14 bp, Homo sapiens
tgacactcccttgg

SEQ ID NO: 2462350 - DNA, 22 bp, Homo sapiens
tgacactcccttgggctccctg

SEQ ID NO: 2462351 - DNA, 15 bp, Homo sapiens
tgacactgctctaac

SEQ ID NO: 2462352 - DNA, 16 bp, Homo sapiens
tgacactgctctaaca

SEQ ID NO: 2462353 - DNA, 22 bp, Homo sapiens
tgacactgctctaacagccctc

SEQ ID NO: 2462354 - DNA, 15 bp, Homo sapiens
tgacagacaggctct

SEQ ID NO: 2462355 - DNA, 12 bp, Homo sapiens
tgacagcagcat

SEQ ID NO: 2462356 - DNA, 14 bp, Homo sapiens
tgacagcagcatct

SEQ ID NO: 2462357 - DNA, 12 bp, Homo sapiens
tgacagcctccc

SEQ ID NO: 2462358 - DNA, 22 bp, Homo sapiens
tgacagtattatacgctggcaa

SEQ ID NO: 2462359 - DNA, 14 bp, Homo sapiens
tgacagtgttttta

SEQ ID NO: 2462360 - DNA, 21 bp, Homo sapiens
tgacatcggaaaaataatcaa

SEQ ID NO: 2462361 - DNA, 18 bp, Homo sapiens
tgacatgtggggccaggt

SEQ ID NO: 2462362 - DNA, 20 bp, Homo sapiens
tgacatgtggggccaggtca

SEQ ID NO: 2462363 - DNA, 12 bp, Homo sapiens
tgacattcacct

SEQ ID NO: 2462364 - DNA, 18 bp, Homo sapiens
tgacattcacctgcccca

SEQ ID NO: 2462365 - DNA, 15 bp, Homo sapiens
tgacattctgaatgc

SEQ ID NO: 2462366 - DNA, 21 bp, Homo sapiens
tgacatttatttttcatttag

SEQ ID NO: 2462367 - DNA, 21 bp, Homo sapiens
tgacatttgggagacatgtga

SEQ ID NO: 2462368 - DNA, 14 bp, Homo sapiens
tgaccaaagtcctt

SEQ ID NO: 2462369 - DNA, 16 bp, Homo sapiens
tgaccaaagtcctttt

SEQ ID NO: 2462370 - DNA, 14 bp, Homo sapiens
tgaccaatgtcttg

SEQ ID NO: 2462371 - DNA, 16 bp, Homo sapiens
tgaccactctgtcttg

SEQ ID NO: 2462372 - DNA, 23 bp, Homo sapiens
tgaccactttttagaaagataat

SEQ ID NO: 2462373 - DNA, 16 bp, Homo sapiens
tgaccagctccccctc

SEQ ID NO: 2462374 - DNA, 22 bp, Homo sapiens
tgaccagctccccctccctccc

SEQ ID NO: 2462375 - DNA, 16 bp, Homo sapiens
tgaccaggctgcctcc

SEQ ID NO: 2462376 - DNA, 18 bp, Homo sapiens
tgaccatgctcatctgct

SEQ ID NO: 2462377 - DNA, 19 bp, Homo sapiens
tgaccatgctcatctgctg

SEQ ID NO: 2462378 - DNA, 23 bp, Homo sapiens
tgacccagtgcccccactgacca

SEQ ID NO: 2462379 - DNA, 12 bp, Homo sapiens
tgaccctgcctc

SEQ ID NO: 2462380 - DNA, 13 bp, Homo sapiens
tgaccctgcctct

SEQ ID NO: 2462381 - DNA, 13 bp, Homo sapiens
tgaccctggctcc

SEQ ID NO: 2462382 - DNA, 13 bp, Homo sapiens
tgacccttttcat

SEQ ID NO: 2462383 - DNA, 21 bp, Homo sapiens
tgacctcaggcaatctgcccg

SEQ ID NO: 2462384 - DNA, 18 bp, Homo sapiens
tgacctccagctttcctg

SEQ ID NO: 2462385 - DNA, 17 bp, Homo sapiens
tgacctccgccatccac

SEQ ID NO: 2462386 - DNA, 19 bp, Homo sapiens
tgacctccgccatccaccc

SEQ ID NO: 2462387 - DNA, 16 bp, Homo sapiens
tgacctcgtactcagg

SEQ ID NO: 2462388 - DNA, 15 bp, Homo sapiens
tgacctgaggctgtg

SEQ ID NO: 2462389 - DNA, 17 bp, Homo sapiens
tgacctgaggctgtggt

SEQ ID NO: 2462390 - DNA, 18 bp, Homo sapiens
tgacctgctaggccagag

SEQ ID NO: 2462391 - DNA, 19 bp, Homo sapiens
tgacctgctaggccagagc

SEQ ID NO: 2462392 - DNA, 11 bp, Homo sapiens
tgacctgctga

SEQ ID NO: 2462393 - DNA, 13 bp, Homo sapiens
tgacctgctgacc

SEQ ID NO: 2462394 - DNA, 18 bp, Homo sapiens
tgacctgctgacctgtgc

SEQ ID NO: 2462395 - DNA, 12 bp, Homo sapiens
tgacctgctgag

SEQ ID NO: 2462396 - DNA, 14 bp, Homo sapiens
tgacctgctgagct

SEQ ID NO: 2462397 - DNA, 16 bp, Homo sapiens
tgacctgctgagctct

SEQ ID NO: 2462398 - DNA, 17 bp, Homo sapiens
tgacctgctgagctctg

SEQ ID NO: 2462399 - DNA, 18 bp, Homo sapiens
tgacctgctgagctctga

SEQ ID NO: 2462400 - DNA, 20 bp, Homo sapiens
tgacctgctgagctctgaga

SEQ ID NO: 2462401 - DNA, 21 bp, Homo sapiens
tgacctgctgagctctgagag

SEQ ID NO: 2462402 - DNA, 15 bp, Homo sapiens
tgacctggccccctc

SEQ ID NO: 2462403 - DNA, 20 bp, Homo sapiens
tgacctgtgagcccagctgg

SEQ ID NO: 2462404 - DNA, 23 bp, Homo sapiens
tgaccttttatgtagtaattgac

SEQ ID NO: 2462405 - DNA, 18 bp, Homo sapiens
tgacgtctgggtggccct

SEQ ID NO: 2462406 - DNA, 12 bp, Homo sapiens
tgactaaacttt

SEQ ID NO: 2462407 - DNA, 19 bp, Homo sapiens
tgactaaactttttttctg

SEQ ID NO: 2462408 - DNA, 17 bp, Homo sapiens
tgactaacaggccaaag

SEQ ID NO: 2462409 - DNA, 21 bp, Homo sapiens
tgactaacaggccaaagagtc

SEQ ID NO: 2462410 - DNA, 20 bp, Homo sapiens
tgactaactagacaccaaag

SEQ ID NO: 2462411 - DNA, 18 bp, Homo sapiens
tgactacagtcaggaaag

SEQ ID NO: 2462412 - DNA, 14 bp, Homo sapiens
tgactcaagaagtg

SEQ ID NO: 2462413 - DNA, 15 bp, Homo sapiens
tgactcaggagcctg

SEQ ID NO: 2462414 - DNA, 19 bp, Homo sapiens
tgactcaggagcctgtgac

SEQ ID NO: 2462415 - DNA, 14 bp, Homo sapiens
tgactcagggctcc

SEQ ID NO: 2462416 - DNA, 17 bp, Homo sapiens
tgactcagggctcctgg

SEQ ID NO: 2462417 - DNA, 16 bp, Homo sapiens
tgactcgggggtgggg

SEQ ID NO: 2462418 - DNA, 18 bp, Homo sapiens
tgactcgggggtggggaa

SEQ ID NO: 2462419 - DNA, 21 bp, Homo sapiens
tgactgccaagactgctgtgg

SEQ ID NO: 2462420 - DNA, 22 bp, Homo sapiens
tgactgccaagactgctgtggc

SEQ ID NO: 2462421 - DNA, 15 bp, Homo sapiens
tgactggctaaagct

SEQ ID NO: 2462422 - DNA, 15 bp, Homo sapiens
tgacttggctggtgt

SEQ ID NO: 2462423 - DNA, 23 bp, Homo sapiens
tgacttgggcacccccagcctgg

SEQ ID NO: 2462424 - DNA, 12 bp, Homo sapiens
tgactttcccca

SEQ ID NO: 2462425 - DNA, 21 bp, Homo sapiens
tgactttccccaccagatgct

SEQ ID NO: 2462426 - DNA, 13 bp, Homo sapiens
tgactttcttttt

SEQ ID NO: 2462427 - DNA, 17 bp, Homo sapiens
tgactttgcttgctttg

SEQ ID NO: 2462428 - DNA, 19 bp, Homo sapiens
tgacttttctgtaattcag

SEQ ID NO: 2462429 - DNA, 18 bp, Homo sapiens
tgagaaaaaggaaaaaaa

SEQ ID NO: 2462430 - DNA, 21 bp, Homo sapiens
tgagaaatatggacacttaat

SEQ ID NO: 2462431 - DNA, 14 bp, Homo sapiens
tgagaaatttaaac

SEQ ID NO: 2462432 - DNA, 12 bp, Homo sapiens
tgagaacctggg

SEQ ID NO: 2462433 - DNA, 18 bp, Homo sapiens
tgcatggtttcagcacta

SEQ ID NO: 2462434 - DNA, 22 bp, Homo sapiens
tgcatggtttcagcactagcca

SEQ ID NO: 2462435 - DNA, 12 bp, Homo sapiens
tgcatgtagtaa

SEQ ID NO: 2462436 - DNA, 15 bp, Homo sapiens
tgcattaaattcaca

SEQ ID NO: 2462437 - DNA, 21 bp, Homo sapiens
tgcattaaattcacaaacttt

SEQ ID NO: 2462438 - DNA, 16 bp, Homo sapiens
tgcattctggatttta

SEQ ID NO: 2462439 - DNA, 16 bp, Homo sapiens
tgcattcttctgagca

SEQ ID NO: 2462440 - DNA, 20 bp, Homo sapiens
tgcattcttctgagcactgt

SEQ ID NO: 2462441 - DNA, 14 bp, Homo sapiens
tgcattgaacacaa

SEQ ID NO: 2462442 - DNA, 15 bp, Homo sapiens
tgcattgaacacaaa

SEQ ID NO: 2462443 - DNA, 21 bp, Homo sapiens
tgcattgaacacaaactgtaa

SEQ ID NO: 2462444 - DNA, 17 bp, Homo sapiens
tgcattggaactggagg

SEQ ID NO: 2462445 - DNA, 19 bp, Homo sapiens
tgcattgtgattggcctgt

SEQ ID NO: 2462446 - DNA, 17 bp, Homo sapiens
tgcatttgggtccagga

SEQ ID NO: 2462447 - DNA, 20 bp, Homo sapiens
tgcatttgggtccaggagga

SEQ ID NO: 2462448 - DNA, 13 bp, Homo sapiens
tgcatttgtttat

SEQ ID NO: 2462449 - DNA, 21 bp, Homo sapiens
tgcatttgtttatgtaatttc

SEQ ID NO: 2462450 - DNA, 17 bp, Homo sapiens
tgcattttcaccccacc

SEQ ID NO: 2462451 - DNA, 23 bp, Homo sapiens
tgcattttggagagtttcctgaa

SEQ ID NO: 2462452 - DNA, 18 bp, Homo sapiens
tgccaaaaagtgaaataa

SEQ ID NO: 2462453 - DNA, 19 bp, Homo sapiens
tgccaaaaagtgaaataat

SEQ ID NO: 2462454 - DNA, 23 bp, Homo sapiens
tgccaaacaaaaaggttctcagg

SEQ ID NO: 2462455 - DNA, 16 bp, Homo sapiens
tgccaaaggatgtgat

SEQ ID NO: 2462456 - DNA, 17 bp, Homo sapiens
tgccaaaggatgtgata

SEQ ID NO: 2462457 - DNA, 19 bp, Homo sapiens
tgccaaaggatgtgatata

SEQ ID NO: 2462458 - DNA, 22 bp, Homo sapiens
tgccaagactgctgtggccagg

SEQ ID NO: 2462459 - DNA, 13 bp, Homo sapiens
tgccaagctccaa

SEQ ID NO: 2462460 - DNA, 18 bp, Homo sapiens
tgccaaggcagaggcctg

SEQ ID NO: 2462461 - DNA, 19 bp, Homo sapiens
tgccaaggcagaggcctgg

SEQ ID NO: 2462462 - DNA, 21 bp, Homo sapiens
tgccaagggcataaattattg

SEQ ID NO: 2462463 - DNA, 13 bp, Homo sapiens
tgccaagtccagg

SEQ ID NO: 2462464 - DNA, 15 bp, Homo sapiens
tgccacaaggacttc

SEQ ID NO: 2462465 - DNA, 19 bp, Homo sapiens
tgccacaaggacttcctgt

SEQ ID NO: 2462466 - DNA, 22 bp, Homo sapiens
tgccacacaaggatagatgctg

SEQ ID NO: 2462467 - DNA, 17 bp, Homo sapiens
tgccacagccctgtcag

SEQ ID NO: 2462468 - DNA, 22 bp, Homo sapiens
tgccacagccctgtcagcatga

SEQ ID NO: 2462469 - DNA, 16 bp, Homo sapiens
tgccacagcttttgca

SEQ ID NO: 2462470 - DNA, 17 bp, Homo sapiens
tgccacagcttttgcaa

SEQ ID NO: 2462471 - DNA, 13 bp, Homo sapiens
tgccaccaggcca

SEQ ID NO: 2462472 - DNA, 18 bp, Homo sapiens
tgccaccatggccagcca

SEQ ID NO: 2462473 - DNA, 14 bp, Homo sapiens
tgccactcactagg

SEQ ID NO: 2462474 - DNA, 15 bp, Homo sapiens
tgccactcactaggc

SEQ ID NO: 2462475 - DNA, 20 bp, Homo sapiens
tgccactcactaggccccca

SEQ ID NO: 2462476 - DNA, 22 bp, Homo sapiens
tgccactcactaggcccccact

SEQ ID NO: 2462477 - DNA, 22 bp, Homo sapiens
tgccactgccttcgcttcttgc

SEQ ID NO: 2462478 - DNA, 19 bp, Homo sapiens
tgccactggggaaaactcc

SEQ ID NO: 2462479 - DNA, 12 bp, Homo sapiens
tgccactgttgt

SEQ ID NO: 2462480 - DNA, 20 bp, Homo sapiens
tgccacttaatgtatgttac

SEQ ID NO: 2462481 - DNA, 13 bp, Homo sapiens
tgccagagaaccc

SEQ ID NO: 2462482 - DNA, 14 bp, Homo sapiens
tgccagagcctggg

SEQ ID NO: 2462483 - DNA, 16 bp, Homo sapiens
tgccagagcctggggc

SEQ ID NO: 2462484 - DNA, 17 bp, Homo sapiens
tgccagagcctggggct

SEQ ID NO: 2462485 - DNA, 18 bp, Homo sapiens
tgccagagcctggggctc

SEQ ID NO: 2462486 - DNA, 19 bp, Homo sapiens
tgccagagcctggggctct

SEQ ID NO: 2462487 - DNA, 20 bp, Homo sapiens
tgccagagcctggggctcta

SEQ ID NO: 2462488 - DNA, 22 bp, Homo sapiens
tgccagaggctgatgtcaagca

SEQ ID NO: 2462489 - DNA, 11 bp, Homo sapiens
tgccagcccct

SEQ ID NO: 2462490 - DNA, 15 bp, Homo sapiens
tgccagctgcactga

SEQ ID NO: 2462491 - DNA, 20 bp, Homo sapiens
tgccaggagcacggctctgt

SEQ ID NO: 2462492 - DNA, 13 bp, Homo sapiens
tgccaggaggacc

SEQ ID NO: 2462493 - DNA, 23 bp, Homo sapiens
tgccaggaggacccagggctctg

SEQ ID NO: 2462494 - DNA, 24 bp, Homo sapiens
tgccaggagggacaaaggagcctg

SEQ ID NO: 2462495 - DNA, 20 bp, Homo sapiens
tgccaggcgaggcccttggc

SEQ ID NO: 2462496 - DNA, 17 bp, Homo sapiens
tgccaggctaatttttt

SEQ ID NO: 2462497 - DNA, 22 bp, Homo sapiens
tgccagggcaatgatgaatgag

SEQ ID NO: 2462498 - DNA, 16 bp, Homo sapiens
tgccagggcagggccc

SEQ ID NO: 2462499 - DNA, 18 bp, Homo sapiens
tgccagtaacgcgtcttc

SEQ ID NO: 2462500 - DNA, 17 bp, Homo sapiens
tgccagtattttaaaat

SEQ ID NO: 2462501 - DNA, 17 bp, Homo sapiens
tgccagtgacagacagg

SEQ ID NO: 2462502 - DNA, 19 bp, Homo sapiens
tgccagtgacagacaggct

SEQ ID NO: 2462503 - DNA, 23 bp, Homo sapiens
tgccatattaaattttttgttga

SEQ ID NO: 2462504 - DNA, 14 bp, Homo sapiens
tgccatattttcac

SEQ ID NO: 2462505 - DNA, 16 bp, Homo sapiens
tgccatcatctcctgc

SEQ ID NO: 2462506 - DNA, 20 bp, Homo sapiens
tgccatgacaacttctaatt

SEQ ID NO: 2462507 - DNA, 19 bp, Homo sapiens
tgccatgatgcctctgtct

SEQ ID NO: 2462508 - DNA, 19 bp, Homo sapiens
tgccattggggtagttgtg

SEQ ID NO: 2462509 - DNA, 11 bp, Homo sapiens
tgccattgtag

SEQ ID NO: 2462510 - DNA, 22 bp, Homo sapiens
tgcccaagccagaggctgggtt

SEQ ID NO: 2462511 - DNA, 14 bp, Homo sapiens
tgcccacaggccgc

SEQ ID NO: 2462512 - DNA, 22 bp, Homo sapiens
tgcccaccctctggagaaggtg

SEQ ID NO: 2462513 - DNA, 22 bp, Homo sapiens
tgcccacctcagcctcccaaag

SEQ ID NO: 2462514 - DNA, 19 bp, Homo sapiens
tgcccagaataagttattg

SEQ ID NO: 2462515 - DNA, 16 bp, Homo sapiens
tgcccagagacccagc

SEQ ID NO: 2462516 - DNA, 20 bp, Homo sapiens
tgcccagagacccagcggac

SEQ ID NO: 2462517 - DNA, 19 bp, Homo sapiens
tgcccagccctaaacatca

SEQ ID NO: 2462518 - DNA, 11 bp, Homo sapiens
tgcccaggaga

SEQ ID NO: 2462519 - DNA, 12 bp, Homo sapiens
tgcccaggagaa

SEQ ID NO: 2462520 - DNA, 15 bp, Homo sapiens
tgcccaggcactgca

SEQ ID NO: 2462521 - DNA, 23 bp, Homo sapiens
tgcccagttaatcttgctttctt

SEQ ID NO: 2462522 - DNA, 20 bp, Homo sapiens
tgcccatgctgggagcccac

SEQ ID NO: 2462523 - DNA, 14 bp, Homo sapiens
tgcccattttgaat

SEQ ID NO: 2462524 - DNA, 22 bp, Homo sapiens
tgccccaactccttccagctag

SEQ ID NO: 2462525 - DNA, 18 bp, Homo sapiens
tgccccacttgtccttag

SEQ ID NO: 2462526 - DNA, 20 bp, Homo sapiens
tgccccatcagtgctccctc

SEQ ID NO: 2462527 - DNA, 16 bp, Homo sapiens
tgcccccaaccatttc

SEQ ID NO: 2462528 - DNA, 19 bp, Homo sapiens
tgcccccaccccattcccg

SEQ ID NO: 2462529 - DNA, 15 bp, Homo sapiens
tgcccccatttctga

SEQ ID NO: 2462530 - DNA, 18 bp, Homo sapiens
tgcccccatttctgaggt

SEQ ID NO: 2462531 - DNA, 15 bp, Homo sapiens
tgccccccagcctct

SEQ ID NO: 2462532 - DNA, 22 bp, Homo sapiens
tgccccctgcagaaccggagag

SEQ ID NO: 2462533 - DNA, 22 bp, Homo sapiens
tgccccctgcaggaaggagctg

SEQ ID NO: 2462534 - DNA, 17 bp, Homo sapiens
tgccccggcccctcccc

SEQ ID NO: 2462535 - DNA, 12 bp, Homo sapiens
tgcccctctcac

SEQ ID NO: 2462536 - DNA, 15 bp, Homo sapiens
tgcccctctcaccaa

SEQ ID NO: 2462537 - DNA, 21 bp, Homo sapiens
gtcatgaggagattctgcctt

SEQ ID NO: 2462538 - DNA, 19 bp, Homo sapiens
gtcatgcacagtatttgta

SEQ ID NO: 2462539 - DNA, 13 bp, Homo sapiens
gtcatgtttatct

SEQ ID NO: 2462540 - DNA, 20 bp, Homo sapiens
gtcatttttacaatgtaatt

SEQ ID NO: 2462541 - DNA, 15 bp, Homo sapiens
gtccaaaaccgccag

SEQ ID NO: 2462542 - DNA, 17 bp, Homo sapiens
gtccaaaaccgccagct

SEQ ID NO: 2462543 - DNA, 16 bp, Homo sapiens
gtccaagattccggat

SEQ ID NO: 2462544 - DNA, 16 bp, Homo sapiens
gtccaatgagctttct

SEQ ID NO: 2462545 - DNA, 23 bp, Homo sapiens
gtccaatgagctttctgaacagc

SEQ ID NO: 2462546 - DNA, 16 bp, Homo sapiens
gtccaattagtttcct

SEQ ID NO: 2462547 - DNA, 17 bp, Homo sapiens
gtccaattagtttcctt

SEQ ID NO: 2462548 - DNA, 22 bp, Homo sapiens
gtccacaagcttctgtcctgcc

SEQ ID NO: 2462549 - DNA, 16 bp, Homo sapiens
gtccacgactgtctcc

SEQ ID NO: 2462550 - DNA, 16 bp, Homo sapiens
gtccacttctgacagc

SEQ ID NO: 2462551 - DNA, 17 bp, Homo sapiens
gtccacttctgacagcc

SEQ ID NO: 2462552 - DNA, 18 bp, Homo sapiens
gtccacttctgacagcct

SEQ ID NO: 2462553 - DNA, 19 bp, Homo sapiens
gtccacttctgacagcctc

SEQ ID NO: 2462554 - DNA, 13 bp, Homo sapiens
gtccagctctgga

SEQ ID NO: 2462555 - DNA, 18 bp, Homo sapiens
gtccagggctagtgactt

SEQ ID NO: 2462556 - DNA, 15 bp, Homo sapiens
gtccaggtcctggtg

SEQ ID NO: 2462557 - DNA, 16 bp, Homo sapiens
gtccaggtcctggtgg

SEQ ID NO: 2462558 - DNA, 21 bp, Homo sapiens
gtccaggtcctggtggggcag

SEQ ID NO: 2462559 - DNA, 22 bp, Homo sapiens
gtccaggtcctggtggggcagc

SEQ ID NO: 2462560 - DNA, 23 bp, Homo sapiens
gtccaggtcctggtggggcagct

SEQ ID NO: 2462561 - DNA, 18 bp, Homo sapiens
gtccagtcctatctgggc

SEQ ID NO: 2462562 - DNA, 16 bp, Homo sapiens
gtccatatcacacaca

SEQ ID NO: 2462563 - DNA, 17 bp, Homo sapiens
gtccatatcacacacat

SEQ ID NO: 2462564 - DNA, 23 bp, Homo sapiens
gtccatgggcagagcccaaggga

SEQ ID NO: 2462565 - DNA, 15 bp, Homo sapiens
gtaaatataaagacg

SEQ ID NO: 2462566 - DNA, 23 bp, Homo sapiens
gtaaatatgtacatttctcaggc

SEQ ID NO: 2462567 - DNA, 23 bp, Homo sapiens
gtaaatattttaaagaattgtgt

SEQ ID NO: 2462568 - DNA, 17 bp, Homo sapiens
gtaaatcagtaagaggt

SEQ ID NO: 2462569 - DNA, 21 bp, Homo sapiens
gtaaatcagtaagaggtgtta

SEQ ID NO: 2462570 - DNA, 13 bp, Homo sapiens
gtaaatttgtact

SEQ ID NO: 2462571 - DNA, 20 bp, Homo sapiens
gtaaatttgtactatttaac

SEQ ID NO: 2462572 - DNA, 22 bp, Homo sapiens
gtaaatttgtactatttaactg

SEQ ID NO: 2462573 - DNA, 16 bp, Homo sapiens
gtaacactaatatatt

SEQ ID NO: 2462574 - DNA, 14 bp, Homo sapiens
gtaacatttgctgt

SEQ ID NO: 2462575 - DNA, 18 bp, Homo sapiens
gtaacctcttcagaggcc

SEQ ID NO: 2462576 - DNA, 20 bp, Homo sapiens
gtaacctcttcagaggccct

SEQ ID NO: 2462577 - DNA, 15 bp, Homo sapiens
gtaactaaaataatt

SEQ ID NO: 2462578 - DNA, 14 bp, Homo sapiens
gtaactactttata

SEQ ID NO: 2462579 - DNA, 17 bp, Homo sapiens
gtaactgcctagaaaca

SEQ ID NO: 2462580 - DNA, 15 bp, Homo sapiens
gtaactgctttctgt

SEQ ID NO: 2462581 - DNA, 18 bp, Homo sapiens
gtaacttcttatggaatt

SEQ ID NO: 2462582 - DNA, 13 bp, Homo sapiens
gtaagaaatacag

SEQ ID NO: 2462583 - DNA, 21 bp, Homo sapiens
gtaagatttgtttttaaactg

SEQ ID NO: 2462584 - DNA, 20 bp, Homo sapiens
gtaagcactgactgggacca

SEQ ID NO: 2462585 - DNA, 14 bp, Homo sapiens
gtaagtacagagaa

SEQ ID NO: 2462586 - DNA, 15 bp, Homo sapiens
gtaagtacagagaag

SEQ ID NO: 2462587 - DNA, 16 bp, Homo sapiens
gtaataataaagaata

SEQ ID NO: 2462588 - DNA, 22 bp, Homo sapiens
gtaatacaaactaatttagtaa

SEQ ID NO: 2462589 - DNA, 18 bp, Homo sapiens
gtaatacttcttgtgtgt

SEQ ID NO: 2462590 - DNA, 23 bp, Homo sapiens
gtaatacttcttgtgtgtatgca

SEQ ID NO: 2462591 - DNA, 19 bp, Homo sapiens
gtaatataaagtattcaac

SEQ ID NO: 2462592 - DNA, 16 bp, Homo sapiens
gtaatattgacttgta

SEQ ID NO: 2462593 - DNA, 22 bp, Homo sapiens
gtaatctatgaattctaagtga

SEQ ID NO: 2462594 - DNA, 16 bp, Homo sapiens
gtaatggcagttatat

SEQ ID NO: 2462595 - DNA, 15 bp, Homo sapiens
gtaatggtgtagaac

SEQ ID NO: 2462596 - DNA, 16 bp, Homo sapiens
gtaatggtgtagaaca

SEQ ID NO: 2462597 - DNA, 18 bp, Homo sapiens
ggctccctgactgggagt

SEQ ID NO: 2462598 - DNA, 20 bp, Homo sapiens
ggctccctgtaacctcttca

SEQ ID NO: 2462599 - DNA, 16 bp, Homo sapiens
ggctccgtgtgggaga

SEQ ID NO: 2462600 - DNA, 11 bp, Homo sapiens
ggctcctggac

SEQ ID NO: 2462601 - DNA, 14 bp, Homo sapiens
ggctcctggacccc

SEQ ID NO: 2462602 - DNA, 18 bp, Homo sapiens
ggctcgaatctctgtgcc

SEQ ID NO: 2462603 - DNA, 20 bp, Homo sapiens
ggctcgaatctctgtgcctt

SEQ ID NO: 2462604 - DNA, 13 bp, Homo sapiens
ggctcgtggactg

SEQ ID NO: 2462605 - DNA, 23 bp, Homo sapiens
ggctcgtggactgagtgggaagc

SEQ ID NO: 2462606 - DNA, 18 bp, Homo sapiens
ggctcgttgactggctgt

SEQ ID NO: 2462607 - DNA, 23 bp, Homo sapiens
ggctctaacgcctgagcccaggg

SEQ ID NO: 2462608 - DNA, 11 bp, Homo sapiens
ggctctagatc

SEQ ID NO: 2462609 - DNA, 15 bp, Homo sapiens
ggctctgagagtcta

SEQ ID NO: 2462610 - DNA, 20 bp, Homo sapiens
ggctctgagagtctagattc

SEQ ID NO: 2462611 - DNA, 15 bp, Homo sapiens
ggctctgagcgcctc

SEQ ID NO: 2462612 - DNA, 20 bp, Homo sapiens
ggctctgaggtgcctgtccc

SEQ ID NO: 2462613 - DNA, 22 bp, Homo sapiens
ggctctgatgaaaaattgctga

SEQ ID NO: 2462614 - DNA, 19 bp, Homo sapiens
ggctctgcaattcccctct

SEQ ID NO: 2462615 - DNA, 18 bp, Homo sapiens
ggctctgtccccagcctg

SEQ ID NO: 2462616 - DNA, 18 bp, Homo sapiens
ggctcttagcagcttcca

SEQ ID NO: 2462617 - DNA, 21 bp, Homo sapiens
ggctcttgatacccccctctg

SEQ ID NO: 2462618 - DNA, 14 bp, Homo sapiens
ggctgaaattctcc

SEQ ID NO: 2462619 - DNA, 18 bp, Homo sapiens
ggctgaaattctcctgga

SEQ ID NO: 2462620 - DNA, 16 bp, Homo sapiens
ggctgaccacagcaca

SEQ ID NO: 2462621 - DNA, 17 bp, Homo sapiens
ggctgaccacagcacag

SEQ ID NO: 2462622 - DNA, 18 bp, Homo sapiens
ggctgaccacagcacagc

SEQ ID NO: 2462623 - DNA, 22 bp, Homo sapiens
ggctgaccacagcacagccaac

SEQ ID NO: 2462624 - DNA, 14 bp, Homo sapiens
ggctgaggcctgga

SEQ ID NO: 2462625 - DNA, 17 bp, Homo sapiens
ggctgaggctggcacag

SEQ ID NO: 2462626 - DNA, 16 bp, Homo sapiens
ggctgagggagcctgg

SEQ ID NO: 2462627 - DNA, 15 bp, Homo sapiens
ggctgataattttaa

SEQ ID NO: 2462628 - DNA, 22 bp, Homo sapiens
ggctgatgtcaatttctgtgtt

SEQ ID NO: 2462629 - DNA, 20 bp, Homo sapiens
ggctgcattgaaaagagctg

SEQ ID NO: 2462630 - DNA, 15 bp, Homo sapiens
ggctgcccctctcac

SEQ ID NO: 2462631 - DNA, 13 bp, Homo sapiens
ggctgccctcctg

SEQ ID NO: 2462632 - DNA, 14 bp, Homo sapiens
ggctgccctcctgt

SEQ ID NO: 2462633 - DNA, 18 bp, Homo sapiens
ggctgccctcctgtgctc

SEQ ID NO: 2462634 - DNA, 22 bp, Homo sapiens
ggctgccctcctgtgctcagcc

SEQ ID NO: 2462635 - DNA, 16 bp, Homo sapiens
ggctgccgtggggccg

SEQ ID NO: 2462636 - DNA, 20 bp, Homo sapiens
ggctgcctcccttgtggcag

SEQ ID NO: 2462637 - DNA, 15 bp, Homo sapiens
ggctgcgcactgtgt

SEQ ID NO: 2462638 - DNA, 19 bp, Homo sapiens
ggctgctgatcgccttccc

SEQ ID NO: 2462639 - DNA, 11 bp, Homo sapiens
ggctgctgctg

SEQ ID NO: 2462640 - DNA, 13 bp, Homo sapiens
ggctgcttcctcc

SEQ ID NO: 2462641 - DNA, 17 bp, Homo sapiens
ggctgcttcctcctgga

SEQ ID NO: 2462642 - DNA, 19 bp, Homo sapiens
ggctgcttcctcctggaaa

SEQ ID NO: 2462643 - DNA, 19 bp, Homo sapiens
ggctggacccagccaggcc

SEQ ID NO: 2462644 - DNA, 16 bp, Homo sapiens
ggtagccagcacacag

SEQ ID NO: 2462645 - DNA, 21 bp, Homo sapiens
ggtaggaatagcatgtcacta

SEQ ID NO: 2462646 - DNA, 18 bp, Homo sapiens
ggtaggccaaggtgtcct

SEQ ID NO: 2462647 - DNA, 21 bp, Homo sapiens
ggtaggccaaggtgtcctaca

SEQ ID NO: 2462648 - DNA, 14 bp, Homo sapiens
ggtaggggcccctc

SEQ ID NO: 2462649 - DNA, 21 bp, Homo sapiens
ggtaggggcccctctcagccc

SEQ ID NO: 2462650 - DNA, 14 bp, Homo sapiens
ggtaggggctggga

SEQ ID NO: 2462651 - DNA, 13 bp, Homo sapiens
ggtaggggttggg

SEQ ID NO: 2462652 - DNA, 21 bp, Homo sapiens
ggtagtaccttttatatccca

SEQ ID NO: 2462653 - DNA, 20 bp, Homo sapiens
ggtagttttttcatcttcag

SEQ ID NO: 2462654 - DNA, 21 bp, Homo sapiens
ggtataggtctcatctcttca

SEQ ID NO: 2462655 - DNA, 22 bp, Homo sapiens
ggtataggtctcatctcttcag

SEQ ID NO: 2462656 - DNA, 23 bp, Homo sapiens
ggtatagttcatgtctgctatca

SEQ ID NO: 2462657 - DNA, 13 bp, Homo sapiens
ggtatatactttg

SEQ ID NO: 2462658 - DNA, 20 bp, Homo sapiens
ggtatctcagaaagtgcctg

SEQ ID NO: 2462659 - DNA, 22 bp, Homo sapiens
ggtatggcgtaagtacagagaa

SEQ ID NO: 2462660 - DNA, 16 bp, Homo sapiens
ggtcaacagttttcct

SEQ ID NO: 2462661 - DNA, 23 bp, Homo sapiens
ggtcaacatcttttacattctgc

SEQ ID NO: 2462662 - DNA, 22 bp, Homo sapiens
ggtcaacttgagcatgttactg

SEQ ID NO: 2462663 - DNA, 16 bp, Homo sapiens
ggtcacagcatggagg

SEQ ID NO: 2462664 - DNA, 15 bp, Homo sapiens
ggtcacagcggaggt

SEQ ID NO: 2462665 - DNA, 12 bp, Homo sapiens
ggtcacagctgt

SEQ ID NO: 2462666 - DNA, 18 bp, Homo sapiens
ggtcagcacatctcaaca

SEQ ID NO: 2462667 - DNA, 13 bp, Homo sapiens
ggtcaggcagggt

SEQ ID NO: 2462668 - DNA, 20 bp, Homo sapiens
ggtcaggcctttgagctcag

SEQ ID NO: 2462669 - DNA, 16 bp, Homo sapiens
ggtccaatgagctttc

SEQ ID NO: 2462670 - DNA, 17 bp, Homo sapiens
ggtccaatgagctttct

SEQ ID NO: 2462671 - DNA, 16 bp, Homo sapiens
ggtccagctctggagg

SEQ ID NO: 2462672 - DNA, 11 bp, Homo sapiens
ggtccaggaga

SEQ ID NO: 2462673 - DNA, 16 bp, Homo sapiens
ggtccatgggcagagc

SEQ ID NO: 2462674 - DNA, 17 bp, Homo sapiens
ggtcccacatccctggg

SEQ ID NO: 2462675 - DNA, 17 bp, Homo sapiens
ggtccccgagtgcctag

SEQ ID NO: 2462676 - DNA, 12 bp, Homo sapiens
ggtcccctcctt

SEQ ID NO: 2462677 - DNA, 21 bp, Homo sapiens
ggtccggtgttctaagatgtg

SEQ ID NO: 2462678 - DNA, 16 bp, Homo sapiens
ggtcctatggcctcat

SEQ ID NO: 2462679 - DNA, 14 bp, Homo sapiens
ggtcctcctccagg

SEQ ID NO: 2462680 - DNA, 13 bp, Homo sapiens
ggtcctctgtcag

SEQ ID NO: 2462681 - DNA, 22 bp, Homo sapiens
ggtcctcttctgggcctgacca

SEQ ID NO: 2462682 - DNA, 19 bp, Homo sapiens
ggtcctgagcactgccagg

SEQ ID NO: 2462683 - DNA, 20 bp, Homo sapiens
ggtcctgagcactgccagga

SEQ ID NO: 2462684 - DNA, 23 bp, Homo sapiens
ggtcctgagcactgccaggaggg

SEQ ID NO: 2462685 - DNA, 21 bp, Homo sapiens
ggtcctggagcagaccacccc

SEQ ID NO: 2462686 - DNA, 19 bp, Homo sapiens
ggtcctggtggggcagctc

SEQ ID NO: 2462687 - DNA, 21 bp, Homo sapiens
ggtcctggtggggcagctcct

SEQ ID NO: 2462688 - DNA, 16 bp, Homo sapiens
ggtccttttgacactg

SEQ ID NO: 2462689 - DNA, 13 bp, Homo sapiens
ggtcgctcctgcc

SEQ ID NO: 2462690 - DNA, 20 bp, Homo sapiens
ggtcggggcatctggcctgg

SEQ ID NO: 2462691 - DNA, 14 bp, Homo sapiens
ggtcggtgccttca

SEQ ID NO: 2462692 - DNA, 15 bp, Homo sapiens
ggtcggtgccttcaa

SEQ ID NO: 2462693 - DNA, 14 bp, Homo sapiens
ggtcgtggagagct

SEQ ID NO: 2462694 - DNA, 20 bp, Homo sapiens
ggtctcacagtgttgcccag

SEQ ID NO: 2462695 - DNA, 15 bp, Homo sapiens
ggtctcaccctggag

SEQ ID NO: 2462696 - DNA, 16 bp, Homo sapiens
ggtctcaccctggagg

SEQ ID NO: 2462697 - DNA, 20 bp, Homo sapiens
ggtctcgctttgttgcccag

SEQ ID NO: 2462698 - DNA, 23 bp, Homo sapiens
ggtctgcctcttctgggagggca

SEQ ID NO: 2462699 - DNA, 18 bp, Homo sapiens
ggtctgctctttctctgc

SEQ ID NO: 2462700 - DNA, 15 bp, Homo sapiens
ggtctggcagcctcc

SEQ ID NO: 2462701 - DNA, 13 bp, Homo sapiens
ggtctggctggtg

SEQ ID NO: 2462702 - DNA, 20 bp, Homo sapiens
ggtctggctggtgttaacag

SEQ ID NO: 2462703 - DNA, 23 bp, Homo sapiens
ggtctggctggtgttaacagaag

SEQ ID NO: 2462704 - DNA, 19 bp, Homo sapiens
ggtctgggagtcacacagt

SEQ ID NO: 2462705 - DNA, 20 bp, Homo sapiens
ggtctgtaggttgcacactt

SEQ ID NO: 2462706 - DNA, 12 bp, Homo sapiens
ggtctgtttgca

SEQ ID NO: 2462707 - DNA, 23 bp, Homo sapiens
ggtcttggaacttgcctgccttt

SEQ ID NO: 2462708 - DNA, 21 bp, Homo sapiens
gggaaggtggggtcctggagc

SEQ ID NO: 2462709 - DNA, 19 bp, Homo sapiens
gggacaactgctcccacct

SEQ ID NO: 2462710 - DNA, 18 bp, Homo sapiens
gggacaagtggactcagg

SEQ ID NO: 2462711 - DNA, 19 bp, Homo sapiens
gggacagaggccccagcct

SEQ ID NO: 2462712 - DNA, 17 bp, Homo sapiens
gggaccaccctgagccg

SEQ ID NO: 2462713 - DNA, 19 bp, Homo sapiens
gggaccaccctgagccggc

SEQ ID NO: 2462714 - DNA, 20 bp, Homo sapiens
gggaccagcagccccacacc

SEQ ID NO: 2462715 - DNA, 12 bp, Homo sapiens
gggaccaggagt

SEQ ID NO: 2462716 - DNA, 23 bp, Homo sapiens
gggaccaggagtgggtggggagt

SEQ ID NO: 2462717 - DNA, 20 bp, Homo sapiens
gggacctagggaggcatggt

SEQ ID NO: 2462718 - DNA, 18 bp, Homo sapiens
gggacctggtaccctcct

SEQ ID NO: 2462719 - DNA, 22 bp, Homo sapiens
gggacgcctgggggtgccagga

SEQ ID NO: 2462720 - DNA, 17 bp, Homo sapiens
gggacggtgcccaagcc

SEQ ID NO: 2462721 - DNA, 14 bp, Homo sapiens
gggacgtggctcag

SEQ ID NO: 2462722 - DNA, 18 bp, Homo sapiens
gggacgtggctcagccag

SEQ ID NO: 2462723 - DNA, 15 bp, Homo sapiens
gggactgaccagcag

SEQ ID NO: 2462724 - DNA, 15 bp, Homo sapiens
gggactgctaaataa

SEQ ID NO: 2462725 - DNA, 15 bp, Homo sapiens
gggactgtcgctgct

SEQ ID NO: 2462726 - DNA, 12 bp, Homo sapiens
gggagaagctcc

SEQ ID NO: 2462727 - DNA, 15 bp, Homo sapiens
gggagacatgtgaca

SEQ ID NO: 2462728 - DNA, 20 bp, Homo sapiens
gggagaccggcctgccagga

SEQ ID NO: 2462729 - DNA, 16 bp, Homo sapiens
gggagactgggctgag

SEQ ID NO: 2462730 - DNA, 20 bp, Homo sapiens
gggagagcccaggagctccc

SEQ ID NO: 2462731 - DNA, 21 bp, Homo sapiens
gggagaggcagcccaggaagt

SEQ ID NO: 2462732 - DNA, 12 bp, Homo sapiens
gggagcaggcag

SEQ ID NO: 2462733 - DNA, 13 bp, Homo sapiens
gggagccaaggga

SEQ ID NO: 2462734 - DNA, 21 bp, Homo sapiens
gggagcccactgtcctgggcc

SEQ ID NO: 2462735 - DNA, 16 bp, Homo sapiens
gggagcccccagcctg

SEQ ID NO: 2462736 - DNA, 19 bp, Homo sapiens
gggagccccttctgctcag

SEQ ID NO: 2462737 - DNA, 19 bp, Homo sapiens
gggagctccactctgcttc

SEQ ID NO: 2462738 - DNA, 23 bp, Homo sapiens
gggagctccactctgcttctctg

SEQ ID NO: 2462739 - DNA, 12 bp, Homo sapiens
gggagctgaggc

SEQ ID NO: 2462740 - DNA, 14 bp, Homo sapiens
gggagctgggcctg

SEQ ID NO: 2462741 - DNA, 16 bp, Homo sapiens
gggagctgggcctggt

SEQ ID NO: 2462742 - DNA, 18 bp, Homo sapiens
gggagctgggcctggtct

SEQ ID NO: 2462743 - DNA, 14 bp, Homo sapiens
gggagctgggcttc

SEQ ID NO: 2462744 - DNA, 16 bp, Homo sapiens
gggaggccaggcgggc

SEQ ID NO: 2462745 - DNA, 16 bp, Homo sapiens
gggaggccgggcggtc

SEQ ID NO: 2462746 - DNA, 13 bp, Homo sapiens
gggaggctcaggt

SEQ ID NO: 2462747 - DNA, 18 bp, Homo sapiens
gggagggaagggagccaa

SEQ ID NO: 2462748 - DNA, 11 bp, Homo sapiens
gggagggcaga

SEQ ID NO: 2462749 - DNA, 15 bp, Homo sapiens
gggagggcagagctg

SEQ ID NO: 2462750 - DNA, 20 bp, Homo sapiens
gggagggcagagctggtgcg

SEQ ID NO: 2462751 - DNA, 11 bp, Homo sapiens
gggagggcagc

SEQ ID NO: 2462752 - DNA, 17 bp, Homo sapiens
ggggaagacagtggccc

SEQ ID NO: 2462753 - DNA, 21 bp, Homo sapiens
ggggaagacccattccttccc

SEQ ID NO: 2462754 - DNA, 22 bp, Homo sapiens
ggggaagacccattccttccca

SEQ ID NO: 2462755 - DNA, 19 bp, Homo sapiens
ggggacacatgtatttggt

SEQ ID NO: 2462756 - DNA, 21 bp, Homo sapiens
ggggaccaggagtgggtgggg

SEQ ID NO: 2462757 - DNA, 18 bp, Homo sapiens
ggggagactgggctgagg

SEQ ID NO: 2462758 - DNA, 11 bp, Homo sapiens
ggggagcccac

SEQ ID NO: 2462759 - DNA, 15 bp, Homo sapiens
ggggagctgggcctg

SEQ ID NO: 2462760 - DNA, 22 bp, Homo sapiens
ggggagtaaagaattattttgt

SEQ ID NO: 2462761 - DNA, 21 bp, Homo sapiens
ggggagttaagacctggcagc

SEQ ID NO: 2462762 - DNA, 21 bp, Homo sapiens
ggggatccctcccccccatgc

SEQ ID NO: 2462763 - DNA, 23 bp, Homo sapiens
ggggatccctcccccccatgcac

SEQ ID NO: 2462764 - DNA, 17 bp, Homo sapiens
ggggcaggagtagctga

SEQ ID NO: 2462765 - DNA, 19 bp, Homo sapiens
ggggcaggagtagctgagc

SEQ ID NO: 2462766 - DNA, 13 bp, Homo sapiens
ggggcaggctggg

SEQ ID NO: 2462767 - DNA, 14 bp, Homo sapiens
ggggcaggctgggc

SEQ ID NO: 2462768 - DNA, 13 bp, Homo sapiens
ggggccagaggct

SEQ ID NO: 2462769 - DNA, 15 bp, Homo sapiens
ggggcccctctcagc

SEQ ID NO: 2462770 - DNA, 18 bp, Homo sapiens
ggggcccctctcagccct

SEQ ID NO: 2462771 - DNA, 19 bp, Homo sapiens
ggggccgatgcccagagac

SEQ ID NO: 2462772 - DNA, 21 bp, Homo sapiens
ggggccgatgcccagagacac

SEQ ID NO: 2462773 - DNA, 12 bp, Homo sapiens
ggggcctgagca

SEQ ID NO: 2462774 - DNA, 23 bp, Homo sapiens
ggggcctgagcagtccttggcct

SEQ ID NO: 2462775 - DNA, 18 bp, Homo sapiens
ggggcctgccacctggac

SEQ ID NO: 2462776 - DNA, 12 bp, Homo sapiens
ggggcctgggag

SEQ ID NO: 2462777 - DNA, 18 bp, Homo sapiens
ggggcctgtactgcctgc

SEQ ID NO: 2462778 - DNA, 15 bp, Homo sapiens
ggggctgaggagcag

SEQ ID NO: 2462779 - DNA, 21 bp, Homo sapiens
ggggctggaggagcccaggcc

SEQ ID NO: 2462780 - DNA, 21 bp, Homo sapiens
ggggcttcctggtgctggagg

SEQ ID NO: 2462781 - DNA, 14 bp, Homo sapiens
ggggcttgccttct

SEQ ID NO: 2462782 - DNA, 17 bp, Homo sapiens
gggggaactcagatcca

SEQ ID NO: 2462783 - DNA, 22 bp, Homo sapiens
gggggagccccttctgctcagc

SEQ ID NO: 2462784 - DNA, 15 bp, Homo sapiens
gggggcacaagactg

SEQ ID NO: 2462785 - DNA, 17 bp, Homo sapiens
gggggcctggctggctg

SEQ ID NO: 2462786 - DNA, 16 bp, Homo sapiens
gggggctggaggagcc

SEQ ID NO: 2462787 - DNA, 16 bp, Homo sapiens
gggggtcctcctccag

SEQ ID NO: 2462788 - DNA, 19 bp, Homo sapiens
gggggtcctcctccaggga

SEQ ID NO: 2462789 - DNA, 20 bp, Homo sapiens
gggggtcctcctccagggac

SEQ ID NO: 2462790 - DNA, 17 bp, Homo sapiens
gggggtctggctggtgt

SEQ ID NO: 2462791 - DNA, 20 bp, Homo sapiens
gggggtgatgagggcagcag

SEQ ID NO: 2462792 - DNA, 20 bp, Homo sapiens
gggggtggccaggccgggaa

SEQ ID NO: 2462793 - DNA, 23 bp, Homo sapiens
gggggtggccgctgagtggcagg

SEQ ID NO: 2462794 - DNA, 15 bp, Homo sapiens
ggggtataggtctca

SEQ ID NO: 2462795 - DNA, 20 bp, Homo sapiens
ggggtataggtctcatctct

SEQ ID NO: 2462796 - DNA, 19 bp, Homo sapiens
ggggtcctggagcagacca

SEQ ID NO: 2462797 - DNA, 21 bp, Homo sapiens
ggggtctggctggtgttaaca

SEQ ID NO: 2462798 - DNA, 14 bp, Homo sapiens
ggggtgaggagctg

SEQ ID NO: 2462799 - DNA, 23 bp, Homo sapiens
ggggtgatgagggcagcagccag

SEQ ID NO: 2462800 - DNA, 13 bp, Homo sapiens
ggggtgggctggt

SEQ ID NO: 2462801 - DNA, 16 bp, Homo sapiens
ggggttattttctggt

SEQ ID NO: 2462802 - DNA, 21 bp, Homo sapiens
ggggttccgtgtccaccccca

SEQ ID NO: 2462803 - DNA, 21 bp, Homo sapiens
gggtaaaccctcacatcagag

SEQ ID NO: 2462804 - DNA, 20 bp, Homo sapiens
gggtaggcaggattggggaa

SEQ ID NO: 2462805 - DNA, 14 bp, Homo sapiens
gggtaggctggagt

SEQ ID NO: 2462806 - DNA, 22 bp, Homo sapiens
gggtatggcgtaagtacagaga

SEQ ID NO: 2462807 - DNA, 23 bp, Homo sapiens
gggtcaagttattaatttcttca

SEQ ID NO: 2462808 - DNA, 15 bp, Homo sapiens
gggtcctcctccagg

SEQ ID NO: 2462809 - DNA, 19 bp, Homo sapiens
gggtcctcttctgggcctg

SEQ ID NO: 2462810 - DNA, 19 bp, Homo sapiens
gggtccttttgacactgct

SEQ ID NO: 2462811 - DNA, 14 bp, Homo sapiens
gggtcggctgacca

SEQ ID NO: 2462812 - DNA, 16 bp, Homo sapiens
gggtctgagctccagc

SEQ ID NO: 2462813 - DNA, 10 bp, Homo sapiens
gctctgagaa

SEQ ID NO: 2462814 - DNA, 15 bp, Homo sapiens
gctctgagaggccct

SEQ ID NO: 2462815 - DNA, 16 bp, Homo sapiens
gctctgagaggccctg

SEQ ID NO: 2462816 - DNA, 20 bp, Homo sapiens
gctctgagagtctagattct

SEQ ID NO: 2462817 - DNA, 12 bp, Homo sapiens
gctctgagctgt

SEQ ID NO: 2462818 - DNA, 13 bp, Homo sapiens
gctctgagctgtc

SEQ ID NO: 2462819 - DNA, 23 bp, Homo sapiens
gctctgaggcgccccaacccgtg

SEQ ID NO: 2462820 - DNA, 11 bp, Homo sapiens
gctctgaggga

SEQ ID NO: 2462821 - DNA, 23 bp, Homo sapiens
gctctgatccctctacagagctt

SEQ ID NO: 2462822 - DNA, 13 bp, Homo sapiens
gctctgatgaaaa

SEQ ID NO: 2462823 - DNA, 16 bp, Homo sapiens
gctctgccagtcctgt

SEQ ID NO: 2462824 - DNA, 17 bp, Homo sapiens
gctctgccagtcctgtc

SEQ ID NO: 2462825 - DNA, 18 bp, Homo sapiens
gctctgccagtcctgtcc

SEQ ID NO: 2462826 - DNA, 22 bp, Homo sapiens
gctctgctattaggccagcaag

SEQ ID NO: 2462827 - DNA, 22 bp, Homo sapiens
gctctgctcccctaaagcctca

SEQ ID NO: 2462828 - DNA, 15 bp, Homo sapiens
gctctggaggggagg

SEQ ID NO: 2462829 - DNA, 14 bp, Homo sapiens
gctctgggccattc

SEQ ID NO: 2462830 - DNA, 19 bp, Homo sapiens
gctctggttgtttctgttc

SEQ ID NO: 2462831 - DNA, 17 bp, Homo sapiens
gctctgtagtgctacag

SEQ ID NO: 2462832 - DNA, 23 bp, Homo sapiens
gctctgtagtgctacagggtcca

SEQ ID NO: 2462833 - DNA, 15 bp, Homo sapiens
gctctgtccccagcc

SEQ ID NO: 2462834 - DNA, 17 bp, Homo sapiens
gctctgtccccagcctg

SEQ ID NO: 2462835 - DNA, 18 bp, Homo sapiens
gctctgttcttcctcagc

SEQ ID NO: 2462836 - DNA, 13 bp, Homo sapiens
gctcttaattgcc

SEQ ID NO: 2462837 - DNA, 22 bp, Homo sapiens
gctcttgatacccccctctgtc

SEQ ID NO: 2462838 - DNA, 23 bp, Homo sapiens
gctcttgatacccccctctgtct

SEQ ID NO: 2462839 - DNA, 17 bp, Homo sapiens
gctcttggagctgtgag

SEQ ID NO: 2462840 - DNA, 14 bp, Homo sapiens
gctcttggctggac

SEQ ID NO: 2462841 - DNA, 20 bp, Homo sapiens
gctcttggctggacccagcc

SEQ ID NO: 2462842 - DNA, 23 bp, Homo sapiens
gctcttggctggacccagccagg

SEQ ID NO: 2462843 - DNA, 21 bp, Homo sapiens
gctcttgttgagccgtgggca

SEQ ID NO: 2462844 - DNA, 14 bp, Homo sapiens
gctctttctctgcc

SEQ ID NO: 2462845 - DNA, 15 bp, Homo sapiens
gctctttctctgcca

SEQ ID NO: 2462846 - DNA, 16 bp, Homo sapiens
gctctttctctgccag

SEQ ID NO: 2462847 - DNA, 17 bp, Homo sapiens
gctctttctctgccagt

SEQ ID NO: 2462848 - DNA, 18 bp, Homo sapiens
gctctttctctgccagtg

SEQ ID NO: 2462849 - DNA, 15 bp, Homo sapiens
gctgaaattctcctg

SEQ ID NO: 2462850 - DNA, 22 bp, Homo sapiens
gctgaacagtggaggaagaggg

SEQ ID NO: 2462851 - DNA, 17 bp, Homo sapiens
gctgaatgttgggactg

SEQ ID NO: 2462852 - DNA, 20 bp, Homo sapiens
gctgaatgttgggactgcta

SEQ ID NO: 2462853 - DNA, 23 bp, Homo sapiens
gctgaatgttgggactgctaaat

SEQ ID NO: 2462854 - DNA, 17 bp, Homo sapiens
gctgaatgtttttctaa

SEQ ID NO: 2462855 - DNA, 17 bp, Homo sapiens
gctgacattcacctgcc

SEQ ID NO: 2462856 - DNA, 13 bp, Homo sapiens
gctgaccacagca

SEQ ID NO: 2462857 - DNA, 14 bp, Homo sapiens
gctgaccacagcac

SEQ ID NO: 2462858 - DNA, 13 bp, Homo sapiens
gctgacggccagg

SEQ ID NO: 2462859 - DNA, 14 bp, Homo sapiens
gctgactgtagctt

SEQ ID NO: 2462860 - DNA, 17 bp, Homo sapiens
gctgacttggctggtgt

SEQ ID NO: 2462861 - DNA, 16 bp, Homo sapiens
gctgagaacctggcct

SEQ ID NO: 2462862 - DNA, 17 bp, Homo sapiens
gctgagaacctggcctt

SEQ ID NO: 2462863 - DNA, 18 bp, Homo sapiens
gctgagaacctggccttc

SEQ ID NO: 2462864 - DNA, 18 bp, Homo sapiens
gctgagcaaatcaccaca

SEQ ID NO: 2462865 - DNA, 14 bp, Homo sapiens
gctgagcaggccac

SEQ ID NO: 2462866 - DNA, 23 bp, Homo sapiens
gctgagcgaggagatgctccttg

SEQ ID NO: 2462867 - DNA, 20 bp, Homo sapiens
gctgagctcacaaggcagca

SEQ ID NO: 2462868 - DNA, 16 bp, Homo sapiens
gctgagctctgagagg

SEQ ID NO: 2462869 - DNA, 17 bp, Homo sapiens
gctgagctctgagaggc

SEQ ID NO: 2462870 - DNA, 18 bp, Homo sapiens
gctgagctctgagaggcc

SEQ ID NO: 2462871 - DNA, 19 bp, Homo sapiens
gctgagctctgagaggccc

SEQ ID NO: 2462872 - DNA, 21 bp, Homo sapiens
gctgagctctgagaggccctg

SEQ ID NO: 2462873 - DNA, 13 bp, Homo sapiens
gctgaggcagcag

SEQ ID NO: 2462874 - DNA, 23 bp, Homo sapiens
gctgaggcagcagtgtgaggcca

SEQ ID NO: 2462875 - DNA, 17 bp, Homo sapiens
gctgaggcctgggccgc

SEQ ID NO: 2462876 - DNA, 14 bp, Homo sapiens
gctgagggagcctg

SEQ ID NO: 2462877 - DNA, 20 bp, Homo sapiens
gctgagggcagttcgcagcc

SEQ ID NO: 2462878 - DNA, 18 bp, Homo sapiens
gctgaggtgcccaggaga

SEQ ID NO: 2462879 - DNA, 19 bp, Homo sapiens
gctgagtggcaggggacag

SEQ ID NO: 2462880 - DNA, 15 bp, Homo sapiens
gctgagtttcctatg

SEQ ID NO: 2462881 - DNA, 13 bp, Homo sapiens
gctgataatttta

SEQ ID NO: 2462882 - DNA, 14 bp, Homo sapiens
gctgataattttaa

SEQ ID NO: 2462883 - DNA, 15 bp, Homo sapiens
gctgataattttaaa

SEQ ID NO: 2462884 - DNA, 17 bp, Homo sapiens
gctgatcgccttcccca

SEQ ID NO: 2462885 - DNA, 20 bp, Homo sapiens
gctgatgtagcatgcttgtt

SEQ ID NO: 2462886 - DNA, 23 bp, Homo sapiens
gctgatgtcaatttctgtgttgc

SEQ ID NO: 2462887 - DNA, 15 bp, Homo sapiens
gctgattaaatgaca

SEQ ID NO: 2462888 - DNA, 18 bp, Homo sapiens
gctgcacctttttgcatg

SEQ ID NO: 2462889 - DNA, 14 bp, Homo sapiens
gctgcagcctcagg

SEQ ID NO: 2462890 - DNA, 18 bp, Homo sapiens
gctgcagcctcaggactg

SEQ ID NO: 2462891 - DNA, 17 bp, Homo sapiens
gctgcaggaatctttaa

SEQ ID NO: 2462892 - DNA, 22 bp, Homo sapiens
gctgcatggcagggggctgctg

SEQ ID NO: 2462893 - DNA, 18 bp, Homo sapiens
gctgccagctctgtatca

SEQ ID NO: 2462894 - DNA, 18 bp, Homo sapiens
gctgccccatcagtgctc

SEQ ID NO: 2462895 - DNA, 15 bp, Homo sapiens
gctgcccccacctct

SEQ ID NO: 2462896 - DNA, 13 bp, Homo sapiens
gctgccccggccc

SEQ ID NO: 2462897 - DNA, 23 bp, Homo sapiens
gctgccccggcccctccccctga

SEQ ID NO: 2462898 - DNA, 14 bp, Homo sapiens
gctgcccctctcac

SEQ ID NO: 2462899 - DNA, 22 bp, Homo sapiens
gctgccctcctgtgctcagccc

SEQ ID NO: 2462900 - DNA, 13 bp, Homo sapiens
gctgcctggaccc

SEQ ID NO: 2462901 - DNA, 21 bp, Homo sapiens
gctgccttattcagggaagga

SEQ ID NO: 2462902 - DNA, 14 bp, Homo sapiens
gctgcgcactgtgt

SEQ ID NO: 2462903 - DNA, 18 bp, Homo sapiens
gctgctaatattttcctc

SEQ ID NO: 2462904 - DNA, 23 bp, Homo sapiens
ggccctcgctgccagctctgtat

SEQ ID NO: 2462905 - DNA, 16 bp, Homo sapiens
ggccctctcccctgcc

SEQ ID NO: 2462906 - DNA, 14 bp, Homo sapiens
ggccctctctgctc

SEQ ID NO: 2462907 - DNA, 21 bp, Homo sapiens
ggccctctctgctctgcgtgt

SEQ ID NO: 2462908 - DNA, 16 bp, Homo sapiens
ggccctgcttcctgct

SEQ ID NO: 2462909 - DNA, 23 bp, Homo sapiens
ggccctggatcagcgtggccttg

SEQ ID NO: 2462910 - DNA, 14 bp, Homo sapiens
ggccctggcctccc

SEQ ID NO: 2462911 - DNA, 15 bp, Homo sapiens
ggccctgggctggaa

SEQ ID NO: 2462912 - DNA, 13 bp, Homo sapiens
ggccctggggcct

SEQ ID NO: 2462913 - DNA, 20 bp, Homo sapiens
ggcccttatgactgccaaga

SEQ ID NO: 2462914 - DNA, 13 bp, Homo sapiens
ggcccttcctgga

SEQ ID NO: 2462915 - DNA, 17 bp, Homo sapiens
ggcccttcctggacagc

SEQ ID NO: 2462916 - DNA, 19 bp, Homo sapiens
ggcccttcctggacagctg

SEQ ID NO: 2462917 - DNA, 20 bp, Homo sapiens
ggcccttcctggacagctgt

SEQ ID NO: 2462918 - DNA, 23 bp, Homo sapiens
ggcccttcctggacagctgtgcc

SEQ ID NO: 2462919 - DNA, 18 bp, Homo sapiens
ggccgaagctaacaggga

SEQ ID NO: 2462920 - DNA, 20 bp, Homo sapiens
ggccgaagctaacagggaag

SEQ ID NO: 2462921 - DNA, 22 bp, Homo sapiens
ggccgccccctgccccccagcc

SEQ ID NO: 2462922 - DNA, 14 bp, Homo sapiens
ggccgccgcctctt

SEQ ID NO: 2462923 - DNA, 17 bp, Homo sapiens
ggccgctgagtggcagg

SEQ ID NO: 2462924 - DNA, 22 bp, Homo sapiens
ggccggcttcatgccagctact

SEQ ID NO: 2462925 - DNA, 14 bp, Homo sapiens
ggccgtggctgctg

SEQ ID NO: 2462926 - DNA, 20 bp, Homo sapiens
ggcctaccccgcagacacct

SEQ ID NO: 2462927 - DNA, 24 bp, Homo sapiens
ggcctactagagtctgaacagctg

SEQ ID NO: 2462928 - DNA, 17 bp, Homo sapiens
ggcctaggagggtcctc

SEQ ID NO: 2462929 - DNA, 12 bp, Homo sapiens
ggcctaggctgc

SEQ ID NO: 2462930 - DNA, 13 bp, Homo sapiens
ggcctaggctgca

SEQ ID NO: 2462931 - DNA, 18 bp, Homo sapiens
ggcctatgacttgggcac

SEQ ID NO: 2462932 - DNA, 15 bp, Homo sapiens
ggcctatggagagcc

SEQ ID NO: 2462933 - DNA, 22 bp, Homo sapiens
ggcctatggagagccctgggac

SEQ ID NO: 2462934 - DNA, 18 bp, Homo sapiens
ggcctcaaaggcccgctc

SEQ ID NO: 2462935 - DNA, 18 bp, Homo sapiens
ggcctcagctcccacaag

SEQ ID NO: 2462936 - DNA, 14 bp, Homo sapiens
ggcctcatgtggct

SEQ ID NO: 2462937 - DNA, 17 bp, Homo sapiens
ggcctcatgtggctgga

SEQ ID NO: 2462938 - DNA, 19 bp, Homo sapiens
ggcctcatgtggctggaag

SEQ ID NO: 2462939 - DNA, 11 bp, Homo sapiens
ggcctccccca

SEQ ID NO: 2462940 - DNA, 14 bp, Homo sapiens
ggcctcccccactt

SEQ ID NO: 2462941 - DNA, 15 bp, Homo sapiens
ggcctcccctgccac

SEQ ID NO: 2462942 - DNA, 19 bp, Homo sapiens
ggcctcccctgccaccagg

SEQ ID NO: 2462943 - DNA, 15 bp, Homo sapiens
ggcctcctgcctcta

SEQ ID NO: 2462944 - DNA, 20 bp, Homo sapiens
ggcctctccctcctccagga

SEQ ID NO: 2462945 - DNA, 22 bp, Homo sapiens
ggcctctctatcctctcttcct

SEQ ID NO: 2462946 - DNA, 23 bp, Homo sapiens
ggcctctctatcctctcttcctc

SEQ ID NO: 2462947 - DNA, 16 bp, Homo sapiens
ggcctcttgagcagtg

SEQ ID NO: 2462948 - DNA, 15 bp, Homo sapiens
ggcctgcaaactggg

SEQ ID NO: 2462949 - DNA, 16 bp, Homo sapiens
ggcctgcaaactggga

SEQ ID NO: 2462950 - DNA, 22 bp, Homo sapiens
ggcctgcagggcctctgtcaat

SEQ ID NO: 2462951 - DNA, 19 bp, Homo sapiens
ggcctgccacctggacccc

SEQ ID NO: 2462952 - DNA, 13 bp, Homo sapiens
ggcctgccaggag

SEQ ID NO: 2462953 - DNA, 10 bp, Homo sapiens
ggcctgctgc

SEQ ID NO: 2462954 - DNA, 20 bp, Homo sapiens
ggcctgctgctgagaacctg

SEQ ID NO: 2462955 - DNA, 18 bp, Homo sapiens
ggcctggactttcctgca

SEQ ID NO: 2462956 - DNA, 15 bp, Homo sapiens
ggcctggctggctga

SEQ ID NO: 2462957 - DNA, 17 bp, Homo sapiens
ggcctggctggctgagg

SEQ ID NO: 2462958 - DNA, 19 bp, Homo sapiens
ggcctggctggctgagggc

SEQ ID NO: 2462959 - DNA, 19 bp, Homo sapiens
ggcctggggtgacccggca

SEQ ID NO: 2462960 - DNA, 23 bp, Homo sapiens
ggcctggtctcaccctggaggca

SEQ ID NO: 2462961 - DNA, 15 bp, Homo sapiens
ggcctgtactgcctg

SEQ ID NO: 2462962 - DNA, 18 bp, Homo sapiens
ggcctgtactgcctgctt

SEQ ID NO: 2462963 - DNA, 17 bp, Homo sapiens
ggcctgtagagttgctg

SEQ ID NO: 2462964 - DNA, 22 bp, Homo sapiens
ggcctgtctcaagctcttcctt

SEQ ID NO: 2462965 - DNA, 22 bp, Homo sapiens
ggcctgtgttcttcctggccgc

SEQ ID NO: 2462966 - DNA, 17 bp, Homo sapiens
ggccttattgcatccca

SEQ ID NO: 2462967 - DNA, 20 bp, Homo sapiens
ggccttcacaatctgtcagt

SEQ ID NO: 2462968 - DNA, 12 bp, Homo sapiens
ggcagcaaggcc

SEQ ID NO: 2462969 - DNA, 11 bp, Homo sapiens
ggcagcagcca

SEQ ID NO: 2462970 - DNA, 15 bp, Homo sapiens
ggcagcagccagccc

SEQ ID NO: 2462971 - DNA, 22 bp, Homo sapiens
ggcagcagccagccctgcctgg

SEQ ID NO: 2462972 - DNA, 12 bp, Homo sapiens
ggcagcagcccc

SEQ ID NO: 2462973 - DNA, 14 bp, Homo sapiens
ggcagcagccccca

SEQ ID NO: 2462974 - DNA, 23 bp, Homo sapiens
ggcagcagcccccagctcccacc

SEQ ID NO: 2462975 - DNA, 18 bp, Homo sapiens
ggcagcagggctaccctg

SEQ ID NO: 2462976 - DNA, 15 bp, Homo sapiens
ggcagcaggggttgg

SEQ ID NO: 2462977 - DNA, 14 bp, Homo sapiens
ggcagcagtgtgag

SEQ ID NO: 2462978 - DNA, 18 bp, Homo sapiens
ggcagccagggagagccc

SEQ ID NO: 2462979 - DNA, 20 bp, Homo sapiens
ggcagccagggagagcccag

SEQ ID NO: 2462980 - DNA, 21 bp, Homo sapiens
ggcagccagggagagcccagg

SEQ ID NO: 2462981 - DNA, 14 bp, Homo sapiens
ggcagcccagccag

SEQ ID NO: 2462982 - DNA, 14 bp, Homo sapiens
ggcagccccaggcc

SEQ ID NO: 2462983 - DNA, 21 bp, Homo sapiens
ggcagcctcccatccagggcc

SEQ ID NO: 2462984 - DNA, 12 bp, Homo sapiens
ggcagcctctgg

SEQ ID NO: 2462985 - DNA, 23 bp, Homo sapiens
ggcagcctctggggggtggccag

SEQ ID NO: 2462986 - DNA, 21 bp, Homo sapiens
ggcagcgccaggctgaccaca

SEQ ID NO: 2462987 - DNA, 13 bp, Homo sapiens
ggcagcttttaaa

SEQ ID NO: 2462988 - DNA, 15 bp, Homo sapiens
ggcagcttttaaaag

SEQ ID NO: 2462989 - DNA, 21 bp, Homo sapiens
ggcaggaccttcgggctgtgc

SEQ ID NO: 2462990 - DNA, 17 bp, Homo sapiens
ggcaggagtagctgagc

SEQ ID NO: 2462991 - DNA, 19 bp, Homo sapiens
ggcaggagtagctgagctc

SEQ ID NO: 2462992 - DNA, 15 bp, Homo sapiens
ggcaggattggggaa

SEQ ID NO: 2462993 - DNA, 17 bp, Homo sapiens
ggcaggattggggaaga

SEQ ID NO: 2462994 - DNA, 20 bp, Homo sapiens
ggcaggcagaggcccaggct

SEQ ID NO: 2462995 - DNA, 18 bp, Homo sapiens
ggcaggcaggctcccagg

SEQ ID NO: 2462996 - DNA, 13 bp, Homo sapiens
ggcaggcagggct

SEQ ID NO: 2462997 - DNA, 22 bp, Homo sapiens
ggcaggcagggctctcctggct

SEQ ID NO: 2462998 - DNA, 15 bp, Homo sapiens
ggcaggccacctggc

SEQ ID NO: 2462999 - DNA, 19 bp, Homo sapiens
ggcaggccacctggctctc

SEQ ID NO: 2463000 - DNA, 17 bp, Homo sapiens
ggcaggctggccagtcc

SEQ ID NO: 2463001 - DNA, 22 bp, Homo sapiens
ggcaggctgggccatgtccaaa

SEQ ID NO: 2463002 - DNA, 22 bp, Homo sapiens
ggcagggagcggccggccagcc

SEQ ID NO: 2463003 - DNA, 19 bp, Homo sapiens
ggcagggcgggcagagggc

SEQ ID NO: 2463004 - DNA, 12 bp, Homo sapiens
ggcagggctctc

SEQ ID NO: 2463005 - DNA, 14 bp, Homo sapiens
gctattctgtccct

SEQ ID NO: 2463006 - DNA, 17 bp, Homo sapiens
gctatttgtaaatctgc

SEQ ID NO: 2463007 - DNA, 23 bp, Homo sapiens
gctgctgtccctcccccttgtcc

SEQ ID NO: 2463008 - DNA, 20 bp, Homo sapiens
gctgctgtctgggtgctact

SEQ ID NO: 2463009 - DNA, 21 bp, Homo sapiens
gctgctgtctgggtgctactg

SEQ ID NO: 2463010 - DNA, 22 bp, Homo sapiens
gctgctgtctgggtgctactgg

SEQ ID NO: 2463011 - DNA, 24 bp, Homo sapiens
gctgctgtctgggtgctactgggg

SEQ ID NO: 2463012 - DNA, 22 bp, Homo sapiens
gctgctgtgtgctttttttgtg

SEQ ID NO: 2463013 - DNA, 13 bp, Homo sapiens
gctgcttcctcct

SEQ ID NO: 2463014 - DNA, 14 bp, Homo sapiens
gctgcttcctcctg

SEQ ID NO: 2463015 - DNA, 16 bp, Homo sapiens
gctgcttcctcctgga

SEQ ID NO: 2463016 - DNA, 19 bp, Homo sapiens
gctgcttctcccaggcaag

SEQ ID NO: 2463017 - DNA, 17 bp, Homo sapiens
gctggaagatagctgtg

SEQ ID NO: 2463018 - DNA, 18 bp, Homo sapiens
gctggaagatagctgtga

SEQ ID NO: 2463019 - DNA, 15 bp, Homo sapiens
gctggaagatcctgc

SEQ ID NO: 2463020 - DNA, 17 bp, Homo sapiens
gctggaagatcctgcgg

SEQ ID NO: 2463021 - DNA, 18 bp, Homo sapiens
gctggaagatcctgcggg

SEQ ID NO: 2463022 - DNA, 16 bp, Homo sapiens
gctggaagctgggagg

SEQ ID NO: 2463023 - DNA, 13 bp, Homo sapiens
gctggacccagcc

SEQ ID NO: 2463024 - DNA, 14 bp, Homo sapiens
gctggaccctgacc

SEQ ID NO: 2463025 - DNA, 23 bp, Homo sapiens
gctggaccctgaccagctccccc

SEQ ID NO: 2463026 - DNA, 21 bp, Homo sapiens
gctggaggagcccaggccagg

SEQ ID NO: 2463027 - DNA, 20 bp, Homo sapiens
gctggaggcaggggcttcct

SEQ ID NO: 2463028 - DNA, 23 bp, Homo sapiens
gctggaggcaggggcttcctggt

SEQ ID NO: 2463029 - DNA, 12 bp, Homo sapiens
gctggaggccca

SEQ ID NO: 2463030 - DNA, 20 bp, Homo sapiens
gctggaggcccaggctggga

SEQ ID NO: 2463031 - DNA, 12 bp, Homo sapiens
gctggagggagg

SEQ ID NO: 2463032 - DNA, 13 bp, Homo sapiens
gctggagggaggc

SEQ ID NO: 2463033 - DNA, 14 bp, Homo sapiens
gctggatgagctcc

SEQ ID NO: 2463034 - DNA, 17 bp, Homo sapiens
gctggccatggagaaag

SEQ ID NO: 2463035 - DNA, 19 bp, Homo sapiens
gctggccatggagaaagct

SEQ ID NO: 2463036 - DNA, 15 bp, Homo sapiens
gctggcccagggccc

SEQ ID NO: 2463037 - DNA, 19 bp, Homo sapiens
gctggcccagggcccagag

SEQ ID NO: 2463038 - DNA, 17 bp, Homo sapiens
gctggctccagatgcag

SEQ ID NO: 2463039 - DNA, 21 bp, Homo sapiens
gctggctccagatgcagggca

SEQ ID NO: 2463040 - DNA, 16 bp, Homo sapiens
gctggctgagggcagt

SEQ ID NO: 2463041 - DNA, 15 bp, Homo sapiens
gctggcttgggcagc

SEQ ID NO: 2463042 - DNA, 21 bp, Homo sapiens
gctgggacgtggctcagccag

SEQ ID NO: 2463043 - DNA, 12 bp, Homo sapiens
gctgggactcag

SEQ ID NO: 2463044 - DNA, 15 bp, Homo sapiens
gctgggactcagcct

SEQ ID NO: 2463045 - DNA, 15 bp, Homo sapiens
gctgggaggaaggac

SEQ ID NO: 2463046 - DNA, 18 bp, Homo sapiens
gctgggagtagttgtctt

SEQ ID NO: 2463047 - DNA, 17 bp, Homo sapiens
gctgggccatgtccaaa

SEQ ID NO: 2463048 - DNA, 14 bp, Homo sapiens
gctggggaagacag

SEQ ID NO: 2463049 - DNA, 19 bp, Homo sapiens
gctggggtcccagcagctg

SEQ ID NO: 2463050 - DNA, 15 bp, Homo sapiens
gctggggtgcaggga

SEQ ID NO: 2463051 - DNA, 19 bp, Homo sapiens
gctgggtccaattgtggca

SEQ ID NO: 2463052 - DNA, 17 bp, Homo sapiens
gctgggtggtaccctct

SEQ ID NO: 2463053 - DNA, 14 bp, Homo sapiens
gctggtagagcagg

SEQ ID NO: 2463054 - DNA, 19 bp, Homo sapiens
gctggtccagggctagtga

SEQ ID NO: 2463055 - DNA, 17 bp, Homo sapiens
gctggtcctttcttccg

SEQ ID NO: 2463056 - DNA, 18 bp, Homo sapiens
gctggtgcggctggccat

SEQ ID NO: 2463057 - DNA, 19 bp, Homo sapiens
gctggtgggctggccgctg

SEQ ID NO: 2463058 - DNA, 12 bp, Homo sapiens
gctggtgtagct

SEQ ID NO: 2463059 - DNA, 15 bp, Homo sapiens
gctggtgtagctaca

SEQ ID NO: 2463060 - DNA, 21 bp, Homo sapiens
gctggtgtagctacagagaaa

SEQ ID NO: 2463061 - DNA, 15 bp, Homo sapiens
gctggtgtggtacag

SEQ ID NO: 2463062 - DNA, 23 bp, Homo sapiens
gctggtgtggtacagagaagcca

SEQ ID NO: 2463063 - DNA, 13 bp, Homo sapiens
gctggtgttaaca

SEQ ID NO: 2463064 - DNA, 14 bp, Homo sapiens
gctggtgttaacag

SEQ ID NO: 2463065 - DNA, 18 bp, Homo sapiens
gctggtgttaacagaagg

SEQ ID NO: 2463066 - DNA, 21 bp, Homo sapiens
gctgtaactactttataacta

SEQ ID NO: 2463067 - DNA, 13 bp, Homo sapiens
gctgtaaggctct

SEQ ID NO: 2463068 - DNA, 22 bp, Homo sapiens
gctgtaatctatgaattctaag

SEQ ID NO: 2463069 - DNA, 12 bp, Homo sapiens
gctgtacatcta

SEQ ID NO: 2463070 - DNA, 22 bp, Homo sapiens
gctgtacatctattttggattg

SEQ ID NO: 2463071 - DNA, 16 bp, Homo sapiens
gctgtagtaggcattt

SEQ ID NO: 2463072 - DNA, 23 bp, Homo sapiens
gctgtagtaggcatttttaccat

SEQ ID NO: 2463073 - DNA, 14 bp, Homo sapiens
gctgtcaaggctca

SEQ ID NO: 2463074 - DNA, 15 bp, Homo sapiens
gctgtcatctgtgca

SEQ ID NO: 2463075 - DNA, 14 bp, Homo sapiens
gctgtcccggaggc

SEQ ID NO: 2463076 - DNA, 23 bp, Homo sapiens
gctgtctgggtgctactggggaa

SEQ ID NO: 2463077 - DNA, 21 bp, Homo sapiens
gctgtcttaaactaaatgtgc

SEQ ID NO: 2463078 - DNA, 13 bp, Homo sapiens
gctgtgacctgct

SEQ ID NO: 2463079 - DNA, 14 bp, Homo sapiens
gctgtgacctgctg

SEQ ID NO: 2463080 - DNA, 15 bp, Homo sapiens
gctgtgacctgctga

SEQ ID NO: 2463081 - DNA, 17 bp, Homo sapiens
gctgtgacctgctgagc

SEQ ID NO: 2463082 - DNA, 19 bp, Homo sapiens
gctgtgacctgctgagctc

SEQ ID NO: 2463083 - DNA, 14 bp, Homo sapiens
gctgtgaggctgtc

SEQ ID NO: 2463084 - DNA, 22 bp, Homo sapiens
gctgtgagtctttggttctaag

SEQ ID NO: 2463085 - DNA, 20 bp, Homo sapiens
gctgtgatacgatgcttcaa

SEQ ID NO: 2463086 - DNA, 22 bp, Homo sapiens
gctgtggaccatggagtggcag

SEQ ID NO: 2463087 - DNA, 21 bp, Homo sapiens
gctgtggcatgggtgaagagg

SEQ ID NO: 2463088 - DNA, 13 bp, Homo sapiens
gctgtggccagga

SEQ ID NO: 2463089 - DNA, 14 bp, Homo sapiens
gctgtggccaggag

SEQ ID NO: 2463090 - DNA, 18 bp, Homo sapiens
gctgtggccaggaggtgc

SEQ ID NO: 2463091 - DNA, 18 bp, Homo sapiens
gctgtgtgaatacctgct

SEQ ID NO: 2463092 - DNA, 15 bp, Homo sapiens
gctgttaaatacagg

SEQ ID NO: 2463093 - DNA, 16 bp, Homo sapiens
gctgtttattaatctt

SEQ ID NO: 2463094 - DNA, 13 bp, Homo sapiens
gctgttttgttat

SEQ ID NO: 2463095 - DNA, 14 bp, Homo sapiens
gctgttttgttata

SEQ ID NO: 2463096 - DNA, 19 bp, Homo sapiens
gctgttttgttgacattct

SEQ ID NO: 2463097 - DNA, 12 bp, Homo sapiens
gcttaaaataca

SEQ ID NO: 2463098 - DNA, 13 bp, Homo sapiens
gcttaaaatacaa

SEQ ID NO: 2463099 - DNA, 17 bp, Homo sapiens
gcttaatcagatagata

SEQ ID NO: 2463100 - DNA, 15 bp, Homo sapiens
gcttaatctttgaaa

SEQ ID NO: 2463101 - DNA, 20 bp, Homo sapiens
gcttaatggctgataatttt

SEQ ID NO: 2463102 - DNA, 22 bp, Homo sapiens
gcttacctggcccatcagggta

SEQ ID NO: 2463103 - DNA, 13 bp, Homo sapiens
gcttagatttcat

SEQ ID NO: 2463104 - DNA, 23 bp, Homo sapiens
gcttagctttagaaacagtgcaa

SEQ ID NO: 2463105 - DNA, 21 bp, Homo sapiens
gcttagtttgtgtgttgtctc

SEQ ID NO: 2463106 - DNA, 17 bp, Homo sapiens
gcttatacgaaataatt

SEQ ID NO: 2463107 - DNA, 22 bp, Homo sapiens
gcttatacgaaataattgttgt

SEQ ID NO: 2463108 - DNA, 15 bp, Homo sapiens
gcttatggtaccaga

SEQ ID NO: 2463109 - DNA, 15 bp, Homo sapiens
gcttattccatgact

SEQ ID NO: 2463110 - DNA, 18 bp, Homo sapiens
gcttattccatgactgct

SEQ ID NO: 2463111 - DNA, 23 bp, Homo sapiens
gcttcaggcccccgccttggcct

SEQ ID NO: 2463112 - DNA, 16 bp, Homo sapiens
gcccccagcctgtcag

SEQ ID NO: 2463113 - DNA, 15 bp, Homo sapiens
gcccccagctaagaa

SEQ ID NO: 2463114 - DNA, 22 bp, Homo sapiens
gcccccagctaagaacctggaa

SEQ ID NO: 2463115 - DNA, 17 bp, Homo sapiens
gcccccatcatcctctg

SEQ ID NO: 2463116 - DNA, 13 bp, Homo sapiens
gcccccatctcat

SEQ ID NO: 2463117 - DNA, 13 bp, Homo sapiens
gcccccctggcct

SEQ ID NO: 2463118 - DNA, 14 bp, Homo sapiens
gcctgccactgtgt

SEQ ID NO: 2463119 - DNA, 14 bp, Homo sapiens
gcctgccagctgca

SEQ ID NO: 2463120 - DNA, 16 bp, Homo sapiens
gcaattcaaaagttcc

SEQ ID NO: 2463121 - DNA, 18 bp, Homo sapiens
gcaattcccctctgctgc

SEQ ID NO: 2463122 - DNA, 20 bp, Homo sapiens
gcacaataactcctcccagg

SEQ ID NO: 2463123 - DNA, 18 bp, Homo sapiens
gcacacagctactctccc

SEQ ID NO: 2463124 - DNA, 13 bp, Homo sapiens
gcacacagggcag

SEQ ID NO: 2463125 - DNA, 14 bp, Homo sapiens
gcacagatggccag

SEQ ID NO: 2463126 - DNA, 23 bp, Homo sapiens
gcacagatggccagccccttaga

SEQ ID NO: 2463127 - DNA, 22 bp, Homo sapiens
gcacagcacaaattagttatat

SEQ ID NO: 2463128 - DNA, 11 bp, Homo sapiens
gcacagccctt

SEQ ID NO: 2463129 - DNA, 15 bp, Homo sapiens
gcacagctaattcta

SEQ ID NO: 2463130 - DNA, 16 bp, Homo sapiens
gcacagcttagatttc

SEQ ID NO: 2463131 - DNA, 12 bp, Homo sapiens
gcacaggagcta

SEQ ID NO: 2463132 - DNA, 21 bp, Homo sapiens
gcacaggagggggtcgtggag

SEQ ID NO: 2463133 - DNA, 22 bp, Homo sapiens
gcacaggagggggtcgtggaga

SEQ ID NO: 2463134 - DNA, 16 bp, Homo sapiens
gcacagtcactgctct

SEQ ID NO: 2463135 - DNA, 13 bp, Homo sapiens
gcacagtgtgtga

SEQ ID NO: 2463136 - DNA, 17 bp, Homo sapiens
gcacagtgtgtgactta

SEQ ID NO: 2463137 - DNA, 19 bp, Homo sapiens
gcacatctcaacaggcctc

SEQ ID NO: 2463138 - DNA, 22 bp, Homo sapiens
gcacatctcaacaggcctcagg

SEQ ID NO: 2463139 - DNA, 17 bp, Homo sapiens
gcacatctgtgtcttgt

SEQ ID NO: 2463140 - DNA, 21 bp, Homo sapiens
gcaccaaatcaaaatctctcc

SEQ ID NO: 2463141 - DNA, 23 bp, Homo sapiens
gcaccaaatcaaaatctctccac

SEQ ID NO: 2463142 - DNA, 15 bp, Homo sapiens
gcaccaagcaggaaa

SEQ ID NO: 2463143 - DNA, 20 bp, Homo sapiens
gccaccctgaggagtctgag

SEQ ID NO: 2463144 - DNA, 17 bp, Homo sapiens
gccaccgagtgccttca

SEQ ID NO: 2463145 - DNA, 23 bp, Homo sapiens
gccacctcagaccccggggtgag

SEQ ID NO: 2463146 - DNA, 13 bp, Homo sapiens
gccacctggaccc

SEQ ID NO: 2463147 - DNA, 20 bp, Homo sapiens
gccacctggctctcacctct

SEQ ID NO: 2463148 - DNA, 15 bp, Homo sapiens
gccacgctccagctg

SEQ ID NO: 2463149 - DNA, 17 bp, Homo sapiens
gccacgctccagctgcc

SEQ ID NO: 2463150 - DNA, 19 bp, Homo sapiens
gccactaaccttgcctggt

SEQ ID NO: 2463151 - DNA, 14 bp, Homo sapiens
gccactcactaggc

SEQ ID NO: 2463152 - DNA, 23 bp, Homo sapiens
gccactcactaggcccccacttg

SEQ ID NO: 2463153 - DNA, 17 bp, Homo sapiens
gccactcctctgactca

SEQ ID NO: 2463154 - DNA, 23 bp, Homo sapiens
gccactcctctgactcagggctc

SEQ ID NO: 2463155 - DNA, 23 bp, Homo sapiens
gccactgcttttccctttgtgag

SEQ ID NO: 2463156 - DNA, 14 bp, Homo sapiens
gccactggggctca

SEQ ID NO: 2463157 - DNA, 16 bp, Homo sapiens
gccactggggctcaga

SEQ ID NO: 2463158 - DNA, 19 bp, Homo sapiens
gccactggggctcagagcc

SEQ ID NO: 2463159 - DNA, 16 bp, Homo sapiens
gccagacacaggccct

SEQ ID NO: 2463160 - DNA, 18 bp, Homo sapiens
gccagacatgccacaagg

SEQ ID NO: 2463161 - DNA, 21 bp, Homo sapiens
gccagagatccaaaagaagcc

SEQ ID NO: 2463162 - DNA, 22 bp, Homo sapiens
gccagagccaaggggcttcagg

SEQ ID NO: 2463163 - DNA, 15 bp, Homo sapiens
gccagagcctggggc

SEQ ID NO: 2463164 - DNA, 16 bp, Homo sapiens
gccagagcctggggct

SEQ ID NO: 2463165 - DNA, 14 bp, Homo sapiens
gccagaggccccca

SEQ ID NO: 2463166 - DNA, 20 bp, Homo sapiens
gccagaggcccccagcccag

SEQ ID NO: 2463167 - DNA, 15 bp, Homo sapiens
gccagcacacagggc

SEQ ID NO: 2463168 - DNA, 20 bp, Homo sapiens
gccagcaccggaccagcctg

SEQ ID NO: 2463169 - DNA, 13 bp, Homo sapiens
gccagcagcacct

SEQ ID NO: 2463170 - DNA, 18 bp, Homo sapiens
gccagcaggggctgcccg

SEQ ID NO: 2463171 - DNA, 14 bp, Homo sapiens
gccagcatctgggc

SEQ ID NO: 2463172 - DNA, 14 bp, Homo sapiens
gccagcccctgcca

SEQ ID NO: 2463173 - DNA, 10 bp, Homo sapiens
gccagccctg

SEQ ID NO: 2463174 - DNA, 23 bp, Homo sapiens
gccagccctgcctggaggacctg

SEQ ID NO: 2463175 - DNA, 24 bp, Homo sapiens
gccagccgagcaggaggcctagga

SEQ ID NO: 2463176 - DNA, 19 bp, Homo sapiens
gccagccgcgcatcagact

SEQ ID NO: 2463177 - DNA, 20 bp, Homo sapiens
gccagccgcgcatcagactg

SEQ ID NO: 2463178 - DNA, 23 bp, Homo sapiens
gccagccggggcgagtggcacgt

SEQ ID NO: 2463179 - DNA, 15 bp, Homo sapiens
gccagcctggcctcc

SEQ ID NO: 2463180 - DNA, 12 bp, Homo sapiens
gccagcgtcctc

SEQ ID NO: 2463181 - DNA, 19 bp, Homo sapiens
gccagcgtcctcctctgtg

SEQ ID NO: 2463182 - DNA, 20 bp, Homo sapiens
gccagcgtcggtctgtgccc

SEQ ID NO: 2463183 - DNA, 16 bp, Homo sapiens
gccagctaaggggtgg

SEQ ID NO: 2463184 - DNA, 13 bp, Homo sapiens
gccagctctgtat

SEQ ID NO: 2463185 - DNA, 23 bp, Homo sapiens
gccagctctgttcttcctcagcc

SEQ ID NO: 2463186 - DNA, 14 bp, Homo sapiens
gccagctgcactga

SEQ ID NO: 2463187 - DNA, 15 bp, Homo sapiens
gccagcttgtttaca

SEQ ID NO: 2463188 - DNA, 16 bp, Homo sapiens
gccagcttgtttacat

SEQ ID NO: 2463189 - DNA, 21 bp, Homo sapiens
gccaggaatttcccaggaccc

SEQ ID NO: 2463190 - DNA, 23 bp, Homo sapiens
gccaggaatttcccaggaccctg

SEQ ID NO: 2463191 - DNA, 16 bp, Homo sapiens
gccaggactctgcagc

SEQ ID NO: 2463192 - DNA, 17 bp, Homo sapiens
gccaggactctgcagcc

SEQ ID NO: 2463193 - DNA, 20 bp, Homo sapiens
gccaggactctgcagcctca

SEQ ID NO: 2463194 - DNA, 19 bp, Homo sapiens
gccaggagaagctcagctg

SEQ ID NO: 2463195 - DNA, 18 bp, Homo sapiens
gccaggagcacggctctg

SEQ ID NO: 2463196 - DNA, 21 bp, Homo sapiens
gccaggagcacggctctgtcc

SEQ ID NO: 2463197 - DNA, 13 bp, Homo sapiens
gccaggagggaca

SEQ ID NO: 2463198 - DNA, 18 bp, Homo sapiens
gccaggaggtgccactgg

SEQ ID NO: 2463199 - DNA, 20 bp, Homo sapiens
gccaggatggaacacggcca

SEQ ID NO: 2463200 - DNA, 22 bp, Homo sapiens
gccaggatggaacacggccaca

SEQ ID NO: 2463201 - DNA, 13 bp, Homo sapiens
gccaggccgggaa

SEQ ID NO: 2463202 - DNA, 14 bp, Homo sapiens
gccaggcctctccc

SEQ ID NO: 2463203 - DNA, 13 bp, Homo sapiens
gccaggcgaggcc

SEQ ID NO: 2463204 - DNA, 15 bp, Homo sapiens
gccaggcgaggccct

SEQ ID NO: 2463205 - DNA, 15 bp, Homo sapiens
gccaggctgaccaca

SEQ ID NO: 2463206 - DNA, 19 bp, Homo sapiens
gccaggctgaccacagcac

SEQ ID NO: 2463207 - DNA, 14 bp, Homo sapiens
gccagggagaagct

SEQ ID NO: 2463208 - DNA, 16 bp, Homo sapiens
gccagggagaagctcc

SEQ ID NO: 2463209 - DNA, 20 bp, Homo sapiens
gccagggagaagctcctctc

SEQ ID NO: 2463210 - DNA, 13 bp, Homo sapiens
gccagggagagcc

SEQ ID NO: 2463211 - DNA, 17 bp, Homo sapiens
gccagggagagcccagg

SEQ ID NO: 2463212 - DNA, 19 bp, Homo sapiens
gccagggagagcccaggag

SEQ ID NO: 2463213 - DNA, 21 bp, Homo sapiens
gccagggagagcccaggagct

SEQ ID NO: 2463214 - DNA, 15 bp, Homo sapiens
gccagggcagagtga

SEQ ID NO: 2463215 - DNA, 16 bp, Homo sapiens
gccagggcagagtgag

SEQ ID NO: 2463216 - DNA, 21 bp, Homo sapiens
gccagggcagagtgagaccca

SEQ ID NO: 2463217 - DNA, 14 bp, Homo sapiens
gccagggcagggcc

SEQ ID NO: 2463218 - DNA, 15 bp, Homo sapiens
gccagggccacgctc

SEQ ID NO: 2463219 - DNA, 19 bp, Homo sapiens
gccagggccacgctccagc

SEQ ID NO: 2463220 - DNA, 16 bp, Homo sapiens
gccagggcccctctcc

SEQ ID NO: 2463221 - DNA, 20 bp, Homo sapiens
gccagggcccctctccccag

SEQ ID NO: 2463222 - DNA, 22 bp, Homo sapiens
gccagggcccctctccccaggg

SEQ ID NO: 2463223 - DNA, 20 bp, Homo sapiens
gccaggggggtgaggagctg

SEQ ID NO: 2463224 - DNA, 19 bp, Homo sapiens
gccagggtctccagaaagc

SEQ ID NO: 2463225 - DNA, 21 bp, Homo sapiens
gccaggtgactgtctggggag

SEQ ID NO: 2463226 - DNA, 18 bp, Homo sapiens
gccaggtgaggtcagcac

SEQ ID NO: 2463227 - DNA, 23 bp, Homo sapiens
gccaggttctccgttagctcctg

SEQ ID NO: 2463228 - DNA, 21 bp, Homo sapiens
gccagtaacgcgtcttcctga

SEQ ID NO: 2463229 - DNA, 12 bp, Homo sapiens
gccagtcaggcc

SEQ ID NO: 2463230 - DNA, 13 bp, Homo sapiens
gccagtccaggct

SEQ ID NO: 2463231 - DNA, 20 bp, Homo sapiens
gccagtctgtggatcagaga

SEQ ID NO: 2463232 - DNA, 17 bp, Homo sapiens
gagtctgaggtcctgag

SEQ ID NO: 2463233 - DNA, 22 bp, Homo sapiens
gagtctgaggtcctgagcactg

SEQ ID NO: 2463234 - DNA, 16 bp, Homo sapiens
gagtctgccacccagg

SEQ ID NO: 2463235 - DNA, 12 bp, Homo sapiens
gagtctgccagg

SEQ ID NO: 2463236 - DNA, 20 bp, Homo sapiens
gagtctgccagggcccctct

SEQ ID NO: 2463237 - DNA, 14 bp, Homo sapiens
gagtctttggttct

SEQ ID NO: 2463238 - DNA, 15 bp, Homo sapiens
gagtctttggttcta

SEQ ID NO: 2463239 - DNA, 15 bp, Homo sapiens
gagtgaataaatgtc

SEQ ID NO: 2463240 - DNA, 16 bp, Homo sapiens
gagtgaattccctcac

SEQ ID NO: 2463241 - DNA, 14 bp, Homo sapiens
gagtgcagtcctga

SEQ ID NO: 2463242 - DNA, 17 bp, Homo sapiens
gagtgcagtcctgatca

SEQ ID NO: 2463243 - DNA, 19 bp, Homo sapiens
gagtggagtctgccaccca

SEQ ID NO: 2463244 - DNA, 16 bp, Homo sapiens
gagtggcagcccagcc

SEQ ID NO: 2463245 - DNA, 21 bp, Homo sapiens
gagtggcagcccagccagcgt

SEQ ID NO: 2463246 - DNA, 14 bp, Homo sapiens
gagtggcaggggac

SEQ ID NO: 2463247 - DNA, 23 bp, Homo sapiens
gagtggcaggggacaggagtcca

SEQ ID NO: 2463248 - DNA, 18 bp, Homo sapiens
gagtgtagcaactacagt

SEQ ID NO: 2463249 - DNA, 17 bp, Homo sapiens
gagttaagacctggcag

SEQ ID NO: 2463250 - DNA, 16 bp, Homo sapiens
gagttacagttctgtg

SEQ ID NO: 2463251 - DNA, 21 bp, Homo sapiens
gagttagggactgaccagcag

SEQ ID NO: 2463252 - DNA, 19 bp, Homo sapiens
gagttctttttgaagtatt

SEQ ID NO: 2463253 - DNA, 21 bp, Homo sapiens
gagttgatctggaacccagac

SEQ ID NO: 2463254 - DNA, 22 bp, Homo sapiens
gagttgcttttcagctgaggtt

SEQ ID NO: 2463255 - DNA, 20 bp, Homo sapiens
gagtttaaaatcatcagaaa

SEQ ID NO: 2463256 - DNA, 18 bp, Homo sapiens
gagtttatgttccattaa

SEQ ID NO: 2463257 - DNA, 17 bp, Homo sapiens
gagtttcctatgggaac

SEQ ID NO: 2463258 - DNA, 18 bp, Homo sapiens
gagttttccatggcagga

SEQ ID NO: 2463259 - DNA, 22 bp, Homo sapiens
gataaacacaagattggtgttt

SEQ ID NO: 2463260 - DNA, 17 bp, Homo sapiens
gataaagattttttaat

SEQ ID NO: 2463261 - DNA, 13 bp, Homo sapiens
gataaggaaatca

SEQ ID NO: 2463262 - DNA, 20 bp, Homo sapiens
gataaggtaaaatgccatga

SEQ ID NO: 2463263 - DNA, 22 bp, Homo sapiens
gataagtgttctgtctgacttt

SEQ ID NO: 2463264 - DNA, 13 bp, Homo sapiens
gataatgaacaga

SEQ ID NO: 2463265 - DNA, 14 bp, Homo sapiens
gataattataatat

SEQ ID NO: 2463266 - DNA, 18 bp, Homo sapiens
gataattttaaattctct

SEQ ID NO: 2463267 - DNA, 17 bp, Homo sapiens
gatacatccaaagcaga

SEQ ID NO: 2463268 - DNA, 20 bp, Homo sapiens
gatacatccaaagcagacag

SEQ ID NO: 2463269 - DNA, 21 bp, Homo sapiens
gatacatccaaagcagacagc

SEQ ID NO: 2463270 - DNA, 19 bp, Homo sapiens
gatactgcgactttctgcc

SEQ ID NO: 2463271 - DNA, 23 bp, Homo sapiens
gatactgcgactttctgcctgga

SEQ ID NO: 2463272 - DNA, 12 bp, Homo sapiens
gatactgttgca

SEQ ID NO: 2463273 - DNA, 18 bp, Homo sapiens
gatactgttgcacgtgtg

SEQ ID NO: 2463274 - DNA, 20 bp, Homo sapiens
gatacttaagtgctgcaatt

SEQ ID NO: 2463275 - DNA, 19 bp, Homo sapiens
gatacttcgacactgttct

SEQ ID NO: 2463276 - DNA, 20 bp, Homo sapiens
gatacttggatttagtttca

SEQ ID NO: 2463277 - DNA, 23 bp, Homo sapiens
gatagagactggaacactagaca

SEQ ID NO: 2463278 - DNA, 12 bp, Homo sapiens
gatagatgctgg

SEQ ID NO: 2463279 - DNA, 18 bp, Homo sapiens
gatagatgctggcccagg

SEQ ID NO: 2463280 - DNA, 20 bp, Homo sapiens
gatagatgctggcccagggc

SEQ ID NO: 2463281 - DNA, 13 bp, Homo sapiens
gatagctgtgact

SEQ ID NO: 2463282 - DNA, 14 bp, Homo sapiens
gatagttttcatcc

SEQ ID NO: 2463283 - DNA, 20 bp, Homo sapiens
gatatatcatgagtgaataa

SEQ ID NO: 2463284 - DNA, 21 bp, Homo sapiens
gatatatcatgagtgaataaa

SEQ ID NO: 2463285 - DNA, 16 bp, Homo sapiens
gatatattttctttct

SEQ ID NO: 2463286 - DNA, 20 bp, Homo sapiens
gatatcttggacaaatcaca

SEQ ID NO: 2463287 - DNA, 16 bp, Homo sapiens
gatatgtaaaacattt

SEQ ID NO: 2463288 - DNA, 18 bp, Homo sapiens
gatatgtaaaacatttat

SEQ ID NO: 2463289 - DNA, 19 bp, Homo sapiens
gatatgtaaaacatttatt

SEQ ID NO: 2463290 - DNA, 17 bp, Homo sapiens
gatatgtatgggtaggg

SEQ ID NO: 2463291 - DNA, 12 bp, Homo sapiens
gatattctaaga

SEQ ID NO: 2463292 - DNA, 16 bp, Homo sapiens
gatcaaaaactatttg

SEQ ID NO: 2463293 - DNA, 12 bp, Homo sapiens
gatcaaagatga

SEQ ID NO: 2463294 - DNA, 18 bp, Homo sapiens
gatcaaagatgaaaagta

SEQ ID NO: 2463295 - DNA, 22 bp, Homo sapiens
gatcaaggccttattggaaagc

SEQ ID NO: 2463296 - DNA, 13 bp, Homo sapiens
gatcacaaaaaca

SEQ ID NO: 2463297 - DNA, 17 bp, Homo sapiens
gatcacaagatggaatt

SEQ ID NO: 2463298 - DNA, 23 bp, Homo sapiens
gatcagccccaccctggcctaga

SEQ ID NO: 2463299 - DNA, 20 bp, Homo sapiens
gatcagtgtaccatttgcct

SEQ ID NO: 2463300 - DNA, 13 bp, Homo sapiens
gatcataaggctt

SEQ ID NO: 2463301 - DNA, 19 bp, Homo sapiens
gatccaaaagaagccccca

SEQ ID NO: 2463302 - DNA, 20 bp, Homo sapiens
gatccaaaagaagcccccag

SEQ ID NO: 2463303 - DNA, 14 bp, Homo sapiens
gatccacctgtctc

SEQ ID NO: 2463304 - DNA, 18 bp, Homo sapiens
gatccacctgtctcagcc

SEQ ID NO: 2463305 - DNA, 19 bp, Homo sapiens
gatccacctgtctcagcct

SEQ ID NO: 2463306 - DNA, 16 bp, Homo sapiens
gatccaggagctccag

SEQ ID NO: 2463307 - DNA, 15 bp, Homo sapiens
gattattcagtgtca

SEQ ID NO: 2463308 - DNA, 15 bp, Homo sapiens
gattcaaaggttcta

SEQ ID NO: 2463309 - DNA, 21 bp, Homo sapiens
gattcagaaaatgttctgttt

SEQ ID NO: 2463310 - DNA, 23 bp, Homo sapiens
gattcagaaaatgttctgtttgc

SEQ ID NO: 2463311 - DNA, 21 bp, Homo sapiens
gattcaggaaaaggcctgggg

SEQ ID NO: 2463312 - DNA, 23 bp, Homo sapiens
gattcaggaaaaggcctggggtg

SEQ ID NO: 2463313 - DNA, 17 bp, Homo sapiens
gattccctctcccaggc

SEQ ID NO: 2463314 - DNA, 18 bp, Homo sapiens
gattccctctcccaggcc

SEQ ID NO: 2463315 - DNA, 18 bp, Homo sapiens
gattccggatcctaagca

SEQ ID NO: 2463316 - DNA, 18 bp, Homo sapiens
gattccttagactctttt

SEQ ID NO: 2463317 - DNA, 15 bp, Homo sapiens
gattcctttaacaac

SEQ ID NO: 2463318 - DNA, 20 bp, Homo sapiens
gattcctttaacaacatgtt

SEQ ID NO: 2463319 - DNA, 12 bp, Homo sapiens
gattctaaaatg

SEQ ID NO: 2463320 - DNA, 14 bp, Homo sapiens
gattctaaagattc

SEQ ID NO: 2463321 - DNA, 18 bp, Homo sapiens
gattctcaaaggagcgag

SEQ ID NO: 2463322 - DNA, 23 bp, Homo sapiens
gattctctggctgtaaggctcta

SEQ ID NO: 2463323 - DNA, 15 bp, Homo sapiens
gattctctgtgtcta

SEQ ID NO: 2463324 - DNA, 18 bp, Homo sapiens
gattctctgtgtctaaga

SEQ ID NO: 2463325 - DNA, 15 bp, Homo sapiens
gattctcttgcctca

SEQ ID NO: 2463326 - DNA, 16 bp, Homo sapiens
gattctcttgcctcaa

SEQ ID NO: 2463327 - DNA, 17 bp, Homo sapiens
gattctgcctttgccag

SEQ ID NO: 2463328 - DNA, 19 bp, Homo sapiens
gattctgctggcctctgcg

SEQ ID NO: 2463329 - DNA, 18 bp, Homo sapiens
gattgaaaatgtccagga

SEQ ID NO: 2463330 - DNA, 17 bp, Homo sapiens
gattgagctctctgccc

SEQ ID NO: 2463331 - DNA, 16 bp, Homo sapiens
gattgagtctgtgcca

SEQ ID NO: 2463332 - DNA, 16 bp, Homo sapiens
gaggagggaggccagg

SEQ ID NO: 2463333 - DNA, 14 bp, Homo sapiens
gaggagggaggccg

SEQ ID NO: 2463334 - DNA, 20 bp, Homo sapiens
gaggagggtcggtgccttca

SEQ ID NO: 2463335 - DNA, 21 bp, Homo sapiens
gaggagggtcggtgccttcaa

SEQ ID NO: 2463336 - DNA, 11 bp, Homo sapiens
gaggagtaaca

SEQ ID NO: 2463337 - DNA, 14 bp, Homo sapiens
gaggagtctgaggt

SEQ ID NO: 2463338 - DNA, 20 bp, Homo sapiens
gaggagtctgaggtcctgag

SEQ ID NO: 2463339 - DNA, 21 bp, Homo sapiens
gaggatgtaaagatcaataaa

SEQ ID NO: 2463340 - DNA, 13 bp, Homo sapiens
gaggcaccaggaa

SEQ ID NO: 2463341 - DNA, 13 bp, Homo sapiens
gaggcagcccagg

SEQ ID NO: 2463342 - DNA, 16 bp, Homo sapiens
gaggcaggggcttcct

SEQ ID NO: 2463343 - DNA, 23 bp, Homo sapiens
gaggcaggggcttcctggtgctg

SEQ ID NO: 2463344 - DNA, 18 bp, Homo sapiens
gaggccacactcagcaca

SEQ ID NO: 2463345 - DNA, 11 bp, Homo sapiens
gaggccagcct

SEQ ID NO: 2463346 - DNA, 22 bp, Homo sapiens
gaggccagcctggcctcctgcc

SEQ ID NO: 2463347 - DNA, 20 bp, Homo sapiens
gaggccatggactctgtcct

SEQ ID NO: 2463348 - DNA, 20 bp, Homo sapiens
gaggcccacattggaagagc

SEQ ID NO: 2463349 - DNA, 15 bp, Homo sapiens
gaggcccaggctggg

SEQ ID NO: 2463350 - DNA, 20 bp, Homo sapiens
gaggcccagttcaccctgat

SEQ ID NO: 2463351 - DNA, 13 bp, Homo sapiens
gaggccccagccg

SEQ ID NO: 2463352 - DNA, 14 bp, Homo sapiens
gaggcccccagccc

SEQ ID NO: 2463353 - DNA, 15 bp, Homo sapiens
gaggcccccagccca

SEQ ID NO: 2463354 - DNA, 21 bp, Homo sapiens
gaggccctccacacctgcggc

SEQ ID NO: 2463355 - DNA, 22 bp, Homo sapiens
gaggccctccacacctgcggcc

SEQ ID NO: 2463356 - DNA, 18 bp, Homo sapiens
gaggccgaagctaacagg

SEQ ID NO: 2463357 - DNA, 18 bp, Homo sapiens
gaggcctaccccgcagac

SEQ ID NO: 2463358 - DNA, 19 bp, Homo sapiens
gaggcctgcagggcctctg

SEQ ID NO: 2463359 - DNA, 21 bp, Homo sapiens
gaggcctgcagggcctctgtc

SEQ ID NO: 2463360 - DNA, 16 bp, Homo sapiens
gaggcctgggccgctg

SEQ ID NO: 2463361 - DNA, 21 bp, Homo sapiens
gaggcctgggccgctgccacg

SEQ ID NO: 2463362 - DNA, 17 bp, Homo sapiens
gaggcctgggctgggaa

SEQ ID NO: 2463363 - DNA, 14 bp, Homo sapiens
gaggctccagaggg

SEQ ID NO: 2463364 - DNA, 20 bp, Homo sapiens
gaggctgaggctggcacagg

SEQ ID NO: 2463365 - DNA, 15 bp, Homo sapiens
gaggctgcccctctc

SEQ ID NO: 2463366 - DNA, 13 bp, Homo sapiens
gaggctgccctcc

SEQ ID NO: 2463367 - DNA, 13 bp, Homo sapiens
gaggctgctcggg

SEQ ID NO: 2463368 - DNA, 13 bp, Homo sapiens
gaggctggcacag

SEQ ID NO: 2463369 - DNA, 18 bp, Homo sapiens
gaggctggtcctatggcc

SEQ ID NO: 2463370 - DNA, 20 bp, Homo sapiens
gaggctttggatttgacatt

SEQ ID NO: 2463371 - DNA, 20 bp, Homo sapiens
gagggacaaaggagcctgtg

SEQ ID NO: 2463372 - DNA, 14 bp, Homo sapiens
gagggacgcctggg

SEQ ID NO: 2463373 - DNA, 15 bp, Homo sapiens
gagggacgcctgggg

SEQ ID NO: 2463374 - DNA, 18 bp, Homo sapiens
gagggactgtcgctgctt

SEQ ID NO: 2463375 - DNA, 21 bp, Homo sapiens
gagggattctggttccagggt

SEQ ID NO: 2463376 - DNA, 17 bp, Homo sapiens
gagggcagagctggtgc

SEQ ID NO: 2463377 - DNA, 20 bp, Homo sapiens
gagggcagcagccagccctg

SEQ ID NO: 2463378 - DNA, 23 bp, Homo sapiens
gagggcagcagccagccctgcct

SEQ ID NO: 2463379 - DNA, 12 bp, Homo sapiens
gagggcagcagg

SEQ ID NO: 2463380 - DNA, 15 bp, Homo sapiens
gagggcagcagggct

SEQ ID NO: 2463381 - DNA, 16 bp, Homo sapiens
gagggcagcagggcta

SEQ ID NO: 2463382 - DNA, 19 bp, Homo sapiens
gagggcagcagggctaccc

SEQ ID NO: 2463383 - DNA, 18 bp, Homo sapiens
gagggcagttcgcagcca

SEQ ID NO: 2463384 - DNA, 20 bp, Homo sapiens
gagggcagttcgcagccacc

SEQ ID NO: 2463385 - DNA, 15 bp, Homo sapiens
gagggcgcaggccgt

SEQ ID NO: 2463386 - DNA, 17 bp, Homo sapiens
gagggctcactcagcca

SEQ ID NO: 2463387 - DNA, 21 bp, Homo sapiens
gagggctcgaggggtgggctg

SEQ ID NO: 2463388 - DNA, 12 bp, Homo sapiens
gagggctctgag

SEQ ID NO: 2463389 - DNA, 16 bp, Homo sapiens
gagggctggctggcct

SEQ ID NO: 2463390 - DNA, 16 bp, Homo sapiens
gaggggaccaggagtg

SEQ ID NO: 2463391 - DNA, 19 bp, Homo sapiens
gaggggccgatgcccagag

SEQ ID NO: 2463392 - DNA, 17 bp, Homo sapiens
gaggggcctgccacctg

SEQ ID NO: 2463393 - DNA, 20 bp, Homo sapiens
gaggggcctgccacctggac

SEQ ID NO: 2463394 - DNA, 17 bp, Homo sapiens
gagggggtcgtggagag

SEQ ID NO: 2463395 - DNA, 21 bp, Homo sapiens
gagggggtcgtggagagctag

SEQ ID NO: 2463396 - DNA, 19 bp, Homo sapiens
gaggggtaggggctgggaa

SEQ ID NO: 2463397 - DNA, 23 bp, Homo sapiens
gaggggttcctcccctccagctc

SEQ ID NO: 2463398 - DNA, 13 bp, Homo sapiens
gagggtaggcagg

SEQ ID NO: 2463399 - DNA, 20 bp, Homo sapiens
gaggtccctgctgccagctt

SEQ ID NO: 2463400 - DNA, 18 bp, Homo sapiens
gaggtcctgagcactgcc

SEQ ID NO: 2463401 - DNA, 20 bp, Homo sapiens
gaggtcctgagcactgccag

SEQ ID NO: 2463402 - DNA, 13 bp, Homo sapiens
gaggtctaatcta

SEQ ID NO: 2463403 - DNA, 14 bp, Homo sapiens
gaggtctgttcctt

SEQ ID NO: 2463404 - DNA, 16 bp, Homo sapiens
gaggtgaccccagggc

SEQ ID NO: 2463405 - DNA, 19 bp, Homo sapiens
gaggtgaccccagggcaca

SEQ ID NO: 2463406 - DNA, 18 bp, Homo sapiens
gatgaaaaattgctgact

SEQ ID NO: 2463407 - DNA, 23 bp, Homo sapiens
gatgaaaagtatattgataacct

SEQ ID NO: 2463408 - DNA, 13 bp, Homo sapiens
gatgaatgagaat

SEQ ID NO: 2463409 - DNA, 15 bp, Homo sapiens
gatgacccttttcat

SEQ ID NO: 2463410 - DNA, 13 bp, Homo sapiens
gatgagctcccac

SEQ ID NO: 2463411 - DNA, 15 bp, Homo sapiens
gatgaggccctccac

SEQ ID NO: 2463412 - DNA, 21 bp, Homo sapiens
gatgagggaaaagaaaaagat

SEQ ID NO: 2463413 - DNA, 15 bp, Homo sapiens
gatgagggcagcagc

SEQ ID NO: 2463414 - DNA, 17 bp, Homo sapiens
gatgagggcagcagcca

SEQ ID NO: 2463415 - DNA, 13 bp, Homo sapiens
gatgatcaattat

SEQ ID NO: 2463416 - DNA, 22 bp, Homo sapiens
gatgatcaattatagtttctga

SEQ ID NO: 2463417 - DNA, 16 bp, Homo sapiens
gatgatttcagttcta

SEQ ID NO: 2463418 - DNA, 22 bp, Homo sapiens
gatgcagaggcctgcagggcct

SEQ ID NO: 2463419 - DNA, 14 bp, Homo sapiens
gatgcagggcagtc

SEQ ID NO: 2463420 - DNA, 20 bp, Homo sapiens
gatgcatcagaaagggaggg

SEQ ID NO: 2463421 - DNA, 15 bp, Homo sapiens
gatgcatttgggtcc

SEQ ID NO: 2463422 - DNA, 18 bp, Homo sapiens
gatgcatttgggtccagg

SEQ ID NO: 2463423 - DNA, 21 bp, Homo sapiens
gatgcatttgggtccaggagg

SEQ ID NO: 2463424 - DNA, 22 bp, Homo sapiens
gatgcatttgggtccaggagga

SEQ ID NO: 2463425 - DNA, 19 bp, Homo sapiens
gatgccaatattaaatctg

SEQ ID NO: 2463426 - DNA, 15 bp, Homo sapiens
gatgccacacaagga

SEQ ID NO: 2463427 - DNA, 12 bp, Homo sapiens
gatgccagccaa

SEQ ID NO: 2463428 - DNA, 17 bp, Homo sapiens
gatgcccaaatccttag

SEQ ID NO: 2463429 - DNA, 23 bp, Homo sapiens
gatgccccctaatccccttctcc

SEQ ID NO: 2463430 - DNA, 15 bp, Homo sapiens
gatgcctccttcctc

SEQ ID NO: 2463431 - DNA, 13 bp, Homo sapiens
gatgctccttggg

SEQ ID NO: 2463432 - DNA, 14 bp, Homo sapiens
gatgctccttgggc

SEQ ID NO: 2463433 - DNA, 21 bp, Homo sapiens
gatgctccttgggccctttga

SEQ ID NO: 2463434 - DNA, 17 bp, Homo sapiens
gatgctgaaaatgtcct

SEQ ID NO: 2463435 - DNA, 21 bp, Homo sapiens
gatgctgacattcacctgccc

SEQ ID NO: 2463436 - DNA, 12 bp, Homo sapiens
gatgctgcccct

SEQ ID NO: 2463437 - DNA, 19 bp, Homo sapiens
gatgctggcccagggccca

SEQ ID NO: 2463438 - DNA, 21 bp, Homo sapiens
gatgctggcccagggcccaga

SEQ ID NO: 2463439 - DNA, 22 bp, Homo sapiens
gatgctggcccagggcccagag

SEQ ID NO: 2463440 - DNA, 14 bp, Homo sapiens
gatgcttttaacag

SEQ ID NO: 2463441 - DNA, 15 bp, Homo sapiens
gatgcttttaacaga

SEQ ID NO: 2463442 - DNA, 13 bp, Homo sapiens
gatggagtttcta

SEQ ID NO: 2463443 - DNA, 16 bp, Homo sapiens
gatggcaacagatctg

SEQ ID NO: 2463444 - DNA, 21 bp, Homo sapiens
gatggcaacagatctggaacc

SEQ ID NO: 2463445 - DNA, 18 bp, Homo sapiens
gatggctcccaggggctc

SEQ ID NO: 2463446 - DNA, 17 bp, Homo sapiens
gatgggattctggacag

SEQ ID NO: 2463447 - DNA, 16 bp, Homo sapiens
gatggggaccagcagc

SEQ ID NO: 2463448 - DNA, 20 bp, Homo sapiens
gatgggggaactcagatcca

SEQ ID NO: 2463449 - DNA, 14 bp, Homo sapiens
gatgtaaaatcttg

SEQ ID NO: 2463450 - DNA, 14 bp, Homo sapiens
gatgtaaagatgtt

SEQ ID NO: 2463451 - DNA, 13 bp, Homo sapiens
gatgtaattttgt

SEQ ID NO: 2463452 - DNA, 16 bp, Homo sapiens
gatgtaggagggactg

SEQ ID NO: 2463453 - DNA, 18 bp, Homo sapiens
gatgtcaatttctgtgtt

SEQ ID NO: 2463454 - DNA, 17 bp, Homo sapiens
gatgtcatacagagaag

SEQ ID NO: 2463455 - DNA, 15 bp, Homo sapiens
gatgtccccagcaga

SEQ ID NO: 2463456 - DNA, 15 bp, Homo sapiens
gatgtctcctaagca

SEQ ID NO: 2463457 - DNA, 13 bp, Homo sapiens
gatgtcttggaac

SEQ ID NO: 2463458 - DNA, 21 bp, Homo sapiens
gatgtcttggaacattggaat

SEQ ID NO: 2463459 - DNA, 16 bp, Homo sapiens
gatgtctttgttaaga

SEQ ID NO: 2463460 - DNA, 14 bp, Homo sapiens
gatgtgaagccaat

SEQ ID NO: 2463461 - DNA, 23 bp, Homo sapiens
gatgtgaagccaattcagacagg

SEQ ID NO: 2463462 - DNA, 18 bp, Homo sapiens
gatgtgggttccacagac

SEQ ID NO: 2463463 - DNA, 18 bp, Homo sapiens
gatgtggtcacagctgta

SEQ ID NO: 2463464 - DNA, 18 bp, Homo sapiens
gatgtgtcctgacactgc

SEQ ID NO: 2463465 - DNA, 17 bp, Homo sapiens
gatgtgtgttgatactg

SEQ ID NO: 2463466 - DNA, 20 bp, Homo sapiens
gatgtgtgttgatactgttg

SEQ ID NO: 2463467 - DNA, 14 bp, Homo sapiens
gatgtgtttgcttt

SEQ ID NO: 2463468 - DNA, 16 bp, Homo sapiens
gatgtgtttgctttct

SEQ ID NO: 2463469 - DNA, 18 bp, Homo sapiens
gatgtgtttgctttctga

SEQ ID NO: 2463470 - DNA, 20 bp, Homo sapiens
gatgttcagcactgtccctt

SEQ ID NO: 2463471 - DNA, 12 bp, Homo sapiens
gatgttctaagg

SEQ ID NO: 2463472 - DNA, 19 bp, Homo sapiens
gatgttctaaggctctgag

SEQ ID NO: 2463473 - DNA, 13 bp, Homo sapiens
gatgttgaactgg

SEQ ID NO: 2463474 - DNA, 19 bp, Homo sapiens
gatgtttattcttctagag

SEQ ID NO: 2463475 - DNA, 21 bp, Homo sapiens
gatgtttattcttctagagtt

SEQ ID NO: 2463476 - DNA, 21 bp, Homo sapiens
gattaaatgacactcatataa

SEQ ID NO: 2463477 - DNA, 20 bp, Homo sapiens
gattacaaatcagaagtcat

SEQ ID NO: 2463478 - DNA, 20 bp, Homo sapiens
gattacaggcatgagccact

SEQ ID NO: 2463479 - DNA, 13 bp, Homo sapiens
gattacctcctga

SEQ ID NO: 2463480 - DNA, 17 bp, Homo sapiens
gattacctcctgagaaa

SEQ ID NO: 2463481 - DNA, 16 bp, Homo sapiens
gattagacagaacacc

SEQ ID NO: 2463482 - DNA, 22 bp, Homo sapiens
gattatagattctaaagattct

SEQ ID NO: 2463483 - DNA, 19 bp, Homo sapiens
gattattaacgatgtccaa

SEQ ID NO: 2463484 - DNA, 16 bp, Homo sapiens
gaagcccggctcctgg

SEQ ID NO: 2463485 - DNA, 20 bp, Homo sapiens
gaagccgtgctcgccccagc

SEQ ID NO: 2463486 - DNA, 16 bp, Homo sapiens
gaagcctcagattcct

SEQ ID NO: 2463487 - DNA, 20 bp, Homo sapiens
gaagcctcagattccttccc

SEQ ID NO: 2463488 - DNA, 22 bp, Homo sapiens
gaagcctcagattccttcccat

SEQ ID NO: 2463489 - DNA, 12 bp, Homo sapiens
gaagcctggggg

SEQ ID NO: 2463490 - DNA, 13 bp, Homo sapiens
gaagcctgggggc

SEQ ID NO: 2463491 - DNA, 18 bp, Homo sapiens
gaagcctgggggcctggc

SEQ ID NO: 2463492 - DNA, 20 bp, Homo sapiens
gaagcctgggggcctggctg

SEQ ID NO: 2463493 - DNA, 16 bp, Homo sapiens
gaagccttcaagctct

SEQ ID NO: 2463494 - DNA, 18 bp, Homo sapiens
gaagccttcaagctctga

SEQ ID NO: 2463495 - DNA, 22 bp, Homo sapiens
gaagccttcaagctctgaggga

SEQ ID NO: 2463496 - DNA, 17 bp, Homo sapiens
gaagctaatttgcatta

SEQ ID NO: 2463497 - DNA, 20 bp, Homo sapiens
gaagctactgtgtgtgtgaa

SEQ ID NO: 2463498 - DNA, 22 bp, Homo sapiens
gaagctactgtgtgtgtgaatg

SEQ ID NO: 2463499 - DNA, 21 bp, Homo sapiens
gaagctagacacatgaaggta

SEQ ID NO: 2463500 - DNA, 22 bp, Homo sapiens
gaagctagacacatgaaggtaa

SEQ ID NO: 2463501 - DNA, 23 bp, Homo sapiens
gaagctagacacatgaaggtaaa

SEQ ID NO: 2463502 - DNA, 14 bp, Homo sapiens
gaagctagtctttt

SEQ ID NO: 2463503 - DNA, 12 bp, Homo sapiens
gaagctccccca

SEQ ID NO: 2463504 - DNA, 16 bp, Homo sapiens
gaagctgttgtgtgag

SEQ ID NO: 2463505 - DNA, 18 bp, Homo sapiens
gaagcttggggaagaccc

SEQ ID NO: 2463506 - DNA, 20 bp, Homo sapiens
gaagctttggtgagaacctg

SEQ ID NO: 2463507 - DNA, 20 bp, Homo sapiens
gaaggagccccattcctggg

SEQ ID NO: 2463508 - DNA, 22 bp, Homo sapiens
gaaggagccccattcctgggaa

SEQ ID NO: 2463509 - DNA, 19 bp, Homo sapiens
gaaggagctgcctggaccc

SEQ ID NO: 2463510 - DNA, 16 bp, Homo sapiens
gaaggaggagcctgtc

SEQ ID NO: 2463511 - DNA, 21 bp, Homo sapiens
gaaggattctgctggcctctg

SEQ ID NO: 2463512 - DNA, 15 bp, Homo sapiens
gaaggcaggcagggc

SEQ ID NO: 2463513 - DNA, 19 bp, Homo sapiens
gaaggcaggcagggctctc

SEQ ID NO: 2463514 - DNA, 21 bp, Homo sapiens
gaaggcagggggaaggtgggg

SEQ ID NO: 2463515 - DNA, 22 bp, Homo sapiens
gaaggcagggggaaggtggggt

SEQ ID NO: 2463516 - DNA, 19 bp, Homo sapiens
gaaggcatttgcagggtcc

SEQ ID NO: 2463517 - DNA, 23 bp, Homo sapiens
gaaggcatttgcagggtcctctt

SEQ ID NO: 2463518 - DNA, 19 bp, Homo sapiens
gaaggctacttcggggctg

SEQ ID NO: 2463519 - DNA, 16 bp, Homo sapiens
gaaggcttctctctgt

SEQ ID NO: 2463520 - DNA, 15 bp, Homo sapiens
gaaggcttgggattt

SEQ ID NO: 2463521 - DNA, 20 bp, Homo sapiens
gaaggcttgggatttgctgt

SEQ ID NO: 2463522 - DNA, 19 bp, Homo sapiens
gaaggcttgttgtgctttt

SEQ ID NO: 2463523 - DNA, 17 bp, Homo sapiens
gaagggaataaggtaca

SEQ ID NO: 2463524 - DNA, 12 bp, Homo sapiens
gaagggagccaa

SEQ ID NO: 2463525 - DNA, 23 bp, Homo sapiens
gaagggagccaagggatggacat

SEQ ID NO: 2463526 - DNA, 15 bp, Homo sapiens
gaagggagggcagag

SEQ ID NO: 2463527 - DNA, 16 bp, Homo sapiens
gaagggagggcagagc

SEQ ID NO: 2463528 - DNA, 18 bp, Homo sapiens
gaagggccagagccaggg

SEQ ID NO: 2463529 - DNA, 15 bp, Homo sapiens
gaaggggaccctccg

SEQ ID NO: 2463530 - DNA, 16 bp, Homo sapiens
gaaggggccagaggct

SEQ ID NO: 2463531 - DNA, 17 bp, Homo sapiens
gaaggggccagaggctc

SEQ ID NO: 2463532 - DNA, 14 bp, Homo sapiens
gaagggggcggcct

SEQ ID NO: 2463533 - DNA, 17 bp, Homo sapiens
gaaggtaaataaaaaga

SEQ ID NO: 2463534 - DNA, 22 bp, Homo sapiens
gaaggtgaatagccatatttgt

SEQ ID NO: 2463535 - DNA, 20 bp, Homo sapiens
gaagtaaactttttgttctg

SEQ ID NO: 2463536 - DNA, 13 bp, Homo sapiens
gaagtaccagact

SEQ ID NO: 2463537 - DNA, 14 bp, Homo sapiens
gaagtataaagaat

SEQ ID NO: 2463538 - DNA, 18 bp, Homo sapiens
gaagtcatcttgctacca

SEQ ID NO: 2463539 - DNA, 13 bp, Homo sapiens
gacactgctggag

SEQ ID NO: 2463540 - DNA, 23 bp, Homo sapiens
gacactgttcttagctcaatgag

SEQ ID NO: 2463541 - DNA, 16 bp, Homo sapiens
gacagaaaacatgttt

SEQ ID NO: 2463542 - DNA, 17 bp, Homo sapiens
gacagaaccacagggct

SEQ ID NO: 2463543 - DNA, 14 bp, Homo sapiens
gacagacaggctct

SEQ ID NO: 2463544 - DNA, 16 bp, Homo sapiens
gacagagttgattttt

SEQ ID NO: 2463545 - DNA, 15 bp, Homo sapiens
gacagatgaggcttt

SEQ ID NO: 2463546 - DNA, 16 bp, Homo sapiens
gacagatgaggctttc

SEQ ID NO: 2463547 - DNA, 18 bp, Homo sapiens
gacagcaacctgtagagt

SEQ ID NO: 2463548 - DNA, 13 bp, Homo sapiens
gacagctgtgcct

SEQ ID NO: 2463549 - DNA, 14 bp, Homo sapiens
gacagctgtgcctc

SEQ ID NO: 2463550 - DNA, 17 bp, Homo sapiens
gacagctgtgcctcgct

SEQ ID NO: 2463551 - DNA, 14 bp, Homo sapiens
gacaggatgtgttt

SEQ ID NO: 2463552 - DNA, 16 bp, Homo sapiens
gacaggcaaataaaag

SEQ ID NO: 2463553 - DNA, 17 bp, Homo sapiens
gacaggctcttagcagc

SEQ ID NO: 2463554 - DNA, 21 bp, Homo sapiens
gacaggctggaagatagctgt

SEQ ID NO: 2463555 - DNA, 22 bp, Homo sapiens
gacaggctggaagatagctgtg

SEQ ID NO: 2463556 - DNA, 12 bp, Homo sapiens
gacaggctggct

SEQ ID NO: 2463557 - DNA, 22 bp, Homo sapiens
gacaggctggctccagatgcag

SEQ ID NO: 2463558 - DNA, 16 bp, Homo sapiens
gacagggcgggggtgg

SEQ ID NO: 2463559 - DNA, 21 bp, Homo sapiens
gacagtgttccccgataccat

SEQ ID NO: 2463560 - DNA, 23 bp, Homo sapiens
gacagtttaccagttgcctttta

SEQ ID NO: 2463561 - DNA, 17 bp, Homo sapiens
gacataaaggaaaagac

SEQ ID NO: 2463562 - DNA, 18 bp, Homo sapiens
gacatacttgaagggcca

SEQ ID NO: 2463563 - DNA, 16 bp, Homo sapiens
gacatcaggtttttcc

SEQ ID NO: 2463564 - DNA, 13 bp, Homo sapiens
gacatccaggagg

SEQ ID NO: 2463565 - DNA, 15 bp, Homo sapiens
gacatcctcctccca

SEQ ID NO: 2463566 - DNA, 15 bp, Homo sapiens
gacatcggaaaaata

SEQ ID NO: 2463567 - DNA, 17 bp, Homo sapiens
gacatgaattttagctt

SEQ ID NO: 2463568 - DNA, 17 bp, Homo sapiens
gacatgcggtagccagc

SEQ ID NO: 2463569 - DNA, 19 bp, Homo sapiens
gacatgcggtagccagcac

SEQ ID NO: 2463570 - DNA, 23 bp, Homo sapiens
gacatgcggtagccagcacacag

SEQ ID NO: 2463571 - DNA, 16 bp, Homo sapiens
gacatggaggttctaa

SEQ ID NO: 2463572 - DNA, 21 bp, Homo sapiens
gacatggaggttctaaggcct

SEQ ID NO: 2463573 - DNA, 17 bp, Homo sapiens
gacatgtggggccaggt

SEQ ID NO: 2463574 - DNA, 17 bp, Homo sapiens
gacattatgtggtttta

SEQ ID NO: 2463575 - DNA, 18 bp, Homo sapiens
gacattcacctgccccaa

SEQ ID NO: 2463576 - DNA, 21 bp, Homo sapiens
gacattcacctgccccaactc

SEQ ID NO: 2463577 - DNA, 20 bp, Homo sapiens
gacattctgaatgcttctaa

SEQ ID NO: 2463578 - DNA, 13 bp, Homo sapiens
gacatttctctaa

SEQ ID NO: 2463579 - DNA, 16 bp, Homo sapiens
gacatttctctaagag

SEQ ID NO: 2463580 - DNA, 20 bp, Homo sapiens
gaccaagcatcttggggggg

SEQ ID NO: 2463581 - DNA, 15 bp, Homo sapiens
gaccacagcacagcc

SEQ ID NO: 2463582 - DNA, 20 bp, Homo sapiens
gaccaccagggcatctctgg

SEQ ID NO: 2463583 - DNA, 22 bp, Homo sapiens
gaccaccagggcatctctgggc

SEQ ID NO: 2463584 - DNA, 23 bp, Homo sapiens
gaccaccagggcatctctgggct

SEQ ID NO: 2463585 - DNA, 18 bp, Homo sapiens
gaccaccccgcctgccct

SEQ ID NO: 2463586 - DNA, 15 bp, Homo sapiens
gaccaccctgagccg

SEQ ID NO: 2463587 - DNA, 19 bp, Homo sapiens
gaccactcagagacatgca

SEQ ID NO: 2463588 - DNA, 21 bp, Homo sapiens
gaccactcagagacatgcaga

SEQ ID NO: 2463589 - DNA, 16 bp, Homo sapiens
gaccactcctcatagc

SEQ ID NO: 2463590 - DNA, 19 bp, Homo sapiens
cttttccctttgtgagtca

SEQ ID NO: 2463591 - DNA, 15 bp, Homo sapiens
cttttccttcccaaa

SEQ ID NO: 2463592 - DNA, 20 bp, Homo sapiens
cttttccttcccttttctgt

SEQ ID NO: 2463593 - DNA, 16 bp, Homo sapiens
cttttctgaccaaaga

SEQ ID NO: 2463594 - DNA, 15 bp, Homo sapiens
cttttctgtaattca

SEQ ID NO: 2463595 - DNA, 12 bp, Homo sapiens
cttttgacactg

SEQ ID NO: 2463596 - DNA, 18 bp, Homo sapiens
cttttgacactgctctaa

SEQ ID NO: 2463597 - DNA, 15 bp, Homo sapiens
cttttgatatgcata

SEQ ID NO: 2463598 - DNA, 21 bp, Homo sapiens
cttttgcaaagaaagaaaaaa

SEQ ID NO: 2463599 - DNA, 16 bp, Homo sapiens
cttttgcaaccaggaa

SEQ ID NO: 2463600 - DNA, 17 bp, Homo sapiens
cttttgcaaccaggaac

SEQ ID NO: 2463601 - DNA, 17 bp, Homo sapiens
cttttgccattaaactt

SEQ ID NO: 2463602 - DNA, 15 bp, Homo sapiens
cttttgccctttgat

SEQ ID NO: 2463603 - DNA, 11 bp, Homo sapiens
cttttgctttt

SEQ ID NO: 2463604 - DNA, 18 bp, Homo sapiens
cttttgggggtcaacagt

SEQ ID NO: 2463605 - DNA, 13 bp, Homo sapiens
cttttgtttattt

SEQ ID NO: 2463606 - DNA, 16 bp, Homo sapiens
cttttgtttccttttt

SEQ ID NO: 2463607 - DNA, 14 bp, Homo sapiens
ctttttaatatgct

SEQ ID NO: 2463608 - DNA, 16 bp, Homo sapiens
ctttttaatatgctta

SEQ ID NO: 2463609 - DNA, 20 bp, Homo sapiens
ctttttatatatatatataa

SEQ ID NO: 2463610 - DNA, 13 bp, Homo sapiens
ctttttcatttat

SEQ ID NO: 2463611 - DNA, 23 bp, Homo sapiens
ctttttccaacttggctgcagga

SEQ ID NO: 2463612 - DNA, 15 bp, Homo sapiens
ctttttgaggcaaaa

SEQ ID NO: 2463613 - DNA, 20 bp, Homo sapiens
ctttttgaggcaaaagaagg

SEQ ID NO: 2463614 - DNA, 13 bp, Homo sapiens
ctttttgtataaa

SEQ ID NO: 2463615 - DNA, 15 bp, Homo sapiens
ctttttgtgtttttt

SEQ ID NO: 2463616 - DNA, 15 bp, Homo sapiens
cttttttccccagac

SEQ ID NO: 2463617 - DNA, 14 bp, Homo sapiens
ctttttttctgtac

SEQ ID NO: 2463618 - DNA, 20 bp, Homo sapiens
ctttttttctgtaccagtta

SEQ ID NO: 2463619 - DNA, 13 bp, Homo sapiens
ctttttttgtata

SEQ ID NO: 2463620 - DNA, 14 bp, Homo sapiens
cttttttttttctt

SEQ ID NO: 2463621 - DNA, 21 bp, Homo sapiens
gaaaaaaaacctgagatttat

SEQ ID NO: 2463622 - DNA, 15 bp, Homo sapiens
gaaaaaaatgtattt

SEQ ID NO: 2463623 - DNA, 14 bp, Homo sapiens
gaaaaaaattgaaa

SEQ ID NO: 2463624 - DNA, 11 bp, Homo sapiens
gaaaaaatata

SEQ ID NO: 2463625 - DNA, 21 bp, Homo sapiens
gaaaaaatatatgtatataca

SEQ ID NO: 2463626 - DNA, 12 bp, Homo sapiens
gaaaaagaagca

SEQ ID NO: 2463627 - DNA, 15 bp, Homo sapiens
gaaaaagacattcag

SEQ ID NO: 2463628 - DNA, 13 bp, Homo sapiens
gaaaaagcgaaaa

SEQ ID NO: 2463629 - DNA, 14 bp, Homo sapiens
gaaaaagtttgttt

SEQ ID NO: 2463630 - DNA, 13 bp, Homo sapiens
gaaaaataaagaa

SEQ ID NO: 2463631 - DNA, 17 bp, Homo sapiens
gaaaaataaagaaaaga

SEQ ID NO: 2463632 - DNA, 17 bp, Homo sapiens
gaaaaatcatgggccag

SEQ ID NO: 2463633 - DNA, 16 bp, Homo sapiens
gaaaacagaacactta

SEQ ID NO: 2463634 - DNA, 11 bp, Homo sapiens
gaaaacctttc

SEQ ID NO: 2463635 - DNA, 12 bp, Homo sapiens
gaaaactttaaa

SEQ ID NO: 2463636 - DNA, 12 bp, Homo sapiens
gaaaagaaaaag

SEQ ID NO: 2463637 - DNA, 14 bp, Homo sapiens
gaaaagaatagaag

SEQ ID NO: 2463638 - DNA, 11 bp, Homo sapiens
gaaaagatgca

SEQ ID NO: 2463639 - DNA, 16 bp, Homo sapiens
gaaaagcaacattcat

SEQ ID NO: 2463640 - DNA, 18 bp, Homo sapiens
gaaaagcatcagaaagag

SEQ ID NO: 2463641 - DNA, 22 bp, Homo sapiens
gaaaagcctgggtttggtgtat

SEQ ID NO: 2463642 - DNA, 14 bp, Homo sapiens
gaaaaggcctgggg

SEQ ID NO: 2463643 - DNA, 16 bp, Homo sapiens
gaaaaggcctggggtg

SEQ ID NO: 2463644 - DNA, 20 bp, Homo sapiens
gaaaaggttcttactgcttg

SEQ ID NO: 2463645 - DNA, 18 bp, Homo sapiens
gaaaataagaatagaaat

SEQ ID NO: 2463646 - DNA, 17 bp, Homo sapiens
gaaaataagagctcagg

SEQ ID NO: 2463647 - DNA, 16 bp, Homo sapiens
gacctccagctttcct

SEQ ID NO: 2463648 - DNA, 18 bp, Homo sapiens
gacctccagctttcctgt

SEQ ID NO: 2463649 - DNA, 19 bp, Homo sapiens
gacctccagctttcctgta

SEQ ID NO: 2463650 - DNA, 15 bp, Homo sapiens
gacctctgacagcag

SEQ ID NO: 2463651 - DNA, 24 bp, Homo sapiens
gacctgaagggttgactttaccca

SEQ ID NO: 2463652 - DNA, 14 bp, Homo sapiens
gacctgagcctgcc

SEQ ID NO: 2463653 - DNA, 15 bp, Homo sapiens
gacctgagcctgccg

SEQ ID NO: 2463654 - DNA, 17 bp, Homo sapiens
gacctgaggctgtggtc

SEQ ID NO: 2463655 - DNA, 21 bp, Homo sapiens
gacctgatcctggaggcccag

SEQ ID NO: 2463656 - DNA, 20 bp, Homo sapiens
gacctgcactggggagcccg

SEQ ID NO: 2463657 - DNA, 15 bp, Homo sapiens
gacctgctaggccag

SEQ ID NO: 2463658 - DNA, 21 bp, Homo sapiens
gacctgctaggccagagccca

SEQ ID NO: 2463659 - DNA, 10 bp, Homo sapiens
gacctgctga

SEQ ID NO: 2463660 - DNA, 18 bp, Homo sapiens
gacctgctgacctgtgca

SEQ ID NO: 2463661 - DNA, 11 bp, Homo sapiens
gacctgctgag

SEQ ID NO: 2463662 - DNA, 14 bp, Homo sapiens
gacctgctgagctc

SEQ ID NO: 2463663 - DNA, 16 bp, Homo sapiens
gacctgctgagctctg

SEQ ID NO: 2463664 - DNA, 17 bp, Homo sapiens
gacctgctgagctctga

SEQ ID NO: 2463665 - DNA, 18 bp, Homo sapiens
gacctgctgagctctgag

SEQ ID NO: 2463666 - DNA, 16 bp, Homo sapiens
gacctggcagctctgg

SEQ ID NO: 2463667 - DNA, 23 bp, Homo sapiens
gacctggtaccctcctggctctt

SEQ ID NO: 2463668 - DNA, 14 bp, Homo sapiens
gacctgtgcacacc

SEQ ID NO: 2463669 - DNA, 19 bp, Homo sapiens
gacctgttagcagacaggc

SEQ ID NO: 2463670 - DNA, 19 bp, Homo sapiens
gaccttcgggctgtgcccg

SEQ ID NO: 2463671 - DNA, 16 bp, Homo sapiens
gaccttgttacttctg

SEQ ID NO: 2463672 - DNA, 17 bp, Homo sapiens
gacctttccaccacagc

SEQ ID NO: 2463673 - DNA, 18 bp, Homo sapiens
gacctttccaccacagcc

SEQ ID NO: 2463674 - DNA, 22 bp, Homo sapiens
gacgacacggtcggggcatctg

SEQ ID NO: 2463675 - DNA, 12 bp, Homo sapiens
gacgcactgagc

SEQ ID NO: 2463676 - DNA, 15 bp, Homo sapiens
gacgcctggctgctg

SEQ ID NO: 2463677 - DNA, 16 bp, Homo sapiens
gacgcctggctgctga

SEQ ID NO: 2463678 - DNA, 21 bp, Homo sapiens
gacgcctgggggtgccaggac

SEQ ID NO: 2463679 - DNA, 17 bp, Homo sapiens
gacgtctgggtggccct

SEQ ID NO: 2463680 - DNA, 22 bp, Homo sapiens
gacgtgaccggacttttctgca

SEQ ID NO: 2463681 - DNA, 21 bp, Homo sapiens
gactaacactcagaagcctgg

SEQ ID NO: 2463682 - DNA, 23 bp, Homo sapiens
gactaacactcagaagcctgggg

SEQ ID NO: 2463683 - DNA, 23 bp, Homo sapiens
gactaaccatgtgttatgttttc

SEQ ID NO: 2463684 - DNA, 22 bp, Homo sapiens
gactaatagaaaagtatgttct

SEQ ID NO: 2463685 - DNA, 13 bp, Homo sapiens
gactaatttcaaa

SEQ ID NO: 2463686 - DNA, 19 bp, Homo sapiens
gactacagctggggtgcag

SEQ ID NO: 2463687 - DNA, 18 bp, Homo sapiens
gactacagtcaggaaagg

SEQ ID NO: 2463688 - DNA, 14 bp, Homo sapiens
gactagatgatgga

SEQ ID NO: 2463689 - DNA, 17 bp, Homo sapiens
gactagatggacctgcc

SEQ ID NO: 2463690 - DNA, 17 bp, Homo sapiens
gactagatgtagtattt

SEQ ID NO: 2463691 - DNA, 23 bp, Homo sapiens
gactaggccttgcggctcctcag

SEQ ID NO: 2463692 - DNA, 19 bp, Homo sapiens
gactatatttgggcctgct

SEQ ID NO: 2463693 - DNA, 18 bp, Homo sapiens
gactatctgtctggtggc

SEQ ID NO: 2463694 - DNA, 17 bp, Homo sapiens
gactatcttactatttc

SEQ ID NO: 2463695 - DNA, 15 bp, Homo sapiens
gactcaaatgttcta

SEQ ID NO: 2463696 - DNA, 23 bp, Homo sapiens
gactcaaatgttctaagtttcta

SEQ ID NO: 2463697 - DNA, 23 bp, Homo sapiens
gactcacacctgaactgaacacc

SEQ ID NO: 2463698 - DNA, 14 bp, Homo sapiens
gactcagccttcag

SEQ ID NO: 2463699 - DNA, 15 bp, Homo sapiens
gactcagccttcaga

SEQ ID NO: 2463700 - DNA, 15 bp, Homo sapiens
gacttggttggtagg

SEQ ID NO: 2463701 - DNA, 20 bp, Homo sapiens
gacttggttggtagggtggg

SEQ ID NO: 2463702 - DNA, 19 bp, Homo sapiens
gactttaacataagctatt

SEQ ID NO: 2463703 - DNA, 14 bp, Homo sapiens
gactttccattaca

SEQ ID NO: 2463704 - DNA, 18 bp, Homo sapiens
gactttccccaccagatg

SEQ ID NO: 2463705 - DNA, 15 bp, Homo sapiens
gactttctgcctgga

SEQ ID NO: 2463706 - DNA, 16 bp, Homo sapiens
gactttctgcctggag

SEQ ID NO: 2463707 - DNA, 18 bp, Homo sapiens
gactttctgcctggagtg

SEQ ID NO: 2463708 - DNA, 23 bp, Homo sapiens
gactttctttttgtagctggggc

SEQ ID NO: 2463709 - DNA, 23 bp, Homo sapiens
gactttcttttttgatatagaag

SEQ ID NO: 2463710 - DNA, 17 bp, Homo sapiens
gactttgcttgctttga

SEQ ID NO: 2463711 - DNA, 13 bp, Homo sapiens
gacttttctgcaa

SEQ ID NO: 2463712 - DNA, 17 bp, Homo sapiens
gagaaaaaggaaaaaaa

SEQ ID NO: 2463713 - DNA, 17 bp, Homo sapiens
gagaaacagttggtaac

SEQ ID NO: 2463714 - DNA, 13 bp, Homo sapiens
gagaaaccagctt

SEQ ID NO: 2463715 - DNA, 21 bp, Homo sapiens
gagaaagggccctgggcctgc

SEQ ID NO: 2463716 - DNA, 19 bp, Homo sapiens
gagaaattcgtgtgttttt

SEQ ID NO: 2463717 - DNA, 13 bp, Homo sapiens
gagaaccaaatct

SEQ ID NO: 2463718 - DNA, 17 bp, Homo sapiens
gagaaccaaatctggaa

SEQ ID NO: 2463719 - DNA, 18 bp, Homo sapiens
gagaaccaaatctggaag

SEQ ID NO: 2463720 - DNA, 15 bp, Homo sapiens
gagaacctggccttc

SEQ ID NO: 2463721 - DNA, 23 bp, Homo sapiens
gagaacctgggttgcagacagga

SEQ ID NO: 2463722 - DNA, 12 bp, Homo sapiens
gagaagccagga

SEQ ID NO: 2463723 - DNA, 15 bp, Homo sapiens
gagaagcccgtgtga

SEQ ID NO: 2463724 - DNA, 18 bp, Homo sapiens
gagaagccttcaagctct

SEQ ID NO: 2463725 - DNA, 19 bp, Homo sapiens
gagaagctcctctccccag

SEQ ID NO: 2463726 - DNA, 22 bp, Homo sapiens
gagaagtcacagggcagtacct

SEQ ID NO: 2463727 - DNA, 13 bp, Homo sapiens
gagaagtctcagc

SEQ ID NO: 2463728 - DNA, 21 bp, Homo sapiens
gagaagtctcagctaagctca

SEQ ID NO: 2463729 - DNA, 17 bp, Homo sapiens
gagaagtgtgccttctc

SEQ ID NO: 2463730 - DNA, 20 bp, Homo sapiens
gagaataaattgatttttat

SEQ ID NO: 2463731 - DNA, 21 bp, Homo sapiens
gagaatctacccccagatcca

SEQ ID NO: 2463732 - DNA, 19 bp, Homo sapiens
gagaatggctttggtctct

SEQ ID NO: 2463733 - DNA, 17 bp, Homo sapiens
gagacactggcccctca

SEQ ID NO: 2463734 - DNA, 15 bp, Homo sapiens
gagacagactagaag

SEQ ID NO: 2463735 - DNA, 17 bp, Homo sapiens
gagacagactagaagtt

SEQ ID NO: 2463736 - DNA, 19 bp, Homo sapiens
gagacagggtttcaccatg

SEQ ID NO: 2463737 - DNA, 13 bp, Homo sapiens
gagacatgtgaca

SEQ ID NO: 2463738 - DNA, 14 bp, Homo sapiens
gagacatgtgacat

SEQ ID NO: 2463739 - DNA, 18 bp, Homo sapiens
gagacccagcggacacac

SEQ ID NO: 2463740 - DNA, 17 bp, Homo sapiens
gagaccggcctgccagg

SEQ ID NO: 2463741 - DNA, 15 bp, Homo sapiens
gagactgcccagcta

SEQ ID NO: 2463742 - DNA, 21 bp, Homo sapiens
gagactgtctggcccccctgg

SEQ ID NO: 2463743 - DNA, 19 bp, Homo sapiens
gagactgtgtgtgccctct

SEQ ID NO: 2463744 - DNA, 21 bp, Homo sapiens
gagactgtgtgtgccctctgg

SEQ ID NO: 2463745 - DNA, 23 bp, Homo sapiens
gagactgtgtgtgccctctgggc

SEQ ID NO: 2463746 - DNA, 18 bp, Homo sapiens
gagacttagggcaccagg

SEQ ID NO: 2463747 - DNA, 16 bp, Homo sapiens
gagagacactggtggg

SEQ ID NO: 2463748 - DNA, 18 bp, Homo sapiens
gagagacactggtgggga

SEQ ID NO: 2463749 - DNA, 12 bp, Homo sapiens
gagagacttgtt

SEQ ID NO: 2463750 - DNA, 14 bp, Homo sapiens
gagagatgtgtgtt

SEQ ID NO: 2463751 - DNA, 22 bp, Homo sapiens
gagagcaagggaagtggttctt

SEQ ID NO: 2463752 - DNA, 15 bp, Homo sapiens
gagagcccaggagct

SEQ ID NO: 2463753 - DNA, 13 bp, Homo sapiens
gagaggccctgga

SEQ ID NO: 2463754 - DNA, 15 bp, Homo sapiens
gagagggaatgtgaa

SEQ ID NO: 2463755 - DNA, 18 bp, Homo sapiens
gagagggcgcaggccgtg

SEQ ID NO: 2463756 - DNA, 20 bp, Homo sapiens
gagaggggccgatgcccaga

SEQ ID NO: 2463757 - DNA, 21 bp, Homo sapiens
gagaggggccgatgcccagag

SEQ ID NO: 2463758 - DNA, 13 bp, Homo sapiens
gagagggggctgg

SEQ ID NO: 2463759 - DNA, 14 bp, Homo sapiens
gagaggtgggccag

SEQ ID NO: 2463760 - DNA, 20 bp, Homo sapiens
gagaggtttgcagtcccaag

SEQ ID NO: 2463761 - DNA, 15 bp, Homo sapiens
gagataccagcgagg

SEQ ID NO: 2463762 - DNA, 17 bp, Homo sapiens
gagatagttttcatcca

SEQ ID NO: 2463763 - DNA, 11 bp, Homo sapiens
gagatattaat

SEQ ID NO: 2463764 - DNA, 18 bp, Homo sapiens
gagatattaatgcccaga

SEQ ID NO: 2463765 - DNA, 21 bp, Homo sapiens
gagatccaaaagaagccccca

SEQ ID NO: 2463766 - DNA, 12 bp, Homo sapiens
gagatgctggct

SEQ ID NO: 2463767 - DNA, 18 bp, Homo sapiens
gagatggagtcttgctct

SEQ ID NO: 2463768 - DNA, 16 bp, Homo sapiens
gagatgggcttcccaa

SEQ ID NO: 2463769 - DNA, 17 bp, Homo sapiens
gagatgggcttcccaag

SEQ ID NO: 2463770 - DNA, 15 bp, Homo sapiens
gagatggtgaggctg

SEQ ID NO: 2463771 - DNA, 15 bp, Homo sapiens
gagatgtcttggaac

SEQ ID NO: 2463772 - DNA, 22 bp, Homo sapiens
gagatgtgtgttgatactgttg

SEQ ID NO: 2463773 - DNA, 15 bp, Homo sapiens
gagattctgcctttg

SEQ ID NO: 2463774 - DNA, 16 bp, Homo sapiens
gagatttattaaagaa

SEQ ID NO: 2463775 - DNA, 12 bp, Homo sapiens
gagcaaagcctg

SEQ ID NO: 2463776 - DNA, 16 bp, Homo sapiens
gagcaaccgtggccct

SEQ ID NO: 2463777 - DNA, 23 bp, Homo sapiens
gagcaaccgtggcccttcctgga

SEQ ID NO: 2463778 - DNA, 20 bp, Homo sapiens
gagcacaataaatggctgta

SEQ ID NO: 2463779 - DNA, 19 bp, Homo sapiens
gagcacctccacatcctcc

SEQ ID NO: 2463780 - DNA, 17 bp, Homo sapiens
gagcacctgctgtctgg

SEQ ID NO: 2463781 - DNA, 23 bp, Homo sapiens
gagcacggctctgtccccagcct

SEQ ID NO: 2463782 - DNA, 22 bp, Homo sapiens
gagcagaaaacccttgggccag

SEQ ID NO: 2463783 - DNA, 14 bp, Homo sapiens
gagcagaagcagca

SEQ ID NO: 2463784 - DNA, 22 bp, Homo sapiens
gagcagaccaccccgcctgccc

SEQ ID NO: 2463785 - DNA, 14 bp, Homo sapiens
gagcagactacagc

SEQ ID NO: 2463786 - DNA, 14 bp, Homo sapiens
gagcagaggtctcc

SEQ ID NO: 2463787 - DNA, 19 bp, Homo sapiens
gagcagcacctcctcagcc

SEQ ID NO: 2463788 - DNA, 20 bp, Homo sapiens
gagcagcacctcctcagcct

SEQ ID NO: 2463789 - DNA, 22 bp, Homo sapiens
gagcagcacctcctcagcctga

SEQ ID NO: 2463790 - DNA, 15 bp, Homo sapiens
gagcagcgagcctgc

SEQ ID NO: 2463791 - DNA, 13 bp, Homo sapiens
gagcagctgagca

SEQ ID NO: 2463792 - DNA, 20 bp, Homo sapiens
gagcagctgagcagggccgg

SEQ ID NO: 2463793 - DNA, 14 bp, Homo sapiens
gagcaggaatggga

SEQ ID NO: 2463794 - DNA, 22 bp, Homo sapiens
gagcagggattaacctctgcac

SEQ ID NO: 2463795 - DNA, 15 bp, Homo sapiens
gagcagggccgggga

SEQ ID NO: 2463796 - DNA, 22 bp, Homo sapiens
gagcagggccggggaactggcc

SEQ ID NO: 2463797 - DNA, 20 bp, Homo sapiens
gagcagtcctgcctcagcct

SEQ ID NO: 2463798 - DNA, 22 bp, Homo sapiens
gagcagtccttggcctgctaag

SEQ ID NO: 2463799 - DNA, 23 bp, Homo sapiens
gagcagtggctggtccagggcta

SEQ ID NO: 2463800 - DNA, 13 bp, Homo sapiens
gagcatcacagaa

SEQ ID NO: 2463801 - DNA, 13 bp, Homo sapiens
gagcatcatgcct

SEQ ID NO: 2463802 - DNA, 23 bp, Homo sapiens
gagcatcatgcctctgaggccag

SEQ ID NO: 2463803 - DNA, 22 bp, Homo sapiens
gagcatgtactgagccttgtaa

SEQ ID NO: 2463804 - DNA, 15 bp, Homo sapiens
gagcatttctcatca

SEQ ID NO: 2463805 - DNA, 19 bp, Homo sapiens
gagcatttctcatcagtag

SEQ ID NO: 2463806 - DNA, 14 bp, Homo sapiens
gagccaagggatgg

SEQ ID NO: 2463807 - DNA, 17 bp, Homo sapiens
gagccaagggatggaca

SEQ ID NO: 2463808 - DNA, 14 bp, Homo sapiens
gagccactcctctg

SEQ ID NO: 2463809 - DNA, 12 bp, Homo sapiens
gagccaggagaa

SEQ ID NO: 2463810 - DNA, 14 bp, Homo sapiens
gagccaggagaagc

SEQ ID NO: 2463811 - DNA, 17 bp, Homo sapiens
gagccaggagaagctca

SEQ ID NO: 2463812 - DNA, 21 bp, Homo sapiens
gagccaggagaagctcagctg

SEQ ID NO: 2463813 - DNA, 13 bp, Homo sapiens
gagccatttgaga

SEQ ID NO: 2463814 - DNA, 20 bp, Homo sapiens
gagcccacgacactgcagcc

SEQ ID NO: 2463815 - DNA, 14 bp, Homo sapiens
gagcccagctctga

SEQ ID NO: 2463816 - DNA, 13 bp, Homo sapiens
gagcccagctggg

SEQ ID NO: 2463817 - DNA, 12 bp, Homo sapiens
gagcccaggagc

SEQ ID NO: 2463818 - DNA, 13 bp, Homo sapiens
gagcccaggccag

SEQ ID NO: 2463819 - DNA, 18 bp, Homo sapiens
gagcccaggccaggactc

SEQ ID NO: 2463820 - DNA, 22 bp, Homo sapiens
gagcccaggctcggcctgcccc

SEQ ID NO: 2463821 - DNA, 22 bp, Homo sapiens
gagcccccaccctgttcctgct

SEQ ID NO: 2463822 - DNA, 13 bp, Homo sapiens
gagcccccagcct

SEQ ID NO: 2463823 - DNA, 15 bp, Homo sapiens
gagcccccagcctgt

SEQ ID NO: 2463824 - DNA, 18 bp, Homo sapiens
gagcccccagcctgtcag

SEQ ID NO: 2463825 - DNA, 20 bp, Homo sapiens
gagccccttctgctcagctc

SEQ ID NO: 2463826 - DNA, 20 bp, Homo sapiens
gagcccgaggaggtgtctca

SEQ ID NO: 2463827 - DNA, 24 bp, Homo sapiens
gagcccgaggaggtgtctcaggct

SEQ ID NO: 2463828 - DNA, 12 bp, Homo sapiens
gagccctgggac

SEQ ID NO: 2463829 - DNA, 20 bp, Homo sapiens
gagccgggtctgcctcttct

SEQ ID NO: 2463830 - DNA, 14 bp, Homo sapiens
gagcctgccgagca

SEQ ID NO: 2463831 - DNA, 16 bp, Homo sapiens
gagcctgccgagcaac

SEQ ID NO: 2463832 - DNA, 23 bp, Homo sapiens
gagcctgccgagcaaccgtggcc

SEQ ID NO: 2463833 - DNA, 17 bp, Homo sapiens
gagcctgtcctgcctgt

SEQ ID NO: 2463834 - DNA, 18 bp, Homo sapiens
gagcctgtcctgcctgtg

SEQ ID NO: 2463835 - DNA, 19 bp, Homo sapiens
gagcctgtcctgcctgtgg

SEQ ID NO: 2463836 - DNA, 20 bp, Homo sapiens
gagcctgtgaacccaggaca

SEQ ID NO: 2463837 - DNA, 17 bp, Homo sapiens
gagcgagagatcaaaga

SEQ ID NO: 2463838 - DNA, 20 bp, Homo sapiens
gagcgagtggagtctgccac

SEQ ID NO: 2463839 - DNA, 23 bp, Homo sapiens
gagcgcccagctcctgacactgc

SEQ ID NO: 2463840 - DNA, 14 bp, Homo sapiens
gagcgccctgcaga

SEQ ID NO: 2463841 - DNA, 20 bp, Homo sapiens
gagcgccctgcagaccctgc

SEQ ID NO: 2463842 - DNA, 21 bp, Homo sapiens
gagcgccctgcagaccctgcc

SEQ ID NO: 2463843 - DNA, 22 bp, Homo sapiens
gagcgccctgcagaccctgccc

SEQ ID NO: 2463844 - DNA, 17 bp, Homo sapiens
gagcgtgagctgagcag

SEQ ID NO: 2463845 - DNA, 19 bp, Homo sapiens
gagcgtgagctgagcaggc

SEQ ID NO: 2463846 - DNA, 20 bp, Homo sapiens
gagctacgtatttaatagca

SEQ ID NO: 2463847 - DNA, 20 bp, Homo sapiens
gagctaggagcaaagcctgt

SEQ ID NO: 2463848 - DNA, 14 bp, Homo sapiens
gagctcacaaggca

SEQ ID NO: 2463849 - DNA, 16 bp, Homo sapiens
gagctcacaaggcagc

SEQ ID NO: 2463850 - DNA, 11 bp, Homo sapiens
gagctcaggat

SEQ ID NO: 2463851 - DNA, 13 bp, Homo sapiens
gagctcaggatga

SEQ ID NO: 2463852 - DNA, 13 bp, Homo sapiens
gagctccactctg

SEQ ID NO: 2463853 - DNA, 21 bp, Homo sapiens
gagctccactctgcttctctg

SEQ ID NO: 2463854 - DNA, 22 bp, Homo sapiens
gagctccactctgcttctctga

SEQ ID NO: 2463855 - DNA, 19 bp, Homo sapiens
gagctccagctcctttggg

SEQ ID NO: 2463856 - DNA, 14 bp, Homo sapiens
gagctccagtgtcc

SEQ ID NO: 2463857 - DNA, 17 bp, Homo sapiens
gagctcccacaagcctg

SEQ ID NO: 2463858 - DNA, 19 bp, Homo sapiens
gagctcctcttccatgctg

SEQ ID NO: 2463859 - DNA, 12 bp, Homo sapiens
gagctctgagag

SEQ ID NO: 2463860 - DNA, 14 bp, Homo sapiens
gagctctgagaggc

SEQ ID NO: 2463861 - DNA, 15 bp, Homo sapiens
gaaataattgttgtt

SEQ ID NO: 2463862 - DNA, 19 bp, Homo sapiens
gaaataattgttgttctgt

SEQ ID NO: 2463863 - DNA, 17 bp, Homo sapiens
gaaatacagactggatg

SEQ ID NO: 2463864 - DNA, 15 bp, Homo sapiens
gaaatactatttaaa

SEQ ID NO: 2463865 - DNA, 18 bp, Homo sapiens
gaaatagacagcatgaga

SEQ ID NO: 2463866 - DNA, 21 bp, Homo sapiens
gaaatagcttatgaaaagaat

SEQ ID NO: 2463867 - DNA, 13 bp, Homo sapiens
gaaatattttaaa

SEQ ID NO: 2463868 - DNA, 15 bp, Homo sapiens
gaaatcaacttgctt

SEQ ID NO: 2463869 - DNA, 14 bp, Homo sapiens
gaaatccattcaca

SEQ ID NO: 2463870 - DNA, 22 bp, Homo sapiens
gaaatctggcttctggccagga

SEQ ID NO: 2463871 - DNA, 14 bp, Homo sapiens
gaaatgtaaggctg

SEQ ID NO: 2463872 - DNA, 21 bp, Homo sapiens
gaaatgtaaggctgtgtaaga

SEQ ID NO: 2463873 - DNA, 22 bp, Homo sapiens
gaaatgttattttttaattatt

SEQ ID NO: 2463874 - DNA, 19 bp, Homo sapiens
gaaatgtttttaataaaag

SEQ ID NO: 2463875 - DNA, 17 bp, Homo sapiens
gaaattaagaaggcaaa

SEQ ID NO: 2463876 - DNA, 16 bp, Homo sapiens
gaaattacctgtggat

SEQ ID NO: 2463877 - DNA, 17 bp, Homo sapiens
gaaattcgtgtgttttt

SEQ ID NO: 2463878 - DNA, 16 bp, Homo sapiens
gaaattctcctggagg

SEQ ID NO: 2463879 - DNA, 13 bp, Homo sapiens
gaaattgaatact

SEQ ID NO: 2463880 - DNA, 19 bp, Homo sapiens
gaaattgaatactttgaat

SEQ ID NO: 2463881 - DNA, 20 bp, Homo sapiens
gaaattgaatactttgaatg

SEQ ID NO: 2463882 - DNA, 19 bp, Homo sapiens
gaaattgtatattgtaatt

SEQ ID NO: 2463883 - DNA, 13 bp, Homo sapiens
gaaatttaaagca

SEQ ID NO: 2463884 - DNA, 23 bp, Homo sapiens
gaaatttaaagcaggttcttgtt

SEQ ID NO: 2463885 - DNA, 14 bp, Homo sapiens
gaaatttagcattg

SEQ ID NO: 2463886 - DNA, 18 bp, Homo sapiens
gaaatttcacatagccca

SEQ ID NO: 2463887 - DNA, 15 bp, Homo sapiens
gaaatttttcttctt

SEQ ID NO: 2463888 - DNA, 17 bp, Homo sapiens
gaaatttttcttcttga

SEQ ID NO: 2463889 - DNA, 17 bp, Homo sapiens
gaacaagagaagcattc

SEQ ID NO: 2463890 - DNA, 19 bp, Homo sapiens
gaacacaaactgtaaataa

SEQ ID NO: 2463891 - DNA, 18 bp, Homo sapiens
gaacactagacaagccag

SEQ ID NO: 2463892 - DNA, 12 bp, Homo sapiens
gaacagctggtg

SEQ ID NO: 2463893 - DNA, 13 bp, Homo sapiens
gaacagctggtgt

SEQ ID NO: 2463894 - DNA, 14 bp, Homo sapiens
gaacagctggtgta

SEQ ID NO: 2463895 - DNA, 20 bp, Homo sapiens
gaacagctggtgtagctaca

SEQ ID NO: 2463896 - DNA, 23 bp, Homo sapiens
gaacagctggtgtagctacagag

SEQ ID NO: 2463897 - DNA, 24 bp, Homo sapiens
gaacagtgtgcaaggcagccgtgg

SEQ ID NO: 2463898 - DNA, 17 bp, Homo sapiens
gaacatctgagtcctgg

SEQ ID NO: 2463899 - DNA, 15 bp, Homo sapiens
gaacatggggaggag

SEQ ID NO: 2463900 - DNA, 22 bp, Homo sapiens
gaacattggaatgttctcagat

SEQ ID NO: 2463901 - DNA, 15 bp, Homo sapiens
gaacattggttcttt

SEQ ID NO: 2463902 - DNA, 16 bp, Homo sapiens
gaaccaaatctggaag

SEQ ID NO: 2463903 - DNA, 15 bp, Homo sapiens
gaaccaacactaaca

SEQ ID NO: 2463904 - DNA, 13 bp, Homo sapiens
gaaccactttctt

SEQ ID NO: 2463905 - DNA, 17 bp, Homo sapiens
gaaccagactcttgcct

SEQ ID NO: 2463906 - DNA, 19 bp, Homo sapiens
gaaccagtccccccaccct

SEQ ID NO: 2463907 - DNA, 13 bp, Homo sapiens
gaacccagactca

SEQ ID NO: 2463908 - DNA, 17 bp, Homo sapiens
gaacccagactcagaca

SEQ ID NO: 2463909 - DNA, 13 bp, Homo sapiens
gaacccaggacaa

SEQ ID NO: 2463910 - DNA, 17 bp, Homo sapiens
gaaccgttttgaagcta

SEQ ID NO: 2463911 - DNA, 19 bp, Homo sapiens
gaaccgttttgaagctact

SEQ ID NO: 2463912 - DNA, 12 bp, Homo sapiens
gaacctcagcct

SEQ ID NO: 2463913 - DNA, 16 bp, Homo sapiens
gaacctggccttcagt

SEQ ID NO: 2463914 - DNA, 12 bp, Homo sapiens
gaacctgtgtcc

SEQ ID NO: 2463915 - DNA, 17 bp, Homo sapiens
gaacctttgtgccctat

SEQ ID NO: 2463916 - DNA, 20 bp, Homo sapiens
gaacctttgtgccctatcac

SEQ ID NO: 2463917 - DNA, 16 bp, Homo sapiens
gaacgaaaatgaaagc

SEQ ID NO: 2463918 - DNA, 19 bp, Homo sapiens
gaactagaatttgattatt

SEQ ID NO: 2463919 - DNA, 16 bp, Homo sapiens
gaactcaaatggggcc

SEQ ID NO: 2463920 - DNA, 20 bp, Homo sapiens
gaactcaaatggggccagat

SEQ ID NO: 2463921 - DNA, 16 bp, Homo sapiens
gaactcaactttgaca

SEQ ID NO: 2463922 - DNA, 18 bp, Homo sapiens
gaactctggtggcacagg

SEQ ID NO: 2463923 - DNA, 12 bp, Homo sapiens
gaactgaactca

SEQ ID NO: 2463924 - DNA, 23 bp, Homo sapiens
gaactgcaggccctggcctcccc

SEQ ID NO: 2463925 - DNA, 22 bp, Homo sapiens
gaactgctagtcaagtgcgtcc

SEQ ID NO: 2463926 - DNA, 14 bp, Homo sapiens
gaactggccaagct

SEQ ID NO: 2463927 - DNA, 15 bp, Homo sapiens
gaactggccaagctg

SEQ ID NO: 2463928 - DNA, 16 bp, Homo sapiens
gaacttagattttaca

SEQ ID NO: 2463929 - DNA, 19 bp, Homo sapiens
gaacttagattttacatga

SEQ ID NO: 2463930 - DNA, 14 bp, Homo sapiens
gaacttcagaaaga

SEQ ID NO: 2463931 - DNA, 18 bp, Homo sapiens
gaacttcagaaagacttg

SEQ ID NO: 2463932 - DNA, 15 bp, Homo sapiens
gaacttgcattgtga

SEQ ID NO: 2463933 - DNA, 11 bp, Homo sapiens
gaacttgcctg

SEQ ID NO: 2463934 - DNA, 14 bp, Homo sapiens
gaagaaaaagaagc

SEQ ID NO: 2463935 - DNA, 19 bp, Homo sapiens
gaagaaccagtccccccac

SEQ ID NO: 2463936 - DNA, 22 bp, Homo sapiens
gaagaaccagtccccccaccct

SEQ ID NO: 2463937 - DNA, 21 bp, Homo sapiens
gaagaatctcatctcagtgaa

SEQ ID NO: 2463938 - DNA, 23 bp, Homo sapiens
gaagaatgcacaagaatggatca

SEQ ID NO: 2463939 - DNA, 24 bp, Homo sapiens
gaagaatgcttaatcagatagata

SEQ ID NO: 2463940 - DNA, 13 bp, Homo sapiens
gaagaattatttt

SEQ ID NO: 2463941 - DNA, 17 bp, Homo sapiens
gaagacagaagtttgca

SEQ ID NO: 2463942 - DNA, 10 bp, Homo sapiens
gaagacagtg

SEQ ID NO: 2463943 - DNA, 12 bp, Homo sapiens
gaagacagtggc

SEQ ID NO: 2463944 - DNA, 15 bp, Homo sapiens
gaagactggaagcta

SEQ ID NO: 2463945 - DNA, 20 bp, Homo sapiens
gaagagagcctgcaggatct

SEQ ID NO: 2463946 - DNA, 23 bp, Homo sapiens
gaagagcagcacctcctcagcct

SEQ ID NO: 2463947 - DNA, 18 bp, Homo sapiens
gaagagcaggactccagg

SEQ ID NO: 2463948 - DNA, 22 bp, Homo sapiens
gaagagcaggactccaggccca

SEQ ID NO: 2463949 - DNA, 17 bp, Homo sapiens
gaagagccttccaccca

SEQ ID NO: 2463950 - DNA, 20 bp, Homo sapiens
gaagaggcctgtttggcctc

SEQ ID NO: 2463951 - DNA, 16 bp, Homo sapiens
gaagatagctgtgact

SEQ ID NO: 2463952 - DNA, 21 bp, Homo sapiens
gaagatctaaataaaatgcta

SEQ ID NO: 2463953 - DNA, 13 bp, Homo sapiens
gaagcagcagcct

SEQ ID NO: 2463954 - DNA, 12 bp, Homo sapiens
gaagcagcctct

SEQ ID NO: 2463955 - DNA, 19 bp, Homo sapiens
gaagcaggttcccaagctc

SEQ ID NO: 2463956 - DNA, 14 bp, Homo sapiens
gaagcagtggcctt

SEQ ID NO: 2463957 - DNA, 13 bp, Homo sapiens
gaagcattgtaaa

SEQ ID NO: 2463958 - DNA, 17 bp, Homo sapiens
gaagcattgtaaaataa

SEQ ID NO: 2463959 - DNA, 22 bp, Homo sapiens
gaagccagcttgtttacatgct

SEQ ID NO: 2463960 - DNA, 24 bp, Homo sapiens
gaagccaggaatttcccaggaccc

SEQ ID NO: 2463961 - DNA, 18 bp, Homo sapiens
gaagcccaattgctggag

SEQ ID NO: 2463962 - DNA, 16 bp, Homo sapiens
gaagcccatcctgacc

SEQ ID NO: 2463963 - DNA, 19 bp, Homo sapiens
gaagcccatcctgaccagc

SEQ ID NO: 2463964 - DNA, 22 bp, Homo sapiens
gaagcccccagctaagaacctg

SEQ ID NO: 2463965 - DNA, 15 bp, Homo sapiens
gaagcccggctcctg

SEQ ID NO: 2463966 - DNA, 20 bp, Homo sapiens
cttcatctcccacctagcag

SEQ ID NO: 2463967 - DNA, 15 bp, Homo sapiens
cttcatggcagaagg

SEQ ID NO: 2463968 - DNA, 21 bp, Homo sapiens
cttcatggcagaaggcaaacc

SEQ ID NO: 2463969 - DNA, 16 bp, Homo sapiens
cttccaaatcccctaa

SEQ ID NO: 2463970 - DNA, 16 bp, Homo sapiens
cttccaatgtctggag

SEQ ID NO: 2463971 - DNA, 18 bp, Homo sapiens
cttccaatgtctggagac

SEQ ID NO: 2463972 - DNA, 19 bp, Homo sapiens
cttccaatgtctggagacc

SEQ ID NO: 2463973 - DNA, 22 bp, Homo sapiens
cttccacagggtcccacagcca

SEQ ID NO: 2463974 - DNA, 18 bp, Homo sapiens
cttccagctagtgaccca

SEQ ID NO: 2463975 - DNA, 20 bp, Homo sapiens
cttccaggtgttactgtaat

SEQ ID NO: 2463976 - DNA, 22 bp, Homo sapiens
cttccaggtgttactgtaattc

SEQ ID NO: 2463977 - DNA, 17 bp, Homo sapiens
cttccagtgtcatttct

SEQ ID NO: 2463978 - DNA, 14 bp, Homo sapiens
cttccagtttgctt

SEQ ID NO: 2463979 - DNA, 21 bp, Homo sapiens
cttccagtttgctttgccctt

SEQ ID NO: 2463980 - DNA, 14 bp, Homo sapiens
cttccatgattcta

SEQ ID NO: 2463981 - DNA, 16 bp, Homo sapiens
cttcccaaagcaagca

SEQ ID NO: 2463982 - DNA, 22 bp, Homo sapiens
cttcccagaggggcctgccacc

SEQ ID NO: 2463983 - DNA, 17 bp, Homo sapiens
cttcccatccccagcga

SEQ ID NO: 2463984 - DNA, 15 bp, Homo sapiens
cttcccatcgctgtc

SEQ ID NO: 2463985 - DNA, 20 bp, Homo sapiens
cttccccacccaccaaccct

SEQ ID NO: 2463986 - DNA, 18 bp, Homo sapiens
cttccccagacgcctggc

SEQ ID NO: 2463987 - DNA, 19 bp, Homo sapiens
cttccccatggccctgagc

SEQ ID NO: 2463988 - DNA, 21 bp, Homo sapiens
cttccccatggccctgagcga

SEQ ID NO: 2463989 - DNA, 18 bp, Homo sapiens
cttccccctctcccagtt

SEQ ID NO: 2463990 - DNA, 21 bp, Homo sapiens
cttccccttatcctccctgta

SEQ ID NO: 2463991 - DNA, 12 bp, Homo sapiens
cttccctaatct

SEQ ID NO: 2463992 - DNA, 14 bp, Homo sapiens
cttccctgactcat

SEQ ID NO: 2463993 - DNA, 15 bp, Homo sapiens
cttccctgtgcctcc

SEQ ID NO: 2463994 - DNA, 21 bp, Homo sapiens
cttccctgtgcctcctccctc

SEQ ID NO: 2463995 - DNA, 14 bp, Homo sapiens
cttcccttttctgt

SEQ ID NO: 2463996 - DNA, 15 bp, Homo sapiens
cttccgccactgggg

SEQ ID NO: 2463997 - DNA, 16 bp, Homo sapiens
cttccgccactggggc

SEQ ID NO: 2463998 - DNA, 17 bp, Homo sapiens
cttccgccactggggct

SEQ ID NO: 2463999 - DNA, 22 bp, Homo sapiens
cttccgcttggagctattttcc

SEQ ID NO: 2464000 - DNA, 17 bp, Homo sapiens
cttccggcccctcccct

SEQ ID NO: 2464001 - DNA, 19 bp, Homo sapiens
cttcctaccaagtcaaact

SEQ ID NO: 2464002 - DNA, 15 bp, Homo sapiens
cttcctacctatccc

SEQ ID NO: 2464003 - DNA, 14 bp, Homo sapiens
cttcctcagccagc

SEQ ID NO: 2464004 - DNA, 23 bp, Homo sapiens
cttcctcatccaccccatccctc

SEQ ID NO: 2464005 - DNA, 15 bp, Homo sapiens
cttgtcatgtgtata

SEQ ID NO: 2464006 - DNA, 16 bp, Homo sapiens
cttgtcatgtgtataa

SEQ ID NO: 2464007 - DNA, 19 bp, Homo sapiens
cttgtcatgtgtataaaaa

SEQ ID NO: 2464008 - DNA, 20 bp, Homo sapiens
cttgtccttagcctggacct

SEQ ID NO: 2464009 - DNA, 16 bp, Homo sapiens
cttgtctataaagcat

SEQ ID NO: 2464010 - DNA, 17 bp, Homo sapiens
cttgtctataaagcatt

SEQ ID NO: 2464011 - DNA, 18 bp, Homo sapiens
cttgtctcttgcctgcca

SEQ ID NO: 2464012 - DNA, 23 bp, Homo sapiens
cttgtctcttgcctgccactgtg

SEQ ID NO: 2464013 - DNA, 13 bp, Homo sapiens
cttgtctttattt

SEQ ID NO: 2464014 - DNA, 19 bp, Homo sapiens
cttgtgaatcaagggtcag

SEQ ID NO: 2464015 - DNA, 20 bp, Homo sapiens
cttgtgaatcaagggtcagg

SEQ ID NO: 2464016 - DNA, 22 bp, Homo sapiens
cttgtgaatcaagggtcaggcc

SEQ ID NO: 2464017 - DNA, 21 bp, Homo sapiens
cttgtgatgtcatacagagaa

SEQ ID NO: 2464018 - DNA, 14 bp, Homo sapiens
cttgtgggcctggg

SEQ ID NO: 2464019 - DNA, 17 bp, Homo sapiens
cttgtgggcctgggctc

SEQ ID NO: 2464020 - DNA, 15 bp, Homo sapiens
cttgtggggcctggg

SEQ ID NO: 2464021 - DNA, 16 bp, Homo sapiens
cttgtggggcctggga

SEQ ID NO: 2464022 - DNA, 14 bp, Homo sapiens
cttgtgtcccatga

SEQ ID NO: 2464023 - DNA, 20 bp, Homo sapiens
cttgtgtgtatgcacatgaa

SEQ ID NO: 2464024 - DNA, 22 bp, Homo sapiens
cttgtgtgtatgcacatgaact

SEQ ID NO: 2464025 - DNA, 17 bp, Homo sapiens
cttgtgttggctgtggc

SEQ ID NO: 2464026 - DNA, 14 bp, Homo sapiens
cttgttacttctga

SEQ ID NO: 2464027 - DNA, 15 bp, Homo sapiens
cttgttacttctgag

SEQ ID NO: 2464028 - DNA, 17 bp, Homo sapiens
cttgttacttctgaggt

SEQ ID NO: 2464029 - DNA, 21 bp, Homo sapiens
cttgttccccactgacagcct

SEQ ID NO: 2464030 - DNA, 13 bp, Homo sapiens
cttgttctgtcac

SEQ ID NO: 2464031 - DNA, 13 bp, Homo sapiens
cttgttgagccgt

SEQ ID NO: 2464032 - DNA, 23 bp, Homo sapiens
cttgttggcgtaggctacagaga

SEQ ID NO: 2464033 - DNA, 16 bp, Homo sapiens
cttgttgtttcttgcc

SEQ ID NO: 2464034 - DNA, 17 bp, Homo sapiens
cttgtttacatgcttat

SEQ ID NO: 2464035 - DNA, 22 bp, Homo sapiens
cttgtttcaattccacctgcaa

SEQ ID NO: 2464036 - DNA, 17 bp, Homo sapiens
cttgtttgcttcaactg

SEQ ID NO: 2464037 - DNA, 18 bp, Homo sapiens
cttgtttggggcaggagt

SEQ ID NO: 2464038 - DNA, 12 bp, Homo sapiens
cttgtttttgca

SEQ ID NO: 2464039 - DNA, 23 bp, Homo sapiens
cttgttttttgtttgtttgttgc

SEQ ID NO: 2464040 - DNA, 23 bp, Homo sapiens
ctttaaagtgactaatggcatga

SEQ ID NO: 2464041 - DNA, 18 bp, Homo sapiens
ctttaactgacaagccat

SEQ ID NO: 2464042 - DNA, 19 bp, Homo sapiens
ctttaatataaatgcaaat

SEQ ID NO: 2464043 - DNA, 21 bp, Homo sapiens
ctttaatgatatgcttgtaac

SEQ ID NO: 2464044 - DNA, 20 bp, Homo sapiens
ctttacacaatagaattata

SEQ ID NO: 2464045 - DNA, 17 bp, Homo sapiens
ctttacatgaggactct

SEQ ID NO: 2464046 - DNA, 10 bp, Homo sapiens
ctttactgta

SEQ ID NO: 2464047 - DNA, 14 bp, Homo sapiens
cttcctcctgggcc

SEQ ID NO: 2464048 - DNA, 15 bp, Homo sapiens
cttcctgccagcccc

SEQ ID NO: 2464049 - DNA, 17 bp, Homo sapiens
cttcctgccagcccctg

SEQ ID NO: 2464050 - DNA, 14 bp, Homo sapiens
cttcctggacagct

SEQ ID NO: 2464051 - DNA, 17 bp, Homo sapiens
cttcctggacagctgtg

SEQ ID NO: 2464052 - DNA, 23 bp, Homo sapiens
cttcctggacagctgtgcctcgc

SEQ ID NO: 2464053 - DNA, 18 bp, Homo sapiens
cttcctggagcagaagca

SEQ ID NO: 2464054 - DNA, 22 bp, Homo sapiens
cttcctgtttaaaaaaccacat

SEQ ID NO: 2464055 - DNA, 15 bp, Homo sapiens
cttccttcagagagc

SEQ ID NO: 2464056 - DNA, 21 bp, Homo sapiens
cttccttcagagagcagtgct

SEQ ID NO: 2464057 - DNA, 22 bp, Homo sapiens
cttccttcagagagcagtgctt

SEQ ID NO: 2464058 - DNA, 22 bp, Homo sapiens
cttccttgaagaactgcaggcc

SEQ ID NO: 2464059 - DNA, 16 bp, Homo sapiens
cttcgcttcttgcctc

SEQ ID NO: 2464060 - DNA, 17 bp, Homo sapiens
cttcgggcccttcccac

SEQ ID NO: 2464061 - DNA, 21 bp, Homo sapiens
cttcgtctttcccatggggag

SEQ ID NO: 2464062 - DNA, 22 bp, Homo sapiens
cttcgtctttcccatggggagg

SEQ ID NO: 2464063 - DNA, 22 bp, Homo sapiens
cttctaaacttccccatcttct

SEQ ID NO: 2464064 - DNA, 21 bp, Homo sapiens
cttctaagtaaatacaatttt

SEQ ID NO: 2464065 - DNA, 15 bp, Homo sapiens
cttctaattgccatg

SEQ ID NO: 2464066 - DNA, 16 bp, Homo sapiens
cttctaattgccatgt

SEQ ID NO: 2464067 - DNA, 20 bp, Homo sapiens
cttctactcacttttcccac

SEQ ID NO: 2464068 - DNA, 9 bp, Homo sapiens
cttctagag

SEQ ID NO: 2464069 - DNA, 14 bp, Homo sapiens
cttctagagttcag

SEQ ID NO: 2464070 - DNA, 17 bp, Homo sapiens
cttctataattttgcct

SEQ ID NO: 2464071 - DNA, 20 bp, Homo sapiens
cttctataattttgccttta

SEQ ID NO: 2464072 - DNA, 17 bp, Homo sapiens
cttctcaagttctaaga

SEQ ID NO: 2464073 - DNA, 21 bp, Homo sapiens
cttctcaagttctaagattct

SEQ ID NO: 2464074 - DNA, 17 bp, Homo sapiens
cttctcaggacacaggc

SEQ ID NO: 2464075 - DNA, 15 bp, Homo sapiens
cttctcccactctcc

SEQ ID NO: 2464076 - DNA, 17 bp, Homo sapiens
cttctcccactctccta

SEQ ID NO: 2464077 - DNA, 18 bp, Homo sapiens
cttctcccaggcaaggct

SEQ ID NO: 2464078 - DNA, 20 bp, Homo sapiens
cttctcccaggcaaggctgt

SEQ ID NO: 2464079 - DNA, 21 bp, Homo sapiens
cttctcccaggcaaggctgtg

SEQ ID NO: 2464080 - DNA, 17 bp, Homo sapiens
cttctccccagctccca

SEQ ID NO: 2464081 - DNA, 21 bp, Homo sapiens
cttctcccctgcactgtaaaa

SEQ ID NO: 2464082 - DNA, 16 bp, Homo sapiens
cttctctccagctgac

SEQ ID NO: 2464083 - DNA, 20 bp, Homo sapiens
cttctctgacttctgcctgg

SEQ ID NO: 2464084 - DNA, 13 bp, Homo sapiens
cttctctttgcct

SEQ ID NO: 2464085 - DNA, 16 bp, Homo sapiens
cttctctttgcctcaa

SEQ ID NO: 2464086 - DNA, 23 bp, Homo sapiens
cttctgagcactgtttatacact

SEQ ID NO: 2464087 - DNA, 18 bp, Homo sapiens
cttctgagcagcgagcct

SEQ ID NO: 2464088 - DNA, 13 bp, Homo sapiens
cttctgcctggag

SEQ ID NO: 2464089 - DNA, 16 bp, Homo sapiens
cttctgcctggagact

SEQ ID NO: 2464090 - DNA, 18 bp, Homo sapiens
cttctgccttagtctcag

SEQ ID NO: 2464091 - DNA, 14 bp, Homo sapiens
cttctgctcagctc

SEQ ID NO: 2464092 - DNA, 18 bp, Homo sapiens
cttctgctcagctctggg

SEQ ID NO: 2464093 - DNA, 22 bp, Homo sapiens
cttctggccaggaagctttggt

SEQ ID NO: 2464094 - DNA, 19 bp, Homo sapiens
cttctgggagggcagcagg

SEQ ID NO: 2464095 - DNA, 16 bp, Homo sapiens
cttctgggcctgacca

SEQ ID NO: 2464096 - DNA, 22 bp, Homo sapiens
cttctggggcaggctgggccat

SEQ ID NO: 2464097 - DNA, 20 bp, Homo sapiens
cttctgtaattgtgtggatt

SEQ ID NO: 2464098 - DNA, 22 bp, Homo sapiens
cttcttagctatcattgcttcc

SEQ ID NO: 2464099 - DNA, 13 bp, Homo sapiens
cttcttcaccatt

SEQ ID NO: 2464100 - DNA, 12 bp, Homo sapiens
cttcttgaaggt

SEQ ID NO: 2464101 - DNA, 17 bp, Homo sapiens
cttcttgcctctgtgct

SEQ ID NO: 2464102 - DNA, 22 bp, Homo sapiens
cttgaaaataagaatagaaata

SEQ ID NO: 2464103 - DNA, 13 bp, Homo sapiens
cttgaaagaaatg

SEQ ID NO: 2464104 - DNA, 21 bp, Homo sapiens
cttgaaagaagaaaaggttct

SEQ ID NO: 2464105 - DNA, 19 bp, Homo sapiens
cttgaaatatcctgcttga

SEQ ID NO: 2464106 - DNA, 12 bp, Homo sapiens
cttgaagaactg

SEQ ID NO: 2464107 - DNA, 15 bp, Homo sapiens
cttgaagggccagag

SEQ ID NO: 2464108 - DNA, 16 bp, Homo sapiens
cttgaagggccagagc

SEQ ID NO: 2464109 - DNA, 18 bp, Homo sapiens
cttgaagggccagagcca

SEQ ID NO: 2464110 - DNA, 22 bp, Homo sapiens
cttgaaggtgctgacggccagg

SEQ ID NO: 2464111 - DNA, 12 bp, Homo sapiens
cttgaatgaaaa

SEQ ID NO: 2464112 - DNA, 17 bp, Homo sapiens
cttgaattgtaactgtt

SEQ ID NO: 2464113 - DNA, 22 bp, Homo sapiens
cttgaattgtaactgttcttga

SEQ ID NO: 2464114 - DNA, 20 bp, Homo sapiens
cttgacaactggcaggcagg

SEQ ID NO: 2464115 - DNA, 13 bp, Homo sapiens
cttgaccaggctg

SEQ ID NO: 2464116 - DNA, 17 bp, Homo sapiens
cttgacctgaggctgtg

SEQ ID NO: 2464117 - DNA, 16 bp, Homo sapiens
cttgagccagtaattg

SEQ ID NO: 2464118 - DNA, 11 bp, Homo sapiens
cttgagctcta

SEQ ID NO: 2464119 - DNA, 14 bp, Homo sapiens
cttgagctctatta

SEQ ID NO: 2464120 - DNA, 16 bp, Homo sapiens
cttgagctctattatg

SEQ ID NO: 2464121 - DNA, 19 bp, Homo sapiens
cttgaggggaagctagtct

SEQ ID NO: 2464122 - DNA, 16 bp, Homo sapiens
cttgaggggaccagga

SEQ ID NO: 2464123 - DNA, 21 bp, Homo sapiens
cttgaggggaccaggagtggg

SEQ ID NO: 2464124 - DNA, 16 bp, Homo sapiens
cttgaggtctcagccc

SEQ ID NO: 2464125 - DNA, 22 bp, Homo sapiens
cttgagtggggttatctctgtg

SEQ ID NO: 2464126 - DNA, 16 bp, Homo sapiens
cttgagtttgtcgctc

SEQ ID NO: 2464127 - DNA, 21 bp, Homo sapiens
cttgagtttgtcgctcatgtg

SEQ ID NO: 2464128 - DNA, 17 bp, Homo sapiens
cttgatagaaatgccaa

SEQ ID NO: 2464129 - DNA, 22 bp, Homo sapiens
cttgatcagttaagaaatttca

SEQ ID NO: 2464130 - DNA, 17 bp, Homo sapiens
cttgatccatttctaat

SEQ ID NO: 2464131 - DNA, 18 bp, Homo sapiens
cttgatccatttctaatt

SEQ ID NO: 2464132 - DNA, 18 bp, Homo sapiens
cttgatgaccaaagtcct

SEQ ID NO: 2464133 - DNA, 15 bp, Homo sapiens
cttgatgtaaaatct

SEQ ID NO: 2464134 - DNA, 18 bp, Homo sapiens
cttgatgtaaaatcttgt

SEQ ID NO: 2464135 - DNA, 20 bp, Homo sapiens
cttgatgtaaaatcttgtca

SEQ ID NO: 2464136 - DNA, 23 bp, Homo sapiens
cttgatgtaaaatcttgtcatgt

SEQ ID NO: 2464137 - DNA, 22 bp, Homo sapiens
cttgatttatcacacaaagcag

SEQ ID NO: 2464138 - DNA, 20 bp, Homo sapiens
cttgcacgaccgccccagtt

SEQ ID NO: 2464139 - DNA, 13 bp, Homo sapiens
cttgcatgtaacg

SEQ ID NO: 2464140 - DNA, 14 bp, Homo sapiens
cttgccaaggcaga

SEQ ID NO: 2464141 - DNA, 12 bp, Homo sapiens
cttgccagagat

SEQ ID NO: 2464142 - DNA, 21 bp, Homo sapiens
cttgcccccctggcctccccc

SEQ ID NO: 2464143 - DNA, 15 bp, Homo sapiens
cttgccctaagcaga

SEQ ID NO: 2464144 - DNA, 16 bp, Homo sapiens
cttgccctaagcagaa

SEQ ID NO: 2464145 - DNA, 17 bp, Homo sapiens
cttgcctcaacctccca

SEQ ID NO: 2464146 - DNA, 13 bp, Homo sapiens
cttgcctcatttt

SEQ ID NO: 2464147 - DNA, 15 bp, Homo sapiens
cttgcctctgtgctg

SEQ ID NO: 2464148 - DNA, 19 bp, Homo sapiens
cttgcctctgtgctgtgtg

SEQ ID NO: 2464149 - DNA, 14 bp, Homo sapiens
cttgcctgccactg

SEQ ID NO: 2464150 - DNA, 15 bp, Homo sapiens
cttgcctgccactgt

SEQ ID NO: 2464151 - DNA, 18 bp, Homo sapiens
ctgttccaaattcagttt

SEQ ID NO: 2464152 - DNA, 21 bp, Homo sapiens
ctgttccaaattcagtttcat

SEQ ID NO: 2464153 - DNA, 20 bp, Homo sapiens
ctgttccagtggtaagctat

SEQ ID NO: 2464154 - DNA, 12 bp, Homo sapiens
ctgttcctgctg

SEQ ID NO: 2464155 - DNA, 15 bp, Homo sapiens
ctgttcctgctgctg

SEQ ID NO: 2464156 - DNA, 16 bp, Homo sapiens
ctgttcctgctgctgt

SEQ ID NO: 2464157 - DNA, 18 bp, Homo sapiens
ctgttcctgctgctgtct

SEQ ID NO: 2464158 - DNA, 22 bp, Homo sapiens
ctgttccttccctgtgcctcct

SEQ ID NO: 2464159 - DNA, 16 bp, Homo sapiens
ctgttctaaagctctg

SEQ ID NO: 2464160 - DNA, 17 bp, Homo sapiens
ctgttctaaagctctga

SEQ ID NO: 2464161 - DNA, 19 bp, Homo sapiens
ctgttctagttttttactt

SEQ ID NO: 2464162 - DNA, 11 bp, Homo sapiens
ctgttctgtgt

SEQ ID NO: 2464163 - DNA, 15 bp, Homo sapiens
ctgttctgtttcaag

SEQ ID NO: 2464164 - DNA, 13 bp, Homo sapiens
ctgttcttagctc

SEQ ID NO: 2464165 - DNA, 17 bp, Homo sapiens
ctgttcttagctcaatg

SEQ ID NO: 2464166 - DNA, 21 bp, Homo sapiens
ctgttcttagctcaatgagca

SEQ ID NO: 2464167 - DNA, 18 bp, Homo sapiens
ctgttgcacgtgtgtttt

SEQ ID NO: 2464168 - DNA, 12 bp, Homo sapiens
ctgttgggagag

SEQ ID NO: 2464169 - DNA, 16 bp, Homo sapiens
ctgtttaaaaaaccac

SEQ ID NO: 2464170 - DNA, 17 bp, Homo sapiens
ctgtttagtagcagtga

SEQ ID NO: 2464171 - DNA, 11 bp, Homo sapiens
ctgtttcaagg

SEQ ID NO: 2464172 - DNA, 16 bp, Homo sapiens
ctgtttcagaggctca

SEQ ID NO: 2464173 - DNA, 16 bp, Homo sapiens
ctgtttcccaggccca

SEQ ID NO: 2464174 - DNA, 23 bp, Homo sapiens
ctgtttgacacctcttttttcgt

SEQ ID NO: 2464175 - DNA, 21 bp, Homo sapiens
ctgtttgaggaaagcaagaat

SEQ ID NO: 2464176 - DNA, 18 bp, Homo sapiens
ctgttttgttatataatt

SEQ ID NO: 2464177 - DNA, 19 bp, Homo sapiens
ctgttttgttatataattt

SEQ ID NO: 2464178 - DNA, 16 bp, Homo sapiens
ctgttttgttgacatt

SEQ ID NO: 2464179 - DNA, 20 bp, Homo sapiens
ctgttttgttgacattctga

SEQ ID NO: 2464180 - DNA, 22 bp, Homo sapiens
ctgttttgttgacattctgaat

SEQ ID NO: 2464181 - DNA, 13 bp, Homo sapiens
cttaaaatacaag

SEQ ID NO: 2464182 - DNA, 13 bp, Homo sapiens
cttaaacaaaaat

SEQ ID NO: 2464183 - DNA, 13 bp, Homo sapiens
cttaaaggggaga

SEQ ID NO: 2464184 - DNA, 22 bp, Homo sapiens
cttaaagtgccagtattttaaa

SEQ ID NO: 2464185 - DNA, 13 bp, Homo sapiens
cttaaataagaaa

SEQ ID NO: 2464186 - DNA, 16 bp, Homo sapiens
cttaaataagaaactt

SEQ ID NO: 2464187 - DNA, 22 bp, Homo sapiens
cttaaatgcaaccatttgaaac

SEQ ID NO: 2464188 - DNA, 14 bp, Homo sapiens
cttaacttcttgct

SEQ ID NO: 2464189 - DNA, 21 bp, Homo sapiens
cttaacttcttgcttctttct

SEQ ID NO: 2464190 - DNA, 22 bp, Homo sapiens
cttaacttcttgcttctttcta

SEQ ID NO: 2464191 - DNA, 17 bp, Homo sapiens
ctgacagcagcatctct

SEQ ID NO: 2464192 - DNA, 12 bp, Homo sapiens
ctgacagcctcc

SEQ ID NO: 2464193 - DNA, 13 bp, Homo sapiens
ctgacagcctccc

SEQ ID NO: 2464194 - DNA, 21 bp, Homo sapiens
ctgacaggtgaggtctgttcc

SEQ ID NO: 2464195 - DNA, 17 bp, Homo sapiens
ctgacatcaaaaaaggc

SEQ ID NO: 2464196 - DNA, 21 bp, Homo sapiens
ctgacatgtggggccaggtca

SEQ ID NO: 2464197 - DNA, 12 bp, Homo sapiens
ctgaccacagca

SEQ ID NO: 2464198 - DNA, 14 bp, Homo sapiens
ctgaccacagcaca

SEQ ID NO: 2464199 - DNA, 18 bp, Homo sapiens
ctgaccacagcacagcca

SEQ ID NO: 2464200 - DNA, 13 bp, Homo sapiens
ctgaccactcaga

SEQ ID NO: 2464201 - DNA, 20 bp, Homo sapiens
ctgaccagctccccctccct

SEQ ID NO: 2464202 - DNA, 16 bp, Homo sapiens
ctgaccagctgctccg

SEQ ID NO: 2464203 - DNA, 19 bp, Homo sapiens
ctgaccagctgctccgagg

SEQ ID NO: 2464204 - DNA, 20 bp, Homo sapiens
ctgacccagtgcccccactg

SEQ ID NO: 2464205 - DNA, 23 bp, Homo sapiens
ctgacccagtgcccccactgacc

SEQ ID NO: 2464206 - DNA, 16 bp, Homo sapiens
ctgaccccatcaccta

SEQ ID NO: 2464207 - DNA, 14 bp, Homo sapiens
ctgacctccgccat

SEQ ID NO: 2464208 - DNA, 17 bp, Homo sapiens
ctgacctccgccatcca

SEQ ID NO: 2464209 - DNA, 14 bp, Homo sapiens
ctgacctgctgacc

SEQ ID NO: 2464210 - DNA, 10 bp, Homo sapiens
ctgacctggc

SEQ ID NO: 2464211 - DNA, 14 bp, Homo sapiens
ctgacctggccccc

SEQ ID NO: 2464212 - DNA, 20 bp, Homo sapiens
ctgacctggccccctcagtg

SEQ ID NO: 2464213 - DNA, 20 bp, Homo sapiens
ctgacctgtgagcccagctg

SEQ ID NO: 2464214 - DNA, 15 bp, Homo sapiens
ctgaccttaaatgca

SEQ ID NO: 2464215 - DNA, 16 bp, Homo sapiens
ctgacggagtcctgtg

SEQ ID NO: 2464216 - DNA, 18 bp, Homo sapiens
ctgactattcttgatgta

SEQ ID NO: 2464217 - DNA, 20 bp, Homo sapiens
ctgactattcttgatgtaaa

SEQ ID NO: 2464218 - DNA, 21 bp, Homo sapiens
ctgactattcttgatgtaaaa

SEQ ID NO: 2464219 - DNA, 22 bp, Homo sapiens
ctgactattcttgatgtaaaat

SEQ ID NO: 2464220 - DNA, 23 bp, Homo sapiens
ctgactattcttgatgtaaaatc

SEQ ID NO: 2464221 - DNA, 22 bp, Homo sapiens
ctgactcacacctgaactgaac

SEQ ID NO: 2464222 - DNA, 12 bp, Homo sapiens
ctgactcagggc

SEQ ID NO: 2464223 - DNA, 18 bp, Homo sapiens
ctgactcagggctcctgg

SEQ ID NO: 2464224 - DNA, 15 bp, Homo sapiens
ctgactcggtttctc

SEQ ID NO: 2464225 - DNA, 18 bp, Homo sapiens
ctgactcggtttctccaa

SEQ ID NO: 2464226 - DNA, 18 bp, Homo sapiens
ctgactgggaccaggcac

SEQ ID NO: 2464227 - DNA, 12 bp, Homo sapiens
ctgactgggagt

SEQ ID NO: 2464228 - DNA, 13 bp, Homo sapiens
ctgactgtagctt

SEQ ID NO: 2464229 - DNA, 18 bp, Homo sapiens
ctgactgtagctttggaa

SEQ ID NO: 2464230 - DNA, 12 bp, Homo sapiens
ctgacttctgcc

SEQ ID NO: 2464231 - DNA, 15 bp, Homo sapiens
ctgacttctgcctgg

SEQ ID NO: 2464232 - DNA, 16 bp, Homo sapiens
ctgacttctgcctgga

SEQ ID NO: 2464233 - DNA, 19 bp, Homo sapiens
ctgacttctgcctggagac

SEQ ID NO: 2464234 - DNA, 12 bp, Homo sapiens
ctgacttggctg

SEQ ID NO: 2464235 - DNA, 14 bp, Homo sapiens
ctgacttggctggt

SEQ ID NO: 2464236 - DNA, 16 bp, Homo sapiens
ctgacttggctggtgt

SEQ ID NO: 2464237 - DNA, 18 bp, Homo sapiens
ctgactttgcttgctttg

SEQ ID NO: 2464238 - DNA, 16 bp, Homo sapiens
ctgagaacctggcctt

SEQ ID NO: 2464239 - DNA, 17 bp, Homo sapiens
ctgagaacctggccttc

SEQ ID NO: 2464240 - DNA, 15 bp, Homo sapiens
ctgagactccagacc

SEQ ID NO: 2464241 - DNA, 18 bp, Homo sapiens
ctgagactccagacctga

SEQ ID NO: 2464242 - DNA, 13 bp, Homo sapiens
ctgagaggccctg

SEQ ID NO: 2464243 - DNA, 17 bp, Homo sapiens
ctgagagggctcgaggg

SEQ ID NO: 2464244 - DNA, 15 bp, Homo sapiens
ctgagagtctagatt

SEQ ID NO: 2464245 - DNA, 17 bp, Homo sapiens
ctgagatacatacagaa

SEQ ID NO: 2464246 - DNA, 18 bp, Homo sapiens
ctgagataccagcgagga

SEQ ID NO: 2464247 - DNA, 21 bp, Homo sapiens
ctgagatggctcccaggggct

SEQ ID NO: 2464248 - DNA, 20 bp, Homo sapiens
ctgagatgggcttcccaagg

SEQ ID NO: 2464249 - DNA, 15 bp, Homo sapiens
ctgagcactgccagg

SEQ ID NO: 2464250 - DNA, 17 bp, Homo sapiens
ctgagcactgccaggag

SEQ ID NO: 2464251 - DNA, 22 bp, Homo sapiens
ctgagcactgccaggagggaca

SEQ ID NO: 2464252 - DNA, 20 bp, Homo sapiens
ctgagcactgtttatacact

SEQ ID NO: 2464253 - DNA, 17 bp, Homo sapiens
ctgagcagcgagcctgc

SEQ ID NO: 2464254 - DNA, 18 bp, Homo sapiens
ctgagcagcgagcctgct

SEQ ID NO: 2464255 - DNA, 16 bp, Homo sapiens
ctgagcagggccgggg

SEQ ID NO: 2464256 - DNA, 19 bp, Homo sapiens
ctgagccagggtctccaga

SEQ ID NO: 2464257 - DNA, 22 bp, Homo sapiens
ctgagccagggtctccagaaag

SEQ ID NO: 2464258 - DNA, 23 bp, Homo sapiens
ctgagccggccccaggctcgtgg

SEQ ID NO: 2464259 - DNA, 20 bp, Homo sapiens
ctgagcgaggagatgctcct

SEQ ID NO: 2464260 - DNA, 15 bp, Homo sapiens
ctgagcgcctccatc

SEQ ID NO: 2464261 - DNA, 15 bp, Homo sapiens
ctgagctcagcgtgg

SEQ ID NO: 2464262 - DNA, 17 bp, Homo sapiens
ctgagctcagcgtggag

SEQ ID NO: 2464263 - DNA, 14 bp, Homo sapiens
ctgagctctgagag

SEQ ID NO: 2464264 - DNA, 15 bp, Homo sapiens
ctgagctgaccagcc

SEQ ID NO: 2464265 - DNA, 11 bp, Homo sapiens
ctgagctgtca

SEQ ID NO: 2464266 - DNA, 23 bp, Homo sapiens
ctgcagtcccagcggtgggacct

SEQ ID NO: 2464267 - DNA, 21 bp, Homo sapiens
ctgcatatgttgaatactttt

SEQ ID NO: 2464268 - DNA, 21 bp, Homo sapiens
ctgcatccattctcctgagga

SEQ ID NO: 2464269 - DNA, 15 bp, Homo sapiens
ctgcatcctctggag

SEQ ID NO: 2464270 - DNA, 20 bp, Homo sapiens
ctgcatgcccagagacccag

SEQ ID NO: 2464271 - DNA, 21 bp, Homo sapiens
ctgcatgcccagagacccagc

SEQ ID NO: 2464272 - DNA, 13 bp, Homo sapiens
ctgcatggcaggg

SEQ ID NO: 2464273 - DNA, 14 bp, Homo sapiens
ctgcatggcagggg

SEQ ID NO: 2464274 - DNA, 17 bp, Homo sapiens
ctgcatggcagggggct

SEQ ID NO: 2464275 - DNA, 23 bp, Homo sapiens
ctgcatggcagggggctgctgct

SEQ ID NO: 2464276 - DNA, 17 bp, Homo sapiens
ctgcatggcatcctcca

SEQ ID NO: 2464277 - DNA, 21 bp, Homo sapiens
ctgcatgtactgtatattaca

SEQ ID NO: 2464278 - DNA, 12 bp, Homo sapiens
ctgcattccgca

SEQ ID NO: 2464279 - DNA, 13 bp, Homo sapiens
ctgcattccgcag

SEQ ID NO: 2464280 - DNA, 19 bp, Homo sapiens
ctgcattggaactggaggc

SEQ ID NO: 2464281 - DNA, 22 bp, Homo sapiens
ctgcattggaactggaggcagg

SEQ ID NO: 2464282 - DNA, 16 bp, Homo sapiens
ctgccaacctaaaact

SEQ ID NO: 2464283 - DNA, 22 bp, Homo sapiens
ctgccaacctaaaactctttcg

SEQ ID NO: 2464284 - DNA, 17 bp, Homo sapiens
ctgccaagactgctgtg

SEQ ID NO: 2464285 - DNA, 20 bp, Homo sapiens
ctgccaagactgctgtggcc

SEQ ID NO: 2464286 - DNA, 18 bp, Homo sapiens
ctgccaccaggccacctc

SEQ ID NO: 2464287 - DNA, 18 bp, Homo sapiens
ctgccacccagccccagc

SEQ ID NO: 2464288 - DNA, 16 bp, Homo sapiens
ctgccacccaggatcc

SEQ ID NO: 2464289 - DNA, 13 bp, Homo sapiens
ctgccacctggac

SEQ ID NO: 2464290 - DNA, 20 bp, Homo sapiens
ctgccacctggacccctgca

SEQ ID NO: 2464291 - DNA, 23 bp, Homo sapiens
ctgccactgaggggggatccagt

SEQ ID NO: 2464292 - DNA, 13 bp, Homo sapiens
ctgccagcagggg

SEQ ID NO: 2464293 - DNA, 12 bp, Homo sapiens
ctgccagctgca

SEQ ID NO: 2464294 - DNA, 16 bp, Homo sapiens
ctgccagctgcactga

SEQ ID NO: 2464295 - DNA, 19 bp, Homo sapiens
ctgccaggaggacccaggg

SEQ ID NO: 2464296 - DNA, 13 bp, Homo sapiens
ctgccaggaggga

SEQ ID NO: 2464297 - DNA, 19 bp, Homo sapiens
ctgccagggcccctctccc

SEQ ID NO: 2464298 - DNA, 20 bp, Homo sapiens
ctgccagggcccctctcccc

SEQ ID NO: 2464299 - DNA, 19 bp, Homo sapiens
ctgccagtgacagacaggc

SEQ ID NO: 2464300 - DNA, 15 bp, Homo sapiens
ctgccattaaagaat

SEQ ID NO: 2464301 - DNA, 20 bp, Homo sapiens
ctgcccaacccttccctcac

SEQ ID NO: 2464302 - DNA, 17 bp, Homo sapiens
ctgcccactcccaggac

SEQ ID NO: 2464303 - DNA, 15 bp, Homo sapiens
ctgcccaggcactgc

SEQ ID NO: 2464304 - DNA, 20 bp, Homo sapiens
ctgcccaggcactgctaggc

SEQ ID NO: 2464305 - DNA, 13 bp, Homo sapiens
ctgcccagttgca

SEQ ID NO: 2464306 - DNA, 22 bp, Homo sapiens
ctgccccaactccttccagcta

SEQ ID NO: 2464307 - DNA, 20 bp, Homo sapiens
ctgccccacttgtccttagc

SEQ ID NO: 2464308 - DNA, 15 bp, Homo sapiens
ctgccccaggcctga

SEQ ID NO: 2464309 - DNA, 16 bp, Homo sapiens
ctgccccccagcctct

SEQ ID NO: 2464310 - DNA, 13 bp, Homo sapiens
ctgccccctgcag

SEQ ID NO: 2464311 - DNA, 16 bp, Homo sapiens
ctgccccctgcaggaa

SEQ ID NO: 2464312 - DNA, 13 bp, Homo sapiens
ctgccccctgctg

SEQ ID NO: 2464313 - DNA, 18 bp, Homo sapiens
ctgccccctgctgccatg

SEQ ID NO: 2464314 - DNA, 22 bp, Homo sapiens
ctgccccggcccctccccctga

SEQ ID NO: 2464315 - DNA, 20 bp, Homo sapiens
ctgccctcctgtgctcagcc

SEQ ID NO: 2464316 - DNA, 17 bp, Homo sapiens
ctgccctctgcatcctc

SEQ ID NO: 2464317 - DNA, 18 bp, Homo sapiens
ctgccctggtggccctct

SEQ ID NO: 2464318 - DNA, 20 bp, Homo sapiens
ctgcccttgtttggggcagg

SEQ ID NO: 2464319 - DNA, 14 bp, Homo sapiens
ctgccgagcaaccg

SEQ ID NO: 2464320 - DNA, 21 bp, Homo sapiens
ctgccgagcaaccgtggccct

SEQ ID NO: 2464321 - DNA, 15 bp, Homo sapiens
ctgccgcgcagtgtg

SEQ ID NO: 2464322 - DNA, 16 bp, Homo sapiens
ctgccggctccttggt

SEQ ID NO: 2464323 - DNA, 20 bp, Homo sapiens
ctgccgtcagtgctgtgctg

SEQ ID NO: 2464324 - DNA, 22 bp, Homo sapiens
ctgccgtcccctagagtcccag

SEQ ID NO: 2464325 - DNA, 13 bp, Homo sapiens
ctgccgtggggcc

SEQ ID NO: 2464326 - DNA, 20 bp, Homo sapiens
ctgcctagaaacaacactgt

SEQ ID NO: 2464327 - DNA, 15 bp, Homo sapiens
ctgcctagattcagg

SEQ ID NO: 2464328 - DNA, 18 bp, Homo sapiens
ctgcctcagcctcccaag

SEQ ID NO: 2464329 - DNA, 10 bp, Homo sapiens
ctgcctcagg

SEQ ID NO: 2464330 - DNA, 23 bp, Homo sapiens
ctgcctcaggaggcaggaccttc

SEQ ID NO: 2464331 - DNA, 13 bp, Homo sapiens
ctgcctccagccg

SEQ ID NO: 2464332 - DNA, 23 bp, Homo sapiens
ctgcctcctgccggctccttggt

SEQ ID NO: 2464333 - DNA, 18 bp, Homo sapiens
ctgcctcgaaacacagaa

SEQ ID NO: 2464334 - DNA, 17 bp, Homo sapiens
ctgcctctactgggaag

SEQ ID NO: 2464335 - DNA, 14 bp, Homo sapiens
ctgcctctcccagg

SEQ ID NO: 2464336 - DNA, 19 bp, Homo sapiens
ctgcctctcccaggcaggg

SEQ ID NO: 2464337 - DNA, 20 bp, Homo sapiens
ctgcctctcccaggcagggg

SEQ ID NO: 2464338 - DNA, 17 bp, Homo sapiens
ctgcctcttctgggagg

SEQ ID NO: 2464339 - DNA, 20 bp, Homo sapiens
ctgcctgacatttggagtgt

SEQ ID NO: 2464340 - DNA, 15 bp, Homo sapiens
ctgcctgccagctgc

SEQ ID NO: 2464341 - DNA, 16 bp, Homo sapiens
ctgcctgccagctgca

SEQ ID NO: 2464342 - DNA, 21 bp, Homo sapiens
ctgcctgccagctgcactgat

SEQ ID NO: 2464343 - DNA, 14 bp, Homo sapiens
ctgcctgccctggt

SEQ ID NO: 2464344 - DNA, 15 bp, Homo sapiens
ctgcctgctcccatc

SEQ ID NO: 2464345 - DNA, 11 bp, Homo sapiens
ctgcctggacc

SEQ ID NO: 2464346 - DNA, 18 bp, Homo sapiens
ctgcctggaggacctgag

SEQ ID NO: 2464347 - DNA, 21 bp, Homo sapiens
ctgcctgtccctaccccatgg

SEQ ID NO: 2464348 - DNA, 23 bp, Homo sapiens
ctgcctgtggccatgaccctgcc

SEQ ID NO: 2464349 - DNA, 20 bp, Homo sapiens
ctgccttagtctcagtttgt

SEQ ID NO: 2464350 - DNA, 23 bp, Homo sapiens
ctgccttagtctcagtttgtgtg

SEQ ID NO: 2464351 - DNA, 18 bp, Homo sapiens
ctgccttattcagggaag

SEQ ID NO: 2464352 - DNA, 14 bp, Homo sapiens
ctgccttcgcttct

SEQ ID NO: 2464353 - DNA, 15 bp, Homo sapiens
ctgccttcgcttctt

SEQ ID NO: 2464354 - DNA, 15 bp, Homo sapiens
ctgcctttccatcca

SEQ ID NO: 2464355 - DNA, 22 bp, Homo sapiens
ctgcctttccatccatggccag

SEQ ID NO: 2464356 - DNA, 16 bp, Homo sapiens
ctgcgactttctgcct

SEQ ID NO: 2464357 - DNA, 17 bp, Homo sapiens
ctgcgactttctgcctg

SEQ ID NO: 2464358 - DNA, 18 bp, Homo sapiens
ctgcgactttctgcctgg

SEQ ID NO: 2464359 - DNA, 19 bp, Homo sapiens
ctgcgactttctgcctgga

SEQ ID NO: 2464360 - DNA, 15 bp, Homo sapiens
ctgcgagtggtttct

SEQ ID NO: 2464361 - DNA, 23 bp, Homo sapiens
ctgcgggtgaacaaagcagccac

SEQ ID NO: 2464362 - DNA, 13 bp, Homo sapiens
ctgcgggtggggc

SEQ ID NO: 2464363 - DNA, 19 bp, Homo sapiens
ctgctaacggtgctcaggg

SEQ ID NO: 2464364 - DNA, 15 bp, Homo sapiens
ctgctaatattttcc

SEQ ID NO: 2464365 - DNA, 16 bp, Homo sapiens
ctgctaatattttcct

SEQ ID NO: 2464366 - DNA, 23 bp, Homo sapiens
ctgctaatattttcctcctgagt

SEQ ID NO: 2464367 - DNA, 13 bp, Homo sapiens
ctgctacttatat

SEQ ID NO: 2464368 - DNA, 19 bp, Homo sapiens
ctgctaggccagagcccac

SEQ ID NO: 2464369 - DNA, 15 bp, Homo sapiens
ctgctatcattattc

SEQ ID NO: 2464370 - DNA, 23 bp, Homo sapiens
ctgctgctcttggctggacccag

SEQ ID NO: 2464371 - DNA, 14 bp, Homo sapiens
ctgctgctgagaac

SEQ ID NO: 2464372 - DNA, 16 bp, Homo sapiens
ctgctgctgagaacct

SEQ ID NO: 2464373 - DNA, 19 bp, Homo sapiens
ctgctgctgagaacctggc

SEQ ID NO: 2464374 - DNA, 23 bp, Homo sapiens
ctgctgctgagaacctggccttc

SEQ ID NO: 2464375 - DNA, 16 bp, Homo sapiens
ctgctgctgtctgggt

SEQ ID NO: 2464376 - DNA, 18 bp, Homo sapiens
ctgctgctgtctgggtgc

SEQ ID NO: 2464377 - DNA, 18 bp, Homo sapiens
ctgctggagaggccccag

SEQ ID NO: 2464378 - DNA, 21 bp, Homo sapiens
ctgctggagaggccccagccg

SEQ ID NO: 2464379 - DNA, 16 bp, Homo sapiens
ctgctggcccagccaa

SEQ ID NO: 2464380 - DNA, 14 bp, Homo sapiens
ctgctggcctctgc

SEQ ID NO: 2464381 - DNA, 16 bp, Homo sapiens
ctgctggcctctgcga

SEQ ID NO: 2464382 - DNA, 21 bp, Homo sapiens
ctgctggcctctgcgagtggt

SEQ ID NO: 2464383 - DNA, 16 bp, Homo sapiens
ctgctgggctcagtga

SEQ ID NO: 2464384 - DNA, 14 bp, Homo sapiens
ctgctggggaagac

SEQ ID NO: 2464385 - DNA, 19 bp, Homo sapiens
ctgctggggaagacagtgg

SEQ ID NO: 2464386 - DNA, 22 bp, Homo sapiens
ctgctggggcctgggacaactg

SEQ ID NO: 2464387 - DNA, 20 bp, Homo sapiens
ctgctgtccctcccccttgt

SEQ ID NO: 2464388 - DNA, 19 bp, Homo sapiens
ctgctgtctgggtggctca

SEQ ID NO: 2464389 - DNA, 21 bp, Homo sapiens
ctgctgtctgggtggctcact

SEQ ID NO: 2464390 - DNA, 16 bp, Homo sapiens
ctgctgtggccaggag

SEQ ID NO: 2464391 - DNA, 15 bp, Homo sapiens
ctgcttcctcctgga

SEQ ID NO: 2464392 - DNA, 16 bp, Homo sapiens
ctgcttcctcctggaa

SEQ ID NO: 2464393 - DNA, 14 bp, Homo sapiens
ctgcttcctgcttg

SEQ ID NO: 2464394 - DNA, 13 bp, Homo sapiens
ctgcttctcccag

SEQ ID NO: 2464395 - DNA, 14 bp, Homo sapiens
ctgcttctcccagg

SEQ ID NO: 2464396 - DNA, 20 bp, Homo sapiens
ctgcttctcccaggcaaggc

SEQ ID NO: 2464397 - DNA, 19 bp, Homo sapiens
ctgcttctctgacttctgc

SEQ ID NO: 2464398 - DNA, 20 bp, Homo sapiens
ctgcttctctgacttctgcc

SEQ ID NO: 2464399 - DNA, 21 bp, Homo sapiens
ctgcttctctgacttctgcct

SEQ ID NO: 2464400 - DNA, 16 bp, Homo sapiens
ctgcttgaggaaaaca

SEQ ID NO: 2464401 - DNA, 21 bp, Homo sapiens
ctgcttgatgggattctggac

SEQ ID NO: 2464402 - DNA, 23 bp, Homo sapiens
ctgcttgccaaggcagaggcctg

SEQ ID NO: 2464403 - DNA, 16 bp, Homo sapiens
ctgcttggagctgagc

SEQ ID NO: 2464404 - DNA, 17 bp, Homo sapiens
ctgcttggagctgagca

SEQ ID NO: 2464405 - DNA, 11 bp, Homo sapiens
ctgctttctgt

SEQ ID NO: 2464406 - DNA, 21 bp, Homo sapiens
ctgctttgctcttcaagaaat

SEQ ID NO: 2464407 - DNA, 18 bp, Homo sapiens
ctgcttttccctttgtga

SEQ ID NO: 2464408 - DNA, 19 bp, Homo sapiens
ctgcttttccctttgtgag

SEQ ID NO: 2464409 - DNA, 22 bp, Homo sapiens
ctgcttttccctttgtgagtca

SEQ ID NO: 2464410 - DNA, 19 bp, Homo sapiens
ctggaacccagactcagac

SEQ ID NO: 2464411 - DNA, 22 bp, Homo sapiens
ctggaacccagactcagacatt

SEQ ID NO: 2464412 - DNA, 16 bp, Homo sapiens
ctggaacctcagcctg

SEQ ID NO: 2464413 - DNA, 17 bp, Homo sapiens
ctggaacctcagcctgg

SEQ ID NO: 2464414 - DNA, 20 bp, Homo sapiens
ctggaacctcagcctggcca

SEQ ID NO: 2464415 - DNA, 23 bp, Homo sapiens
ctggaacctcagcctggccagac

SEQ ID NO: 2464416 - DNA, 15 bp, Homo sapiens
ctggaagatagctgt

SEQ ID NO: 2464417 - DNA, 19 bp, Homo sapiens
ctggaagatagctgtgact

SEQ ID NO: 2464418 - DNA, 19 bp, Homo sapiens
ctggaagtccaatgtggca

SEQ ID NO: 2464419 - DNA, 23 bp, Homo sapiens
ctggaatcaggaatattttccaa

SEQ ID NO: 2464420 - DNA, 20 bp, Homo sapiens
ctggaatgtaatcaatgttt

SEQ ID NO: 2464421 - DNA, 21 bp, Homo sapiens
ctggaatgtaatcaatgtttc

SEQ ID NO: 2464422 - DNA, 18 bp, Homo sapiens
ctggacactcagacctga

SEQ ID NO: 2464423 - DNA, 16 bp, Homo sapiens
ctggacagccccaccc

SEQ ID NO: 2464424 - DNA, 15 bp, Homo sapiens
ctggacagctgtgcc

SEQ ID NO: 2464425 - DNA, 11 bp, Homo sapiens
ctggacccagc

SEQ ID NO: 2464426 - DNA, 18 bp, Homo sapiens
ctggacccagccaggccc

SEQ ID NO: 2464427 - DNA, 23 bp, Homo sapiens
ctggacccccctttcacaggcag

SEQ ID NO: 2464428 - DNA, 23 bp, Homo sapiens
ctggacccgttcatgggggaggg

SEQ ID NO: 2464429 - DNA, 21 bp, Homo sapiens
ctggaccctgaccagctcccc

SEQ ID NO: 2464430 - DNA, 18 bp, Homo sapiens
ctggacctctgacagcag

SEQ ID NO: 2464431 - DNA, 21 bp, Homo sapiens
ctggacctctgacagcagcat

SEQ ID NO: 2464432 - DNA, 23 bp, Homo sapiens
ctggactctcagtctctgagcag

SEQ ID NO: 2464433 - DNA, 22 bp, Homo sapiens
ctggacttaagcatctggctct

SEQ ID NO: 2464434 - DNA, 15 bp, Homo sapiens
ctggactttcctgca

SEQ ID NO: 2464435 - DNA, 13 bp, Homo sapiens
ctggagaaagggc

SEQ ID NO: 2464436 - DNA, 15 bp, Homo sapiens
ctggagatcctcctg

SEQ ID NO: 2464437 - DNA, 16 bp, Homo sapiens
ctggagatcctcctgc

SEQ ID NO: 2464438 - DNA, 17 bp, Homo sapiens
ctggagatcctcctgca

SEQ ID NO: 2464439 - DNA, 20 bp, Homo sapiens
ctggagatcctcctgcagac

SEQ ID NO: 2464440 - DNA, 19 bp, Homo sapiens
ctggagcacaaagaccctg

SEQ ID NO: 2464441 - DNA, 22 bp, Homo sapiens
ctggagcacaaagaccctggct

SEQ ID NO: 2464442 - DNA, 22 bp, Homo sapiens
ctggagcacaataaatggctgt

SEQ ID NO: 2464443 - DNA, 16 bp, Homo sapiens
ctggagcagaagcagc

SEQ ID NO: 2464444 - DNA, 14 bp, Homo sapiens
ctggagccagccga

SEQ ID NO: 2464445 - DNA, 14 bp, Homo sapiens
ctggaggacctgag

SEQ ID NO: 2464446 - DNA, 15 bp, Homo sapiens
ctggaggacctgagc

SEQ ID NO: 2464447 - DNA, 17 bp, Homo sapiens
ctggaggacctgagcct

SEQ ID NO: 2464448 - DNA, 22 bp, Homo sapiens
ctggaggacctgagcctgccga

SEQ ID NO: 2464449 - DNA, 19 bp, Homo sapiens
ctggaggcaggggcttcct

SEQ ID NO: 2464450 - DNA, 21 bp, Homo sapiens
ctggaggcaggggcttcctgg

SEQ ID NO: 2464451 - DNA, 15 bp, Homo sapiens
ctggaggcccaggct

SEQ ID NO: 2464452 - DNA, 15 bp, Homo sapiens
ctggaggcccagttc

SEQ ID NO: 2464453 - DNA, 20 bp, Homo sapiens
ctggagggggaatggcagca

SEQ ID NO: 2464454 - DNA, 21 bp, Homo sapiens
ctggagggggaatggcagcag

SEQ ID NO: 2464455 - DNA, 16 bp, Homo sapiens
ctggaggggtgtggct

SEQ ID NO: 2464456 - DNA, 20 bp, Homo sapiens
ctggagttgatctggaaccc

SEQ ID NO: 2464457 - DNA, 22 bp, Homo sapiens
ctggagttgatctggaacccag

SEQ ID NO: 2464458 - DNA, 17 bp, Homo sapiens
ctggataacttccacag

SEQ ID NO: 2464459 - DNA, 18 bp, Homo sapiens
ctggataacttccacagg

SEQ ID NO: 2464460 - DNA, 15 bp, Homo sapiens
ctggatcagaacagg

SEQ ID NO: 2464461 - DNA, 13 bp, Homo sapiens
ctggatctccctg

SEQ ID NO: 2464462 - DNA, 15 bp, Homo sapiens
ctggatgacattaaa

SEQ ID NO: 2464463 - DNA, 15 bp, Homo sapiens
ctggatgagctccca

SEQ ID NO: 2464464 - DNA, 20 bp, Homo sapiens
ctggatgagctcccacaagc

SEQ ID NO: 2464465 - DNA, 22 bp, Homo sapiens
ctggatgatactaataaactaa

SEQ ID NO: 2464466 - DNA, 15 bp, Homo sapiens
ctggatggggcaggc

SEQ ID NO: 2464467 - DNA, 20 bp, Homo sapiens
ctggattccccatctcaggc

SEQ ID NO: 2464468 - DNA, 15 bp, Homo sapiens
ctggcaacacagagg

SEQ ID NO: 2464469 - DNA, 15 bp, Homo sapiens
ctggcaatgccacag

SEQ ID NO: 2464470 - DNA, 19 bp, Homo sapiens
ctggcaatgccacagccct

SEQ ID NO: 2464471 - DNA, 20 bp, Homo sapiens
ctggcaatgccacagccctg

SEQ ID NO: 2464472 - DNA, 23 bp, Homo sapiens
ctggcagccacacttctcaggac

SEQ ID NO: 2464473 - DNA, 23 bp, Homo sapiens
ctggcagcctcccatccagggcc

SEQ ID NO: 2464474 - DNA, 12 bp, Homo sapiens
ctggcagctctg

SEQ ID NO: 2464475 - DNA, 19 bp, Homo sapiens
ctggcatactatgtggatg

SEQ ID NO: 2464476 - DNA, 17 bp, Homo sapiens
ctggcatcgcaccattc

SEQ ID NO: 2464477 - DNA, 19 bp, Homo sapiens
ctggcatcgcaccattctg

SEQ ID NO: 2464478 - DNA, 22 bp, Homo sapiens
ctggcatcgcaccattctgact

SEQ ID NO: 2464479 - DNA, 15 bp, Homo sapiens
ctggccaagctgagg

SEQ ID NO: 2464480 - DNA, 16 bp, Homo sapiens
ctggccaagctgaggt

SEQ ID NO: 2464481 - DNA, 17 bp, Homo sapiens
ctggccagacacaggcc

SEQ ID NO: 2464482 - DNA, 18 bp, Homo sapiens
ctggccagacacaggccc

SEQ ID NO: 2464483 - DNA, 20 bp, Homo sapiens
ctggccagcgagcgcccagc

SEQ ID NO: 2464484 - DNA, 23 bp, Homo sapiens
ctggccagcgagcgcccagctcc

SEQ ID NO: 2464485 - DNA, 20 bp, Homo sapiens
ctggccagggccacgctcca

SEQ ID NO: 2464486 - DNA, 21 bp, Homo sapiens
ctggccagtccaggctgccgt

SEQ ID NO: 2464487 - DNA, 22 bp, Homo sapiens
ctggccagtccaggctgccgtg

SEQ ID NO: 2464488 - DNA, 20 bp, Homo sapiens
ctggccagtgccctgatccc

SEQ ID NO: 2464489 - DNA, 22 bp, Homo sapiens
ctggccagtgccctgatcccag

SEQ ID NO: 2464490 - DNA, 13 bp, Homo sapiens
ctggccagtgttt

SEQ ID NO: 2464491 - DNA, 15 bp, Homo sapiens
ctggccatggagaaa

SEQ ID NO: 2464492 - DNA, 19 bp, Homo sapiens
ctggccatggagaaagctg

SEQ ID NO: 2464493 - DNA, 23 bp, Homo sapiens
ctggccatggagaaagctgactt

SEQ ID NO: 2464494 - DNA, 11 bp, Homo sapiens
ctggcccagcc

SEQ ID NO: 2464495 - DNA, 23 bp, Homo sapiens
ctggcccagccaaaccctgtctg

SEQ ID NO: 2464496 - DNA, 11 bp, Homo sapiens
ctggcccaggg

SEQ ID NO: 2464497 - DNA, 19 bp, Homo sapiens
ctggcccagggcccagagc

SEQ ID NO: 2464498 - DNA, 21 bp, Homo sapiens
ctggcccagggcccagagccc

SEQ ID NO: 2464499 - DNA, 13 bp, Homo sapiens
ctggcccatcagg

SEQ ID NO: 2464500 - DNA, 22 bp, Homo sapiens
ctggcccatcagggtaggctgg

SEQ ID NO: 2464501 - DNA, 13 bp, Homo sapiens
ctggcccctctcc

SEQ ID NO: 2464502 - DNA, 14 bp, Homo sapiens
ctggcccctctccc

SEQ ID NO: 2464503 - DNA, 15 bp, Homo sapiens
ctggcccctctccct

SEQ ID NO: 2464504 - DNA, 14 bp, Homo sapiens
ctggccctatttag

SEQ ID NO: 2464505 - DNA, 18 bp, Homo sapiens
ctggccgagtccaagctg

SEQ ID NO: 2464506 - DNA, 23 bp, Homo sapiens
ctggccgagtccaagctgggaga

SEQ ID NO: 2464507 - DNA, 17 bp, Homo sapiens
ctggccgcctgggtcca

SEQ ID NO: 2464508 - DNA, 14 bp, Homo sapiens
ctggcctcccaaat

SEQ ID NO: 2464509 - DNA, 14 bp, Homo sapiens
ctggcctcccccac

SEQ ID NO: 2464510 - DNA, 16 bp, Homo sapiens
ctggcctcctgcctct

SEQ ID NO: 2464511 - DNA, 14 bp, Homo sapiens
ctggcctggactgt

SEQ ID NO: 2464512 - DNA, 17 bp, Homo sapiens
ctggcctggccagtgcc

SEQ ID NO: 2464513 - DNA, 21 bp, Homo sapiens
ctggcctttttcatttatcta

SEQ ID NO: 2464514 - DNA, 16 bp, Homo sapiens
ctggcggggggcccat

SEQ ID NO: 2464515 - DNA, 13 bp, Homo sapiens
ctggctaaagctc

SEQ ID NO: 2464516 - DNA, 18 bp, Homo sapiens
ctggctatagatgtcttt

SEQ ID NO: 2464517 - DNA, 20 bp, Homo sapiens
ctggctccagatgcagggca

SEQ ID NO: 2464518 - DNA, 16 bp, Homo sapiens
ctggctctcacctcta

SEQ ID NO: 2464519 - DNA, 22 bp, Homo sapiens
ctggctctcacctctaggtccc

SEQ ID NO: 2464520 - DNA, 12 bp, Homo sapiens
ctggctctgagc

SEQ ID NO: 2464521 - DNA, 12 bp, Homo sapiens
ctggctgagggc

SEQ ID NO: 2464522 - DNA, 14 bp, Homo sapiens
ctggctggctgagg

SEQ ID NO: 2464523 - DNA, 15 bp, Homo sapiens
ctggctggctgaggg

SEQ ID NO: 2464524 - DNA, 16 bp, Homo sapiens
ctggctggctgagggc

SEQ ID NO: 2464525 - DNA, 12 bp, Homo sapiens
ctggctgggacg

SEQ ID NO: 2464526 - DNA, 17 bp, Homo sapiens
ctggctggtagagcagg

SEQ ID NO: 2464527 - DNA, 12 bp, Homo sapiens
ctggctggtgtt

SEQ ID NO: 2464528 - DNA, 21 bp, Homo sapiens
ctggctggtgttaacagaagg

SEQ ID NO: 2464529 - DNA, 22 bp, Homo sapiens
ctggctggtgttaacagaaggg

SEQ ID NO: 2464530 - DNA, 15 bp, Homo sapiens
ctggctgtaaggctc

SEQ ID NO: 2464531 - DNA, 17 bp, Homo sapiens
ctggctgtaaggctcta

SEQ ID NO: 2464532 - DNA, 19 bp, Homo sapiens
ctggctgtaaggctctaga

SEQ ID NO: 2464533 - DNA, 20 bp, Homo sapiens
ctggctgtaaggctctagat

SEQ ID NO: 2464534 - DNA, 20 bp, Homo sapiens
ctggcttcccatccccagcg

SEQ ID NO: 2464535 - DNA, 23 bp, Homo sapiens
ctgggaaaaactttggaaccaga

SEQ ID NO: 2464536 - DNA, 16 bp, Homo sapiens
ctgggaaatattccct

SEQ ID NO: 2464537 - DNA, 14 bp, Homo sapiens
ctgggaaatgagat

SEQ ID NO: 2464538 - DNA, 18 bp, Homo sapiens
ctgggacaactgctccca

SEQ ID NO: 2464539 - DNA, 22 bp, Homo sapiens
ctgggaccacaggttcatgcca

SEQ ID NO: 2464540 - DNA, 24 bp, Homo sapiens
ctgggaccgctacaccactctggc

SEQ ID NO: 2464541 - DNA, 15 bp, Homo sapiens
ctgggacgtggctca

SEQ ID NO: 2464542 - DNA, 13 bp, Homo sapiens
ctgggactcagcc

SEQ ID NO: 2464543 - DNA, 13 bp, Homo sapiens
ctgggagaaatct

SEQ ID NO: 2464544 - DNA, 20 bp, Homo sapiens
ctgggagaaatctggcttct

SEQ ID NO: 2464545 - DNA, 13 bp, Homo sapiens
ctgggagaggcag

SEQ ID NO: 2464546 - DNA, 15 bp, Homo sapiens
ctgggagaggcagcc

SEQ ID NO: 2464547 - DNA, 20 bp, Homo sapiens
ctgggagaggcagcccagga

SEQ ID NO: 2464548 - DNA, 19 bp, Homo sapiens
ctgggagattcaagggacc

SEQ ID NO: 2464549 - DNA, 17 bp, Homo sapiens
ctgggagcccccagcct

SEQ ID NO: 2464550 - DNA, 18 bp, Homo sapiens
ctgggagcccccagcctg

SEQ ID NO: 2464551 - DNA, 20 bp, Homo sapiens
ctgggagctccactctgctt

SEQ ID NO: 2464552 - DNA, 21 bp, Homo sapiens
ctgggagctccactctgcttc

SEQ ID NO: 2464553 - DNA, 22 bp, Homo sapiens
ctgggaggaaggacttccctgt

SEQ ID NO: 2464554 - DNA, 17 bp, Homo sapiens
ctgggaggctccccttc

SEQ ID NO: 2464555 - DNA, 17 bp, Homo sapiens
ctgggagggcagcaggg

SEQ ID NO: 2464556 - DNA, 19 bp, Homo sapiens
ctgggagggcagcagggct

SEQ ID NO: 2464557 - DNA, 23 bp, Homo sapiens
ctgggagtagttgtctttcctgg

SEQ ID NO: 2464558 - DNA, 14 bp, Homo sapiens
ctgggagtcacaca

SEQ ID NO: 2464559 - DNA, 22 bp, Homo sapiens
ctgggagtcacacagtgttgga

SEQ ID NO: 2464560 - DNA, 23 bp, Homo sapiens
ctgggattccttagactcttttc

SEQ ID NO: 2464561 - DNA, 18 bp, Homo sapiens
ctgggccatgtccaaaga

SEQ ID NO: 2464562 - DNA, 19 bp, Homo sapiens
ctgggccatgtccaaagag

SEQ ID NO: 2464563 - DNA, 23 bp, Homo sapiens
ctgggccatgtccaaagaggctg

SEQ ID NO: 2464564 - DNA, 19 bp, Homo sapiens
ctgggccattctccacagc

SEQ ID NO: 2464565 - DNA, 20 bp, Homo sapiens
ctgggccattctccacagca

SEQ ID NO: 2464566 - DNA, 18 bp, Homo sapiens
ctgggccctctctgctct

SEQ ID NO: 2464567 - DNA, 13 bp, Homo sapiens
ctgggccctgggc

SEQ ID NO: 2464568 - DNA, 15 bp, Homo sapiens
ctgggccgctgccac

SEQ ID NO: 2464569 - DNA, 16 bp, Homo sapiens
ctgggccgctgccacg

SEQ ID NO: 2464570 - DNA, 12 bp, Homo sapiens
ctgggcctatgg

SEQ ID NO: 2464571 - DNA, 19 bp, Homo sapiens
ctgggcctatggagagccc

SEQ ID NO: 2464572 - DNA, 21 bp, Homo sapiens
ctgggcctatggagagccctg

SEQ ID NO: 2464573 - DNA, 15 bp, Homo sapiens
ctgggcctgcctcac

SEQ ID NO: 2464574 - DNA, 16 bp, Homo sapiens
ctgggcctgcctcacc

SEQ ID NO: 2464575 - DNA, 18 bp, Homo sapiens
ctgggcctgctgctgaga

SEQ ID NO: 2464576 - DNA, 22 bp, Homo sapiens
ctgggcctgctgctgagaacct

SEQ ID NO: 2464577 - DNA, 21 bp, Homo sapiens
ctctattatgaatgtgaagcc

SEQ ID NO: 2464578 - DNA, 22 bp, Homo sapiens
ctctattatgaatgtgaagcct

SEQ ID NO: 2464579 - DNA, 20 bp, Homo sapiens
ctctattcgccacacagtat

SEQ ID NO: 2464580 - DNA, 14 bp, Homo sapiens
ctctcacctggccc

SEQ ID NO: 2464581 - DNA, 13 bp, Homo sapiens
ctctcagccctca

SEQ ID NO: 2464582 - DNA, 12 bp, Homo sapiens
ctctcagctcca

SEQ ID NO: 2464583 - DNA, 19 bp, Homo sapiens
ctctcagggccaggcctct

SEQ ID NO: 2464584 - DNA, 18 bp, Homo sapiens
ctctcaggtgaaaggaaa

SEQ ID NO: 2464585 - DNA, 17 bp, Homo sapiens
ctctcagtctctgagca

SEQ ID NO: 2464586 - DNA, 17 bp, Homo sapiens
ctctcatttagcctgtc

SEQ ID NO: 2464587 - DNA, 18 bp, Homo sapiens
ctctccactttcagctgt

SEQ ID NO: 2464588 - DNA, 14 bp, Homo sapiens
ctctccagctgact

SEQ ID NO: 2464589 - DNA, 17 bp, Homo sapiens
ctctccattctgctcct

SEQ ID NO: 2464590 - DNA, 13 bp, Homo sapiens
ctctcccaactct

SEQ ID NO: 2464591 - DNA, 14 bp, Homo sapiens
ctctcccaccctct

SEQ ID NO: 2464592 - DNA, 16 bp, Homo sapiens
ctctcccaccctcttc

SEQ ID NO: 2464593 - DNA, 21 bp, Homo sapiens
ctctcccaccctcttcctact

SEQ ID NO: 2464594 - DNA, 16 bp, Homo sapiens
ctctcccaggccccat

SEQ ID NO: 2464595 - DNA, 19 bp, Homo sapiens
ctctcccaggccccatgac

SEQ ID NO: 2464596 - DNA, 21 bp, Homo sapiens
ctctcccaggccccatgacct

SEQ ID NO: 2464597 - DNA, 12 bp, Homo sapiens
ctctcccagttg

SEQ ID NO: 2464598 - DNA, 11 bp, Homo sapiens
ctctccccagc

SEQ ID NO: 2464599 - DNA, 17 bp, Homo sapiens
ctctccccagcccagag

SEQ ID NO: 2464600 - DNA, 19 bp, Homo sapiens
ctctccccagcccagagac

SEQ ID NO: 2464601 - DNA, 20 bp, Homo sapiens
ctctccccagggaagcagca

SEQ ID NO: 2464602 - DNA, 20 bp, Homo sapiens
ctctccccaggtccagctct

SEQ ID NO: 2464603 - DNA, 17 bp, Homo sapiens
ctctccccctatttatt

SEQ ID NO: 2464604 - DNA, 20 bp, Homo sapiens
ctctccccctatttattgac

SEQ ID NO: 2464605 - DNA, 17 bp, Homo sapiens
ctctcccctgacctgtg

SEQ ID NO: 2464606 - DNA, 15 bp, Homo sapiens
ctctcccctgccccc

SEQ ID NO: 2464607 - DNA, 19 bp, Homo sapiens
ctctcccctgccccctgca

SEQ ID NO: 2464608 - DNA, 23 bp, Homo sapiens
ctctcccggaggttgggtgggcc

SEQ ID NO: 2464609 - DNA, 16 bp, Homo sapiens
ctctcccttgggctct

SEQ ID NO: 2464610 - DNA, 21 bp, Homo sapiens
ctctcctaggcattctggacc

SEQ ID NO: 2464611 - DNA, 12 bp, Homo sapiens
ctctcctggctt

SEQ ID NO: 2464612 - DNA, 16 bp, Homo sapiens
ctctcctggcttccca

SEQ ID NO: 2464613 - DNA, 15 bp, Homo sapiens
ctctcggctccccat

SEQ ID NO: 2464614 - DNA, 16 bp, Homo sapiens
ctctcggctccccatg

SEQ ID NO: 2464615 - DNA, 17 bp, Homo sapiens
ctctcggctccccatgt

SEQ ID NO: 2464616 - DNA, 16 bp, Homo sapiens
ctctctacagtctcgt

SEQ ID NO: 2464617 - DNA, 12 bp, Homo sapiens
ctctctgctctg

SEQ ID NO: 2464618 - DNA, 22 bp, Homo sapiens
ctctctgctctgcgtgtcacct

SEQ ID NO: 2464619 - DNA, 12 bp, Homo sapiens
ctctctggagaa

SEQ ID NO: 2464620 - DNA, 19 bp, Homo sapiens
ctctctttatacagctgta

SEQ ID NO: 2464621 - DNA, 23 bp, Homo sapiens
ctctctttgcccagttggagact

SEQ ID NO: 2464622 - DNA, 23 bp, Homo sapiens
ctctgacagcagcatctctacct

SEQ ID NO: 2464623 - DNA, 16 bp, Homo sapiens
ctctgactcagggctc

SEQ ID NO: 2464624 - DNA, 17 bp, Homo sapiens
ctctgactcagggctcc

SEQ ID NO: 2464625 - DNA, 16 bp, Homo sapiens
ctctgacttctgcctg

SEQ ID NO: 2464626 - DNA, 17 bp, Homo sapiens
ctctgacttctgcctgg

SEQ ID NO: 2464627 - DNA, 15 bp, Homo sapiens
ctctgagaggccctg

SEQ ID NO: 2464628 - DNA, 13 bp, Homo sapiens
ctctgagcgcctc

SEQ ID NO: 2464629 - DNA, 13 bp, Homo sapiens
ctctgagctgtca

SEQ ID NO: 2464630 - DNA, 19 bp, Homo sapiens
ctctgagctgtcaacgaga

SEQ ID NO: 2464631 - DNA, 12 bp, Homo sapiens
ctctgaggacaa

SEQ ID NO: 2464632 - DNA, 14 bp, Homo sapiens
ctctgaggccagcc

SEQ ID NO: 2464633 - DNA, 21 bp, Homo sapiens
ctctgaggccagcctggcctc

SEQ ID NO: 2464634 - DNA, 21 bp, Homo sapiens
ctctgaggcgccccaacccgt

SEQ ID NO: 2464635 - DNA, 22 bp, Homo sapiens
ctctgaggcgccccaacccgtg

SEQ ID NO: 2464636 - DNA, 15 bp, Homo sapiens
ctctgaggtgcctgt

SEQ ID NO: 2464637 - DNA, 17 bp, Homo sapiens
ctctgagtgttttatga

SEQ ID NO: 2464638 - DNA, 14 bp, Homo sapiens
ctctgataagagaa

SEQ ID NO: 2464639 - DNA, 14 bp, Homo sapiens
ctctgatgcagctt

SEQ ID NO: 2464640 - DNA, 20 bp, Homo sapiens
ctctgatgcatcagaaaggg

SEQ ID NO: 2464641 - DNA, 16 bp, Homo sapiens
ctctgcaattcccctc

SEQ ID NO: 2464642 - DNA, 17 bp, Homo sapiens
ctctgcaattcccctct

SEQ ID NO: 2464643 - DNA, 18 bp, Homo sapiens
ctctgcactactgacatg

SEQ ID NO: 2464644 - DNA, 22 bp, Homo sapiens
ctctgcactactgacatgtggg

SEQ ID NO: 2464645 - DNA, 20 bp, Homo sapiens
ctctgcactcccacctgaca

SEQ ID NO: 2464646 - DNA, 23 bp, Homo sapiens
ctctgcactcccacctgacacac

SEQ ID NO: 2464647 - DNA, 17 bp, Homo sapiens
ctctgcagacttcccag

SEQ ID NO: 2464648 - DNA, 18 bp, Homo sapiens
ctctgcagacttcccagc

SEQ ID NO: 2464649 - DNA, 15 bp, Homo sapiens
ctctgcagcctcaga

SEQ ID NO: 2464650 - DNA, 16 bp, Homo sapiens
ctctgcagcctcagag

SEQ ID NO: 2464651 - DNA, 15 bp, Homo sapiens
ctctgcagtcccagc

SEQ ID NO: 2464652 - DNA, 17 bp, Homo sapiens
ctctgcatcctctggag

SEQ ID NO: 2464653 - DNA, 14 bp, Homo sapiens
ctctgccaaaggat

SEQ ID NO: 2464654 - DNA, 13 bp, Homo sapiens
ctctgccagtcct

SEQ ID NO: 2464655 - DNA, 13 bp, Homo sapiens
ctctgccagtgac

SEQ ID NO: 2464656 - DNA, 20 bp, Homo sapiens
ctctgccagtgacagacagg

SEQ ID NO: 2464657 - DNA, 14 bp, Homo sapiens
ctctgcccaaccct

SEQ ID NO: 2464658 - DNA, 14 bp, Homo sapiens
ctctgcccaggcac

SEQ ID NO: 2464659 - DNA, 21 bp, Homo sapiens
ctctgcccttgatcagcccca

SEQ ID NO: 2464660 - DNA, 18 bp, Homo sapiens
ctctgctattaggccagc

SEQ ID NO: 2464661 - DNA, 16 bp, Homo sapiens
ctctgctgacctgctg

SEQ ID NO: 2464662 - DNA, 16 bp, Homo sapiens
ctctgctgctgtccct

SEQ ID NO: 2464663 - DNA, 22 bp, Homo sapiens
ctctgctgctgtccctccccct

SEQ ID NO: 2464664 - DNA, 14 bp, Homo sapiens
ctctgctggcccag

SEQ ID NO: 2464665 - DNA, 15 bp, Homo sapiens
ctctggagcatttct

SEQ ID NO: 2464666 - DNA, 13 bp, Homo sapiens
ctctggagccagc

SEQ ID NO: 2464667 - DNA, 21 bp, Homo sapiens
ctctggagccagccgagcagg

SEQ ID NO: 2464668 - DNA, 13 bp, Homo sapiens
ctctggcagccac

SEQ ID NO: 2464669 - DNA, 14 bp, Homo sapiens
ctctggcagccaca

SEQ ID NO: 2464670 - DNA, 23 bp, Homo sapiens
ctctggcattagaattatttaaa

SEQ ID NO: 2464671 - DNA, 13 bp, Homo sapiens
ctctgggctctga

SEQ ID NO: 2464672 - DNA, 15 bp, Homo sapiens
ctctgggctctgagt

SEQ ID NO: 2464673 - DNA, 19 bp, Homo sapiens
ctctgggctggatgagctc

SEQ ID NO: 2464674 - DNA, 21 bp, Homo sapiens
ctctgggctggatgagctccc

SEQ ID NO: 2464675 - DNA, 20 bp, Homo sapiens
ctctggggggtggccaggcc

SEQ ID NO: 2464676 - DNA, 18 bp, Homo sapiens
ctctggtcgctcctgccc

SEQ ID NO: 2464677 - DNA, 14 bp, Homo sapiens
ctctggtgcctcca

SEQ ID NO: 2464678 - DNA, 18 bp, Homo sapiens
ctctggttgtttctgttc

SEQ ID NO: 2464679 - DNA, 23 bp, Homo sapiens
ctctggttgtttctgttccaaat

SEQ ID NO: 2464680 - DNA, 14 bp, Homo sapiens
ctctgtaattgcaa

SEQ ID NO: 2464681 - DNA, 15 bp, Homo sapiens
ctctgtaattgcaaa

SEQ ID NO: 2464682 - DNA, 15 bp, Homo sapiens
ctctaacgcctgagc

SEQ ID NO: 2464683 - DNA, 20 bp, Homo sapiens
ctctaacgcctgagcccagg

SEQ ID NO: 2464684 - DNA, 14 bp, Homo sapiens
ctctaagatcttag

SEQ ID NO: 2464685 - DNA, 14 bp, Homo sapiens
ctctaaggttgggc

SEQ ID NO: 2464686 - DNA, 15 bp, Homo sapiens
ctctaatacattcca

SEQ ID NO: 2464687 - DNA, 15 bp, Homo sapiens
ctctaattcacagtg

SEQ ID NO: 2464688 - DNA, 16 bp, Homo sapiens
ctctaattcacagtgc

SEQ ID NO: 2464689 - DNA, 18 bp, Homo sapiens
ctctaattctattaaagt

SEQ ID NO: 2464690 - DNA, 18 bp, Homo sapiens
ctctacagagcttccctg

SEQ ID NO: 2464691 - DNA, 20 bp, Homo sapiens
ctctacagagcttccctgac

SEQ ID NO: 2464692 - DNA, 16 bp, Homo sapiens
ctctacccatattaca

SEQ ID NO: 2464693 - DNA, 14 bp, Homo sapiens
ctctaccccaattt

SEQ ID NO: 2464694 - DNA, 12 bp, Homo sapiens
ctctacctgaca

SEQ ID NO: 2464695 - DNA, 16 bp, Homo sapiens
ctctaccttctcccca

SEQ ID NO: 2464696 - DNA, 18 bp, Homo sapiens
ctctaccttctccccagc

SEQ ID NO: 2464697 - DNA, 21 bp, Homo sapiens
ctctactaacaatcagctcct

SEQ ID NO: 2464698 - DNA, 17 bp, Homo sapiens
ctctactgaatgtcatt

SEQ ID NO: 2464699 - DNA, 12 bp, Homo sapiens
ctctactgggaa

SEQ ID NO: 2464700 - DNA, 16 bp, Homo sapiens
ctctactgggaaggct

SEQ ID NO: 2464701 - DNA, 17 bp, Homo sapiens
ctctacttaatccaatg

SEQ ID NO: 2464702 - DNA, 18 bp, Homo sapiens
ctctacttaatccaatgg

SEQ ID NO: 2464703 - DNA, 12 bp, Homo sapiens
ctctagaatctg

SEQ ID NO: 2464704 - DNA, 15 bp, Homo sapiens
ctctagagtccaagg

SEQ ID NO: 2464705 - DNA, 16 bp, Homo sapiens
ctctagctgtgggggt

SEQ ID NO: 2464706 - DNA, 23 bp, Homo sapiens
ctctaggtacgatgacagtgttc

SEQ ID NO: 2464707 - DNA, 13 bp, Homo sapiens
ctctagttctttg

SEQ ID NO: 2464708 - DNA, 14 bp, Homo sapiens
ctctattatgaatg

SEQ ID NO: 2464709 - DNA, 21 bp, Homo sapiens
cgtgtgagaagtgaatgctgg

SEQ ID NO: 2464710 - DNA, 23 bp, Homo sapiens
cgtgtgagaagtgaatgctggga

SEQ ID NO: 2464711 - DNA, 16 bp, Homo sapiens
cgtgttctccttttcc

SEQ ID NO: 2464712 - DNA, 21 bp, Homo sapiens
cgtgtttgggtttttttcctt

SEQ ID NO: 2464713 - DNA, 15 bp, Homo sapiens
cgttagctcctgtgg

SEQ ID NO: 2464714 - DNA, 16 bp, Homo sapiens
cgttagctcctgtggc

SEQ ID NO: 2464715 - DNA, 23 bp, Homo sapiens
cgttcctagagaagacaggctgg

SEQ ID NO: 2464716 - DNA, 13 bp, Homo sapiens
cgttctctctttg

SEQ ID NO: 2464717 - DNA, 13 bp, Homo sapiens
cgttcttgtaatt

SEQ ID NO: 2464718 - DNA, 14 bp, Homo sapiens
cgttcttgtaattt

SEQ ID NO: 2464719 - DNA, 15 bp, Homo sapiens
cgttcttgtaatttt

SEQ ID NO: 2464720 - DNA, 12 bp, Homo sapiens
cgttgcccccat

SEQ ID NO: 2464721 - DNA, 21 bp, Homo sapiens
cgttgcccccatttctgaggt

SEQ ID NO: 2464722 - DNA, 22 bp, Homo sapiens
cgtttcatttagtcatgtgacc

SEQ ID NO: 2464723 - DNA, 19 bp, Homo sapiens
cgtttgtttgtttgtttaa

SEQ ID NO: 2464724 - DNA, 13 bp, Homo sapiens
cgttttaaaaaag

SEQ ID NO: 2464725 - DNA, 13 bp, Homo sapiens
ctaaaagaaactt

SEQ ID NO: 2464726 - DNA, 17 bp, Homo sapiens
ctaaaatcttatagttc

SEQ ID NO: 2464727 - DNA, 19 bp, Homo sapiens
ctaaaatgtgatgttctaa

SEQ ID NO: 2464728 - DNA, 18 bp, Homo sapiens
ctaaacacgtgacacaaa

SEQ ID NO: 2464729 - DNA, 16 bp, Homo sapiens
ctaaacccaatccaaa

SEQ ID NO: 2464730 - DNA, 17 bp, Homo sapiens
ctaaacggattccaaag

SEQ ID NO: 2464731 - DNA, 14 bp, Homo sapiens
ctaaactggagact

SEQ ID NO: 2464732 - DNA, 15 bp, Homo sapiens
ctaaactggagactg

SEQ ID NO: 2464733 - DNA, 21 bp, Homo sapiens
ctaaactttttttctgtacca

SEQ ID NO: 2464734 - DNA, 13 bp, Homo sapiens
ctaaagaaaaaca

SEQ ID NO: 2464735 - DNA, 17 bp, Homo sapiens
ctaaagatggagtttct

SEQ ID NO: 2464736 - DNA, 18 bp, Homo sapiens
ctaaagatggagtttcta

SEQ ID NO: 2464737 - DNA, 17 bp, Homo sapiens
ctaaagattctatagtt

SEQ ID NO: 2464738 - DNA, 23 bp, Homo sapiens
ctaaagattctatagttctagac

SEQ ID NO: 2464739 - DNA, 11 bp, Homo sapiens
ctaaagccaaa

SEQ ID NO: 2464740 - DNA, 14 bp, Homo sapiens
ctaaagcctttatt

SEQ ID NO: 2464741 - DNA, 19 bp, Homo sapiens
ctaaaggaaaaaaccatcc

SEQ ID NO: 2464742 - DNA, 13 bp, Homo sapiens
ctaaaggagttta

SEQ ID NO: 2464743 - DNA, 15 bp, Homo sapiens
ctaaaggtccacagg

SEQ ID NO: 2464744 - DNA, 13 bp, Homo sapiens
ctaaagttctaag

SEQ ID NO: 2464745 - DNA, 14 bp, Homo sapiens
ctaaagttctaaga

SEQ ID NO: 2464746 - DNA, 20 bp, Homo sapiens
ctaaagttctaagattctga

SEQ ID NO: 2464747 - DNA, 13 bp, Homo sapiens
ctaaataaaatgc

SEQ ID NO: 2464748 - DNA, 22 bp, Homo sapiens
ctaaataaaatgctaggttcta

SEQ ID NO: 2464749 - DNA, 23 bp, Homo sapiens
ctaaataaagcttgcaacaaaat

SEQ ID NO: 2464750 - DNA, 22 bp, Homo sapiens
ctaaatatggactgctcaggaa

SEQ ID NO: 2464751 - DNA, 21 bp, Homo sapiens
ctaaatcctttactgttagtc

SEQ ID NO: 2464752 - DNA, 20 bp, Homo sapiens
ctaaatcttttataggattt

SEQ ID NO: 2464753 - DNA, 16 bp, Homo sapiens
ctaaatgaatgtttac

SEQ ID NO: 2464754 - DNA, 17 bp, Homo sapiens
ctaaatggcctcatgtg

SEQ ID NO: 2464755 - DNA, 17 bp, Homo sapiens
ctaaattttcctgtcct

SEQ ID NO: 2464756 - DNA, 19 bp, Homo sapiens
ctaaattttcctgtcctct

SEQ ID NO: 2464757 - DNA, 12 bp, Homo sapiens
ctaacagccctc

SEQ ID NO: 2464758 - DNA, 22 bp, Homo sapiens
ctaacagccctcctctgcactc

SEQ ID NO: 2464759 - DNA, 15 bp, Homo sapiens
ctaacagggaaggca

SEQ ID NO: 2464760 - DNA, 18 bp, Homo sapiens
ctaacagggaaggcaggc

SEQ ID NO: 2464761 - DNA, 12 bp, Homo sapiens
ctaacatataat

SEQ ID NO: 2464762 - DNA, 17 bp, Homo sapiens
ctaacatgtcctgccta

SEQ ID NO: 2464763 - DNA, 21 bp, Homo sapiens
ctaaccaagctgagtttccta

SEQ ID NO: 2464764 - DNA, 15 bp, Homo sapiens
ctaacctcatcttct

SEQ ID NO: 2464765 - DNA, 13 bp, Homo sapiens
ctaaccttgcctg

SEQ ID NO: 2464766 - DNA, 16 bp, Homo sapiens
ctaaccttgcctggta

SEQ ID NO: 2464767 - DNA, 20 bp, Homo sapiens
ctaaccttgcctggtacagt

SEQ ID NO: 2464768 - DNA, 14 bp, Homo sapiens
ctaacgcctgagcc

SEQ ID NO: 2464769 - DNA, 15 bp, Homo sapiens
ctaacgcctgagccc

SEQ ID NO: 2464770 - DNA, 19 bp, Homo sapiens
ctaacgcctgagcccaggg

SEQ ID NO: 2464771 - DNA, 20 bp, Homo sapiens
ctaacgcctgagcccaggga

SEQ ID NO: 2464772 - DNA, 19 bp, Homo sapiens
ctaacggtgctcagggggc

SEQ ID NO: 2464773 - DNA, 17 bp, Homo sapiens
ctaacgttgagcccctg

SEQ ID NO: 2464774 - DNA, 19 bp, Homo sapiens
ctaactacaaaggtttaaa

SEQ ID NO: 2464775 - DNA, 15 bp, Homo sapiens
ctaacttggctcaca

SEQ ID NO: 2464776 - DNA, 20 bp, Homo sapiens
ctaagaaacatttatattga

SEQ ID NO: 2464777 - DNA, 16 bp, Homo sapiens
ctaagactcaaatgtt

SEQ ID NO: 2464778 - DNA, 22 bp, Homo sapiens
ctaagactcaaatgttctaagt

SEQ ID NO: 2464779 - DNA, 19 bp, Homo sapiens
ctaagacttactctaagat

SEQ ID NO: 2464780 - DNA, 13 bp, Homo sapiens
ctaagagaagtag

SEQ ID NO: 2464781 - DNA, 17 bp, Homo sapiens
ctaagagaagtagaaat

SEQ ID NO: 2464782 - DNA, 19 bp, Homo sapiens
ctaagagaagtagaaatca

SEQ ID NO: 2464783 - DNA, 23 bp, Homo sapiens
ctaagaggctgccctcctgtgct

SEQ ID NO: 2464784 - DNA, 22 bp, Homo sapiens
ctaagagtgctgggcattttta

SEQ ID NO: 2464785 - DNA, 12 bp, Homo sapiens
ctaagatcttag

SEQ ID NO: 2464786 - DNA, 14 bp, Homo sapiens
ctaagatcttagat

SEQ ID NO: 2464787 - DNA, 20 bp, Homo sapiens
ctaagatcttagattctctg

SEQ ID NO: 2464788 - DNA, 19 bp, Homo sapiens
ctaagatgtgatattctaa

SEQ ID NO: 2464789 - DNA, 21 bp, Homo sapiens
ctaagatgtgatattctaaga

SEQ ID NO: 2464790 - DNA, 23 bp, Homo sapiens
ctaagatgtgatattctaagact

SEQ ID NO: 2464791 - DNA, 23 bp, Homo sapiens
ctaagattacaaatcagaagtca

SEQ ID NO: 2464792 - DNA, 14 bp, Homo sapiens
ctaagattctaaag

SEQ ID NO: 2464793 - DNA, 15 bp, Homo sapiens
ctaagattctaatga

SEQ ID NO: 2464794 - DNA, 13 bp, Homo sapiens
ctaagattctaga

SEQ ID NO: 2464795 - DNA, 16 bp, Homo sapiens
ctaagattctagatca

SEQ ID NO: 2464796 - DNA, 16 bp, Homo sapiens
ctaagcagaaagtgcc

SEQ ID NO: 2464797 - DNA, 19 bp, Homo sapiens
ctaagcagaaagtgccttt

SEQ ID NO: 2464798 - DNA, 15 bp, Homo sapiens
ctaagcatctaagtt

SEQ ID NO: 2464799 - DNA, 22 bp, Homo sapiens
ctcagccccaccccagggcagc

SEQ ID NO: 2464800 - DNA, 17 bp, Homo sapiens
ctcagccctcacacacc

SEQ ID NO: 2464801 - DNA, 16 bp, Homo sapiens
ctcagccctgaggaca

SEQ ID NO: 2464802 - DNA, 16 bp, Homo sapiens
ctcagcctgaacccca

SEQ ID NO: 2464803 - DNA, 20 bp, Homo sapiens
ctcagcctggccagacacag

SEQ ID NO: 2464804 - DNA, 22 bp, Homo sapiens
ctcagccttgccagagatccaa

SEQ ID NO: 2464805 - DNA, 19 bp, Homo sapiens
ctcagctccaggtggctct

SEQ ID NO: 2464806 - DNA, 13 bp, Homo sapiens
ctcagctcccaca

SEQ ID NO: 2464807 - DNA, 18 bp, Homo sapiens
ctcagctcccacaagcct

SEQ ID NO: 2464808 - DNA, 23 bp, Homo sapiens
ctcagctctgggccattctccac

SEQ ID NO: 2464809 - DNA, 19 bp, Homo sapiens
ctcagctgtcaaggctcag

SEQ ID NO: 2464810 - DNA, 22 bp, Homo sapiens
ctcaggaaacgagactttccat

SEQ ID NO: 2464811 - DNA, 14 bp, Homo sapiens
ctcaggacacaggc

SEQ ID NO: 2464812 - DNA, 18 bp, Homo sapiens
ctcaggacacaggcctgt

SEQ ID NO: 2464813 - DNA, 14 bp, Homo sapiens
ctcaggactgcgac

SEQ ID NO: 2464814 - DNA, 23 bp, Homo sapiens
ctcaggactgggagcccccagcc

SEQ ID NO: 2464815 - DNA, 20 bp, Homo sapiens
ctcaggagcccgatggggaa

SEQ ID NO: 2464816 - DNA, 14 bp, Homo sapiens
ctcaggagcctgtg

SEQ ID NO: 2464817 - DNA, 17 bp, Homo sapiens
ctcaggaggcaggacct

SEQ ID NO: 2464818 - DNA, 18 bp, Homo sapiens
ctcaggaggcaggacctt

SEQ ID NO: 2464819 - DNA, 12 bp, Homo sapiens
ctcaggatccaa

SEQ ID NO: 2464820 - DNA, 14 bp, Homo sapiens
ctcaggcacacagc

SEQ ID NO: 2464821 - DNA, 20 bp, Homo sapiens
ctcaggccaagaaacgtctt

SEQ ID NO: 2464822 - DNA, 21 bp, Homo sapiens
ctcaggcgatccacctgtctc

SEQ ID NO: 2464823 - DNA, 19 bp, Homo sapiens
ctcaggctaggccagcagg

SEQ ID NO: 2464824 - DNA, 14 bp, Homo sapiens
ctcaggctgcctga

SEQ ID NO: 2464825 - DNA, 17 bp, Homo sapiens
ctcagggaccatggctt

SEQ ID NO: 2464826 - DNA, 17 bp, Homo sapiens
ctcagggccatgctgag

SEQ ID NO: 2464827 - DNA, 18 bp, Homo sapiens
ctcagggccatgctgagg

SEQ ID NO: 2464828 - DNA, 20 bp, Homo sapiens
ctcagggccatgctgaggcc

SEQ ID NO: 2464829 - DNA, 14 bp, Homo sapiens
ctcagggctccttg

SEQ ID NO: 2464830 - DNA, 19 bp, Homo sapiens
ctcagggggcgcctgtggt

SEQ ID NO: 2464831 - DNA, 15 bp, Homo sapiens
ctcaggtacttgtaa

SEQ ID NO: 2464832 - DNA, 20 bp, Homo sapiens
ctcaggtccctggggctagg

SEQ ID NO: 2464833 - DNA, 13 bp, Homo sapiens
ctcagtaccccat

SEQ ID NO: 2464834 - DNA, 17 bp, Homo sapiens
ctcagtctctcttctct

SEQ ID NO: 2464835 - DNA, 13 bp, Homo sapiens
ctcagtctctgag

SEQ ID NO: 2464836 - DNA, 20 bp, Homo sapiens
ctcagtgaagttgctgcttc

SEQ ID NO: 2464837 - DNA, 20 bp, Homo sapiens
ctcagtgaccctggctcctt

SEQ ID NO: 2464838 - DNA, 16 bp, Homo sapiens
ctcagttgattttctg

SEQ ID NO: 2464839 - DNA, 18 bp, Homo sapiens
ctcagttgattttctgga

SEQ ID NO: 2464840 - DNA, 20 bp, Homo sapiens
ctcagttgtgactaactaga

SEQ ID NO: 2464841 - DNA, 17 bp, Homo sapiens
ctcagttttatcatttt

SEQ ID NO: 2464842 - DNA, 18 bp, Homo sapiens
ctcatagcaatacttgga

SEQ ID NO: 2464843 - DNA, 19 bp, Homo sapiens
ctcatagcaatacttggag

SEQ ID NO: 2464844 - DNA, 15 bp, Homo sapiens
ctcatcattctctgt

SEQ ID NO: 2464845 - DNA, 18 bp, Homo sapiens
ctcatcattctctgtctc

SEQ ID NO: 2464846 - DNA, 20 bp, Homo sapiens
ctcatcattctctgtctcat

SEQ ID NO: 2464847 - DNA, 22 bp, Homo sapiens
ctcatcattctctgtctcatcc

SEQ ID NO: 2464848 - DNA, 18 bp, Homo sapiens
ctcatccacataccctga

SEQ ID NO: 2464849 - DNA, 20 bp, Homo sapiens
ctcatccacataccctgacc

SEQ ID NO: 2464850 - DNA, 22 bp, Homo sapiens
ctcatccactctactaatgcct

SEQ ID NO: 2464851 - DNA, 19 bp, Homo sapiens
ctcatccatcatcatgtgt

SEQ ID NO: 2464852 - DNA, 12 bp, Homo sapiens
ctcatcctcctt

SEQ ID NO: 2464853 - DNA, 14 bp, Homo sapiens
ctcatcctccttct

SEQ ID NO: 2464854 - DNA, 17 bp, Homo sapiens
ctcatctctctgcccaa

SEQ ID NO: 2464855 - DNA, 13 bp, Homo sapiens
ctcatctcttcag

SEQ ID NO: 2464856 - DNA, 20 bp, Homo sapiens
ctcatctgctggtccgtggg

SEQ ID NO: 2464857 - DNA, 12 bp, Homo sapiens
ctcatctgggga

SEQ ID NO: 2464858 - DNA, 19 bp, Homo sapiens
ctcatctggggagcaggca

SEQ ID NO: 2464859 - DNA, 17 bp, Homo sapiens
ctcatcttcttcaccat

SEQ ID NO: 2464860 - DNA, 14 bp, Homo sapiens
ctcatgaatgtaaa

SEQ ID NO: 2464861 - DNA, 16 bp, Homo sapiens
ctcatgaatgtaaatt

SEQ ID NO: 2464862 - DNA, 18 bp, Homo sapiens
ctcatgataccaccttta

SEQ ID NO: 2464863 - DNA, 21 bp, Homo sapiens
ctcatgataccacctttactg

SEQ ID NO: 2464864 - DNA, 20 bp, Homo sapiens
ctcatggcccctctgacctg

SEQ ID NO: 2464865 - DNA, 15 bp, Homo sapiens
ctcatgggtggcact

SEQ ID NO: 2464866 - DNA, 15 bp, Homo sapiens
ctcatgtggctggaa

SEQ ID NO: 2464867 - DNA, 19 bp, Homo sapiens
ctcattggaaatttagcat

SEQ ID NO: 2464868 - DNA, 19 bp, Homo sapiens
ctcattgtctgtgtagagt

SEQ ID NO: 2464869 - DNA, 13 bp, Homo sapiens
ctcatttaatcct

SEQ ID NO: 2464870 - DNA, 19 bp, Homo sapiens
ctcatttaatcctcccttc

SEQ ID NO: 2464871 - DNA, 19 bp, Homo sapiens
ctcatttagcctgtcctgt

SEQ ID NO: 2464872 - DNA, 15 bp, Homo sapiens
ctccaaaatgtgcct

SEQ ID NO: 2464873 - DNA, 16 bp, Homo sapiens
ctccaaaatgtgccta

SEQ ID NO: 2464874 - DNA, 21 bp, Homo sapiens
ctccaaagtcataattgcatt

SEQ ID NO: 2464875 - DNA, 22 bp, Homo sapiens
ctccaacaccaagcacagcagc

SEQ ID NO: 2464876 - DNA, 13 bp, Homo sapiens
ctccaacctgcaa

SEQ ID NO: 2464877 - DNA, 21 bp, Homo sapiens
ctccaacctgcaaagatctgt

SEQ ID NO: 2464878 - DNA, 14 bp, Homo sapiens
ctccaagagctaca

SEQ ID NO: 2464879 - DNA, 17 bp, Homo sapiens
ctccaagattctagatg

SEQ ID NO: 2464880 - DNA, 13 bp, Homo sapiens
ctatgcatggtgc

SEQ ID NO: 2464881 - DNA, 23 bp, Homo sapiens
ctatgcatggtgccccaggacca

SEQ ID NO: 2464882 - DNA, 15 bp, Homo sapiens
ctatgcatggtttca

SEQ ID NO: 2464883 - DNA, 16 bp, Homo sapiens
ctatgcctctctacag

SEQ ID NO: 2464884 - DNA, 11 bp, Homo sapiens
ctatgctttga

SEQ ID NO: 2464885 - DNA, 15 bp, Homo sapiens
ctatgctttgaaaca

SEQ ID NO: 2464886 - DNA, 15 bp, Homo sapiens
ctatggagagccctg

SEQ ID NO: 2464887 - DNA, 21 bp, Homo sapiens
ctatggagagccctgggaccg

SEQ ID NO: 2464888 - DNA, 14 bp, Homo sapiens
ctatggcctcatgt

SEQ ID NO: 2464889 - DNA, 23 bp, Homo sapiens
ctatggggaaggttatcagtgct

SEQ ID NO: 2464890 - DNA, 14 bp, Homo sapiens
ctatggtgctctgt

SEQ ID NO: 2464891 - DNA, 17 bp, Homo sapiens
ctatggtgctctgtcta

SEQ ID NO: 2464892 - DNA, 16 bp, Homo sapiens
ctatgtttttaatgta

SEQ ID NO: 2464893 - DNA, 20 bp, Homo sapiens
ctatgtttttgttcaaagcc

SEQ ID NO: 2464894 - DNA, 19 bp, Homo sapiens
ctattaaagtgctaaggtt

SEQ ID NO: 2464895 - DNA, 17 bp, Homo sapiens
ctattacattttcagtg

SEQ ID NO: 2464896 - DNA, 22 bp, Homo sapiens
ctattcttgatgtaaaatcttg

SEQ ID NO: 2464897 - DNA, 19 bp, Homo sapiens
ctattgctagagctcctcc

SEQ ID NO: 2464898 - DNA, 22 bp, Homo sapiens
ctattgtgcaatgtaaatattt

SEQ ID NO: 2464899 - DNA, 15 bp, Homo sapiens
ctatttattgacttt

SEQ ID NO: 2464900 - DNA, 14 bp, Homo sapiens
ctatttcactggag

SEQ ID NO: 2464901 - DNA, 16 bp, Homo sapiens
ctatttcactggagca

SEQ ID NO: 2464902 - DNA, 16 bp, Homo sapiens
ctatttctcctccatg

SEQ ID NO: 2464903 - DNA, 12 bp, Homo sapiens
ctattttcagat

SEQ ID NO: 2464904 - DNA, 17 bp, Homo sapiens
ctattttggattgtata

SEQ ID NO: 2464905 - DNA, 17 bp, Homo sapiens
ctattttgtgaagccat

SEQ ID NO: 2464906 - DNA, 20 bp, Homo sapiens
ctatttttctaactacaaag

SEQ ID NO: 2464907 - DNA, 13 bp, Homo sapiens
ctcaaaacaaagg

SEQ ID NO: 2464908 - DNA, 13 bp, Homo sapiens
ctcaaacaatgac

SEQ ID NO: 2464909 - DNA, 21 bp, Homo sapiens
ctcaaacaatgacaaagcaga

SEQ ID NO: 2464910 - DNA, 13 bp, Homo sapiens
ctcaaagaaagtg

SEQ ID NO: 2464911 - DNA, 16 bp, Homo sapiens
ctcaaagaaagtgtat

SEQ ID NO: 2464912 - DNA, 20 bp, Homo sapiens
ctcaaagcatgggattatta

SEQ ID NO: 2464913 - DNA, 22 bp, Homo sapiens
ctcaaaggtttggaaggagcag

SEQ ID NO: 2464914 - DNA, 21 bp, Homo sapiens
ctcaaataaaaagtgcttttg

SEQ ID NO: 2464915 - DNA, 20 bp, Homo sapiens
ctcaaatgagtaacatttgc

SEQ ID NO: 2464916 - DNA, 17 bp, Homo sapiens
ctcaaatggggccagat

SEQ ID NO: 2464917 - DNA, 13 bp, Homo sapiens
ctcaaatgttcta

SEQ ID NO: 2464918 - DNA, 24 bp, Homo sapiens
ctcaaatgttctaagtttctaaga

SEQ ID NO: 2464919 - DNA, 16 bp, Homo sapiens
ctcaacaccatgattc

SEQ ID NO: 2464920 - DNA, 21 bp, Homo sapiens
ctcaacaccatgattccttta

SEQ ID NO: 2464921 - DNA, 22 bp, Homo sapiens
ctcaacaccatgattcctttaa

SEQ ID NO: 2464922 - DNA, 20 bp, Homo sapiens
ctcaacacccaactgtctcg

SEQ ID NO: 2464923 - DNA, 13 bp, Homo sapiens
ctcaacacccagt

SEQ ID NO: 2464924 - DNA, 16 bp, Homo sapiens
ctcaacaggcctcagg

SEQ ID NO: 2464925 - DNA, 21 bp, Homo sapiens
ctcaacaggcctcagggctcc

SEQ ID NO: 2464926 - DNA, 22 bp, Homo sapiens
ctcaacaggcctcagggctcct

SEQ ID NO: 2464927 - DNA, 21 bp, Homo sapiens
ctcaacccctcccctccatcc

SEQ ID NO: 2464928 - DNA, 15 bp, Homo sapiens
ctcaacgtattgttt

SEQ ID NO: 2464929 - DNA, 22 bp, Homo sapiens
ctcaagaaataaaaggaagcca

SEQ ID NO: 2464930 - DNA, 15 bp, Homo sapiens
ctcaagagatcccaa

SEQ ID NO: 2464931 - DNA, 19 bp, Homo sapiens
ctcaagagatcccaagtag

SEQ ID NO: 2464932 - DNA, 16 bp, Homo sapiens
ctcaagcgattctcct

SEQ ID NO: 2464933 - DNA, 22 bp, Homo sapiens
ctcaaggactttgcagccggca

SEQ ID NO: 2464934 - DNA, 17 bp, Homo sapiens
ctcaaggcggtgcttga

SEQ ID NO: 2464935 - DNA, 22 bp, Homo sapiens
ctcaaggttttaggttctaaag

SEQ ID NO: 2464936 - DNA, 15 bp, Homo sapiens
ctcaagtctttctct

SEQ ID NO: 2464937 - DNA, 15 bp, Homo sapiens
ctcaagttctaagat

SEQ ID NO: 2464938 - DNA, 16 bp, Homo sapiens
ctcaatcagtctcaga

SEQ ID NO: 2464939 - DNA, 15 bp, Homo sapiens
ctcaatccctgagga

SEQ ID NO: 2464940 - DNA, 21 bp, Homo sapiens
ctcaatgagcatgtttagact

SEQ ID NO: 2464941 - DNA, 17 bp, Homo sapiens
ctcaatggactggaagg

SEQ ID NO: 2464942 - DNA, 21 bp, Homo sapiens
ctcaattccaacagtttaatg

SEQ ID NO: 2464943 - DNA, 23 bp, Homo sapiens
ctcaattttatccctcacctgta

SEQ ID NO: 2464944 - DNA, 19 bp, Homo sapiens
ctcacaaggcagcaaggcc

SEQ ID NO: 2464945 - DNA, 20 bp, Homo sapiens
ctcacaagtgggtaccccca

SEQ ID NO: 2464946 - DNA, 19 bp, Homo sapiens
ctcacactggtctgctgtc

SEQ ID NO: 2464947 - DNA, 15 bp, Homo sapiens
ctcacaggtcccaaa

SEQ ID NO: 2464948 - DNA, 16 bp, Homo sapiens
ctcacaggtcccaaat

SEQ ID NO: 2464949 - DNA, 15 bp, Homo sapiens
ctcacagtgctttta

SEQ ID NO: 2464950 - DNA, 16 bp, Homo sapiens
ctcacatcagagtgac

SEQ ID NO: 2464951 - DNA, 21 bp, Homo sapiens
ctcaccactgccccctgctgc

SEQ ID NO: 2464952 - DNA, 18 bp, Homo sapiens
ctcaccaggcagcctctg

SEQ ID NO: 2464953 - DNA, 21 bp, Homo sapiens
ctcaccaggcagcctctgggg

SEQ ID NO: 2464954 - DNA, 12 bp, Homo sapiens
ctcaccattcca

SEQ ID NO: 2464955 - DNA, 14 bp, Homo sapiens
ctcaccccctcacc

SEQ ID NO: 2464956 - DNA, 21 bp, Homo sapiens
ctcacccccttctccatccac

SEQ ID NO: 2464957 - DNA, 17 bp, Homo sapiens
ctcacctgcactaacag

SEQ ID NO: 2464958 - DNA, 12 bp, Homo sapiens
ctcacctggact

SEQ ID NO: 2464959 - DNA, 21 bp, Homo sapiens
ctcaccttctgagtacagagt

SEQ ID NO: 2464960 - DNA, 19 bp, Homo sapiens
ctcaccttggcaccagaca

SEQ ID NO: 2464961 - DNA, 18 bp, Homo sapiens
ctcacggccacacagctg

SEQ ID NO: 2464962 - DNA, 19 bp, Homo sapiens
ctcacggccacacagctgc

SEQ ID NO: 2464963 - DNA, 14 bp, Homo sapiens
ctcacgtcaaatgc

SEQ ID NO: 2464964 - DNA, 12 bp, Homo sapiens
ctcactcagcca

SEQ ID NO: 2464965 - DNA, 22 bp, Homo sapiens
ctcactcagccaccctgagttg

SEQ ID NO: 2464966 - DNA, 18 bp, Homo sapiens
ctcactccccacatccca

SEQ ID NO: 2464967 - DNA, 18 bp, Homo sapiens
ctcactccttttaaagaa

SEQ ID NO: 2464968 - DNA, 15 bp, Homo sapiens
ctcactctgtttcct

SEQ ID NO: 2464969 - DNA, 21 bp, Homo sapiens
ctcactgttgaattttctcta

SEQ ID NO: 2464970 - DNA, 12 bp, Homo sapiens
ctcacttcaggt

SEQ ID NO: 2464971 - DNA, 10 bp, Homo sapiens
ctcagaaagt

SEQ ID NO: 2464972 - DNA, 23 bp, Homo sapiens
ctcagaagcctgggggcctggct

SEQ ID NO: 2464973 - DNA, 11 bp, Homo sapiens
ctcagaagtaa

SEQ ID NO: 2464974 - DNA, 14 bp, Homo sapiens
ctcagactctaaga

SEQ ID NO: 2464975 - DNA, 13 bp, Homo sapiens
ctcagagaccagg

SEQ ID NO: 2464976 - DNA, 14 bp, Homo sapiens
ctcagatcctcctc

SEQ ID NO: 2464977 - DNA, 13 bp, Homo sapiens
ctcagatggcagc

SEQ ID NO: 2464978 - DNA, 14 bp, Homo sapiens
ctcagatggcagct

SEQ ID NO: 2464979 - DNA, 16 bp, Homo sapiens
ctcagatggcagcttt

SEQ ID NO: 2464980 - DNA, 21 bp, Homo sapiens
ctcagatggcagcttttaaaa

SEQ ID NO: 2464981 - DNA, 22 bp, Homo sapiens
ctcagattgtaatatgtaaatg

SEQ ID NO: 2464982 - DNA, 20 bp, Homo sapiens
ctcagcacaaggccatctgg

SEQ ID NO: 2464983 - DNA, 21 bp, Homo sapiens
ctcagcactgcctgctcccat

SEQ ID NO: 2464984 - DNA, 17 bp, Homo sapiens
ctcagcacttggccctt

SEQ ID NO: 2464985 - DNA, 21 bp, Homo sapiens
ctactcacttttcccactcca

SEQ ID NO: 2464986 - DNA, 22 bp, Homo sapiens
ctactctccccacgagggctgg

SEQ ID NO: 2464987 - DNA, 17 bp, Homo sapiens
ctactctgtgccagagc

SEQ ID NO: 2464988 - DNA, 20 bp, Homo sapiens
ctactctgtgccagagcctg

SEQ ID NO: 2464989 - DNA, 14 bp, Homo sapiens
ctactgacatgtgg

SEQ ID NO: 2464990 - DNA, 16 bp, Homo sapiens
ctactggggaaactgg

SEQ ID NO: 2464991 - DNA, 20 bp, Homo sapiens
ctactggggaaactggccat

SEQ ID NO: 2464992 - DNA, 13 bp, Homo sapiens
ctactggtctctc

SEQ ID NO: 2464993 - DNA, 15 bp, Homo sapiens
ctactgtgtgtgtga

SEQ ID NO: 2464994 - DNA, 20 bp, Homo sapiens
ctactgttctaaagctctga

SEQ ID NO: 2464995 - DNA, 17 bp, Homo sapiens
ctacttcggggctggga

SEQ ID NO: 2464996 - DNA, 17 bp, Homo sapiens
ctacttctgtaattgtg

SEQ ID NO: 2464997 - DNA, 14 bp, Homo sapiens
ctactttccctctg

SEQ ID NO: 2464998 - DNA, 17 bp, Homo sapiens
ctactttccctctggga

SEQ ID NO: 2464999 - DNA, 11 bp, Homo sapiens
ctagaaaaaca

SEQ ID NO: 2465000 - DNA, 16 bp, Homo sapiens
ctagaaaaacaggcac

SEQ ID NO: 2465001 - DNA, 18 bp, Homo sapiens
ctagaaacaacactgtag

SEQ ID NO: 2465002 - DNA, 14 bp, Homo sapiens
ctagacaagccaga

SEQ ID NO: 2465003 - DNA, 16 bp, Homo sapiens
ctagacaagccagaac

SEQ ID NO: 2465004 - DNA, 17 bp, Homo sapiens
ctagacaagccagaact

SEQ ID NO: 2465005 - DNA, 16 bp, Homo sapiens
ctagacaccaaagttc

SEQ ID NO: 2465006 - DNA, 21 bp, Homo sapiens
ctagacatggaggttctaagg

SEQ ID NO: 2465007 - DNA, 14 bp, Homo sapiens
ctagagcactgcca

SEQ ID NO: 2465008 - DNA, 18 bp, Homo sapiens
ctagagcactgccaccag

SEQ ID NO: 2465009 - DNA, 15 bp, Homo sapiens
ctagagcagggatta

SEQ ID NO: 2465010 - DNA, 15 bp, Homo sapiens
ctagagctcctccct

SEQ ID NO: 2465011 - DNA, 17 bp, Homo sapiens
ctagagctcctccctct

SEQ ID NO: 2465012 - DNA, 19 bp, Homo sapiens
ctagagctcctccctctca

SEQ ID NO: 2465013 - DNA, 20 bp, Homo sapiens
ctagagctcctccctctcaa

SEQ ID NO: 2465014 - DNA, 15 bp, Homo sapiens
ctagaggtgagaaat

SEQ ID NO: 2465015 - DNA, 20 bp, Homo sapiens
ctagagtccaaggtttaaag

SEQ ID NO: 2465016 - DNA, 18 bp, Homo sapiens
ctagatcagatgctccaa

SEQ ID NO: 2465017 - DNA, 20 bp, Homo sapiens
ctagatcagatgctccaaga

SEQ ID NO: 2465018 - DNA, 15 bp, Homo sapiens
ctagatcctaagggt

SEQ ID NO: 2465019 - DNA, 20 bp, Homo sapiens
ctagatgattaaataagatt

SEQ ID NO: 2465020 - DNA, 22 bp, Homo sapiens
ctagatgattaaataagattct

SEQ ID NO: 2465021 - DNA, 23 bp, Homo sapiens
ctagatgattaaataagattcta

SEQ ID NO: 2465022 - DNA, 18 bp, Homo sapiens
ctagatggacctgcctgc

SEQ ID NO: 2465023 - DNA, 12 bp, Homo sapiens
ctagattcaaag

SEQ ID NO: 2465024 - DNA, 15 bp, Homo sapiens
ctagattcaaaggtt

SEQ ID NO: 2465025 - DNA, 17 bp, Homo sapiens
ctagattcaaaggttct

SEQ ID NO: 2465026 - DNA, 14 bp, Homo sapiens
ctagatttaatata

SEQ ID NO: 2465027 - DNA, 22 bp, Homo sapiens
ctagcagcaccgttctgtgcac

SEQ ID NO: 2465028 - DNA, 21 bp, Homo sapiens
ctagcagtggcaggcagaggc

SEQ ID NO: 2465029 - DNA, 19 bp, Homo sapiens
ctagcatttcccaacacaa

SEQ ID NO: 2465030 - DNA, 21 bp, Homo sapiens
ctagccaaacctcaccaactc

SEQ ID NO: 2465031 - DNA, 13 bp, Homo sapiens
ctagcctcagggg

SEQ ID NO: 2465032 - DNA, 20 bp, Homo sapiens
ctagcgctatctccctgcct

SEQ ID NO: 2465033 - DNA, 21 bp, Homo sapiens
ctagctcttgttgagccgtgg

SEQ ID NO: 2465034 - DNA, 17 bp, Homo sapiens
ctagctgaatgtttttc

SEQ ID NO: 2465035 - DNA, 23 bp, Homo sapiens
ctagctgtcctttttcctctcca

SEQ ID NO: 2465036 - DNA, 14 bp, Homo sapiens
ctaggaaaataaaa

SEQ ID NO: 2465037 - DNA, 15 bp, Homo sapiens
ctaggaaaataaaac

SEQ ID NO: 2465038 - DNA, 19 bp, Homo sapiens
ctaggaagagcaggactcc

SEQ ID NO: 2465039 - DNA, 16 bp, Homo sapiens
ctaggaagaggagtgg

SEQ ID NO: 2465040 - DNA, 18 bp, Homo sapiens
ctaggagaaccaaatctg

SEQ ID NO: 2465041 - DNA, 21 bp, Homo sapiens
ctaggagaaccaaatctggaa

SEQ ID NO: 2465042 - DNA, 15 bp, Homo sapiens
ctaggagcaaagcct

SEQ ID NO: 2465043 - DNA, 17 bp, Homo sapiens
ctaggagcaaagcctgt

SEQ ID NO: 2465044 - DNA, 17 bp, Homo sapiens
ctaggagctttgactca

SEQ ID NO: 2465045 - DNA, 21 bp, Homo sapiens
ctaggagctttgactcaggag

SEQ ID NO: 2465046 - DNA, 18 bp, Homo sapiens
ctaggagggagacactgg

SEQ ID NO: 2465047 - DNA, 13 bp, Homo sapiens
ctaggattctaaa

SEQ ID NO: 2465048 - DNA, 13 bp, Homo sapiens
ctaggatttcatg

SEQ ID NO: 2465049 - DNA, 13 bp, Homo sapiens
ctaggcaacatag

SEQ ID NO: 2465050 - DNA, 20 bp, Homo sapiens
ctaggcactgtagttctaag

SEQ ID NO: 2465051 - DNA, 21 bp, Homo sapiens
ctaggcactgtagttctaaga

SEQ ID NO: 2465052 - DNA, 14 bp, Homo sapiens
ctaggcattctgga

SEQ ID NO: 2465053 - DNA, 20 bp, Homo sapiens
ctaggcattctggacctctg

SEQ ID NO: 2465054 - DNA, 16 bp, Homo sapiens
ctaggccagagcccac

SEQ ID NO: 2465055 - DNA, 16 bp, Homo sapiens
ctaggccagcaggggc

SEQ ID NO: 2465056 - DNA, 17 bp, Homo sapiens
ctaggccagcaggggct

SEQ ID NO: 2465057 - DNA, 17 bp, Homo sapiens
ctaggcccccacttgcc

SEQ ID NO: 2465058 - DNA, 15 bp, Homo sapiens
ctaggcctagtcctg

SEQ ID NO: 2465059 - DNA, 15 bp, Homo sapiens
ctaggcctgggcagt

SEQ ID NO: 2465060 - DNA, 21 bp, Homo sapiens
ctaggctgacacctaactctt

SEQ ID NO: 2465061 - DNA, 14 bp, Homo sapiens
ctagggagccatgt

SEQ ID NO: 2465062 - DNA, 22 bp, Homo sapiens
ctagggaggcatggtctgccct

SEQ ID NO: 2465063 - DNA, 16 bp, Homo sapiens
ctagggccaagcccag

SEQ ID NO: 2465064 - DNA, 17 bp, Homo sapiens
ctagggtacatggtgct

SEQ ID NO: 2465065 - DNA, 21 bp, Homo sapiens
ctagggtacatggtgctggga

SEQ ID NO: 2465066 - DNA, 15 bp, Homo sapiens
ctaggtggaaaagcc

SEQ ID NO: 2465067 - DNA, 14 bp, Homo sapiens
ctaggtgttttgtt

SEQ ID NO: 2465068 - DNA, 15 bp, Homo sapiens
ctagtcaatgacatg

SEQ ID NO: 2465069 - DNA, 20 bp, Homo sapiens
ctagtcaatgacatgaattt

SEQ ID NO: 2465070 - DNA, 21 bp, Homo sapiens
ctagtcacgcatgcagtgttg

SEQ ID NO: 2465071 - DNA, 17 bp, Homo sapiens
ctagtgacccacatgcc

SEQ ID NO: 2465072 - DNA, 19 bp, Homo sapiens
ctagtgacccacatgccat

SEQ ID NO: 2465073 - DNA, 19 bp, Homo sapiens
ctagtgacttgtgtcccat

SEQ ID NO: 2465074 - DNA, 23 bp, Homo sapiens
ctagttatacttatttgtatatg

SEQ ID NO: 2465075 - DNA, 15 bp, Homo sapiens
ctagttctagaaaaa

SEQ ID NO: 2465076 - DNA, 21 bp, Homo sapiens
ctagttcttcatcccactcca

SEQ ID NO: 2465077 - DNA, 14 bp, Homo sapiens
ctataaagcagtat

SEQ ID NO: 2465078 - DNA, 16 bp, Homo sapiens
ctataaagcagtattt

SEQ ID NO: 2465079 - DNA, 19 bp, Homo sapiens
ctataaagcagtatttttc

SEQ ID NO: 2465080 - DNA, 14 bp, Homo sapiens
ctataaagcattta

SEQ ID NO: 2465081 - DNA, 15 bp, Homo sapiens
ctataaagcatttaa

SEQ ID NO: 2465082 - DNA, 16 bp, Homo sapiens
ctataaccagacacat

SEQ ID NO: 2465083 - DNA, 22 bp, Homo sapiens
ctataagcaagaaggcaaaaat

SEQ ID NO: 2465084 - DNA, 22 bp, Homo sapiens
ctataaggtgctctctttctgt

SEQ ID NO: 2465085 - DNA, 23 bp, Homo sapiens
ctataaggtgctctctttctgtc

SEQ ID NO: 2465086 - DNA, 22 bp, Homo sapiens
ctataatttacctaagattaca

SEQ ID NO: 2465087 - DNA, 19 bp, Homo sapiens
ctataattttgcctttaac

SEQ ID NO: 2465088 - DNA, 20 bp, Homo sapiens
ctatagttattaagttcttt

SEQ ID NO: 2465089 - DNA, 16 bp, Homo sapiens
ctatcacccaacgctc

SEQ ID NO: 2465090 - DNA, 19 bp, Homo sapiens
ctatcacccaacgctccaa

SEQ ID NO: 2465091 - DNA, 19 bp, Homo sapiens
ctatcattgcttcctcctc

SEQ ID NO: 2465092 - DNA, 20 bp, Homo sapiens
ctatccaatcaatcttgcat

SEQ ID NO: 2465093 - DNA, 23 bp, Homo sapiens
ctatccaatcaatcttgcatgta

SEQ ID NO: 2465094 - DNA, 16 bp, Homo sapiens
ctatcctctcttcctc

SEQ ID NO: 2465095 - DNA, 14 bp, Homo sapiens
ctatctgggcttcc

SEQ ID NO: 2465096 - DNA, 15 bp, Homo sapiens
ctatctgggcttcct

SEQ ID NO: 2465097 - DNA, 20 bp, Homo sapiens
ctatctgggcttcctggagc

SEQ ID NO: 2465098 - DNA, 21 bp, Homo sapiens
ctatctgggcttcctggagca

SEQ ID NO: 2465099 - DNA, 14 bp, Homo sapiens
ctatctgtctggtg

SEQ ID NO: 2465100 - DNA, 17 bp, Homo sapiens
ctatctgtctggtggcc

SEQ ID NO: 2465101 - DNA, 21 bp, Homo sapiens
ctatgaaaagctagaattgag

SEQ ID NO: 2465102 - DNA, 16 bp, Homo sapiens
ctatgacttgggcacc

SEQ ID NO: 2465103 - DNA, 23 bp, Homo sapiens
ctatgacttgggcacccccagcc

SEQ ID NO: 2465104 - DNA, 14 bp, Homo sapiens
ctatgagtctagat

SEQ ID NO: 2465105 - DNA, 16 bp, Homo sapiens
ctatgagtctagatgt

SEQ ID NO: 2465106 - DNA, 14 bp, Homo sapiens
ctatgattattaac

SEQ ID NO: 2465107 - DNA, 14 bp, Homo sapiens
cctttgtgccctat

SEQ ID NO: 2465108 - DNA, 17 bp, Homo sapiens
cctttgtgtgctctcca

SEQ ID NO: 2465109 - DNA, 11 bp, Homo sapiens
ccttttcatag

SEQ ID NO: 2465110 - DNA, 18 bp, Homo sapiens
ccttttgacactgctcta

SEQ ID NO: 2465111 - DNA, 19 bp, Homo sapiens
cctttttaatatgcttaaa

SEQ ID NO: 2465112 - DNA, 12 bp, Homo sapiens
cctttttcaatg

SEQ ID NO: 2465113 - DNA, 13 bp, Homo sapiens
cctttttcattta

SEQ ID NO: 2465114 - DNA, 16 bp, Homo sapiens
cctttttctccagctg

SEQ ID NO: 2465115 - DNA, 19 bp, Homo sapiens
cgaaaacccccaaaccaga

SEQ ID NO: 2465116 - DNA, 16 bp, Homo sapiens
cgaaataattgttgtt

SEQ ID NO: 2465117 - DNA, 19 bp, Homo sapiens
cgaaataattgttgttctg

SEQ ID NO: 2465118 - DNA, 14 bp, Homo sapiens
cgaaatgttatttt

SEQ ID NO: 2465119 - DNA, 17 bp, Homo sapiens
cgaagctaacagggaag

SEQ ID NO: 2465120 - DNA, 17 bp, Homo sapiens
cgaatctactaattcca

SEQ ID NO: 2465121 - DNA, 22 bp, Homo sapiens
cgaatctctttttgctttcgaa

SEQ ID NO: 2465122 - DNA, 16 bp, Homo sapiens
cgaatgtgtctttaga

SEQ ID NO: 2465123 - DNA, 19 bp, Homo sapiens
cgaatgtgtctttagatag

SEQ ID NO: 2465124 - DNA, 13 bp, Homo sapiens
cgaccgccccagt

SEQ ID NO: 2465125 - DNA, 16 bp, Homo sapiens
cgactccgttggccac

SEQ ID NO: 2465126 - DNA, 15 bp, Homo sapiens
cgactggccagggcc

SEQ ID NO: 2465127 - DNA, 11 bp, Homo sapiens
cgactgtctcc

SEQ ID NO: 2465128 - DNA, 15 bp, Homo sapiens
cgactttctgcctgg

SEQ ID NO: 2465129 - DNA, 16 bp, Homo sapiens
cgactttctgcctgga

SEQ ID NO: 2465130 - DNA, 12 bp, Homo sapiens
cgagagatgtgt

SEQ ID NO: 2465131 - DNA, 13 bp, Homo sapiens
cgagagatgtgtg

SEQ ID NO: 2465132 - DNA, 21 bp, Homo sapiens
cgagaggggccgatgcccaga

SEQ ID NO: 2465133 - DNA, 23 bp, Homo sapiens
cgagaggtgggccagtctgtgga

SEQ ID NO: 2465134 - DNA, 17 bp, Homo sapiens
cgagatcagtatttaac

SEQ ID NO: 2465135 - DNA, 19 bp, Homo sapiens
cgagatcagtatttaacta

SEQ ID NO: 2465136 - DNA, 23 bp, Homo sapiens
cgagcaaccgtggcccttcctgg

SEQ ID NO: 2465137 - DNA, 13 bp, Homo sapiens
cgagcacctccac

SEQ ID NO: 2465138 - DNA, 13 bp, Homo sapiens
cgagcagctgagc

SEQ ID NO: 2465139 - DNA, 15 bp, Homo sapiens
cgagcagctgagcag

SEQ ID NO: 2465140 - DNA, 19 bp, Homo sapiens
cgagcagctgagcagggcc

SEQ ID NO: 2465141 - DNA, 13 bp, Homo sapiens
cgagcaggaggcc

SEQ ID NO: 2465142 - DNA, 14 bp, Homo sapiens
cgagcaggaggcct

SEQ ID NO: 2465143 - DNA, 21 bp, Homo sapiens
cgagcagtcctgcctcagcct

SEQ ID NO: 2465144 - DNA, 19 bp, Homo sapiens
cgagcgccctgcagaccct

SEQ ID NO: 2465145 - DNA, 21 bp, Homo sapiens
cgagcgccctgcagaccctgc

SEQ ID NO: 2465146 - DNA, 10 bp, Homo sapiens
cgagctcctc

SEQ ID NO: 2465147 - DNA, 17 bp, Homo sapiens
cgaggcctaccccgcag

SEQ ID NO: 2465148 - DNA, 23 bp, Homo sapiens
cgaggcctaccccgcagacacct

SEQ ID NO: 2465149 - DNA, 12 bp, Homo sapiens
cgaggctgagaa

SEQ ID NO: 2465150 - DNA, 20 bp, Homo sapiens
cgaggctgagaatcagactg

SEQ ID NO: 2465151 - DNA, 15 bp, Homo sapiens
cgagggctggctggc

SEQ ID NO: 2465152 - DNA, 19 bp, Homo sapiens
cgagggctggctggcctca

SEQ ID NO: 2465153 - DNA, 18 bp, Homo sapiens
cgaggggtgtcttgggca

SEQ ID NO: 2465154 - DNA, 19 bp, Homo sapiens
cgaggggtgtcttgggcag

SEQ ID NO: 2465155 - DNA, 17 bp, Homo sapiens
cgaggtccctgctgcca

SEQ ID NO: 2465156 - DNA, 18 bp, Homo sapiens
cgaggtccctgctgccag

SEQ ID NO: 2465157 - DNA, 20 bp, Homo sapiens
cgagtgccttcaacacagct

SEQ ID NO: 2465158 - DNA, 14 bp, Homo sapiens
cgagtggagtctgc

SEQ ID NO: 2465159 - DNA, 19 bp, Homo sapiens
cgagtggagtctgccaccc

SEQ ID NO: 2465160 - DNA, 15 bp, Homo sapiens
cgatatactctagat

SEQ ID NO: 2465161 - DNA, 14 bp, Homo sapiens
cgatgcccagagac

SEQ ID NO: 2465162 - DNA, 20 bp, Homo sapiens
cgatgtggaactgctgccac

SEQ ID NO: 2465163 - DNA, 23 bp, Homo sapiens
cgattccctctcccaggccccat

SEQ ID NO: 2465164 - DNA, 13 bp, Homo sapiens
cgcaacccgtgcc

SEQ ID NO: 2465165 - DNA, 14 bp, Homo sapiens
cgcaacccgtgcca

SEQ ID NO: 2465166 - DNA, 19 bp, Homo sapiens
cgcaacccgtgccaagtcc

SEQ ID NO: 2465167 - DNA, 14 bp, Homo sapiens
cgcacctgcctcag

SEQ ID NO: 2465168 - DNA, 17 bp, Homo sapiens
cgcactgtgacccccag

SEQ ID NO: 2465169 - DNA, 11 bp, Homo sapiens
cgcagccaccc

SEQ ID NO: 2465170 - DNA, 23 bp, Homo sapiens
cgcagtgggagcaaactgcatgc

SEQ ID NO: 2465171 - DNA, 12 bp, Homo sapiens
cgcagttttttt

SEQ ID NO: 2465172 - DNA, 15 bp, Homo sapiens
cgcataggacctttc

SEQ ID NO: 2465173 - DNA, 18 bp, Homo sapiens
cgccaccgagtgccttca

SEQ ID NO: 2465174 - DNA, 19 bp, Homo sapiens
cgccagctctgttcttcct

SEQ ID NO: 2465175 - DNA, 21 bp, Homo sapiens
cgccaggatggaacacggcca

SEQ ID NO: 2465176 - DNA, 16 bp, Homo sapiens
cgccaggctgaccaca

SEQ ID NO: 2465177 - DNA, 17 bp, Homo sapiens
cgccaggctgaccacag

SEQ ID NO: 2465178 - DNA, 17 bp, Homo sapiens
cgcccaaaggacgcact

SEQ ID NO: 2465179 - DNA, 20 bp, Homo sapiens
cgcccaaaggacgcactgag

SEQ ID NO: 2465180 - DNA, 22 bp, Homo sapiens
cgcccaaaggacgcactgagca

SEQ ID NO: 2465181 - DNA, 18 bp, Homo sapiens
cgcccacaggaagcctgc

SEQ ID NO: 2465182 - DNA, 19 bp, Homo sapiens
cgccccctccgccctgcca

SEQ ID NO: 2465183 - DNA, 15 bp, Homo sapiens
cgcccgtcctgcctg

SEQ ID NO: 2465184 - DNA, 11 bp, Homo sapiens
cgccctgcaga

SEQ ID NO: 2465185 - DNA, 12 bp, Homo sapiens
cgccctgcagac

SEQ ID NO: 2465186 - DNA, 20 bp, Homo sapiens
cgccctttcctcctcaggca

SEQ ID NO: 2465187 - DNA, 18 bp, Homo sapiens
cgcctccatccaaggcca

SEQ ID NO: 2465188 - DNA, 21 bp, Homo sapiens
cgcctgacaaccactggtctg

SEQ ID NO: 2465189 - DNA, 11 bp, Homo sapiens
cgcctgagccc

SEQ ID NO: 2465190 - DNA, 15 bp, Homo sapiens
cgcctgagcccaggg

SEQ ID NO: 2465191 - DNA, 21 bp, Homo sapiens
cgcctgagcccagggaggccg

SEQ ID NO: 2465192 - DNA, 17 bp, Homo sapiens
cgcctgccctcatggcc

SEQ ID NO: 2465193 - DNA, 20 bp, Homo sapiens
cgcctgccctcatggcccct

SEQ ID NO: 2465194 - DNA, 14 bp, Homo sapiens
cgcctggcctggcc

SEQ ID NO: 2465195 - DNA, 13 bp, Homo sapiens
cgcctttcccagg

SEQ ID NO: 2465196 - DNA, 14 bp, Homo sapiens
cgcggccctcagta

SEQ ID NO: 2465197 - DNA, 16 bp, Homo sapiens
cgctacaccactctgg

SEQ ID NO: 2465198 - DNA, 17 bp, Homo sapiens
cgctacaccactctggc

SEQ ID NO: 2465199 - DNA, 20 bp, Homo sapiens
cgctacaccactctggcagc

SEQ ID NO: 2465200 - DNA, 14 bp, Homo sapiens
cgctagcagtggca

SEQ ID NO: 2465201 - DNA, 22 bp, Homo sapiens
cgctcagggccatgctgaggcc

SEQ ID NO: 2465202 - DNA, 15 bp, Homo sapiens
cgctccccactctgc

SEQ ID NO: 2465203 - DNA, 17 bp, Homo sapiens
cgctcctggcccagcct

SEQ ID NO: 2465204 - DNA, 14 bp, Homo sapiens
cgctctctccaggc

SEQ ID NO: 2465205 - DNA, 20 bp, Homo sapiens
ccttagactcttttccttcc

SEQ ID NO: 2465206 - DNA, 15 bp, Homo sapiens
ccttaggaagagcct

SEQ ID NO: 2465207 - DNA, 14 bp, Homo sapiens
ccttagtctcagtt

SEQ ID NO: 2465208 - DNA, 21 bp, Homo sapiens
ccttatagttactgtgtaatt

SEQ ID NO: 2465209 - DNA, 14 bp, Homo sapiens
ccttatccccactt

SEQ ID NO: 2465210 - DNA, 17 bp, Homo sapiens
ccttatgactgccaaga

SEQ ID NO: 2465211 - DNA, 14 bp, Homo sapiens
ccttattcagggaa

SEQ ID NO: 2465212 - DNA, 14 bp, Homo sapiens
ccttcaacccgaga

SEQ ID NO: 2465213 - DNA, 16 bp, Homo sapiens
ccttcaagctctgagg

SEQ ID NO: 2465214 - DNA, 21 bp, Homo sapiens
ccttcaagctctgagggaaag

SEQ ID NO: 2465215 - DNA, 16 bp, Homo sapiens
ccttcagagagcagtg

SEQ ID NO: 2465216 - DNA, 20 bp, Homo sapiens
ccttcagagagcagtgcttt

SEQ ID NO: 2465217 - DNA, 23 bp, Homo sapiens
ccttcagagagcagtgcttttgg

SEQ ID NO: 2465218 - DNA, 15 bp, Homo sapiens
ccttcatacttgaac

SEQ ID NO: 2465219 - DNA, 19 bp, Homo sapiens
ccttcatacttgaacgttt

SEQ ID NO: 2465220 - DNA, 19 bp, Homo sapiens
ccttcatatcatccacaca

SEQ ID NO: 2465221 - DNA, 18 bp, Homo sapiens
ccttcatgacagcctcca

SEQ ID NO: 2465222 - DNA, 21 bp, Homo sapiens
ccttccaatgtctggagacca

SEQ ID NO: 2465223 - DNA, 15 bp, Homo sapiens
ccttccacccagggg

SEQ ID NO: 2465224 - DNA, 17 bp, Homo sapiens
ccttcccagaggggcct

SEQ ID NO: 2465225 - DNA, 24 bp, Homo sapiens
ccttcccagaggggcctgccacct

SEQ ID NO: 2465226 - DNA, 14 bp, Homo sapiens
ccttcccatcgctg

SEQ ID NO: 2465227 - DNA, 20 bp, Homo sapiens
ccttccccttatcctccctg

SEQ ID NO: 2465228 - DNA, 17 bp, Homo sapiens
ccttccctgtgcctcct

SEQ ID NO: 2465229 - DNA, 20 bp, Homo sapiens
ccttccctgtgcctcctccc

SEQ ID NO: 2465230 - DNA, 22 bp, Homo sapiens
ccttccctgttttccccccaag

SEQ ID NO: 2465231 - DNA, 16 bp, Homo sapiens
ccttccgccactgggg

SEQ ID NO: 2465232 - DNA, 18 bp, Homo sapiens
ccttccgccactggggct

SEQ ID NO: 2465233 - DNA, 22 bp, Homo sapiens
ccttccgccactggggctcaga

SEQ ID NO: 2465234 - DNA, 12 bp, Homo sapiens
ccttcctcctgg

SEQ ID NO: 2465235 - DNA, 20 bp, Homo sapiens
ccttcctcttttccttccca

SEQ ID NO: 2465236 - DNA, 16 bp, Homo sapiens
ccttcctgccagcccc

SEQ ID NO: 2465237 - DNA, 17 bp, Homo sapiens
ccttcctgccagcccct

SEQ ID NO: 2465238 - DNA, 17 bp, Homo sapiens
ccttcctggacagctgt

SEQ ID NO: 2465239 - DNA, 20 bp, Homo sapiens
ccttcctggacagctgtgcc

SEQ ID NO: 2465240 - DNA, 21 bp, Homo sapiens
ccttcctggacagctgtgcct

SEQ ID NO: 2465241 - DNA, 22 bp, Homo sapiens
ccttcctggacagctgtgcctc

SEQ ID NO: 2465242 - DNA, 19 bp, Homo sapiens
ccttcgcttcttgcctctg

SEQ ID NO: 2465243 - DNA, 14 bp, Homo sapiens
ccttcgggctgtgc

SEQ ID NO: 2465244 - DNA, 15 bp, Homo sapiens
ccttcgggctgtgcc

SEQ ID NO: 2465245 - DNA, 22 bp, Homo sapiens
ccttctatttggggcttgatga

SEQ ID NO: 2465246 - DNA, 13 bp, Homo sapiens
ccttctccatcca

SEQ ID NO: 2465247 - DNA, 20 bp, Homo sapiens
ccttctcccactctcctagg

SEQ ID NO: 2465248 - DNA, 12 bp, Homo sapiens
ccttctccccag

SEQ ID NO: 2465249 - DNA, 18 bp, Homo sapiens
ccttctccccagctccca

SEQ ID NO: 2465250 - DNA, 23 bp, Homo sapiens
ccttctccccagctcccaggacc

SEQ ID NO: 2465251 - DNA, 17 bp, Homo sapiens
ccttctcccctgcactg

SEQ ID NO: 2465252 - DNA, 23 bp, Homo sapiens
ccttctcccctgcactgtaaaat

SEQ ID NO: 2465253 - DNA, 14 bp, Homo sapiens
ccttctctctccct

SEQ ID NO: 2465254 - DNA, 14 bp, Homo sapiens
ccttctgagctcct

SEQ ID NO: 2465255 - DNA, 15 bp, Homo sapiens
ccttctgagctcctg

SEQ ID NO: 2465256 - DNA, 17 bp, Homo sapiens
ccttctgagctcctgtc

SEQ ID NO: 2465257 - DNA, 21 bp, Homo sapiens
ccttctgagctcctgtcccct

SEQ ID NO: 2465258 - DNA, 22 bp, Homo sapiens
ccttctgagctcctgtcccctg

SEQ ID NO: 2465259 - DNA, 12 bp, Homo sapiens
ccttctgctcag

SEQ ID NO: 2465260 - DNA, 13 bp, Homo sapiens
ccttctttctacc

SEQ ID NO: 2465261 - DNA, 23 bp, Homo sapiens
ccttgaagaactgcaggccctgg

SEQ ID NO: 2465262 - DNA, 16 bp, Homo sapiens
ccttgacaactggcag

SEQ ID NO: 2465263 - DNA, 21 bp, Homo sapiens
ccttgacaactggcaggcagg

SEQ ID NO: 2465264 - DNA, 21 bp, Homo sapiens
ccttgagggtgcttgttccct

SEQ ID NO: 2465265 - DNA, 14 bp, Homo sapiens
ccttgaggtctcag

SEQ ID NO: 2465266 - DNA, 23 bp, Homo sapiens
ccttgagtggggttatctctgtg

SEQ ID NO: 2465267 - DNA, 12 bp, Homo sapiens
ccttgccagaga

SEQ ID NO: 2465268 - DNA, 17 bp, Homo sapiens
ccttgcccccctggcct

SEQ ID NO: 2465269 - DNA, 19 bp, Homo sapiens
ccttgcctcaatgccagta

SEQ ID NO: 2465270 - DNA, 20 bp, Homo sapiens
ccttgcctcaatgccagtaa

SEQ ID NO: 2465271 - DNA, 16 bp, Homo sapiens
ccttgcggctcctcag

SEQ ID NO: 2465272 - DNA, 12 bp, Homo sapiens
ccttgctgtgaa

SEQ ID NO: 2465273 - DNA, 17 bp, Homo sapiens
ccttgcttacctctcag

SEQ ID NO: 2465274 - DNA, 16 bp, Homo sapiens
ccttggacacgctcag

SEQ ID NO: 2465275 - DNA, 16 bp, Homo sapiens
ccttggacatcctcct

SEQ ID NO: 2465276 - DNA, 15 bp, Homo sapiens
ccttggcaccagaca

SEQ ID NO: 2465277 - DNA, 21 bp, Homo sapiens
ccttgggctccgtgtgggaga

SEQ ID NO: 2465278 - DNA, 21 bp, Homo sapiens
ccttgggggtcctcctccagg

SEQ ID NO: 2465279 - DNA, 18 bp, Homo sapiens
ccttgggttagacctaca

SEQ ID NO: 2465280 - DNA, 20 bp, Homo sapiens
ccttgggttagacctacagg

SEQ ID NO: 2465281 - DNA, 22 bp, Homo sapiens
ccttggttgtctggcaaggact

SEQ ID NO: 2465282 - DNA, 23 bp, Homo sapiens
ccttggtttttactgctctgaga

SEQ ID NO: 2465283 - DNA, 15 bp, Homo sapiens
ccttgtagctcctcc

SEQ ID NO: 2465284 - DNA, 17 bp, Homo sapiens
ccttgtatcccctgcag

SEQ ID NO: 2465285 - DNA, 21 bp, Homo sapiens
ccttgtgatgtcatacagaga

SEQ ID NO: 2465286 - DNA, 12 bp, Homo sapiens
ccttgtgccaga

SEQ ID NO: 2465287 - DNA, 16 bp, Homo sapiens
ccttgtgggcctgggc

SEQ ID NO: 2465288 - DNA, 17 bp, Homo sapiens
ccttgtgggcctgggct

SEQ ID NO: 2465289 - DNA, 19 bp, Homo sapiens
ccttgtttacacataccct

SEQ ID NO: 2465290 - DNA, 16 bp, Homo sapiens
ccttgtttggggcagg

SEQ ID NO: 2465291 - DNA, 17 bp, Homo sapiens
cctttaacaacatgttt

SEQ ID NO: 2465292 - DNA, 12 bp, Homo sapiens
cctttacatgag

SEQ ID NO: 2465293 - DNA, 18 bp, Homo sapiens
cctttacatgaggactct

SEQ ID NO: 2465294 - DNA, 23 bp, Homo sapiens
cctttatttgttaatagttcctg

SEQ ID NO: 2465295 - DNA, 22 bp, Homo sapiens
cctttccataaatccttgatga

SEQ ID NO: 2465296 - DNA, 18 bp, Homo sapiens
cctttccatccatggcca

SEQ ID NO: 2465297 - DNA, 22 bp, Homo sapiens
cctttcccaccccaacctgctc

SEQ ID NO: 2465298 - DNA, 19 bp, Homo sapiens
cctttcccaggtgctacac

SEQ ID NO: 2465299 - DNA, 21 bp, Homo sapiens
cctttcggatccagggaggct

SEQ ID NO: 2465300 - DNA, 14 bp, Homo sapiens
cctttctgagggcc

SEQ ID NO: 2465301 - DNA, 12 bp, Homo sapiens
cctttcttccgg

SEQ ID NO: 2465302 - DNA, 14 bp, Homo sapiens
cctgccagcagggg

SEQ ID NO: 2465303 - DNA, 13 bp, Homo sapiens
cctgccagctgca

SEQ ID NO: 2465304 - DNA, 11 bp, Homo sapiens
cctgccaggag

SEQ ID NO: 2465305 - DNA, 23 bp, Homo sapiens
cctgccaggaggacccagggctc

SEQ ID NO: 2465306 - DNA, 16 bp, Homo sapiens
cctgcccagttgcact

SEQ ID NO: 2465307 - DNA, 17 bp, Homo sapiens
cctgccccaactccttc

SEQ ID NO: 2465308 - DNA, 16 bp, Homo sapiens
cctgccccaggcctga

SEQ ID NO: 2465309 - DNA, 19 bp, Homo sapiens
cctgcccccaaggaggcag

SEQ ID NO: 2465310 - DNA, 16 bp, Homo sapiens
cctgcccccaatccat

SEQ ID NO: 2465311 - DNA, 19 bp, Homo sapiens
cctgcccccaccccattcc

SEQ ID NO: 2465312 - DNA, 22 bp, Homo sapiens
cctgccccccagcctctggcat

SEQ ID NO: 2465313 - DNA, 14 bp, Homo sapiens
cctgccccctgcag

SEQ ID NO: 2465314 - DNA, 20 bp, Homo sapiens
cctgccccctgcaggaagga

SEQ ID NO: 2465315 - DNA, 18 bp, Homo sapiens
cctgccctacctgcccca

SEQ ID NO: 2465316 - DNA, 21 bp, Homo sapiens
cctgccctcatggcccctctg

SEQ ID NO: 2465317 - DNA, 21 bp, Homo sapiens
cctgcccttgtttggggcagg

SEQ ID NO: 2465318 - DNA, 19 bp, Homo sapiens
cctgcctattatctgtcag

SEQ ID NO: 2465319 - DNA, 16 bp, Homo sapiens
cctgcctcaccacgga

SEQ ID NO: 2465320 - DNA, 13 bp, Homo sapiens
cctgcctcagcct

SEQ ID NO: 2465321 - DNA, 14 bp, Homo sapiens
cctgcctcagcctc

SEQ ID NO: 2465322 - DNA, 23 bp, Homo sapiens
cctgcctcctgccggctccttgg

SEQ ID NO: 2465323 - DNA, 12 bp, Homo sapiens
cctgcctctact

SEQ ID NO: 2465324 - DNA, 21 bp, Homo sapiens
cctgcctctcccaggcagggg

SEQ ID NO: 2465325 - DNA, 14 bp, Homo sapiens
cctgcctggaggac

SEQ ID NO: 2465326 - DNA, 21 bp, Homo sapiens
cctgcctggaggacctgagcc

SEQ ID NO: 2465327 - DNA, 17 bp, Homo sapiens
cctgccttcctcctggg

SEQ ID NO: 2465328 - DNA, 24 bp, Homo sapiens
cctgcgggtgaacaaagcagccac

SEQ ID NO: 2465329 - DNA, 19 bp, Homo sapiens
cctgctaacggtgctcagg

SEQ ID NO: 2465330 - DNA, 17 bp, Homo sapiens
cctgctaaggtcttgga

SEQ ID NO: 2465331 - DNA, 14 bp, Homo sapiens
cctgctacacctat

SEQ ID NO: 2465332 - DNA, 21 bp, Homo sapiens
cctgctacacctattatccca

SEQ ID NO: 2465333 - DNA, 23 bp, Homo sapiens
cctgctacacctattatcccagc

SEQ ID NO: 2465334 - DNA, 11 bp, Homo sapiens
cctgctccaga

SEQ ID NO: 2465335 - DNA, 12 bp, Homo sapiens
cctgctccagac

SEQ ID NO: 2465336 - DNA, 13 bp, Homo sapiens
cctgctccagacc

SEQ ID NO: 2465337 - DNA, 14 bp, Homo sapiens
cctgctccagacct

SEQ ID NO: 2465338 - DNA, 16 bp, Homo sapiens
cctgctccagacctga

SEQ ID NO: 2465339 - DNA, 15 bp, Homo sapiens
cctgctgacctgtgc

SEQ ID NO: 2465340 - DNA, 16 bp, Homo sapiens
cctgctgacctgtgca

SEQ ID NO: 2465341 - DNA, 13 bp, Homo sapiens
cctgctgagctct

SEQ ID NO: 2465342 - DNA, 19 bp, Homo sapiens
cctgctgagctctgagagg

SEQ ID NO: 2465343 - DNA, 20 bp, Homo sapiens
cctgctgagctctgagaggc

SEQ ID NO: 2465344 - DNA, 13 bp, Homo sapiens
cctgctgccagct

SEQ ID NO: 2465345 - DNA, 15 bp, Homo sapiens
cctgctgctccctca

SEQ ID NO: 2465346 - DNA, 18 bp, Homo sapiens
cctgctgctccctcagac

SEQ ID NO: 2465347 - DNA, 16 bp, Homo sapiens
cctgctgctgagaacc

SEQ ID NO: 2465348 - DNA, 24 bp, Homo sapiens
cctgctgctgagaacctggccttc

SEQ ID NO: 2465349 - DNA, 18 bp, Homo sapiens
cctgcttcctgcttgcca

SEQ ID NO: 2465350 - DNA, 22 bp, Homo sapiens
cctgcttgatgggattctggac

SEQ ID NO: 2465351 - DNA, 17 bp, Homo sapiens
cctgcttgccaaggcag

SEQ ID NO: 2465352 - DNA, 18 bp, Homo sapiens
cctgcttgccaaggcaga

SEQ ID NO: 2465353 - DNA, 21 bp, Homo sapiens
cctgcttgccaaggcagaggc

SEQ ID NO: 2465354 - DNA, 22 bp, Homo sapiens
cctgcttgccaaggcagaggcc

SEQ ID NO: 2465355 - DNA, 13 bp, Homo sapiens
cctggaacttggg

SEQ ID NO: 2465356 - DNA, 17 bp, Homo sapiens
cctggacactcagacct

SEQ ID NO: 2465357 - DNA, 16 bp, Homo sapiens
cctggacagctgtgcc

SEQ ID NO: 2465358 - DNA, 19 bp, Homo sapiens
cctggacagctgtgcctcg

SEQ ID NO: 2465359 - DNA, 20 bp, Homo sapiens
cctggacagctgtgcctcgc

SEQ ID NO: 2465360 - DNA, 22 bp, Homo sapiens
cctggacagctgtgcctcgctc

SEQ ID NO: 2465361 - DNA, 23 bp, Homo sapiens
cctggacccccctttcacaggca

SEQ ID NO: 2465362 - DNA, 13 bp, Homo sapiens
cctggacccctgc

SEQ ID NO: 2465363 - DNA, 23 bp, Homo sapiens
cctggacccgttcatgggggagg

SEQ ID NO: 2465364 - DNA, 12 bp, Homo sapiens
cctggacctctg

SEQ ID NO: 2465365 - DNA, 14 bp, Homo sapiens
cctggactttcctg

SEQ ID NO: 2465366 - DNA, 16 bp, Homo sapiens
cctggactttcctgca

SEQ ID NO: 2465367 - DNA, 16 bp, Homo sapiens
cctggagatcctcctg

SEQ ID NO: 2465368 - DNA, 21 bp, Homo sapiens
cctggagatcctcctgcagac

SEQ ID NO: 2465369 - DNA, 21 bp, Homo sapiens
cctggagatgacttgaggcct

SEQ ID NO: 2465370 - DNA, 16 bp, Homo sapiens
cctggagcacaaagac

SEQ ID NO: 2465371 - DNA, 13 bp, Homo sapiens
cctggagcagaag

SEQ ID NO: 2465372 - DNA, 21 bp, Homo sapiens
cctggagcagaagcagcaact

SEQ ID NO: 2465373 - DNA, 22 bp, Homo sapiens
cctggagcagaagcagcaactt

SEQ ID NO: 2465374 - DNA, 16 bp, Homo sapiens
cctggaggacctgagc

SEQ ID NO: 2465375 - DNA, 22 bp, Homo sapiens
cctggaggacctgagcctgccg

SEQ ID NO: 2465376 - DNA, 16 bp, Homo sapiens
cctggaggatttcatc

SEQ ID NO: 2465377 - DNA, 21 bp, Homo sapiens
cctggagggggaatggcagca

SEQ ID NO: 2465378 - DNA, 17 bp, Homo sapiens
cctggatcagcgtggcc

SEQ ID NO: 2465379 - DNA, 19 bp, Homo sapiens
cctggatcagcgtggcctt

SEQ ID NO: 2465380 - DNA, 16 bp, Homo sapiens
cctggatgacattaaa

SEQ ID NO: 2465381 - DNA, 19 bp, Homo sapiens
cctggcagagatgcctccc

SEQ ID NO: 2465382 - DNA, 13 bp, Homo sapiens
cctggcagctctg

SEQ ID NO: 2465383 - DNA, 17 bp, Homo sapiens
cctggcagctctggaca

SEQ ID NO: 2465384 - DNA, 12 bp, Homo sapiens
cctggccagaca

SEQ ID NO: 2465385 - DNA, 14 bp, Homo sapiens
cctggccagacaca

SEQ ID NO: 2465386 - DNA, 16 bp, Homo sapiens
cctggccagacacagg

SEQ ID NO: 2465387 - DNA, 14 bp, Homo sapiens
cctggcccacccca

SEQ ID NO: 2465388 - DNA, 21 bp, Homo sapiens
cctggcccaccccacccactt

SEQ ID NO: 2465389 - DNA, 22 bp, Homo sapiens
cctggcccaccccacccacttc

SEQ ID NO: 2465390 - DNA, 13 bp, Homo sapiens
cctggcccagcct

SEQ ID NO: 2465391 - DNA, 14 bp, Homo sapiens
cctggcccagcctt

SEQ ID NO: 2465392 - DNA, 20 bp, Homo sapiens
cctggccccctccctggatg

SEQ ID NO: 2465393 - DNA, 12 bp, Homo sapiens
cctggcccctct

SEQ ID NO: 2465394 - DNA, 15 bp, Homo sapiens
cctggcccctctccc

SEQ ID NO: 2465395 - DNA, 16 bp, Homo sapiens
cctggcccctctccct

SEQ ID NO: 2465396 - DNA, 14 bp, Homo sapiens
cctggccctgcttc

SEQ ID NO: 2465397 - DNA, 16 bp, Homo sapiens
cctggccctgcttcct

SEQ ID NO: 2465398 - DNA, 18 bp, Homo sapiens
cctggccgagtccaagct

SEQ ID NO: 2465399 - DNA, 18 bp, Homo sapiens
cctggccgcctgggtcca

SEQ ID NO: 2465400 - DNA, 17 bp, Homo sapiens
cctggcctagaccagca

SEQ ID NO: 2465401 - DNA, 20 bp, Homo sapiens
cctggcctagaccagcagac

SEQ ID NO: 2465402 - DNA, 14 bp, Homo sapiens
cctggcctccccca

SEQ ID NO: 2465403 - DNA, 14 bp, Homo sapiens
ccttaaaggggaga

SEQ ID NO: 2465404 - DNA, 22 bp, Homo sapiens
ccttaagacctactgttctaaa

SEQ ID NO: 2465405 - DNA, 16 bp, Homo sapiens
ccttaatttgcacagt

SEQ ID NO: 2465406 - DNA, 12 bp, Homo sapiens
ccttactcctgt

SEQ ID NO: 2465407 - DNA, 20 bp, Homo sapiens
ccttagacagaggccctcaa

SEQ ID NO: 2465408 - DNA, 16 bp, Homo sapiens
atgtgagaggtttgac

SEQ ID NO: 2465409 - DNA, 19 bp, Homo sapiens
atgtgatatataagtgtac

SEQ ID NO: 2465410 - DNA, 21 bp, Homo sapiens
atgtgatatataagtgtacat

SEQ ID NO: 2465411 - DNA, 16 bp, Homo sapiens
atgtgatattctaaga

SEQ ID NO: 2465412 - DNA, 19 bp, Homo sapiens
atgtgatcatgtgtggaag

SEQ ID NO: 2465413 - DNA, 19 bp, Homo sapiens
atgtgatgaatactgtatt

SEQ ID NO: 2465414 - DNA, 16 bp, Homo sapiens
atgtgatgttctaagg

SEQ ID NO: 2465415 - DNA, 17 bp, Homo sapiens
atgtgatgttctaaggc

SEQ ID NO: 2465416 - DNA, 19 bp, Homo sapiens
atgtgatgttctaaggctc

SEQ ID NO: 2465417 - DNA, 15 bp, Homo sapiens
atgtgattgtggaat

SEQ ID NO: 2465418 - DNA, 15 bp, Homo sapiens
atgtgcaagtttatc

SEQ ID NO: 2465419 - DNA, 20 bp, Homo sapiens
atgtgcctattgctagagct

SEQ ID NO: 2465420 - DNA, 23 bp, Homo sapiens
atgtgcctattgctagagctcct

SEQ ID NO: 2465421 - DNA, 13 bp, Homo sapiens
atgtggctggaag

SEQ ID NO: 2465422 - DNA, 14 bp, Homo sapiens
atgtggctggaaga

SEQ ID NO: 2465423 - DNA, 16 bp, Homo sapiens
atgtggcttgagaaat

SEQ ID NO: 2465424 - DNA, 20 bp, Homo sapiens
atgtgggattatgggtcaca

SEQ ID NO: 2465425 - DNA, 13 bp, Homo sapiens
atgtggggccagg

SEQ ID NO: 2465426 - DNA, 16 bp, Homo sapiens
atgtgggttccacaga

SEQ ID NO: 2465427 - DNA, 15 bp, Homo sapiens
atgtggtcacagctg

SEQ ID NO: 2465428 - DNA, 17 bp, Homo sapiens
atgtggtcacagctgta

SEQ ID NO: 2465429 - DNA, 16 bp, Homo sapiens
atgtggttttagattt

SEQ ID NO: 2465430 - DNA, 16 bp, Homo sapiens
atgtgtagttcatgta

SEQ ID NO: 2465431 - DNA, 20 bp, Homo sapiens
atgtgtagttcatgtaaata

SEQ ID NO: 2465432 - DNA, 13 bp, Homo sapiens
atgtgtataaaaa

SEQ ID NO: 2465433 - DNA, 12 bp, Homo sapiens
atgtgtataaac

SEQ ID NO: 2465434 - DNA, 13 bp, Homo sapiens
atgtgtataaaca

SEQ ID NO: 2465435 - DNA, 17 bp, Homo sapiens
atgtgtcctgacactgc

SEQ ID NO: 2465436 - DNA, 16 bp, Homo sapiens
atgtgtgttttgctaa

SEQ ID NO: 2465437 - DNA, 23 bp, Homo sapiens
atgtgtgttttgctaaaggaaaa

SEQ ID NO: 2465438 - DNA, 17 bp, Homo sapiens
atgtgtttcacagtttg

SEQ ID NO: 2465439 - DNA, 12 bp, Homo sapiens
atgtgtttgctt

SEQ ID NO: 2465440 - DNA, 17 bp, Homo sapiens
atgtgtttgctttctga

SEQ ID NO: 2465441 - DNA, 14 bp, Homo sapiens
atgttaaaatgtgt

SEQ ID NO: 2465442 - DNA, 23 bp, Homo sapiens
atgttaaacttataacccacttt

SEQ ID NO: 2465443 - DNA, 15 bp, Homo sapiens
atgttaatattgatt

SEQ ID NO: 2465444 - DNA, 20 bp, Homo sapiens
atgttagttaccttatagtt

SEQ ID NO: 2465445 - DNA, 22 bp, Homo sapiens
atgttagttaccttatagttac

SEQ ID NO: 2465446 - DNA, 14 bp, Homo sapiens
atgttatatataaa

SEQ ID NO: 2465447 - DNA, 22 bp, Homo sapiens
atgttatatataaatatattat

SEQ ID NO: 2465448 - DNA, 20 bp, Homo sapiens
atgttatcttctcaagttct

SEQ ID NO: 2465449 - DNA, 13 bp, Homo sapiens
atgttattatctg

SEQ ID NO: 2465450 - DNA, 15 bp, Homo sapiens
atgttatttgtaata

SEQ ID NO: 2465451 - DNA, 17 bp, Homo sapiens
atgttattttttaatta

SEQ ID NO: 2465452 - DNA, 18 bp, Homo sapiens
atgttcacttttgacaaa

SEQ ID NO: 2465453 - DNA, 20 bp, Homo sapiens
atgttcacttttgacaaagg

SEQ ID NO: 2465454 - DNA, 22 bp, Homo sapiens
atgttcacttttgacaaaggca

SEQ ID NO: 2465455 - DNA, 19 bp, Homo sapiens
atgttcagcactgtccctt

SEQ ID NO: 2465456 - DNA, 12 bp, Homo sapiens
atgttccttcca

SEQ ID NO: 2465457 - DNA, 12 bp, Homo sapiens
atgttctaaggc

SEQ ID NO: 2465458 - DNA, 18 bp, Homo sapiens
atgttctaaggctctgag

SEQ ID NO: 2465459 - DNA, 19 bp, Homo sapiens
atgttctaaggctctgaga

SEQ ID NO: 2465460 - DNA, 18 bp, Homo sapiens
atgttctaagtctttcca

SEQ ID NO: 2465461 - DNA, 19 bp, Homo sapiens
atgttctaagtttctaaga

SEQ ID NO: 2465462 - DNA, 23 bp, Homo sapiens
atgttctaagtttctaagattct

SEQ ID NO: 2465463 - DNA, 13 bp, Homo sapiens
atgttctttggaa

SEQ ID NO: 2465464 - DNA, 14 bp, Homo sapiens
atgttctttggaaa

SEQ ID NO: 2465465 - DNA, 14 bp, Homo sapiens
ccagtgccctgagc

SEQ ID NO: 2465466 - DNA, 20 bp, Homo sapiens
ccagtgtcctgagctcagcg

SEQ ID NO: 2465467 - DNA, 17 bp, Homo sapiens
ccagtgttagggaaggg

SEQ ID NO: 2465468 - DNA, 17 bp, Homo sapiens
ccagttaaaaaaaattt

SEQ ID NO: 2465469 - DNA, 15 bp, Homo sapiens
ccagttgccatctgc

SEQ ID NO: 2465470 - DNA, 23 bp, Homo sapiens
ccagttggagttttttgtaccaa

SEQ ID NO: 2465471 - DNA, 17 bp, Homo sapiens
ccagtttctaaactgga

SEQ ID NO: 2465472 - DNA, 13 bp, Homo sapiens
ccataactgaaca

SEQ ID NO: 2465473 - DNA, 17 bp, Homo sapiens
ccatatgctaccaccag

SEQ ID NO: 2465474 - DNA, 18 bp, Homo sapiens
ccatattgtaaaacaggt

SEQ ID NO: 2465475 - DNA, 18 bp, Homo sapiens
ccatatttacctcagcct

SEQ ID NO: 2465476 - DNA, 19 bp, Homo sapiens
ccatatttgtaaaatgaca

SEQ ID NO: 2465477 - DNA, 20 bp, Homo sapiens
ccatatttgtaaaatgacaa

SEQ ID NO: 2465478 - DNA, 18 bp, Homo sapiens
ccatcaacaaaaattgtc

SEQ ID NO: 2465479 - DNA, 17 bp, Homo sapiens
ccatcacctcagatggc

SEQ ID NO: 2465480 - DNA, 18 bp, Homo sapiens
ccatcactgagttttcca

SEQ ID NO: 2465481 - DNA, 13 bp, Homo sapiens
ccatcatcctctg

SEQ ID NO: 2465482 - DNA, 14 bp, Homo sapiens
ccatccatggccag

SEQ ID NO: 2465483 - DNA, 15 bp, Homo sapiens
ccatccatggccagc

SEQ ID NO: 2465484 - DNA, 17 bp, Homo sapiens
ccatccatggccagcag

SEQ ID NO: 2465485 - DNA, 18 bp, Homo sapiens
ccatccatggccagcagc

SEQ ID NO: 2465486 - DNA, 14 bp, Homo sapiens
ccatcccacaccct

SEQ ID NO: 2465487 - DNA, 13 bp, Homo sapiens
ccatcccatgctg

SEQ ID NO: 2465488 - DNA, 22 bp, Homo sapiens
ccatccccttgaggtctcagcc

SEQ ID NO: 2465489 - DNA, 13 bp, Homo sapiens
ccatccctgtggt

SEQ ID NO: 2465490 - DNA, 13 bp, Homo sapiens
ccatcctgtgtgt

SEQ ID NO: 2465491 - DNA, 14 bp, Homo sapiens
ccatcctgtgtgtt

SEQ ID NO: 2465492 - DNA, 22 bp, Homo sapiens
ccatcctgtgtgttaagctctg

SEQ ID NO: 2465493 - DNA, 21 bp, Homo sapiens
ccatcgttgcccccatttctg

SEQ ID NO: 2465494 - DNA, 14 bp, Homo sapiens
ccatctcaggccag

SEQ ID NO: 2465495 - DNA, 15 bp, Homo sapiens
ccatctccctggtgc

SEQ ID NO: 2465496 - DNA, 14 bp, Homo sapiens
ccatctctccctcc

SEQ ID NO: 2465497 - DNA, 13 bp, Homo sapiens
ccatctgctcctg

SEQ ID NO: 2465498 - DNA, 15 bp, Homo sapiens
ccatctgtctgccaa

SEQ ID NO: 2465499 - DNA, 14 bp, Homo sapiens
ccatcttgagatgg

SEQ ID NO: 2465500 - DNA, 20 bp, Homo sapiens
ccatcttgcttccctaatct

SEQ ID NO: 2465501 - DNA, 21 bp, Homo sapiens
ccatgaccctgcctctcccag

SEQ ID NO: 2465502 - DNA, 23 bp, Homo sapiens
ccatgaccctgcctctcccaggc

SEQ ID NO: 2465503 - DNA, 20 bp, Homo sapiens
ccatgacctccagctttcct

SEQ ID NO: 2465504 - DNA, 12 bp, Homo sapiens
ccatgactgctt

SEQ ID NO: 2465505 - DNA, 13 bp, Homo sapiens
ccatgactgcttg

SEQ ID NO: 2465506 - DNA, 21 bp, Homo sapiens
ccatgagttggggtctggcag

SEQ ID NO: 2465507 - DNA, 23 bp, Homo sapiens
ccatgagttggggtctggcagcc

SEQ ID NO: 2465508 - DNA, 16 bp, Homo sapiens
ccatgatggcaacaga

SEQ ID NO: 2465509 - DNA, 22 bp, Homo sapiens
ccatgcgccccctccgccctgc

SEQ ID NO: 2465510 - DNA, 17 bp, Homo sapiens
ccatgctcatctgctgg

SEQ ID NO: 2465511 - DNA, 13 bp, Homo sapiens
ccatgctcctctt

SEQ ID NO: 2465512 - DNA, 15 bp, Homo sapiens
ccatgctcctcttcc

SEQ ID NO: 2465513 - DNA, 16 bp, Homo sapiens
ccatgctcctcttccc

SEQ ID NO: 2465514 - DNA, 24 bp, Homo sapiens
ccatgctcctcttccccagacgcc

SEQ ID NO: 2465515 - DNA, 16 bp, Homo sapiens
ccatgctgaggcctgg

SEQ ID NO: 2465516 - DNA, 19 bp, Homo sapiens
ccatgctgaggcctgggcc

SEQ ID NO: 2465517 - DNA, 20 bp, Homo sapiens
ccatgctgctggggaagaca

SEQ ID NO: 2465518 - DNA, 21 bp, Homo sapiens
ccatgctgctggggaagacag

SEQ ID NO: 2465519 - DNA, 14 bp, Homo sapiens
ccatggacaggctg

SEQ ID NO: 2465520 - DNA, 18 bp, Homo sapiens
ccatggacaggctggctc

SEQ ID NO: 2465521 - DNA, 16 bp, Homo sapiens
ccatggactctgtcct

SEQ ID NO: 2465522 - DNA, 21 bp, Homo sapiens
ccatggactctgtcctgaagg

SEQ ID NO: 2465523 - DNA, 15 bp, Homo sapiens
ccatggagaaagctg

SEQ ID NO: 2465524 - DNA, 19 bp, Homo sapiens
ccatggagaaagctgactt

SEQ ID NO: 2465525 - DNA, 14 bp, Homo sapiens
ccatggagtggcag

SEQ ID NO: 2465526 - DNA, 16 bp, Homo sapiens
ccatggccagcagcac

SEQ ID NO: 2465527 - DNA, 21 bp, Homo sapiens
ccatggccagcagcacctgcc

SEQ ID NO: 2465528 - DNA, 18 bp, Homo sapiens
ccatggcctgcaaactgg

SEQ ID NO: 2465529 - DNA, 12 bp, Homo sapiens
ccatggggaggg

SEQ ID NO: 2465530 - DNA, 20 bp, Homo sapiens
ccatggttaagagtccaaga

SEQ ID NO: 2465531 - DNA, 19 bp, Homo sapiens
ccatgtaactgcctagaaa

SEQ ID NO: 2465532 - DNA, 20 bp, Homo sapiens
ccatgtaactgcctagaaac

SEQ ID NO: 2465533 - DNA, 23 bp, Homo sapiens
ccatgtaatggcagttatatttt

SEQ ID NO: 2465534 - DNA, 16 bp, Homo sapiens
ccatgtacatgaagaa

SEQ ID NO: 2465535 - DNA, 15 bp, Homo sapiens
ccatgtagaaaattt

SEQ ID NO: 2465536 - DNA, 20 bp, Homo sapiens
ccatgtccaaagaggctgcc

SEQ ID NO: 2465537 - DNA, 13 bp, Homo sapiens
ccatgtcttctcc

SEQ ID NO: 2465538 - DNA, 19 bp, Homo sapiens
ccatgtcttctccctggaa

SEQ ID NO: 2465539 - DNA, 13 bp, Homo sapiens
ccatgtgcccagt

SEQ ID NO: 2465540 - DNA, 15 bp, Homo sapiens
ccatgttctgtccct

SEQ ID NO: 2465541 - DNA, 12 bp, Homo sapiens
ccattaaaccat

SEQ ID NO: 2465542 - DNA, 18 bp, Homo sapiens
ccattaaaccatctccct

SEQ ID NO: 2465543 - DNA, 23 bp, Homo sapiens
ccattaaacgatttttaaaatgt

SEQ ID NO: 2465544 - DNA, 18 bp, Homo sapiens
ccattaaagaatatgaaa

SEQ ID NO: 2465545 - DNA, 16 bp, Homo sapiens
ccattcctgaagaacc

SEQ ID NO: 2465546 - DNA, 22 bp, Homo sapiens
ccattcctgggaaatattccct

SEQ ID NO: 2465547 - DNA, 16 bp, Homo sapiens
ccattccttcccagag

SEQ ID NO: 2465548 - DNA, 21 bp, Homo sapiens
ccattctcacaggtcccaaat

SEQ ID NO: 2465549 - DNA, 16 bp, Homo sapiens
ccattctccacagcaa

SEQ ID NO: 2465550 - DNA, 18 bp, Homo sapiens
ccattctccacagcaacc

SEQ ID NO: 2465551 - DNA, 13 bp, Homo sapiens
ccattctcctgag

SEQ ID NO: 2465552 - DNA, 13 bp, Homo sapiens
ccattctgactcg

SEQ ID NO: 2465553 - DNA, 19 bp, Homo sapiens
ccattctgctccttcccca

SEQ ID NO: 2465554 - DNA, 17 bp, Homo sapiens
ccattgaaggcttaaac

SEQ ID NO: 2465555 - DNA, 15 bp, Homo sapiens
ccattggatctcatt

SEQ ID NO: 2465556 - DNA, 19 bp, Homo sapiens
ccattggctatttaaaact

SEQ ID NO: 2465557 - DNA, 21 bp, Homo sapiens
ccattggctatttaaaacttg

SEQ ID NO: 2465558 - DNA, 14 bp, Homo sapiens
ccattggtccaaga

SEQ ID NO: 2465559 - DNA, 20 bp, Homo sapiens
ccattgtagcgtctttcttt

SEQ ID NO: 2465560 - DNA, 20 bp, Homo sapiens
ccatttaatggggaggacaa

SEQ ID NO: 2465561 - DNA, 15 bp, Homo sapiens
ccatttgcatttgtt

SEQ ID NO: 2465562 - DNA, 23 bp, Homo sapiens
ccattttgttattgactaacagg

SEQ ID NO: 2465563 - DNA, 12 bp, Homo sapiens
ccatttttcctt

SEQ ID NO: 2465564 - DNA, 22 bp, Homo sapiens
cccaaacgccctttcctcctca

SEQ ID NO: 2465565 - DNA, 15 bp, Homo sapiens
cccaaagctttcctg

SEQ ID NO: 2465566 - DNA, 20 bp, Homo sapiens
cccaaagctttcctgcccca

SEQ ID NO: 2465567 - DNA, 15 bp, Homo sapiens
cccaaagtgctgaga

SEQ ID NO: 2465568 - DNA, 14 bp, Homo sapiens
cccaaatggccctg

SEQ ID NO: 2465569 - DNA, 23 bp, Homo sapiens
ccctatactgcttggagctgagc

SEQ ID NO: 2465570 - DNA, 23 bp, Homo sapiens
ccctcaagtctttctctttccct

SEQ ID NO: 2465571 - DNA, 18 bp, Homo sapiens
ccctcacagtattgctca

SEQ ID NO: 2465572 - DNA, 14 bp, Homo sapiens
ccctcacctcctct

SEQ ID NO: 2465573 - DNA, 16 bp, Homo sapiens
ccctcaccttctgagt

SEQ ID NO: 2465574 - DNA, 20 bp, Homo sapiens
ccctcaccttggcaccagac

SEQ ID NO: 2465575 - DNA, 21 bp, Homo sapiens
ccctcaccttggcaccagaca

SEQ ID NO: 2465576 - DNA, 23 bp, Homo sapiens
ccctcaccttggcaccagacacc

SEQ ID NO: 2465577 - DNA, 16 bp, Homo sapiens
ccctcagactggggca

SEQ ID NO: 2465578 - DNA, 10 bp, Homo sapiens
ccctcagggc

SEQ ID NO: 2465579 - DNA, 16 bp, Homo sapiens
ccctcagggcaaagcc

SEQ ID NO: 2465580 - DNA, 21 bp, Homo sapiens
ccctcagggcaaagccaggtc

SEQ ID NO: 2465581 - DNA, 17 bp, Homo sapiens
ccctcatcccgagcacc

SEQ ID NO: 2465582 - DNA, 13 bp, Homo sapiens
ccctccacacctg

SEQ ID NO: 2465583 - DNA, 15 bp, Homo sapiens
ccctccacacctgcg

SEQ ID NO: 2465584 - DNA, 17 bp, Homo sapiens
ccctccacacctgcggc

SEQ ID NO: 2465585 - DNA, 17 bp, Homo sapiens
ccctcccagagcacctg

SEQ ID NO: 2465586 - DNA, 21 bp, Homo sapiens
ccctccccaactgaccacctt

SEQ ID NO: 2465587 - DNA, 18 bp, Homo sapiens
ccctcccccccatgcact

SEQ ID NO: 2465588 - DNA, 19 bp, Homo sapiens
ccctccgccctgccactca

SEQ ID NO: 2465589 - DNA, 18 bp, Homo sapiens
ccctcctctagctgtggg

SEQ ID NO: 2465590 - DNA, 18 bp, Homo sapiens
ccctcctgtgctcagccc

SEQ ID NO: 2465591 - DNA, 19 bp, Homo sapiens
ccctcctgtgctcagccct

SEQ ID NO: 2465592 - DNA, 20 bp, Homo sapiens
ccctcctgtgctcagccctg

SEQ ID NO: 2465593 - DNA, 21 bp, Homo sapiens
ccctcctgtgctcagccctga

SEQ ID NO: 2465594 - DNA, 21 bp, Homo sapiens
ccctccttcccaagtgagtct

SEQ ID NO: 2465595 - DNA, 14 bp, Homo sapiens
ccctccttcctaaa

SEQ ID NO: 2465596 - DNA, 18 bp, Homo sapiens
ccctcggggatgtgtcct

SEQ ID NO: 2465597 - DNA, 15 bp, Homo sapiens
ccctctcagccctca

SEQ ID NO: 2465598 - DNA, 13 bp, Homo sapiens
ccctctcagctcc

SEQ ID NO: 2465599 - DNA, 14 bp, Homo sapiens
ccctctcagctcca

SEQ ID NO: 2465600 - DNA, 12 bp, Homo sapiens
ccctctcccagg

SEQ ID NO: 2465601 - DNA, 13 bp, Homo sapiens
ccctctcccaggc

SEQ ID NO: 2465602 - DNA, 18 bp, Homo sapiens
ccctctcccctgccccct

SEQ ID NO: 2465603 - DNA, 22 bp, Homo sapiens
ccctctcccctgccccctgcag

SEQ ID NO: 2465604 - DNA, 15 bp, Homo sapiens
ccctctccctgcatg

SEQ ID NO: 2465605 - DNA, 22 bp, Homo sapiens
ccctctcccttgggctctgatg

SEQ ID NO: 2465606 - DNA, 17 bp, Homo sapiens
ccctctccttcctgtgt

SEQ ID NO: 2465607 - DNA, 20 bp, Homo sapiens
ccctctctgcagacttccca

SEQ ID NO: 2465608 - DNA, 14 bp, Homo sapiens
ccctctctgctctg

SEQ ID NO: 2465609 - DNA, 22 bp, Homo sapiens
ccctctggaggggtgtggctcc

SEQ ID NO: 2465610 - DNA, 11 bp, Homo sapiens
ccctctgggat

SEQ ID NO: 2465611 - DNA, 16 bp, Homo sapiens
ccctctgggctctgag

SEQ ID NO: 2465612 - DNA, 22 bp, Homo sapiens
ccctctggtcgctcctgcccac

SEQ ID NO: 2465613 - DNA, 24 bp, Homo sapiens
ccctctgtccaggcactgagatac

SEQ ID NO: 2465614 - DNA, 18 bp, Homo sapiens
ccctctgttccttccctg

SEQ ID NO: 2465615 - DNA, 23 bp, Homo sapiens
ccctcttggagaagtctcagcta

SEQ ID NO: 2465616 - DNA, 19 bp, Homo sapiens
ccctctttggctcccctgt

SEQ ID NO: 2465617 - DNA, 20 bp, Homo sapiens
ccctctttggctcccctgta

SEQ ID NO: 2465618 - DNA, 20 bp, Homo sapiens
ccctgaagtgagcacagcct

SEQ ID NO: 2465619 - DNA, 15 bp, Homo sapiens
ccctgaccagctccc

SEQ ID NO: 2465620 - DNA, 16 bp, Homo sapiens
ccctgacctggccccc

SEQ ID NO: 2465621 - DNA, 19 bp, Homo sapiens
ccctgacctggccccctca

SEQ ID NO: 2465622 - DNA, 19 bp, Homo sapiens
ccctgagcgagtggagtct

SEQ ID NO: 2465623 - DNA, 19 bp, Homo sapiens
ccctgagctgaggcagcag

SEQ ID NO: 2465624 - DNA, 21 bp, Homo sapiens
ccctgagctgaggcagcagtg

SEQ ID NO: 2465625 - DNA, 16 bp, Homo sapiens
ccctgaggagtctgag

SEQ ID NO: 2465626 - DNA, 14 bp, Homo sapiens
ccctgatcccagag

SEQ ID NO: 2465627 - DNA, 20 bp, Homo sapiens
ccctgatcccagagagcccg

SEQ ID NO: 2465628 - DNA, 18 bp, Homo sapiens
ccctgcaaaaggactctc

SEQ ID NO: 2465629 - DNA, 16 bp, Homo sapiens
ccctgcactgtaaaat

SEQ ID NO: 2465630 - DNA, 22 bp, Homo sapiens
ccctgcagcttgtagccagccg

SEQ ID NO: 2465631 - DNA, 20 bp, Homo sapiens
ccctgcaggaaggagctgcc

SEQ ID NO: 2465632 - DNA, 22 bp, Homo sapiens
ccctgcaggaaggagctgcctg

SEQ ID NO: 2465633 - DNA, 18 bp, Homo sapiens
ccctgcaggctgagtgca

SEQ ID NO: 2465634 - DNA, 21 bp, Homo sapiens
ccctgcattggaactggaggc

SEQ ID NO: 2465635 - DNA, 12 bp, Homo sapiens
ccctgccagggc

SEQ ID NO: 2465636 - DNA, 20 bp, Homo sapiens
ccctgcccaccctctggaga

SEQ ID NO: 2465637 - DNA, 15 bp, Homo sapiens
ccctgccccccagcc

SEQ ID NO: 2465638 - DNA, 16 bp, Homo sapiens
ccctgccccccagcct

SEQ ID NO: 2465639 - DNA, 16 bp, Homo sapiens
ccctgccccctgcagg

SEQ ID NO: 2465640 - DNA, 19 bp, Homo sapiens
ccctgccccctgcaggaag

SEQ ID NO: 2465641 - DNA, 17 bp, Homo sapiens
ccctgcctcctgccggc

SEQ ID NO: 2465642 - DNA, 20 bp, Homo sapiens
ccctgcctctcccaggcagg

SEQ ID NO: 2465643 - DNA, 13 bp, Homo sapiens
ccctgcctggagg

SEQ ID NO: 2465644 - DNA, 14 bp, Homo sapiens
ccctgcctggagga

SEQ ID NO: 2465645 - DNA, 19 bp, Homo sapiens
ccctgcctggaggacctga

SEQ ID NO: 2465646 - DNA, 23 bp, Homo sapiens
ccctgcctggaggacctgagcct

SEQ ID NO: 2465647 - DNA, 13 bp, Homo sapiens
ccctgctacacct

SEQ ID NO: 2465648 - DNA, 16 bp, Homo sapiens
ccctgctacacctatt

SEQ ID NO: 2465649 - DNA, 15 bp, Homo sapiens
ccctgctcatccact

SEQ ID NO: 2465650 - DNA, 19 bp, Homo sapiens
ccctgcttcctgcttgcca

SEQ ID NO: 2465651 - DNA, 18 bp, Homo sapiens
ccctgctttgggcttggg

SEQ ID NO: 2465652 - DNA, 20 bp, Homo sapiens
ccctggatcagcgtggcctt

SEQ ID NO: 2465653 - DNA, 21 bp, Homo sapiens
ccctggatcagcgtggccttg

SEQ ID NO: 2465654 - DNA, 21 bp, Homo sapiens
ccctggcagagatgcctccct

SEQ ID NO: 2465655 - DNA, 13 bp, Homo sapiens
ccctggccccagg

SEQ ID NO: 2465656 - DNA, 15 bp, Homo sapiens
ccctggccgccccct

SEQ ID NO: 2465657 - DNA, 11 bp, Homo sapiens
ccctggcctcc

SEQ ID NO: 2465658 - DNA, 15 bp, Homo sapiens
ccctggcctccccca

SEQ ID NO: 2465659 - DNA, 20 bp, Homo sapiens
ccctggctccttgtgccaga

SEQ ID NO: 2465660 - DNA, 23 bp, Homo sapiens
ccctggctgggacgtggctcagc

SEQ ID NO: 2465661 - DNA, 23 bp, Homo sapiens
ccctggctttcattttctctcag

SEQ ID NO: 2465662 - DNA, 24 bp, Homo sapiens
ccctgggagaatcgctcctgcagc

SEQ ID NO: 2465663 - DNA, 19 bp, Homo sapiens
ccctgggccctgggctgga

SEQ ID NO: 2465664 - DNA, 19 bp, Homo sapiens
ccctgggcctgcctcacca

SEQ ID NO: 2465665 - DNA, 17 bp, Homo sapiens
ccctgggcctgctgctg

SEQ ID NO: 2465666 - DNA, 14 bp, Homo sapiens
ccctgggccttggg

SEQ ID NO: 2465667 - DNA, 12 bp, Homo sapiens
ccctggggcctg

SEQ ID NO: 2465668 - DNA, 17 bp, Homo sapiens
ccctggggcctgtactg

SEQ ID NO: 2465669 - DNA, 21 bp, Homo sapiens
ccctggggcctgtactgcctg

SEQ ID NO: 2465670 - DNA, 23 bp, Homo sapiens
ccctggggcctgtactgcctgct

SEQ ID NO: 2465671 - DNA, 19 bp, Homo sapiens
ccctggtaatagctgtaaa

SEQ ID NO: 2465672 - DNA, 19 bp, Homo sapiens
cctcccaatttcagactcc

SEQ ID NO: 2465673 - DNA, 13 bp, Homo sapiens
cctcccaccccca

SEQ ID NO: 2465674 - DNA, 11 bp, Homo sapiens
cctcccagaaa

SEQ ID NO: 2465675 - DNA, 23 bp, Homo sapiens
cctccccggctcgagcagtcctg

SEQ ID NO: 2465676 - DNA, 16 bp, Homo sapiens
cctcccctccatccct

SEQ ID NO: 2465677 - DNA, 12 bp, Homo sapiens
cctcccctgcca

SEQ ID NO: 2465678 - DNA, 16 bp, Homo sapiens
cctcccctgccagggc

SEQ ID NO: 2465679 - DNA, 12 bp, Homo sapiens
cctcccctggag

SEQ ID NO: 2465680 - DNA, 14 bp, Homo sapiens
cctccccttgcctg

SEQ ID NO: 2465681 - DNA, 12 bp, Homo sapiens
cctccccttggg

SEQ ID NO: 2465682 - DNA, 21 bp, Homo sapiens
cctccccttgggcccacacct

SEQ ID NO: 2465683 - DNA, 14 bp, Homo sapiens
cctccctccctctc

SEQ ID NO: 2465684 - DNA, 15 bp, Homo sapiens
cctccctccctctcc

SEQ ID NO: 2465685 - DNA, 22 bp, Homo sapiens
cctccctgagctagaaccctct

SEQ ID NO: 2465686 - DNA, 23 bp, Homo sapiens
cctccctgagctagaaccctctg

SEQ ID NO: 2465687 - DNA, 21 bp, Homo sapiens
cctcctcaggcacacagctac

SEQ ID NO: 2465688 - DNA, 21 bp, Homo sapiens
cctcctcatgtacataccctg

SEQ ID NO: 2465689 - DNA, 14 bp, Homo sapiens
cctcctccagggac

SEQ ID NO: 2465690 - DNA, 13 bp, Homo sapiens
cctcctccccact

SEQ ID NO: 2465691 - DNA, 14 bp, Homo sapiens
cctcctccccactt

SEQ ID NO: 2465692 - DNA, 12 bp, Homo sapiens
cctcctctgtga

SEQ ID NO: 2465693 - DNA, 22 bp, Homo sapiens
cctcctctgtgaccaatgtctt

SEQ ID NO: 2465694 - DNA, 19 bp, Homo sapiens
cctcctgacacccttctcc

SEQ ID NO: 2465695 - DNA, 12 bp, Homo sapiens
cctcctgcctct

SEQ ID NO: 2465696 - DNA, 13 bp, Homo sapiens
cctcctgcctcta

SEQ ID NO: 2465697 - DNA, 14 bp, Homo sapiens
cctcctgtgctcag

SEQ ID NO: 2465698 - DNA, 16 bp, Homo sapiens
cctcctgtgctcagcc

SEQ ID NO: 2465699 - DNA, 13 bp, Homo sapiens
cctccttcctctt

SEQ ID NO: 2465700 - DNA, 16 bp, Homo sapiens
cctccttctccctttt

SEQ ID NO: 2465701 - DNA, 17 bp, Homo sapiens
cctccttctgagctcct

SEQ ID NO: 2465702 - DNA, 19 bp, Homo sapiens
cctccttctgagctcctgt

SEQ ID NO: 2465703 - DNA, 18 bp, Homo sapiens
cctccttcttcagggact

SEQ ID NO: 2465704 - DNA, 20 bp, Homo sapiens
cctcgaaacacagaaacctt

SEQ ID NO: 2465705 - DNA, 20 bp, Homo sapiens
cctcgcccagcggcatcagg

SEQ ID NO: 2465706 - DNA, 21 bp, Homo sapiens
cctcgcccagcggcatcaggc

SEQ ID NO: 2465707 - DNA, 16 bp, Homo sapiens
cctcgcccctggcaga

SEQ ID NO: 2465708 - DNA, 13 bp, Homo sapiens
cctcgctgccagc

SEQ ID NO: 2465709 - DNA, 14 bp, Homo sapiens
cctcgctgccagct

SEQ ID NO: 2465710 - DNA, 20 bp, Homo sapiens
cctcgctgccagctctgtat

SEQ ID NO: 2465711 - DNA, 13 bp, Homo sapiens
cctcgtactcagg

SEQ ID NO: 2465712 - DNA, 14 bp, Homo sapiens
cctcgtttgtgttc

SEQ ID NO: 2465713 - DNA, 14 bp, Homo sapiens
cctctaacagcacc

SEQ ID NO: 2465714 - DNA, 15 bp, Homo sapiens
cctctaacagcacca

SEQ ID NO: 2465715 - DNA, 21 bp, Homo sapiens
cctctacagagcttccctgac

SEQ ID NO: 2465716 - DNA, 17 bp, Homo sapiens
cctctactgggaaggct

SEQ ID NO: 2465717 - DNA, 22 bp, Homo sapiens
cctctagctgtgggggtgaggg

SEQ ID NO: 2465718 - DNA, 22 bp, Homo sapiens
cctctaggtccccatactccta

SEQ ID NO: 2465719 - DNA, 16 bp, Homo sapiens
cctctcagctccaggt

SEQ ID NO: 2465720 - DNA, 18 bp, Homo sapiens
cctctcagctccaggtgg

SEQ ID NO: 2465721 - DNA, 23 bp, Homo sapiens
cctctcaggatccaagctaagca

SEQ ID NO: 2465722 - DNA, 17 bp, Homo sapiens
cctctccacacagtgct

SEQ ID NO: 2465723 - DNA, 15 bp, Homo sapiens
cctctcccaccctct

SEQ ID NO: 2465724 - DNA, 12 bp, Homo sapiens
cctctcccaggc

SEQ ID NO: 2465725 - DNA, 22 bp, Homo sapiens
cctctcccaggcaggggcccgc

SEQ ID NO: 2465726 - DNA, 14 bp, Homo sapiens
cctctcccaggccc

SEQ ID NO: 2465727 - DNA, 16 bp, Homo sapiens
cctctcccaggcccca

SEQ ID NO: 2465728 - DNA, 14 bp, Homo sapiens
cctctccccagccc

SEQ ID NO: 2465729 - DNA, 20 bp, Homo sapiens
cctctccccagcccagagac

SEQ ID NO: 2465730 - DNA, 21 bp, Homo sapiens
cctctccccagcccagagaca

SEQ ID NO: 2465731 - DNA, 21 bp, Homo sapiens
cctctccccaggtccagctct

SEQ ID NO: 2465732 - DNA, 23 bp, Homo sapiens
cctctccccaggtccagctctgg

SEQ ID NO: 2465733 - DNA, 13 bp, Homo sapiens
cctctcccctgcc

SEQ ID NO: 2465734 - DNA, 20 bp, Homo sapiens
cctctcccctgccccctgca

SEQ ID NO: 2465735 - DNA, 21 bp, Homo sapiens
cctctcccctgccccctgcag

SEQ ID NO: 2465736 - DNA, 20 bp, Homo sapiens
cctctcccttgggctctgat

SEQ ID NO: 2465737 - DNA, 22 bp, Homo sapiens
cctctcccttgggctctgatga

SEQ ID NO: 2465738 - DNA, 15 bp, Homo sapiens
cctctccttcctgtg

SEQ ID NO: 2465739 - DNA, 14 bp, Homo sapiens
cctctcgcggccct

SEQ ID NO: 2465740 - DNA, 17 bp, Homo sapiens
cctctctatcctctctt

SEQ ID NO: 2465741 - DNA, 21 bp, Homo sapiens
cctctctatcctctcttcctc

SEQ ID NO: 2465742 - DNA, 17 bp, Homo sapiens
cctctctgcagacttcc

SEQ ID NO: 2465743 - DNA, 22 bp, Homo sapiens
cctctctgcagacttcccagct

SEQ ID NO: 2465744 - DNA, 12 bp, Homo sapiens
cctctctggaga

SEQ ID NO: 2465745 - DNA, 23 bp, Homo sapiens
cctctctggagaaagggccctgg

SEQ ID NO: 2465746 - DNA, 12 bp, Homo sapiens
cctctcttcctc

SEQ ID NO: 2465747 - DNA, 12 bp, Homo sapiens
cctctgacagca

SEQ ID NO: 2465748 - DNA, 13 bp, Homo sapiens
cctctgacagcag

SEQ ID NO: 2465749 - DNA, 14 bp, Homo sapiens
cctctgacagcagc

SEQ ID NO: 2465750 - DNA, 18 bp, Homo sapiens
cctctgacagcagcatct

SEQ ID NO: 2465751 - DNA, 17 bp, Homo sapiens
cctctgacctgcactgg

SEQ ID NO: 2465752 - DNA, 17 bp, Homo sapiens
cctctgactcagggctc

SEQ ID NO: 2465753 - DNA, 19 bp, Homo sapiens
cctctgactcagggctcct

SEQ ID NO: 2465754 - DNA, 16 bp, Homo sapiens
cctctgagactccaga

SEQ ID NO: 2465755 - DNA, 19 bp, Homo sapiens
cctctgagactccagacct

SEQ ID NO: 2465756 - DNA, 12 bp, Homo sapiens
cctctgaggcca

SEQ ID NO: 2465757 - DNA, 16 bp, Homo sapiens
cctctgaggccagcct

SEQ ID NO: 2465758 - DNA, 20 bp, Homo sapiens
cctctgccaaaggatgtgat

SEQ ID NO: 2465759 - DNA, 17 bp, Homo sapiens
cctctgctgacctgctg

SEQ ID NO: 2465760 - DNA, 14 bp, Homo sapiens
cctctgctgctgtc

SEQ ID NO: 2465761 - DNA, 19 bp, Homo sapiens
cctctgctgctgtccctcc

SEQ ID NO: 2465762 - DNA, 20 bp, Homo sapiens
cctctgctgctgtccctccc

SEQ ID NO: 2465763 - DNA, 16 bp, Homo sapiens
cctctggagccagccg

SEQ ID NO: 2465764 - DNA, 22 bp, Homo sapiens
cctctggaggggtgtggctcct

SEQ ID NO: 2465765 - DNA, 21 bp, Homo sapiens
cctctggcattagaattattt

SEQ ID NO: 2465766 - DNA, 23 bp, Homo sapiens
cctctggcttggccacagccagg

SEQ ID NO: 2465767 - DNA, 20 bp, Homo sapiens
cctctggggggtggccaggc

SEQ ID NO: 2465768 - DNA, 20 bp, Homo sapiens
cctctggtcgctcctgccca

SEQ ID NO: 2465769 - DNA, 21 bp, Homo sapiens
cctctggtcgctcctgcccac

SEQ ID NO: 2465770 - DNA, 16 bp, Homo sapiens
cctctgtcagtcacag

SEQ ID NO: 2465771 - DNA, 15 bp, Homo sapiens
cctctgtccaggcac

SEQ ID NO: 2465772 - DNA, 19 bp, Homo sapiens
cctctgtccaggcactgag

SEQ ID NO: 2465773 - DNA, 21 bp, Homo sapiens
cctctgtccaggcactgagat

SEQ ID NO: 2465774 - DNA, 15 bp, Homo sapiens
cctctgtctcgagcg

SEQ ID NO: 2465775 - DNA, 18 bp, Homo sapiens
cctctgtctcgagcgccc

SEQ ID NO: 2465776 - DNA, 12 bp, Homo sapiens
tagttgtgtctg

SEQ ID NO: 2465777 - DNA, 13 bp, Homo sapiens
tagtttctgaggc

SEQ ID NO: 2465778 - DNA, 21 bp, Homo sapiens
tagtttgattattcagtgtca

SEQ ID NO: 2465779 - DNA, 19 bp, Homo sapiens
tagtttgtgtgttgtctct

SEQ ID NO: 2465780 - DNA, 13 bp, Homo sapiens
tagttttattctt

SEQ ID NO: 2465781 - DNA, 22 bp, Homo sapiens
tagttttcatccataactgaac

SEQ ID NO: 2465782 - DNA, 21 bp, Homo sapiens
tagtttttcattaaataaatt

SEQ ID NO: 2465783 - DNA, 15 bp, Homo sapiens
tagttttttcatctt

SEQ ID NO: 2465784 - DNA, 15 bp, Homo sapiens
tataaaaaatggttc

SEQ ID NO: 2465785 - DNA, 16 bp, Homo sapiens
tataaaaaatggttca

SEQ ID NO: 2465786 - DNA, 22 bp, Homo sapiens
tataaaaataaaaaagatccca

SEQ ID NO: 2465787 - DNA, 21 bp, Homo sapiens
tataaacaagaaaaataaaga

SEQ ID NO: 2465788 - DNA, 12 bp, Homo sapiens
tataaagcattt

SEQ ID NO: 2465789 - DNA, 15 bp, Homo sapiens
tataaatatattatt

SEQ ID NO: 2465790 - DNA, 19 bp, Homo sapiens
tataaatatattattactt

SEQ ID NO: 2465791 - DNA, 16 bp, Homo sapiens
tataaatgcaaataac

SEQ ID NO: 2465792 - DNA, 16 bp, Homo sapiens
tataacagtgtttaaa

SEQ ID NO: 2465793 - DNA, 19 bp, Homo sapiens
tataaccaacttttctatt

SEQ ID NO: 2465794 - DNA, 22 bp, Homo sapiens
tataaggtgctctctttctgtc

SEQ ID NO: 2465795 - DNA, 14 bp, Homo sapiens
tataagtgtacata

SEQ ID NO: 2465796 - DNA, 17 bp, Homo sapiens
tataatatactatattt

SEQ ID NO: 2465797 - DNA, 20 bp, Homo sapiens
tataatatactatatttatg

SEQ ID NO: 2465798 - DNA, 23 bp, Homo sapiens
tataatcattattacttttgctg

SEQ ID NO: 2465799 - DNA, 16 bp, Homo sapiens
tataatcttataattg

SEQ ID NO: 2465800 - DNA, 17 bp, Homo sapiens
tataatgttgttattta

SEQ ID NO: 2465801 - DNA, 19 bp, Homo sapiens
tataattatatgttgtaag

SEQ ID NO: 2465802 - DNA, 16 bp, Homo sapiens
tataattctttcaata

SEQ ID NO: 2465803 - DNA, 17 bp, Homo sapiens
tataattgccaaaaagt

SEQ ID NO: 2465804 - DNA, 18 bp, Homo sapiens
tataattgttttatctga

SEQ ID NO: 2465805 - DNA, 16 bp, Homo sapiens
tataatttacctaaga

SEQ ID NO: 2465806 - DNA, 15 bp, Homo sapiens
tataccaaaatgttg

SEQ ID NO: 2465807 - DNA, 12 bp, Homo sapiens
tatacctcactt

SEQ ID NO: 2465808 - DNA, 22 bp, Homo sapiens
tatacctgtgtttcttgcctca

SEQ ID NO: 2465809 - DNA, 17 bp, Homo sapiens
tatacgaaataattgtt

SEQ ID NO: 2465810 - DNA, 22 bp, Homo sapiens
tatactagggagccatttgaga

SEQ ID NO: 2465811 - DNA, 21 bp, Homo sapiens
tatactctcaccatttggatc

SEQ ID NO: 2465812 - DNA, 15 bp, Homo sapiens
tatacttgtaattat

SEQ ID NO: 2465813 - DNA, 12 bp, Homo sapiens
tatactttccct

SEQ ID NO: 2465814 - DNA, 20 bp, Homo sapiens
tatactttccctaccctcta

SEQ ID NO: 2465815 - DNA, 17 bp, Homo sapiens
tatagaactgaatgaga

SEQ ID NO: 2465816 - DNA, 19 bp, Homo sapiens
tatagaagtataaagaatt

SEQ ID NO: 2465817 - DNA, 13 bp, Homo sapiens
tatagaagtttag

SEQ ID NO: 2465818 - DNA, 13 bp, Homo sapiens
tatagattctaaa

SEQ ID NO: 2465819 - DNA, 17 bp, Homo sapiens
tatagattctaaagatt

SEQ ID NO: 2465820 - DNA, 21 bp, Homo sapiens
tataggatttatttaaaatag

SEQ ID NO: 2465821 - DNA, 13 bp, Homo sapiens
tatagtgatgtaa

SEQ ID NO: 2465822 - DNA, 17 bp, Homo sapiens
tatagttaacacactac

SEQ ID NO: 2465823 - DNA, 18 bp, Homo sapiens
tatagttactgtgtaatt

SEQ ID NO: 2465824 - DNA, 20 bp, Homo sapiens
tatagttactgtgtaattag

SEQ ID NO: 2465825 - DNA, 22 bp, Homo sapiens
tatagttattaagttctttaaa

SEQ ID NO: 2465826 - DNA, 16 bp, Homo sapiens
tatataatcatcaagt

SEQ ID NO: 2465827 - DNA, 21 bp, Homo sapiens
tatatagccaatataactatc

SEQ ID NO: 2465828 - DNA, 15 bp, Homo sapiens
tatatatatataaag

SEQ ID NO: 2465829 - DNA, 22 bp, Homo sapiens
tatatatggggatggtagtttt

SEQ ID NO: 2465830 - DNA, 14 bp, Homo sapiens
tatatattatactt

SEQ ID NO: 2465831 - DNA, 18 bp, Homo sapiens
tatatggaaatatatatt

SEQ ID NO: 2465832 - DNA, 19 bp, Homo sapiens
tatatggaaatatatatta

SEQ ID NO: 2465833 - DNA, 18 bp, Homo sapiens
tatatggacaaaacaaga

SEQ ID NO: 2465834 - DNA, 12 bp, Homo sapiens
tatatgtacatg

SEQ ID NO: 2465835 - DNA, 17 bp, Homo sapiens
tatattatacttgtaat

SEQ ID NO: 2465836 - DNA, 20 bp, Homo sapiens
tatattatacttgtaattat

SEQ ID NO: 2465837 - DNA, 13 bp, Homo sapiens
tatattatatgga

SEQ ID NO: 2465838 - DNA, 14 bp, Homo sapiens
tatattatatggaa

SEQ ID NO: 2465839 - DNA, 12 bp, Homo sapiens
tatattattact

SEQ ID NO: 2465840 - DNA, 19 bp, Homo sapiens
tatattattacttgtaaat

SEQ ID NO: 2465841 - DNA, 22 bp, Homo sapiens
tatattcaggacttgaaagaaa

SEQ ID NO: 2465842 - DNA, 18 bp, Homo sapiens
tatattgtgtttgtgtat

SEQ ID NO: 2465843 - DNA, 18 bp, Homo sapiens
tatatttaaaagtgtcaa

SEQ ID NO: 2465844 - DNA, 14 bp, Homo sapiens
tatattttcctata

SEQ ID NO: 2465845 - DNA, 17 bp, Homo sapiens
tatattttgtttacaaa

SEQ ID NO: 2465846 - DNA, 19 bp, Homo sapiens
tatcaaaactttcttttct

SEQ ID NO: 2465847 - DNA, 22 bp, Homo sapiens
tatcaaaccctagccttgcttg

SEQ ID NO: 2465848 - DNA, 15 bp, Homo sapiens
tatcaaatctaccac

SEQ ID NO: 2465849 - DNA, 20 bp, Homo sapiens
tatcacacacattgctgtga

SEQ ID NO: 2465850 - DNA, 21 bp, Homo sapiens
tatcacccaacgctccaaagt

SEQ ID NO: 2465851 - DNA, 23 bp, Homo sapiens
tatcacccagacataaaggaaaa

SEQ ID NO: 2465852 - DNA, 23 bp, Homo sapiens
tatcaccgtgggctccctgactg

SEQ ID NO: 2465853 - DNA, 9 bp, Homo sapiens
tatcagtag

SEQ ID NO: 2465854 - DNA, 20 bp, Homo sapiens
tatcagtcaatatttttaga

SEQ ID NO: 2465855 - DNA, 15 bp, Homo sapiens
tatcatccacacatg

SEQ ID NO: 2465856 - DNA, 17 bp, Homo sapiens
tatcatccacacatgaa

SEQ ID NO: 2465857 - DNA, 22 bp, Homo sapiens
tatcatctacctagatttaata

SEQ ID NO: 2465858 - DNA, 13 bp, Homo sapiens
tatcattcaagtg

SEQ ID NO: 2465859 - DNA, 22 bp, Homo sapiens
tatcattcaagtgtaaaatatt

SEQ ID NO: 2465860 - DNA, 24 bp, Homo sapiens
tatccataatgcattcttctctgt

SEQ ID NO: 2465861 - DNA, 17 bp, Homo sapiens
tatccatattgagtcaa

SEQ ID NO: 2465862 - DNA, 16 bp, Homo sapiens
tatcccagctgcctag

SEQ ID NO: 2465863 - DNA, 17 bp, Homo sapiens
tatccccccatcttgct

SEQ ID NO: 2465864 - DNA, 20 bp, Homo sapiens
tatccccccatcttgcttcc

SEQ ID NO: 2465865 - DNA, 15 bp, Homo sapiens
tatccctacatgtat

SEQ ID NO: 2465866 - DNA, 14 bp, Homo sapiens
tatccctcctgttg

SEQ ID NO: 2465867 - DNA, 18 bp, Homo sapiens
tatccggacagagcacgt

SEQ ID NO: 2465868 - DNA, 18 bp, Homo sapiens
tatcctctcttcctcttc

SEQ ID NO: 2465869 - DNA, 22 bp, Homo sapiens
tatcctgtttgaggaaagcaag

SEQ ID NO: 2465870 - DNA, 16 bp, Homo sapiens
tatctccctgcctcct

SEQ ID NO: 2465871 - DNA, 11 bp, Homo sapiens
tatctctgtgt

SEQ ID NO: 2465872 - DNA, 11 bp, Homo sapiens
tatctgggctt

SEQ ID NO: 2465873 - DNA, 16 bp, Homo sapiens
tatctgggcttcctgg

SEQ ID NO: 2465874 - DNA, 21 bp, Homo sapiens
tatctgtagacggctcagtat

SEQ ID NO: 2465875 - DNA, 17 bp, Homo sapiens
tatcttactatttcaca

SEQ ID NO: 2465876 - DNA, 14 bp, Homo sapiens
tatcttcacttgtc

SEQ ID NO: 2465877 - DNA, 17 bp, Homo sapiens
tatcttctcaagttcta

SEQ ID NO: 2465878 - DNA, 18 bp, Homo sapiens
tatcttctcaagttctaa

SEQ ID NO: 2465879 - DNA, 22 bp, Homo sapiens
tatcttctcaagttctaagatt

SEQ ID NO: 2465880 - DNA, 20 bp, Homo sapiens
tcaaggcactctagattcca

SEQ ID NO: 2465881 - DNA, 21 bp, Homo sapiens
tcaaggcactctagattccat

SEQ ID NO: 2465882 - DNA, 21 bp, Homo sapiens
tcaaggttttaggttctaaag

SEQ ID NO: 2465883 - DNA, 15 bp, Homo sapiens
tcaagtaatacaaac

SEQ ID NO: 2465884 - DNA, 16 bp, Homo sapiens
tcaagtctctgctggc

SEQ ID NO: 2465885 - DNA, 14 bp, Homo sapiens
tcaagttctaagat

SEQ ID NO: 2465886 - DNA, 17 bp, Homo sapiens
tcaagttctaagattct

SEQ ID NO: 2465887 - DNA, 18 bp, Homo sapiens
tcaagttctaagattcta

SEQ ID NO: 2465888 - DNA, 19 bp, Homo sapiens
tcaagttctaagattctaa

SEQ ID NO: 2465889 - DNA, 15 bp, Homo sapiens
tcaataatatatttt

SEQ ID NO: 2465890 - DNA, 20 bp, Homo sapiens
tcaataatatattttctgtt

SEQ ID NO: 2465891 - DNA, 15 bp, Homo sapiens
tcaatacagatatat

SEQ ID NO: 2465892 - DNA, 12 bp, Homo sapiens
tcaatagccact

SEQ ID NO: 2465893 - DNA, 23 bp, Homo sapiens
tcaatagccactaaccttgcctg

SEQ ID NO: 2465894 - DNA, 16 bp, Homo sapiens
tcaatatttttagata

SEQ ID NO: 2465895 - DNA, 16 bp, Homo sapiens
tcaatcaactttactg

SEQ ID NO: 2465896 - DNA, 17 bp, Homo sapiens
tcaatcaactttactgt

SEQ ID NO: 2465897 - DNA, 19 bp, Homo sapiens
tcaatcagtctcagaatgt

SEQ ID NO: 2465898 - DNA, 16 bp, Homo sapiens
tcaatcatttctatta

SEQ ID NO: 2465899 - DNA, 19 bp, Homo sapiens
tcaatctctgggggctgag

SEQ ID NO: 2465900 - DNA, 18 bp, Homo sapiens
tcaatcttgcatgtaacg

SEQ ID NO: 2465901 - DNA, 18 bp, Homo sapiens
tcaatctttaaaccaatt

SEQ ID NO: 2465902 - DNA, 15 bp, Homo sapiens
tcaatgacatgaatt

SEQ ID NO: 2465903 - DNA, 22 bp, Homo sapiens
tcaatgacatgaattttagctt

SEQ ID NO: 2465904 - DNA, 23 bp, Homo sapiens
tcaatgacatgaattttagcttt

SEQ ID NO: 2465905 - DNA, 21 bp, Homo sapiens
tcaatgagcatgtttagactt

SEQ ID NO: 2465906 - DNA, 18 bp, Homo sapiens
tcaatgtttcttctaggt

SEQ ID NO: 2465907 - DNA, 15 bp, Homo sapiens
tcaattcaaagctgt

SEQ ID NO: 2465908 - DNA, 22 bp, Homo sapiens
tcaattcaaagctgtgtgtttg

SEQ ID NO: 2465909 - DNA, 15 bp, Homo sapiens
tcaattccaacagtt

SEQ ID NO: 2465910 - DNA, 23 bp, Homo sapiens
tcaatttctgtgttgccaagctc

SEQ ID NO: 2465911 - DNA, 21 bp, Homo sapiens
tcaattttatccctcacctgt

SEQ ID NO: 2465912 - DNA, 20 bp, Homo sapiens
tcacaaaatatattttgttt

SEQ ID NO: 2465913 - DNA, 14 bp, Homo sapiens
tcacaacagcctga

SEQ ID NO: 2465914 - DNA, 16 bp, Homo sapiens
tcacaaggcagcaagg

SEQ ID NO: 2465915 - DNA, 18 bp, Homo sapiens
tcacaaggcagcaaggcc

SEQ ID NO: 2465916 - DNA, 23 bp, Homo sapiens
tcacaaggcagcaaggcccgagc

SEQ ID NO: 2465917 - DNA, 15 bp, Homo sapiens
tcacaatgagattga

SEQ ID NO: 2465918 - DNA, 13 bp, Homo sapiens
tcacacaaagcag

SEQ ID NO: 2465919 - DNA, 14 bp, Homo sapiens
tcacacaaagcaga

SEQ ID NO: 2465920 - DNA, 20 bp, Homo sapiens
tcacacaggcatttcctggg

SEQ ID NO: 2465921 - DNA, 15 bp, Homo sapiens
tcacaccactagcct

SEQ ID NO: 2465922 - DNA, 20 bp, Homo sapiens
tcacaccactagcctcaggg

SEQ ID NO: 2465923 - DNA, 12 bp, Homo sapiens
tcacactcgaca

SEQ ID NO: 2465924 - DNA, 16 bp, Homo sapiens
tcacactcgacatgaa

SEQ ID NO: 2465925 - DNA, 23 bp, Homo sapiens
tcacactgggtggtggcctggtc

SEQ ID NO: 2465926 - DNA, 23 bp, Homo sapiens
tcacagaagtgttaacttttcta

SEQ ID NO: 2465927 - DNA, 16 bp, Homo sapiens
tcacagcatggaggag

SEQ ID NO: 2465928 - DNA, 17 bp, Homo sapiens
tcacagcatggaggagg

SEQ ID NO: 2465929 - DNA, 14 bp, Homo sapiens
tcacagctcctccc

SEQ ID NO: 2465930 - DNA, 16 bp, Homo sapiens
tcacagctcctcccac

SEQ ID NO: 2465931 - DNA, 14 bp, Homo sapiens
tcacaggcagccag

SEQ ID NO: 2465932 - DNA, 23 bp, Homo sapiens
tcacaggcagccagtgccctgag

SEQ ID NO: 2465933 - DNA, 14 bp, Homo sapiens
tcacagtattgctc

SEQ ID NO: 2465934 - DNA, 16 bp, Homo sapiens
tcacagtgaacactca

SEQ ID NO: 2465935 - DNA, 19 bp, Homo sapiens
tcacagttctttgggccag

SEQ ID NO: 2465936 - DNA, 15 bp, Homo sapiens
tcacagtttgaaata

SEQ ID NO: 2465937 - DNA, 14 bp, Homo sapiens
tcacatagcccact

SEQ ID NO: 2465938 - DNA, 22 bp, Homo sapiens
tcacatattttaaaatttgttc

SEQ ID NO: 2465939 - DNA, 21 bp, Homo sapiens
tcacatgaattattacagtgt

SEQ ID NO: 2465940 - DNA, 12 bp, Homo sapiens
tcacattagaag

SEQ ID NO: 2465941 - DNA, 14 bp, Homo sapiens
tcacattagaagac

SEQ ID NO: 2465942 - DNA, 15 bp, Homo sapiens
tcacattagaagaca

SEQ ID NO: 2465943 - DNA, 17 bp, Homo sapiens
tcaccaggcagcctctg

SEQ ID NO: 2465944 - DNA, 19 bp, Homo sapiens
tcaccaggcagcctctggg

SEQ ID NO: 2465945 - DNA, 17 bp, Homo sapiens
tcaccatgttagccagg

SEQ ID NO: 2465946 - DNA, 13 bp, Homo sapiens
tcacccacccctg

SEQ ID NO: 2465947 - DNA, 19 bp, Homo sapiens
tcacccaggctggagtgca

SEQ ID NO: 2465948 - DNA, 12 bp, Homo sapiens
tcaccccaccct

SEQ ID NO: 2465949 - DNA, 15 bp, Homo sapiens
tcacccctgtttctg

SEQ ID NO: 2465950 - DNA, 23 bp, Homo sapiens
tcaccctgatttaggagaagcca

SEQ ID NO: 2465951 - DNA, 17 bp, Homo sapiens
tcaccctggaggcacct

SEQ ID NO: 2465952 - DNA, 22 bp, Homo sapiens
tcaccctttgctgtgaggctgt

SEQ ID NO: 2465953 - DNA, 16 bp, Homo sapiens
tcacctcagatggcag

SEQ ID NO: 2465954 - DNA, 18 bp, Homo sapiens
tcacctcagatggcagct

SEQ ID NO: 2465955 - DNA, 23 bp, Homo sapiens
tcacctcagatggcagcttttaa

SEQ ID NO: 2465956 - DNA, 16 bp, Homo sapiens
tcacctgccccaactc

SEQ ID NO: 2465957 - DNA, 23 bp, Homo sapiens
tcacctggccctgcttcctgctt

SEQ ID NO: 2465958 - DNA, 14 bp, Homo sapiens
tcacctgtgcttcg

SEQ ID NO: 2465959 - DNA, 19 bp, Homo sapiens
tcaccttggcaccagacac

SEQ ID NO: 2465960 - DNA, 16 bp, Homo sapiens
tcacgcatgcagtgtt

SEQ ID NO: 2465961 - DNA, 22 bp, Homo sapiens
tcactaggcccccacttgcctc

SEQ ID NO: 2465962 - DNA, 12 bp, Homo sapiens
tcactcaaggcg

SEQ ID NO: 2465963 - DNA, 20 bp, Homo sapiens
tcactcaaggcggtgcttga

SEQ ID NO: 2465964 - DNA, 19 bp, Homo sapiens
tcactcagccaccctgagt

SEQ ID NO: 2465965 - DNA, 14 bp, Homo sapiens
tcactcgataataa

SEQ ID NO: 2465966 - DNA, 18 bp, Homo sapiens
tcactctagtcaatgaca

SEQ ID NO: 2465967 - DNA, 20 bp, Homo sapiens
tcactcttatgctgtaccca

SEQ ID NO: 2465968 - DNA, 23 bp, Homo sapiens
tcactgagttttccatggcagga

SEQ ID NO: 2465969 - DNA, 17 bp, Homo sapiens
tcactgcaacatgatga

SEQ ID NO: 2465970 - DNA, 14 bp, Homo sapiens
tcactggagcacaa

SEQ ID NO: 2465971 - DNA, 22 bp, Homo sapiens
tcactggcgacacgtagcagct

SEQ ID NO: 2465972 - DNA, 22 bp, Homo sapiens
tcacttaaacttgcatcactta

SEQ ID NO: 2465973 - DNA, 22 bp, Homo sapiens
tcacttgtcaggagtgtgtgtg

SEQ ID NO: 2465974 - DNA, 17 bp, Homo sapiens
tcacttgtgcagtgttg

SEQ ID NO: 2465975 - DNA, 13 bp, Homo sapiens
tcacttttcccac

SEQ ID NO: 2465976 - DNA, 20 bp, Homo sapiens
tcactttttgaggcaaaaga

SEQ ID NO: 2465977 - DNA, 20 bp, Homo sapiens
tcagaaaatatccctcctgt

SEQ ID NO: 2465978 - DNA, 18 bp, Homo sapiens
tcagaaaatgttctgttt

SEQ ID NO: 2465979 - DNA, 19 bp, Homo sapiens
tcagaaaatgttctgtttg

SEQ ID NO: 2465980 - DNA, 17 bp, Homo sapiens
tcagaaagggagggctc

SEQ ID NO: 2465981 - DNA, 20 bp, Homo sapiens
tcagaaagggagggctctga

SEQ ID NO: 2465982 - DNA, 15 bp, Homo sapiens
tcagaaagtgcctga

SEQ ID NO: 2465983 - DNA, 18 bp, Homo sapiens
tccaaattcagtttcata

SEQ ID NO: 2465984 - DNA, 23 bp, Homo sapiens
tccaacaccaagcacagcagcct

SEQ ID NO: 2465985 - DNA, 22 bp, Homo sapiens
tccaacccgtctggcccaccag

SEQ ID NO: 2465986 - DNA, 21 bp, Homo sapiens
tccaactactaatagaataaa

SEQ ID NO: 2465987 - DNA, 23 bp, Homo sapiens
tccaactactaatagaataaagg

SEQ ID NO: 2465988 - DNA, 19 bp, Homo sapiens
tccaactcgaatctgtgtg

SEQ ID NO: 2465989 - DNA, 24 bp, Homo sapiens
tccaactcttccccctctcccagt

SEQ ID NO: 2465990 - DNA, 23 bp, Homo sapiens
tccaactggccctatttagatga

SEQ ID NO: 2465991 - DNA, 19 bp, Homo sapiens
tccaagaatccacatttct

SEQ ID NO: 2465992 - DNA, 21 bp, Homo sapiens
tccaagaatccacatttctaa

SEQ ID NO: 2465993 - DNA, 22 bp, Homo sapiens
tccaagaatccacatttctaaa

SEQ ID NO: 2465994 - DNA, 13 bp, Homo sapiens
tccaagactctag

SEQ ID NO: 2465995 - DNA, 18 bp, Homo sapiens
tccaagatattttaaaat

SEQ ID NO: 2465996 - DNA, 22 bp, Homo sapiens
tccaagatattttaaaatctgt

SEQ ID NO: 2465997 - DNA, 13 bp, Homo sapiens
tccaagattccgg

SEQ ID NO: 2465998 - DNA, 15 bp, Homo sapiens
tccaagattccggat

SEQ ID NO: 2465999 - DNA, 16 bp, Homo sapiens
tccaagattctagatg

SEQ ID NO: 2466000 - DNA, 23 bp, Homo sapiens
tccaagcagcctgagcaactctt

SEQ ID NO: 2466001 - DNA, 15 bp, Homo sapiens
tccaagcagcttaga

SEQ ID NO: 2466002 - DNA, 19 bp, Homo sapiens
tccaagccccatcttctaa

SEQ ID NO: 2466003 - DNA, 22 bp, Homo sapiens
tccaagctcactccccaacccc

SEQ ID NO: 2466004 - DNA, 12 bp, Homo sapiens
tccaagctggga

SEQ ID NO: 2466005 - DNA, 21 bp, Homo sapiens
tccaaggggaatcagaactca

SEQ ID NO: 2466006 - DNA, 19 bp, Homo sapiens
tccaaggtttaaagagtct

SEQ ID NO: 2466007 - DNA, 20 bp, Homo sapiens
tccaaggtttaaagagtcta

SEQ ID NO: 2466008 - DNA, 14 bp, Homo sapiens
tccaagtctccacc

SEQ ID NO: 2466009 - DNA, 14 bp, Homo sapiens
tccaagttaaatgt

SEQ ID NO: 2466010 - DNA, 12 bp, Homo sapiens
tccaatgagctt

SEQ ID NO: 2466011 - DNA, 13 bp, Homo sapiens
tccaatgagcttt

SEQ ID NO: 2466012 - DNA, 15 bp, Homo sapiens
tccaatgtctggaga

SEQ ID NO: 2466013 - DNA, 18 bp, Homo sapiens
tccaatgtggcaaggaaa

SEQ ID NO: 2466014 - DNA, 16 bp, Homo sapiens
tccaattagtttcctt

SEQ ID NO: 2466015 - DNA, 14 bp, Homo sapiens
tccacaagcttctg

SEQ ID NO: 2466016 - DNA, 14 bp, Homo sapiens
tccacacctgcggc

SEQ ID NO: 2466017 - DNA, 18 bp, Homo sapiens
tccacacctgcggcccaa

SEQ ID NO: 2466018 - DNA, 13 bp, Homo sapiens
tccacactgcaca

SEQ ID NO: 2466019 - DNA, 17 bp, Homo sapiens
tccacagaggacacaga

SEQ ID NO: 2466020 - DNA, 20 bp, Homo sapiens
tccacagcaaccccaggctg

SEQ ID NO: 2466021 - DNA, 15 bp, Homo sapiens
tccacagcctgcaag

SEQ ID NO: 2466022 - DNA, 15 bp, Homo sapiens
tccacaggtctagac

SEQ ID NO: 2466023 - DNA, 16 bp, Homo sapiens
tccacataggtttaga

SEQ ID NO: 2466024 - DNA, 15 bp, Homo sapiens
tccacatgggagccg

SEQ ID NO: 2466025 - DNA, 16 bp, Homo sapiens
tccacatttctaaaat

SEQ ID NO: 2466026 - DNA, 19 bp, Homo sapiens
tccaccaaatgtgctttga

SEQ ID NO: 2466027 - DNA, 22 bp, Homo sapiens
tccaccccaatcctcccagaaa

SEQ ID NO: 2466028 - DNA, 22 bp, Homo sapiens
tccaccctggccgagtccaagc

SEQ ID NO: 2466029 - DNA, 23 bp, Homo sapiens
tccacctggtactccctctcagg

SEQ ID NO: 2466030 - DNA, 12 bp, Homo sapiens
tccaccttccca

SEQ ID NO: 2466031 - DNA, 14 bp, Homo sapiens
tccacctttcccaa

SEQ ID NO: 2466032 - DNA, 15 bp, Homo sapiens
tccacgactgtctcc

SEQ ID NO: 2466033 - DNA, 18 bp, Homo sapiens
tccacgactgtctccatg

SEQ ID NO: 2466034 - DNA, 14 bp, Homo sapiens
tccacggagccact

SEQ ID NO: 2466035 - DNA, 21 bp, Homo sapiens
tccacggagccactcctctga

SEQ ID NO: 2466036 - DNA, 19 bp, Homo sapiens
tccactcgatgatgcttct

SEQ ID NO: 2466037 - DNA, 19 bp, Homo sapiens
tccactctgcttctctgac

SEQ ID NO: 2466038 - DNA, 20 bp, Homo sapiens
tccactctgcttctctgact

SEQ ID NO: 2466039 - DNA, 19 bp, Homo sapiens
tccacttctgacagcctca

SEQ ID NO: 2466040 - DNA, 14 bp, Homo sapiens
tccactttcagctg

SEQ ID NO: 2466041 - DNA, 13 bp, Homo sapiens
tccagaaaacaaa

SEQ ID NO: 2466042 - DNA, 16 bp, Homo sapiens
tccagaaagccccacc

SEQ ID NO: 2466043 - DNA, 20 bp, Homo sapiens
tccagaaagccccacccagg

SEQ ID NO: 2466044 - DNA, 14 bp, Homo sapiens
tccagaagtgtgac

SEQ ID NO: 2466045 - DNA, 20 bp, Homo sapiens
tccagaagtgtgactggcta

SEQ ID NO: 2466046 - DNA, 21 bp, Homo sapiens
tccagaatgctgtacatctat

SEQ ID NO: 2466047 - DNA, 11 bp, Homo sapiens
tccagacctga

SEQ ID NO: 2466048 - DNA, 13 bp, Homo sapiens
tccagacctgatc

SEQ ID NO: 2466049 - DNA, 22 bp, Homo sapiens
tccagacctgatcctggaggcc

SEQ ID NO: 2466050 - DNA, 17 bp, Homo sapiens
tccagagggcactctgc

SEQ ID NO: 2466051 - DNA, 22 bp, Homo sapiens
tccagatagtgtagctgaggag

SEQ ID NO: 2466052 - DNA, 16 bp, Homo sapiens
tccagatgcagggcag

SEQ ID NO: 2466053 - DNA, 19 bp, Homo sapiens
tccagatgcagggcagtca

SEQ ID NO: 2466054 - DNA, 18 bp, Homo sapiens
tccagcccctctggtcgc

SEQ ID NO: 2466055 - DNA, 14 bp, Homo sapiens
tccagctcctttgg

SEQ ID NO: 2466056 - DNA, 12 bp, Homo sapiens
tccagctctgga

SEQ ID NO: 2466057 - DNA, 15 bp, Homo sapiens
tccagctctggaggg

SEQ ID NO: 2466058 - DNA, 21 bp, Homo sapiens
tccagctgactaaactttttt

SEQ ID NO: 2466059 - DNA, 16 bp, Homo sapiens
tccagctgagcgccag

SEQ ID NO: 2466060 - DNA, 12 bp, Homo sapiens
tccagctgcccc

SEQ ID NO: 2466061 - DNA, 22 bp, Homo sapiens
tccagctgccccggcccctccc

SEQ ID NO: 2466062 - DNA, 16 bp, Homo sapiens
tccagctgtcccccca

SEQ ID NO: 2466063 - DNA, 17 bp, Homo sapiens
tccagctgtccccccac

SEQ ID NO: 2466064 - DNA, 20 bp, Homo sapiens
tccagctgttgagcccctcc

SEQ ID NO: 2466065 - DNA, 20 bp, Homo sapiens
tccaggagaaggccaattcc

SEQ ID NO: 2466066 - DNA, 17 bp, Homo sapiens
tccaggagctccagtgt

SEQ ID NO: 2466067 - DNA, 23 bp, Homo sapiens
tccaggagctccagtgtcctgag

SEQ ID NO: 2466068 - DNA, 22 bp, Homo sapiens
tccaggatgctaacatctaaaa

SEQ ID NO: 2466069 - DNA, 14 bp, Homo sapiens
tccaggcactgaga

SEQ ID NO: 2466070 - DNA, 19 bp, Homo sapiens
tccaggcagatccaggact

SEQ ID NO: 2466071 - DNA, 15 bp, Homo sapiens
tccagggacagaggc

SEQ ID NO: 2466072 - DNA, 19 bp, Homo sapiens
tccagggacagaggcccca

SEQ ID NO: 2466073 - DNA, 13 bp, Homo sapiens
tccagggacagca

SEQ ID NO: 2466074 - DNA, 14 bp, Homo sapiens
tccagggacagcaa

SEQ ID NO: 2466075 - DNA, 17 bp, Homo sapiens
tccagggaggctggtcc

SEQ ID NO: 2466076 - DNA, 22 bp, Homo sapiens
tccagggaggctggtcctatgg

SEQ ID NO: 2466077 - DNA, 17 bp, Homo sapiens
tccagggcccccatctc

SEQ ID NO: 2466078 - DNA, 14 bp, Homo sapiens
tccagggctagtga

SEQ ID NO: 2466079 - DNA, 18 bp, Homo sapiens
tccagggtccctctgtgt

SEQ ID NO: 2466080 - DNA, 22 bp, Homo sapiens
tccaggtcctggtggggcagct

SEQ ID NO: 2466081 - DNA, 18 bp, Homo sapiens
tccagtcctatctgggct

SEQ ID NO: 2466082 - DNA, 16 bp, Homo sapiens
tccagtgtcctgagct

SEQ ID NO: 2466083 - DNA, 19 bp, Homo sapiens
tccagtgtcctgagctcag

SEQ ID NO: 2466084 - DNA, 21 bp, Homo sapiens
tccagtgtcctgagctcagcg

SEQ ID NO: 2466085 - DNA, 21 bp, Homo sapiens
tccagttaaaaaaaattttaa

SEQ ID NO: 2466086 - DNA, 13 bp, Homo sapiens
tccatccaaggcc

SEQ ID NO: 2466087 - DNA, 16 bp, Homo sapiens
taattatttatgtatg

SEQ ID NO: 2466088 - DNA, 19 bp, Homo sapiens
taattcaattcaaagctgt

SEQ ID NO: 2466089 - DNA, 14 bp, Homo sapiens
taattcaggttttt

SEQ ID NO: 2466090 - DNA, 19 bp, Homo sapiens
taattcaggtttttccttt

SEQ ID NO: 2466091 - DNA, 23 bp, Homo sapiens
taattctattaaagtgctaaggt

SEQ ID NO: 2466092 - DNA, 21 bp, Homo sapiens
taattctttcaatacagatat

SEQ ID NO: 2466093 - DNA, 23 bp, Homo sapiens
taattgccaaaaagtgaaataat

SEQ ID NO: 2466094 - DNA, 18 bp, Homo sapiens
taattgccacctctaaca

SEQ ID NO: 2466095 - DNA, 12 bp, Homo sapiens
taattgccatgt

SEQ ID NO: 2466096 - DNA, 21 bp, Homo sapiens
taattgcttatttattgtatt

SEQ ID NO: 2466097 - DNA, 16 bp, Homo sapiens
taattggatttcctaa

SEQ ID NO: 2466098 - DNA, 23 bp, Homo sapiens
taattggatttcctaatactgtc

SEQ ID NO: 2466099 - DNA, 21 bp, Homo sapiens
taattgggccagcttttcaaa

SEQ ID NO: 2466100 - DNA, 14 bp, Homo sapiens
taattgttgttctg

SEQ ID NO: 2466101 - DNA, 16 bp, Homo sapiens
taattgttgttctgtt

SEQ ID NO: 2466102 - DNA, 17 bp, Homo sapiens
taatttaaacacctcct

SEQ ID NO: 2466103 - DNA, 11 bp, Homo sapiens
taatttaactt

SEQ ID NO: 2466104 - DNA, 22 bp, Homo sapiens
taatttacaaaaatataaaata

SEQ ID NO: 2466105 - DNA, 21 bp, Homo sapiens
taatttacctaagattacaaa

SEQ ID NO: 2466106 - DNA, 15 bp, Homo sapiens
taatttagaaaactt

SEQ ID NO: 2466107 - DNA, 16 bp, Homo sapiens
taatttagaaaacttt

SEQ ID NO: 2466108 - DNA, 21 bp, Homo sapiens
taatttagacttcaagcatgg

SEQ ID NO: 2466109 - DNA, 16 bp, Homo sapiens
taatttagtaaaccaa

SEQ ID NO: 2466110 - DNA, 16 bp, Homo sapiens
taatttataaaaaggt

SEQ ID NO: 2466111 - DNA, 21 bp, Homo sapiens
taatttcaggaggaatactga

SEQ ID NO: 2466112 - DNA, 22 bp, Homo sapiens
taatttcaggaggaatactgaa

SEQ ID NO: 2466113 - DNA, 13 bp, Homo sapiens
taatttgcacagt

SEQ ID NO: 2466114 - DNA, 17 bp, Homo sapiens
taatttgttttggatat

SEQ ID NO: 2466115 - DNA, 23 bp, Homo sapiens
taattttagtttttcattaaata

SEQ ID NO: 2466116 - DNA, 17 bp, Homo sapiens
taattttcctaataaag

SEQ ID NO: 2466117 - DNA, 18 bp, Homo sapiens
taattttgaagtgctgtt

SEQ ID NO: 2466118 - DNA, 22 bp, Homo sapiens
taattttgaagtgctgtttatt

SEQ ID NO: 2466119 - DNA, 14 bp, Homo sapiens
taattttgccttta

SEQ ID NO: 2466120 - DNA, 19 bp, Homo sapiens
taattttgtaatgtatcaa

SEQ ID NO: 2466121 - DNA, 22 bp, Homo sapiens
taatttttacagaattgcttgt

SEQ ID NO: 2466122 - DNA, 16 bp, Homo sapiens
taatttttatttcttc

SEQ ID NO: 2466123 - DNA, 16 bp, Homo sapiens
taatttttcctatatt

SEQ ID NO: 2466124 - DNA, 14 bp, Homo sapiens
taatttttttaatt

SEQ ID NO: 2466125 - DNA, 17 bp, Homo sapiens
tacaaaaatataaaata

SEQ ID NO: 2466126 - DNA, 16 bp, Homo sapiens
tacaaaggtttaaatg

SEQ ID NO: 2466127 - DNA, 16 bp, Homo sapiens
tacaaatcaagtattt

SEQ ID NO: 2466128 - DNA, 18 bp, Homo sapiens
tacaaatgttaaaatgtg

SEQ ID NO: 2466129 - DNA, 19 bp, Homo sapiens
tacaagactgccatattaa

SEQ ID NO: 2466130 - DNA, 22 bp, Homo sapiens
tacaagactgccatattaaatt

SEQ ID NO: 2466131 - DNA, 18 bp, Homo sapiens
tacaagtatttttaatta

SEQ ID NO: 2466132 - DNA, 15 bp, Homo sapiens
tacaagttggagtca

SEQ ID NO: 2466133 - DNA, 13 bp, Homo sapiens
tacaatgtaatta

SEQ ID NO: 2466134 - DNA, 22 bp, Homo sapiens
tacaattaattatcttttcaaa

SEQ ID NO: 2466135 - DNA, 18 bp, Homo sapiens
tacaattttttttattag

SEQ ID NO: 2466136 - DNA, 21 bp, Homo sapiens
tacaattttttttattagtat

SEQ ID NO: 2466137 - DNA, 17 bp, Homo sapiens
tacacacggtgccttta

SEQ ID NO: 2466138 - DNA, 21 bp, Homo sapiens
tacaccactctggcagccaca

SEQ ID NO: 2466139 - DNA, 23 bp, Homo sapiens
tacacgtatttgaatggccttca

SEQ ID NO: 2466140 - DNA, 19 bp, Homo sapiens
tacagaaatttaattcaga

SEQ ID NO: 2466141 - DNA, 16 bp, Homo sapiens
tacagaactctttcaa

SEQ ID NO: 2466142 - DNA, 18 bp, Homo sapiens
tacagaacttcagaaaga

SEQ ID NO: 2466143 - DNA, 19 bp, Homo sapiens
tacagaacttcagaaagac

SEQ ID NO: 2466144 - DNA, 10 bp, Homo sapiens
tacagagaag

SEQ ID NO: 2466145 - DNA, 11 bp, Homo sapiens
tacagagaagc

SEQ ID NO: 2466146 - DNA, 15 bp, Homo sapiens
tacagagaagccagc

SEQ ID NO: 2466147 - DNA, 14 bp, Homo sapiens
tacagagaagccat

SEQ ID NO: 2466148 - DNA, 15 bp, Homo sapiens
tacagagaagccttc

SEQ ID NO: 2466149 - DNA, 18 bp, Homo sapiens
tacagagaagccttcaag

SEQ ID NO: 2466150 - DNA, 19 bp, Homo sapiens
tacagagaagccttcaagc

SEQ ID NO: 2466151 - DNA, 20 bp, Homo sapiens
tacagagaagccttcaagct

SEQ ID NO: 2466152 - DNA, 21 bp, Homo sapiens
tacagagaagccttcaagctc

SEQ ID NO: 2466153 - DNA, 23 bp, Homo sapiens
tacagagaagccttcaagctctg

SEQ ID NO: 2466154 - DNA, 22 bp, Homo sapiens
tacagagaagtcacagggcagt

SEQ ID NO: 2466155 - DNA, 16 bp, Homo sapiens
tacagagcttccctga

SEQ ID NO: 2466156 - DNA, 19 bp, Homo sapiens
tacagagtgtggactctgg

SEQ ID NO: 2466157 - DNA, 13 bp, Homo sapiens
tacagatatattt

SEQ ID NO: 2466158 - DNA, 21 bp, Homo sapiens
tacagatatattttctttctc

SEQ ID NO: 2466159 - DNA, 16 bp, Homo sapiens
tacagcaccctgtggt

SEQ ID NO: 2466160 - DNA, 13 bp, Homo sapiens
tacagctggctct

SEQ ID NO: 2466161 - DNA, 18 bp, Homo sapiens
tacagctgtattgtctga

SEQ ID NO: 2466162 - DNA, 13 bp, Homo sapiens
tacaggaacttca

SEQ ID NO: 2466163 - DNA, 17 bp, Homo sapiens
tacagggggtctggctg

SEQ ID NO: 2466164 - DNA, 17 bp, Homo sapiens
tacagtagattttccaa

SEQ ID NO: 2466165 - DNA, 21 bp, Homo sapiens
tacagtagattttccaaatgt

SEQ ID NO: 2466166 - DNA, 13 bp, Homo sapiens
tacagtaggagcc

SEQ ID NO: 2466167 - DNA, 20 bp, Homo sapiens
tacagtaggagcccagctct

SEQ ID NO: 2466168 - DNA, 22 bp, Homo sapiens
tacagtaggagcccagctctga

SEQ ID NO: 2466169 - DNA, 22 bp, Homo sapiens
tacagtcattggaataaggcat

SEQ ID NO: 2466170 - DNA, 14 bp, Homo sapiens
tacagtctaaagct

SEQ ID NO: 2466171 - DNA, 17 bp, Homo sapiens
tacagtctcgtctcttt

SEQ ID NO: 2466172 - DNA, 18 bp, Homo sapiens
tacagtcttccatttgca

SEQ ID NO: 2466173 - DNA, 19 bp, Homo sapiens
tacagtcttccatttgcaa

SEQ ID NO: 2466174 - DNA, 20 bp, Homo sapiens
tacagtcttccatttgcaag

SEQ ID NO: 2466175 - DNA, 12 bp, Homo sapiens
tacagtgtcttt

SEQ ID NO: 2466176 - DNA, 23 bp, Homo sapiens
tacagtgtctttttttgtatagt

SEQ ID NO: 2466177 - DNA, 23 bp, Homo sapiens
tacagtgtttatcctttcatata

SEQ ID NO: 2466178 - DNA, 15 bp, Homo sapiens
tacagttttaactgt

SEQ ID NO: 2466179 - DNA, 17 bp, Homo sapiens
tacagttttaactgtgg

SEQ ID NO: 2466180 - DNA, 21 bp, Homo sapiens
tacagttttaactgtggatat

SEQ ID NO: 2466181 - DNA, 15 bp, Homo sapiens
tacataagtttagga

SEQ ID NO: 2466182 - DNA, 16 bp, Homo sapiens
tacataattcactctg

SEQ ID NO: 2466183 - DNA, 12 bp, Homo sapiens
tacatcatttct

SEQ ID NO: 2466184 - DNA, 14 bp, Homo sapiens
tacatcatttcttt

SEQ ID NO: 2466185 - DNA, 19 bp, Homo sapiens
tacatccaaagcagacagc

SEQ ID NO: 2466186 - DNA, 18 bp, Homo sapiens
tacatctattttggattg

SEQ ID NO: 2466187 - DNA, 19 bp, Homo sapiens
tacatctattttggattgt

SEQ ID NO: 2466188 - DNA, 23 bp, Homo sapiens
tacatgaggactctattctttaa

SEQ ID NO: 2466189 - DNA, 12 bp, Homo sapiens
tacatgcttatt

SEQ ID NO: 2466190 - DNA, 15 bp, Homo sapiens
tacatgcttattcca

SEQ ID NO: 2466191 - DNA, 16 bp, Homo sapiens
tacatgcttattccat

SEQ ID NO: 2466192 - DNA, 23 bp, Homo sapiens
tacatgcttattccatgactgct

SEQ ID NO: 2466193 - DNA, 20 bp, Homo sapiens
tacatgtattgcacattgta

SEQ ID NO: 2466194 - DNA, 15 bp, Homo sapiens
tacattcatttagct

SEQ ID NO: 2466195 - DNA, 16 bp, Homo sapiens
tacatttacaaactga

SEQ ID NO: 2466196 - DNA, 17 bp, Homo sapiens
tacatttacaaactgaa

SEQ ID NO: 2466197 - DNA, 15 bp, Homo sapiens
tacatttctcaggct

SEQ ID NO: 2466198 - DNA, 15 bp, Homo sapiens
taccaaaaataaata

SEQ ID NO: 2466199 - DNA, 14 bp, Homo sapiens
taccaagtcaaact

SEQ ID NO: 2466200 - DNA, 19 bp, Homo sapiens
taccaatcattttaattat

SEQ ID NO: 2466201 - DNA, 14 bp, Homo sapiens
taaataagattcta

SEQ ID NO: 2466202 - DNA, 22 bp, Homo sapiens
taaataggcggggcttgccttc

SEQ ID NO: 2466203 - DNA, 14 bp, Homo sapiens
taaatataaagacg

SEQ ID NO: 2466204 - DNA, 23 bp, Homo sapiens
taaatataaagacgttttataag

SEQ ID NO: 2466205 - DNA, 18 bp, Homo sapiens
taaatatatctaccccag

SEQ ID NO: 2466206 - DNA, 14 bp, Homo sapiens
taaatatattatta

SEQ ID NO: 2466207 - DNA, 15 bp, Homo sapiens
taaatatattattac

SEQ ID NO: 2466208 - DNA, 22 bp, Homo sapiens
taaatatattattacttgtaaa

SEQ ID NO: 2466209 - DNA, 19 bp, Homo sapiens
taaatatggactgctcagg

SEQ ID NO: 2466210 - DNA, 19 bp, Homo sapiens
taaatatgtacatttctca

SEQ ID NO: 2466211 - DNA, 14 bp, Homo sapiens
taaatattttaaag

SEQ ID NO: 2466212 - DNA, 22 bp, Homo sapiens
taaatcacgctttttgaaaaag

SEQ ID NO: 2466213 - DNA, 14 bp, Homo sapiens
taaatcttttacaa

SEQ ID NO: 2466214 - DNA, 23 bp, Homo sapiens
taaatcttttataggatttattt

SEQ ID NO: 2466215 - DNA, 16 bp, Homo sapiens
taaatggcctcatgtg

SEQ ID NO: 2466216 - DNA, 23 bp, Homo sapiens
taaatggcctcatgtggctggaa

SEQ ID NO: 2466217 - DNA, 22 bp, Homo sapiens
taagcagaaagtgcctttcagg

SEQ ID NO: 2466218 - DNA, 20 bp, Homo sapiens
taagcagaccactgataaaa

SEQ ID NO: 2466219 - DNA, 21 bp, Homo sapiens
taagcaggtggatctatttca

SEQ ID NO: 2466220 - DNA, 19 bp, Homo sapiens
taagcatcattatttatgt

SEQ ID NO: 2466221 - DNA, 17 bp, Homo sapiens
taagccacttaaaatgt

SEQ ID NO: 2466222 - DNA, 18 bp, Homo sapiens
taagcccagtgcactgaa

SEQ ID NO: 2466223 - DNA, 22 bp, Homo sapiens
taagctatttgatgtaatactt

SEQ ID NO: 2466224 - DNA, 21 bp, Homo sapiens
taagctatttttctaactaca

SEQ ID NO: 2466225 - DNA, 22 bp, Homo sapiens
taagctcccagggcctgtctca

SEQ ID NO: 2466226 - DNA, 10 bp, Homo sapiens
taagctctga

SEQ ID NO: 2466227 - DNA, 17 bp, Homo sapiens
taaggaaccaacaatct

SEQ ID NO: 2466228 - DNA, 22 bp, Homo sapiens
taaggacctgaaattccaaagt

SEQ ID NO: 2466229 - DNA, 19 bp, Homo sapiens
taaggccattattgtactt

SEQ ID NO: 2466230 - DNA, 20 bp, Homo sapiens
taaggcctaggattctaaaa

SEQ ID NO: 2466231 - DNA, 12 bp, Homo sapiens
taaggctctaga

SEQ ID NO: 2466232 - DNA, 19 bp, Homo sapiens
taaggctctatgagtctag

SEQ ID NO: 2466233 - DNA, 15 bp, Homo sapiens
taaggctctgagagt

SEQ ID NO: 2466234 - DNA, 19 bp, Homo sapiens
taaggctctgagagtctag

SEQ ID NO: 2466235 - DNA, 22 bp, Homo sapiens
taaggctgtgtaagatttgttt

SEQ ID NO: 2466236 - DNA, 14 bp, Homo sapiens
taagggcacacaca

SEQ ID NO: 2466237 - DNA, 19 bp, Homo sapiens
taagggccagaaatatctt

SEQ ID NO: 2466238 - DNA, 19 bp, Homo sapiens
taaggtacaagaagcattt

SEQ ID NO: 2466239 - DNA, 18 bp, Homo sapiens
taaggtccggtgttctaa

SEQ ID NO: 2466240 - DNA, 13 bp, Homo sapiens
taaggtgtagcca

SEQ ID NO: 2466241 - DNA, 19 bp, Homo sapiens
taaggtgtagccacaccag

SEQ ID NO: 2466242 - DNA, 17 bp, Homo sapiens
taaggttttaatttagt

SEQ ID NO: 2466243 - DNA, 18 bp, Homo sapiens
taaggttttaatttagta

SEQ ID NO: 2466244 - DNA, 14 bp, Homo sapiens
taagtaaatacaat

SEQ ID NO: 2466245 - DNA, 14 bp, Homo sapiens
taagtacagagaag

SEQ ID NO: 2466246 - DNA, 18 bp, Homo sapiens
taagtacagagaagccat

SEQ ID NO: 2466247 - DNA, 22 bp, Homo sapiens
taagtacagagaagccatcacc

SEQ ID NO: 2466248 - DNA, 18 bp, Homo sapiens
taagtgaacacccatgaa

SEQ ID NO: 2466249 - DNA, 16 bp, Homo sapiens
taagttattgcagttt

SEQ ID NO: 2466250 - DNA, 20 bp, Homo sapiens
taagttattgcagtttatca

SEQ ID NO: 2466251 - DNA, 16 bp, Homo sapiens
taagttgggcttgcta

SEQ ID NO: 2466252 - DNA, 19 bp, Homo sapiens
taagttgggcttgctattc

SEQ ID NO: 2466253 - DNA, 13 bp, Homo sapiens
taagtttctaaga

SEQ ID NO: 2466254 - DNA, 17 bp, Homo sapiens
taagtttctaagattct

SEQ ID NO: 2466255 - DNA, 18 bp, Homo sapiens
taagtttctaagattcta

SEQ ID NO: 2466256 - DNA, 23 bp, Homo sapiens
taagtttctaagattctaaaggt

SEQ ID NO: 2466257 - DNA, 16 bp, Homo sapiens
taagtttgatttcatt

SEQ ID NO: 2466258 - DNA, 13 bp, Homo sapiens
taataaactaata

SEQ ID NO: 2466259 - DNA, 21 bp, Homo sapiens
taataaggttttaatttagta

SEQ ID NO: 2466260 - DNA, 13 bp, Homo sapiens
taataatttctaa

SEQ ID NO: 2466261 - DNA, 14 bp, Homo sapiens
taatacaaactaat

SEQ ID NO: 2466262 - DNA, 14 bp, Homo sapiens
taatagaataaagg

SEQ ID NO: 2466263 - DNA, 22 bp, Homo sapiens
taatagaataaaggcagttttc

SEQ ID NO: 2466264 - DNA, 16 bp, Homo sapiens
taatagatgtttgata

SEQ ID NO: 2466265 - DNA, 13 bp, Homo sapiens
taatagcaaagaa

SEQ ID NO: 2466266 - DNA, 21 bp, Homo sapiens
taatataaaaagcttccatga

SEQ ID NO: 2466267 - DNA, 22 bp, Homo sapiens
taatataaagttttatatatta

SEQ ID NO: 2466268 - DNA, 12 bp, Homo sapiens
taatataaatgc

SEQ ID NO: 2466269 - DNA, 18 bp, Homo sapiens
taatatatattatctttt

SEQ ID NO: 2466270 - DNA, 13 bp, Homo sapiens
taatatattttct

SEQ ID NO: 2466271 - DNA, 17 bp, Homo sapiens
taatatattttctgttt

SEQ ID NO: 2466272 - DNA, 16 bp, Homo sapiens
taatattgacttgtat

SEQ ID NO: 2466273 - DNA, 22 bp, Homo sapiens
taatattttcctcctgagtgct

SEQ ID NO: 2466274 - DNA, 23 bp, Homo sapiens
taatcaaatttgtagggtttcta

SEQ ID NO: 2466275 - DNA, 22 bp, Homo sapiens
taatcatataataaatgtacat

SEQ ID NO: 2466276 - DNA, 19 bp, Homo sapiens
taatccaatgggtttttcc

SEQ ID NO: 2466277 - DNA, 18 bp, Homo sapiens
taatccccttctcccctg

SEQ ID NO: 2466278 - DNA, 21 bp, Homo sapiens
taatccctgctttttgtgttt

SEQ ID NO: 2466279 - DNA, 21 bp, Homo sapiens
taatccgaatctctttttgct

SEQ ID NO: 2466280 - DNA, 23 bp, Homo sapiens
taatctgaataaagtgtaacaat

SEQ ID NO: 2466281 - DNA, 15 bp, Homo sapiens
taatctgcctccctc

SEQ ID NO: 2466282 - DNA, 13 bp, Homo sapiens
taatcttagtgta

SEQ ID NO: 2466283 - DNA, 18 bp, Homo sapiens
taatcttataattgttct

SEQ ID NO: 2466284 - DNA, 22 bp, Homo sapiens
taatcttataattgttctcaga

SEQ ID NO: 2466285 - DNA, 15 bp, Homo sapiens
taatcttgctttctt

SEQ ID NO: 2466286 - DNA, 16 bp, Homo sapiens
taatgaaacaaagagt

SEQ ID NO: 2466287 - DNA, 17 bp, Homo sapiens
taatgaagaaagtggaa

SEQ ID NO: 2466288 - DNA, 12 bp, Homo sapiens
taatgcactttc

SEQ ID NO: 2466289 - DNA, 13 bp, Homo sapiens
taatgcactttct

SEQ ID NO: 2466290 - DNA, 14 bp, Homo sapiens
taatgcactttcta

SEQ ID NO: 2466291 - DNA, 18 bp, Homo sapiens
taatgcctcttcattctt

SEQ ID NO: 2466292 - DNA, 15 bp, Homo sapiens
taatggcagttatat

SEQ ID NO: 2466293 - DNA, 17 bp, Homo sapiens
taatggcatgagaaata

SEQ ID NO: 2466294 - DNA, 22 bp, Homo sapiens
taatggctgataattttaaatt

SEQ ID NO: 2466295 - DNA, 23 bp, Homo sapiens
taatggtactgactttgcttgct

SEQ ID NO: 2466296 - DNA, 16 bp, Homo sapiens
taatgtatgttaccaa

SEQ ID NO: 2466297 - DNA, 17 bp, Homo sapiens
taatgtgtagttcatgt

SEQ ID NO: 2466298 - DNA, 22 bp, Homo sapiens
taatgtgtagttcatgtaaata

SEQ ID NO: 2466299 - DNA, 15 bp, Homo sapiens
taatgtgtcccctga

SEQ ID NO: 2466300 - DNA, 21 bp, Homo sapiens
taatgttttttgccacagctt

SEQ ID NO: 2466301 - DNA, 19 bp, Homo sapiens
taattaaaagcaaatcatt

SEQ ID NO: 2466302 - DNA, 16 bp, Homo sapiens
taattatatgttgtaa

SEQ ID NO: 2466303 - DNA, 23 bp, Homo sapiens
taattatcttttcaaaggtactt

SEQ ID NO: 2466304 - DNA, 17 bp, Homo sapiens
taattatggagtcattt

SEQ ID NO: 2466305 - DNA, 14 bp, Homo sapiens
taattattattctt

SEQ ID NO: 2466306 - DNA, 14 bp, Homo sapiens
taattatttatgta

SEQ ID NO: 2466307 - DNA, 21 bp, Homo sapiens
agccatgtcttctccctggaa

SEQ ID NO: 2466308 - DNA, 21 bp, Homo sapiens
agccattggctatttaaaact

SEQ ID NO: 2466309 - DNA, 17 bp, Homo sapiens
agcccaagtgaggcagc

SEQ ID NO: 2466310 - DNA, 18 bp, Homo sapiens
agcccaagtgaggcagcc

SEQ ID NO: 2466311 - DNA, 21 bp, Homo sapiens
agcccaccatttggcatccct

SEQ ID NO: 2466312 - DNA, 22 bp, Homo sapiens
agcccaccatttggcatccctg

SEQ ID NO: 2466313 - DNA, 19 bp, Homo sapiens
agcccacgacactgcagcc

SEQ ID NO: 2466314 - DNA, 20 bp, Homo sapiens
agcccacgacactgcagccc

SEQ ID NO: 2466315 - DNA, 21 bp, Homo sapiens
agcccagagacatacttgaag

SEQ ID NO: 2466316 - DNA, 17 bp, Homo sapiens
agcccagagggtctggg

SEQ ID NO: 2466317 - DNA, 11 bp, Homo sapiens
agcccagccag

SEQ ID NO: 2466318 - DNA, 11 bp, Homo sapiens
agcccagccca

SEQ ID NO: 2466319 - DNA, 19 bp, Homo sapiens
agcccagccccactcctct

SEQ ID NO: 2466320 - DNA, 21 bp, Homo sapiens
agcccaggaagtctcatctgg

SEQ ID NO: 2466321 - DNA, 12 bp, Homo sapiens
agcccaggagct

SEQ ID NO: 2466322 - DNA, 18 bp, Homo sapiens
agcccaggagctcccctc

SEQ ID NO: 2466323 - DNA, 19 bp, Homo sapiens
agcccaggagctcccctcc

SEQ ID NO: 2466324 - DNA, 23 bp, Homo sapiens
agcccaggagctcccctccccaa

SEQ ID NO: 2466325 - DNA, 14 bp, Homo sapiens
agcccaggccagga

SEQ ID NO: 2466326 - DNA, 21 bp, Homo sapiens
agcccaggccaggactctgca

SEQ ID NO: 2466327 - DNA, 20 bp, Homo sapiens
agcccaggctcggcctgccc

SEQ ID NO: 2466328 - DNA, 16 bp, Homo sapiens
agcccagggaggccga

SEQ ID NO: 2466329 - DNA, 17 bp, Homo sapiens
agcccagggctcctgca

SEQ ID NO: 2466330 - DNA, 18 bp, Homo sapiens
agcccagtgcactgaaag

SEQ ID NO: 2466331 - DNA, 14 bp, Homo sapiens
agcccatatgctac

SEQ ID NO: 2466332 - DNA, 21 bp, Homo sapiens
agcccatatgctaccaccagc

SEQ ID NO: 2466333 - DNA, 16 bp, Homo sapiens
agcccatcctgaccag

SEQ ID NO: 2466334 - DNA, 23 bp, Homo sapiens
agcccatcctgaccagctgctcc

SEQ ID NO: 2466335 - DNA, 17 bp, Homo sapiens
agcccatggagattgac

SEQ ID NO: 2466336 - DNA, 18 bp, Homo sapiens
agccccaccccagggcag

SEQ ID NO: 2466337 - DNA, 13 bp, Homo sapiens
agccccagccagg

SEQ ID NO: 2466338 - DNA, 18 bp, Homo sapiens
agcccccagagcccaggc

SEQ ID NO: 2466339 - DNA, 11 bp, Homo sapiens
agccccctcac

SEQ ID NO: 2466340 - DNA, 20 bp, Homo sapiens
agccccctcctggtgccacc

SEQ ID NO: 2466341 - DNA, 12 bp, Homo sapiens
agccccctgacc

SEQ ID NO: 2466342 - DNA, 19 bp, Homo sapiens
agccccctgaccactcaga

SEQ ID NO: 2466343 - DNA, 20 bp, Homo sapiens
agccccctgaccactcagag

SEQ ID NO: 2466344 - DNA, 22 bp, Homo sapiens
agccccctgaccactcagagac

SEQ ID NO: 2466345 - DNA, 12 bp, Homo sapiens
agcccctctggt

SEQ ID NO: 2466346 - DNA, 20 bp, Homo sapiens
agcccctctggtcgctcctg

SEQ ID NO: 2466347 - DNA, 18 bp, Homo sapiens
agcccctcttggagaagt

SEQ ID NO: 2466348 - DNA, 23 bp, Homo sapiens
agcccctcttggagaagtctcag

SEQ ID NO: 2466349 - DNA, 14 bp, Homo sapiens
agcccctgccattg

SEQ ID NO: 2466350 - DNA, 16 bp, Homo sapiens
agcccctgcccctcct

SEQ ID NO: 2466351 - DNA, 22 bp, Homo sapiens
agcccctggggtggccaccagt

SEQ ID NO: 2466352 - DNA, 16 bp, Homo sapiens
agccccttagacagag

SEQ ID NO: 2466353 - DNA, 22 bp, Homo sapiens
agccccttctgctcagctctgg

SEQ ID NO: 2466354 - DNA, 14 bp, Homo sapiens
agcccctttccctt

SEQ ID NO: 2466355 - DNA, 15 bp, Homo sapiens
agcccgcacacctgc

SEQ ID NO: 2466356 - DNA, 13 bp, Homo sapiens
agcccggctcctg

SEQ ID NO: 2466357 - DNA, 19 bp, Homo sapiens
agccctcacacaccctgtc

SEQ ID NO: 2466358 - DNA, 16 bp, Homo sapiens
agccctcatcccgagc

SEQ ID NO: 2466359 - DNA, 12 bp, Homo sapiens
agccctgcacca

SEQ ID NO: 2466360 - DNA, 13 bp, Homo sapiens
agccctgcaccat

SEQ ID NO: 2466361 - DNA, 14 bp, Homo sapiens
agccctgcaccatg

SEQ ID NO: 2466362 - DNA, 19 bp, Homo sapiens
agccctgcctggaggacct

SEQ ID NO: 2466363 - DNA, 22 bp, Homo sapiens
agccctggcatgtcaacagcgt

SEQ ID NO: 2466364 - DNA, 14 bp, Homo sapiens
agccctgtcctggt

SEQ ID NO: 2466365 - DNA, 14 bp, Homo sapiens
agcactgccaggag

SEQ ID NO: 2466366 - DNA, 15 bp, Homo sapiens
agcactgccaggagg

SEQ ID NO: 2466367 - DNA, 17 bp, Homo sapiens
agcactgccaggaggga

SEQ ID NO: 2466368 - DNA, 17 bp, Homo sapiens
agcactgcttgaggaaa

SEQ ID NO: 2466369 - DNA, 12 bp, Homo sapiens
agcactgtccct

SEQ ID NO: 2466370 - DNA, 13 bp, Homo sapiens
agcactgtccctt

SEQ ID NO: 2466371 - DNA, 16 bp, Homo sapiens
agcactgtcccttgcc

SEQ ID NO: 2466372 - DNA, 15 bp, Homo sapiens
agcacttctttttct

SEQ ID NO: 2466373 - DNA, 16 bp, Homo sapiens
agcacttgtccagctg

SEQ ID NO: 2466374 - DNA, 15 bp, Homo sapiens
agcagaaaacccttg

SEQ ID NO: 2466375 - DNA, 18 bp, Homo sapiens
agcagaaagtgcctttca

SEQ ID NO: 2466376 - DNA, 20 bp, Homo sapiens
agcagaaagtgcctttcagg

SEQ ID NO: 2466377 - DNA, 23 bp, Homo sapiens
agcagaaagtgcctttcaggatc

SEQ ID NO: 2466378 - DNA, 15 bp, Homo sapiens
agcagacagagccag

SEQ ID NO: 2466379 - DNA, 23 bp, Homo sapiens
agcagacagagccaggagaagct

SEQ ID NO: 2466380 - DNA, 13 bp, Homo sapiens
agcagactacagc

SEQ ID NO: 2466381 - DNA, 22 bp, Homo sapiens
agcagactacagctggggtgca

SEQ ID NO: 2466382 - DNA, 16 bp, Homo sapiens
agcagcaacttgtcct

SEQ ID NO: 2466383 - DNA, 17 bp, Homo sapiens
agcagcaacttgtccta

SEQ ID NO: 2466384 - DNA, 19 bp, Homo sapiens
agcagcaccgttctgtgca

SEQ ID NO: 2466385 - DNA, 13 bp, Homo sapiens
agcagcacctcct

SEQ ID NO: 2466386 - DNA, 22 bp, Homo sapiens
agcagcacctgccctacctgcc

SEQ ID NO: 2466387 - DNA, 14 bp, Homo sapiens
agcagcacttataa

SEQ ID NO: 2466388 - DNA, 15 bp, Homo sapiens
agcagcacttataaa

SEQ ID NO: 2466389 - DNA, 18 bp, Homo sapiens
agcagcacttataaatca

SEQ ID NO: 2466390 - DNA, 13 bp, Homo sapiens
agcagccagccct

SEQ ID NO: 2466391 - DNA, 17 bp, Homo sapiens
agcagccagccctgcct

SEQ ID NO: 2466392 - DNA, 19 bp, Homo sapiens
agcagccagccctgcctgg

SEQ ID NO: 2466393 - DNA, 23 bp, Homo sapiens
agcagccagccctgcctggagga

SEQ ID NO: 2466394 - DNA, 19 bp, Homo sapiens
agcagcccccagctcccac

SEQ ID NO: 2466395 - DNA, 20 bp, Homo sapiens
agcagcctctccccaggtcc

SEQ ID NO: 2466396 - DNA, 19 bp, Homo sapiens
agcagcctgagcaactctt

SEQ ID NO: 2466397 - DNA, 13 bp, Homo sapiens
agcagctgagcag

SEQ ID NO: 2466398 - DNA, 16 bp, Homo sapiens
agcagctgagcagggc

SEQ ID NO: 2466399 - DNA, 17 bp, Homo sapiens
agcagctgagcagggcc

SEQ ID NO: 2466400 - DNA, 18 bp, Homo sapiens
agcagcttagactaaggc

SEQ ID NO: 2466401 - DNA, 14 bp, Homo sapiens
agcagcttccagat

SEQ ID NO: 2466402 - DNA, 16 bp, Homo sapiens
agcagcttccagattg

SEQ ID NO: 2466403 - DNA, 21 bp, Homo sapiens
agcagctttagaatcccagcc

SEQ ID NO: 2466404 - DNA, 15 bp, Homo sapiens
agcaggaaatgaaaa

SEQ ID NO: 2466405 - DNA, 17 bp, Homo sapiens
agcaggaatgggaagga

SEQ ID NO: 2466406 - DNA, 18 bp, Homo sapiens
agcaggactccaggccca

SEQ ID NO: 2466407 - DNA, 23 bp, Homo sapiens
tcccaccgcccagcggcttgcct

SEQ ID NO: 2466408 - DNA, 24 bp, Homo sapiens
tcccaccgcccagcggcttgcctg

SEQ ID NO: 2466409 - DNA, 15 bp, Homo sapiens
tcccacctccatccc

SEQ ID NO: 2466410 - DNA, 17 bp, Homo sapiens
tcccacctccccttggg

SEQ ID NO: 2466411 - DNA, 20 bp, Homo sapiens
tcccacctcctgacaccctt

SEQ ID NO: 2466412 - DNA, 13 bp, Homo sapiens
tcccacctgacac

SEQ ID NO: 2466413 - DNA, 20 bp, Homo sapiens
tcccacctttcgggccatgt

SEQ ID NO: 2466414 - DNA, 17 bp, Homo sapiens
tcccactccaagcccag

SEQ ID NO: 2466415 - DNA, 13 bp, Homo sapiens
tcccactctccta

SEQ ID NO: 2466416 - DNA, 16 bp, Homo sapiens
tcccactctcctaggc

SEQ ID NO: 2466417 - DNA, 18 bp, Homo sapiens
tcccacttaaaaattaaa

SEQ ID NO: 2466418 - DNA, 17 bp, Homo sapiens
tcccagaagatgactga

SEQ ID NO: 2466419 - DNA, 15 bp, Homo sapiens
tcccagagagcccga

SEQ ID NO: 2466420 - DNA, 19 bp, Homo sapiens
tcccagagcacctgctgtc

SEQ ID NO: 2466421 - DNA, 21 bp, Homo sapiens
tcccagaggagccaccagttc

SEQ ID NO: 2466422 - DNA, 16 bp, Homo sapiens
tcccagaggggcctgc

SEQ ID NO: 2466423 - DNA, 15 bp, Homo sapiens
tcccagagtgctggg

SEQ ID NO: 2466424 - DNA, 14 bp, Homo sapiens
tcccagccccctga

SEQ ID NO: 2466425 - DNA, 16 bp, Homo sapiens
tcccagccccctgacc

SEQ ID NO: 2466426 - DNA, 19 bp, Homo sapiens
tcccaggaccacaggctca

SEQ ID NO: 2466427 - DNA, 12 bp, Homo sapiens
tcccaggaccct

SEQ ID NO: 2466428 - DNA, 14 bp, Homo sapiens
tcccaggaccctga

SEQ ID NO: 2466429 - DNA, 19 bp, Homo sapiens
tcccaggaccctggaccca

SEQ ID NO: 2466430 - DNA, 20 bp, Homo sapiens
tcccaggcaaggctgtggac

SEQ ID NO: 2466431 - DNA, 18 bp, Homo sapiens
tcccaggccccatgacct

SEQ ID NO: 2466432 - DNA, 16 bp, Homo sapiens
tcccagggacacctgg

SEQ ID NO: 2466433 - DNA, 16 bp, Homo sapiens
tcccagggcctgtctc

SEQ ID NO: 2466434 - DNA, 21 bp, Homo sapiens
tcccaggtgttaacattccaa

SEQ ID NO: 2466435 - DNA, 22 bp, Homo sapiens
tcccaggtgttaacattccaag

SEQ ID NO: 2466436 - DNA, 23 bp, Homo sapiens
tcccaggtgttaacattccaaga

SEQ ID NO: 2466437 - DNA, 16 bp, Homo sapiens
tcccaggttggctctg

SEQ ID NO: 2466438 - DNA, 20 bp, Homo sapiens
tcccaggttggctctgccag

SEQ ID NO: 2466439 - DNA, 21 bp, Homo sapiens
tcccaggttggctctgccagt

SEQ ID NO: 2466440 - DNA, 22 bp, Homo sapiens
aaaagaattgttgggggttttt

SEQ ID NO: 2466441 - DNA, 13 bp, Homo sapiens
aaaagacattcag

SEQ ID NO: 2466442 - DNA, 11 bp, Homo sapiens
aaaagactcat

SEQ ID NO: 2466443 - DNA, 12 bp, Homo sapiens
aaaagataaaca

SEQ ID NO: 2466444 - DNA, 19 bp, Homo sapiens
aaaagataaacacaagatt

SEQ ID NO: 2466445 - DNA, 23 bp, Homo sapiens
aaaagatctgttttgaaggcaaa

SEQ ID NO: 2466446 - DNA, 13 bp, Homo sapiens
aaaagatgctttt

SEQ ID NO: 2466447 - DNA, 14 bp, Homo sapiens
aaaagcaacattca

SEQ ID NO: 2466448 - DNA, 14 bp, Homo sapiens
aaaagcattttgta

SEQ ID NO: 2466449 - DNA, 21 bp, Homo sapiens
aaaagcgtgagcttaaaatac

SEQ ID NO: 2466450 - DNA, 13 bp, Homo sapiens
aaaagcttttgtc

SEQ ID NO: 2466451 - DNA, 11 bp, Homo sapiens
aaaaggcctgg

SEQ ID NO: 2466452 - DNA, 16 bp, Homo sapiens
aaaaggtttacagaat

SEQ ID NO: 2466453 - DNA, 19 bp, Homo sapiens
aaaaggtttatgaaaaaga

SEQ ID NO: 2466454 - DNA, 23 bp, Homo sapiens
aaaagtatgttctaacctttaca

SEQ ID NO: 2466455 - DNA, 18 bp, Homo sapiens
aaaagtgggcttgattct

SEQ ID NO: 2466456 - DNA, 15 bp, Homo sapiens
aaaagttccaagagt

SEQ ID NO: 2466457 - DNA, 15 bp, Homo sapiens
aaaagttgcagctgt

SEQ ID NO: 2466458 - DNA, 14 bp, Homo sapiens
aaaagttgctattt

SEQ ID NO: 2466459 - DNA, 22 bp, Homo sapiens
aaaataaaacccgttgattact

SEQ ID NO: 2466460 - DNA, 14 bp, Homo sapiens
aaaataaatatatc

SEQ ID NO: 2466461 - DNA, 14 bp, Homo sapiens
aaaataagcaggtg

SEQ ID NO: 2466462 - DNA, 19 bp, Homo sapiens
aaaataagcaggtggatct

SEQ ID NO: 2466463 - DNA, 16 bp, Homo sapiens
aaaataatactgctga

SEQ ID NO: 2466464 - DNA, 20 bp, Homo sapiens
aaaataattatataactgta

SEQ ID NO: 2466465 - DNA, 16 bp, Homo sapiens
aaaatacttttactct

SEQ ID NO: 2466466 - DNA, 13 bp, Homo sapiens
aaaatagacactc

SEQ ID NO: 2466467 - DNA, 17 bp, Homo sapiens
aaaatagcgttcttgta

SEQ ID NO: 2466468 - DNA, 18 bp, Homo sapiens
aaaatagcgttcttgtaa

SEQ ID NO: 2466469 - DNA, 12 bp, Homo sapiens
aaaataggcagg

SEQ ID NO: 2466470 - DNA, 19 bp, Homo sapiens
aaaatagtttggatatgta

SEQ ID NO: 2466471 - DNA, 13 bp, Homo sapiens
aaaatatagctaa

SEQ ID NO: 2466472 - DNA, 22 bp, Homo sapiens
aaaatatctacattaatatact

SEQ ID NO: 2466473 - DNA, 13 bp, Homo sapiens
aaaatattttgaa

SEQ ID NO: 2466474 - DNA, 13 bp, Homo sapiens
aaaatcatcagaa

SEQ ID NO: 2466475 - DNA, 19 bp, Homo sapiens
aaaatctcccattttggaa

SEQ ID NO: 2466476 - DNA, 15 bp, Homo sapiens
aaaatctctccactt

SEQ ID NO: 2466477 - DNA, 18 bp, Homo sapiens
aaaatctctccactttca

SEQ ID NO: 2466478 - DNA, 20 bp, Homo sapiens
aaaatcttatagttctaggc

SEQ ID NO: 2466479 - DNA, 18 bp, Homo sapiens
aaaatcttgatcagttaa

SEQ ID NO: 2466480 - DNA, 11 bp, Homo sapiens
aaaatcttgtc

SEQ ID NO: 2466481 - DNA, 14 bp, Homo sapiens
aaaatgacaatcat

SEQ ID NO: 2466482 - DNA, 18 bp, Homo sapiens
aaaatgacaatcatgtgt

SEQ ID NO: 2466483 - DNA, 20 bp, Homo sapiens
aaaatgacaatcatgtgtgt

SEQ ID NO: 2466484 - DNA, 14 bp, Homo sapiens
aaaatgatacagca

SEQ ID NO: 2466485 - DNA, 23 bp, Homo sapiens
aaaatgccatgatgcctctgtct

SEQ ID NO: 2466486 - DNA, 13 bp, Homo sapiens
aaaatgctaggtt

SEQ ID NO: 2466487 - DNA, 16 bp, Homo sapiens
aaaatgctaggttcta

SEQ ID NO: 2466488 - DNA, 21 bp, Homo sapiens
aaaatggcagggggtggaatt

SEQ ID NO: 2466489 - DNA, 16 bp, Homo sapiens
aaaatgggcacttaaa

SEQ ID NO: 2466490 - DNA, 14 bp, Homo sapiens
aaaatgtaaagcca

SEQ ID NO: 2466491 - DNA, 23 bp, Homo sapiens
aaaatgtaagattatagattcta

SEQ ID NO: 2466492 - DNA, 21 bp, Homo sapiens
aaaatgtaggcttagtttgtg

SEQ ID NO: 2466493 - DNA, 16 bp, Homo sapiens
aaaatgtatgcatgtt

SEQ ID NO: 2466494 - DNA, 15 bp, Homo sapiens
aaaatgtattttatg

SEQ ID NO: 2466495 - DNA, 22 bp, Homo sapiens
aaaatgtattttatgttatata

SEQ ID NO: 2466496 - DNA, 14 bp, Homo sapiens
aaaatgtccttgtg

SEQ ID NO: 2466497 - DNA, 15 bp, Homo sapiens
aaaatgtgatgttct

SEQ ID NO: 2466498 - DNA, 19 bp, Homo sapiens
aaaatgtgatgttctaagg

SEQ ID NO: 2466499 - DNA, 12 bp, Homo sapiens
aaaatgttcttt

SEQ ID NO: 2466500 - DNA, 13 bp, Homo sapiens
aaaatgttgaaat

SEQ ID NO: 2466501 - DNA, 13 bp, Homo sapiens
aaaattatttgca

SEQ ID NO: 2466502 - DNA, 14 bp, Homo sapiens
aaaattgaaatgta

SEQ ID NO: 2466503 - DNA, 16 bp, Homo sapiens
aaaattgaaatgtaag

SEQ ID NO: 2466504 - DNA, 21 bp, Homo sapiens
aaaattgaatgcaaaccatag

SEQ ID NO: 2466505 - DNA, 15 bp, Homo sapiens
aaaattgcaaatctt

SEQ ID NO: 2466506 - DNA, 20 bp, Homo sapiens
aaaattgttaatttttccta

SEQ ID NO: 2466507 - DNA, 18 bp, Homo sapiens
aaaatttgttattttgca

SEQ ID NO: 2466508 - DNA, 13 bp, Homo sapiens
aaaatttgttgca

SEQ ID NO: 2466509 - DNA, 20 bp, Homo sapiens
aaacaaactcgttttttaca

SEQ ID NO: 2466510 - DNA, 12 bp, Homo sapiens
aaacaacactgt

SEQ ID NO: 2466511 - DNA, 20 bp, Homo sapiens
aaacaagaaaaataaagaaa

SEQ ID NO: 2466512 - DNA, 22 bp, Homo sapiens
aaacaagtatttgttaatttag

SEQ ID NO: 2466513 - DNA, 21 bp, Homo sapiens
aaacacaagattggtgttttt

SEQ ID NO: 2466514 - DNA, 17 bp, Homo sapiens
aaacacattaggaaaag

SEQ ID NO: 2466515 - DNA, 19 bp, Homo sapiens
aaacaccaacatgttggga

SEQ ID NO: 2466516 - DNA, 18 bp, Homo sapiens
aaacacctcctcatgtac

SEQ ID NO: 2466517 - DNA, 22 bp, Homo sapiens
aaacaccttccagctcctgtaa

SEQ ID NO: 2466518 - DNA, 12 bp, Homo sapiens
aaacacttgtaa

SEQ ID NO: 2466519 - DNA, 12 bp, Homo sapiens
aaacagaacact

SEQ ID NO: 2466520 - DNA, 14 bp, Homo sapiens
aaacagaacactta

SEQ ID NO: 2466521 - DNA, 13 bp, Homo sapiens
aaacagaatgtct

SEQ ID NO: 2466522 - DNA, 17 bp, Homo sapiens
aaacaggcactgccctg

SEQ ID NO: 2466523 - DNA, 18 bp, Homo sapiens
aaacaggtatatactttg

SEQ ID NO: 2466524 - DNA, 23 bp, Homo sapiens
aaacaggtatatactttgaaagg

SEQ ID NO: 2466525 - DNA, 23 bp, Homo sapiens
aaacagtggatcacaaagtggaa

SEQ ID NO: 2466526 - DNA, 19 bp, Homo sapiens
aaacagttgcatgtagtaa

SEQ ID NO: 2466527 - DNA, 20 bp, Homo sapiens
aaacagttgcatgtagtaac

SEQ ID NO: 2466528 - DNA, 24 bp, Homo sapiens
aaacagttgcatgtagtaacacta

SEQ ID NO: 2466529 - DNA, 19 bp, Homo sapiens
aaacatgaccctaaatctt

SEQ ID NO: 2466530 - DNA, 20 bp, Homo sapiens
aaacatgtttatttttcttg

SEQ ID NO: 2466531 - DNA, 17 bp, Homo sapiens
aaacatttattttgaca

SEQ ID NO: 2466532 - DNA, 17 bp, Homo sapiens
aaaccactgaaaaaata

SEQ ID NO: 2466533 - DNA, 24 bp, Homo sapiens
aaaccaggtccaatgagctttctg

SEQ ID NO: 2466534 - DNA, 22 bp, Homo sapiens
aaaccatctccctggtgcttat

SEQ ID NO: 2466535 - DNA, 23 bp, Homo sapiens
aaaccatctccctggtgcttatg

SEQ ID NO: 2466536 - DNA, 13 bp, Homo sapiens
aaaccatgtagaa

SEQ ID NO: 2466537 - DNA, 15 bp, Homo sapiens
aaaccccccagatat

SEQ ID NO: 2466538 - DNA, 13 bp, Homo sapiens
aaaccctagcctt

SEQ ID NO: 2466539 - DNA, 13 bp, Homo sapiens
aaaccgccagctc

SEQ ID NO: 2466540 - DNA, 14 bp, Homo sapiens
aaaccgccagctct

SEQ ID NO: 2466541 - DNA, 15 bp, Homo sapiens
aaaccgccagctctg

SEQ ID NO: 2466542 - DNA, 19 bp, Homo sapiens
aaaccgccagctctgttct

SEQ ID NO: 2466543 - DNA, 14 bp, Homo sapiens
aaaccgctaaaaga

SEQ ID NO: 2466544 - DNA, 21 bp, Homo sapiens
aaaccgctaaaagaaactttc

SEQ ID NO: 2466545 - DNA, 22 bp, Homo sapiens
aacactgtgcacatctgtgtct

SEQ ID NO: 2466546 - DNA, 22 bp, Homo sapiens
aacagaaagcctgggtgacatt

SEQ ID NO: 2466547 - DNA, 19 bp, Homo sapiens
aacagaaattgtatattgt

SEQ ID NO: 2466548 - DNA, 18 bp, Homo sapiens
aacagaacatagacagaa

SEQ ID NO: 2466549 - DNA, 18 bp, Homo sapiens
aacagaagggagggcaga

SEQ ID NO: 2466550 - DNA, 13 bp, Homo sapiens
aacagagggctgc

SEQ ID NO: 2466551 - DNA, 22 bp, Homo sapiens
aacagatctggaacctcagcct

SEQ ID NO: 2466552 - DNA, 13 bp, Homo sapiens
aacagatttggaa

SEQ ID NO: 2466553 - DNA, 14 bp, Homo sapiens
aacagatttggaaa

SEQ ID NO: 2466554 - DNA, 15 bp, Homo sapiens
aacagatttggaaag

SEQ ID NO: 2466555 - DNA, 20 bp, Homo sapiens
aacagcaccaaatcaaaatc

SEQ ID NO: 2466556 - DNA, 11 bp, Homo sapiens
aacagctggtg

SEQ ID NO: 2466557 - DNA, 21 bp, Homo sapiens
aacagctggtgtagctacaga

SEQ ID NO: 2466558 - DNA, 22 bp, Homo sapiens
aacagctggtgtagctacagag

SEQ ID NO: 2466559 - DNA, 23 bp, Homo sapiens
aacagctggtgtagctacagaga

SEQ ID NO: 2466560 - DNA, 16 bp, Homo sapiens
aacaggcactgccctg

SEQ ID NO: 2466561 - DNA, 14 bp, Homo sapiens
aacaggcctcaggg

SEQ ID NO: 2466562 - DNA, 18 bp, Homo sapiens
aacaggtaatataaaaag

SEQ ID NO: 2466563 - DNA, 15 bp, Homo sapiens
aacaggtatatactt

SEQ ID NO: 2466564 - DNA, 13 bp, Homo sapiens
aacagtaaaccac

SEQ ID NO: 2466565 - DNA, 16 bp, Homo sapiens
aacagtaaaccactga

SEQ ID NO: 2466566 - DNA, 19 bp, Homo sapiens
aacagtaaaccactgaaaa

SEQ ID NO: 2466567 - DNA, 17 bp, Homo sapiens
aacagtgcaacactggt

SEQ ID NO: 2466568 - DNA, 19 bp, Homo sapiens
aacagtgtgcaaggcagcc

SEQ ID NO: 2466569 - DNA, 21 bp, Homo sapiens
aacagttgcatgtagtaacac

SEQ ID NO: 2466570 - DNA, 14 bp, Homo sapiens
aacagttggtaact

SEQ ID NO: 2466571 - DNA, 20 bp, Homo sapiens
aacagttgtatttaacagaa

SEQ ID NO: 2466572 - DNA, 13 bp, Homo sapiens
aacagtttaatga

SEQ ID NO: 2466573 - DNA, 21 bp, Homo sapiens
aacagtttaatgaagatctaa

SEQ ID NO: 2466574 - DNA, 21 bp, Homo sapiens
aacagttttcctatgctttga

SEQ ID NO: 2466575 - DNA, 13 bp, Homo sapiens
aacataagctatt

SEQ ID NO: 2466576 - DNA, 20 bp, Homo sapiens
aacataagctatttttctaa

SEQ ID NO: 2466577 - DNA, 20 bp, Homo sapiens
aacataccccttacaaatga

SEQ ID NO: 2466578 - DNA, 12 bp, Homo sapiens
aacatagataaa

SEQ ID NO: 2466579 - DNA, 13 bp, Homo sapiens
aacatataatgtt

SEQ ID NO: 2466580 - DNA, 18 bp, Homo sapiens
aacatataatgttgttat

SEQ ID NO: 2466581 - DNA, 21 bp, Homo sapiens
aacatataatgttgttattta

SEQ ID NO: 2466582 - DNA, 17 bp, Homo sapiens
aacatccctttttcaat

SEQ ID NO: 2466583 - DNA, 20 bp, Homo sapiens
aacatgaccctaaatcttga

SEQ ID NO: 2466584 - DNA, 17 bp, Homo sapiens
aacatgatgaggtagta

SEQ ID NO: 2466585 - DNA, 16 bp, Homo sapiens
aacatgcactgatgtt

SEQ ID NO: 2466586 - DNA, 19 bp, Homo sapiens
aacatgtcctgcctattat

SEQ ID NO: 2466587 - DNA, 20 bp, Homo sapiens
aacatgttatttgtaataga

SEQ ID NO: 2466588 - DNA, 16 bp, Homo sapiens
aacatgtttccagcat

SEQ ID NO: 2466589 - DNA, 17 bp, Homo sapiens
aacatgtttccagcatt

SEQ ID NO: 2466590 - DNA, 11 bp, Homo sapiens
aacattccaag

SEQ ID NO: 2466591 - DNA, 12 bp, Homo sapiens
aacattccaaga

SEQ ID NO: 2466592 - DNA, 17 bp, Homo sapiens
aacattccaagactcta

SEQ ID NO: 2466593 - DNA, 16 bp, Homo sapiens
aacattttctggccag

SEQ ID NO: 2466594 - DNA, 23 bp, Homo sapiens
aacattttgaaagtctgtccttg

SEQ ID NO: 2466595 - DNA, 19 bp, Homo sapiens
aacatttttgataaagcct

SEQ ID NO: 2466596 - DNA, 18 bp, Homo sapiens
aaccaagctgagtttcct

SEQ ID NO: 2466597 - DNA, 20 bp, Homo sapiens
aaccaagctgagtttcctat

SEQ ID NO: 2466598 - DNA, 13 bp, Homo sapiens
aaccaatcctgga

SEQ ID NO: 2466599 - DNA, 13 bp, Homo sapiens
aaccaattatttt

SEQ ID NO: 2466600 - DNA, 15 bp, Homo sapiens
aaccactgaaaaaat

SEQ ID NO: 2466601 - DNA, 21 bp, Homo sapiens
aaccactttcttatttttttc

SEQ ID NO: 2466602 - DNA, 23 bp, Homo sapiens
aaccagatctagtcaatcaagtc

SEQ ID NO: 2466603 - DNA, 14 bp, Homo sapiens
aaccagctcagcac

SEQ ID NO: 2466604 - DNA, 16 bp, Homo sapiens
aaccagcttccttcag

SEQ ID NO: 2466605 - DNA, 16 bp, Homo sapiens
aaccaggtccaatgag

SEQ ID NO: 2466606 - DNA, 17 bp, Homo sapiens
aaccaggtccaatgagc

SEQ ID NO: 2466607 - DNA, 21 bp, Homo sapiens
aaccaggtccaatgagctttc

SEQ ID NO: 2466608 - DNA, 22 bp, Homo sapiens
aaccatagcacaggctaatttt

SEQ ID NO: 2466609 - DNA, 12 bp, Homo sapiens
aaccatctccct

SEQ ID NO: 2466610 - DNA, 13 bp, Homo sapiens
aaccatctccctg

SEQ ID NO: 2466611 - DNA, 17 bp, Homo sapiens
aaccattaaccagatct

SEQ ID NO: 2466612 - DNA, 19 bp, Homo sapiens
aaccatttgaaacccctgt

SEQ ID NO: 2466613 - DNA, 19 bp, Homo sapiens
aacccaaggtaccatccta

SEQ ID NO: 2466614 - DNA, 12 bp, Homo sapiens
aacccagactca

SEQ ID NO: 2466615 - DNA, 18 bp, Homo sapiens
aacccagactcagacatt

SEQ ID NO: 2466616 - DNA, 20 bp, Homo sapiens
aacccaggttggcgactgca

SEQ ID NO: 2466617 - DNA, 15 bp, Homo sapiens
aacccagttgccatc

SEQ ID NO: 2466618 - DNA, 20 bp, Homo sapiens
aacccatcaacaaaaattgt

SEQ ID NO: 2466619 - DNA, 15 bp, Homo sapiens
aacccccctgtacac

SEQ ID NO: 2466620 - DNA, 23 bp, Homo sapiens
aacccctcccctccatccctggc

SEQ ID NO: 2466621 - DNA, 14 bp, Homo sapiens
aacccgtgccaagt

SEQ ID NO: 2466622 - DNA, 15 bp, Homo sapiens
aacccgtggaggctg

SEQ ID NO: 2466623 - DNA, 17 bp, Homo sapiens
aacccgtggaggctgct

SEQ ID NO: 2466624 - DNA, 10 bp, Homo sapiens
aaccctcagg

SEQ ID NO: 2466625 - DNA, 18 bp, Homo sapiens
aaccctcagggcaaagcc

SEQ ID NO: 2466626 - DNA, 13 bp, Homo sapiens
aacccttgctgct

SEQ ID NO: 2466627 - DNA, 14 bp, Homo sapiens
aacccttgggccag

SEQ ID NO: 2466628 - DNA, 15 bp, Homo sapiens
aacccttgggccaga

SEQ ID NO: 2466629 - DNA, 18 bp, Homo sapiens
aacccttgggccagaagt

SEQ ID NO: 2466630 - DNA, 20 bp, Homo sapiens
aaccctttgtgtgctctcca

SEQ ID NO: 2466631 - DNA, 17 bp, Homo sapiens
aaccgtagatgatttca

SEQ ID NO: 2466632 - DNA, 11 bp, Homo sapiens
aacctagagat

SEQ ID NO: 2466633 - DNA, 20 bp, Homo sapiens
aacctcaccaactcctagtt

SEQ ID NO: 2466634 - DNA, 13 bp, Homo sapiens
aacctcagcctgg

SEQ ID NO: 2466635 - DNA, 14 bp, Homo sapiens
aacctcagcctggc

SEQ ID NO: 2466636 - DNA, 14 bp, Homo sapiens
aacctgagatttat

SEQ ID NO: 2466637 - DNA, 20 bp, Homo sapiens
aacctgagatttattaaaga

SEQ ID NO: 2466638 - DNA, 13 bp, Homo sapiens
aacctgctctcct

SEQ ID NO: 2466639 - DNA, 18 bp, Homo sapiens
aaccttgcctggtacagt

SEQ ID NO: 2466640 - DNA, 16 bp, Homo sapiens
aacctttcttcaccaa

SEQ ID NO: 2466641 - DNA, 18 bp, Homo sapiens
aacctttcttcaccaaat

SEQ ID NO: 2466642 - DNA, 14 bp, Homo sapiens
aacctttgtgccct

SEQ ID NO: 2466643 - DNA, 14 bp, Homo sapiens
aacgatttttaaaa

SEQ ID NO: 2466644 - DNA, 19 bp, Homo sapiens
aacgcctgagcccagggag

SEQ ID NO: 2466645 - DNA, 13 bp, Homo sapiens
aacggtgctcagg

SEQ ID NO: 2466646 - DNA, 17 bp, Homo sapiens
aacgtgttcaatatttt

SEQ ID NO: 2466647 - DNA, 21 bp, Homo sapiens
aactaaatgtgcaatagaagg

SEQ ID NO: 2466648 - DNA, 14 bp, Homo sapiens
aactaacatgtcct

SEQ ID NO: 2466649 - DNA, 20 bp, Homo sapiens
aactacaaaggtttaaatga

SEQ ID NO: 2466650 - DNA, 19 bp, Homo sapiens
aagggagggctctgaggcg

SEQ ID NO: 2466651 - DNA, 12 bp, Homo sapiens
aagggaggtggg

SEQ ID NO: 2466652 - DNA, 14 bp, Homo sapiens
aagggccagagcca

SEQ ID NO: 2466653 - DNA, 23 bp, Homo sapiens
aagggcctgcccagttgcactca

SEQ ID NO: 2466654 - DNA, 21 bp, Homo sapiens
aagggctgccggggcagcccc

SEQ ID NO: 2466655 - DNA, 19 bp, Homo sapiens
aaggggaccctccgctctg

SEQ ID NO: 2466656 - DNA, 13 bp, Homo sapiens
aaggggagcccac

SEQ ID NO: 2466657 - DNA, 14 bp, Homo sapiens
aaggggatttttat

SEQ ID NO: 2466658 - DNA, 20 bp, Homo sapiens
aaggggatttttatgtctgg

SEQ ID NO: 2466659 - DNA, 17 bp, Homo sapiens
aaggggccagaggctcg

SEQ ID NO: 2466660 - DNA, 23 bp, Homo sapiens
aaggggcctcaccgagtgggggc

SEQ ID NO: 2466661 - DNA, 13 bp, Homo sapiens
aaggggcctgagc

SEQ ID NO: 2466662 - DNA, 22 bp, Homo sapiens
aagggggcggcctatgacttgg

SEQ ID NO: 2466663 - DNA, 12 bp, Homo sapiens
aagggtaaacaa

SEQ ID NO: 2466664 - DNA, 20 bp, Homo sapiens
aagggtcaggcctttgagct

SEQ ID NO: 2466665 - DNA, 18 bp, Homo sapiens
aagggtcgaaagctctag

SEQ ID NO: 2466666 - DNA, 21 bp, Homo sapiens
aagggtgttgggagggtggtt

SEQ ID NO: 2466667 - DNA, 14 bp, Homo sapiens
aagggttgagctgg

SEQ ID NO: 2466668 - DNA, 19 bp, Homo sapiens
aaggtactttcatatttta

SEQ ID NO: 2466669 - DNA, 22 bp, Homo sapiens
aaggtactttcatattttaaac

SEQ ID NO: 2466670 - DNA, 20 bp, Homo sapiens
aaggtcgtttttttcattcc

SEQ ID NO: 2466671 - DNA, 15 bp, Homo sapiens
aaggtgaatagccat

SEQ ID NO: 2466672 - DNA, 20 bp, Homo sapiens
aaggtgaggagcttgaaacc

SEQ ID NO: 2466673 - DNA, 19 bp, Homo sapiens
aaggtgctctctttctgtc

SEQ ID NO: 2466674 - DNA, 19 bp, Homo sapiens
aaggtggatggccccagca

SEQ ID NO: 2466675 - DNA, 13 bp, Homo sapiens
aaggttctaaggc

SEQ ID NO: 2466676 - DNA, 14 bp, Homo sapiens
aaggttctaaggcc

SEQ ID NO: 2466677 - DNA, 13 bp, Homo sapiens
aaggttctaggtt

SEQ ID NO: 2466678 - DNA, 16 bp, Homo sapiens
aaggtttaaatgaaca

SEQ ID NO: 2466679 - DNA, 17 bp, Homo sapiens
aaggtttatgaaaaaga

SEQ ID NO: 2466680 - DNA, 20 bp, Homo sapiens
aaggttttaatttagtaaac

SEQ ID NO: 2466681 - DNA, 17 bp, Homo sapiens
aaggttttttttcagtt

SEQ ID NO: 2466682 - DNA, 18 bp, Homo sapiens
aagtaaaagcaaaaaaga

SEQ ID NO: 2466683 - DNA, 15 bp, Homo sapiens
aagtacactctgctg

SEQ ID NO: 2466684 - DNA, 16 bp, Homo sapiens
aagtacactctgctgt

SEQ ID NO: 2466685 - DNA, 12 bp, Homo sapiens
aagtacagagaa

SEQ ID NO: 2466686 - DNA, 15 bp, Homo sapiens
aagtacagagaagcc

SEQ ID NO: 2466687 - DNA, 22 bp, Homo sapiens
aagtacagagaagccatcacct

SEQ ID NO: 2466688 - DNA, 13 bp, Homo sapiens
aagtagaaatcat

SEQ ID NO: 2466689 - DNA, 15 bp, Homo sapiens
aagtagaaatcatag

SEQ ID NO: 2466690 - DNA, 21 bp, Homo sapiens
aagtatgtattatttacattt

SEQ ID NO: 2466691 - DNA, 19 bp, Homo sapiens
aagtattcaacaatttcaa

SEQ ID NO: 2466692 - DNA, 22 bp, Homo sapiens
aagtatttcaaattggagcttc

SEQ ID NO: 2466693 - DNA, 15 bp, Homo sapiens
aagtattttttcagt

SEQ ID NO: 2466694 - DNA, 20 bp, Homo sapiens
aagtcaaagcaaggaaacta

SEQ ID NO: 2466695 - DNA, 13 bp, Homo sapiens
aagtcaacagtaa

SEQ ID NO: 2466696 - DNA, 16 bp, Homo sapiens
aagtcaacagtaaacc

SEQ ID NO: 2466697 - DNA, 17 bp, Homo sapiens
aagtcaacagtaaacca

SEQ ID NO: 2466698 - DNA, 19 bp, Homo sapiens
aagtcaacagtaaaccact

SEQ ID NO: 2466699 - DNA, 20 bp, Homo sapiens
aagtcatcttgctaccagta

SEQ ID NO: 2466700 - DNA, 15 bp, Homo sapiens
aagtccaggtcctgg

SEQ ID NO: 2466701 - DNA, 17 bp, Homo sapiens
aagtcctacaagctaaa

SEQ ID NO: 2466702 - DNA, 19 bp, Homo sapiens
aagtctcagctaagctcac

SEQ ID NO: 2466703 - DNA, 17 bp, Homo sapiens
aagtctcatctggggag

SEQ ID NO: 2466704 - DNA, 13 bp, Homo sapiens
aagtctgtccttg

SEQ ID NO: 2466705 - DNA, 21 bp, Homo sapiens
aagtctgtccttgaaggacta

SEQ ID NO: 2466706 - DNA, 14 bp, Homo sapiens
aagtctgtttactg

SEQ ID NO: 2466707 - DNA, 16 bp, Homo sapiens
aagtctttctctttcc

SEQ ID NO: 2466708 - DNA, 23 bp, Homo sapiens
aagtctttctctttccctggtcc

SEQ ID NO: 2466709 - DNA, 18 bp, Homo sapiens
aagtcttttgttcgcatg

SEQ ID NO: 2466710 - DNA, 12 bp, Homo sapiens
aagtgaaaatat

SEQ ID NO: 2466711 - DNA, 14 bp, Homo sapiens
aagtgaaataatgt

SEQ ID NO: 2466712 - DNA, 13 bp, Homo sapiens
aagtgaagacaga

SEQ ID NO: 2466713 - DNA, 15 bp, Homo sapiens
aagtgaatgctggga

SEQ ID NO: 2466714 - DNA, 22 bp, Homo sapiens
aagtgacattgcatcaaagcat

SEQ ID NO: 2466715 - DNA, 21 bp, Homo sapiens
aagtgcatctggagagaacag

SEQ ID NO: 2466716 - DNA, 23 bp, Homo sapiens
aagtgccagtattttaaaatagc

SEQ ID NO: 2466717 - DNA, 19 bp, Homo sapiens
aagtgcctttcaggatcta

SEQ ID NO: 2466718 - DNA, 21 bp, Homo sapiens
aagtgctaaggttctaaggcc

SEQ ID NO: 2466719 - DNA, 13 bp, Homo sapiens
aagtgctgagatt

SEQ ID NO: 2466720 - DNA, 14 bp, Homo sapiens
aagtgctgagatta

SEQ ID NO: 2466721 - DNA, 14 bp, Homo sapiens
aagtgctgcactca

SEQ ID NO: 2466722 - DNA, 14 bp, Homo sapiens
aagtgctgtttatt

SEQ ID NO: 2466723 - DNA, 16 bp, Homo sapiens
aagtgctgtttattaa

SEQ ID NO: 2466724 - DNA, 21 bp, Homo sapiens
aagtgggttttttagttgaat

SEQ ID NO: 2466725 - DNA, 22 bp, Homo sapiens
aagtgtaaaatattttgaatca

SEQ ID NO: 2466726 - DNA, 14 bp, Homo sapiens
aagtgtacatatgt

SEQ ID NO: 2466727 - DNA, 13 bp, Homo sapiens
aagtgtatttgga

SEQ ID NO: 2466728 - DNA, 21 bp, Homo sapiens
aagtgtatttggaaataaagt

SEQ ID NO: 2466729 - DNA, 13 bp, Homo sapiens
aagttaaatgtag

SEQ ID NO: 2466730 - DNA, 20 bp, Homo sapiens
aagttagtatcttttgatat

SEQ ID NO: 2466731 - DNA, 15 bp, Homo sapiens
aagttagtttgtata

SEQ ID NO: 2466732 - DNA, 17 bp, Homo sapiens
aagttagtttgtatata

SEQ ID NO: 2466733 - DNA, 15 bp, Homo sapiens
aagttataagactct

SEQ ID NO: 2466734 - DNA, 17 bp, Homo sapiens
aagttatagtgaatact

SEQ ID NO: 2466735 - DNA, 18 bp, Homo sapiens
aagttattaatttcttca

SEQ ID NO: 2466736 - DNA, 15 bp, Homo sapiens
aagttattgcagttt

SEQ ID NO: 2466737 - DNA, 23 bp, Homo sapiens
aagttattgcagtttatcattca

SEQ ID NO: 2466738 - DNA, 16 bp, Homo sapiens
aagttcaacatgttat

SEQ ID NO: 2466739 - DNA, 17 bp, Homo sapiens
aagttccaagagtctaa

SEQ ID NO: 2466740 - DNA, 19 bp, Homo sapiens
aagttcccagttggagctc

SEQ ID NO: 2466741 - DNA, 14 bp, Homo sapiens
aagttctaagattc

SEQ ID NO: 2466742 - DNA, 19 bp, Homo sapiens
aagttctaagattctaatg

SEQ ID NO: 2466743 - DNA, 20 bp, Homo sapiens
aagttctaagattctaatga

SEQ ID NO: 2466744 - DNA, 17 bp, Homo sapiens
aagttctaataatttct

SEQ ID NO: 2466745 - DNA, 23 bp, Homo sapiens
aagttgagatagttttcatccat

SEQ ID NO: 2466746 - DNA, 15 bp, Homo sapiens
aagttgcagctgttt

SEQ ID NO: 2466747 - DNA, 17 bp, Homo sapiens
aagttgggcttgctatt

SEQ ID NO: 2466748 - DNA, 14 bp, Homo sapiens
aagttgtaaagtat

SEQ ID NO: 2466749 - DNA, 17 bp, Homo sapiens
aagtttagattttaatc

SEQ ID NO: 2466750 - DNA, 18 bp, Homo sapiens
aagtttatcagtaaataa

SEQ ID NO: 2466751 - DNA, 13 bp, Homo sapiens
aagtttctaagat

SEQ ID NO: 2466752 - DNA, 15 bp, Homo sapiens
aagtttctaagattc

SEQ ID NO: 2466753 - DNA, 18 bp, Homo sapiens
aagtttctaagattctaa

SEQ ID NO: 2466754 - DNA, 13 bp, Homo sapiens
aattcacaaactt

SEQ ID NO: 2466755 - DNA, 14 bp, Homo sapiens
aattcacaaacttt

SEQ ID NO: 2466756 - DNA, 21 bp, Homo sapiens
aattcacatgatgcacttcaa

SEQ ID NO: 2466757 - DNA, 21 bp, Homo sapiens
aattcaccccctttcctggac

SEQ ID NO: 2466758 - DNA, 15 bp, Homo sapiens
aattcacttagggtc

SEQ ID NO: 2466759 - DNA, 16 bp, Homo sapiens
aattcagacatctgag

SEQ ID NO: 2466760 - DNA, 22 bp, Homo sapiens
aattcagacatctgaggtttta

SEQ ID NO: 2466761 - DNA, 14 bp, Homo sapiens
aattcagcatttga

SEQ ID NO: 2466762 - DNA, 19 bp, Homo sapiens
aattcaggtttttcctttt

SEQ ID NO: 2466763 - DNA, 15 bp, Homo sapiens
aattcagtttcataa

SEQ ID NO: 2466764 - DNA, 18 bp, Homo sapiens
aattccaaagtctctaat

SEQ ID NO: 2466765 - DNA, 22 bp, Homo sapiens
aattcctatacgcagcgtgctt

SEQ ID NO: 2466766 - DNA, 12 bp, Homo sapiens
aattctaaaatg

SEQ ID NO: 2466767 - DNA, 14 bp, Homo sapiens
aattctaaaatgat

SEQ ID NO: 2466768 - DNA, 13 bp, Homo sapiens
aattctatgcctg

SEQ ID NO: 2466769 - DNA, 23 bp, Homo sapiens
aattctattaaagtgctaaggtt

SEQ ID NO: 2466770 - DNA, 18 bp, Homo sapiens
aattctcattaaaagaat

SEQ ID NO: 2466771 - DNA, 13 bp, Homo sapiens
aattctcctggag

SEQ ID NO: 2466772 - DNA, 17 bp, Homo sapiens
aattctgagttttgtgt

SEQ ID NO: 2466773 - DNA, 18 bp, Homo sapiens
aattcttggttgaggaaa

SEQ ID NO: 2466774 - DNA, 20 bp, Homo sapiens
aattcttggttgaggaaaca

SEQ ID NO: 2466775 - DNA, 22 bp, Homo sapiens
aattctttcaatacagatatat

SEQ ID NO: 2466776 - DNA, 18 bp, Homo sapiens
aattgaatactttgaatg

SEQ ID NO: 2466777 - DNA, 19 bp, Homo sapiens
aattgaatactttgaatgt

SEQ ID NO: 2466778 - DNA, 16 bp, Homo sapiens
aattgagtaatggtgt

SEQ ID NO: 2466779 - DNA, 13 bp, Homo sapiens
aattgatttgcat

SEQ ID NO: 2466780 - DNA, 16 bp, Homo sapiens
aattgatttgcattga

SEQ ID NO: 2466781 - DNA, 20 bp, Homo sapiens
aattgatttgcattgaacac

SEQ ID NO: 2466782 - DNA, 19 bp, Homo sapiens
aattgatttttctcttcat

SEQ ID NO: 2466783 - DNA, 20 bp, Homo sapiens
aattgccatgtacagtatgt

SEQ ID NO: 2466784 - DNA, 19 bp, Homo sapiens
aattgcttatttattgtat

SEQ ID NO: 2466785 - DNA, 15 bp, Homo sapiens
aattggaaagcaggt

SEQ ID NO: 2466786 - DNA, 20 bp, Homo sapiens
aattggcaccgaagcccaga

SEQ ID NO: 2466787 - DNA, 21 bp, Homo sapiens
aattgtaaagtaaaagctata

SEQ ID NO: 2466788 - DNA, 14 bp, Homo sapiens
aattgtaactgttc

SEQ ID NO: 2466789 - DNA, 16 bp, Homo sapiens
aattgtaactgttctt

SEQ ID NO: 2466790 - DNA, 14 bp, Homo sapiens
aattgtacagccgg

SEQ ID NO: 2466791 - DNA, 16 bp, Homo sapiens
aattgtactaaagcca

SEQ ID NO: 2466792 - DNA, 17 bp, Homo sapiens
aattgtactaaagccaa

SEQ ID NO: 2466793 - DNA, 11 bp, Homo sapiens
aattgtccctt

SEQ ID NO: 2466794 - DNA, 18 bp, Homo sapiens
aattgtcccttaaacaaa

SEQ ID NO: 2466795 - DNA, 12 bp, Homo sapiens
aattgtctgaaa

SEQ ID NO: 2466796 - DNA, 21 bp, Homo sapiens
aattgtgcagtactttgtgca

SEQ ID NO: 2466797 - DNA, 17 bp, Homo sapiens
aattgtgtagccttttt

SEQ ID NO: 2466798 - DNA, 21 bp, Homo sapiens
aattgtgtagcctttttgtat

SEQ ID NO: 2466799 - DNA, 19 bp, Homo sapiens
aattgtgtggattctttaa

SEQ ID NO: 2466800 - DNA, 13 bp, Homo sapiens
aattgttctcaga

SEQ ID NO: 2466801 - DNA, 13 bp, Homo sapiens
aattgttgttctg

SEQ ID NO: 2466802 - DNA, 14 bp, Homo sapiens
aattgttgttctgt

SEQ ID NO: 2466803 - DNA, 9 bp, Homo sapiens
aatttaaac

SEQ ID NO: 2466804 - DNA, 15 bp, Homo sapiens
aatttaaacacctcc

SEQ ID NO: 2466805 - DNA, 19 bp, Homo sapiens
aatttaaacacctcctcat

SEQ ID NO: 2466806 - DNA, 22 bp, Homo sapiens
aatttaaactataagcaagaag

SEQ ID NO: 2466807 - DNA, 11 bp, Homo sapiens
aatttaaagca

SEQ ID NO: 2466808 - DNA, 19 bp, Homo sapiens
aatttaaagcaggttcttg

SEQ ID NO: 2466809 - DNA, 16 bp, Homo sapiens
aatttacaaaaatata

SEQ ID NO: 2466810 - DNA, 18 bp, Homo sapiens
aatttacaaaaatataaa

SEQ ID NO: 2466811 - DNA, 21 bp, Homo sapiens
aatttacctaagattacaaat

SEQ ID NO: 2466812 - DNA, 21 bp, Homo sapiens
aatttagaaatcattttgcaa

SEQ ID NO: 2466813 - DNA, 16 bp, Homo sapiens
aatttagcattgtagt

SEQ ID NO: 2466814 - DNA, 15 bp, Homo sapiens
aatttagtaaaccaa

SEQ ID NO: 2466815 - DNA, 12 bp, Homo sapiens
aatttagtttca

SEQ ID NO: 2466816 - DNA, 22 bp, Homo sapiens
aatttataaaaaggtgttttga

SEQ ID NO: 2466817 - DNA, 17 bp, Homo sapiens
aatttcaaggttctaac

SEQ ID NO: 2466818 - DNA, 21 bp, Homo sapiens
aatttcaataaaagataaatt

SEQ ID NO: 2466819 - DNA, 23 bp, Homo sapiens
aatttcagactcccattcctgaa

SEQ ID NO: 2466820 - DNA, 12 bp, Homo sapiens
aatttcccagga

SEQ ID NO: 2466821 - DNA, 17 bp, Homo sapiens
aatttcccaggaccctg

SEQ ID NO: 2466822 - DNA, 17 bp, Homo sapiens
aatttcggattttttcc

SEQ ID NO: 2466823 - DNA, 18 bp, Homo sapiens
aatttcggattttttcca

SEQ ID NO: 2466824 - DNA, 20 bp, Homo sapiens
aatttcggattttttccaaa

SEQ ID NO: 2466825 - DNA, 15 bp, Homo sapiens
aatttctactttgaa

SEQ ID NO: 2466826 - DNA, 21 bp, Homo sapiens
aatttctgtgttgccaagctc

SEQ ID NO: 2466827 - DNA, 20 bp, Homo sapiens
aatttcttaacttcttgctt

SEQ ID NO: 2466828 - DNA, 17 bp, Homo sapiens
aatttgattattaacat

SEQ ID NO: 2466829 - DNA, 13 bp, Homo sapiens
aatttgattgatt

SEQ ID NO: 2466830 - DNA, 17 bp, Homo sapiens
aatttgattgatttgaa

SEQ ID NO: 2466831 - DNA, 17 bp, Homo sapiens
aatttgcattaaattac

SEQ ID NO: 2466832 - DNA, 20 bp, Homo sapiens
aatttgcattaaattacaga

SEQ ID NO: 2466833 - DNA, 13 bp, Homo sapiens
aatttggcaattt

SEQ ID NO: 2466834 - DNA, 18 bp, Homo sapiens
aatttggcaattttgtgg

SEQ ID NO: 2466835 - DNA, 16 bp, Homo sapiens
aattttaatgaagaaa

SEQ ID NO: 2466836 - DNA, 19 bp, Homo sapiens
aattttacacgcttttgtg

SEQ ID NO: 2466837 - DNA, 14 bp, Homo sapiens
aattttagtttttc

SEQ ID NO: 2466838 - DNA, 15 bp, Homo sapiens
aattttagtttttca

SEQ ID NO: 2466839 - DNA, 12 bp, Homo sapiens
aattttctttca

SEQ ID NO: 2466840 - DNA, 19 bp, Homo sapiens
aattttgaagtgctgttta

SEQ ID NO: 2466841 - DNA, 12 bp, Homo sapiens
aattttggattt

SEQ ID NO: 2466842 - DNA, 18 bp, Homo sapiens
aattttgtaatgtatcaa

SEQ ID NO: 2466843 - DNA, 14 bp, Homo sapiens
aattttgtgtaaga

SEQ ID NO: 2466844 - DNA, 13 bp, Homo sapiens
aatttttaaacaa

SEQ ID NO: 2466845 - DNA, 13 bp, Homo sapiens
aatttttgatact

SEQ ID NO: 2466846 - DNA, 14 bp, Homo sapiens
aattttttttaaca

SEQ ID NO: 2466847 - DNA, 13 bp, Homo sapiens
acaaaaacaggta

SEQ ID NO: 2466848 - DNA, 20 bp, Homo sapiens
acaaaaacaggtatatactt

SEQ ID NO: 2466849 - DNA, 13 bp, Homo sapiens
acaaaaatataaa

SEQ ID NO: 2466850 - DNA, 14 bp, Homo sapiens
acaaaactgcattt

SEQ ID NO: 2466851 - DNA, 17 bp, Homo sapiens
acaaactgtaatacaat

SEQ ID NO: 2466852 - DNA, 19 bp, Homo sapiens
acaaactttgcatctcagt

SEQ ID NO: 2466853 - DNA, 18 bp, Homo sapiens
acaaagaaacaaagatgt

SEQ ID NO: 2466854 - DNA, 21 bp, Homo sapiens
acaaagcagaatagtattttt

SEQ ID NO: 2466855 - DNA, 15 bp, Homo sapiens
acaaagcccttttat

SEQ ID NO: 2466856 - DNA, 14 bp, Homo sapiens
acaaaggtttaaat

SEQ ID NO: 2466857 - DNA, 20 bp, Homo sapiens
acaaaggtttaaatgaacaa

SEQ ID NO: 2466858 - DNA, 13 bp, Homo sapiens
acaaatagaaaat

SEQ ID NO: 2466859 - DNA, 14 bp, Homo sapiens
acagtcactgctct

SEQ ID NO: 2466860 - DNA, 14 bp, Homo sapiens
acagtctaaagctg

SEQ ID NO: 2466861 - DNA, 19 bp, Homo sapiens
acagtcttccatttgcaag

SEQ ID NO: 2466862 - DNA, 13 bp, Homo sapiens
acagtgaagacag

SEQ ID NO: 2466863 - DNA, 15 bp, Homo sapiens
acagtgacttctgag

SEQ ID NO: 2466864 - DNA, 21 bp, Homo sapiens
acagtgcttttaagtgaaaat

SEQ ID NO: 2466865 - DNA, 14 bp, Homo sapiens
acagtgtctttttt

SEQ ID NO: 2466866 - DNA, 21 bp, Homo sapiens
acagtgtctttttttgtatag

SEQ ID NO: 2466867 - DNA, 12 bp, Homo sapiens
acagttctgtgg

SEQ ID NO: 2466868 - DNA, 17 bp, Homo sapiens
acagttctttgggccag

SEQ ID NO: 2466869 - DNA, 21 bp, Homo sapiens
acagttctttgggccagacat

SEQ ID NO: 2466870 - DNA, 23 bp, Homo sapiens
acagttgcatgtagtaacactaa

SEQ ID NO: 2466871 - DNA, 19 bp, Homo sapiens
acagtttaatgaagatcta

SEQ ID NO: 2466872 - DNA, 18 bp, Homo sapiens
acagtttgaaataagcta

SEQ ID NO: 2466873 - DNA, 22 bp, Homo sapiens
acagtttgaaataagctatttg

SEQ ID NO: 2466874 - DNA, 14 bp, Homo sapiens
acataaaggaaaag

SEQ ID NO: 2466875 - DNA, 18 bp, Homo sapiens
acataaaggaaaagacac

SEQ ID NO: 2466876 - DNA, 12 bp, Homo sapiens
acataaagttga

SEQ ID NO: 2466877 - DNA, 18 bp, Homo sapiens
acataagccattattcac

SEQ ID NO: 2466878 - DNA, 12 bp, Homo sapiens
acataagctatt

SEQ ID NO: 2466879 - DNA, 20 bp, Homo sapiens
acataagctatttttctaac

SEQ ID NO: 2466880 - DNA, 23 bp, Homo sapiens
acataattatccaggaagggaat

SEQ ID NO: 2466881 - DNA, 17 bp, Homo sapiens
acataattcactctgag

SEQ ID NO: 2466882 - DNA, 20 bp, Homo sapiens
acataccccctcccccaccg

SEQ ID NO: 2466883 - DNA, 18 bp, Homo sapiens
acataccccttacaaatg

SEQ ID NO: 2466884 - DNA, 16 bp, Homo sapiens
acataccctgacctgg

SEQ ID NO: 2466885 - DNA, 21 bp, Homo sapiens
acataccctggccgccccctg

SEQ ID NO: 2466886 - DNA, 19 bp, Homo sapiens
acatactggcctggactgt

SEQ ID NO: 2466887 - DNA, 18 bp, Homo sapiens
acatacttgaagggccag

SEQ ID NO: 2466888 - DNA, 18 bp, Homo sapiens
acatatgatctgtctgtg

SEQ ID NO: 2466889 - DNA, 20 bp, Homo sapiens
acatatggaattttgcaaag

SEQ ID NO: 2466890 - DNA, 14 bp, Homo sapiens
acatattttaaaat

SEQ ID NO: 2466891 - DNA, 14 bp, Homo sapiens
acatcacaagacta

SEQ ID NO: 2466892 - DNA, 16 bp, Homo sapiens
acatcacagcccagcc

SEQ ID NO: 2466893 - DNA, 22 bp, Homo sapiens
acatcagagtgacatccaggag

SEQ ID NO: 2466894 - DNA, 21 bp, Homo sapiens
acatcatttctttttgggaga

SEQ ID NO: 2466895 - DNA, 22 bp, Homo sapiens
acatcatttctttttgggagag

SEQ ID NO: 2466896 - DNA, 21 bp, Homo sapiens
acatccaaaatagttaagaca

SEQ ID NO: 2466897 - DNA, 17 bp, Homo sapiens
acatccaaagcagacag

SEQ ID NO: 2466898 - DNA, 13 bp, Homo sapiens
acatccctgggcc

SEQ ID NO: 2466899 - DNA, 14 bp, Homo sapiens
acatccctgggcct

SEQ ID NO: 2466900 - DNA, 15 bp, Homo sapiens
acatccctgggcctg

SEQ ID NO: 2466901 - DNA, 16 bp, Homo sapiens
acatccctgggcctgc

SEQ ID NO: 2466902 - DNA, 17 bp, Homo sapiens
acatccctgggcctgct

SEQ ID NO: 2466903 - DNA, 18 bp, Homo sapiens
acatccctgggcctgctg

SEQ ID NO: 2466904 - DNA, 19 bp, Homo sapiens
acatccctgggcctgctgc

SEQ ID NO: 2466905 - DNA, 15 bp, Homo sapiens
acatcctcctcccac

SEQ ID NO: 2466906 - DNA, 21 bp, Homo sapiens
acatctcaacaggcctcaggg

SEQ ID NO: 2466907 - DNA, 23 bp, Homo sapiens
acatctgaggttttatttcattt

SEQ ID NO: 2466908 - DNA, 16 bp, Homo sapiens
acatctgtgtcttgtt

SEQ ID NO: 2466909 - DNA, 22 bp, Homo sapiens
acatctttgaaattatgtaaat

SEQ ID NO: 2466910 - DNA, 23 bp, Homo sapiens
acatctttgaaattatgtaaatt

SEQ ID NO: 2466911 - DNA, 17 bp, Homo sapiens
acatgaaaggaccctgt

SEQ ID NO: 2466912 - DNA, 22 bp, Homo sapiens
acatgaagattctttcccaatt

SEQ ID NO: 2466913 - DNA, 15 bp, Homo sapiens
acatgaaggtaaata

SEQ ID NO: 2466914 - DNA, 22 bp, Homo sapiens
acatgaaggtaaataaaaagaa

SEQ ID NO: 2466915 - DNA, 12 bp, Homo sapiens
acatgaagtatt

SEQ ID NO: 2466916 - DNA, 19 bp, Homo sapiens
acatgaattattacagtgt

SEQ ID NO: 2466917 - DNA, 17 bp, Homo sapiens
acatgaattttagcttt

SEQ ID NO: 2466918 - DNA, 19 bp, Homo sapiens
acatgaccctaaatcttga

SEQ ID NO: 2466919 - DNA, 18 bp, Homo sapiens
acatgaggactctattct

SEQ ID NO: 2466920 - DNA, 21 bp, Homo sapiens
acatgaggactctattcttta

SEQ ID NO: 2466921 - DNA, 13 bp, Homo sapiens
acatgaggccact

SEQ ID NO: 2466922 - DNA, 13 bp, Homo sapiens
acatgatttcctt

SEQ ID NO: 2466923 - DNA, 18 bp, Homo sapiens
acatgcttattccatgac

SEQ ID NO: 2466924 - DNA, 21 bp, Homo sapiens
acatgcttattccatgactgc

SEQ ID NO: 2466925 - DNA, 14 bp, Homo sapiens
acatggaggttcta

SEQ ID NO: 2466926 - DNA, 16 bp, Homo sapiens
acatggaggttctaag

SEQ ID NO: 2466927 - DNA, 18 bp, Homo sapiens
acatggaggttctaaggc

SEQ ID NO: 2466928 - DNA, 19 bp, Homo sapiens
acatggaggttctaaggcc

SEQ ID NO: 2466929 - DNA, 20 bp, Homo sapiens
acatgggagccgggtctgcc

SEQ ID NO: 2466930 - DNA, 11 bp, Homo sapiens
acatggggagg

SEQ ID NO: 2466931 - DNA, 13 bp, Homo sapiens
acatggggaggag

SEQ ID NO: 2466932 - DNA, 18 bp, Homo sapiens
acatggttaccatgtctt

SEQ ID NO: 2466933 - DNA, 15 bp, Homo sapiens
acatgtcaatctgtc

SEQ ID NO: 2466934 - DNA, 17 bp, Homo sapiens
acatgtgaaaagaatag

SEQ ID NO: 2466935 - DNA, 18 bp, Homo sapiens
acatgtgaaaagaataga

SEQ ID NO: 2466936 - DNA, 13 bp, Homo sapiens
acatgtgacattt

SEQ ID NO: 2466937 - DNA, 15 bp, Homo sapiens
acatgtgacatttat

SEQ ID NO: 2466938 - DNA, 20 bp, Homo sapiens
acatgttgtaagcactgact

SEQ ID NO: 2466939 - DNA, 16 bp, Homo sapiens
acatgtttcctctagt

SEQ ID NO: 2466940 - DNA, 11 bp, Homo sapiens
acattaaagaa

SEQ ID NO: 2466941 - DNA, 15 bp, Homo sapiens
acattagaagacaat

SEQ ID NO: 2466942 - DNA, 20 bp, Homo sapiens
acattagaagacaattgaca

SEQ ID NO: 2466943 - DNA, 22 bp, Homo sapiens
acattatgtggttttagatttt

SEQ ID NO: 2466944 - DNA, 17 bp, Homo sapiens
acattccaaagaacagc

SEQ ID NO: 2466945 - DNA, 11 bp, Homo sapiens
acattctgaat

SEQ ID NO: 2466946 - DNA, 12 bp, Homo sapiens
acattgcttttc

SEQ ID NO: 2466947 - DNA, 15 bp, Homo sapiens
acattggaatgttct

SEQ ID NO: 2466948 - DNA, 17 bp, Homo sapiens
acattgttgagctattg

SEQ ID NO: 2466949 - DNA, 14 bp, Homo sapiens
acatttaaaacatt

SEQ ID NO: 2466950 - DNA, 13 bp, Homo sapiens
acatttatttcct

SEQ ID NO: 2466951 - DNA, 12 bp, Homo sapiens
acatttctcaat

SEQ ID NO: 2466952 - DNA, 22 bp, Homo sapiens
acatttgctgttttaaacatta

SEQ ID NO: 2466953 - DNA, 19 bp, Homo sapiens
acatttgctttttgtgata

SEQ ID NO: 2466954 - DNA, 12 bp, Homo sapiens
acatttggaata

SEQ ID NO: 2466955 - DNA, 18 bp, Homo sapiens
acatttggaatacttttt

SEQ ID NO: 2466956 - DNA, 21 bp, Homo sapiens
acatttgggagtttttatgag

SEQ ID NO: 2466957 - DNA, 20 bp, Homo sapiens
acattttgtaacaaagaact

SEQ ID NO: 2466958 - DNA, 20 bp, Homo sapiens
acattttttaggaaatgttt

SEQ ID NO: 2466959 - DNA, 21 bp, Homo sapiens
accaaaagaagtaaaagcaaa

SEQ ID NO: 2466960 - DNA, 23 bp, Homo sapiens
accaaagatgaatgaagcaaatg

SEQ ID NO: 2466961 - DNA, 20 bp, Homo sapiens
accaaagttctaataatttc

SEQ ID NO: 2466962 - DNA, 15 bp, Homo sapiens
accaaatcaaaatct

SEQ ID NO: 2466963 - DNA, 15 bp, Homo sapiens
accttgttacttctg

SEQ ID NO: 2466964 - DNA, 17 bp, Homo sapiens
accttgttacttctgag

SEQ ID NO: 2466965 - DNA, 15 bp, Homo sapiens
acctttactgtgctt

SEQ ID NO: 2466966 - DNA, 18 bp, Homo sapiens
acctttccaccacagcca

SEQ ID NO: 2466967 - DNA, 14 bp, Homo sapiens
accttttattacat

SEQ ID NO: 2466968 - DNA, 16 bp, Homo sapiens
accttttattgacaca

SEQ ID NO: 2466969 - DNA, 17 bp, Homo sapiens
accttttgaggagcccc

SEQ ID NO: 2466970 - DNA, 18 bp, Homo sapiens
accttttttcaacagtga

SEQ ID NO: 2466971 - DNA, 17 bp, Homo sapiens
acgaaataattgttgtt

SEQ ID NO: 2466972 - DNA, 13 bp, Homo sapiens
acgaaatgttatt

SEQ ID NO: 2466973 - DNA, 23 bp, Homo sapiens
acgaaatgttattttttaattat

SEQ ID NO: 2466974 - DNA, 13 bp, Homo sapiens
acgaaggagccca

SEQ ID NO: 2466975 - DNA, 12 bp, Homo sapiens
acgactgtctcc

SEQ ID NO: 2466976 - DNA, 22 bp, Homo sapiens
acgaggaatctgtgggtctggg

SEQ ID NO: 2466977 - DNA, 12 bp, Homo sapiens
acgagggctggc

SEQ ID NO: 2466978 - DNA, 14 bp, Homo sapiens
acgagggctggctg

SEQ ID NO: 2466979 - DNA, 21 bp, Homo sapiens
acgaggggtgtcttgggcaga

SEQ ID NO: 2466980 - DNA, 14 bp, Homo sapiens
acgatgacagtgtt

SEQ ID NO: 2466981 - DNA, 14 bp, Homo sapiens
acgcacctgcctca

SEQ ID NO: 2466982 - DNA, 23 bp, Homo sapiens
acgcactgagcaacgctattcca

SEQ ID NO: 2466983 - DNA, 12 bp, Homo sapiens
acgcctgagccc

SEQ ID NO: 2466984 - DNA, 18 bp, Homo sapiens
acgcctgagcccagggag

SEQ ID NO: 2466985 - DNA, 21 bp, Homo sapiens
acgcctgagcccagggaggcc

SEQ ID NO: 2466986 - DNA, 19 bp, Homo sapiens
acgcctgaggcaattagac

SEQ ID NO: 2466987 - DNA, 14 bp, Homo sapiens
acgcgccaccgagt

SEQ ID NO: 2466988 - DNA, 13 bp, Homo sapiens
acgctcagtgggg

SEQ ID NO: 2466989 - DNA, 13 bp, Homo sapiens
acgctccaaagtc

SEQ ID NO: 2466990 - DNA, 21 bp, Homo sapiens
acgctccaaagtcataattgc

SEQ ID NO: 2466991 - DNA, 17 bp, Homo sapiens
acgctccagctgccccg

SEQ ID NO: 2466992 - DNA, 14 bp, Homo sapiens
acgctgctgtcaca

SEQ ID NO: 2466993 - DNA, 11 bp, Homo sapiens
acgctttgatt

SEQ ID NO: 2466994 - DNA, 17 bp, Homo sapiens
acgctttttgaaaaagc

SEQ ID NO: 2466995 - DNA, 21 bp, Homo sapiens
acggacagttccagaagtgtg

SEQ ID NO: 2466996 - DNA, 23 bp, Homo sapiens
acggaccaaagggagtctgccag

SEQ ID NO: 2466997 - DNA, 18 bp, Homo sapiens
acggagccactcctctga

SEQ ID NO: 2466998 - DNA, 19 bp, Homo sapiens
acggagccactcctctgac

SEQ ID NO: 2466999 - DNA, 20 bp, Homo sapiens
acggcacctgggccctgggg

SEQ ID NO: 2467000 - DNA, 19 bp, Homo sapiens
acggccacacagctgccgg

SEQ ID NO: 2467001 - DNA, 20 bp, Homo sapiens
acggccacacagctgccggt

SEQ ID NO: 2467002 - DNA, 19 bp, Homo sapiens
acggctctgtccccagcct

SEQ ID NO: 2467003 - DNA, 20 bp, Homo sapiens
acggctctgtccccagcctg

SEQ ID NO: 2467004 - DNA, 18 bp, Homo sapiens
acggctgcgcactgtgtc

SEQ ID NO: 2467005 - DNA, 15 bp, Homo sapiens
acggggtttcaccat

SEQ ID NO: 2467006 - DNA, 23 bp, Homo sapiens
acgggtgtcacggccaggcagat

SEQ ID NO: 2467007 - DNA, 21 bp, Homo sapiens
acggtcggggcatctggcctg

SEQ ID NO: 2467008 - DNA, 15 bp, Homo sapiens
acggtgcccaagcca

SEQ ID NO: 2467009 - DNA, 21 bp, Homo sapiens
acggtgggggtagggggctgg

SEQ ID NO: 2467010 - DNA, 13 bp, Homo sapiens
acgtatttaatag

SEQ ID NO: 2467011 - DNA, 15 bp, Homo sapiens
acgtatttaatagca

SEQ ID NO: 2467012 - DNA, 16 bp, Homo sapiens
acgtcctgagaaagct

SEQ ID NO: 2467013 - DNA, 21 bp, Homo sapiens
acgtgaccggacttttctgca

SEQ ID NO: 2467014 - DNA, 11 bp, Homo sapiens
acgtgcacagg

SEQ ID NO: 2467015 - DNA, 19 bp, Homo sapiens
acgtgctctttgttttgtg

SEQ ID NO: 2467016 - DNA, 19 bp, Homo sapiens
acgtggctcagccagcact

SEQ ID NO: 2467017 - DNA, 18 bp, Homo sapiens
acgtgtgtttttctatta

SEQ ID NO: 2467018 - DNA, 23 bp, Homo sapiens
acgtgtgtttttctattaaaaga

SEQ ID NO: 2467019 - DNA, 14 bp, Homo sapiens
acgttttataagca

SEQ ID NO: 2467020 - DNA, 21 bp, Homo sapiens
acgttttataagcatcattat

SEQ ID NO: 2467021 - DNA, 17 bp, Homo sapiens
actaaaataattttgta

SEQ ID NO: 2467022 - DNA, 17 bp, Homo sapiens
actaaactttttttctg

SEQ ID NO: 2467023 - DNA, 22 bp, Homo sapiens
actaaactttttttctgtacca

SEQ ID NO: 2467024 - DNA, 16 bp, Homo sapiens
actaaagccaaacata

SEQ ID NO: 2467025 - DNA, 18 bp, Homo sapiens
actaacaggccaaagagt

SEQ ID NO: 2467026 - DNA, 23 bp, Homo sapiens
actaaccagggaagctgtccctc

SEQ ID NO: 2467027 - DNA, 20 bp, Homo sapiens
actaactagacaccaaagtt

SEQ ID NO: 2467028 - DNA, 22 bp, Homo sapiens
actaactagacaccaaagttct

SEQ ID NO: 2467029 - DNA, 15 bp, Homo sapiens
actaactatgcatgg

SEQ ID NO: 2467030 - DNA, 13 bp, Homo sapiens
actaataattgca

SEQ ID NO: 2467031 - DNA, 12 bp, Homo sapiens
actaatggcatg

SEQ ID NO: 2467032 - DNA, 21 bp, Homo sapiens
actaatggcatgagaaataca

SEQ ID NO: 2467033 - DNA, 18 bp, Homo sapiens
actaattcataatcactc

SEQ ID NO: 2467034 - DNA, 13 bp, Homo sapiens
actaattccacac

SEQ ID NO: 2467035 - DNA, 16 bp, Homo sapiens
actaatttcaaaatgc

SEQ ID NO: 2467036 - DNA, 19 bp, Homo sapiens
actacaaaggtttaaatga

SEQ ID NO: 2467037 - DNA, 23 bp, Homo sapiens
actacaaaggtttaaatgaacaa

SEQ ID NO: 2467038 - DNA, 17 bp, Homo sapiens
actacagctggggtgca

SEQ ID NO: 2467039 - DNA, 19 bp, Homo sapiens
actacagctggggtgcagg

SEQ ID NO: 2467040 - DNA, 21 bp, Homo sapiens
actacagctggggtgcaggga

SEQ ID NO: 2467041 - DNA, 15 bp, Homo sapiens
actacagtcaggaaa

SEQ ID NO: 2467042 - DNA, 16 bp, Homo sapiens
actacagtctaaagct

SEQ ID NO: 2467043 - DNA, 17 bp, Homo sapiens
actacagtctaaagctg

SEQ ID NO: 2467044 - DNA, 23 bp, Homo sapiens
actaccgaatgtgtctttagata

SEQ ID NO: 2467045 - DNA, 18 bp, Homo sapiens
actaccttggttccccca

SEQ ID NO: 2467046 - DNA, 22 bp, Homo sapiens
actactgacggagtcctgtgtt

SEQ ID NO: 2467047 - DNA, 12 bp, Homo sapiens
actagacaagcc

SEQ ID NO: 2467048 - DNA, 16 bp, Homo sapiens
actagagcaagcagga

SEQ ID NO: 2467049 - DNA, 13 bp, Homo sapiens
actagatgtagta

SEQ ID NO: 2467050 - DNA, 15 bp, Homo sapiens
actagccaaacctca

SEQ ID NO: 2467051 - DNA, 18 bp, Homo sapiens
actagccaaacctcacca

SEQ ID NO: 2467052 - DNA, 11 bp, Homo sapiens
actagctcttg

SEQ ID NO: 2467053 - DNA, 18 bp, Homo sapiens
actaggagaaccaaatct

SEQ ID NO: 2467054 - DNA, 21 bp, Homo sapiens
actaggagctttgactcagga

SEQ ID NO: 2467055 - DNA, 18 bp, Homo sapiens
actaggcccccacttgcc

SEQ ID NO: 2467056 - DNA, 15 bp, Homo sapiens
actagggagccatgt

SEQ ID NO: 2467057 - DNA, 20 bp, Homo sapiens
actagttgtgtctggcagtt

SEQ ID NO: 2467058 - DNA, 13 bp, Homo sapiens
actataagaactt

SEQ ID NO: 2467059 - DNA, 20 bp, Homo sapiens
actatcttactatttcacaa

SEQ ID NO: 2467060 - DNA, 18 bp, Homo sapiens
actatgaaaatgctggct

SEQ ID NO: 2467061 - DNA, 15 bp, Homo sapiens
actatgattattaac

SEQ ID NO: 2467062 - DNA, 19 bp, Homo sapiens
actatgatttaatttgaaa

SEQ ID NO: 2467063 - DNA, 23 bp, Homo sapiens
actatgcatggtgccccaggacc

SEQ ID NO: 2467064 - DNA, 21 bp, Homo sapiens
actatggataaactaaacacg

SEQ ID NO: 2467065 - DNA, 14 bp, Homo sapiens
actatgtaacatgt

SEQ ID NO: 2467066 - DNA, 22 bp, Homo sapiens
actattaaaaaggtttacagaa

SEQ ID NO: 2467067 - DNA, 18 bp, Homo sapiens
actgttccccctgtgcag

SEQ ID NO: 2467068 - DNA, 13 bp, Homo sapiens
actgttctaaagc

SEQ ID NO: 2467069 - DNA, 16 bp, Homo sapiens
actgttctaaagctct

SEQ ID NO: 2467070 - DNA, 21 bp, Homo sapiens
actgttctaaagctctgacat

SEQ ID NO: 2467071 - DNA, 13 bp, Homo sapiens
actgttctgtgtc

SEQ ID NO: 2467072 - DNA, 17 bp, Homo sapiens
actgttctgtgtctttc

SEQ ID NO: 2467073 - DNA, 19 bp, Homo sapiens
actgttcttagctcaatga

SEQ ID NO: 2467074 - DNA, 23 bp, Homo sapiens
actgttcttagctcaatgagcat

SEQ ID NO: 2467075 - DNA, 13 bp, Homo sapiens
actgttcttgaat

SEQ ID NO: 2467076 - DNA, 13 bp, Homo sapiens
actgttgcacgtg

SEQ ID NO: 2467077 - DNA, 14 bp, Homo sapiens
actgttgcacgtgt

SEQ ID NO: 2467078 - DNA, 15 bp, Homo sapiens
actgttgcacgtgtg

SEQ ID NO: 2467079 - DNA, 16 bp, Homo sapiens
actgttgcacgtgtgt

SEQ ID NO: 2467080 - DNA, 12 bp, Homo sapiens
actgttggaatg

SEQ ID NO: 2467081 - DNA, 14 bp, Homo sapiens
actgtttatacact

SEQ ID NO: 2467082 - DNA, 18 bp, Homo sapiens
actgtttatacactgtgt

SEQ ID NO: 2467083 - DNA, 22 bp, Homo sapiens
actgtttgccttctacttttaa

SEQ ID NO: 2467084 - DNA, 19 bp, Homo sapiens
actgtttggaaataaatct

SEQ ID NO: 2467085 - DNA, 18 bp, Homo sapiens
acttaaatgttattatct

SEQ ID NO: 2467086 - DNA, 21 bp, Homo sapiens
acttaagcccagtgcactgaa

SEQ ID NO: 2467087 - DNA, 16 bp, Homo sapiens
acttaatcaaaactca

SEQ ID NO: 2467088 - DNA, 15 bp, Homo sapiens
acttaatgtatgtta

SEQ ID NO: 2467089 - DNA, 16 bp, Homo sapiens
acttactctaagatct

SEQ ID NO: 2467090 - DNA, 13 bp, Homo sapiens
acttacttgctta

SEQ ID NO: 2467091 - DNA, 15 bp, Homo sapiens
acttagattttacat

SEQ ID NO: 2467092 - DNA, 17 bp, Homo sapiens
acttagattttacatga

SEQ ID NO: 2467093 - DNA, 21 bp, Homo sapiens
acttagattttacatgaagta

SEQ ID NO: 2467094 - DNA, 14 bp, Homo sapiens
acttatgctgattt

SEQ ID NO: 2467095 - DNA, 12 bp, Homo sapiens
acttattaacaa

SEQ ID NO: 2467096 - DNA, 21 bp, Homo sapiens
acttattaacaattaggcaga

SEQ ID NO: 2467097 - DNA, 13 bp, Homo sapiens
acttcaaggccca

SEQ ID NO: 2467098 - DNA, 13 bp, Homo sapiens
acttcatttcaga

SEQ ID NO: 2467099 - DNA, 20 bp, Homo sapiens
acttccacagggtcccacag

SEQ ID NO: 2467100 - DNA, 20 bp, Homo sapiens
acttccaggtgttactgtaa

SEQ ID NO: 2467101 - DNA, 23 bp, Homo sapiens
acttcccagctaggaagagcagg

SEQ ID NO: 2467102 - DNA, 18 bp, Homo sapiens
acttcctctcgcggccct

SEQ ID NO: 2467103 - DNA, 21 bp, Homo sapiens
acttcgacactgttcttagct

SEQ ID NO: 2467104 - DNA, 21 bp, Homo sapiens
acttctattttaaagacaatg

SEQ ID NO: 2467105 - DNA, 19 bp, Homo sapiens
acttctcattttttaaaaa

SEQ ID NO: 2467106 - DNA, 16 bp, Homo sapiens
acttctctttgcctca

SEQ ID NO: 2467107 - DNA, 12 bp, Homo sapiens
acttctgcctgg

SEQ ID NO: 2467108 - DNA, 13 bp, Homo sapiens
acttctgcctgga

SEQ ID NO: 2467109 - DNA, 15 bp, Homo sapiens
acttctgtaattgtg

SEQ ID NO: 2467110 - DNA, 16 bp, Homo sapiens
acttcttatggaattg

SEQ ID NO: 2467111 - DNA, 16 bp, Homo sapiens
acttcttgaaggtgct

SEQ ID NO: 2467112 - DNA, 11 bp, Homo sapiens
acttcttgctt

SEQ ID NO: 2467113 - DNA, 20 bp, Homo sapiens
acttcttgcttctttctaga

SEQ ID NO: 2467114 - DNA, 19 bp, Homo sapiens
acttcttgtgtgtatgcac

SEQ ID NO: 2467115 - DNA, 12 bp, Homo sapiens
acttgaaagaaa

SEQ ID NO: 2467116 - DNA, 18 bp, Homo sapiens
acttgaacgttttctaat

SEQ ID NO: 2467117 - DNA, 19 bp, Homo sapiens
acttgaacgttttctaatt

SEQ ID NO: 2467118 - DNA, 21 bp, Homo sapiens
acttgaagggccagagccagg

SEQ ID NO: 2467119 - DNA, 20 bp, Homo sapiens
acttgaatgaaaatgtccat

SEQ ID NO: 2467120 - DNA, 24 bp, Homo sapiens
acttgaatgctagttatacttatt

SEQ ID NO: 2467121 - DNA, 18 bp, Homo sapiens
acttgaccctgagctgac

SEQ ID NO: 2467122 - DNA, 17 bp, Homo sapiens
acttgatccatttctaa

SEQ ID NO: 2467123 - DNA, 14 bp, Homo sapiens
acttgcatcactta

SEQ ID NO: 2467124 - DNA, 14 bp, Homo sapiens
acttgccaaattta

SEQ ID NO: 2467125 - DNA, 13 bp, Homo sapiens
acttgcctcttcc

SEQ ID NO: 2467126 - DNA, 13 bp, Homo sapiens
acttgcctgcctt

SEQ ID NO: 2467127 - DNA, 14 bp, Homo sapiens
acttgcctgccttt

SEQ ID NO: 2467128 - DNA, 22 bp, Homo sapiens
acttgcgagaaattcgtgtgtt

SEQ ID NO: 2467129 - DNA, 16 bp, Homo sapiens
acttgcttatttgaca

SEQ ID NO: 2467130 - DNA, 19 bp, Homo sapiens
acttggagggcccagccca

SEQ ID NO: 2467131 - DNA, 17 bp, Homo sapiens
acttggagtggagagga

SEQ ID NO: 2467132 - DNA, 15 bp, Homo sapiens
acttggcctctctct

SEQ ID NO: 2467133 - DNA, 18 bp, Homo sapiens
acttggctcgaatctctg

SEQ ID NO: 2467134 - DNA, 22 bp, Homo sapiens
acttggctcgaatctctgtgcc

SEQ ID NO: 2467135 - DNA, 16 bp, Homo sapiens
acttggctgcaggaat

SEQ ID NO: 2467136 - DNA, 14 bp, Homo sapiens
acttggctggtgtg

SEQ ID NO: 2467137 - DNA, 19 bp, Homo sapiens
acttggctggtgtggtaca

SEQ ID NO: 2467138 - DNA, 13 bp, Homo sapiens
acttgggaatata

SEQ ID NO: 2467139 - DNA, 20 bp, Homo sapiens
acttgggagacctgtaatca

SEQ ID NO: 2467140 - DNA, 14 bp, Homo sapiens
acttggttttgcta

SEQ ID NO: 2467141 - DNA, 16 bp, Homo sapiens
acttgtaaatataaag

SEQ ID NO: 2467142 - DNA, 13 bp, Homo sapiens
acttgtaattatg

SEQ ID NO: 2467143 - DNA, 19 bp, Homo sapiens
acttgtacaattaattatc

SEQ ID NO: 2467144 - DNA, 23 bp, Homo sapiens
acttgtcattgttatataatcat

SEQ ID NO: 2467145 - DNA, 20 bp, Homo sapiens
acttgtgccctccctgtcct

SEQ ID NO: 2467146 - DNA, 23 bp, Homo sapiens
acttgtgtcccatgatccctgtg

SEQ ID NO: 2467147 - DNA, 22 bp, Homo sapiens
acttgtgtccctaatgtgttta

SEQ ID NO: 2467148 - DNA, 22 bp, Homo sapiens
acttgttggcgtaggctacaga

SEQ ID NO: 2467149 - DNA, 13 bp, Homo sapiens
actttacccattt

SEQ ID NO: 2467150 - DNA, 11 bp, Homo sapiens
actttcagctg

SEQ ID NO: 2467151 - DNA, 22 bp, Homo sapiens
actttcatattttaaacagagg

SEQ ID NO: 2467152 - DNA, 15 bp, Homo sapiens
actttcattccttca

SEQ ID NO: 2467153 - DNA, 21 bp, Homo sapiens
actttccattacaagtatttt

SEQ ID NO: 2467154 - DNA, 20 bp, Homo sapiens
actttccccaccagatgctg

SEQ ID NO: 2467155 - DNA, 13 bp, Homo sapiens
actttccctaccc

SEQ ID NO: 2467156 - DNA, 21 bp, Homo sapiens
actttccctaccctctagaga

SEQ ID NO: 2467157 - DNA, 15 bp, Homo sapiens
actttccctctggga

SEQ ID NO: 2467158 - DNA, 19 bp, Homo sapiens
actttcctcctgaggcttt

SEQ ID NO: 2467159 - DNA, 13 bp, Homo sapiens
actttctgcctgg

SEQ ID NO: 2467160 - DNA, 14 bp, Homo sapiens
actttctgcctgga

SEQ ID NO: 2467161 - DNA, 13 bp, Homo sapiens
actttctttctca

SEQ ID NO: 2467162 - DNA, 16 bp, Homo sapiens
actttctttctcacta

SEQ ID NO: 2467163 - DNA, 18 bp, Homo sapiens
actttctttttgtagctg

SEQ ID NO: 2467164 - DNA, 23 bp, Homo sapiens
actttctttttgtagctggggct

SEQ ID NO: 2467165 - DNA, 17 bp, Homo sapiens
actttcttttttgatat

SEQ ID NO: 2467166 - DNA, 20 bp, Homo sapiens
actttgaaaggagatgtctt

SEQ ID NO: 2467167 - DNA, 17 bp, Homo sapiens
actttgaagttagcttt

SEQ ID NO: 2467168 - DNA, 16 bp, Homo sapiens
actttgacaattactc

SEQ ID NO: 2467169 - DNA, 14 bp, Homo sapiens
actttgacagtgtt

SEQ ID NO: 2467170 - DNA, 17 bp, Homo sapiens
actttgcactgatatat

SEQ ID NO: 2467171 - DNA, 13 bp, Homo sapiens
agaggtgggccag

SEQ ID NO: 2467172 - DNA, 21 bp, Homo sapiens
agaggtgggccagtctgtgga

SEQ ID NO: 2467173 - DNA, 24 bp, Homo sapiens
agaggtgggccagtctgtggatca

SEQ ID NO: 2467174 - DNA, 22 bp, Homo sapiens
agaggtttgactagatgatgga

SEQ ID NO: 2467175 - DNA, 15 bp, Homo sapiens
agagtagaattgcat

SEQ ID NO: 2467176 - DNA, 13 bp, Homo sapiens
agagtctaaagat

SEQ ID NO: 2467177 - DNA, 19 bp, Homo sapiens
agagtctagattcaaaggt

SEQ ID NO: 2467178 - DNA, 23 bp, Homo sapiens
agagtctagattcaaaggttcta

SEQ ID NO: 2467179 - DNA, 13 bp, Homo sapiens
agagtctgaacag

SEQ ID NO: 2467180 - DNA, 15 bp, Homo sapiens
agagttcaagaaata

SEQ ID NO: 2467181 - DNA, 18 bp, Homo sapiens
agagttcaagaaataagt

SEQ ID NO: 2467182 - DNA, 18 bp, Homo sapiens
agagtttgatgaggccct

SEQ ID NO: 2467183 - DNA, 22 bp, Homo sapiens
agagtttgatgaggccctccac

SEQ ID NO: 2467184 - DNA, 12 bp, Homo sapiens
agagttttggga

SEQ ID NO: 2467185 - DNA, 13 bp, Homo sapiens
agataactaggaa

SEQ ID NO: 2467186 - DNA, 15 bp, Homo sapiens
agataactgaaaatt

SEQ ID NO: 2467187 - DNA, 18 bp, Homo sapiens
agataactgaaaattatt

SEQ ID NO: 2467188 - DNA, 22 bp, Homo sapiens
agataactgaaaattatttaaa

SEQ ID NO: 2467189 - DNA, 11 bp, Homo sapiens
agataactttt

SEQ ID NO: 2467190 - DNA, 14 bp, Homo sapiens
agataattcactgt

SEQ ID NO: 2467191 - DNA, 18 bp, Homo sapiens
agatacagaactctttca

SEQ ID NO: 2467192 - DNA, 23 bp, Homo sapiens
agataccagcgaggaggctccag

SEQ ID NO: 2467193 - DNA, 16 bp, Homo sapiens
agatacttaagtgctg

SEQ ID NO: 2467194 - DNA, 17 bp, Homo sapiens
agatagccctgtcctgg

SEQ ID NO: 2467195 - DNA, 17 bp, Homo sapiens
agatatattttctttct

SEQ ID NO: 2467196 - DNA, 22 bp, Homo sapiens
agatatcttggacaaatcacat

SEQ ID NO: 2467197 - DNA, 17 bp, Homo sapiens
agatattaatgcccaga

SEQ ID NO: 2467198 - DNA, 18 bp, Homo sapiens
agatattaatgcccagac

SEQ ID NO: 2467199 - DNA, 16 bp, Homo sapiens
agatattggacaaaga

SEQ ID NO: 2467200 - DNA, 15 bp, Homo sapiens
agatcagtgtaccat

SEQ ID NO: 2467201 - DNA, 13 bp, Homo sapiens
agatcataaggct

SEQ ID NO: 2467202 - DNA, 18 bp, Homo sapiens
agatccaaaagaagcccc

SEQ ID NO: 2467203 - DNA, 13 bp, Homo sapiens
agatccagcctgg

SEQ ID NO: 2467204 - DNA, 13 bp, Homo sapiens
agatccaggacta

SEQ ID NO: 2467205 - DNA, 17 bp, Homo sapiens
agatccaggagctccag

SEQ ID NO: 2467206 - DNA, 22 bp, Homo sapiens
agatccagggacagaggcccca

SEQ ID NO: 2467207 - DNA, 22 bp, Homo sapiens
agatcccaagtagaatctcagt

SEQ ID NO: 2467208 - DNA, 14 bp, Homo sapiens
agatcctaagggtc

SEQ ID NO: 2467209 - DNA, 13 bp, Homo sapiens
agatcctcctcat

SEQ ID NO: 2467210 - DNA, 12 bp, Homo sapiens
agatcctcctgc

SEQ ID NO: 2467211 - DNA, 17 bp, Homo sapiens
agatcctgcgggtgggg

SEQ ID NO: 2467212 - DNA, 18 bp, Homo sapiens
agatcctgcgggtggggc

SEQ ID NO: 2467213 - DNA, 13 bp, Homo sapiens
agatcggccacag

SEQ ID NO: 2467214 - DNA, 16 bp, Homo sapiens
agatcggccacagggc

SEQ ID NO: 2467215 - DNA, 11 bp, Homo sapiens
agatctaaata

SEQ ID NO: 2467216 - DNA, 13 bp, Homo sapiens
agatctggaacct

SEQ ID NO: 2467217 - DNA, 15 bp, Homo sapiens
agatctggaacctca

SEQ ID NO: 2467218 - DNA, 20 bp, Homo sapiens
agatctggaacctcagcctg

SEQ ID NO: 2467219 - DNA, 19 bp, Homo sapiens
agatctgtcctcagccttg

SEQ ID NO: 2467220 - DNA, 21 bp, Homo sapiens
agatctgttttgaaggcaaaa

SEQ ID NO: 2467221 - DNA, 14 bp, Homo sapiens
agatcttagattct

SEQ ID NO: 2467222 - DNA, 15 bp, Homo sapiens
agatgaaagagcagt

SEQ ID NO: 2467223 - DNA, 17 bp, Homo sapiens
agatgaatgtcctgaaa

SEQ ID NO: 2467224 - DNA, 20 bp, Homo sapiens
agatgaccactttttagaaa

SEQ ID NO: 2467225 - DNA, 19 bp, Homo sapiens
agatgacctcgtactcagg

SEQ ID NO: 2467226 - DNA, 20 bp, Homo sapiens
agatgacctcgtactcagga

SEQ ID NO: 2467227 - DNA, 14 bp, Homo sapiens
agatgacttgaggc

SEQ ID NO: 2467228 - DNA, 19 bp, Homo sapiens
agatgatggatgccaatat

SEQ ID NO: 2467229 - DNA, 21 bp, Homo sapiens
agatgattaaataagattcta

SEQ ID NO: 2467230 - DNA, 20 bp, Homo sapiens
agatgcaccaccaagccaag

SEQ ID NO: 2467231 - DNA, 16 bp, Homo sapiens
agatgcagggcagtca

SEQ ID NO: 2467232 - DNA, 23 bp, Homo sapiens
agatgcatttgggtccaggagga

SEQ ID NO: 2467233 - DNA, 13 bp, Homo sapiens
agatgcctccttc

SEQ ID NO: 2467234 - DNA, 15 bp, Homo sapiens
agatgctccaagatt

SEQ ID NO: 2467235 - DNA, 18 bp, Homo sapiens
agatgctccaagattcta

SEQ ID NO: 2467236 - DNA, 19 bp, Homo sapiens
agatgctccaagattctag

SEQ ID NO: 2467237 - DNA, 22 bp, Homo sapiens
agatgctccaagattctagatg

SEQ ID NO: 2467238 - DNA, 20 bp, Homo sapiens
agatgctggcccagggccca

SEQ ID NO: 2467239 - DNA, 21 bp, Homo sapiens
agatgctggcccagggcccag

SEQ ID NO: 2467240 - DNA, 22 bp, Homo sapiens
agatgctggcccagggcccaga

SEQ ID NO: 2467241 - DNA, 17 bp, Homo sapiens
agatgctggcttgggca

SEQ ID NO: 2467242 - DNA, 18 bp, Homo sapiens
agatggaaaattcatttt

SEQ ID NO: 2467243 - DNA, 13 bp, Homo sapiens
agatggagtttct

SEQ ID NO: 2467244 - DNA, 14 bp, Homo sapiens
agatggagtttcta

SEQ ID NO: 2467245 - DNA, 17 bp, Homo sapiens
agatggagtttctaagg

SEQ ID NO: 2467246 - DNA, 20 bp, Homo sapiens
agatggcatcaaaaaagata

SEQ ID NO: 2467247 - DNA, 20 bp, Homo sapiens
agatggccagccccttagac

SEQ ID NO: 2467248 - DNA, 14 bp, Homo sapiens
agatggctcccagg

SEQ ID NO: 2467249 - DNA, 16 bp, Homo sapiens
agatgggcatcttttg

SEQ ID NO: 2467250 - DNA, 20 bp, Homo sapiens
agatgggcatcttttgtatt

SEQ ID NO: 2467251 - DNA, 22 bp, Homo sapiens
agatgggcatcttttgtattaa

SEQ ID NO: 2467252 - DNA, 17 bp, Homo sapiens
agatgggcttcccaagg

SEQ ID NO: 2467253 - DNA, 21 bp, Homo sapiens
agatgggggaaagcaaagcac

SEQ ID NO: 2467254 - DNA, 24 bp, Homo sapiens
agatgggggaaagcaaagcacaga

SEQ ID NO: 2467255 - DNA, 14 bp, Homo sapiens
agatgtaattttgt

SEQ ID NO: 2467256 - DNA, 17 bp, Homo sapiens
agatgtaattttgtgta

SEQ ID NO: 2467257 - DNA, 19 bp, Homo sapiens
agatgtaattttgtgtaag

SEQ ID NO: 2467258 - DNA, 13 bp, Homo sapiens
agatgtaggaggg

SEQ ID NO: 2467259 - DNA, 13 bp, Homo sapiens
agatgtcttggaa

SEQ ID NO: 2467260 - DNA, 16 bp, Homo sapiens
agatgtgatattctaa

SEQ ID NO: 2467261 - DNA, 15 bp, Homo sapiens
agatgtgtgttgata

SEQ ID NO: 2467262 - DNA, 17 bp, Homo sapiens
agatgtgtgttgatact

SEQ ID NO: 2467263 - DNA, 20 bp, Homo sapiens
agatgtgtgttgatactgtt

SEQ ID NO: 2467264 - DNA, 23 bp, Homo sapiens
agatgtgtgttgatactgttgca

SEQ ID NO: 2467265 - DNA, 20 bp, Homo sapiens
agatgttctaagtctttcca

SEQ ID NO: 2467266 - DNA, 22 bp, Homo sapiens
agatgtttattcttctagagtt

SEQ ID NO: 2467267 - DNA, 15 bp, Homo sapiens
agatgtttatttcag

SEQ ID NO: 2467268 - DNA, 17 bp, Homo sapiens
agatgtttgatagattt

SEQ ID NO: 2467269 - DNA, 21 bp, Homo sapiens
agattagagcctgtaaacttt

SEQ ID NO: 2467270 - DNA, 16 bp, Homo sapiens
agattatagattctaa

SEQ ID NO: 2467271 - DNA, 19 bp, Homo sapiens
agattatagattctaaaga

SEQ ID NO: 2467272 - DNA, 20 bp, Homo sapiens
agattatagattctaaagat

SEQ ID NO: 2467273 - DNA, 16 bp, Homo sapiens
agattatcgttttctt

SEQ ID NO: 2467274 - DNA, 19 bp, Homo sapiens
agattatcgttttcttaaa

SEQ ID NO: 2467275 - DNA, 23 bp, Homo sapiens
agcgcctccatccaaggccaggt

SEQ ID NO: 2467276 - DNA, 18 bp, Homo sapiens
agcgctatctccctgcct

SEQ ID NO: 2467277 - DNA, 17 bp, Homo sapiens
agcggaacaaggagtca

SEQ ID NO: 2467278 - DNA, 22 bp, Homo sapiens
agcggaacaaggagtcagacat

SEQ ID NO: 2467279 - DNA, 11 bp, Homo sapiens
agcggccggcc

SEQ ID NO: 2467280 - DNA, 18 bp, Homo sapiens
agcggccggccagcccct

SEQ ID NO: 2467281 - DNA, 12 bp, Homo sapiens
agcgggggaggg

SEQ ID NO: 2467282 - DNA, 19 bp, Homo sapiens
agcgtcctcctctgtgacc

SEQ ID NO: 2467283 - DNA, 15 bp, Homo sapiens
agcgtcggtctgtgc

SEQ ID NO: 2467284 - DNA, 16 bp, Homo sapiens
agcgtcggtctgtgcc

SEQ ID NO: 2467285 - DNA, 16 bp, Homo sapiens
agcgtgagctgagcag

SEQ ID NO: 2467286 - DNA, 12 bp, Homo sapiens
agcgtgagctta

SEQ ID NO: 2467287 - DNA, 13 bp, Homo sapiens
agctaacagggaa

SEQ ID NO: 2467288 - DNA, 13 bp, Homo sapiens
agctaagaacctg

SEQ ID NO: 2467289 - DNA, 16 bp, Homo sapiens
agctaagaacctggaa

SEQ ID NO: 2467290 - DNA, 10 bp, Homo sapiens
agctaaggct

SEQ ID NO: 2467291 - DNA, 15 bp, Homo sapiens
agctaaggctctatg

SEQ ID NO: 2467292 - DNA, 18 bp, Homo sapiens
agctaaggctctatgagt

SEQ ID NO: 2467293 - DNA, 19 bp, Homo sapiens
agctaataaaaagcttttg

SEQ ID NO: 2467294 - DNA, 13 bp, Homo sapiens
agctaatttgcat

SEQ ID NO: 2467295 - DNA, 18 bp, Homo sapiens
agctacagagaaaccagc

SEQ ID NO: 2467296 - DNA, 21 bp, Homo sapiens
agctacagagaaaccagcttc

SEQ ID NO: 2467297 - DNA, 23 bp, Homo sapiens
agctacagagaaaccagcttcct

SEQ ID NO: 2467298 - DNA, 18 bp, Homo sapiens
agctacctgtgtggacag

SEQ ID NO: 2467299 - DNA, 19 bp, Homo sapiens
agctacctgtgtggacagg

SEQ ID NO: 2467300 - DNA, 20 bp, Homo sapiens
agctacctgtgtggacagga

SEQ ID NO: 2467301 - DNA, 22 bp, Homo sapiens
agctacctgtgtggacaggact

SEQ ID NO: 2467302 - DNA, 14 bp, Homo sapiens
agctactaaaatca

SEQ ID NO: 2467303 - DNA, 15 bp, Homo sapiens
agctactgtgtgtgt

SEQ ID NO: 2467304 - DNA, 17 bp, Homo sapiens
agctagaaccctctgtt

SEQ ID NO: 2467305 - DNA, 14 bp, Homo sapiens
agctagaattgagt

SEQ ID NO: 2467306 - DNA, 18 bp, Homo sapiens
agctaggagcaaagcctg

SEQ ID NO: 2467307 - DNA, 18 bp, Homo sapiens
agctagtgacccacatgc

SEQ ID NO: 2467308 - DNA, 20 bp, Homo sapiens
agctagtgacccacatgcca

SEQ ID NO: 2467309 - DNA, 18 bp, Homo sapiens
agctatccggacagagca

SEQ ID NO: 2467310 - DNA, 15 bp, Homo sapiens
agctatttaaagcat

SEQ ID NO: 2467311 - DNA, 13 bp, Homo sapiens
agctattttccag

SEQ ID NO: 2467312 - DNA, 15 bp, Homo sapiens
agctatttttctaac

SEQ ID NO: 2467313 - DNA, 17 bp, Homo sapiens
agctatttttctaacta

SEQ ID NO: 2467314 - DNA, 12 bp, Homo sapiens
agctcaatgagc

SEQ ID NO: 2467315 - DNA, 14 bp, Homo sapiens
agctcaatgagcat

SEQ ID NO: 2467316 - DNA, 15 bp, Homo sapiens
agctcaatgagcatg

SEQ ID NO: 2467317 - DNA, 14 bp, Homo sapiens
agctcaatggactg

SEQ ID NO: 2467318 - DNA, 15 bp, Homo sapiens
agctcacaaggcagc

SEQ ID NO: 2467319 - DNA, 16 bp, Homo sapiens
agctcacaaggcagca

SEQ ID NO: 2467320 - DNA, 18 bp, Homo sapiens
agctcacaaggcagcaag

SEQ ID NO: 2467321 - DNA, 18 bp, Homo sapiens
agctcagaaaatatccct

SEQ ID NO: 2467322 - DNA, 21 bp, Homo sapiens
agctcagaaaatatccctcct

SEQ ID NO: 2467323 - DNA, 19 bp, Homo sapiens
agctcagaggcgcactgtg

SEQ ID NO: 2467324 - DNA, 13 bp, Homo sapiens
agctcagcactgc

SEQ ID NO: 2467325 - DNA, 21 bp, Homo sapiens
agctcagcactgcctgctccc

SEQ ID NO: 2467326 - DNA, 23 bp, Homo sapiens
agctcagcactgcctgctcccat

SEQ ID NO: 2467327 - DNA, 19 bp, Homo sapiens
agctcagctgcattccgca

SEQ ID NO: 2467328 - DNA, 13 bp, Homo sapiens
agctcaggacaga

SEQ ID NO: 2467329 - DNA, 18 bp, Homo sapiens
agctcaggatgagggaaa

SEQ ID NO: 2467330 - DNA, 16 bp, Homo sapiens
agctccaacctgcaaa

SEQ ID NO: 2467331 - DNA, 18 bp, Homo sapiens
agctccaacctgcaaaga

SEQ ID NO: 2467332 - DNA, 22 bp, Homo sapiens
agctccaacctgcaaagatctg

SEQ ID NO: 2467333 - DNA, 17 bp, Homo sapiens
agctccaccctggccga

SEQ ID NO: 2467334 - DNA, 11 bp, Homo sapiens
agctccactct

SEQ ID NO: 2467335 - DNA, 12 bp, Homo sapiens
agctccactctg

SEQ ID NO: 2467336 - DNA, 13 bp, Homo sapiens
agctccagcctga

SEQ ID NO: 2467337 - DNA, 14 bp, Homo sapiens
agctccagtgtcct

SEQ ID NO: 2467338 - DNA, 16 bp, Homo sapiens
agctcccacaagcctg

SEQ ID NO: 2467339 - DNA, 19 bp, Homo sapiens
agctcccacctccccttgg

SEQ ID NO: 2467340 - DNA, 21 bp, Homo sapiens
agctcccacctccccttgggc

SEQ ID NO: 2467341 - DNA, 19 bp, Homo sapiens
agctcccccagcaaagccc

SEQ ID NO: 2467342 - DNA, 17 bp, Homo sapiens
agctcctcccctggagg

SEQ ID NO: 2467343 - DNA, 13 bp, Homo sapiens
agctcctccctct

SEQ ID NO: 2467344 - DNA, 15 bp, Homo sapiens
agctcctccctctca

SEQ ID NO: 2467345 - DNA, 21 bp, Homo sapiens
agctcctctccccagcccaga

SEQ ID NO: 2467346 - DNA, 22 bp, Homo sapiens
agctcctctccccagcccagag

SEQ ID NO: 2467347 - DNA, 12 bp, Homo sapiens
agctcctctgtc

SEQ ID NO: 2467348 - DNA, 24 bp, Homo sapiens
agctcctctgtctcgagcgccctg

SEQ ID NO: 2467349 - DNA, 18 bp, Homo sapiens
agctcctcttccatgctg

SEQ ID NO: 2467350 - DNA, 10 bp, Homo sapiens
agctcctgac

SEQ ID NO: 2467351 - DNA, 14 bp, Homo sapiens
agctcctgaccagt

SEQ ID NO: 2467352 - DNA, 12 bp, Homo sapiens
agctcctgtggc

SEQ ID NO: 2467353 - DNA, 22 bp, Homo sapiens
agctcctgtggccccaccctgg

SEQ ID NO: 2467354 - DNA, 16 bp, Homo sapiens
agctctgagaggccct

SEQ ID NO: 2467355 - DNA, 19 bp, Homo sapiens
agctctgagaggccctgga

SEQ ID NO: 2467356 - DNA, 20 bp, Homo sapiens
agctctgagaggccctggat

SEQ ID NO: 2467357 - DNA, 12 bp, Homo sapiens
agctctgagctg

SEQ ID NO: 2467358 - DNA, 14 bp, Homo sapiens
agctctgagctgtc

SEQ ID NO: 2467359 - DNA, 15 bp, Homo sapiens
agctctgagctgtca

SEQ ID NO: 2467360 - DNA, 21 bp, Homo sapiens
agctctggacagccccaccct

SEQ ID NO: 2467361 - DNA, 16 bp, Homo sapiens
agctctggaggggagg

SEQ ID NO: 2467362 - DNA, 20 bp, Homo sapiens
agctctggaggggaggggga

SEQ ID NO: 2467363 - DNA, 21 bp, Homo sapiens
agctctgttcttcctcagcca

SEQ ID NO: 2467364 - DNA, 23 bp, Homo sapiens
agctctgttcttcctcagccagc

SEQ ID NO: 2467365 - DNA, 22 bp, Homo sapiens
agctcttccttactcccaggca

SEQ ID NO: 2467366 - DNA, 18 bp, Homo sapiens
agctcttgttgagccgtg

SEQ ID NO: 2467367 - DNA, 14 bp, Homo sapiens
agctctttgtcagg

SEQ ID NO: 2467368 - DNA, 16 bp, Homo sapiens
agctctttgtcaggga

SEQ ID NO: 2467369 - DNA, 17 bp, Homo sapiens
agctctttgtcagggag

SEQ ID NO: 2467370 - DNA, 17 bp, Homo sapiens
agctgaatgtttttcta

SEQ ID NO: 2467371 - DNA, 20 bp, Homo sapiens
agctgaatgtttttctaaag

SEQ ID NO: 2467372 - DNA, 19 bp, Homo sapiens
agctgaccagccgtgagca

SEQ ID NO: 2467373 - DNA, 14 bp, Homo sapiens
agctgacttggctg

SEQ ID NO: 2467374 - DNA, 18 bp, Homo sapiens
agctgacttggctggtgt

SEQ ID NO: 2467375 - DNA, 22 bp, Homo sapiens
agctgacttggctggtgtggta

SEQ ID NO: 2467376 - DNA, 16 bp, Homo sapiens
agctgagcaaatcacc

SEQ ID NO: 2467377 - DNA, 15 bp, Homo sapiens
agctgagcaggccac

SEQ ID NO: 2467378 - DNA, 15 bp, Homo sapiens
agctgagcagggccg

SEQ ID NO: 2467379 - DNA, 17 bp, Homo sapiens
agctgagctcacaaggc

SEQ ID NO: 2467380 - DNA, 17 bp, Homo sapiens
aggcaaaattgcaaatc

SEQ ID NO: 2467381 - DNA, 15 bp, Homo sapiens
aggcaaatttgcatt

SEQ ID NO: 2467382 - DNA, 22 bp, Homo sapiens
aggcaaggctgtggaccatgga

SEQ ID NO: 2467383 - DNA, 15 bp, Homo sapiens
aggcacacagctact

SEQ ID NO: 2467384 - DNA, 13 bp, Homo sapiens
aggcaccaggaag

SEQ ID NO: 2467385 - DNA, 14 bp, Homo sapiens
aggcaccaggaagc

SEQ ID NO: 2467386 - DNA, 16 bp, Homo sapiens
aggcaccaggaagccg

SEQ ID NO: 2467387 - DNA, 14 bp, Homo sapiens
aggcacccatctgt

SEQ ID NO: 2467388 - DNA, 23 bp, Homo sapiens
aggcacctacactcacctgcact

SEQ ID NO: 2467389 - DNA, 15 bp, Homo sapiens
aggcactctagattc

SEQ ID NO: 2467390 - DNA, 17 bp, Homo sapiens
aggcactgaagtgctta

SEQ ID NO: 2467391 - DNA, 15 bp, Homo sapiens
aggcactgccctggt

SEQ ID NO: 2467392 - DNA, 21 bp, Homo sapiens
aggcactgccctggtggccct

SEQ ID NO: 2467393 - DNA, 22 bp, Homo sapiens
aggcactgccctggtggccctc

SEQ ID NO: 2467394 - DNA, 17 bp, Homo sapiens
aggcactgtagttctaa

SEQ ID NO: 2467395 - DNA, 21 bp, Homo sapiens
aggcactgtagttctaagact

SEQ ID NO: 2467396 - DNA, 19 bp, Homo sapiens
aggcacttgagggggaagg

SEQ ID NO: 2467397 - DNA, 17 bp, Homo sapiens
aggcagaggcccaggct

SEQ ID NO: 2467398 - DNA, 19 bp, Homo sapiens
aggcagaggcccaggctgc

SEQ ID NO: 2467399 - DNA, 21 bp, Homo sapiens
aggcagaggcccaggctgccg

SEQ ID NO: 2467400 - DNA, 14 bp, Homo sapiens
aggcagaggcctgg

SEQ ID NO: 2467401 - DNA, 17 bp, Homo sapiens
aggcagaggcctgggct

SEQ ID NO: 2467402 - DNA, 18 bp, Homo sapiens
aggcagaggcctgggctg

SEQ ID NO: 2467403 - DNA, 15 bp, Homo sapiens
aggcagatccaggac

SEQ ID NO: 2467404 - DNA, 17 bp, Homo sapiens
aggcagatccaggacta

SEQ ID NO: 2467405 - DNA, 16 bp, Homo sapiens
aggcagcaaggcccga

SEQ ID NO: 2467406 - DNA, 20 bp, Homo sapiens
aggcagcagtgtgaggccag

SEQ ID NO: 2467407 - DNA, 20 bp, Homo sapiens
aggcagccagcatctgggcc

SEQ ID NO: 2467408 - DNA, 13 bp, Homo sapiens
aggcagccagcca

SEQ ID NO: 2467409 - DNA, 17 bp, Homo sapiens
aggcagccagtgccctg

SEQ ID NO: 2467410 - DNA, 12 bp, Homo sapiens
aggcagcccagg

SEQ ID NO: 2467411 - DNA, 21 bp, Homo sapiens
aggcagcccaggaagtctcat

SEQ ID NO: 2467412 - DNA, 21 bp, Homo sapiens
aggcagcctctggggggtggc

SEQ ID NO: 2467413 - DNA, 22 bp, Homo sapiens
aggcagcctctggggggtggcc

SEQ ID NO: 2467414 - DNA, 16 bp, Homo sapiens
aggcaggattgaaaat

SEQ ID NO: 2467415 - DNA, 14 bp, Homo sapiens
aggcaggcagggct

SEQ ID NO: 2467416 - DNA, 16 bp, Homo sapiens
aggcaggcagggctct

SEQ ID NO: 2467417 - DNA, 18 bp, Homo sapiens
aggcaggcagggctctcc

SEQ ID NO: 2467418 - DNA, 20 bp, Homo sapiens
aggcaggcagggctctcctg

SEQ ID NO: 2467419 - DNA, 21 bp, Homo sapiens
aggcagggaacatggggagga

SEQ ID NO: 2467420 - DNA, 14 bp, Homo sapiens
aggcagggctctcc

SEQ ID NO: 2467421 - DNA, 18 bp, Homo sapiens
aggcagggctctcctggc

SEQ ID NO: 2467422 - DNA, 15 bp, Homo sapiens
aggcaggggcttcct

SEQ ID NO: 2467423 - DNA, 23 bp, Homo sapiens
aggcagggggaaggtggggtcct

SEQ ID NO: 2467424 - DNA, 18 bp, Homo sapiens
aggcagttaccattaaac

SEQ ID NO: 2467425 - DNA, 24 bp, Homo sapiens
aggcagttaccattaaaccatctc

SEQ ID NO: 2467426 - DNA, 16 bp, Homo sapiens
aggcattctggacctc

SEQ ID NO: 2467427 - DNA, 12 bp, Homo sapiens
aggcatttccta

SEQ ID NO: 2467428 - DNA, 13 bp, Homo sapiens
aggcatttcctgg

SEQ ID NO: 2467429 - DNA, 18 bp, Homo sapiens
aggcatttgcagggtcct

SEQ ID NO: 2467430 - DNA, 21 bp, Homo sapiens
aggccaaaggggacctggaag

SEQ ID NO: 2467431 - DNA, 14 bp, Homo sapiens
aggccacctcccca

SEQ ID NO: 2467432 - DNA, 21 bp, Homo sapiens
aggccacctggctctcacctc

SEQ ID NO: 2467433 - DNA, 20 bp, Homo sapiens
aggccactggagacgcatat

SEQ ID NO: 2467434 - DNA, 20 bp, Homo sapiens
aggccactgtgttccttccg

SEQ ID NO: 2467435 - DNA, 19 bp, Homo sapiens
aggccactgtttggaaata

SEQ ID NO: 2467436 - DNA, 14 bp, Homo sapiens
aggccagagccaag

SEQ ID NO: 2467437 - DNA, 14 bp, Homo sapiens
aggccagagcccac

SEQ ID NO: 2467438 - DNA, 17 bp, Homo sapiens
aggccagagcccactcc

SEQ ID NO: 2467439 - DNA, 22 bp, Homo sapiens
aggccagcactcgctagcagtg

SEQ ID NO: 2467440 - DNA, 22 bp, Homo sapiens
aggccagccgcgcatcagactg

SEQ ID NO: 2467441 - DNA, 13 bp, Homo sapiens
aggccagcctggc

SEQ ID NO: 2467442 - DNA, 15 bp, Homo sapiens
aggccagcctggcct

SEQ ID NO: 2467443 - DNA, 16 bp, Homo sapiens
aggccagcctggcctc

SEQ ID NO: 2467444 - DNA, 18 bp, Homo sapiens
aggccagcctggcctcct

SEQ ID NO: 2467445 - DNA, 16 bp, Homo sapiens
aggccagctgtggttt

SEQ ID NO: 2467446 - DNA, 15 bp, Homo sapiens
aggccaggactctgc

SEQ ID NO: 2467447 - DNA, 17 bp, Homo sapiens
aggccaggactctgcag

SEQ ID NO: 2467448 - DNA, 20 bp, Homo sapiens
aggccaggactctgcagcct

SEQ ID NO: 2467449 - DNA, 23 bp, Homo sapiens
aggccaggactctgcagcctcag

SEQ ID NO: 2467450 - DNA, 11 bp, Homo sapiens
aggccaggcat

SEQ ID NO: 2467451 - DNA, 13 bp, Homo sapiens
aggccagggcaga

SEQ ID NO: 2467452 - DNA, 16 bp, Homo sapiens
aggccataaaacaggt

SEQ ID NO: 2467453 - DNA, 17 bp, Homo sapiens
aggccatggactctgtc

SEQ ID NO: 2467454 - DNA, 17 bp, Homo sapiens
aggcccaaggctcccgg

SEQ ID NO: 2467455 - DNA, 16 bp, Homo sapiens
aggcccactgtgcctc

SEQ ID NO: 2467456 - DNA, 13 bp, Homo sapiens
aggcccaggctgc

SEQ ID NO: 2467457 - DNA, 15 bp, Homo sapiens
aggcccaggctgccg

SEQ ID NO: 2467458 - DNA, 15 bp, Homo sapiens
aggcccaggctggga

SEQ ID NO: 2467459 - DNA, 14 bp, Homo sapiens
aggccccagcctcc

SEQ ID NO: 2467460 - DNA, 13 bp, Homo sapiens
aggcccccacttg

SEQ ID NO: 2467461 - DNA, 17 bp, Homo sapiens
aggcccccagcccaggg

SEQ ID NO: 2467462 - DNA, 15 bp, Homo sapiens
aggcccgagcagctg

SEQ ID NO: 2467463 - DNA, 20 bp, Homo sapiens
aggcccgctctacatcttct

SEQ ID NO: 2467464 - DNA, 23 bp, Homo sapiens
aggcccggatgcagaggcctgca

SEQ ID NO: 2467465 - DNA, 16 bp, Homo sapiens
aggccctccacacctg

SEQ ID NO: 2467466 - DNA, 20 bp, Homo sapiens
aggccctccctgttccccag

SEQ ID NO: 2467467 - DNA, 17 bp, Homo sapiens
aggccctcgctgccagc

SEQ ID NO: 2467468 - DNA, 18 bp, Homo sapiens
aggccctggatcagcgtg

SEQ ID NO: 2467469 - DNA, 14 bp, Homo sapiens
aggccctggcctcc

SEQ ID NO: 2467470 - DNA, 13 bp, Homo sapiens
aggccctgtgccc

SEQ ID NO: 2467471 - DNA, 16 bp, Homo sapiens
aggcccttggcgggca

SEQ ID NO: 2467472 - DNA, 23 bp, Homo sapiens
aggccgaagctaacagggaaggc

SEQ ID NO: 2467473 - DNA, 14 bp, Homo sapiens
aggccgggaaaaag

SEQ ID NO: 2467474 - DNA, 18 bp, Homo sapiens
aggccgggcggtcacagc

SEQ ID NO: 2467475 - DNA, 20 bp, Homo sapiens
aggccgtgacgtctgggtgg

SEQ ID NO: 2467476 - DNA, 16 bp, Homo sapiens
aggcctaccccgcaga

SEQ ID NO: 2467477 - DNA, 16 bp, Homo sapiens
aggcctaggattctaa

SEQ ID NO: 2467478 - DNA, 13 bp, Homo sapiens
aggcctcagggct

SEQ ID NO: 2467479 - DNA, 14 bp, Homo sapiens
aggcctgcagggcc

SEQ ID NO: 2467480 - DNA, 17 bp, Homo sapiens
aggcctggactttcctg

SEQ ID NO: 2467481 - DNA, 16 bp, Homo sapiens
aggcctgggctgggaa

SEQ ID NO: 2467482 - DNA, 21 bp, Homo sapiens
aggcctggggtgacccggcac

SEQ ID NO: 2467483 - DNA, 21 bp, Homo sapiens
aggcctgtgtagctgtgacct

SEQ ID NO: 2467484 - DNA, 21 bp, Homo sapiens
agggcagttcgcagccaccct

SEQ ID NO: 2467485 - DNA, 22 bp, Homo sapiens
agggcagttcgcagccaccctg

SEQ ID NO: 2467486 - DNA, 23 bp, Homo sapiens
agggcagttcgcagccaccctga

SEQ ID NO: 2467487 - DNA, 16 bp, Homo sapiens
agggcatctctgggct

SEQ ID NO: 2467488 - DNA, 17 bp, Homo sapiens
agggcatctctgggctg

SEQ ID NO: 2467489 - DNA, 21 bp, Homo sapiens
agggccacatgggaggctcac

SEQ ID NO: 2467490 - DNA, 15 bp, Homo sapiens
agggccacgctccag

SEQ ID NO: 2467491 - DNA, 17 bp, Homo sapiens
agggccacgctccagct

SEQ ID NO: 2467492 - DNA, 20 bp, Homo sapiens
agggccacgctccagctgcc

SEQ ID NO: 2467493 - DNA, 11 bp, Homo sapiens
agggccagagc

SEQ ID NO: 2467494 - DNA, 12 bp, Homo sapiens
agggccagagcc

SEQ ID NO: 2467495 - DNA, 15 bp, Homo sapiens
agggccagagccagg

SEQ ID NO: 2467496 - DNA, 22 bp, Homo sapiens
agggccatgctgaggcctgggc

SEQ ID NO: 2467497 - DNA, 23 bp, Homo sapiens
agggccatgctgaggcctgggcc

SEQ ID NO: 2467498 - DNA, 15 bp, Homo sapiens
agggcccagagccca

SEQ ID NO: 2467499 - DNA, 19 bp, Homo sapiens
agggcccagagcccagctc

SEQ ID NO: 2467500 - DNA, 12 bp, Homo sapiens
agggcccctctc

SEQ ID NO: 2467501 - DNA, 13 bp, Homo sapiens
agggcccctctcc

SEQ ID NO: 2467502 - DNA, 16 bp, Homo sapiens
agggccctgggcctgc

SEQ ID NO: 2467503 - DNA, 19 bp, Homo sapiens
agggccgactaagagaagt

SEQ ID NO: 2467504 - DNA, 20 bp, Homo sapiens
agggccggggaactggccaa

SEQ ID NO: 2467505 - DNA, 13 bp, Homo sapiens
agggcctgctgga

SEQ ID NO: 2467506 - DNA, 14 bp, Homo sapiens
agggcgcaggccgt

SEQ ID NO: 2467507 - DNA, 17 bp, Homo sapiens
agggcggcctccttctg

SEQ ID NO: 2467508 - DNA, 20 bp, Homo sapiens
agggcgggcagagggctgga

SEQ ID NO: 2467509 - DNA, 17 bp, Homo sapiens
agggcgggggtggcggc

SEQ ID NO: 2467510 - DNA, 20 bp, Homo sapiens
agggctaccctgagctgagg

SEQ ID NO: 2467511 - DNA, 23 bp, Homo sapiens
agggctaccctgagctgaggcag

SEQ ID NO: 2467512 - DNA, 15 bp, Homo sapiens
agggctccagcccct

SEQ ID NO: 2467513 - DNA, 20 bp, Homo sapiens
agggctccttgtgggcctgg

SEQ ID NO: 2467514 - DNA, 21 bp, Homo sapiens
agggctccttgtgggcctggg

SEQ ID NO: 2467515 - DNA, 13 bp, Homo sapiens
agggctctgaggc

SEQ ID NO: 2467516 - DNA, 14 bp, Homo sapiens
agggctctgaggcg

SEQ ID NO: 2467517 - DNA, 17 bp, Homo sapiens
agggctggctcaattga

SEQ ID NO: 2467518 - DNA, 17 bp, Homo sapiens
agggctggctggcctca

SEQ ID NO: 2467519 - DNA, 14 bp, Homo sapiens
agggctgggaggaa

SEQ ID NO: 2467520 - DNA, 16 bp, Homo sapiens
agggctgggaggaagg

SEQ ID NO: 2467521 - DNA, 18 bp, Homo sapiens
agggctgggaggaaggac

SEQ ID NO: 2467522 - DNA, 20 bp, Homo sapiens
agggctgtaactgccaggct

SEQ ID NO: 2467523 - DNA, 14 bp, Homo sapiens
aggggaagaggcct

SEQ ID NO: 2467524 - DNA, 21 bp, Homo sapiens
aggggaagcagaaatccaagc

SEQ ID NO: 2467525 - DNA, 20 bp, Homo sapiens
aggggaccaggagtgggtgg

SEQ ID NO: 2467526 - DNA, 19 bp, Homo sapiens
aggggagacctcagaagta

SEQ ID NO: 2467527 - DNA, 17 bp, Homo sapiens
aggggagcacggagccg

SEQ ID NO: 2467528 - DNA, 19 bp, Homo sapiens
aggggagcacggagccgcg

SEQ ID NO: 2467529 - DNA, 16 bp, Homo sapiens
aggggagcagaggggc

SEQ ID NO: 2467530 - DNA, 22 bp, Homo sapiens
aggggagcagaggggcagaggc

SEQ ID NO: 2467531 - DNA, 17 bp, Homo sapiens
aggggaggggctccttt

SEQ ID NO: 2467532 - DNA, 12 bp, Homo sapiens
aggggccagagg

SEQ ID NO: 2467533 - DNA, 15 bp, Homo sapiens
aggggccagaggctc

SEQ ID NO: 2467534 - DNA, 13 bp, Homo sapiens
aggggcccctctc

SEQ ID NO: 2467535 - DNA, 17 bp, Homo sapiens
aggggccgatgcccaga

SEQ ID NO: 2467536 - DNA, 18 bp, Homo sapiens
aggggccgatgcccagag

SEQ ID NO: 2467537 - DNA, 22 bp, Homo sapiens
aggggcctccatgggccccagg

SEQ ID NO: 2467538 - DNA, 15 bp, Homo sapiens
aggggcctgccacct

SEQ ID NO: 2467539 - DNA, 17 bp, Homo sapiens
aggggcctgccacctgg

SEQ ID NO: 2467540 - DNA, 13 bp, Homo sapiens
aggggcctggaga

SEQ ID NO: 2467541 - DNA, 18 bp, Homo sapiens
aggggcctggagatcctc

SEQ ID NO: 2467542 - DNA, 21 bp, Homo sapiens
aggggcctggagatcctcctg

SEQ ID NO: 2467543 - DNA, 16 bp, Homo sapiens
aggggctcctttccat

SEQ ID NO: 2467544 - DNA, 16 bp, Homo sapiens
aggggctgcttcctcc

SEQ ID NO: 2467545 - DNA, 15 bp, Homo sapiens
aggggcttcaggtcc

SEQ ID NO: 2467546 - DNA, 19 bp, Homo sapiens
agggggaaaaagtgtcaac

SEQ ID NO: 2467547 - DNA, 16 bp, Homo sapiens
agggggaatggcagca

SEQ ID NO: 2467548 - DNA, 21 bp, Homo sapiens
agggggagccccttctgctca

SEQ ID NO: 2467549 - DNA, 22 bp, Homo sapiens
agggggagctgggcctggtctc

SEQ ID NO: 2467550 - DNA, 20 bp, Homo sapiens
agggggcgcctgtggttctg

SEQ ID NO: 2467551 - DNA, 19 bp, Homo sapiens
agggggctgctgctgggct

SEQ ID NO: 2467552 - DNA, 16 bp, Homo sapiens
agggggctggaggagc

SEQ ID NO: 2467553 - DNA, 19 bp, Homo sapiens
agggggctggaggagccca

SEQ ID NO: 2467554 - DNA, 17 bp, Homo sapiens
agggggtcgtggagagc

SEQ ID NO: 2467555 - DNA, 19 bp, Homo sapiens
agggggtcgtggagagcta

SEQ ID NO: 2467556 - DNA, 11 bp, Homo sapiens
agggggtctgg

SEQ ID NO: 2467557 - DNA, 14 bp, Homo sapiens
aggggtgggctggt

SEQ ID NO: 2467558 - DNA, 20 bp, Homo sapiens
caggtgctaatttgttttgg

SEQ ID NO: 2467559 - DNA, 22 bp, Homo sapiens
caggtggctctgaggtgcctgt

SEQ ID NO: 2467560 - DNA, 20 bp, Homo sapiens
caggtggggagactgggctg

SEQ ID NO: 2467561 - DNA, 20 bp, Homo sapiens
caggtgttaacattccaaga

SEQ ID NO: 2467562 - DNA, 22 bp, Homo sapiens
caggtgttactgtaattcctca

SEQ ID NO: 2467563 - DNA, 14 bp, Homo sapiens
caggtgttgccaaa

SEQ ID NO: 2467564 - DNA, 14 bp, Homo sapiens
caggttaagaaaat

SEQ ID NO: 2467565 - DNA, 17 bp, Homo sapiens
caggttataacagtgtt

SEQ ID NO: 2467566 - DNA, 15 bp, Homo sapiens
caggttccacagagg

SEQ ID NO: 2467567 - DNA, 19 bp, Homo sapiens
caggttccacagaggacac

SEQ ID NO: 2467568 - DNA, 18 bp, Homo sapiens
caggttccctcccagagg

SEQ ID NO: 2467569 - DNA, 23 bp, Homo sapiens
caggttccctcccagaggagcca

SEQ ID NO: 2467570 - DNA, 21 bp, Homo sapiens
caggttctccgttagctcctg

SEQ ID NO: 2467571 - DNA, 22 bp, Homo sapiens
caggttctccgttagctcctgt

SEQ ID NO: 2467572 - DNA, 21 bp, Homo sapiens
caggttcttgttggtgcacag

SEQ ID NO: 2467573 - DNA, 16 bp, Homo sapiens
caggttggctctgcca

SEQ ID NO: 2467574 - DNA, 17 bp, Homo sapiens
caggttggctctgccag

SEQ ID NO: 2467575 - DNA, 18 bp, Homo sapiens
caggttggctctgccagt

SEQ ID NO: 2467576 - DNA, 22 bp, Homo sapiens
caggtttctaagcataaaagat

SEQ ID NO: 2467577 - DNA, 17 bp, Homo sapiens
cagtaaataactggaaa

SEQ ID NO: 2467578 - DNA, 23 bp, Homo sapiens
cagtaaataactggaaaacagaa

SEQ ID NO: 2467579 - DNA, 12 bp, Homo sapiens
cagtaaatcttt

SEQ ID NO: 2467580 - DNA, 18 bp, Homo sapiens
cagtaactgttttttaag

SEQ ID NO: 2467581 - DNA, 21 bp, Homo sapiens
cagtaattggtccgatctttg

SEQ ID NO: 2467582 - DNA, 23 bp, Homo sapiens
cagtaccatttaatggggaggac

SEQ ID NO: 2467583 - DNA, 14 bp, Homo sapiens
cagtaccctctcag

SEQ ID NO: 2467584 - DNA, 15 bp, Homo sapiens
cagtaccctctcagc

SEQ ID NO: 2467585 - DNA, 16 bp, Homo sapiens
cagtaccctctcagct

SEQ ID NO: 2467586 - DNA, 19 bp, Homo sapiens
cagtaccctctcagctcca

SEQ ID NO: 2467587 - DNA, 21 bp, Homo sapiens
cagtacctgagggtctgtagg

SEQ ID NO: 2467588 - DNA, 23 bp, Homo sapiens
cagtaccttcaaactagggccaa

SEQ ID NO: 2467589 - DNA, 21 bp, Homo sapiens
cagtaggagcccagctctgaa

SEQ ID NO: 2467590 - DNA, 22 bp, Homo sapiens
cagtaggttatttagcttggga

SEQ ID NO: 2467591 - DNA, 23 bp, Homo sapiens
cagtagtcttgatgaccaaagtc

SEQ ID NO: 2467592 - DNA, 17 bp, Homo sapiens
cagtatcatgccctgtg

SEQ ID NO: 2467593 - DNA, 20 bp, Homo sapiens
cagtatcatgccctgtgcaa

SEQ ID NO: 2467594 - DNA, 19 bp, Homo sapiens
cagtatgaattattcaatt

SEQ ID NO: 2467595 - DNA, 13 bp, Homo sapiens
cagtattatatgt

SEQ ID NO: 2467596 - DNA, 14 bp, Homo sapiens
cagtattatatgta

SEQ ID NO: 2467597 - DNA, 15 bp, Homo sapiens
cagtattgctcaccc

SEQ ID NO: 2467598 - DNA, 21 bp, Homo sapiens
cagtattgctcacccagtgcc

SEQ ID NO: 2467599 - DNA, 14 bp, Homo sapiens
cagtatttaactaa

SEQ ID NO: 2467600 - DNA, 15 bp, Homo sapiens
cagtcaacctgggca

SEQ ID NO: 2467601 - DNA, 21 bp, Homo sapiens
cagtcaacctgggcaaagcct

SEQ ID NO: 2467602 - DNA, 12 bp, Homo sapiens
cagtcacagcca

SEQ ID NO: 2467603 - DNA, 13 bp, Homo sapiens
cagtcacagccac

SEQ ID NO: 2467604 - DNA, 20 bp, Homo sapiens
cagtcactctagtcaatgac

SEQ ID NO: 2467605 - DNA, 21 bp, Homo sapiens
cagtcactctagtcaatgaca

SEQ ID NO: 2467606 - DNA, 12 bp, Homo sapiens
cagtcactgctc

SEQ ID NO: 2467607 - DNA, 20 bp, Homo sapiens
cagtccacctgaggaactgt

SEQ ID NO: 2467608 - DNA, 23 bp, Homo sapiens
cagtccaggatgctaacatctaa

SEQ ID NO: 2467609 - DNA, 15 bp, Homo sapiens
cagtccaggctgccg

SEQ ID NO: 2467610 - DNA, 22 bp, Homo sapiens
cagtccagtcctatctgggctt

SEQ ID NO: 2467611 - DNA, 14 bp, Homo sapiens
cagtccccccaccc

SEQ ID NO: 2467612 - DNA, 14 bp, Homo sapiens
cagtccccttccct

SEQ ID NO: 2467613 - DNA, 17 bp, Homo sapiens
cagtcctatctgggctt

SEQ ID NO: 2467614 - DNA, 22 bp, Homo sapiens
cagtcctatctgggcttcctgg

SEQ ID NO: 2467615 - DNA, 22 bp, Homo sapiens
cagtcctgatcagagccgtggt

SEQ ID NO: 2467616 - DNA, 19 bp, Homo sapiens
cagtcctgcctcagcctcc

SEQ ID NO: 2467617 - DNA, 13 bp, Homo sapiens
cagtccttggcct

SEQ ID NO: 2467618 - DNA, 16 bp, Homo sapiens
cagtcgatagagctgt

SEQ ID NO: 2467619 - DNA, 13 bp, Homo sapiens
cagtcgtgcctgt

SEQ ID NO: 2467620 - DNA, 17 bp, Homo sapiens
cagtcgtgcctgtgtcc

SEQ ID NO: 2467621 - DNA, 16 bp, Homo sapiens
cagtcgttcccagtgt

SEQ ID NO: 2467622 - DNA, 19 bp, Homo sapiens
cagtctcagaatgtcattt

SEQ ID NO: 2467623 - DNA, 12 bp, Homo sapiens
cagtctctgagc

SEQ ID NO: 2467624 - DNA, 21 bp, Homo sapiens
cagtcttccatttgcaaggga

SEQ ID NO: 2467625 - DNA, 15 bp, Homo sapiens
cagtgaagactatga

SEQ ID NO: 2467626 - DNA, 16 bp, Homo sapiens
cagtgaagttgctgct

SEQ ID NO: 2467627 - DNA, 17 bp, Homo sapiens
cagtgaagttgctgctt

SEQ ID NO: 2467628 - DNA, 18 bp, Homo sapiens
cagtgaagttgctgcttc

SEQ ID NO: 2467629 - DNA, 17 bp, Homo sapiens
cagtgaccctggctcct

SEQ ID NO: 2467630 - DNA, 17 bp, Homo sapiens
cagtgacttctgagatc

SEQ ID NO: 2467631 - DNA, 20 bp, Homo sapiens
cagtgattgtcttaatattg

SEQ ID NO: 2467632 - DNA, 14 bp, Homo sapiens
cagtgcactgaaag

SEQ ID NO: 2467633 - DNA, 15 bp, Homo sapiens
cagtgcccccactga

SEQ ID NO: 2467634 - DNA, 22 bp, Homo sapiens
cagtgcccccactgaccagaac

SEQ ID NO: 2467635 - DNA, 23 bp, Homo sapiens
cagtgcccccactgaccagaact

SEQ ID NO: 2467636 - DNA, 14 bp, Homo sapiens
cagtgccctgagcc

SEQ ID NO: 2467637 - DNA, 16 bp, Homo sapiens
cagtgccctgagccag

SEQ ID NO: 2467638 - DNA, 23 bp, Homo sapiens
cagtgctcttttctcctcactgt

SEQ ID NO: 2467639 - DNA, 22 bp, Homo sapiens
cagtgctgtgctgtgctatggt

SEQ ID NO: 2467640 - DNA, 15 bp, Homo sapiens
cagtgcttcccgagt

SEQ ID NO: 2467641 - DNA, 15 bp, Homo sapiens
cagtggaggaagagg

SEQ ID NO: 2467642 - DNA, 21 bp, Homo sapiens
cagtggcccatggcattttat

SEQ ID NO: 2467643 - DNA, 11 bp, Homo sapiens
cagtggcctta

SEQ ID NO: 2467644 - DNA, 22 bp, Homo sapiens
cagtgggagcaaactgcatgcc

SEQ ID NO: 2467645 - DNA, 16 bp, Homo sapiens
cagtgtatggggcagc

SEQ ID NO: 2467646 - DNA, 23 bp, Homo sapiens
cagtgtatggggcagcttccggc

SEQ ID NO: 2467647 - DNA, 13 bp, Homo sapiens
cagtgtcaggcac

SEQ ID NO: 2467648 - DNA, 14 bp, Homo sapiens
cagtgtcctgagct

SEQ ID NO: 2467649 - DNA, 16 bp, Homo sapiens
cagtgtcctgagctca

SEQ ID NO: 2467650 - DNA, 18 bp, Homo sapiens
cagtgtcctgagctcagc

SEQ ID NO: 2467651 - DNA, 17 bp, Homo sapiens
cagtgtctttttttgta

SEQ ID NO: 2467652 - DNA, 19 bp, Homo sapiens
cagtgtctttttttgtata

SEQ ID NO: 2467653 - DNA, 21 bp, Homo sapiens
cagtgtctttttttgtatagt

SEQ ID NO: 2467654 - DNA, 23 bp, Homo sapiens
cagtgtctttttttgtatagtta

SEQ ID NO: 2467655 - DNA, 18 bp, Homo sapiens
cagtgtgaggccagggca

SEQ ID NO: 2467656 - DNA, 19 bp, Homo sapiens
cagtgtgaggccagggcag

SEQ ID NO: 2467657 - DNA, 19 bp, Homo sapiens
cagtgttaaatgtgatgaa

SEQ ID NO: 2467658 - DNA, 19 bp, Homo sapiens
cagtgttagggaagggcct

SEQ ID NO: 2467659 - DNA, 14 bp, Homo sapiens
cagtgtttaaaact

SEQ ID NO: 2467660 - DNA, 18 bp, Homo sapiens
cagtgtttatcctttcat

SEQ ID NO: 2467661 - DNA, 21 bp, Homo sapiens
catcaaggacacgggcctgtc

SEQ ID NO: 2467662 - DNA, 14 bp, Homo sapiens
catcaagtaataca

SEQ ID NO: 2467663 - DNA, 19 bp, Homo sapiens
catcacactgggtggtggc

SEQ ID NO: 2467664 - DNA, 22 bp, Homo sapiens
catcacctcagatggcagcttt

SEQ ID NO: 2467665 - DNA, 17 bp, Homo sapiens
catcactgagttttcca

SEQ ID NO: 2467666 - DNA, 23 bp, Homo sapiens
catcactgagttttccatggcag

SEQ ID NO: 2467667 - DNA, 18 bp, Homo sapiens
catcagaaaggaaaaaca

SEQ ID NO: 2467668 - DNA, 16 bp, Homo sapiens
catcagaaagggaggg

SEQ ID NO: 2467669 - DNA, 15 bp, Homo sapiens
catcatcctctggct

SEQ ID NO: 2467670 - DNA, 20 bp, Homo sapiens
catcatctcctgccttcctc

SEQ ID NO: 2467671 - DNA, 13 bp, Homo sapiens
catcatgcctctg

SEQ ID NO: 2467672 - DNA, 16 bp, Homo sapiens
catcatgcctctgagg

SEQ ID NO: 2467673 - DNA, 20 bp, Homo sapiens
catcatgcctctgaggccag

SEQ ID NO: 2467674 - DNA, 23 bp, Homo sapiens
catcatgcctctgaggccagcct

SEQ ID NO: 2467675 - DNA, 13 bp, Homo sapiens
catcatggccagc

SEQ ID NO: 2467676 - DNA, 15 bp, Homo sapiens
catcatggccagctg

SEQ ID NO: 2467677 - DNA, 14 bp, Homo sapiens
catcattatttatg

SEQ ID NO: 2467678 - DNA, 21 bp, Homo sapiens
catcattctctgtctcatcca

SEQ ID NO: 2467679 - DNA, 22 bp, Homo sapiens
catcattctctgtctcatccat

SEQ ID NO: 2467680 - DNA, 20 bp, Homo sapiens
catcatttctttttgggaga

SEQ ID NO: 2467681 - DNA, 17 bp, Homo sapiens
catccaaaatcttgatc

SEQ ID NO: 2467682 - DNA, 15 bp, Homo sapiens
catccaaagcagaca

SEQ ID NO: 2467683 - DNA, 17 bp, Homo sapiens
catccacatgggagccg

SEQ ID NO: 2467684 - DNA, 12 bp, Homo sapiens
catccaccccat

SEQ ID NO: 2467685 - DNA, 15 bp, Homo sapiens
catccagctcactca

SEQ ID NO: 2467686 - DNA, 11 bp, Homo sapiens
catccagggcc

SEQ ID NO: 2467687 - DNA, 13 bp, Homo sapiens
catccatcatcat

SEQ ID NO: 2467688 - DNA, 14 bp, Homo sapiens
catccatgcctcag

SEQ ID NO: 2467689 - DNA, 17 bp, Homo sapiens
catccatgcctcagaag

SEQ ID NO: 2467690 - DNA, 23 bp, Homo sapiens
catccatgcctcagaagtgcatc

SEQ ID NO: 2467691 - DNA, 21 bp, Homo sapiens
catccattctcacaggtccca

SEQ ID NO: 2467692 - DNA, 16 bp, Homo sapiens
catccattctcctgag

SEQ ID NO: 2467693 - DNA, 17 bp, Homo sapiens
catcccagacaggtccc

SEQ ID NO: 2467694 - DNA, 16 bp, Homo sapiens
catcccccggcacctc

SEQ ID NO: 2467695 - DNA, 16 bp, Homo sapiens
catcccgtgttctcct

SEQ ID NO: 2467696 - DNA, 13 bp, Homo sapiens
catccctggcccc

SEQ ID NO: 2467697 - DNA, 20 bp, Homo sapiens
catccctggccccctccctg

SEQ ID NO: 2467698 - DNA, 20 bp, Homo sapiens
catccctgggcctgctgctg

SEQ ID NO: 2467699 - DNA, 17 bp, Homo sapiens
catccctgggccttggg

SEQ ID NO: 2467700 - DNA, 14 bp, Homo sapiens
catcctcaaagaaa

SEQ ID NO: 2467701 - DNA, 18 bp, Homo sapiens
catcctccacgttctgct

SEQ ID NO: 2467702 - DNA, 17 bp, Homo sapiens
catcctccagatagtgt

SEQ ID NO: 2467703 - DNA, 20 bp, Homo sapiens
catcctcctcccacccggct

SEQ ID NO: 2467704 - DNA, 23 bp, Homo sapiens
catcctctggcttggccacagcc

SEQ ID NO: 2467705 - DNA, 13 bp, Homo sapiens
catccttgtctta

SEQ ID NO: 2467706 - DNA, 18 bp, Homo sapiens
catcgcaccattctgact

SEQ ID NO: 2467707 - DNA, 16 bp, Homo sapiens
catcggaaaaataatc

SEQ ID NO: 2467708 - DNA, 20 bp, Homo sapiens
catcggacaagacccccagc

SEQ ID NO: 2467709 - DNA, 23 bp, Homo sapiens
catctaaaaatagacttaaatct

SEQ ID NO: 2467710 - DNA, 15 bp, Homo sapiens
catctaacctcatct

SEQ ID NO: 2467711 - DNA, 19 bp, Homo sapiens
catctaacctcatcttctt

SEQ ID NO: 2467712 - DNA, 20 bp, Homo sapiens
catctaagttataagactct

SEQ ID NO: 2467713 - DNA, 15 bp, Homo sapiens
catctcaacaggcct

SEQ ID NO: 2467714 - DNA, 20 bp, Homo sapiens
catctcaacaggcctcaggg

SEQ ID NO: 2467715 - DNA, 18 bp, Homo sapiens
catctcaggccagagcca

SEQ ID NO: 2467716 - DNA, 20 bp, Homo sapiens
catctcatttaatcctccct

SEQ ID NO: 2467717 - DNA, 18 bp, Homo sapiens
catctcccagataatgtg

SEQ ID NO: 2467718 - DNA, 20 bp, Homo sapiens
catctccctggtgcttatgc

SEQ ID NO: 2467719 - DNA, 23 bp, Homo sapiens
catctccctggtgcttatgctct

SEQ ID NO: 2467720 - DNA, 16 bp, Homo sapiens
catctcctgccttcct

SEQ ID NO: 2467721 - DNA, 12 bp, Homo sapiens
catctctccctc

SEQ ID NO: 2467722 - DNA, 16 bp, Homo sapiens
catctctctgcccaac

SEQ ID NO: 2467723 - DNA, 11 bp, Homo sapiens
catctcttcag

SEQ ID NO: 2467724 - DNA, 13 bp, Homo sapiens
catctcttcaggt

SEQ ID NO: 2467725 - DNA, 14 bp, Homo sapiens
catctcttcaggtt

SEQ ID NO: 2467726 - DNA, 13 bp, Homo sapiens
catctgattaaaa

SEQ ID NO: 2467727 - DNA, 19 bp, Homo sapiens
catctgcgtgacaataaaa

SEQ ID NO: 2467728 - DNA, 16 bp, Homo sapiens
catctgcttcaggccc

SEQ ID NO: 2467729 - DNA, 12 bp, Homo sapiens
catctggcctgg

SEQ ID NO: 2467730 - DNA, 14 bp, Homo sapiens
catctggcctggcc

SEQ ID NO: 2467731 - DNA, 18 bp, Homo sapiens
catctggcctggccagtg

SEQ ID NO: 2467732 - DNA, 14 bp, Homo sapiens
catctggctctaat

SEQ ID NO: 2467733 - DNA, 15 bp, Homo sapiens
catctgggccttggc

SEQ ID NO: 2467734 - DNA, 23 bp, Homo sapiens
catctgggccttggcctggagca

SEQ ID NO: 2467735 - DNA, 17 bp, Homo sapiens
catctgggctcctccag

SEQ ID NO: 2467736 - DNA, 18 bp, Homo sapiens
catctggggagcaggcag

SEQ ID NO: 2467737 - DNA, 19 bp, Homo sapiens
catctggggagcaggcagc

SEQ ID NO: 2467738 - DNA, 22 bp, Homo sapiens
catctgtaaatctacacacggt

SEQ ID NO: 2467739 - DNA, 18 bp, Homo sapiens
catctgtccctccgggac

SEQ ID NO: 2467740 - DNA, 15 bp, Homo sapiens
catcttcagttgtct

SEQ ID NO: 2467741 - DNA, 22 bp, Homo sapiens
catcttcagttgtctctgatgc

SEQ ID NO: 2467742 - DNA, 21 bp, Homo sapiens
catcttctaaacccaatccaa

SEQ ID NO: 2467743 - DNA, 14 bp, Homo sapiens
catcttcttcacca

SEQ ID NO: 2467744 - DNA, 16 bp, Homo sapiens
catcttgcattatgca

SEQ ID NO: 2467745 - DNA, 23 bp, Homo sapiens
catcttgctaccagtatttagaa

SEQ ID NO: 2467746 - DNA, 15 bp, Homo sapiens
catcttgcttcccta

SEQ ID NO: 2467747 - DNA, 16 bp, Homo sapiens
catcttggaactgcat

SEQ ID NO: 2467748 - DNA, 11 bp, Homo sapiens
catcttggggg

SEQ ID NO: 2467749 - DNA, 22 bp, Homo sapiens
catctttacaaaactacatgag

SEQ ID NO: 2467750 - DNA, 14 bp, Homo sapiens
catcttttgtatta

SEQ ID NO: 2467751 - DNA, 15 bp, Homo sapiens
catcttttgtattaa

SEQ ID NO: 2467752 - DNA, 19 bp, Homo sapiens
catcttttgtattaagaaa

SEQ ID NO: 2467753 - DNA, 15 bp, Homo sapiens
catgaaaattcagaa

SEQ ID NO: 2467754 - DNA, 17 bp, Homo sapiens
catgaacttagatttta

SEQ ID NO: 2467755 - DNA, 15 bp, Homo sapiens
catgaagctgttgtg

SEQ ID NO: 2467756 - DNA, 14 bp, Homo sapiens
catgaaggtaaata

SEQ ID NO: 2467757 - DNA, 13 bp, Homo sapiens
catgaagtatttt

SEQ ID NO: 2467758 - DNA, 14 bp, Homo sapiens
catgaatgtaaatt

SEQ ID NO: 2467759 - DNA, 17 bp, Homo sapiens
catgaattttagctttt

SEQ ID NO: 2467760 - DNA, 19 bp, Homo sapiens
catgaattttagcttttgt

SEQ ID NO: 2467761 - DNA, 14 bp, Homo sapiens
catgaccctgcctc

SEQ ID NO: 2467762 - DNA, 17 bp, Homo sapiens
catgacctccagctttc

SEQ ID NO: 2467763 - DNA, 17 bp, Homo sapiens
catgactcgggggtggg

SEQ ID NO: 2467764 - DNA, 13 bp, Homo sapiens
catgactgcttgc

SEQ ID NO: 2467765 - DNA, 23 bp, Homo sapiens
catgtggggccaggtcacccttt

SEQ ID NO: 2467766 - DNA, 22 bp, Homo sapiens
catgtggtggcacaggccccct

SEQ ID NO: 2467767 - DNA, 14 bp, Homo sapiens
catgtgtcccagaa

SEQ ID NO: 2467768 - DNA, 17 bp, Homo sapiens
catgtgtcccagaagat

SEQ ID NO: 2467769 - DNA, 21 bp, Homo sapiens
catgtgtcctggttcccgttt

SEQ ID NO: 2467770 - DNA, 22 bp, Homo sapiens
catgtgtgtccacgactgtctc

SEQ ID NO: 2467771 - DNA, 13 bp, Homo sapiens
catgttagccagg

SEQ ID NO: 2467772 - DNA, 14 bp, Homo sapiens
catgttagttacct

SEQ ID NO: 2467773 - DNA, 23 bp, Homo sapiens
catgttatttgtaatagatgttt

SEQ ID NO: 2467774 - DNA, 20 bp, Homo sapiens
catgttggccaggctggtct

SEQ ID NO: 2467775 - DNA, 19 bp, Homo sapiens
catgttgggaaacttggct

SEQ ID NO: 2467776 - DNA, 18 bp, Homo sapiens
catgtttatttttcttgt

SEQ ID NO: 2467777 - DNA, 12 bp, Homo sapiens
catgtttccagc

SEQ ID NO: 2467778 - DNA, 13 bp, Homo sapiens
catgtttccagca

SEQ ID NO: 2467779 - DNA, 21 bp, Homo sapiens
catgtttcctctagttctttg

SEQ ID NO: 2467780 - DNA, 21 bp, Homo sapiens
catgttttctgaaaatataac

SEQ ID NO: 2467781 - DNA, 11 bp, Homo sapiens
cattaaaatat

SEQ ID NO: 2467782 - DNA, 11 bp, Homo sapiens
cattaaagaag

SEQ ID NO: 2467783 - DNA, 14 bp, Homo sapiens
cattaaattacaga

SEQ ID NO: 2467784 - DNA, 20 bp, Homo sapiens
cattaaattacagaaattta

SEQ ID NO: 2467785 - DNA, 14 bp, Homo sapiens
cattaaattcacaa

SEQ ID NO: 2467786 - DNA, 17 bp, Homo sapiens
cattaaattcacaaact

SEQ ID NO: 2467787 - DNA, 21 bp, Homo sapiens
cattaaattcacaaactttta

SEQ ID NO: 2467788 - DNA, 17 bp, Homo sapiens
cattaatagcagccttt

SEQ ID NO: 2467789 - DNA, 14 bp, Homo sapiens
cattagaattattt

SEQ ID NO: 2467790 - DNA, 19 bp, Homo sapiens
cattagaattatttaaaca

SEQ ID NO: 2467791 - DNA, 21 bp, Homo sapiens
cattagtcatgtttatctgct

SEQ ID NO: 2467792 - DNA, 24 bp, Homo sapiens
cattatctagttcattgaatcatt

SEQ ID NO: 2467793 - DNA, 19 bp, Homo sapiens
cattatgcaatttttatat

SEQ ID NO: 2467794 - DNA, 18 bp, Homo sapiens
cattattacttttgctgt

SEQ ID NO: 2467795 - DNA, 23 bp, Homo sapiens
cattattacttttgctgtaatgt

SEQ ID NO: 2467796 - DNA, 16 bp, Homo sapiens
cattcacctgccccaa

SEQ ID NO: 2467797 - DNA, 13 bp, Homo sapiens
cattcagaagaaa

SEQ ID NO: 2467798 - DNA, 17 bp, Homo sapiens
cattcagaagaaaaaga

SEQ ID NO: 2467799 - DNA, 21 bp, Homo sapiens
cattcattagtcatgtttatc

SEQ ID NO: 2467800 - DNA, 20 bp, Homo sapiens
cattcatttagctaaacgga

SEQ ID NO: 2467801 - DNA, 16 bp, Homo sapiens
cattccaaagaacagc

SEQ ID NO: 2467802 - DNA, 19 bp, Homo sapiens
cattccagcccctctggtc

SEQ ID NO: 2467803 - DNA, 22 bp, Homo sapiens
cattccagcccctctggtcgct

SEQ ID NO: 2467804 - DNA, 15 bp, Homo sapiens
cattccatgtgccca

SEQ ID NO: 2467805 - DNA, 18 bp, Homo sapiens
cattccatgtgcccagtt

SEQ ID NO: 2467806 - DNA, 21 bp, Homo sapiens
cattccatgtgcccagttaat

SEQ ID NO: 2467807 - DNA, 19 bp, Homo sapiens
cattcctcatgaatgtaaa

SEQ ID NO: 2467808 - DNA, 13 bp, Homo sapiens
cattcctgaagaa

SEQ ID NO: 2467809 - DNA, 23 bp, Homo sapiens
cattctaggtaggggcccacttc

SEQ ID NO: 2467810 - DNA, 17 bp, Homo sapiens
cattctcattggaaatt

SEQ ID NO: 2467811 - DNA, 14 bp, Homo sapiens
cattctccacagca

SEQ ID NO: 2467812 - DNA, 15 bp, Homo sapiens
cattctccacagcaa

SEQ ID NO: 2467813 - DNA, 18 bp, Homo sapiens
cattctccacagcaaccc

SEQ ID NO: 2467814 - DNA, 15 bp, Homo sapiens
cattctgaatgcttc

SEQ ID NO: 2467815 - DNA, 19 bp, Homo sapiens
cattctgactcggtttctc

SEQ ID NO: 2467816 - DNA, 16 bp, Homo sapiens
cattctgctccttccc

SEQ ID NO: 2467817 - DNA, 16 bp, Homo sapiens
cattctggacctctgg

SEQ ID NO: 2467818 - DNA, 18 bp, Homo sapiens
cattcttctctgttgtcg

SEQ ID NO: 2467819 - DNA, 18 bp, Homo sapiens
cattcttctgagcactgt

SEQ ID NO: 2467820 - DNA, 19 bp, Homo sapiens
cattcttctgagcactgtt

SEQ ID NO: 2467821 - DNA, 22 bp, Homo sapiens
cattgaatggctatgtttttaa

SEQ ID NO: 2467822 - DNA, 21 bp, Homo sapiens
cattgaattcttggttgagga

SEQ ID NO: 2467823 - DNA, 22 bp, Homo sapiens
cattgaattcttggttgaggaa

SEQ ID NO: 2467824 - DNA, 21 bp, Homo sapiens
cattgaccgcgactaatttca

SEQ ID NO: 2467825 - DNA, 21 bp, Homo sapiens
cattgactttccccaccagat

SEQ ID NO: 2467826 - DNA, 19 bp, Homo sapiens
cattggaagagcagcacct

SEQ ID NO: 2467827 - DNA, 22 bp, Homo sapiens
cattggaataaggcatggctca

SEQ ID NO: 2467828 - DNA, 16 bp, Homo sapiens
cattggaatgttctca

SEQ ID NO: 2467829 - DNA, 17 bp, Homo sapiens
cattggacccttccatg

SEQ ID NO: 2467830 - DNA, 18 bp, Homo sapiens
cattggatattttttact

SEQ ID NO: 2467831 - DNA, 21 bp, Homo sapiens
cattggcacctaatccaggca

SEQ ID NO: 2467832 - DNA, 14 bp, Homo sapiens
cattggctatttaa

SEQ ID NO: 2467833 - DNA, 23 bp, Homo sapiens
cattggggtagttgtgtttcaac

SEQ ID NO: 2467834 - DNA, 13 bp, Homo sapiens
cattggtccaaga

SEQ ID NO: 2467835 - DNA, 13 bp, Homo sapiens
cattgtaaaataa

SEQ ID NO: 2467836 - DNA, 14 bp, Homo sapiens
cattgtaaaataat

SEQ ID NO: 2467837 - DNA, 15 bp, Homo sapiens
cattgtaaacaaact

SEQ ID NO: 2467838 - DNA, 20 bp, Homo sapiens
cattgtctttttagatgccc

SEQ ID NO: 2467839 - DNA, 21 bp, Homo sapiens
cattgtgggatgttcagcact

SEQ ID NO: 2467840 - DNA, 22 bp, Homo sapiens
cattgtgggatgttcagcactg

SEQ ID NO: 2467841 - DNA, 14 bp, Homo sapiens
cattgtgttacctg

SEQ ID NO: 2467842 - DNA, 17 bp, Homo sapiens
cattgttatataatcat

SEQ ID NO: 2467843 - DNA, 21 bp, Homo sapiens
cattgttatataatcattatt

SEQ ID NO: 2467844 - DNA, 13 bp, Homo sapiens
cattgttgagcta

SEQ ID NO: 2467845 - DNA, 17 bp, Homo sapiens
catttaaatacagtctt

SEQ ID NO: 2467846 - DNA, 20 bp, Homo sapiens
catttaaatacagtcttcca

SEQ ID NO: 2467847 - DNA, 23 bp, Homo sapiens
catttaacccccctgtacacaac

SEQ ID NO: 2467848 - DNA, 16 bp, Homo sapiens
catttagcctgtcctg

SEQ ID NO: 2467849 - DNA, 23 bp, Homo sapiens
catttagtttgattattcagtgt

SEQ ID NO: 2467850 - DNA, 13 bp, Homo sapiens
catttatatattg

SEQ ID NO: 2467851 - DNA, 13 bp, Homo sapiens
catttatattgat

SEQ ID NO: 2467852 - DNA, 20 bp, Homo sapiens
catttatctaaatatggact

SEQ ID NO: 2467853 - DNA, 14 bp, Homo sapiens
catttattttgaca

SEQ ID NO: 2467854 - DNA, 13 bp, Homo sapiens
catttcagaagtt

SEQ ID NO: 2467855 - DNA, 23 bp, Homo sapiens
catttcagaagttagtttgtata

SEQ ID NO: 2467856 - DNA, 20 bp, Homo sapiens
catttcctgggtggctactc

SEQ ID NO: 2467857 - DNA, 20 bp, Homo sapiens
catttctaattatgtagctc

SEQ ID NO: 2467858 - DNA, 21 bp, Homo sapiens
catttctaattatgtagctct

SEQ ID NO: 2467859 - DNA, 19 bp, Homo sapiens
catttctatttctcctcca

SEQ ID NO: 2467860 - DNA, 22 bp, Homo sapiens
catttctcaggctaggccagca

SEQ ID NO: 2467861 - DNA, 12 bp, Homo sapiens
catttctcatcc

SEQ ID NO: 2467862 - DNA, 15 bp, Homo sapiens
catttctctaagaga

SEQ ID NO: 2467863 - DNA, 21 bp, Homo sapiens
catttctgaggtgcactggga

SEQ ID NO: 2467864 - DNA, 21 bp, Homo sapiens
catttgaaacccctgtaggcc

SEQ ID NO: 2467865 - DNA, 14 bp, Homo sapiens
catttgcagggtcc

SEQ ID NO: 2467866 - DNA, 19 bp, Homo sapiens
catttgcagggtcctcttc

SEQ ID NO: 2467867 - DNA, 17 bp, Homo sapiens
catttgctgttttaaac

SEQ ID NO: 2467868 - DNA, 22 bp, Homo sapiens
ccaatttcggattttttccaaa

SEQ ID NO: 2467869 - DNA, 23 bp, Homo sapiens
ccacaaaataaccaatcctggac

SEQ ID NO: 2467870 - DNA, 14 bp, Homo sapiens
ccacaaactgtaat

SEQ ID NO: 2467871 - DNA, 21 bp, Homo sapiens
ccacaagcctctgcccaggca

SEQ ID NO: 2467872 - DNA, 20 bp, Homo sapiens
ccacaagcctgagggaaagg

SEQ ID NO: 2467873 - DNA, 21 bp, Homo sapiens
ccacaagcctgagggaaaggc

SEQ ID NO: 2467874 - DNA, 21 bp, Homo sapiens
ccacaaggacttcctgtccag

SEQ ID NO: 2467875 - DNA, 22 bp, Homo sapiens
ccacacaaggatagatgctggc

SEQ ID NO: 2467876 - DNA, 12 bp, Homo sapiens
ccacacagctgc

SEQ ID NO: 2467877 - DNA, 22 bp, Homo sapiens
ccacacagtgctcaaggccagc

SEQ ID NO: 2467878 - DNA, 23 bp, Homo sapiens
ccacacagtgctcaaggccagct

SEQ ID NO: 2467879 - DNA, 19 bp, Homo sapiens
ccacaccagggccagcctc

SEQ ID NO: 2467880 - DNA, 11 bp, Homo sapiens
ccacacctcct

SEQ ID NO: 2467881 - DNA, 16 bp, Homo sapiens
ccacacctccttccct

SEQ ID NO: 2467882 - DNA, 19 bp, Homo sapiens
ccacacctccttccctctc

SEQ ID NO: 2467883 - DNA, 18 bp, Homo sapiens
ccacacttcaaactactt

SEQ ID NO: 2467884 - DNA, 18 bp, Homo sapiens
ccacacttctcaggacac

SEQ ID NO: 2467885 - DNA, 19 bp, Homo sapiens
ccacagcaaccccaggctg

SEQ ID NO: 2467886 - DNA, 20 bp, Homo sapiens
ccacagcaaccccaggctga

SEQ ID NO: 2467887 - DNA, 14 bp, Homo sapiens
ccacagcacagcca

SEQ ID NO: 2467888 - DNA, 13 bp, Homo sapiens
ccacagccagggg

SEQ ID NO: 2467889 - DNA, 17 bp, Homo sapiens
ccacagccctgtcagca

SEQ ID NO: 2467890 - DNA, 20 bp, Homo sapiens
ccacagccctgtcagcatga

SEQ ID NO: 2467891 - DNA, 20 bp, Homo sapiens
ccacagcctcccctgccagg

SEQ ID NO: 2467892 - DNA, 13 bp, Homo sapiens
ccacagcttttgc

SEQ ID NO: 2467893 - DNA, 19 bp, Homo sapiens
ccacaggaagcctgcagtc

SEQ ID NO: 2467894 - DNA, 16 bp, Homo sapiens
ccacaggacatttctc

SEQ ID NO: 2467895 - DNA, 16 bp, Homo sapiens
ccacaggccgccctgc

SEQ ID NO: 2467896 - DNA, 14 bp, Homo sapiens
ccacaggcttctga

SEQ ID NO: 2467897 - DNA, 16 bp, Homo sapiens
ccacagggtcccacag

SEQ ID NO: 2467898 - DNA, 20 bp, Homo sapiens
ccacagggtcccacagccac

SEQ ID NO: 2467899 - DNA, 15 bp, Homo sapiens
ccacagtagtcttga

SEQ ID NO: 2467900 - DNA, 13 bp, Homo sapiens
ccacagtgtcagg

SEQ ID NO: 2467901 - DNA, 15 bp, Homo sapiens
ccacatccctgggcc

SEQ ID NO: 2467902 - DNA, 21 bp, Homo sapiens
ccacatccctgggcctgctgc

SEQ ID NO: 2467903 - DNA, 13 bp, Homo sapiens
ccacatcctccac

SEQ ID NO: 2467904 - DNA, 16 bp, Homo sapiens
ccacattaaagaagac

SEQ ID NO: 2467905 - DNA, 17 bp, Homo sapiens
ccacattggaagagcag

SEQ ID NO: 2467906 - DNA, 14 bp, Homo sapiens
ccacatttctaaaa

SEQ ID NO: 2467907 - DNA, 15 bp, Homo sapiens
ccacatttctaaaat

SEQ ID NO: 2467908 - DNA, 16 bp, Homo sapiens
ccaccaaaactgctcc

SEQ ID NO: 2467909 - DNA, 15 bp, Homo sapiens
ccaccaaccctcagg

SEQ ID NO: 2467910 - DNA, 16 bp, Homo sapiens
ccaccaaccctcaggg

SEQ ID NO: 2467911 - DNA, 18 bp, Homo sapiens
ccaccacagccagcacct

SEQ ID NO: 2467912 - DNA, 19 bp, Homo sapiens
ccaccaggccacctcccca

SEQ ID NO: 2467913 - DNA, 12 bp, Homo sapiens
ccaccagttctc

SEQ ID NO: 2467914 - DNA, 17 bp, Homo sapiens
ccaccatggccagccaa

SEQ ID NO: 2467915 - DNA, 17 bp, Homo sapiens
ccaccatttggcatccc

SEQ ID NO: 2467916 - DNA, 15 bp, Homo sapiens
ccacccacttctgca

SEQ ID NO: 2467917 - DNA, 23 bp, Homo sapiens
ccacccaggggcagccccaggcc

SEQ ID NO: 2467918 - DNA, 15 bp, Homo sapiens
ccaccccacccactt

SEQ ID NO: 2467919 - DNA, 13 bp, Homo sapiens
ccacccccaaggt

SEQ ID NO: 2467920 - DNA, 13 bp, Homo sapiens
ccacccccagctc

SEQ ID NO: 2467921 - DNA, 22 bp, Homo sapiens
ccaccctcggggatgtgtcctg

SEQ ID NO: 2467922 - DNA, 15 bp, Homo sapiens
ccaccctgagccggc

SEQ ID NO: 2467923 - DNA, 22 bp, Homo sapiens
ccaccctgagccggccccaggc

SEQ ID NO: 2467924 - DNA, 23 bp, Homo sapiens
ccaccctgaggagtctgaggtcc

SEQ ID NO: 2467925 - DNA, 20 bp, Homo sapiens
ccaccctgagttgcttttca

SEQ ID NO: 2467926 - DNA, 13 bp, Homo sapiens
ccaccctgctcat

SEQ ID NO: 2467927 - DNA, 20 bp, Homo sapiens
ccaccctgctcatccactct

SEQ ID NO: 2467928 - DNA, 16 bp, Homo sapiens
ccaccctgggccctgg

SEQ ID NO: 2467929 - DNA, 16 bp, Homo sapiens
ccaccctgttcctgct

SEQ ID NO: 2467930 - DNA, 18 bp, Homo sapiens
ccaccctgttcctgctgc

SEQ ID NO: 2467931 - DNA, 18 bp, Homo sapiens
ccaccgaagccgcctgtg

SEQ ID NO: 2467932 - DNA, 17 bp, Homo sapiens
ccaccgcccagagaccc

SEQ ID NO: 2467933 - DNA, 15 bp, Homo sapiens
ccaccgggccactcc

SEQ ID NO: 2467934 - DNA, 15 bp, Homo sapiens
ccacctccccttggg

SEQ ID NO: 2467935 - DNA, 15 bp, Homo sapiens
ccacctctaacagca

SEQ ID NO: 2467936 - DNA, 18 bp, Homo sapiens
ccacctctaacagcacca

SEQ ID NO: 2467937 - DNA, 20 bp, Homo sapiens
ccacctctaacagcaccaaa

SEQ ID NO: 2467938 - DNA, 13 bp, Homo sapiens
ccacctctgctgc

SEQ ID NO: 2467939 - DNA, 17 bp, Homo sapiens
ccacctgacacaccagg

SEQ ID NO: 2467940 - DNA, 20 bp, Homo sapiens
ccacctgaggaactgtctcg

SEQ ID NO: 2467941 - DNA, 11 bp, Homo sapiens
ccacctggacc

SEQ ID NO: 2467942 - DNA, 19 bp, Homo sapiens
ccacctggacccctgcatt

SEQ ID NO: 2467943 - DNA, 20 bp, Homo sapiens
ccacctggacccctgcattg

SEQ ID NO: 2467944 - DNA, 15 bp, Homo sapiens
ccacctggctctcac

SEQ ID NO: 2467945 - DNA, 19 bp, Homo sapiens
ccacctggctctcacctct

SEQ ID NO: 2467946 - DNA, 22 bp, Homo sapiens
ccacctggctctcacctctagg

SEQ ID NO: 2467947 - DNA, 18 bp, Homo sapiens
ccacctgtctcagcctcc

SEQ ID NO: 2467948 - DNA, 14 bp, Homo sapiens
ccacgaaggagccc

SEQ ID NO: 2467949 - DNA, 15 bp, Homo sapiens
ccacgactgtctcca

SEQ ID NO: 2467950 - DNA, 16 bp, Homo sapiens
ccacgactgtctccat

SEQ ID NO: 2467951 - DNA, 14 bp, Homo sapiens
ccacgagggctggc

SEQ ID NO: 2467952 - DNA, 17 bp, Homo sapiens
ccacgagggctggctgg

SEQ ID NO: 2467953 - DNA, 20 bp, Homo sapiens
ccacgagggctggctggcct

SEQ ID NO: 2467954 - DNA, 15 bp, Homo sapiens
ccacgcccgtcctgc

SEQ ID NO: 2467955 - DNA, 18 bp, Homo sapiens
ccacgcccgtcctgcctg

SEQ ID NO: 2467956 - DNA, 19 bp, Homo sapiens
ccacgcccgtcctgcctgt

SEQ ID NO: 2467957 - DNA, 20 bp, Homo sapiens
ccacgcccgtcctgcctgtg

SEQ ID NO: 2467958 - DNA, 21 bp, Homo sapiens
ccacgcccgtcctgcctgtgg

SEQ ID NO: 2467959 - DNA, 19 bp, Homo sapiens
ccacgcctcttgaccaggc

SEQ ID NO: 2467960 - DNA, 20 bp, Homo sapiens
ccacggagccactcctctga

SEQ ID NO: 2467961 - DNA, 15 bp, Homo sapiens
ccacggcacctgggc

SEQ ID NO: 2467962 - DNA, 20 bp, Homo sapiens
ccacgttggagaagcccgtg

SEQ ID NO: 2467963 - DNA, 16 bp, Homo sapiens
ccactagcctcagggg

SEQ ID NO: 2467964 - DNA, 15 bp, Homo sapiens
ccactcagagacatg

SEQ ID NO: 2467965 - DNA, 13 bp, Homo sapiens
ccactccatctgg

SEQ ID NO: 2467966 - DNA, 17 bp, Homo sapiens
ccactccatctggtaga

SEQ ID NO: 2467967 - DNA, 22 bp, Homo sapiens
ccactcctctgctgacctgctg

SEQ ID NO: 2467968 - DNA, 13 bp, Homo sapiens
ccactccttcctg

SEQ ID NO: 2467969 - DNA, 15 bp, Homo sapiens
ccactctaaagcaaa

SEQ ID NO: 2467970 - DNA, 13 bp, Homo sapiens
ccactctcctagg

SEQ ID NO: 2467971 - DNA, 14 bp, Homo sapiens
ccactctgctctga

SEQ ID NO: 2467972 - DNA, 22 bp, Homo sapiens
ccagccgcttggcgatgccagc

SEQ ID NO: 2467973 - DNA, 23 bp, Homo sapiens
ccagccgcttggcgatgccagcc

SEQ ID NO: 2467974 - DNA, 20 bp, Homo sapiens
ccagccggggcgagtggcac

SEQ ID NO: 2467975 - DNA, 13 bp, Homo sapiens
ccagcctccctga

SEQ ID NO: 2467976 - DNA, 13 bp, Homo sapiens
ccagcctggccca

SEQ ID NO: 2467977 - DNA, 14 bp, Homo sapiens
ccagcctggcctcc

SEQ ID NO: 2467978 - DNA, 21 bp, Homo sapiens
ccagcctggcctcctgcctct

SEQ ID NO: 2467979 - DNA, 20 bp, Homo sapiens
ccagcctgggaaagcccctg

SEQ ID NO: 2467980 - DNA, 22 bp, Homo sapiens
ccagcctgggcctatggagagc

SEQ ID NO: 2467981 - DNA, 18 bp, Homo sapiens
ccagcctgtcagatccag

SEQ ID NO: 2467982 - DNA, 20 bp, Homo sapiens
ccagcgagcgcccagctcct

SEQ ID NO: 2467983 - DNA, 17 bp, Homo sapiens
ccagcgagggcgtgtct

SEQ ID NO: 2467984 - DNA, 19 bp, Homo sapiens
ccagcgattccctctccca

SEQ ID NO: 2467985 - DNA, 22 bp, Homo sapiens
ccagcgattccctctcccaggc

SEQ ID NO: 2467986 - DNA, 14 bp, Homo sapiens
ccagcggacacacg

SEQ ID NO: 2467987 - DNA, 17 bp, Homo sapiens
ccagctaagaacctgga

SEQ ID NO: 2467988 - DNA, 18 bp, Homo sapiens
ccagctaagaacctggaa

SEQ ID NO: 2467989 - DNA, 15 bp, Homo sapiens
ccagctaaggggtgg

SEQ ID NO: 2467990 - DNA, 21 bp, Homo sapiens
ccagctaccctttttctccag

SEQ ID NO: 2467991 - DNA, 22 bp, Homo sapiens
ccagctaccctttttctccagc

SEQ ID NO: 2467992 - DNA, 13 bp, Homo sapiens
ccagctcaggaca

SEQ ID NO: 2467993 - DNA, 15 bp, Homo sapiens
ccagctccccctccc

SEQ ID NO: 2467994 - DNA, 18 bp, Homo sapiens
ccagctccctgtgccccc

SEQ ID NO: 2467995 - DNA, 12 bp, Homo sapiens
ccagctcctgac

SEQ ID NO: 2467996 - DNA, 20 bp, Homo sapiens
ccagctcctgacactgctgg

SEQ ID NO: 2467997 - DNA, 23 bp, Homo sapiens
ccagctcctgacactgctggaga

SEQ ID NO: 2467998 - DNA, 13 bp, Homo sapiens
ccagctcctttgg

SEQ ID NO: 2467999 - DNA, 21 bp, Homo sapiens
ccagctctgaaaccagtgtta

SEQ ID NO: 2468000 - DNA, 14 bp, Homo sapiens
ccagctctgtatca

SEQ ID NO: 2468001 - DNA, 18 bp, Homo sapiens
ccagctctgtatcaggac

SEQ ID NO: 2468002 - DNA, 21 bp, Homo sapiens
ccagctctgttcttcctcagc

SEQ ID NO: 2468003 - DNA, 14 bp, Homo sapiens
ccagctgactaaac

SEQ ID NO: 2468004 - DNA, 17 bp, Homo sapiens
ccagctgactaaacttt

SEQ ID NO: 2468005 - DNA, 17 bp, Homo sapiens
ccagctgagcgccagga

SEQ ID NO: 2468006 - DNA, 13 bp, Homo sapiens
ccagctgcactga

SEQ ID NO: 2468007 - DNA, 18 bp, Homo sapiens
ccagctgccccggcccct

SEQ ID NO: 2468008 - DNA, 23 bp, Homo sapiens
ccagctggaggcaggggcttcct

SEQ ID NO: 2468009 - DNA, 19 bp, Homo sapiens
ccagctgtccccccactcc

SEQ ID NO: 2468010 - DNA, 15 bp, Homo sapiens
ccagctgtgcttatg

SEQ ID NO: 2468011 - DNA, 21 bp, Homo sapiens
ccagctgtgcttatggtacca

SEQ ID NO: 2468012 - DNA, 23 bp, Homo sapiens
ccagctgtggttttcttttgcca

SEQ ID NO: 2468013 - DNA, 16 bp, Homo sapiens
ccagcttcaggtgacc

SEQ ID NO: 2468014 - DNA, 14 bp, Homo sapiens
ccagcttccttcag

SEQ ID NO: 2468015 - DNA, 20 bp, Homo sapiens
ccagcttccttcagagagca

SEQ ID NO: 2468016 - DNA, 23 bp, Homo sapiens
ccagcttgtttacatgcttattc

SEQ ID NO: 2468017 - DNA, 12 bp, Homo sapiens
ccagctttcctg

SEQ ID NO: 2468018 - DNA, 16 bp, Homo sapiens
ccaggaatttcccagg

SEQ ID NO: 2468019 - DNA, 22 bp, Homo sapiens
ccaggaatttcccaggaccctg

SEQ ID NO: 2468020 - DNA, 23 bp, Homo sapiens
ccaggaatttcccaggaccctga

SEQ ID NO: 2468021 - DNA, 17 bp, Homo sapiens
ccaggacaagcatggtc

SEQ ID NO: 2468022 - DNA, 20 bp, Homo sapiens
ccaggacaagcatggtccca

SEQ ID NO: 2468023 - DNA, 18 bp, Homo sapiens
ccaggaccacaggctcag

SEQ ID NO: 2468024 - DNA, 17 bp, Homo sapiens
ccaggaccagctcagga

SEQ ID NO: 2468025 - DNA, 15 bp, Homo sapiens
ccaggacctggctgc

SEQ ID NO: 2468026 - DNA, 13 bp, Homo sapiens
ccaggactctgca

SEQ ID NO: 2468027 - DNA, 22 bp, Homo sapiens
ccaggagaagctcagctgcatt

SEQ ID NO: 2468028 - DNA, 18 bp, Homo sapiens
ccaggagcacggctctgt

SEQ ID NO: 2468029 - DNA, 22 bp, Homo sapiens
ccaggagcacggctctgtcccc

SEQ ID NO: 2468030 - DNA, 13 bp, Homo sapiens
ccaggagctccag

SEQ ID NO: 2468031 - DNA, 14 bp, Homo sapiens
ccaggagctccagt

SEQ ID NO: 2468032 - DNA, 23 bp, Homo sapiens
ccaggagctccagtgtcctgagc

SEQ ID NO: 2468033 - DNA, 14 bp, Homo sapiens
ccaggaggacccag

SEQ ID NO: 2468034 - DNA, 24 bp, Homo sapiens
ccaggagggacaaaggagcctgtg

SEQ ID NO: 2468035 - DNA, 19 bp, Homo sapiens
ccaggaggtgccactggag

SEQ ID NO: 2468036 - DNA, 18 bp, Homo sapiens
ccaggatagagactggaa

SEQ ID NO: 2468037 - DNA, 12 bp, Homo sapiens
ccaggcaaggct

SEQ ID NO: 2468038 - DNA, 15 bp, Homo sapiens
ccaggcaaggctgtg

SEQ ID NO: 2468039 - DNA, 12 bp, Homo sapiens
ccaggcactgca

SEQ ID NO: 2468040 - DNA, 13 bp, Homo sapiens
ccaggcactgcaa

SEQ ID NO: 2468041 - DNA, 16 bp, Homo sapiens
ccaggcactgctaggc

SEQ ID NO: 2468042 - DNA, 13 bp, Homo sapiens
ccaggcagatcca

SEQ ID NO: 2468043 - DNA, 18 bp, Homo sapiens
ccaggcagatccaggact

SEQ ID NO: 2468044 - DNA, 19 bp, Homo sapiens
ccaggcagatccaggacta

SEQ ID NO: 2468045 - DNA, 17 bp, Homo sapiens
ccaggcaggtctgaagc

SEQ ID NO: 2468046 - DNA, 22 bp, Homo sapiens
ccaggccaggactctgcagcct

SEQ ID NO: 2468047 - DNA, 14 bp, Homo sapiens
ccaggcccaaggct

SEQ ID NO: 2468048 - DNA, 15 bp, Homo sapiens
ccaggcccaaggctc

SEQ ID NO: 2468049 - DNA, 20 bp, Homo sapiens
ccaggccccatgacctccag

SEQ ID NO: 2468050 - DNA, 21 bp, Homo sapiens
ccaggccgggaaaaagcccac

SEQ ID NO: 2468051 - DNA, 23 bp, Homo sapiens
ccaggcctctccctcctccagga

SEQ ID NO: 2468052 - DNA, 12 bp, Homo sapiens
ccaggcgaggcc

SEQ ID NO: 2468053 - DNA, 18 bp, Homo sapiens
ccaggctcgtggactgag

SEQ ID NO: 2468054 - DNA, 20 bp, Homo sapiens
ccaggctcgtggactgagtg

SEQ ID NO: 2468055 - DNA, 21 bp, Homo sapiens
ccaggctcgtggactgagtgg

SEQ ID NO: 2468056 - DNA, 23 bp, Homo sapiens
ccaggctcgtggactgagtggga

SEQ ID NO: 2468057 - DNA, 23 bp, Homo sapiens
ccaggctctcgcacacctctgca

SEQ ID NO: 2468058 - DNA, 13 bp, Homo sapiens
ccaggctgaagca

SEQ ID NO: 2468059 - DNA, 19 bp, Homo sapiens
ccaggctgaccacagcaca

SEQ ID NO: 2468060 - DNA, 21 bp, Homo sapiens
ccaggctgaccacagcacagc

SEQ ID NO: 2468061 - DNA, 23 bp, Homo sapiens
ccaggctgaccacagcacagcca

SEQ ID NO: 2468062 - DNA, 15 bp, Homo sapiens
ccaggctgccgtggg

SEQ ID NO: 2468063 - DNA, 11 bp, Homo sapiens
ccaggctggga

SEQ ID NO: 2468064 - DNA, 14 bp, Homo sapiens
ccaggctggtctca

SEQ ID NO: 2468065 - DNA, 13 bp, Homo sapiens
ccagggacagagg

SEQ ID NO: 2468066 - DNA, 22 bp, Homo sapiens
ccagggacagaggccccagcct

SEQ ID NO: 2468067 - DNA, 15 bp, Homo sapiens
ccagggagagcccag

SEQ ID NO: 2468068 - DNA, 18 bp, Homo sapiens
ccagggagagcccaggag

SEQ ID NO: 2468069 - DNA, 20 bp, Homo sapiens
ccagggagagcccaggagct

SEQ ID NO: 2468070 - DNA, 23 bp, Homo sapiens
ccagggagagcccaggagctccc

SEQ ID NO: 2468071 - DNA, 18 bp, Homo sapiens
ccagggagagggggctgg

SEQ ID NO: 2468072 - DNA, 22 bp, Homo sapiens
ccagggagagggggctggtggg

SEQ ID NO: 2468073 - DNA, 20 bp, Homo sapiens
ccagggcacaggagctacct

SEQ ID NO: 2468074 - DNA, 13 bp, Homo sapiens
ccagggcagccag

SEQ ID NO: 2468075 - DNA, 17 bp, Homo sapiens
ccatgctgaggcctggg

SEQ ID NO: 2468076 - DNA, 18 bp, Homo sapiens
ccatgctgaggcctgggc

SEQ ID NO: 2468077 - DNA, 19 bp, Homo sapiens
ccatgctgctggggaagac

SEQ ID NO: 2468078 - DNA, 22 bp, Homo sapiens
ccatgctgctggggaagacagt

SEQ ID NO: 2468079 - DNA, 23 bp, Homo sapiens
ccatgctgctggggaagacagtg

SEQ ID NO: 2468080 - DNA, 19 bp, Homo sapiens
ccatgctgtgcgcccaggg

SEQ ID NO: 2468081 - DNA, 20 bp, Homo sapiens
ccatgctgtgcgcccagggc

SEQ ID NO: 2468082 - DNA, 15 bp, Homo sapiens
ccatggactctgtcc

SEQ ID NO: 2468083 - DNA, 13 bp, Homo sapiens
ccatggagaaagc

SEQ ID NO: 2468084 - DNA, 18 bp, Homo sapiens
ccatggagattgacctgg

SEQ ID NO: 2468085 - DNA, 19 bp, Homo sapiens
ccatggagtggcagcccag

SEQ ID NO: 2468086 - DNA, 20 bp, Homo sapiens
ccatggccagcagcacctgc

SEQ ID NO: 2468087 - DNA, 16 bp, Homo sapiens
ccatggcctgcaaact

SEQ ID NO: 2468088 - DNA, 16 bp, Homo sapiens
ccatgggcagagccca

SEQ ID NO: 2468089 - DNA, 14 bp, Homo sapiens
ccatgtaactgcct

SEQ ID NO: 2468090 - DNA, 18 bp, Homo sapiens
ccatgtaactgcctagaa

SEQ ID NO: 2468091 - DNA, 16 bp, Homo sapiens
ccatgtagaaaatttg

SEQ ID NO: 2468092 - DNA, 18 bp, Homo sapiens
ccatgtccaaagaggctg

SEQ ID NO: 2468093 - DNA, 20 bp, Homo sapiens
ccatgtcttctccctggaat

SEQ ID NO: 2468094 - DNA, 17 bp, Homo sapiens
ccatgtggtggcacagg

SEQ ID NO: 2468095 - DNA, 17 bp, Homo sapiens
ccatgtgtcctggttcc

SEQ ID NO: 2468096 - DNA, 18 bp, Homo sapiens
ccatgttagccaggctgg

SEQ ID NO: 2468097 - DNA, 22 bp, Homo sapiens
ccatgttctgtcccttgccccc

SEQ ID NO: 2468098 - DNA, 20 bp, Homo sapiens
ccatgttggccaggatggtc

SEQ ID NO: 2468099 - DNA, 13 bp, Homo sapiens
ccatgtttagtga

SEQ ID NO: 2468100 - DNA, 21 bp, Homo sapiens
ccatgtttagtgaatgacttt

SEQ ID NO: 2468101 - DNA, 22 bp, Homo sapiens
ccatgtttagtgaatgactttt

SEQ ID NO: 2468102 - DNA, 10 bp, Homo sapiens
ccattaaacg

SEQ ID NO: 2468103 - DNA, 22 bp, Homo sapiens
ccattaaccagatctagtcaat

SEQ ID NO: 2468104 - DNA, 16 bp, Homo sapiens
ccattaccatgtaatg

SEQ ID NO: 2468105 - DNA, 18 bp, Homo sapiens
ccattcgacctataagaa

SEQ ID NO: 2468106 - DNA, 15 bp, Homo sapiens
ccattcgtgaaaaca

SEQ ID NO: 2468107 - DNA, 15 bp, Homo sapiens
ccattctccacagca

SEQ ID NO: 2468108 - DNA, 13 bp, Homo sapiens
ccattctgctcct

SEQ ID NO: 2468109 - DNA, 14 bp, Homo sapiens
ccattctgctcctt

SEQ ID NO: 2468110 - DNA, 12 bp, Homo sapiens
ccattgaaggct

SEQ ID NO: 2468111 - DNA, 21 bp, Homo sapiens
ccattgaaggcttaaacccat

SEQ ID NO: 2468112 - DNA, 13 bp, Homo sapiens
ccattgaattctt

SEQ ID NO: 2468113 - DNA, 22 bp, Homo sapiens
ccattgaattcttggttgagga

SEQ ID NO: 2468114 - DNA, 24 bp, Homo sapiens
ccattgaggcttggttccttccca

SEQ ID NO: 2468115 - DNA, 20 bp, Homo sapiens
ccattggctatttaaaactt

SEQ ID NO: 2468116 - DNA, 17 bp, Homo sapiens
ccatttacatgttttaa

SEQ ID NO: 2468117 - DNA, 12 bp, Homo sapiens
ccatttctaatt

SEQ ID NO: 2468118 - DNA, 13 bp, Homo sapiens
ccatttctaatta

SEQ ID NO: 2468119 - DNA, 21 bp, Homo sapiens
ccatttctaattatgtagctc

SEQ ID NO: 2468120 - DNA, 19 bp, Homo sapiens
ccatttctgaggtgcactg

SEQ ID NO: 2468121 - DNA, 22 bp, Homo sapiens
ccatttgcatttgtttatgtaa

SEQ ID NO: 2468122 - DNA, 19 bp, Homo sapiens
ccatttggcatccctgggc

SEQ ID NO: 2468123 - DNA, 13 bp, Homo sapiens
ccatttgtactga

SEQ ID NO: 2468124 - DNA, 22 bp, Homo sapiens
ccattttgttattgactaacag

SEQ ID NO: 2468125 - DNA, 22 bp, Homo sapiens
cccaaacaccttccagctcctg

SEQ ID NO: 2468126 - DNA, 23 bp, Homo sapiens
cccaaacgccctttcctcctcag

SEQ ID NO: 2468127 - DNA, 13 bp, Homo sapiens
cccaaagcaagca

SEQ ID NO: 2468128 - DNA, 14 bp, Homo sapiens
cccaaatgagccat

SEQ ID NO: 2468129 - DNA, 15 bp, Homo sapiens
cccaacagctggacc

SEQ ID NO: 2468130 - DNA, 23 bp, Homo sapiens
cccaacagctggaccctgaccag

SEQ ID NO: 2468131 - DNA, 17 bp, Homo sapiens
cccaacccgtggaggct

SEQ ID NO: 2468132 - DNA, 22 bp, Homo sapiens
cccaacccgtggaggctgctcg

SEQ ID NO: 2468133 - DNA, 17 bp, Homo sapiens
cccaacccttccctcac

SEQ ID NO: 2468134 - DNA, 12 bp, Homo sapiens
cccaacgctcca

SEQ ID NO: 2468135 - DNA, 20 bp, Homo sapiens
cccaactctcccctgacctg

SEQ ID NO: 2468136 - DNA, 18 bp, Homo sapiens
cccaagagcatcatgcct

SEQ ID NO: 2468137 - DNA, 20 bp, Homo sapiens
cccaagagcatcatgcctct

SEQ ID NO: 2468138 - DNA, 14 bp, Homo sapiens
cccaagccagaggc

SEQ ID NO: 2468139 - DNA, 15 bp, Homo sapiens
cccaagccagaggct

SEQ ID NO: 2468140 - DNA, 16 bp, Homo sapiens
cccaagcggtgtctct

SEQ ID NO: 2468141 - DNA, 18 bp, Homo sapiens
cccaaggggcctgagcag

SEQ ID NO: 2468142 - DNA, 23 bp, Homo sapiens
cccaagtagctgggattacaggt

SEQ ID NO: 2468143 - DNA, 15 bp, Homo sapiens
cccaagtgaggcagc

SEQ ID NO: 2468144 - DNA, 20 bp, Homo sapiens
cccaagtgagtctctctggg

SEQ ID NO: 2468145 - DNA, 22 bp, Homo sapiens
cccaatttcggattttttccaa

SEQ ID NO: 2468146 - DNA, 19 bp, Homo sapiens
cccacaacccaaaaggttt

SEQ ID NO: 2468147 - DNA, 13 bp, Homo sapiens
cccacaagcctga

SEQ ID NO: 2468148 - DNA, 21 bp, Homo sapiens
cccacactcagatcctcctca

SEQ ID NO: 2468149 - DNA, 19 bp, Homo sapiens
cccacaggacatttctcta

SEQ ID NO: 2468150 - DNA, 14 bp, Homo sapiens
cccacatccctggg

SEQ ID NO: 2468151 - DNA, 17 bp, Homo sapiens
cccacatccctgggcct

SEQ ID NO: 2468152 - DNA, 18 bp, Homo sapiens
cccacatccctgggcctg

SEQ ID NO: 2468153 - DNA, 19 bp, Homo sapiens
cccacatccctgggcctgc

SEQ ID NO: 2468154 - DNA, 24 bp, Homo sapiens
cccacatccctgggcctgctgctg

SEQ ID NO: 2468155 - DNA, 20 bp, Homo sapiens
cccacattggaagagcagca

SEQ ID NO: 2468156 - DNA, 19 bp, Homo sapiens
cccaccaaccctcagggca

SEQ ID NO: 2468157 - DNA, 18 bp, Homo sapiens
cccaccatttggcatccc

SEQ ID NO: 2468158 - DNA, 23 bp, Homo sapiens
cccaccatttggcatccctgggc

SEQ ID NO: 2468159 - DNA, 13 bp, Homo sapiens
cccacccaggcca

SEQ ID NO: 2468160 - DNA, 17 bp, Homo sapiens
cccaccccattcccgca

SEQ ID NO: 2468161 - DNA, 20 bp, Homo sapiens
cccaccctggcctagaccag

SEQ ID NO: 2468162 - DNA, 14 bp, Homo sapiens
cccaccctgggccc

SEQ ID NO: 2468163 - DNA, 15 bp, Homo sapiens
cccaccctgttcctg

SEQ ID NO: 2468164 - DNA, 20 bp, Homo sapiens
cccaccctgttcctgctgct

SEQ ID NO: 2468165 - DNA, 17 bp, Homo sapiens
cccaccgtgggcaggga

SEQ ID NO: 2468166 - DNA, 17 bp, Homo sapiens
cccaccgttgtctcatg

SEQ ID NO: 2468167 - DNA, 20 bp, Homo sapiens
cccaccgttgtctcatgcca

SEQ ID NO: 2468168 - DNA, 20 bp, Homo sapiens
cccacggagtcgtggggtgt

SEQ ID NO: 2468169 - DNA, 23 bp, Homo sapiens
cccactcctctgctgacctgctg

SEQ ID NO: 2468170 - DNA, 16 bp, Homo sapiens
cccactctgctctgat

SEQ ID NO: 2468171 - DNA, 16 bp, Homo sapiens
cccactgacagcctcc

SEQ ID NO: 2468172 - DNA, 14 bp, Homo sapiens
cccactgaccagaa

SEQ ID NO: 2468173 - DNA, 22 bp, Homo sapiens
cccactggagcagaaggggaga

SEQ ID NO: 2468174 - DNA, 15 bp, Homo sapiens
cccactgtgcctcag

SEQ ID NO: 2468175 - DNA, 16 bp, Homo sapiens
cccactgtgcctcaga

SEQ ID NO: 2468176 - DNA, 12 bp, Homo sapiens
cccacttctgca

SEQ ID NO: 2468177 - DNA, 14 bp, Homo sapiens
cccacttgtcctta

SEQ ID NO: 2468178 - DNA, 16 bp, Homo sapiens
ccccaactccttccag

SEQ ID NO: 2468179 - DNA, 18 bp, Homo sapiens
ccccaaggaggcagcctg

SEQ ID NO: 2468180 - DNA, 20 bp, Homo sapiens
ccccaagggaggctgctgct

SEQ ID NO: 2468181 - DNA, 18 bp, Homo sapiens
ccccacaagtgccctcca

SEQ ID NO: 2468182 - DNA, 14 bp, Homo sapiens
ccccacccacttct

SEQ ID NO: 2468183 - DNA, 16 bp, Homo sapiens
ccccacccacttctgc

SEQ ID NO: 2468184 - DNA, 23 bp, Homo sapiens
aggtactttcatattttaaacag

SEQ ID NO: 2468185 - DNA, 17 bp, Homo sapiens
aggtaggggcccctctc

SEQ ID NO: 2468186 - DNA, 22 bp, Homo sapiens
aggtaggggcccctctcagccc

SEQ ID NO: 2468187 - DNA, 20 bp, Homo sapiens
aggtcaaaatagtgccacta

SEQ ID NO: 2468188 - DNA, 17 bp, Homo sapiens
aggtccaatgagctttc

SEQ ID NO: 2468189 - DNA, 20 bp, Homo sapiens
aggtccacaggtctagacta

SEQ ID NO: 2468190 - DNA, 17 bp, Homo sapiens
aggtccctgctgccagc

SEQ ID NO: 2468191 - DNA, 19 bp, Homo sapiens
aggtccggtgttctaagat

SEQ ID NO: 2468192 - DNA, 19 bp, Homo sapiens
aggtcctgagcactgccag

SEQ ID NO: 2468193 - DNA, 17 bp, Homo sapiens
aggtcctggtggggcag

SEQ ID NO: 2468194 - DNA, 22 bp, Homo sapiens
aggtcggtaggttcagccaagg

SEQ ID NO: 2468195 - DNA, 14 bp, Homo sapiens
aggtctcagcccct

SEQ ID NO: 2468196 - DNA, 22 bp, Homo sapiens
aggtctcatctcttcaggttct

SEQ ID NO: 2468197 - DNA, 13 bp, Homo sapiens
aggtctgaaattt

SEQ ID NO: 2468198 - DNA, 18 bp, Homo sapiens
aggtctgggtggggccca

SEQ ID NO: 2468199 - DNA, 21 bp, Homo sapiens
aggtcttcatcgaatctacta

SEQ ID NO: 2468200 - DNA, 19 bp, Homo sapiens
aggtcttggaacttgcctg

SEQ ID NO: 2468201 - DNA, 21 bp, Homo sapiens
aggtcttggaacttgcctgcc

SEQ ID NO: 2468202 - DNA, 20 bp, Homo sapiens
aggtgaaactccagatgcca

SEQ ID NO: 2468203 - DNA, 22 bp, Homo sapiens
aggtgaaactccagatgccaca

SEQ ID NO: 2468204 - DNA, 15 bp, Homo sapiens
aggtgaaaggaaatt

SEQ ID NO: 2468205 - DNA, 19 bp, Homo sapiens
aggtgaaagttaatccact

SEQ ID NO: 2468206 - DNA, 19 bp, Homo sapiens
aggtgaccaaatcagtgtg

SEQ ID NO: 2468207 - DNA, 13 bp, Homo sapiens
aggtgaccccagg

SEQ ID NO: 2468208 - DNA, 14 bp, Homo sapiens
aggtgaccccaggg

SEQ ID NO: 2468209 - DNA, 15 bp, Homo sapiens
aggtgaccccagggc

SEQ ID NO: 2468210 - DNA, 21 bp, Homo sapiens
aggtgaccccagggcacagga

SEQ ID NO: 2468211 - DNA, 24 bp, Homo sapiens
aggtgaccccagggcacaggagct

SEQ ID NO: 2468212 - DNA, 21 bp, Homo sapiens
aggtgactgtctggggagcgg

SEQ ID NO: 2468213 - DNA, 16 bp, Homo sapiens
aggtgcaatttcaagg

SEQ ID NO: 2468214 - DNA, 18 bp, Homo sapiens
aggtgcaatttcaaggtt

SEQ ID NO: 2468215 - DNA, 22 bp, Homo sapiens
aggtgcactgggaggctcccct

SEQ ID NO: 2468216 - DNA, 21 bp, Homo sapiens
aggtgcccagaataagttatt

SEQ ID NO: 2468217 - DNA, 17 bp, Homo sapiens
aggtgcctgtcccaccc

SEQ ID NO: 2468218 - DNA, 18 bp, Homo sapiens
aggtgcctgtcccacccc

SEQ ID NO: 2468219 - DNA, 16 bp, Homo sapiens
aggtgctgacggccag

SEQ ID NO: 2468220 - DNA, 20 bp, Homo sapiens
aggtgctgacggccagggag

SEQ ID NO: 2468221 - DNA, 15 bp, Homo sapiens
aggtggatggcccca

SEQ ID NO: 2468222 - DNA, 23 bp, Homo sapiens
aggtggatggccccagcacagct

SEQ ID NO: 2468223 - DNA, 16 bp, Homo sapiens
aggtggccaagttcct

SEQ ID NO: 2468224 - DNA, 17 bp, Homo sapiens
aggtggccaagttcctc

SEQ ID NO: 2468225 - DNA, 19 bp, Homo sapiens
aggtggccaagttcctcta

SEQ ID NO: 2468226 - DNA, 14 bp, Homo sapiens
aggtggccctactg

SEQ ID NO: 2468227 - DNA, 15 bp, Homo sapiens
aggtgtcctacagaa

SEQ ID NO: 2468228 - DNA, 16 bp, Homo sapiens
aggtgtcctacagaaa

SEQ ID NO: 2468229 - DNA, 17 bp, Homo sapiens
aggtgtcctacagaaaa

SEQ ID NO: 2468230 - DNA, 14 bp, Homo sapiens
aggtgtctcaggct

SEQ ID NO: 2468231 - DNA, 21 bp, Homo sapiens
aggtgtgaaggtgatttaagg

SEQ ID NO: 2468232 - DNA, 20 bp, Homo sapiens
aggtgtggagccgaggccta

SEQ ID NO: 2468233 - DNA, 23 bp, Homo sapiens
aggtgttgccaaatatgtcctgg

SEQ ID NO: 2468234 - DNA, 17 bp, Homo sapiens
aggtgttggctgcacgt

SEQ ID NO: 2468235 - DNA, 13 bp, Homo sapiens
aggttaatattta

SEQ ID NO: 2468236 - DNA, 16 bp, Homo sapiens
aggttaatatttaaga

SEQ ID NO: 2468237 - DNA, 21 bp, Homo sapiens
aggttcatgccaccatggcca

SEQ ID NO: 2468238 - DNA, 14 bp, Homo sapiens
aggttcccaagctc

SEQ ID NO: 2468239 - DNA, 16 bp, Homo sapiens
aggttcccaagctcag

SEQ ID NO: 2468240 - DNA, 11 bp, Homo sapiens
aggttctaaag

SEQ ID NO: 2468241 - DNA, 14 bp, Homo sapiens
aggttctaaagttc

SEQ ID NO: 2468242 - DNA, 16 bp, Homo sapiens
aggttctaaagttcta

SEQ ID NO: 2468243 - DNA, 17 bp, Homo sapiens
aggttctaaagttctaa

SEQ ID NO: 2468244 - DNA, 23 bp, Homo sapiens
aggttctaaagttctaagattct

SEQ ID NO: 2468245 - DNA, 12 bp, Homo sapiens
aggttctaaggc

SEQ ID NO: 2468246 - DNA, 13 bp, Homo sapiens
aggttctaaggcc

SEQ ID NO: 2468247 - DNA, 22 bp, Homo sapiens
aggttctaaggcctaggattct

SEQ ID NO: 2468248 - DNA, 19 bp, Homo sapiens
aggttctaggtttcaaaga

SEQ ID NO: 2468249 - DNA, 20 bp, Homo sapiens
aggttctccgttagctcctg

SEQ ID NO: 2468250 - DNA, 16 bp, Homo sapiens
aggttcttactgcttg

SEQ ID NO: 2468251 - DNA, 24 bp, Homo sapiens
aggttgagctcttcttaaagtatt

SEQ ID NO: 2468252 - DNA, 12 bp, Homo sapiens
aggttgcacact

SEQ ID NO: 2468253 - DNA, 18 bp, Homo sapiens
aggttggctctgccagtc

SEQ ID NO: 2468254 - DNA, 22 bp, Homo sapiens
aggttggctctgccagtcctgt

SEQ ID NO: 2468255 - DNA, 22 bp, Homo sapiens
aggttgtggcctttgcgctcct

SEQ ID NO: 2468256 - DNA, 15 bp, Homo sapiens
aggtttaaagagtct

SEQ ID NO: 2468257 - DNA, 16 bp, Homo sapiens
aggtttaaagagtcta

SEQ ID NO: 2468258 - DNA, 16 bp, Homo sapiens
aggtttatgaaaaaga

SEQ ID NO: 2468259 - DNA, 13 bp, Homo sapiens
aggtttcaaagat

SEQ ID NO: 2468260 - DNA, 17 bp, Homo sapiens
aggtttcaaagatgctg

SEQ ID NO: 2468261 - DNA, 17 bp, Homo sapiens
aggttttggagagtttg

SEQ ID NO: 2468262 - DNA, 16 bp, Homo sapiens
aggttttttttcagtt

SEQ ID NO: 2468263 - DNA, 12 bp, Homo sapiens
agtaaaagcaaa

SEQ ID NO: 2468264 - DNA, 16 bp, Homo sapiens
agtaaaagcaaaaaag

SEQ ID NO: 2468265 - DNA, 15 bp, Homo sapiens
agtaaaccactgaaa

SEQ ID NO: 2468266 - DNA, 17 bp, Homo sapiens
agtaaaccactgaaaaa

SEQ ID NO: 2468267 - DNA, 23 bp, Homo sapiens
agtaaaccactgaaaaaatatat

SEQ ID NO: 2468268 - DNA, 14 bp, Homo sapiens
agtaaataatgctt

SEQ ID NO: 2468269 - DNA, 15 bp, Homo sapiens
agtaaatacaatttt

SEQ ID NO: 2468270 - DNA, 20 bp, Homo sapiens
agtaacaatacaaatggatt

SEQ ID NO: 2468271 - DNA, 23 bp, Homo sapiens
agtaacactaatatatttaaaaa

SEQ ID NO: 2468272 - DNA, 11 bp, Homo sapiens
agtaactgttt

SEQ ID NO: 2468273 - DNA, 17 bp, Homo sapiens
agtaactgttttttaag

SEQ ID NO: 2468274 - DNA, 17 bp, Homo sapiens
agtaacttcttatggaa

SEQ ID NO: 2468275 - DNA, 19 bp, Homo sapiens
agtaacttcttatggaatt

SEQ ID NO: 2468276 - DNA, 13 bp, Homo sapiens
agtaatacaaact

SEQ ID NO: 2468277 - DNA, 19 bp, Homo sapiens
agtaatctaatatggccac

SEQ ID NO: 2468278 - DNA, 23 bp, Homo sapiens
agtaatctgcattattggaatat

SEQ ID NO: 2468279 - DNA, 18 bp, Homo sapiens
agtaatggtgtagaacac

SEQ ID NO: 2468280 - DNA, 22 bp, Homo sapiens
agtaattggtccgatctttgac

SEQ ID NO: 2468281 - DNA, 12 bp, Homo sapiens
agtaatttagaa

SEQ ID NO: 2468282 - DNA, 13 bp, Homo sapiens
agtacagagaagc

SEQ ID NO: 2468283 - DNA, 23 bp, Homo sapiens
agtaccatttaatggggaggaca

SEQ ID NO: 2468284 - DNA, 16 bp, Homo sapiens
agtaccctctcagctc

SEQ ID NO: 2468285 - DNA, 18 bp, Homo sapiens
agtacgaacctacagttt

SEQ ID NO: 2468286 - DNA, 13 bp, Homo sapiens
agtactccacact

SEQ ID NO: 2468287 - DNA, 16 bp, Homo sapiens
agtactccacactgca

SEQ ID NO: 2468288 - DNA, 15 bp, Homo sapiens
agtgaagacagaagt

SEQ ID NO: 2468289 - DNA, 21 bp, Homo sapiens
agtgaagactagaaaattaga

SEQ ID NO: 2468290 - DNA, 14 bp, Homo sapiens
agtgaagttgctgc

SEQ ID NO: 2468291 - DNA, 13 bp, Homo sapiens
agtgaataaatgt

SEQ ID NO: 2468292 - DNA, 20 bp, Homo sapiens
agtgaatactgctacagcaa

SEQ ID NO: 2468293 - DNA, 16 bp, Homo sapiens
agtgaatgattcagtg

SEQ ID NO: 2468294 - DNA, 19 bp, Homo sapiens
agtgaatgattcagtgtta

SEQ ID NO: 2468295 - DNA, 15 bp, Homo sapiens
agtgaattccctcac

SEQ ID NO: 2468296 - DNA, 17 bp, Homo sapiens
agtgaattccctcactc

SEQ ID NO: 2468297 - DNA, 16 bp, Homo sapiens
agtgacagacaggctc

SEQ ID NO: 2468298 - DNA, 17 bp, Homo sapiens
agtgacccacatgccat

SEQ ID NO: 2468299 - DNA, 17 bp, Homo sapiens
agtgacttctgagatct

SEQ ID NO: 2468300 - DNA, 18 bp, Homo sapiens
agtgacttgtgtcccatg

SEQ ID NO: 2468301 - DNA, 21 bp, Homo sapiens
agtgagacccagccctcatcc

SEQ ID NO: 2468302 - DNA, 16 bp, Homo sapiens
agtgaggtgtgtcaca

SEQ ID NO: 2468303 - DNA, 20 bp, Homo sapiens
agtgagtaattttggatttt

SEQ ID NO: 2468304 - DNA, 13 bp, Homo sapiens
agtgagtctctct

SEQ ID NO: 2468305 - DNA, 14 bp, Homo sapiens
agtgagtctctctg

SEQ ID NO: 2468306 - DNA, 15 bp, Homo sapiens
agtgagttttttagt

SEQ ID NO: 2468307 - DNA, 15 bp, Homo sapiens
agtgatagtcttttg

SEQ ID NO: 2468308 - DNA, 16 bp, Homo sapiens
agtgcagtcctgatca

SEQ ID NO: 2468309 - DNA, 22 bp, Homo sapiens
agtgcagtcctgatcagagccg

SEQ ID NO: 2468310 - DNA, 23 bp, Homo sapiens
agtgcagtcctgatcagagccgt

SEQ ID NO: 2468311 - DNA, 18 bp, Homo sapiens
agtgccacttaatgtatg

SEQ ID NO: 2468312 - DNA, 21 bp, Homo sapiens
agtgccacttaatgtatgtta

SEQ ID NO: 2468313 - DNA, 12 bp, Homo sapiens
agtgccctctcc

SEQ ID NO: 2468314 - DNA, 22 bp, Homo sapiens
agtgccctctcccaccctcttc

SEQ ID NO: 2468315 - DNA, 21 bp, Homo sapiens
agtgccctgagccagggtctc

SEQ ID NO: 2468316 - DNA, 18 bp, Homo sapiens
agtgcctgacacactaac

SEQ ID NO: 2468317 - DNA, 18 bp, Homo sapiens
agtgccttcaacacagct

SEQ ID NO: 2468318 - DNA, 17 bp, Homo sapiens
agtgcctttcaggatct

SEQ ID NO: 2468319 - DNA, 19 bp, Homo sapiens
agtgcctttcaggatctat

SEQ ID NO: 2468320 - DNA, 21 bp, Homo sapiens
agtgcctttcaggatctattt

SEQ ID NO: 2468321 - DNA, 13 bp, Homo sapiens
agtgctaaggttc

SEQ ID NO: 2468322 - DNA, 15 bp, Homo sapiens
agtgctaaggttcta

SEQ ID NO: 2468323 - DNA, 17 bp, Homo sapiens
agtgctccctcacatgt

SEQ ID NO: 2468324 - DNA, 17 bp, Homo sapiens
agtgctctgatccctct

SEQ ID NO: 2468325 - DNA, 21 bp, Homo sapiens
agtgctctgatccctctacag

SEQ ID NO: 2468326 - DNA, 14 bp, Homo sapiens
agtgctgaacagtg

SEQ ID NO: 2468327 - DNA, 20 bp, Homo sapiens
agtgctgagattacaggcat

SEQ ID NO: 2468328 - DNA, 20 bp, Homo sapiens
agtgctgggattacaggtgt

SEQ ID NO: 2468329 - DNA, 23 bp, Homo sapiens
agtgctgtcttaaactaaatgtg

SEQ ID NO: 2468330 - DNA, 20 bp, Homo sapiens
agtgctgtttattaatctta

SEQ ID NO: 2468331 - DNA, 22 bp, Homo sapiens
agtgctgtttattaatcttagt

SEQ ID NO: 2468332 - DNA, 20 bp, Homo sapiens
agtgctgttttgttatataa

SEQ ID NO: 2468333 - DNA, 22 bp, Homo sapiens
agtgctgttttgttatataatt

SEQ ID NO: 2468334 - DNA, 23 bp, Homo sapiens
agtgctgttttgttatataattt

SEQ ID NO: 2468335 - DNA, 16 bp, Homo sapiens
agtggactcagggcag

SEQ ID NO: 2468336 - DNA, 14 bp, Homo sapiens
agtggagtctgcca

SEQ ID NO: 2468337 - DNA, 13 bp, Homo sapiens
agtggcagcccag

SEQ ID NO: 2468338 - DNA, 18 bp, Homo sapiens
agtggccaagaagcagtg

SEQ ID NO: 2468339 - DNA, 24 bp, Homo sapiens
agtgggcaaaagcttacaaatact

SEQ ID NO: 2468340 - DNA, 15 bp, Homo sapiens
agtgggttttttagt

SEQ ID NO: 2468341 - DNA, 21 bp, Homo sapiens
agtgggttttttagttgaatt

SEQ ID NO: 2468342 - DNA, 22 bp, Homo sapiens
agtgggttttttagttgaattt

SEQ ID NO: 2468343 - DNA, 15 bp, Homo sapiens
agtggtgtgatctca

SEQ ID NO: 2468344 - DNA, 18 bp, Homo sapiens
agtgtaacaattgtgtag

SEQ ID NO: 2468345 - DNA, 15 bp, Homo sapiens
agtgtagaacctaat

SEQ ID NO: 2468346 - DNA, 15 bp, Homo sapiens
agtgtcaggcactgg

SEQ ID NO: 2468347 - DNA, 22 bp, Homo sapiens
agtgtcctcttccctctctgca

SEQ ID NO: 2468348 - DNA, 18 bp, Homo sapiens
agtgtcctgagccccagg

SEQ ID NO: 2468349 - DNA, 17 bp, Homo sapiens
agtgtcctgagctcagc

SEQ ID NO: 2468350 - DNA, 20 bp, Homo sapiens
agtgtcctgagctcagcgtg

SEQ ID NO: 2468351 - DNA, 23 bp, Homo sapiens
agtgtctttccacggagccactc

SEQ ID NO: 2468352 - DNA, 19 bp, Homo sapiens
agtgtctttttttgtatag

SEQ ID NO: 2468353 - DNA, 20 bp, Homo sapiens
agtgtctttttttgtatagt

SEQ ID NO: 2468354 - DNA, 15 bp, Homo sapiens
agtgtgaggccaggg

SEQ ID NO: 2468355 - DNA, 13 bp, Homo sapiens
agtgtgcaaggca

SEQ ID NO: 2468356 - DNA, 22 bp, Homo sapiens
agtgtgcgtggtggtccctggg

SEQ ID NO: 2468357 - DNA, 15 bp, Homo sapiens
agtgttaaatgtgat

SEQ ID NO: 2468358 - DNA, 21 bp, Homo sapiens
agtgttagccttttttcccca

SEQ ID NO: 2468359 - DNA, 23 bp, Homo sapiens
agtgttatcagtcataactaaat

SEQ ID NO: 2468360 - DNA, 16 bp, Homo sapiens
agtgttccccttccac

SEQ ID NO: 2468361 - DNA, 23 bp, Homo sapiens
agtgttccctatccaatcaatct

SEQ ID NO: 2468362 - DNA, 17 bp, Homo sapiens
agtgttgggtgtaccac

SEQ ID NO: 2468363 - DNA, 13 bp, Homo sapiens
agtgttttctggg

SEQ ID NO: 2468364 - DNA, 12 bp, Homo sapiens
agttaaatgtag

SEQ ID NO: 2468365 - DNA, 20 bp, Homo sapiens
agttaagacatgatttcctt

SEQ ID NO: 2468366 - DNA, 17 bp, Homo sapiens
agttaagacctggcagc

SEQ ID NO: 2468367 - DNA, 16 bp, Homo sapiens
agttaatcttgctttc

SEQ ID NO: 2468368 - DNA, 18 bp, Homo sapiens
agttaatcttgctttctt

SEQ ID NO: 2468369 - DNA, 17 bp, Homo sapiens
agttaatttttccaact

SEQ ID NO: 2468370 - DNA, 14 bp, Homo sapiens
agttacagttctgt

SEQ ID NO: 2468371 - DNA, 19 bp, Homo sapiens
agttaccattaaaccatct

SEQ ID NO: 2468372 - DNA, 11 bp, Homo sapiens
agttactgtgt

SEQ ID NO: 2468373 - DNA, 18 bp, Homo sapiens
agttactgtgtaattagt

SEQ ID NO: 2468374 - DNA, 14 bp, Homo sapiens
agttattaacttta

SEQ ID NO: 2468375 - DNA, 18 bp, Homo sapiens
agttattaagttctttaa

SEQ ID NO: 2468376 - DNA, 17 bp, Homo sapiens
agttcatgtaaataata

SEQ ID NO: 2468377 - DNA, 16 bp, Homo sapiens
agttcatgtctgctat

SEQ ID NO: 2468378 - DNA, 18 bp, Homo sapiens
agttcattagaaatattt

SEQ ID NO: 2468379 - DNA, 23 bp, Homo sapiens
agttcattagaaatattttaaaa

SEQ ID NO: 2468380 - DNA, 13 bp, Homo sapiens
agttccactgaga

SEQ ID NO: 2468381 - DNA, 15 bp, Homo sapiens
agttccactgagacc

SEQ ID NO: 2468382 - DNA, 15 bp, Homo sapiens
agttccagaaagtaa

SEQ ID NO: 2468383 - DNA, 18 bp, Homo sapiens
agttccagaagtgtgact

SEQ ID NO: 2468384 - DNA, 18 bp, Homo sapiens
agttcccacattaaagaa

SEQ ID NO: 2468385 - DNA, 22 bp, Homo sapiens
agttcgactctgtgctggccag

SEQ ID NO: 2468386 - DNA, 13 bp, Homo sapiens
agttcgcagccac

SEQ ID NO: 2468387 - DNA, 17 bp, Homo sapiens
agttcgcagccaccctg

SEQ ID NO: 2468388 - DNA, 18 bp, Homo sapiens
agttctaagactcaaatg

SEQ ID NO: 2468389 - DNA, 23 bp, Homo sapiens
agttctaagactcaaatgttcta

SEQ ID NO: 2468390 - DNA, 14 bp, Homo sapiens
agttctaagattct

SEQ ID NO: 2468391 - DNA, 17 bp, Homo sapiens
ataactcctcattgtaa

SEQ ID NO: 2468392 - DNA, 14 bp, Homo sapiens
ataactcctcccag

SEQ ID NO: 2468393 - DNA, 16 bp, Homo sapiens
ataactcctcccaggg

SEQ ID NO: 2468394 - DNA, 21 bp, Homo sapiens
ataactggaaaacagaacact

SEQ ID NO: 2468395 - DNA, 18 bp, Homo sapiens
ataacttccacagggtcc

SEQ ID NO: 2468396 - DNA, 23 bp, Homo sapiens
ataacttttttttttctttataa

SEQ ID NO: 2468397 - DNA, 14 bp, Homo sapiens
ataagaaacttttt

SEQ ID NO: 2468398 - DNA, 22 bp, Homo sapiens
ataagaaacttttttatttaaa

SEQ ID NO: 2468399 - DNA, 11 bp, Homo sapiens
ataagaaagcc

SEQ ID NO: 2468400 - DNA, 11 bp, Homo sapiens
ataagaagaat

SEQ ID NO: 2468401 - DNA, 19 bp, Homo sapiens
ataagaagaatgcttaatc

SEQ ID NO: 2468402 - DNA, 17 bp, Homo sapiens
ataagaattattttgat

SEQ ID NO: 2468403 - DNA, 15 bp, Homo sapiens
ataagagaatcaaca

SEQ ID NO: 2468404 - DNA, 16 bp, Homo sapiens
ataagagtagaaactg

SEQ ID NO: 2468405 - DNA, 16 bp, Homo sapiens
ataagagttggctggt

SEQ ID NO: 2468406 - DNA, 20 bp, Homo sapiens
ataagatcttttattttgcc

SEQ ID NO: 2468407 - DNA, 13 bp, Homo sapiens
ataagcaggtgga

SEQ ID NO: 2468408 - DNA, 15 bp, Homo sapiens
ataagctatttgatg

SEQ ID NO: 2468409 - DNA, 14 bp, Homo sapiens
ataagcttttcttt

SEQ ID NO: 2468410 - DNA, 13 bp, Homo sapiens
ataaggaaaagct

SEQ ID NO: 2468411 - DNA, 18 bp, Homo sapiens
ataaggtaaaatgccatg

SEQ ID NO: 2468412 - DNA, 16 bp, Homo sapiens
ataagtatttcaaatt

SEQ ID NO: 2468413 - DNA, 18 bp, Homo sapiens
ataagtatttcaaattgg

SEQ ID NO: 2468414 - DNA, 14 bp, Homo sapiens
ataagtcaacagta

SEQ ID NO: 2468415 - DNA, 16 bp, Homo sapiens
ataagtcaacagtaaa

SEQ ID NO: 2468416 - DNA, 19 bp, Homo sapiens
ataagtgtacatatgtgct

SEQ ID NO: 2468417 - DNA, 21 bp, Homo sapiens
ataagttattgcagtttatca

SEQ ID NO: 2468418 - DNA, 21 bp, Homo sapiens
ataagtttctgggacctcagt

SEQ ID NO: 2468419 - DNA, 23 bp, Homo sapiens
ataataaagaatagctttaatga

SEQ ID NO: 2468420 - DNA, 15 bp, Homo sapiens
ataataaatgtacat

SEQ ID NO: 2468421 - DNA, 21 bp, Homo sapiens
ataatactgctgagatacata

SEQ ID NO: 2468422 - DNA, 22 bp, Homo sapiens
ataatcactctaattaattgta

SEQ ID NO: 2468423 - DNA, 21 bp, Homo sapiens
ataatcattattacttttgct

SEQ ID NO: 2468424 - DNA, 21 bp, Homo sapiens
ataatgggattttcttttctt

SEQ ID NO: 2468425 - DNA, 13 bp, Homo sapiens
ataatgtgaaaat

SEQ ID NO: 2468426 - DNA, 19 bp, Homo sapiens
ataatgtgtagttcatgta

SEQ ID NO: 2468427 - DNA, 20 bp, Homo sapiens
ataatgtgtagttcatgtaa

SEQ ID NO: 2468428 - DNA, 23 bp, Homo sapiens
ataatgtgtagttcatgtaaata

SEQ ID NO: 2468429 - DNA, 22 bp, Homo sapiens
ataattcactgtactatcaggt

SEQ ID NO: 2468430 - DNA, 16 bp, Homo sapiens
ataattgcattgactt

SEQ ID NO: 2468431 - DNA, 22 bp, Homo sapiens
ataattgcattgactttcccca

SEQ ID NO: 2468432 - DNA, 23 bp, Homo sapiens
ataattgccaaaaagtgaaataa

SEQ ID NO: 2468433 - DNA, 17 bp, Homo sapiens
ataattggatttcctaa

SEQ ID NO: 2468434 - DNA, 20 bp, Homo sapiens
ataattgtgattagacagaa

SEQ ID NO: 2468435 - DNA, 15 bp, Homo sapiens
ataattgttctcaga

SEQ ID NO: 2468436 - DNA, 15 bp, Homo sapiens
ataattgttgttctg

SEQ ID NO: 2468437 - DNA, 18 bp, Homo sapiens
ataattgttgttctgtta

SEQ ID NO: 2468438 - DNA, 12 bp, Homo sapiens
ataatttctaat

SEQ ID NO: 2468439 - DNA, 23 bp, Homo sapiens
ataattttgtaatgtatcaaata

SEQ ID NO: 2468440 - DNA, 20 bp, Homo sapiens
atacaattttttttattagt

SEQ ID NO: 2468441 - DNA, 11 bp, Homo sapiens
atacacaaatt

SEQ ID NO: 2468442 - DNA, 18 bp, Homo sapiens
atacagaactctttcaaa

SEQ ID NO: 2468443 - DNA, 20 bp, Homo sapiens
atacagaattactgtaactg

SEQ ID NO: 2468444 - DNA, 17 bp, Homo sapiens
atacatacagaattact

SEQ ID NO: 2468445 - DNA, 18 bp, Homo sapiens
atacatgctaagagaagt

SEQ ID NO: 2468446 - DNA, 22 bp, Homo sapiens
atacatgctaagagaagtagaa

SEQ ID NO: 2468447 - DNA, 15 bp, Homo sapiens
atacattatatttct

SEQ ID NO: 2468448 - DNA, 17 bp, Homo sapiens
atacattatatttctat

SEQ ID NO: 2468449 - DNA, 15 bp, Homo sapiens
ataccaaaatgttgc

SEQ ID NO: 2468450 - DNA, 16 bp, Homo sapiens
ataccaaaatgttgct

SEQ ID NO: 2468451 - DNA, 19 bp, Homo sapiens
ataccaatgaaaaaatgta

SEQ ID NO: 2468452 - DNA, 21 bp, Homo sapiens
ataccaatgaaaaaatgtata

SEQ ID NO: 2468453 - DNA, 17 bp, Homo sapiens
ataccacctttactgtg

SEQ ID NO: 2468454 - DNA, 17 bp, Homo sapiens
ataccacgctagggctg

SEQ ID NO: 2468455 - DNA, 14 bp, Homo sapiens
ataccactctgtaa

SEQ ID NO: 2468456 - DNA, 18 bp, Homo sapiens
ataccactctgtaattgc

SEQ ID NO: 2468457 - DNA, 22 bp, Homo sapiens
ataccagcgaggaggctccaga

SEQ ID NO: 2468458 - DNA, 20 bp, Homo sapiens
atacctgtgtttcttgcctc

SEQ ID NO: 2468459 - DNA, 14 bp, Homo sapiens
atacgaaataattg

SEQ ID NO: 2468460 - DNA, 19 bp, Homo sapiens
atacgaaataattgttgtt

SEQ ID NO: 2468461 - DNA, 21 bp, Homo sapiens
atacgaaataattgttgttct

SEQ ID NO: 2468462 - DNA, 23 bp, Homo sapiens
atacgctcagctcatccatgcct

SEQ ID NO: 2468463 - DNA, 13 bp, Homo sapiens
atacggtgggggt

SEQ ID NO: 2468464 - DNA, 15 bp, Homo sapiens
atacggtgggggtag

SEQ ID NO: 2468465 - DNA, 17 bp, Homo sapiens
atactaaaaagaagtgc

SEQ ID NO: 2468466 - DNA, 21 bp, Homo sapiens
atactaagcattgaatggcta

SEQ ID NO: 2468467 - DNA, 21 bp, Homo sapiens
atactaatgaaaacagaatgt

SEQ ID NO: 2468468 - DNA, 15 bp, Homo sapiens
atactaccttgaaaa

SEQ ID NO: 2468469 - DNA, 21 bp, Homo sapiens
atactagggagccatttgaga

SEQ ID NO: 2468470 - DNA, 23 bp, Homo sapiens
atactatgtggatgtgacagtgg

SEQ ID NO: 2468471 - DNA, 21 bp, Homo sapiens
atactattaaaaaggtttaca

SEQ ID NO: 2468472 - DNA, 19 bp, Homo sapiens
atactcaaatgagtaacat

SEQ ID NO: 2468473 - DNA, 20 bp, Homo sapiens
atactcaaatgagtaacatt

SEQ ID NO: 2468474 - DNA, 17 bp, Homo sapiens
atactcatttttcatga

SEQ ID NO: 2468475 - DNA, 17 bp, Homo sapiens
atactctagatgaagtt

SEQ ID NO: 2468476 - DNA, 15 bp, Homo sapiens
atactctttctgtat

SEQ ID NO: 2468477 - DNA, 22 bp, Homo sapiens
atactgcgactttctgcctgga

SEQ ID NO: 2468478 - DNA, 19 bp, Homo sapiens
atactgctgagatacatac

SEQ ID NO: 2468479 - DNA, 21 bp, Homo sapiens
atactgctgagatacatacag

SEQ ID NO: 2468480 - DNA, 16 bp, Homo sapiens
atactgtagtattctt

SEQ ID NO: 2468481 - DNA, 19 bp, Homo sapiens
atactgtatattcaggact

SEQ ID NO: 2468482 - DNA, 11 bp, Homo sapiens
atactgttgca

SEQ ID NO: 2468483 - DNA, 14 bp, Homo sapiens
atactgttgcacgt

SEQ ID NO: 2468484 - DNA, 18 bp, Homo sapiens
atacttgaagggccagag

SEQ ID NO: 2468485 - DNA, 20 bp, Homo sapiens
atacttgaagggccagagcc

SEQ ID NO: 2468486 - DNA, 23 bp, Homo sapiens
atacttgaagggccagagccagg

SEQ ID NO: 2468487 - DNA, 16 bp, Homo sapiens
atacttgtaattatgg

SEQ ID NO: 2468488 - DNA, 17 bp, Homo sapiens
atacttgtaattatgga

SEQ ID NO: 2468489 - DNA, 15 bp, Homo sapiens
atactttccctaccc

SEQ ID NO: 2468490 - DNA, 22 bp, Homo sapiens
atactttccctaccctctagag

SEQ ID NO: 2468491 - DNA, 12 bp, Homo sapiens
atactttgaatg

SEQ ID NO: 2468492 - DNA, 23 bp, Homo sapiens
atactttgaatgtgtttcacagt

SEQ ID NO: 2468493 - DNA, 16 bp, Homo sapiens
atacttttactctgcc

SEQ ID NO: 2468494 - DNA, 14 bp, Homo sapiens
atatttaaaaataa

SEQ ID NO: 2468495 - DNA, 19 bp, Homo sapiens
atatttaaatgtaaagaca

SEQ ID NO: 2468496 - DNA, 17 bp, Homo sapiens
atatttacctcagcctg

SEQ ID NO: 2468497 - DNA, 18 bp, Homo sapiens
atatttacctcagcctgg

SEQ ID NO: 2468498 - DNA, 15 bp, Homo sapiens
atatttgtaaaatga

SEQ ID NO: 2468499 - DNA, 17 bp, Homo sapiens
atatttgtaaaatgaca

SEQ ID NO: 2468500 - DNA, 15 bp, Homo sapiens
atattttaaaatttg

SEQ ID NO: 2468501 - DNA, 20 bp, Homo sapiens
atattttaaagaattgtgtc

SEQ ID NO: 2468502 - DNA, 23 bp, Homo sapiens
atattttagcattttaattctct

SEQ ID NO: 2468503 - DNA, 12 bp, Homo sapiens
atattttctgtt

SEQ ID NO: 2468504 - DNA, 21 bp, Homo sapiens
atatttttttttaagctctga

SEQ ID NO: 2468505 - DNA, 13 bp, Homo sapiens
atcaaaatctctc

SEQ ID NO: 2468506 - DNA, 12 bp, Homo sapiens
atcaaaatgctt

SEQ ID NO: 2468507 - DNA, 22 bp, Homo sapiens
atcaaacaccaacataaaaatg

SEQ ID NO: 2468508 - DNA, 23 bp, Homo sapiens
atcaaacaccaacataaaaatga

SEQ ID NO: 2468509 - DNA, 15 bp, Homo sapiens
atcaaacattttctg

SEQ ID NO: 2468510 - DNA, 16 bp, Homo sapiens
atcaaacattttctgg

SEQ ID NO: 2468511 - DNA, 15 bp, Homo sapiens
atcaaacattttgaa

SEQ ID NO: 2468512 - DNA, 16 bp, Homo sapiens
atcaaacattttgaaa

SEQ ID NO: 2468513 - DNA, 18 bp, Homo sapiens
atcaaaccctagccttgc

SEQ ID NO: 2468514 - DNA, 14 bp, Homo sapiens
atcaaatacattta

SEQ ID NO: 2468515 - DNA, 20 bp, Homo sapiens
atcaaatctaccactgtatg

SEQ ID NO: 2468516 - DNA, 18 bp, Homo sapiens
atcaaatggtatcttttg

SEQ ID NO: 2468517 - DNA, 14 bp, Homo sapiens
atcaaggtcgtttt

SEQ ID NO: 2468518 - DNA, 20 bp, Homo sapiens
atcaagtatttgggaagtga

SEQ ID NO: 2468519 - DNA, 24 bp, Homo sapiens
atcacaaagtggaacgaaaatgaa

SEQ ID NO: 2468520 - DNA, 13 bp, Homo sapiens
atcacacacattg

SEQ ID NO: 2468521 - DNA, 23 bp, Homo sapiens
atcacccagacataaaggaaaag

SEQ ID NO: 2468522 - DNA, 19 bp, Homo sapiens
atcacctactcacacaggc

SEQ ID NO: 2468523 - DNA, 16 bp, Homo sapiens
atcacctagctgaatg

SEQ ID NO: 2468524 - DNA, 20 bp, Homo sapiens
atcacctagctgaatgtttt

SEQ ID NO: 2468525 - DNA, 22 bp, Homo sapiens
atcacctatttccattcaacaa

SEQ ID NO: 2468526 - DNA, 16 bp, Homo sapiens
atcacctcagatggca

SEQ ID NO: 2468527 - DNA, 23 bp, Homo sapiens
atcacctcagatggcagctttta

SEQ ID NO: 2468528 - DNA, 12 bp, Homo sapiens
atcactcaccat

SEQ ID NO: 2468529 - DNA, 17 bp, Homo sapiens
atcactgagttttccat

SEQ ID NO: 2468530 - DNA, 17 bp, Homo sapiens
atcacttaaacttgcat

SEQ ID NO: 2468531 - DNA, 23 bp, Homo sapiens
atcacttaacggaccaaagcaag

SEQ ID NO: 2468532 - DNA, 22 bp, Homo sapiens
atcagaaaggaaaaacaaactc

SEQ ID NO: 2468533 - DNA, 16 bp, Homo sapiens
atcagaaagggagggc

SEQ ID NO: 2468534 - DNA, 19 bp, Homo sapiens
atcagaaagggagggctct

SEQ ID NO: 2468535 - DNA, 19 bp, Homo sapiens
atcagaatagccacatttg

SEQ ID NO: 2468536 - DNA, 16 bp, Homo sapiens
atcagaccataatgtt

SEQ ID NO: 2468537 - DNA, 16 bp, Homo sapiens
atcagactaagccagc

SEQ ID NO: 2468538 - DNA, 17 bp, Homo sapiens
atcagactaagccagca

SEQ ID NO: 2468539 - DNA, 13 bp, Homo sapiens
atcagactgacag

SEQ ID NO: 2468540 - DNA, 14 bp, Homo sapiens
atcagagaaggaac

SEQ ID NO: 2468541 - DNA, 16 bp, Homo sapiens
atcagagtgacatcca

SEQ ID NO: 2468542 - DNA, 19 bp, Homo sapiens
atcagccccaccctggcct

SEQ ID NO: 2468543 - DNA, 16 bp, Homo sapiens
atcagcgtggccttgt

SEQ ID NO: 2468544 - DNA, 13 bp, Homo sapiens
atcagctccttcc

SEQ ID NO: 2468545 - DNA, 15 bp, Homo sapiens
atcagctccttcctg

SEQ ID NO: 2468546 - DNA, 17 bp, Homo sapiens
atcagctccttcctgga

SEQ ID NO: 2468547 - DNA, 20 bp, Homo sapiens
atcaggacccagaggaaggg

SEQ ID NO: 2468548 - DNA, 14 bp, Homo sapiens
atcaggctttctta

SEQ ID NO: 2468549 - DNA, 14 bp, Homo sapiens
atcagtaaataact

SEQ ID NO: 2468550 - DNA, 16 bp, Homo sapiens
atcagtagttcacata

SEQ ID NO: 2468551 - DNA, 19 bp, Homo sapiens
atcagtcataactaaataa

SEQ ID NO: 2468552 - DNA, 16 bp, Homo sapiens
atcagtctcagaatgt

SEQ ID NO: 2468553 - DNA, 18 bp, Homo sapiens
atcagttaagaaatttca

SEQ ID NO: 2468554 - DNA, 19 bp, Homo sapiens
atcagttcattagaaatat

SEQ ID NO: 2468555 - DNA, 21 bp, Homo sapiens
atcagttcattagaaatattt

SEQ ID NO: 2468556 - DNA, 13 bp, Homo sapiens
atcataaggcttc

SEQ ID NO: 2468557 - DNA, 16 bp, Homo sapiens
atcatataataaatgt

SEQ ID NO: 2468558 - DNA, 15 bp, Homo sapiens
atcatcaagagaatt

SEQ ID NO: 2468559 - DNA, 13 bp, Homo sapiens
atcatcctctggc

SEQ ID NO: 2468560 - DNA, 23 bp, Homo sapiens
atcatctcctgccttcctcctgg

SEQ ID NO: 2468561 - DNA, 16 bp, Homo sapiens
atcatgcctctgaggc

SEQ ID NO: 2468562 - DNA, 22 bp, Homo sapiens
atcatgcctctgaggccagcct

SEQ ID NO: 2468563 - DNA, 23 bp, Homo sapiens
atcatgcctctgaggccagcctg

SEQ ID NO: 2468564 - DNA, 12 bp, Homo sapiens
atcatggccagc

SEQ ID NO: 2468565 - DNA, 14 bp, Homo sapiens
atcatgggccagag

SEQ ID NO: 2468566 - DNA, 18 bp, Homo sapiens
atcatgggccagagcctc

SEQ ID NO: 2468567 - DNA, 17 bp, Homo sapiens
atcattatttatgtatt

SEQ ID NO: 2468568 - DNA, 12 bp, Homo sapiens
atcattcaagtg

SEQ ID NO: 2468569 - DNA, 16 bp, Homo sapiens
atcattctctgtctca

SEQ ID NO: 2468570 - DNA, 24 bp, Homo sapiens
atcattctctgtctcatccatcat

SEQ ID NO: 2468571 - DNA, 15 bp, Homo sapiens
atcatttctatttct

SEQ ID NO: 2468572 - DNA, 14 bp, Homo sapiens
atccaagttaaatg

SEQ ID NO: 2468573 - DNA, 22 bp, Homo sapiens
atccaatggactgcataaataa

SEQ ID NO: 2468574 - DNA, 15 bp, Homo sapiens
atccacatttctaaa

SEQ ID NO: 2468575 - DNA, 13 bp, Homo sapiens
atccacctgtctc

SEQ ID NO: 2468576 - DNA, 21 bp, Homo sapiens
atccacctgtctcagcctccc

SEQ ID NO: 2468577 - DNA, 12 bp, Homo sapiens
atccagcctggg

SEQ ID NO: 2468578 - DNA, 23 bp, Homo sapiens
atccaggactatatttgggcctg

SEQ ID NO: 2468579 - DNA, 15 bp, Homo sapiens
atccaggagctccag

SEQ ID NO: 2468580 - DNA, 16 bp, Homo sapiens
atccaggagctccagt

SEQ ID NO: 2468581 - DNA, 16 bp, Homo sapiens
atccagggacagaggc

SEQ ID NO: 2468582 - DNA, 19 bp, Homo sapiens
atccagggacagaggcccc

SEQ ID NO: 2468583 - DNA, 23 bp, Homo sapiens
atccagggaggctggtcctatgg

SEQ ID NO: 2468584 - DNA, 19 bp, Homo sapiens
atccaggttccctcccaga

SEQ ID NO: 2468585 - DNA, 15 bp, Homo sapiens
atccataactgaaca

SEQ ID NO: 2468586 - DNA, 17 bp, Homo sapiens
atccatggccagcagca

SEQ ID NO: 2468587 - DNA, 23 bp, Homo sapiens
atccatggccagcagcacctgcc

SEQ ID NO: 2468588 - DNA, 13 bp, Homo sapiens
atccatttcccct

SEQ ID NO: 2468589 - DNA, 14 bp, Homo sapiens
atccatttctaatt

SEQ ID NO: 2468590 - DNA, 15 bp, Homo sapiens
atccatttctaatta

SEQ ID NO: 2468591 - DNA, 23 bp, Homo sapiens
atccatttctaattatgtagctc

SEQ ID NO: 2468592 - DNA, 16 bp, Homo sapiens
atcccaaaggacagcc

SEQ ID NO: 2468593 - DNA, 15 bp, Homo sapiens
atcccaaagttgttg

SEQ ID NO: 2468594 - DNA, 14 bp, Homo sapiens
atcccacaccctgg

SEQ ID NO: 2468595 - DNA, 18 bp, Homo sapiens
atcccacctccatcccag

SEQ ID NO: 2468596 - DNA, 19 bp, Homo sapiens
atcccagccccctgaccac

SEQ ID NO: 2468597 - DNA, 23 bp, Homo sapiens
atcccatcgtctcggccttcaca

SEQ ID NO: 2468598 - DNA, 18 bp, Homo sapiens
atctggaacccagactca

SEQ ID NO: 2468599 - DNA, 16 bp, Homo sapiens
atctggaacctcagcc

SEQ ID NO: 2468600 - DNA, 21 bp, Homo sapiens
atctggaacctcagcctggcc

SEQ ID NO: 2468601 - DNA, 14 bp, Homo sapiens
atctggagagaaca

SEQ ID NO: 2468602 - DNA, 16 bp, Homo sapiens
atctggagagaacagg

SEQ ID NO: 2468603 - DNA, 14 bp, Homo sapiens
atctggcctggcca

SEQ ID NO: 2468604 - DNA, 12 bp, Homo sapiens
atctggcttctg

SEQ ID NO: 2468605 - DNA, 20 bp, Homo sapiens
atctggcttctggccaggaa

SEQ ID NO: 2468606 - DNA, 22 bp, Homo sapiens
atctggcttctggccaggaagc

SEQ ID NO: 2468607 - DNA, 16 bp, Homo sapiens
atctgggccttggcct

SEQ ID NO: 2468608 - DNA, 19 bp, Homo sapiens
atctgggccttggcctgga

SEQ ID NO: 2468609 - DNA, 13 bp, Homo sapiens
atctgggcttcct

SEQ ID NO: 2468610 - DNA, 15 bp, Homo sapiens
atctgggcttcctgg

SEQ ID NO: 2468611 - DNA, 22 bp, Homo sapiens
atctggggagcaggcagccagc

SEQ ID NO: 2468612 - DNA, 19 bp, Homo sapiens
atctggtagaagggaaagc

SEQ ID NO: 2468613 - DNA, 15 bp, Homo sapiens
atctgtcccccttta

SEQ ID NO: 2468614 - DNA, 17 bp, Homo sapiens
atctgtcctcagccttg

SEQ ID NO: 2468615 - DNA, 22 bp, Homo sapiens
atctgtctgccaacctaaaact

SEQ ID NO: 2468616 - DNA, 16 bp, Homo sapiens
atctgtgcactgccca

SEQ ID NO: 2468617 - DNA, 13 bp, Homo sapiens
atctgtgtcttgt

SEQ ID NO: 2468618 - DNA, 18 bp, Homo sapiens
atctgttttgaaggcaaa

SEQ ID NO: 2468619 - DNA, 18 bp, Homo sapiens
atcttagattctctgtgt

SEQ ID NO: 2468620 - DNA, 20 bp, Homo sapiens
atcttagattctctgtgtct

SEQ ID NO: 2468621 - DNA, 23 bp, Homo sapiens
atcttagattctctgtgtctaag

SEQ ID NO: 2468622 - DNA, 14 bp, Homo sapiens
atcttagtgtatga

SEQ ID NO: 2468623 - DNA, 16 bp, Homo sapiens
atcttataattgttct

SEQ ID NO: 2468624 - DNA, 13 bp, Homo sapiens
atcttctaaatgg

SEQ ID NO: 2468625 - DNA, 16 bp, Homo sapiens
atcttctcaagttcta

SEQ ID NO: 2468626 - DNA, 19 bp, Homo sapiens
atcttctcaagttctaaga

SEQ ID NO: 2468627 - DNA, 12 bp, Homo sapiens
atcttgaaatta

SEQ ID NO: 2468628 - DNA, 22 bp, Homo sapiens
atcttgaaattaagaaggcaaa

SEQ ID NO: 2468629 - DNA, 23 bp, Homo sapiens
atcttgaaattaagaaggcaaaa

SEQ ID NO: 2468630 - DNA, 16 bp, Homo sapiens
atcttgactcactgca

SEQ ID NO: 2468631 - DNA, 13 bp, Homo sapiens
atcttgcatgtaa

SEQ ID NO: 2468632 - DNA, 14 bp, Homo sapiens
atcttgcatgtaac

SEQ ID NO: 2468633 - DNA, 16 bp, Homo sapiens
atcttgctaccagtat

SEQ ID NO: 2468634 - DNA, 20 bp, Homo sapiens
atcttgggggggtggccgct

SEQ ID NO: 2468635 - DNA, 17 bp, Homo sapiens
atcttgtcatgtgtata

SEQ ID NO: 2468636 - DNA, 21 bp, Homo sapiens
atctttaaaagatgcttttaa

SEQ ID NO: 2468637 - DNA, 21 bp, Homo sapiens
atctttacaaaactacatgag

SEQ ID NO: 2468638 - DNA, 22 bp, Homo sapiens
atctttgaaaggttagagaata

SEQ ID NO: 2468639 - DNA, 22 bp, Homo sapiens
atcttttgtattaagaaaggaa

SEQ ID NO: 2468640 - DNA, 18 bp, Homo sapiens
atctttttacctttcata

SEQ ID NO: 2468641 - DNA, 17 bp, Homo sapiens
atgaaaacagaatgtct

SEQ ID NO: 2468642 - DNA, 17 bp, Homo sapiens
atgaaatactatttaaa

SEQ ID NO: 2468643 - DNA, 14 bp, Homo sapiens
atgaacaagagaag

SEQ ID NO: 2468644 - DNA, 18 bp, Homo sapiens
atgaacaagagaagcatt

SEQ ID NO: 2468645 - DNA, 16 bp, Homo sapiens
atgaacagaacataga

SEQ ID NO: 2468646 - DNA, 21 bp, Homo sapiens
atgaacagaacatagacagaa

SEQ ID NO: 2468647 - DNA, 18 bp, Homo sapiens
atgaacccgaggctgaga

SEQ ID NO: 2468648 - DNA, 14 bp, Homo sapiens
atgaactcaacttt

SEQ ID NO: 2468649 - DNA, 22 bp, Homo sapiens
atgaacttagattttacatgaa

SEQ ID NO: 2468650 - DNA, 22 bp, Homo sapiens
atgaagatctaaataaaatgct

SEQ ID NO: 2468651 - DNA, 21 bp, Homo sapiens
atgaagcaaatgtcatgctgc

SEQ ID NO: 2468652 - DNA, 22 bp, Homo sapiens
atgaagcaaatgtcatgctgcc

SEQ ID NO: 2468653 - DNA, 15 bp, Homo sapiens
atgaaggtaaataaa

SEQ ID NO: 2468654 - DNA, 12 bp, Homo sapiens
atgaagtatttt

SEQ ID NO: 2468655 - DNA, 14 bp, Homo sapiens
atgaagttttacat

SEQ ID NO: 2468656 - DNA, 16 bp, Homo sapiens
atgaatgagaatctac

SEQ ID NO: 2468657 - DNA, 12 bp, Homo sapiens
atgaatgtaaat

SEQ ID NO: 2468658 - DNA, 16 bp, Homo sapiens
atgaatgtaaatttgt

SEQ ID NO: 2468659 - DNA, 19 bp, Homo sapiens
atgaatgtaaatttgtact

SEQ ID NO: 2468660 - DNA, 14 bp, Homo sapiens
atgaatgtgaagcc

SEQ ID NO: 2468661 - DNA, 15 bp, Homo sapiens
atgaatgtgaagcct

SEQ ID NO: 2468662 - DNA, 16 bp, Homo sapiens
atgaatgtgaagcctt

SEQ ID NO: 2468663 - DNA, 22 bp, Homo sapiens
atgaatgtttacactctttgta

SEQ ID NO: 2468664 - DNA, 15 bp, Homo sapiens
atgaattattacagt

SEQ ID NO: 2468665 - DNA, 17 bp, Homo sapiens
atgaattattacagtgt

SEQ ID NO: 2468666 - DNA, 14 bp, Homo sapiens
atgacaacttctaa

SEQ ID NO: 2468667 - DNA, 18 bp, Homo sapiens
atgacaacttctaattgc

SEQ ID NO: 2468668 - DNA, 20 bp, Homo sapiens
atgacaacttctaattgcca

SEQ ID NO: 2468669 - DNA, 15 bp, Homo sapiens
atgacaatcatgtgt

SEQ ID NO: 2468670 - DNA, 12 bp, Homo sapiens
atgacacttgta

SEQ ID NO: 2468671 - DNA, 12 bp, Homo sapiens
atgacatgaatt

SEQ ID NO: 2468672 - DNA, 22 bp, Homo sapiens
atgacattaaagaagggttgag

SEQ ID NO: 2468673 - DNA, 14 bp, Homo sapiens
atgaccctgcctct

SEQ ID NO: 2468674 - DNA, 18 bp, Homo sapiens
atgaccctgcctctccca

SEQ ID NO: 2468675 - DNA, 13 bp, Homo sapiens
atgactgaatggg

SEQ ID NO: 2468676 - DNA, 12 bp, Homo sapiens
atgactgcttgc

SEQ ID NO: 2468677 - DNA, 21 bp, Homo sapiens
atgactgcttgccctaagcag

SEQ ID NO: 2468678 - DNA, 22 bp, Homo sapiens
atgactgcttgccctaagcaga

SEQ ID NO: 2468679 - DNA, 23 bp, Homo sapiens
atgacttgggcacccccagcctg

SEQ ID NO: 2468680 - DNA, 15 bp, Homo sapiens
atgagaaagccttct

SEQ ID NO: 2468681 - DNA, 19 bp, Homo sapiens
atgagaaagccttcttttg

SEQ ID NO: 2468682 - DNA, 23 bp, Homo sapiens
atgagaatctacccccagatcca

SEQ ID NO: 2468683 - DNA, 18 bp, Homo sapiens
atgagaccactgttatca

SEQ ID NO: 2468684 - DNA, 23 bp, Homo sapiens
atgagatgatacatccaaagcag

SEQ ID NO: 2468685 - DNA, 24 bp, Homo sapiens
atgagatgatacatccaaagcaga

SEQ ID NO: 2468686 - DNA, 22 bp, Homo sapiens
atgagatgctggcttgggcagc

SEQ ID NO: 2468687 - DNA, 14 bp, Homo sapiens
atgagcatgtttag

SEQ ID NO: 2468688 - DNA, 20 bp, Homo sapiens
atgagctcccacaagcctga

SEQ ID NO: 2468689 - DNA, 13 bp, Homo sapiens
atgagctttctga

SEQ ID NO: 2468690 - DNA, 23 bp, Homo sapiens
atgagctttctgaacagctggtg

SEQ ID NO: 2468691 - DNA, 21 bp, Homo sapiens
atgagctttgtctacttcaaa

SEQ ID NO: 2468692 - DNA, 15 bp, Homo sapiens
atgaggccactggag

SEQ ID NO: 2468693 - DNA, 15 bp, Homo sapiens
atgaggccatggact

SEQ ID NO: 2468694 - DNA, 19 bp, Homo sapiens
atgaggccctccacacctg

SEQ ID NO: 2468695 - DNA, 14 bp, Homo sapiens
atgagggaaaagaa

SEQ ID NO: 2468696 - DNA, 13 bp, Homo sapiens
atgagggcagcag

SEQ ID NO: 2468697 - DNA, 17 bp, Homo sapiens
atgagggcagcagccag

SEQ ID NO: 2468698 - DNA, 19 bp, Homo sapiens
atgagggcagcagccagcc

SEQ ID NO: 2468699 - DNA, 22 bp, Homo sapiens
atgagggcagcagccagccctg

SEQ ID NO: 2468700 - DNA, 16 bp, Homo sapiens
atgagtaacatttgct

SEQ ID NO: 2468701 - DNA, 18 bp, Homo sapiens
atgagtgtattttttaaa

SEQ ID NO: 2468702 - DNA, 15 bp, Homo sapiens
atggagtcttgctct

SEQ ID NO: 2468703 - DNA, 12 bp, Homo sapiens
atggagtgctgt

SEQ ID NO: 2468704 - DNA, 18 bp, Homo sapiens
atggagtgctgttttgtt

SEQ ID NO: 2468705 - DNA, 19 bp, Homo sapiens
atggagtgctgttttgtta

SEQ ID NO: 2468706 - DNA, 18 bp, Homo sapiens
atggagtggcagcccagc

SEQ ID NO: 2468707 - DNA, 20 bp, Homo sapiens
atggagtggcagcccagcca

SEQ ID NO: 2468708 - DNA, 14 bp, Homo sapiens
atggagtttctaag

SEQ ID NO: 2468709 - DNA, 15 bp, Homo sapiens
atggagtttctaagg

SEQ ID NO: 2468710 - DNA, 19 bp, Homo sapiens
atggatgggggaactcaga

SEQ ID NO: 2468711 - DNA, 14 bp, Homo sapiens
atggattctaaaat

SEQ ID NO: 2468712 - DNA, 21 bp, Homo sapiens
atggattttgggagtgactca

SEQ ID NO: 2468713 - DNA, 21 bp, Homo sapiens
atggcagaaggcaaacccatc

SEQ ID NO: 2468714 - DNA, 14 bp, Homo sapiens
atggcagatgtagg

SEQ ID NO: 2468715 - DNA, 11 bp, Homo sapiens
atggcagcagg

SEQ ID NO: 2468716 - DNA, 18 bp, Homo sapiens
atggcagcttttaaaaga

SEQ ID NO: 2468717 - DNA, 22 bp, Homo sapiens
atggcagggggctgctgctggg

SEQ ID NO: 2468718 - DNA, 17 bp, Homo sapiens
atggcataacctgtctc

SEQ ID NO: 2468719 - DNA, 13 bp, Homo sapiens
atggccagcccct

SEQ ID NO: 2468720 - DNA, 15 bp, Homo sapiens
atggcccatcctgtg

SEQ ID NO: 2468721 - DNA, 18 bp, Homo sapiens
atggccccagcacagctt

SEQ ID NO: 2468722 - DNA, 20 bp, Homo sapiens
atggccccagcacagcttga

SEQ ID NO: 2468723 - DNA, 18 bp, Homo sapiens
atggcccctctgacctgc

SEQ ID NO: 2468724 - DNA, 18 bp, Homo sapiens
atggccggagaggaccgg

SEQ ID NO: 2468725 - DNA, 13 bp, Homo sapiens
atggcctcatgtg

SEQ ID NO: 2468726 - DNA, 18 bp, Homo sapiens
atggcctcatgtggctgg

SEQ ID NO: 2468727 - DNA, 18 bp, Homo sapiens
atggcctgcaaactggga

SEQ ID NO: 2468728 - DNA, 22 bp, Homo sapiens
atggcctgcaaactgggaaccc

SEQ ID NO: 2468729 - DNA, 18 bp, Homo sapiens
atggcgtaagtacagaga

SEQ ID NO: 2468730 - DNA, 20 bp, Homo sapiens
atggcgtaagtacagagaag

SEQ ID NO: 2468731 - DNA, 21 bp, Homo sapiens
atggcgtaagtacagagaagc

SEQ ID NO: 2468732 - DNA, 17 bp, Homo sapiens
atgggaacaattgaagt

SEQ ID NO: 2468733 - DNA, 18 bp, Homo sapiens
atgggagacccttgacac

SEQ ID NO: 2468734 - DNA, 14 bp, Homo sapiens
atgggcagagccca

SEQ ID NO: 2468735 - DNA, 21 bp, Homo sapiens
atgggcatcttttgtattaag

SEQ ID NO: 2468736 - DNA, 13 bp, Homo sapiens
atgggcatggtgt

SEQ ID NO: 2468737 - DNA, 17 bp, Homo sapiens
atggggaggacaaaatg

SEQ ID NO: 2468738 - DNA, 14 bp, Homo sapiens
atggggaggaggag

SEQ ID NO: 2468739 - DNA, 11 bp, Homo sapiens
atggggaggga

SEQ ID NO: 2468740 - DNA, 15 bp, Homo sapiens
atggggcaggccacc

SEQ ID NO: 2468741 - DNA, 17 bp, Homo sapiens
atggggcaggccacctg

SEQ ID NO: 2468742 - DNA, 19 bp, Homo sapiens
atggggccagatccagcct

SEQ ID NO: 2468743 - DNA, 21 bp, Homo sapiens
atggggccagatccagcctgg

SEQ ID NO: 2468744 - DNA, 18 bp, Homo sapiens
atgggggaactcagatcc

SEQ ID NO: 2468745 - DNA, 21 bp, Homo sapiens
atgggggaactcagatccagg

SEQ ID NO: 2468746 - DNA, 13 bp, Homo sapiens
atgggggagaggg

SEQ ID NO: 2468747 - DNA, 12 bp, Homo sapiens
atgggtcacagg

SEQ ID NO: 2468748 - DNA, 20 bp, Homo sapiens
atggtaactgctttctgttc

SEQ ID NO: 2468749 - DNA, 18 bp, Homo sapiens
atggtaggcatttcctat

SEQ ID NO: 2468750 - DNA, 18 bp, Homo sapiens
atggtcagccctagggtg

SEQ ID NO: 2468751 - DNA, 16 bp, Homo sapiens
atggtccaggagaagg

SEQ ID NO: 2468752 - DNA, 22 bp, Homo sapiens
atggtcccacatccctgggcct

SEQ ID NO: 2468753 - DNA, 12 bp, Homo sapiens
atggtgaggctg

SEQ ID NO: 2468754 - DNA, 19 bp, Homo sapiens
atggtgcattacgtgggca

SEQ ID NO: 2468755 - DNA, 15 bp, Homo sapiens
atggtgccccaggac

SEQ ID NO: 2468756 - DNA, 14 bp, Homo sapiens
atggtggagggcca

SEQ ID NO: 2468757 - DNA, 22 bp, Homo sapiens
atggtgttctcctgctgctccc

SEQ ID NO: 2468758 - DNA, 18 bp, Homo sapiens
atggttaagagtccaaga

SEQ ID NO: 2468759 - DNA, 20 bp, Homo sapiens
atgtaaaacatttattttga

SEQ ID NO: 2468760 - DNA, 12 bp, Homo sapiens
atgtaaaatctt

SEQ ID NO: 2468761 - DNA, 22 bp, Homo sapiens
atgtaaaatcttgtcatgtgta

SEQ ID NO: 2468762 - DNA, 14 bp, Homo sapiens
atgtaaactgtgca

SEQ ID NO: 2468763 - DNA, 14 bp, Homo sapiens
atgtaaagccatgc

SEQ ID NO: 2468764 - DNA, 20 bp, Homo sapiens
atgtaaaggagtcaaaacta

SEQ ID NO: 2468765 - DNA, 19 bp, Homo sapiens
atgtaaatattttaaagaa

SEQ ID NO: 2468766 - DNA, 21 bp, Homo sapiens
atgtaaatattttaaagaatt

SEQ ID NO: 2468767 - DNA, 19 bp, Homo sapiens
atgtaagattatagattct

SEQ ID NO: 2468768 - DNA, 21 bp, Homo sapiens
atgtaatacttcttgtgtgta

SEQ ID NO: 2468769 - DNA, 17 bp, Homo sapiens
atgtaatggcagttata

SEQ ID NO: 2468770 - DNA, 18 bp, Homo sapiens
atgtaatggcagttatat

SEQ ID NO: 2468771 - DNA, 15 bp, Homo sapiens
atgtaattatttatg

SEQ ID NO: 2468772 - DNA, 23 bp, Homo sapiens
atgtaattatttatgtatggtgc

SEQ ID NO: 2468773 - DNA, 12 bp, Homo sapiens
atgtaattttgt

SEQ ID NO: 2468774 - DNA, 23 bp, Homo sapiens
atgtaattttgtgtaagaaatac

SEQ ID NO: 2468775 - DNA, 20 bp, Homo sapiens
atgtacaaaaaaaaaaccct

SEQ ID NO: 2468776 - DNA, 15 bp, Homo sapiens
atgtacatttctcag

SEQ ID NO: 2468777 - DNA, 15 bp, Homo sapiens
atgtaccatgtacat

SEQ ID NO: 2468778 - DNA, 18 bp, Homo sapiens
atgtaccctctgaaatac

SEQ ID NO: 2468779 - DNA, 19 bp, Homo sapiens
atgtagcatgcttgttgca

SEQ ID NO: 2468780 - DNA, 12 bp, Homo sapiens
atgtagctcttt

SEQ ID NO: 2468781 - DNA, 13 bp, Homo sapiens
atgtagtaacact

SEQ ID NO: 2468782 - DNA, 13 bp, Homo sapiens
atgtagtaattga

SEQ ID NO: 2468783 - DNA, 22 bp, Homo sapiens
atgtagtattttttgtataatt

SEQ ID NO: 2468784 - DNA, 18 bp, Homo sapiens
atgtagttctgctccaga

SEQ ID NO: 2468785 - DNA, 21 bp, Homo sapiens
atgtagtttttatatgttgta

SEQ ID NO: 2468786 - DNA, 12 bp, Homo sapiens
atgtatagtaaa

SEQ ID NO: 2468787 - DNA, 15 bp, Homo sapiens
atgtatagtaaatca

SEQ ID NO: 2468788 - DNA, 21 bp, Homo sapiens
atgtatgggtagggtaaatca

SEQ ID NO: 2468789 - DNA, 12 bp, Homo sapiens
atgtatggtgca

SEQ ID NO: 2468790 - DNA, 17 bp, Homo sapiens
atgtattgcacattgta

SEQ ID NO: 2468791 - DNA, 17 bp, Homo sapiens
atgtattgtgcaatgtg

SEQ ID NO: 2468792 - DNA, 16 bp, Homo sapiens
atgtattttatgttat

SEQ ID NO: 2468793 - DNA, 19 bp, Homo sapiens
atgtcaatttctgtgttgc

SEQ ID NO: 2468794 - DNA, 22 bp, Homo sapiens
atgtcactaaagcaggcctttt

SEQ ID NO: 2468795 - DNA, 17 bp, Homo sapiens
atgtcagtaccttcaaa

SEQ ID NO: 2468796 - DNA, 13 bp, Homo sapiens
atgtcatacagag

SEQ ID NO: 2468797 - DNA, 16 bp, Homo sapiens
atgtcatacagagaag

SEQ ID NO: 2468798 - DNA, 18 bp, Homo sapiens
atgtcatacagagaagtc

SEQ ID NO: 2468799 - DNA, 20 bp, Homo sapiens
atgtcatacagagaagtcac

SEQ ID NO: 2468800 - DNA, 21 bp, Homo sapiens
atgtccaaagaggctgcccct

SEQ ID NO: 2468801 - DNA, 20 bp, Homo sapiens
atgtcctgcctattatctgt

SEQ ID NO: 2468802 - DNA, 21 bp, Homo sapiens
atgtcctgcctattatctgtc

SEQ ID NO: 2468803 - DNA, 17 bp, Homo sapiens
atgtctggttctcaatt

SEQ ID NO: 2468804 - DNA, 21 bp, Homo sapiens
atgtctggttctcaattccaa

SEQ ID NO: 2468805 - DNA, 23 bp, Homo sapiens
atgtctggttctcaattccaaca

SEQ ID NO: 2468806 - DNA, 17 bp, Homo sapiens
attgtatattgtgtttg

SEQ ID NO: 2468807 - DNA, 12 bp, Homo sapiens
attgtattctgg

SEQ ID NO: 2468808 - DNA, 15 bp, Homo sapiens
attgtccttttgcaa

SEQ ID NO: 2468809 - DNA, 16 bp, Homo sapiens
attgtctgaacttgca

SEQ ID NO: 2468810 - DNA, 16 bp, Homo sapiens
attgtcttaatattgt

SEQ ID NO: 2468811 - DNA, 23 bp, Homo sapiens
attgtgatcagaccataatgtta

SEQ ID NO: 2468812 - DNA, 15 bp, Homo sapiens
attgtgattggcctg

SEQ ID NO: 2468813 - DNA, 16 bp, Homo sapiens
attgtgattggcctgt

SEQ ID NO: 2468814 - DNA, 16 bp, Homo sapiens
attgtgcaatgtgtat

SEQ ID NO: 2468815 - DNA, 20 bp, Homo sapiens
attgtggtttatatatttaa

SEQ ID NO: 2468816 - DNA, 14 bp, Homo sapiens
attgtgtagccttt

SEQ ID NO: 2468817 - DNA, 18 bp, Homo sapiens
attgtgtagcctttttgt

SEQ ID NO: 2468818 - DNA, 20 bp, Homo sapiens
attgttacattatgtggaaa

SEQ ID NO: 2468819 - DNA, 19 bp, Homo sapiens
attgttacgtagcctaagg

SEQ ID NO: 2468820 - DNA, 14 bp, Homo sapiens
attgttctcagaat

SEQ ID NO: 2468821 - DNA, 19 bp, Homo sapiens
attgttgagctattgctgt

SEQ ID NO: 2468822 - DNA, 15 bp, Homo sapiens
attgttgtccttttc

SEQ ID NO: 2468823 - DNA, 16 bp, Homo sapiens
attgttgtccttttca

SEQ ID NO: 2468824 - DNA, 19 bp, Homo sapiens
attgttgttctgttaactg

SEQ ID NO: 2468825 - DNA, 18 bp, Homo sapiens
atttaaaaataagtcaac

SEQ ID NO: 2468826 - DNA, 19 bp, Homo sapiens
atttaaaaataagtcaaca

SEQ ID NO: 2468827 - DNA, 13 bp, Homo sapiens
atttaaaactgtt

SEQ ID NO: 2468828 - DNA, 14 bp, Homo sapiens
atttaaaagcctgc

SEQ ID NO: 2468829 - DNA, 15 bp, Homo sapiens
atttaaaagtgtcaa

SEQ ID NO: 2468830 - DNA, 15 bp, Homo sapiens
atttaaaatagcaaa

SEQ ID NO: 2468831 - DNA, 21 bp, Homo sapiens
atttaaaatagcaaaagaaga

SEQ ID NO: 2468832 - DNA, 12 bp, Homo sapiens
atttaaagcagg

SEQ ID NO: 2468833 - DNA, 15 bp, Homo sapiens
atttaaagcaggttc

SEQ ID NO: 2468834 - DNA, 15 bp, Homo sapiens
atttaaagcctcctc

SEQ ID NO: 2468835 - DNA, 16 bp, Homo sapiens
atttaacagaaattgt

SEQ ID NO: 2468836 - DNA, 17 bp, Homo sapiens
atttaacagaaattgta

SEQ ID NO: 2468837 - DNA, 18 bp, Homo sapiens
atttaacagaaattgtat

SEQ ID NO: 2468838 - DNA, 18 bp, Homo sapiens
atttaacccccctgtaca

SEQ ID NO: 2468839 - DNA, 23 bp, Homo sapiens
atttaacttttagtaaagtcaag

SEQ ID NO: 2468840 - DNA, 15 bp, Homo sapiens
atttaagataattat

SEQ ID NO: 2468841 - DNA, 23 bp, Homo sapiens
atttaatataaagttttatatat

SEQ ID NO: 2468842 - DNA, 17 bp, Homo sapiens
atttaatggggaggaca

SEQ ID NO: 2468843 - DNA, 12 bp, Homo sapiens
atttaattcaga

SEQ ID NO: 2468844 - DNA, 15 bp, Homo sapiens
atttacaggaacttc

SEQ ID NO: 2468845 - DNA, 19 bp, Homo sapiens
atttacatgttttaaagaa

SEQ ID NO: 2468846 - DNA, 14 bp, Homo sapiens
atttacctaagatt

SEQ ID NO: 2468847 - DNA, 15 bp, Homo sapiens
atttacctaagatta

SEQ ID NO: 2468848 - DNA, 18 bp, Homo sapiens
atttacctaagattacaa

SEQ ID NO: 2468849 - DNA, 12 bp, Homo sapiens
atttacctcagc

SEQ ID NO: 2468850 - DNA, 13 bp, Homo sapiens
atttagaaaactt

SEQ ID NO: 2468851 - DNA, 12 bp, Homo sapiens
atttagaagcca

SEQ ID NO: 2468852 - DNA, 13 bp, Homo sapiens
atttagaagccaa

SEQ ID NO: 2468853 - DNA, 23 bp, Homo sapiens
atttagaagccaactatgattat

SEQ ID NO: 2468854 - DNA, 21 bp, Homo sapiens
atttagctaaacggattccaa

SEQ ID NO: 2468855 - DNA, 17 bp, Homo sapiens
atttaggagaagccagg

SEQ ID NO: 2468856 - DNA, 14 bp, Homo sapiens
atttagtcatgtga

SEQ ID NO: 2468857 - DNA, 22 bp, Homo sapiens
atttataaatatatttaagata

SEQ ID NO: 2468858 - DNA, 14 bp, Homo sapiens
atttatatatgtat

SEQ ID NO: 2468859 - DNA, 15 bp, Homo sapiens
atttatatgtacatg

SEQ ID NO: 2468860 - DNA, 16 bp, Homo sapiens
atttatatgtacatga

SEQ ID NO: 2468861 - DNA, 17 bp, Homo sapiens
atttatatgtacatgag

SEQ ID NO: 2468862 - DNA, 17 bp, Homo sapiens
atttatcgcagaccttt

SEQ ID NO: 2468863 - DNA, 21 bp, Homo sapiens
atttatcgctgggaaatgaga

SEQ ID NO: 2468864 - DNA, 10 bp, Homo sapiens
atttatctat

SEQ ID NO: 2468865 - DNA, 15 bp, Homo sapiens
atttatgtccaggtg

SEQ ID NO: 2468866 - DNA, 20 bp, Homo sapiens
atttattaatatatattatc

SEQ ID NO: 2468867 - DNA, 19 bp, Homo sapiens
atttattgactttgacaat

SEQ ID NO: 2468868 - DNA, 14 bp, Homo sapiens
atttattggttttg

SEQ ID NO: 2468869 - DNA, 14 bp, Homo sapiens
atttatttaaaata

SEQ ID NO: 2468870 - DNA, 13 bp, Homo sapiens
atttattttgaca

SEQ ID NO: 2468871 - DNA, 22 bp, Homo sapiens
atttattttttcttttctttac

SEQ ID NO: 2468872 - DNA, 13 bp, Homo sapiens
atttcaaaatgct

SEQ ID NO: 2468873 - DNA, 17 bp, Homo sapiens
atttcaaattggagctt

SEQ ID NO: 2468874 - DNA, 18 bp, Homo sapiens
atttcaacatgagtgtat

SEQ ID NO: 2468875 - DNA, 14 bp, Homo sapiens
atttcactggagca

SEQ ID NO: 2468876 - DNA, 16 bp, Homo sapiens
atttcactggagcaca

SEQ ID NO: 2468877 - DNA, 22 bp, Homo sapiens
atttcactgtctttaattctgt

SEQ ID NO: 2468878 - DNA, 18 bp, Homo sapiens
atttcagactcccattcc

SEQ ID NO: 2468879 - DNA, 19 bp, Homo sapiens
atttcaggaggaatactga

SEQ ID NO: 2468880 - DNA, 16 bp, Homo sapiens
atttcagttctaggaa

SEQ ID NO: 2468881 - DNA, 18 bp, Homo sapiens
atttcagttctaggaaaa

SEQ ID NO: 2468882 - DNA, 15 bp, Homo sapiens
atttcatagttcaga

SEQ ID NO: 2468883 - DNA, 19 bp, Homo sapiens
atttcatagttcagaattt

SEQ ID NO: 2468884 - DNA, 15 bp, Homo sapiens
atttcatgattagaa

SEQ ID NO: 2468885 - DNA, 19 bp, Homo sapiens
atttccaactcgaatctgt

SEQ ID NO: 2468886 - DNA, 12 bp, Homo sapiens
atttcccaggac

SEQ ID NO: 2468887 - DNA, 14 bp, Homo sapiens
atttcccaggaccc

SEQ ID NO: 2468888 - DNA, 16 bp, Homo sapiens
atttcccaggaccctg

SEQ ID NO: 2468889 - DNA, 15 bp, Homo sapiens
atttcccctccttcc

SEQ ID NO: 2468890 - DNA, 18 bp, Homo sapiens
atttcctatcacctattt

SEQ ID NO: 2468891 - DNA, 19 bp, Homo sapiens
atttcggattttttccaaa

SEQ ID NO: 2468892 - DNA, 20 bp, Homo sapiens
atttcggattttttccaaaa

SEQ ID NO: 2468893 - DNA, 18 bp, Homo sapiens
atttctaatgttggacac

SEQ ID NO: 2468894 - DNA, 18 bp, Homo sapiens
atttctactttgaagtca

SEQ ID NO: 2468895 - DNA, 20 bp, Homo sapiens
atttctatttctcctccatg

SEQ ID NO: 2468896 - DNA, 22 bp, Homo sapiens
atttctgcatatgttgaatact

SEQ ID NO: 2468897 - DNA, 13 bp, Homo sapiens
atttctgcctccc

SEQ ID NO: 2468898 - DNA, 11 bp, Homo sapiens
atttctgtgtt

SEQ ID NO: 2468899 - DNA, 23 bp, Homo sapiens
atttctgtgttgccaagctccaa

SEQ ID NO: 2468900 - DNA, 14 bp, Homo sapiens
atttcttaacttct

SEQ ID NO: 2468901 - DNA, 17 bp, Homo sapiens
atttcttaacttcttgc

SEQ ID NO: 2468902 - DNA, 16 bp, Homo sapiens
atttctttgaaaaaaa

SEQ ID NO: 2468903 - DNA, 22 bp, Homo sapiens
atttctttgaaaaaaaataaat

SEQ ID NO: 2468904 - DNA, 15 bp, Homo sapiens
atttgaaataagaat

SEQ ID NO: 2468905 - DNA, 20 bp, Homo sapiens
atttgaactttttattgatt

SEQ ID NO: 2468906 - DNA, 16 bp, Homo sapiens
atttgagtgctctgat

SEQ ID NO: 2468907 - DNA, 13 bp, Homo sapiens
atttgatgtaata

SEQ ID NO: 2468908 - DNA, 18 bp, Homo sapiens
atttgatgtaatacttct

SEQ ID NO: 2468909 - DNA, 16 bp, Homo sapiens
atttgattgatttgaa

SEQ ID NO: 2468910 - DNA, 20 bp, Homo sapiens
atttgcaagggaaaagtctc

SEQ ID NO: 2468911 - DNA, 22 bp, Homo sapiens
caacagttttttatgctaatca

SEQ ID NO: 2468912 - DNA, 19 bp, Homo sapiens
caacatgaggccactggag

SEQ ID NO: 2468913 - DNA, 15 bp, Homo sapiens
caacatgcactgatg

SEQ ID NO: 2468914 - DNA, 13 bp, Homo sapiens
caacatggctttg

SEQ ID NO: 2468915 - DNA, 20 bp, Homo sapiens
caacatgtttccagcattcc

SEQ ID NO: 2468916 - DNA, 14 bp, Homo sapiens
caaccactggtctg

SEQ ID NO: 2468917 - DNA, 22 bp, Homo sapiens
caaccactggtctgtagggatt

SEQ ID NO: 2468918 - DNA, 18 bp, Homo sapiens
caaccatgagaccactgt

SEQ ID NO: 2468919 - DNA, 13 bp, Homo sapiens
caaccccaggctg

SEQ ID NO: 2468920 - DNA, 20 bp, Homo sapiens
caacccgtctggcccaccag

SEQ ID NO: 2468921 - DNA, 18 bp, Homo sapiens
caacccgtggaggctgct

SEQ ID NO: 2468922 - DNA, 12 bp, Homo sapiens
caaccctcaggg

SEQ ID NO: 2468923 - DNA, 18 bp, Homo sapiens
caacccttccctcacctt

SEQ ID NO: 2468924 - DNA, 15 bp, Homo sapiens
caaccgtggcccttc

SEQ ID NO: 2468925 - DNA, 18 bp, Homo sapiens
caaccgtggcccttcctg

SEQ ID NO: 2468926 - DNA, 19 bp, Homo sapiens
caaccgtggcccttcctgg

SEQ ID NO: 2468927 - DNA, 20 bp, Homo sapiens
caaccgtggcccttcctgga

SEQ ID NO: 2468928 - DNA, 13 bp, Homo sapiens
caacctaaaactc

SEQ ID NO: 2468929 - DNA, 15 bp, Homo sapiens
caacctcagtaattt

SEQ ID NO: 2468930 - DNA, 18 bp, Homo sapiens
caacctcagtaatttaga

SEQ ID NO: 2468931 - DNA, 20 bp, Homo sapiens
caacctccacctcctgggtt

SEQ ID NO: 2468932 - DNA, 17 bp, Homo sapiens
caacctgcaaagatctg

SEQ ID NO: 2468933 - DNA, 20 bp, Homo sapiens
caacgtgctctttgttttgt

SEQ ID NO: 2468934 - DNA, 13 bp, Homo sapiens
caactactaatag

SEQ ID NO: 2468935 - DNA, 15 bp, Homo sapiens
caactactaatagaa

SEQ ID NO: 2468936 - DNA, 17 bp, Homo sapiens
caactactgtgttatgc

SEQ ID NO: 2468937 - DNA, 18 bp, Homo sapiens
caactagcccctggggtg

SEQ ID NO: 2468938 - DNA, 14 bp, Homo sapiens
caactattttcaga

SEQ ID NO: 2468939 - DNA, 16 bp, Homo sapiens
caactcactcctttta

SEQ ID NO: 2468940 - DNA, 20 bp, Homo sapiens
caactcactccttttaaaga

SEQ ID NO: 2468941 - DNA, 23 bp, Homo sapiens
caactcactccttttaaagaaaa

SEQ ID NO: 2468942 - DNA, 16 bp, Homo sapiens
caactcctagttctag

SEQ ID NO: 2468943 - DNA, 22 bp, Homo sapiens
caactcctagttctagaaaaac

SEQ ID NO: 2468944 - DNA, 23 bp, Homo sapiens
caactcctagttctagaaaaaca

SEQ ID NO: 2468945 - DNA, 12 bp, Homo sapiens
caactcttgatt

SEQ ID NO: 2468946 - DNA, 15 bp, Homo sapiens
caactctttgagaaa

SEQ ID NO: 2468947 - DNA, 19 bp, Homo sapiens
caactgctcccacctcctg

SEQ ID NO: 2468948 - DNA, 22 bp, Homo sapiens
caactgctcccacctcctgaca

SEQ ID NO: 2468949 - DNA, 14 bp, Homo sapiens
caactggcaggcag

SEQ ID NO: 2468950 - DNA, 19 bp, Homo sapiens
caactggccctatttagat

SEQ ID NO: 2468951 - DNA, 21 bp, Homo sapiens
caactgtctcgatgcaatgaa

SEQ ID NO: 2468952 - DNA, 22 bp, Homo sapiens
caacttaatactcaaatgagta

SEQ ID NO: 2468953 - DNA, 11 bp, Homo sapiens
caacttattaa

SEQ ID NO: 2468954 - DNA, 16 bp, Homo sapiens
caacttggctgcagga

SEQ ID NO: 2468955 - DNA, 19 bp, Homo sapiens
caacttgtcctagcacaga

SEQ ID NO: 2468956 - DNA, 17 bp, Homo sapiens
caagaaaaataaagaaa

SEQ ID NO: 2468957 - DNA, 18 bp, Homo sapiens
caagaaaaataaagaaaa

SEQ ID NO: 2468958 - DNA, 16 bp, Homo sapiens
caagaaaacaggcact

SEQ ID NO: 2468959 - DNA, 19 bp, Homo sapiens
caagaaaacaggcactgcc

SEQ ID NO: 2468960 - DNA, 18 bp, Homo sapiens
caagaaataagtttttgt

SEQ ID NO: 2468961 - DNA, 17 bp, Homo sapiens
caagaagcattttgtaa

SEQ ID NO: 2468962 - DNA, 12 bp, Homo sapiens
caagaaggattt

SEQ ID NO: 2468963 - DNA, 19 bp, Homo sapiens
caagaatagcattgtaaaa

SEQ ID NO: 2468964 - DNA, 21 bp, Homo sapiens
caagaatccacatttctaaaa

SEQ ID NO: 2468965 - DNA, 22 bp, Homo sapiens
caagaatccacatttctaaaat

SEQ ID NO: 2468966 - DNA, 13 bp, Homo sapiens
caagacccccagc

SEQ ID NO: 2468967 - DNA, 15 bp, Homo sapiens
caagacccccagcac

SEQ ID NO: 2468968 - DNA, 21 bp, Homo sapiens
caagactctagagtccaaggt

SEQ ID NO: 2468969 - DNA, 16 bp, Homo sapiens
caagactgacgccagg

SEQ ID NO: 2468970 - DNA, 20 bp, Homo sapiens
caagactgctgtggccagga

SEQ ID NO: 2468971 - DNA, 23 bp, Homo sapiens
caagactgctgtggccaggaggt

SEQ ID NO: 2468972 - DNA, 20 bp, Homo sapiens
caagacttctctttgcctca

SEQ ID NO: 2468973 - DNA, 14 bp, Homo sapiens
caagagaagcattc

SEQ ID NO: 2468974 - DNA, 16 bp, Homo sapiens
caagagaagcattctc

SEQ ID NO: 2468975 - DNA, 22 bp, Homo sapiens
caagagaagcattctcattgga

SEQ ID NO: 2468976 - DNA, 13 bp, Homo sapiens
caagagataactg

SEQ ID NO: 2468977 - DNA, 13 bp, Homo sapiens
caagagccctgtc

SEQ ID NO: 2468978 - DNA, 21 bp, Homo sapiens
caagaggagcccccaccctgt

SEQ ID NO: 2468979 - DNA, 20 bp, Homo sapiens
caagagtgaattccctcact

SEQ ID NO: 2468980 - DNA, 23 bp, Homo sapiens
caagatattttaaaatctgtcac

SEQ ID NO: 2468981 - DNA, 19 bp, Homo sapiens
caagatggaatttatcaaa

SEQ ID NO: 2468982 - DNA, 19 bp, Homo sapiens
caagattccggatcctaag

SEQ ID NO: 2468983 - DNA, 18 bp, Homo sapiens
caagattctagatgatta

SEQ ID NO: 2468984 - DNA, 20 bp, Homo sapiens
caagattggtgtttttttct

SEQ ID NO: 2468985 - DNA, 13 bp, Homo sapiens
caagcacagcagc

SEQ ID NO: 2468986 - DNA, 14 bp, Homo sapiens
caagcacttctttt

SEQ ID NO: 2468987 - DNA, 17 bp, Homo sapiens
caagcaggaaatgaaaa

SEQ ID NO: 2468988 - DNA, 15 bp, Homo sapiens
caagcagtcgtgcct

SEQ ID NO: 2468989 - DNA, 21 bp, Homo sapiens
caagcagtcgtgcctgtgtcc

SEQ ID NO: 2468990 - DNA, 21 bp, Homo sapiens
caagcatcttgggggggtggc

SEQ ID NO: 2468991 - DNA, 21 bp, Homo sapiens
caagccaagggaacctgtgtc

SEQ ID NO: 2468992 - DNA, 22 bp, Homo sapiens
caagccaagggaacctgtgtcc

SEQ ID NO: 2468993 - DNA, 13 bp, Homo sapiens
caagccagaactt

SEQ ID NO: 2468994 - DNA, 20 bp, Homo sapiens
caagccatcttgagtggtca

SEQ ID NO: 2468995 - DNA, 18 bp, Homo sapiens
caagcctgagggaaaggc

SEQ ID NO: 2468996 - DNA, 15 bp, Homo sapiens
caagcgattctcttg

SEQ ID NO: 2468997 - DNA, 16 bp, Homo sapiens
caagcggtgtctctcc

SEQ ID NO: 2468998 - DNA, 16 bp, Homo sapiens
caagctaagcactgcc

SEQ ID NO: 2468999 - DNA, 17 bp, Homo sapiens
caagctctgagggaaag

SEQ ID NO: 2469000 - DNA, 23 bp, Homo sapiens
caagctctgagggaaagggccct

SEQ ID NO: 2469001 - DNA, 15 bp, Homo sapiens
caagctgaggtgccc

SEQ ID NO: 2469002 - DNA, 18 bp, Homo sapiens
caagctgaggtgcccagg

SEQ ID NO: 2469003 - DNA, 20 bp, Homo sapiens
caagctgaggtgcccaggag

SEQ ID NO: 2469004 - DNA, 20 bp, Homo sapiens
caagcttaatggctgataat

SEQ ID NO: 2469005 - DNA, 12 bp, Homo sapiens
caaggaagtcaa

SEQ ID NO: 2469006 - DNA, 12 bp, Homo sapiens
caaggaatttct

SEQ ID NO: 2469007 - DNA, 15 bp, Homo sapiens
caaggaatttcttaa

SEQ ID NO: 2469008 - DNA, 18 bp, Homo sapiens
caaggaatttcttaactt

SEQ ID NO: 2469009 - DNA, 23 bp, Homo sapiens
caaggacttcctgtccagctcca

SEQ ID NO: 2469010 - DNA, 15 bp, Homo sapiens
caaggactttgcagc

SEQ ID NO: 2469011 - DNA, 14 bp, Homo sapiens
caaggaggcagcct

SEQ ID NO: 2469012 - DNA, 16 bp, Homo sapiens
caaggatagatgctgg

SEQ ID NO: 2469013 - DNA, 13 bp, Homo sapiens
caaggcagaggcc

SEQ ID NO: 2469014 - DNA, 14 bp, Homo sapiens
caaggcagaggcct

SEQ ID NO: 2469015 - DNA, 17 bp, Homo sapiens
cacctcagatggcagct

SEQ ID NO: 2469016 - DNA, 14 bp, Homo sapiens
cacctccccagcat

SEQ ID NO: 2469017 - DNA, 16 bp, Homo sapiens
cacctccccagcattc

SEQ ID NO: 2469018 - DNA, 14 bp, Homo sapiens
cacctccccttggg

SEQ ID NO: 2469019 - DNA, 16 bp, Homo sapiens
cacctcctcagcctga

SEQ ID NO: 2469020 - DNA, 13 bp, Homo sapiens
cacctccttccct

SEQ ID NO: 2469021 - DNA, 16 bp, Homo sapiens
cacctctaacagcacc

SEQ ID NO: 2469022 - DNA, 17 bp, Homo sapiens
cacctgacacaccaggc

SEQ ID NO: 2469023 - DNA, 20 bp, Homo sapiens
cacctgacacaccaggcgct

SEQ ID NO: 2469024 - DNA, 16 bp, Homo sapiens
cacctgcactaacaga

SEQ ID NO: 2469025 - DNA, 20 bp, Homo sapiens
cacctgcctcaggactgcga

SEQ ID NO: 2469026 - DNA, 14 bp, Homo sapiens
cacctgcctccagc

SEQ ID NO: 2469027 - DNA, 17 bp, Homo sapiens
cacctgcctccagccgc

SEQ ID NO: 2469028 - DNA, 23 bp, Homo sapiens
cacctgctgtctgggtggctcac

SEQ ID NO: 2469029 - DNA, 15 bp, Homo sapiens
cacctggacccctgc

SEQ ID NO: 2469030 - DNA, 16 bp, Homo sapiens
cacctggccctgcttc

SEQ ID NO: 2469031 - DNA, 17 bp, Homo sapiens
cacctgggagaaatctg

SEQ ID NO: 2469032 - DNA, 17 bp, Homo sapiens
cacctgggccctggggc

SEQ ID NO: 2469033 - DNA, 19 bp, Homo sapiens
cacctgggccctggggcct

SEQ ID NO: 2469034 - DNA, 16 bp, Homo sapiens
cacctggtggccatgc

SEQ ID NO: 2469035 - DNA, 15 bp, Homo sapiens
cacctgtctcagcct

SEQ ID NO: 2469036 - DNA, 18 bp, Homo sapiens
cacctgtctcagcctccc

SEQ ID NO: 2469037 - DNA, 15 bp, Homo sapiens
caccttccagctcct

SEQ ID NO: 2469038 - DNA, 18 bp, Homo sapiens
caccttccagctcctgta

SEQ ID NO: 2469039 - DNA, 18 bp, Homo sapiens
caccttcccactttccca

SEQ ID NO: 2469040 - DNA, 12 bp, Homo sapiens
caccttctgagt

SEQ ID NO: 2469041 - DNA, 18 bp, Homo sapiens
caccttggacatcctcct

SEQ ID NO: 2469042 - DNA, 13 bp, Homo sapiens
cacctttactgtg

SEQ ID NO: 2469043 - DNA, 22 bp, Homo sapiens
cacctttactgtgcttattttt

SEQ ID NO: 2469044 - DNA, 19 bp, Homo sapiens
cacctttgtttctccccca

SEQ ID NO: 2469045 - DNA, 16 bp, Homo sapiens
cacgaaatgttatttt

SEQ ID NO: 2469046 - DNA, 15 bp, Homo sapiens
cacgacactgcagcc

SEQ ID NO: 2469047 - DNA, 14 bp, Homo sapiens
cacgacagtggatg

SEQ ID NO: 2469048 - DNA, 20 bp, Homo sapiens
cacgagctgtttactaggga

SEQ ID NO: 2469049 - DNA, 13 bp, Homo sapiens
cacgagggctggc

SEQ ID NO: 2469050 - DNA, 17 bp, Homo sapiens
cacgagggctggctggc

SEQ ID NO: 2469051 - DNA, 22 bp, Homo sapiens
cacgagggctggctggcctcac

SEQ ID NO: 2469052 - DNA, 12 bp, Homo sapiens
cacgcacctgcc

SEQ ID NO: 2469053 - DNA, 16 bp, Homo sapiens
cacgcacctgcctcag

SEQ ID NO: 2469054 - DNA, 14 bp, Homo sapiens
cacgctccagctgc

SEQ ID NO: 2469055 - DNA, 19 bp, Homo sapiens
cacgctccagctgccccgg

SEQ ID NO: 2469056 - DNA, 20 bp, Homo sapiens
cacggaccaaagggagtctg

SEQ ID NO: 2469057 - DNA, 21 bp, Homo sapiens
cacggaccaaagggagtctgc

SEQ ID NO: 2469058 - DNA, 15 bp, Homo sapiens
cacggagccactcct

SEQ ID NO: 2469059 - DNA, 23 bp, Homo sapiens
cacggagccactcctctgactca

SEQ ID NO: 2469060 - DNA, 17 bp, Homo sapiens
cacggatttgtgtctgt

SEQ ID NO: 2469061 - DNA, 19 bp, Homo sapiens
cacggcacctgggccctgg

SEQ ID NO: 2469062 - DNA, 20 bp, Homo sapiens
cacggcacctgggccctggg

SEQ ID NO: 2469063 - DNA, 19 bp, Homo sapiens
cacggccacacagctgccg

SEQ ID NO: 2469064 - DNA, 13 bp, Homo sapiens
cacggccaggcag

SEQ ID NO: 2469065 - DNA, 19 bp, Homo sapiens
cacggctctgtccccagcc

SEQ ID NO: 2469066 - DNA, 21 bp, Homo sapiens
cacggctctgtccccagcctg

SEQ ID NO: 2469067 - DNA, 17 bp, Homo sapiens
cacggctgcgcactgtg

SEQ ID NO: 2469068 - DNA, 17 bp, Homo sapiens
cacgggcctgtccacag

SEQ ID NO: 2469069 - DNA, 24 bp, Homo sapiens
cacgggcctgtccacaggcttctg

SEQ ID NO: 2469070 - DNA, 13 bp, Homo sapiens
cacgtcctgagaa

SEQ ID NO: 2469071 - DNA, 17 bp, Homo sapiens
cacgtgacacaaacaca

SEQ ID NO: 2469072 - DNA, 18 bp, Homo sapiens
cacgtggcctcttgagca

SEQ ID NO: 2469073 - DNA, 20 bp, Homo sapiens
cacgtggcctcttgagcagt

SEQ ID NO: 2469074 - DNA, 15 bp, Homo sapiens
cacgtgtgtttttct

SEQ ID NO: 2469075 - DNA, 18 bp, Homo sapiens
cacgtgtgtttttctatt

SEQ ID NO: 2469076 - DNA, 14 bp, Homo sapiens
cactaacagagtgg

SEQ ID NO: 2469077 - DNA, 23 bp, Homo sapiens
cactaaccttgcctggtacagta

SEQ ID NO: 2469078 - DNA, 20 bp, Homo sapiens
cactaatatatttaaaaata

SEQ ID NO: 2469079 - DNA, 15 bp, Homo sapiens
cactacattcattta

SEQ ID NO: 2469080 - DNA, 20 bp, Homo sapiens
cactaccgaatgtgtcttta

SEQ ID NO: 2469081 - DNA, 16 bp, Homo sapiens
cactagacaagccaga

SEQ ID NO: 2469082 - DNA, 19 bp, Homo sapiens
cactagccaaacctcacca

SEQ ID NO: 2469083 - DNA, 19 bp, Homo sapiens
cactagcctcaggggtctg

SEQ ID NO: 2469084 - DNA, 20 bp, Homo sapiens
cactaggcccccacttgcct

SEQ ID NO: 2469085 - DNA, 21 bp, Homo sapiens
cactaggcccccacttgcctc

SEQ ID NO: 2469086 - DNA, 23 bp, Homo sapiens
cactaggcccccacttgcctctt

SEQ ID NO: 2469087 - DNA, 14 bp, Homo sapiens
cactatctttcagc

SEQ ID NO: 2469088 - DNA, 14 bp, Homo sapiens
cactcagaagcctg

SEQ ID NO: 2469089 - DNA, 15 bp, Homo sapiens
cactcagagacatgc

SEQ ID NO: 2469090 - DNA, 17 bp, Homo sapiens
cactcagccaccctgag

SEQ ID NO: 2469091 - DNA, 16 bp, Homo sapiens
cactccaagcccagcc

SEQ ID NO: 2469092 - DNA, 17 bp, Homo sapiens
cactcccacatgggccc

SEQ ID NO: 2469093 - DNA, 15 bp, Homo sapiens
cactccccaaccccc

SEQ ID NO: 2469094 - DNA, 18 bp, Homo sapiens
cactccccgaagtctttt

SEQ ID NO: 2469095 - DNA, 14 bp, Homo sapiens
cactccctcctaac

SEQ ID NO: 2469096 - DNA, 23 bp, Homo sapiens
cactcctctgactcagggctcct

SEQ ID NO: 2469097 - DNA, 14 bp, Homo sapiens
cactcctctgctga

SEQ ID NO: 2469098 - DNA, 18 bp, Homo sapiens
cactcctctgctgacctg

SEQ ID NO: 2469099 - DNA, 22 bp, Homo sapiens
cactcctctgctgacctgctga

SEQ ID NO: 2469100 - DNA, 12 bp, Homo sapiens
cactccttcctg

SEQ ID NO: 2469101 - DNA, 14 bp, Homo sapiens
cactcgtctccccc

SEQ ID NO: 2469102 - DNA, 16 bp, Homo sapiens
cactctgctctgatgc

SEQ ID NO: 2469103 - DNA, 13 bp, Homo sapiens
cactctgcttctc

SEQ ID NO: 2469104 - DNA, 17 bp, Homo sapiens
cactctgcttctctgac

SEQ ID NO: 2469105 - DNA, 19 bp, Homo sapiens
cactctgcttctctgactt

SEQ ID NO: 2469106 - DNA, 16 bp, Homo sapiens
cactctgcttgttatt

SEQ ID NO: 2469107 - DNA, 14 bp, Homo sapiens
cactctggcagcca

SEQ ID NO: 2469108 - DNA, 13 bp, Homo sapiens
cactctgtaattg

SEQ ID NO: 2469109 - DNA, 14 bp, Homo sapiens
cactcttatgctgt

SEQ ID NO: 2469110 - DNA, 12 bp, Homo sapiens
cactgaaaaaat

SEQ ID NO: 2469111 - DNA, 20 bp, Homo sapiens
cactgaaaaatctaagtgat

SEQ ID NO: 2469112 - DNA, 14 bp, Homo sapiens
cactgacagcctcc

SEQ ID NO: 2469113 - DNA, 15 bp, Homo sapiens
cactgacagcctccc

SEQ ID NO: 2469114 - DNA, 20 bp, Homo sapiens
cactgacagcctcccacccc

SEQ ID NO: 2469115 - DNA, 14 bp, Homo sapiens
cactgaccagaact

SEQ ID NO: 2469116 - DNA, 23 bp, Homo sapiens
cactgagaccccaggctgttagg

SEQ ID NO: 2469117 - DNA, 14 bp, Homo sapiens
cactgagggcagtc

SEQ ID NO: 2469118 - DNA, 21 bp, Homo sapiens
cactgagttttccatggcagg

SEQ ID NO: 2469119 - DNA, 17 bp, Homo sapiens
cagaagggagggcagag

SEQ ID NO: 2469120 - DNA, 17 bp, Homo sapiens
cagaaggggagatggac

SEQ ID NO: 2469121 - DNA, 20 bp, Homo sapiens
cagaagtaccagactagatg

SEQ ID NO: 2469122 - DNA, 20 bp, Homo sapiens
cagaagtcatcttgctacca

SEQ ID NO: 2469123 - DNA, 17 bp, Homo sapiens
cagaagtgtgactggct

SEQ ID NO: 2469124 - DNA, 22 bp, Homo sapiens
cagaagtttgcactatctttca

SEQ ID NO: 2469125 - DNA, 19 bp, Homo sapiens
cagaataagttattgcagt

SEQ ID NO: 2469126 - DNA, 23 bp, Homo sapiens
cagaataagttattgcagtttat

SEQ ID NO: 2469127 - DNA, 15 bp, Homo sapiens
cagaatacatacaaa

SEQ ID NO: 2469128 - DNA, 15 bp, Homo sapiens
cagaatagccacatt

SEQ ID NO: 2469129 - DNA, 22 bp, Homo sapiens
cagaatagccacatttggaata

SEQ ID NO: 2469130 - DNA, 15 bp, Homo sapiens
cagaatatcacagaa

SEQ ID NO: 2469131 - DNA, 14 bp, Homo sapiens
cagaattaaacttt

SEQ ID NO: 2469132 - DNA, 19 bp, Homo sapiens
cagaattaaacttttaatt

SEQ ID NO: 2469133 - DNA, 22 bp, Homo sapiens
cagaattactgtaactgattac

SEQ ID NO: 2469134 - DNA, 19 bp, Homo sapiens
cagaatttgggttctgcct

SEQ ID NO: 2469135 - DNA, 17 bp, Homo sapiens
cagacaacacgttacta

SEQ ID NO: 2469136 - DNA, 14 bp, Homo sapiens
cagacacaggccct

SEQ ID NO: 2469137 - DNA, 18 bp, Homo sapiens
cagacacaggccctccct

SEQ ID NO: 2469138 - DNA, 12 bp, Homo sapiens
cagacacccagg

SEQ ID NO: 2469139 - DNA, 15 bp, Homo sapiens
cagacacccaggact

SEQ ID NO: 2469140 - DNA, 14 bp, Homo sapiens
cagacagagccagg

SEQ ID NO: 2469141 - DNA, 16 bp, Homo sapiens
cagacagagccaggag

SEQ ID NO: 2469142 - DNA, 18 bp, Homo sapiens
cagacagagccaggagaa

SEQ ID NO: 2469143 - DNA, 14 bp, Homo sapiens
cagacagagccctg

SEQ ID NO: 2469144 - DNA, 17 bp, Homo sapiens
cagacagatgaggcttt

SEQ ID NO: 2469145 - DNA, 15 bp, Homo sapiens
cagacaggccccgtg

SEQ ID NO: 2469146 - DNA, 14 bp, Homo sapiens
cagacaggctctta

SEQ ID NO: 2469147 - DNA, 14 bp, Homo sapiens
cagacataaaggaa

SEQ ID NO: 2469148 - DNA, 22 bp, Homo sapiens
cagacatccaaactaaaaggaa

SEQ ID NO: 2469149 - DNA, 15 bp, Homo sapiens
cagaccacatgcccc

SEQ ID NO: 2469150 - DNA, 16 bp, Homo sapiens
cagaccacatgcccca

SEQ ID NO: 2469151 - DNA, 22 bp, Homo sapiens
cagaccacgcccgtcctgcctg

SEQ ID NO: 2469152 - DNA, 13 bp, Homo sapiens
cagaccctgccct

SEQ ID NO: 2469153 - DNA, 22 bp, Homo sapiens
cagaccctggaggccccaaccc

SEQ ID NO: 2469154 - DNA, 14 bp, Homo sapiens
cagacctgatcctg

SEQ ID NO: 2469155 - DNA, 19 bp, Homo sapiens
cagacctgttagcagacag

SEQ ID NO: 2469156 - DNA, 20 bp, Homo sapiens
cagacctgttagcagacagg

SEQ ID NO: 2469157 - DNA, 15 bp, Homo sapiens
cagaccttttttagg

SEQ ID NO: 2469158 - DNA, 16 bp, Homo sapiens
cagacgcctgaggaac

SEQ ID NO: 2469159 - DNA, 18 bp, Homo sapiens
cagacgctgctgtcacaa

SEQ ID NO: 2469160 - DNA, 22 bp, Homo sapiens
cagacggaagggtaaacaatat

SEQ ID NO: 2469161 - DNA, 12 bp, Homo sapiens
cagactacagct

SEQ ID NO: 2469162 - DNA, 22 bp, Homo sapiens
cagactagatggacctgcctgc

SEQ ID NO: 2469163 - DNA, 15 bp, Homo sapiens
cagactatttttaga

SEQ ID NO: 2469164 - DNA, 14 bp, Homo sapiens
cagactcccattcc

SEQ ID NO: 2469165 - DNA, 18 bp, Homo sapiens
cagactccttcaacaatt

SEQ ID NO: 2469166 - DNA, 23 bp, Homo sapiens
cagactccttcaacaattctaaa

SEQ ID NO: 2469167 - DNA, 15 bp, Homo sapiens
cagactctttatgct

SEQ ID NO: 2469168 - DNA, 19 bp, Homo sapiens
cagactctttatgcttgca

SEQ ID NO: 2469169 - DNA, 20 bp, Homo sapiens
cagacttcccagctaggaag

SEQ ID NO: 2469170 - DNA, 16 bp, Homo sapiens
cagagaaaatgaattt

SEQ ID NO: 2469171 - DNA, 13 bp, Homo sapiens
cagagaaaccagc

SEQ ID NO: 2469172 - DNA, 22 bp, Homo sapiens
cagagaaaccagcttccttcag

SEQ ID NO: 2469173 - DNA, 18 bp, Homo sapiens
cagagaaaggggagccca

SEQ ID NO: 2469174 - DNA, 16 bp, Homo sapiens
cagagaacccagccca

SEQ ID NO: 2469175 - DNA, 13 bp, Homo sapiens
cagagaagccatc

SEQ ID NO: 2469176 - DNA, 12 bp, Homo sapiens
cagagaagcctt

SEQ ID NO: 2469177 - DNA, 20 bp, Homo sapiens
cagagaagccttcaagctct

SEQ ID NO: 2469178 - DNA, 23 bp, Homo sapiens
cagagaagccttcaagctctgag

SEQ ID NO: 2469179 - DNA, 17 bp, Homo sapiens
cagagacatacttgaag

SEQ ID NO: 2469180 - DNA, 19 bp, Homo sapiens
cagagacatacttgaaggg

SEQ ID NO: 2469181 - DNA, 23 bp, Homo sapiens
cagagacatacttgaagggccag

SEQ ID NO: 2469182 - DNA, 17 bp, Homo sapiens
cagagacatcagccctt

SEQ ID NO: 2469183 - DNA, 23 bp, Homo sapiens
cagagacatcagcccttgggggt

SEQ ID NO: 2469184 - DNA, 17 bp, Homo sapiens
cagagacatgcagagat

SEQ ID NO: 2469185 - DNA, 12 bp, Homo sapiens
cagagacccagc

SEQ ID NO: 2469186 - DNA, 17 bp, Homo sapiens
cagagaccttccagaaa

SEQ ID NO: 2469187 - DNA, 20 bp, Homo sapiens
cagagagaaataagtgccct

SEQ ID NO: 2469188 - DNA, 16 bp, Homo sapiens
cagagagaatggcttt

SEQ ID NO: 2469189 - DNA, 18 bp, Homo sapiens
cagagaggactgtaggga

SEQ ID NO: 2469190 - DNA, 18 bp, Homo sapiens
cagagaggtttgcagtcc

SEQ ID NO: 2469191 - DNA, 23 bp, Homo sapiens
cagagaggtttgcagtcccaagc

SEQ ID NO: 2469192 - DNA, 19 bp, Homo sapiens
cagagatccaaaagaagcc

SEQ ID NO: 2469193 - DNA, 21 bp, Homo sapiens
cagagatccaaaagaagcccc

SEQ ID NO: 2469194 - DNA, 23 bp, Homo sapiens
cagagatccaaaagaagccccca

SEQ ID NO: 2469195 - DNA, 14 bp, Homo sapiens
cagagatgcctccc

SEQ ID NO: 2469196 - DNA, 15 bp, Homo sapiens
cagagatgcctccct

SEQ ID NO: 2469197 - DNA, 24 bp, Homo sapiens
cagagattgggtttttggacttct

SEQ ID NO: 2469198 - DNA, 18 bp, Homo sapiens
cagagccatgtcttctcc

SEQ ID NO: 2469199 - DNA, 13 bp, Homo sapiens
cagagcccactcc

SEQ ID NO: 2469200 - DNA, 18 bp, Homo sapiens
cagagcccactccatctg

SEQ ID NO: 2469201 - DNA, 11 bp, Homo sapiens
cagagcccagc

SEQ ID NO: 2469202 - DNA, 14 bp, Homo sapiens
cagagcccagctcc

SEQ ID NO: 2469203 - DNA, 23 bp, Homo sapiens
cagagccggggtggggtggctgc

SEQ ID NO: 2469204 - DNA, 19 bp, Homo sapiens
cagagccgtggtcctttgg

SEQ ID NO: 2469205 - DNA, 11 bp, Homo sapiens
cagagcctggg

SEQ ID NO: 2469206 - DNA, 14 bp, Homo sapiens
cagagcctggggct

SEQ ID NO: 2469207 - DNA, 22 bp, Homo sapiens
cagagcgtgagctgagcaggcc

SEQ ID NO: 2469208 - DNA, 13 bp, Homo sapiens
cagagctggctct

SEQ ID NO: 2469209 - DNA, 18 bp, Homo sapiens
cagagctggctctgagcg

SEQ ID NO: 2469210 - DNA, 21 bp, Homo sapiens
cagagctggtgcggctggcca

SEQ ID NO: 2469211 - DNA, 22 bp, Homo sapiens
cagagctggtgcggctggccat

SEQ ID NO: 2469212 - DNA, 13 bp, Homo sapiens
cagagcttccctg

SEQ ID NO: 2469213 - DNA, 14 bp, Homo sapiens
cagagcttccctga

SEQ ID NO: 2469214 - DNA, 18 bp, Homo sapiens
cagagcttccctgactca

SEQ ID NO: 2469215 - DNA, 18 bp, Homo sapiens
cagaggaaggggccagag

SEQ ID NO: 2469216 - DNA, 19 bp, Homo sapiens
cagaggaaggggccagagg

SEQ ID NO: 2469217 - DNA, 21 bp, Homo sapiens
cagaggaaggggccagaggct

SEQ ID NO: 2469218 - DNA, 17 bp, Homo sapiens
cagaggcagtacctggg

SEQ ID NO: 2469219 - DNA, 21 bp, Homo sapiens
cagaggcagtacctgggcaag

SEQ ID NO: 2469220 - DNA, 17 bp, Homo sapiens
cagaggcccaggctgcc

SEQ ID NO: 2469221 - DNA, 13 bp, Homo sapiens
cagaggccccagc

SEQ ID NO: 2469222 - DNA, 17 bp, Homo sapiens
cagaggccccagcctcc

SEQ ID NO: 2469223 - DNA, 18 bp, Homo sapiens
caggaggcaggaccttcg

SEQ ID NO: 2469224 - DNA, 20 bp, Homo sapiens
caggagggacaaaggagcct

SEQ ID NO: 2469225 - DNA, 22 bp, Homo sapiens
caggagggacaaaggagcctgt

SEQ ID NO: 2469226 - DNA, 22 bp, Homo sapiens
caggagggcggcctccttctga

SEQ ID NO: 2469227 - DNA, 16 bp, Homo sapiens
caggagggggtcgtgg

SEQ ID NO: 2469228 - DNA, 18 bp, Homo sapiens
caggagggggtcgtggag

SEQ ID NO: 2469229 - DNA, 21 bp, Homo sapiens
caggagggggtcgtggagagc

SEQ ID NO: 2469230 - DNA, 19 bp, Homo sapiens
caggaggtgccactggagt

SEQ ID NO: 2469231 - DNA, 13 bp, Homo sapiens
caggagtagctga

SEQ ID NO: 2469232 - DNA, 15 bp, Homo sapiens
caggagtagctgagc

SEQ ID NO: 2469233 - DNA, 16 bp, Homo sapiens
caggagtagctgagct

SEQ ID NO: 2469234 - DNA, 17 bp, Homo sapiens
caggagtagctgagctc

SEQ ID NO: 2469235 - DNA, 18 bp, Homo sapiens
caggagtagctgagctca

SEQ ID NO: 2469236 - DNA, 16 bp, Homo sapiens
caggagtgggtgggga

SEQ ID NO: 2469237 - DNA, 17 bp, Homo sapiens
caggagtgtcctcttcc

SEQ ID NO: 2469238 - DNA, 19 bp, Homo sapiens
caggagtgtcctcttccct

SEQ ID NO: 2469239 - DNA, 14 bp, Homo sapiens
caggatagagactg

SEQ ID NO: 2469240 - DNA, 23 bp, Homo sapiens
caggatgctaacatctaaaaata

SEQ ID NO: 2469241 - DNA, 15 bp, Homo sapiens
caggatgtgtttgct

SEQ ID NO: 2469242 - DNA, 18 bp, Homo sapiens
caggatgtgtttgctttc

SEQ ID NO: 2469243 - DNA, 17 bp, Homo sapiens
caggattgcgagagatg

SEQ ID NO: 2469244 - DNA, 21 bp, Homo sapiens
caggattgcgagagatgtgtg

SEQ ID NO: 2469245 - DNA, 15 bp, Homo sapiens
caggattggggaaga

SEQ ID NO: 2469246 - DNA, 12 bp, Homo sapiens
caggcacacagc

SEQ ID NO: 2469247 - DNA, 13 bp, Homo sapiens
caggcacacagct

SEQ ID NO: 2469248 - DNA, 20 bp, Homo sapiens
caggcacacagctactctcc

SEQ ID NO: 2469249 - DNA, 16 bp, Homo sapiens
caggcaccaaaagaag

SEQ ID NO: 2469250 - DNA, 19 bp, Homo sapiens
caggcaccaaaagaagtaa

SEQ ID NO: 2469251 - DNA, 23 bp, Homo sapiens
caggcactgagataccagcgagg

SEQ ID NO: 2469252 - DNA, 16 bp, Homo sapiens
caggcactgggcatga

SEQ ID NO: 2469253 - DNA, 17 bp, Homo sapiens
caggcactgggcatgag

SEQ ID NO: 2469254 - DNA, 16 bp, Homo sapiens
caggcacttggcagcc

SEQ ID NO: 2469255 - DNA, 19 bp, Homo sapiens
caggcagaggcccaggctg

SEQ ID NO: 2469256 - DNA, 13 bp, Homo sapiens
caggcagatccag

SEQ ID NO: 2469257 - DNA, 17 bp, Homo sapiens
caggcagatccaggact

SEQ ID NO: 2469258 - DNA, 18 bp, Homo sapiens
caggcagatccaggacta

SEQ ID NO: 2469259 - DNA, 13 bp, Homo sapiens
caggcagccagca

SEQ ID NO: 2469260 - DNA, 17 bp, Homo sapiens
caggcagccagcatctg

SEQ ID NO: 2469261 - DNA, 18 bp, Homo sapiens
caggcagccagcatctgg

SEQ ID NO: 2469262 - DNA, 19 bp, Homo sapiens
caggcagccagtgccctga

SEQ ID NO: 2469263 - DNA, 20 bp, Homo sapiens
caggcagccagtgccctgag

SEQ ID NO: 2469264 - DNA, 24 bp, Homo sapiens
caggcagccagtgccctgagccag

SEQ ID NO: 2469265 - DNA, 11 bp, Homo sapiens
caggcagggct

SEQ ID NO: 2469266 - DNA, 15 bp, Homo sapiens
caggcagggctctcc

SEQ ID NO: 2469267 - DNA, 16 bp, Homo sapiens
caggcagggctctcct

SEQ ID NO: 2469268 - DNA, 21 bp, Homo sapiens
caggcagggctctcctggctt

SEQ ID NO: 2469269 - DNA, 16 bp, Homo sapiens
caggcaggggcctcca

SEQ ID NO: 2469270 - DNA, 20 bp, Homo sapiens
caggcaggtctgaagctcaa

SEQ ID NO: 2469271 - DNA, 19 bp, Homo sapiens
caggcattgccaagggctt

SEQ ID NO: 2469272 - DNA, 14 bp, Homo sapiens
caggcatttcctgg

SEQ ID NO: 2469273 - DNA, 17 bp, Homo sapiens
caggcatttcctgggtg

SEQ ID NO: 2469274 - DNA, 18 bp, Homo sapiens
caggcatttcctgggtgg

SEQ ID NO: 2469275 - DNA, 12 bp, Homo sapiens
caggccacctcc

SEQ ID NO: 2469276 - DNA, 15 bp, Homo sapiens
caggccacctcccca

SEQ ID NO: 2469277 - DNA, 16 bp, Homo sapiens
caggccacctccccag

SEQ ID NO: 2469278 - DNA, 13 bp, Homo sapiens
caggccagctgtg

SEQ ID NO: 2469279 - DNA, 15 bp, Homo sapiens
caggccaggactctg

SEQ ID NO: 2469280 - DNA, 15 bp, Homo sapiens
caggcccactgtgcc

SEQ ID NO: 2469281 - DNA, 16 bp, Homo sapiens
caggcccactgtgcct

SEQ ID NO: 2469282 - DNA, 17 bp, Homo sapiens
caggccccactccttcc

SEQ ID NO: 2469283 - DNA, 16 bp, Homo sapiens
caggccccatgacctc

SEQ ID NO: 2469284 - DNA, 17 bp, Homo sapiens
caggccccatgacctcc

SEQ ID NO: 2469285 - DNA, 18 bp, Homo sapiens
caggccccatgacctcca

SEQ ID NO: 2469286 - DNA, 16 bp, Homo sapiens
caggcccccgccttgg

SEQ ID NO: 2469287 - DNA, 17 bp, Homo sapiens
caggcccccgccttggc

SEQ ID NO: 2469288 - DNA, 14 bp, Homo sapiens
caggcccggatgca

SEQ ID NO: 2469289 - DNA, 15 bp, Homo sapiens
caggcccggatgcag

SEQ ID NO: 2469290 - DNA, 21 bp, Homo sapiens
caggcccggatgcagaggcct

SEQ ID NO: 2469291 - DNA, 22 bp, Homo sapiens
caggcccggatgcagaggcctg

SEQ ID NO: 2469292 - DNA, 18 bp, Homo sapiens
caggccctggcctcccct

SEQ ID NO: 2469293 - DNA, 16 bp, Homo sapiens
caggcctcagggctcc

SEQ ID NO: 2469294 - DNA, 15 bp, Homo sapiens
caggcctgaaagagg

SEQ ID NO: 2469295 - DNA, 20 bp, Homo sapiens
caggcctgaaagaggctgag

SEQ ID NO: 2469296 - DNA, 15 bp, Homo sapiens
caggcctgtccaaca

SEQ ID NO: 2469297 - DNA, 18 bp, Homo sapiens
caggcctttgagaaaggg

SEQ ID NO: 2469298 - DNA, 16 bp, Homo sapiens
caggcctttgagctca

SEQ ID NO: 2469299 - DNA, 12 bp, Homo sapiens
caggcgaggccc

SEQ ID NO: 2469300 - DNA, 16 bp, Homo sapiens
caggcgatccacctgt

SEQ ID NO: 2469301 - DNA, 18 bp, Homo sapiens
caggcgtgagccacctcg

SEQ ID NO: 2469302 - DNA, 16 bp, Homo sapiens
caggctaggccagcag

SEQ ID NO: 2469303 - DNA, 14 bp, Homo sapiens
caggctcggcctgc

SEQ ID NO: 2469304 - DNA, 19 bp, Homo sapiens
caggctcggcctgccccca

SEQ ID NO: 2469305 - DNA, 20 bp, Homo sapiens
caggctcggcctgcccccac

SEQ ID NO: 2469306 - DNA, 18 bp, Homo sapiens
caggctcttagcagcttc

SEQ ID NO: 2469307 - DNA, 14 bp, Homo sapiens
caggctgaccacag

SEQ ID NO: 2469308 - DNA, 20 bp, Homo sapiens
caggctgaccacagcacagc

SEQ ID NO: 2469309 - DNA, 14 bp, Homo sapiens
caggctgcctgagt

SEQ ID NO: 2469310 - DNA, 14 bp, Homo sapiens
caggctggccagtc

SEQ ID NO: 2469311 - DNA, 21 bp, Homo sapiens
caggctggccagtccaggctg

SEQ ID NO: 2469312 - DNA, 18 bp, Homo sapiens
caggctgggaactcatct

SEQ ID NO: 2469313 - DNA, 17 bp, Homo sapiens
caggctgggccatgtcc

SEQ ID NO: 2469314 - DNA, 20 bp, Homo sapiens
caggctgggccatgtccaaa

SEQ ID NO: 2469315 - DNA, 16 bp, Homo sapiens
caggctggtctaaaac

SEQ ID NO: 2469316 - DNA, 18 bp, Homo sapiens
caggctggtctaaaactc

SEQ ID NO: 2469317 - DNA, 13 bp, Homo sapiens
caggctggtctca

SEQ ID NO: 2469318 - DNA, 19 bp, Homo sapiens
caggcttctgctggggcct

SEQ ID NO: 2469319 - DNA, 18 bp, Homo sapiens
cagggaaaataggcagga

SEQ ID NO: 2469320 - DNA, 18 bp, Homo sapiens
cagggaacatggggagga

SEQ ID NO: 2469321 - DNA, 15 bp, Homo sapiens
cagggaagcagcagc

SEQ ID NO: 2469322 - DNA, 16 bp, Homo sapiens
gagcgccctgcagacc

SEQ ID NO: 2469323 - DNA, 19 bp, Homo sapiens
gagcgccctgcagaccctg

SEQ ID NO: 2469324 - DNA, 19 bp, Homo sapiens
gagcgcctccatccaaggc

SEQ ID NO: 2469325 - DNA, 15 bp, Homo sapiens
gagcgggtctgctcc

SEQ ID NO: 2469326 - DNA, 11 bp, Homo sapiens
gagctaaggct

SEQ ID NO: 2469327 - DNA, 15 bp, Homo sapiens
gagctacgtatttaa

SEQ ID NO: 2469328 - DNA, 21 bp, Homo sapiens
gagctaggagcaaagcctgtt

SEQ ID NO: 2469329 - DNA, 18 bp, Homo sapiens
gagctcacaaggcagcaa

SEQ ID NO: 2469330 - DNA, 21 bp, Homo sapiens
gagctcacaaggcagcaaggc

SEQ ID NO: 2469331 - DNA, 23 bp, Homo sapiens
gagctcacaaggcagcaaggccc

SEQ ID NO: 2469332 - DNA, 13 bp, Homo sapiens
gagctcagcgtgg

SEQ ID NO: 2469333 - DNA, 12 bp, Homo sapiens
gagctcaggatg

SEQ ID NO: 2469334 - DNA, 12 bp, Homo sapiens
gagctccactct

SEQ ID NO: 2469335 - DNA, 16 bp, Homo sapiens
gagctccactctgctt

SEQ ID NO: 2469336 - DNA, 14 bp, Homo sapiens
gagctccagcctga

SEQ ID NO: 2469337 - DNA, 16 bp, Homo sapiens
gagctccagtgtcctg

SEQ ID NO: 2469338 - DNA, 19 bp, Homo sapiens
gagctccagtgtcctgagc

SEQ ID NO: 2469339 - DNA, 22 bp, Homo sapiens
gagctccagtgtcctgagctca

SEQ ID NO: 2469340 - DNA, 19 bp, Homo sapiens
gagctcccacaagcctgag

SEQ ID NO: 2469341 - DNA, 18 bp, Homo sapiens
gagctcccctccccaact

SEQ ID NO: 2469342 - DNA, 13 bp, Homo sapiens
gagctctgagagg

SEQ ID NO: 2469343 - DNA, 15 bp, Homo sapiens
gagctctgagaggcc

SEQ ID NO: 2469344 - DNA, 16 bp, Homo sapiens
gagctctgagaggccc

SEQ ID NO: 2469345 - DNA, 17 bp, Homo sapiens
gagctctgagaggccct

SEQ ID NO: 2469346 - DNA, 23 bp, Homo sapiens
gagctctgagaggccctggatca

SEQ ID NO: 2469347 - DNA, 14 bp, Homo sapiens
gagctgcctggacc

SEQ ID NO: 2469348 - DNA, 12 bp, Homo sapiens
gagctggctctg

SEQ ID NO: 2469349 - DNA, 22 bp, Homo sapiens
gagctggctctgagcgcctcca

SEQ ID NO: 2469350 - DNA, 15 bp, Homo sapiens
gagctggggacctgg

SEQ ID NO: 2469351 - DNA, 18 bp, Homo sapiens
gagctgtattaagccact

SEQ ID NO: 2469352 - DNA, 21 bp, Homo sapiens
gagctgtgagttctccctgta

SEQ ID NO: 2469353 - DNA, 18 bp, Homo sapiens
gagctgtgcaggtgggga

SEQ ID NO: 2469354 - DNA, 16 bp, Homo sapiens
gagcttaaaatacaag

SEQ ID NO: 2469355 - DNA, 21 bp, Homo sapiens
gagcttaatctttgaaaggtt

SEQ ID NO: 2469356 - DNA, 13 bp, Homo sapiens
gagcttccctgac

SEQ ID NO: 2469357 - DNA, 23 bp, Homo sapiens
gagctttctgaacagctggtgta

SEQ ID NO: 2469358 - DNA, 21 bp, Homo sapiens
gagctttgactcaggagcctg

SEQ ID NO: 2469359 - DNA, 13 bp, Homo sapiens
gaggaaatccctt

SEQ ID NO: 2469360 - DNA, 20 bp, Homo sapiens
gaggaaatcccttcatactt

SEQ ID NO: 2469361 - DNA, 16 bp, Homo sapiens
gaggaaggacttccct

SEQ ID NO: 2469362 - DNA, 22 bp, Homo sapiens
gaggaatctgtgggtctgggag

SEQ ID NO: 2469363 - DNA, 21 bp, Homo sapiens
gaggacagatgcctccttcct

SEQ ID NO: 2469364 - DNA, 16 bp, Homo sapiens
gaggacccagggctct

SEQ ID NO: 2469365 - DNA, 12 bp, Homo sapiens
gaggacctgagc

SEQ ID NO: 2469366 - DNA, 21 bp, Homo sapiens
gaggacctgagcctgccgagc

SEQ ID NO: 2469367 - DNA, 22 bp, Homo sapiens
gaggacctgagcctgccgagca

SEQ ID NO: 2469368 - DNA, 20 bp, Homo sapiens
gaggactgtagggagggcgg

SEQ ID NO: 2469369 - DNA, 21 bp, Homo sapiens
gaggactgtagggagggcggc

SEQ ID NO: 2469370 - DNA, 14 bp, Homo sapiens
gaggagccccagct

SEQ ID NO: 2469371 - DNA, 19 bp, Homo sapiens
gaggagcctgtcctgcctg

SEQ ID NO: 2469372 - DNA, 22 bp, Homo sapiens
gaggagcctgtcctgcctgtgg

SEQ ID NO: 2469373 - DNA, 18 bp, Homo sapiens
gaggaggaaatcccttca

SEQ ID NO: 2469374 - DNA, 14 bp, Homo sapiens
gaggagggaggcca

SEQ ID NO: 2469375 - DNA, 19 bp, Homo sapiens
gaggaggtgtctcaggctg

SEQ ID NO: 2469376 - DNA, 22 bp, Homo sapiens
gaggaggtgtctcaggctgcct

SEQ ID NO: 2469377 - DNA, 20 bp, Homo sapiens
gaggagtaacaatacaaatg

SEQ ID NO: 2469378 - DNA, 21 bp, Homo sapiens
gaggagtaacaatacaaatgg

SEQ ID NO: 2469379 - DNA, 18 bp, Homo sapiens
gaggagtctgaggtcctg

SEQ ID NO: 2469380 - DNA, 13 bp, Homo sapiens
gaggcagcagtgt

SEQ ID NO: 2469381 - DNA, 20 bp, Homo sapiens
gaggcagcagtgtgaggcca

SEQ ID NO: 2469382 - DNA, 21 bp, Homo sapiens
gaggcagcagtgtgaggccag

SEQ ID NO: 2469383 - DNA, 22 bp, Homo sapiens
gaggcagcagtgtgaggccagg

SEQ ID NO: 2469384 - DNA, 16 bp, Homo sapiens
gaggcagcccaggaag

SEQ ID NO: 2469385 - DNA, 12 bp, Homo sapiens
gaggcagcccgc

SEQ ID NO: 2469386 - DNA, 17 bp, Homo sapiens
gaggcaggggcttcctg

SEQ ID NO: 2469387 - DNA, 23 bp, Homo sapiens
gaggcagtacctgggcaagctgg

SEQ ID NO: 2469388 - DNA, 19 bp, Homo sapiens
gaggcatggtctgccctct

SEQ ID NO: 2469389 - DNA, 21 bp, Homo sapiens
gaggccagaggcccccagccc

SEQ ID NO: 2469390 - DNA, 11 bp, Homo sapiens
gagtcccctca

SEQ ID NO: 2469391 - DNA, 17 bp, Homo sapiens
gagtcccctcacctcct

SEQ ID NO: 2469392 - DNA, 18 bp, Homo sapiens
gagtcccctcacctcctc

SEQ ID NO: 2469393 - DNA, 19 bp, Homo sapiens
gagtcctggatgatactaa

SEQ ID NO: 2469394 - DNA, 18 bp, Homo sapiens
gagtcgtggggtgtgctg

SEQ ID NO: 2469395 - DNA, 16 bp, Homo sapiens
gagtctagatgtttat

SEQ ID NO: 2469396 - DNA, 18 bp, Homo sapiens
gagtctgaggtcctgagc

SEQ ID NO: 2469397 - DNA, 19 bp, Homo sapiens
gagtctgaggtcctgagca

SEQ ID NO: 2469398 - DNA, 18 bp, Homo sapiens
gagtctgccacccaggat

SEQ ID NO: 2469399 - DNA, 15 bp, Homo sapiens
gagtgactcaagaag

SEQ ID NO: 2469400 - DNA, 23 bp, Homo sapiens
gagtgactcaagaagtgaagaat

SEQ ID NO: 2469401 - DNA, 23 bp, Homo sapiens
gagtgagacccagccctcatccc

SEQ ID NO: 2469402 - DNA, 22 bp, Homo sapiens
gagtgcagtcctgatcagagcc

SEQ ID NO: 2469403 - DNA, 18 bp, Homo sapiens
gagtgcttgcttttcatg

SEQ ID NO: 2469404 - DNA, 21 bp, Homo sapiens
gagtggagtctgccacccagg

SEQ ID NO: 2469405 - DNA, 22 bp, Homo sapiens
gagtggcagcccagccagcgtc

SEQ ID NO: 2469406 - DNA, 11 bp, Homo sapiens
gagtgggaagc

SEQ ID NO: 2469407 - DNA, 12 bp, Homo sapiens
gagtgggaagcc

SEQ ID NO: 2469408 - DNA, 13 bp, Homo sapiens
gagtgggggtggg

SEQ ID NO: 2469409 - DNA, 15 bp, Homo sapiens
gagtgggtggggagt

SEQ ID NO: 2469410 - DNA, 19 bp, Homo sapiens
gagtgtctttccacggagc

SEQ ID NO: 2469411 - DNA, 22 bp, Homo sapiens
gagtgtctttccacggagccac

SEQ ID NO: 2469412 - DNA, 13 bp, Homo sapiens
gagttaagacctg

SEQ ID NO: 2469413 - DNA, 14 bp, Homo sapiens
gagttaagacctgg

SEQ ID NO: 2469414 - DNA, 21 bp, Homo sapiens
gagttaagacctggcagctct

SEQ ID NO: 2469415 - DNA, 14 bp, Homo sapiens
gagttacagttctg

SEQ ID NO: 2469416 - DNA, 21 bp, Homo sapiens
gagttcagagtccttaaaatg

SEQ ID NO: 2469417 - DNA, 15 bp, Homo sapiens
gagttccagaaagta

SEQ ID NO: 2469418 - DNA, 22 bp, Homo sapiens
gagttctccctgtacagtgtta

SEQ ID NO: 2469419 - DNA, 17 bp, Homo sapiens
gagttctttttgaagta

SEQ ID NO: 2469420 - DNA, 22 bp, Homo sapiens
gagtttagggaacaatttggca

SEQ ID NO: 2469421 - DNA, 16 bp, Homo sapiens
gagtttctaaggtccg

SEQ ID NO: 2469422 - DNA, 17 bp, Homo sapiens
gagtttgatgaggccct

SEQ ID NO: 2469423 - DNA, 18 bp, Homo sapiens
gagtttgtcgctcatgtg

SEQ ID NO: 2469424 - DNA, 22 bp, Homo sapiens
gagtttgtcgctcatgtgtgca

SEQ ID NO: 2469425 - DNA, 21 bp, Homo sapiens
gagttttccatggcaggaagg

SEQ ID NO: 2469426 - DNA, 15 bp, Homo sapiens
gagttttgtgtttgt

SEQ ID NO: 2469427 - DNA, 14 bp, Homo sapiens
gataaacacaagat

SEQ ID NO: 2469428 - DNA, 19 bp, Homo sapiens
gataaagattttttaataa

SEQ ID NO: 2469429 - DNA, 16 bp, Homo sapiens
gataaccttgaaaaaa

SEQ ID NO: 2469430 - DNA, 21 bp, Homo sapiens
gataactgaaaattatttaaa

SEQ ID NO: 2469431 - DNA, 19 bp, Homo sapiens
gataagtgttctgtctgac

SEQ ID NO: 2469432 - DNA, 16 bp, Homo sapiens
gataataatgaaataa

SEQ ID NO: 2469433 - DNA, 14 bp, Homo sapiens
gataatagattctc

SEQ ID NO: 2469434 - DNA, 14 bp, Homo sapiens
gatacatacagaat

SEQ ID NO: 2469435 - DNA, 22 bp, Homo sapiens
gataccagcgaggaggctccag

SEQ ID NO: 2469436 - DNA, 13 bp, Homo sapiens
gatactgttgcac

SEQ ID NO: 2469437 - DNA, 15 bp, Homo sapiens
gatactgttgcacgt

SEQ ID NO: 2469438 - DNA, 16 bp, Homo sapiens
gatactgttgcacgtg

SEQ ID NO: 2469439 - DNA, 17 bp, Homo sapiens
gatactgttgcacgtgt

SEQ ID NO: 2469440 - DNA, 13 bp, Homo sapiens
gatacttggattt

SEQ ID NO: 2469441 - DNA, 21 bp, Homo sapiens
gatagatgctggcccagggcc

SEQ ID NO: 2469442 - DNA, 15 bp, Homo sapiens
gatagccctgtcctg

SEQ ID NO: 2469443 - DNA, 23 bp, Homo sapiens
gatagtcttttgcttttggcaaa

SEQ ID NO: 2469444 - DNA, 19 bp, Homo sapiens
gatatagaagtataaagaa

SEQ ID NO: 2469445 - DNA, 15 bp, Homo sapiens
gatatataagtgtac

SEQ ID NO: 2469446 - DNA, 17 bp, Homo sapiens
gatatataagtgtacat

SEQ ID NO: 2469447 - DNA, 22 bp, Homo sapiens
gatatgcttgtaactaaaataa

SEQ ID NO: 2469448 - DNA, 17 bp, Homo sapiens
gatatgtaaaacattta

SEQ ID NO: 2469449 - DNA, 18 bp, Homo sapiens
gatatgtatgggtagggt

SEQ ID NO: 2469450 - DNA, 19 bp, Homo sapiens
gatattaaattttttaaaa

SEQ ID NO: 2469451 - DNA, 15 bp, Homo sapiens
gatattggaacttgc

SEQ ID NO: 2469452 - DNA, 13 bp, Homo sapiens
gatcacaagatgg

SEQ ID NO: 2469453 - DNA, 13 bp, Homo sapiens
gatcagaacaaat

SEQ ID NO: 2469454 - DNA, 16 bp, Homo sapiens
gatcagaccataatgt

SEQ ID NO: 2469455 - DNA, 21 bp, Homo sapiens
gatcagatgctccaagattct

SEQ ID NO: 2469456 - DNA, 22 bp, Homo sapiens
gatcagatgctccaagattcta

SEQ ID NO: 2469457 - DNA, 19 bp, Homo sapiens
gatcagcaaaccggggcct

SEQ ID NO: 2469458 - DNA, 16 bp, Homo sapiens
gatcagccccaccctg

SEQ ID NO: 2469459 - DNA, 21 bp, Homo sapiens
gatcagccccaccctggccta

SEQ ID NO: 2469460 - DNA, 16 bp, Homo sapiens
gatcagcgtggccttg

SEQ ID NO: 2469461 - DNA, 19 bp, Homo sapiens
gatcagtatttaactaatt

SEQ ID NO: 2469462 - DNA, 17 bp, Homo sapiens
gatcataaggcttcaaa

SEQ ID NO: 2469463 - DNA, 15 bp, Homo sapiens
gatccaagctaagca

SEQ ID NO: 2469464 - DNA, 15 bp, Homo sapiens
gatccaggagctcca

SEQ ID NO: 2469465 - DNA, 15 bp, Homo sapiens
gatccagggacagag

SEQ ID NO: 2469466 - DNA, 18 bp, Homo sapiens
gatccagggacagaggcc

SEQ ID NO: 2469467 - DNA, 19 bp, Homo sapiens
gatccagggaggctggtcc

SEQ ID NO: 2469468 - DNA, 12 bp, Homo sapiens
gatccagttttg

SEQ ID NO: 2469469 - DNA, 17 bp, Homo sapiens
gatccatgtaactgcct

SEQ ID NO: 2469470 - DNA, 15 bp, Homo sapiens
gatccatttctaatt

SEQ ID NO: 2469471 - DNA, 21 bp, Homo sapiens
gatcccagagagcccgaggag

SEQ ID NO: 2469472 - DNA, 19 bp, Homo sapiens
gatccctcccccccatgca

SEQ ID NO: 2469473 - DNA, 18 bp, Homo sapiens
gatccctgtgttgtctct

SEQ ID NO: 2469474 - DNA, 20 bp, Homo sapiens
gatccctgtgttgtctctag

SEQ ID NO: 2469475 - DNA, 17 bp, Homo sapiens
gatccgactgctttgga

SEQ ID NO: 2469476 - DNA, 20 bp, Homo sapiens
gatccgactgctttggacct

SEQ ID NO: 2469477 - DNA, 19 bp, Homo sapiens
gatcctaagcatctaagtt

SEQ ID NO: 2469478 - DNA, 12 bp, Homo sapiens
gatcctcctcat

SEQ ID NO: 2469479 - DNA, 17 bp, Homo sapiens
gatcctgcgggtggggc

SEQ ID NO: 2469480 - DNA, 15 bp, Homo sapiens
gatcctggaggccca

SEQ ID NO: 2469481 - DNA, 20 bp, Homo sapiens
gatcctgtgtggagagggaa

SEQ ID NO: 2469482 - DNA, 17 bp, Homo sapiens
gatcgaaccgttttgaa

SEQ ID NO: 2469483 - DNA, 17 bp, Homo sapiens
gatcgccttccccaccc

SEQ ID NO: 2469484 - DNA, 13 bp, Homo sapiens
gatcggcaggaca

SEQ ID NO: 2469485 - DNA, 11 bp, Homo sapiens
gatctaaataa

SEQ ID NO: 2469486 - DNA, 16 bp, Homo sapiens
gatctaaataaaatgc

SEQ ID NO: 2469487 - DNA, 17 bp, Homo sapiens
gatctaaataaaatgct

SEQ ID NO: 2469488 - DNA, 14 bp, Homo sapiens
gatctactttccct

SEQ ID NO: 2469489 - DNA, 21 bp, Homo sapiens
gatctactttccctctgggat

SEQ ID NO: 2469490 - DNA, 13 bp, Homo sapiens
gatctatttcatg

SEQ ID NO: 2469491 - DNA, 21 bp, Homo sapiens
gatctcattggacccttccat

SEQ ID NO: 2469492 - DNA, 16 bp, Homo sapiens
gatctccctgagatgg

SEQ ID NO: 2469493 - DNA, 19 bp, Homo sapiens
gatctgatagggtttgtga

SEQ ID NO: 2469494 - DNA, 19 bp, Homo sapiens
gattctagatcagatgctc

SEQ ID NO: 2469495 - DNA, 19 bp, Homo sapiens
gattctatagttctagaca

SEQ ID NO: 2469496 - DNA, 15 bp, Homo sapiens
gattctatttatatg

SEQ ID NO: 2469497 - DNA, 20 bp, Homo sapiens
gattctatttatatgtacat

SEQ ID NO: 2469498 - DNA, 21 bp, Homo sapiens
gattctgaccttaaatgcaac

SEQ ID NO: 2469499 - DNA, 23 bp, Homo sapiens
gattctgaccttaaatgcaacca

SEQ ID NO: 2469500 - DNA, 18 bp, Homo sapiens
gattctgcagtaaatctt

SEQ ID NO: 2469501 - DNA, 17 bp, Homo sapiens
gattctggttccagggt

SEQ ID NO: 2469502 - DNA, 22 bp, Homo sapiens
gattctggttccagggtccctc

SEQ ID NO: 2469503 - DNA, 19 bp, Homo sapiens
gattgaaaatgtccaggaa

SEQ ID NO: 2469504 - DNA, 15 bp, Homo sapiens
gattgatttgaagaa

SEQ ID NO: 2469505 - DNA, 17 bp, Homo sapiens
gattgatttgaagaaca

SEQ ID NO: 2469506 - DNA, 20 bp, Homo sapiens
gattgcacgtggcctcttga

SEQ ID NO: 2469507 - DNA, 14 bp, Homo sapiens
gattgcgagagatg

SEQ ID NO: 2469508 - DNA, 16 bp, Homo sapiens
gattgcgagagatgtg

SEQ ID NO: 2469509 - DNA, 17 bp, Homo sapiens
gattgcgagagatgtgt

SEQ ID NO: 2469510 - DNA, 19 bp, Homo sapiens
gattgcgagagatgtgtgt

SEQ ID NO: 2469511 - DNA, 20 bp, Homo sapiens
gattgcgagagatgtgtgtt

SEQ ID NO: 2469512 - DNA, 22 bp, Homo sapiens
gattgcgagagatgtgtgttga

SEQ ID NO: 2469513 - DNA, 16 bp, Homo sapiens
gattgctgccccatca

SEQ ID NO: 2469514 - DNA, 20 bp, Homo sapiens
gattgctgccccatcagtgc

SEQ ID NO: 2469515 - DNA, 11 bp, Homo sapiens
gattggcctgt

SEQ ID NO: 2469516 - DNA, 20 bp, Homo sapiens
gattggcctgtagagttgct

SEQ ID NO: 2469517 - DNA, 23 bp, Homo sapiens
gattggcctgtagagttgctgag

SEQ ID NO: 2469518 - DNA, 16 bp, Homo sapiens
gattgggaatccgccc

SEQ ID NO: 2469519 - DNA, 20 bp, Homo sapiens
gattggtgtttttttctatg

SEQ ID NO: 2469520 - DNA, 18 bp, Homo sapiens
gatttaaaagcctgctca

SEQ ID NO: 2469521 - DNA, 20 bp, Homo sapiens
gatttaagggcccaggtcag

SEQ ID NO: 2469522 - DNA, 14 bp, Homo sapiens
gatttagtttcagt

SEQ ID NO: 2469523 - DNA, 15 bp, Homo sapiens
gatttatcacacaaa

SEQ ID NO: 2469524 - DNA, 12 bp, Homo sapiens
gatttatttaaa

SEQ ID NO: 2469525 - DNA, 18 bp, Homo sapiens
gatttatttaaaatagca

SEQ ID NO: 2469526 - DNA, 21 bp, Homo sapiens
gatttcaacatgagtgtattt

SEQ ID NO: 2469527 - DNA, 19 bp, Homo sapiens
gatttcagttctaggaaaa

SEQ ID NO: 2469528 - DNA, 20 bp, Homo sapiens
gatttcatttcaactgtttg

SEQ ID NO: 2469529 - DNA, 14 bp, Homo sapiens
gatttctttgaaaa

SEQ ID NO: 2469530 - DNA, 20 bp, Homo sapiens
gatttgaagaacatgtgaga

SEQ ID NO: 2469531 - DNA, 17 bp, Homo sapiens
gatttgcattgaacaca

SEQ ID NO: 2469532 - DNA, 22 bp, Homo sapiens
gatttgtgtctgtgacttttgt

SEQ ID NO: 2469533 - DNA, 21 bp, Homo sapiens
gattttaggagctaaggctct

SEQ ID NO: 2469534 - DNA, 12 bp, Homo sapiens
gattttcagtta

SEQ ID NO: 2469535 - DNA, 14 bp, Homo sapiens
gattttcagttact

SEQ ID NO: 2469536 - DNA, 11 bp, Homo sapiens
gatttttctct

SEQ ID NO: 2469537 - DNA, 15 bp, Homo sapiens
gatttttctcttcat

SEQ ID NO: 2469538 - DNA, 15 bp, Homo sapiens
gatttttctttaact

SEQ ID NO: 2469539 - DNA, 15 bp, Homo sapiens
gatttttctttacaa

SEQ ID NO: 2469540 - DNA, 22 bp, Homo sapiens
gatttttgttttgtttttacaa

SEQ ID NO: 2469541 - DNA, 21 bp, Homo sapiens
gattttttttttttctctcaa

SEQ ID NO: 2469542 - DNA, 13 bp, Homo sapiens
gcaaaaaagaaaa

SEQ ID NO: 2469543 - DNA, 19 bp, Homo sapiens
gcaaaagcttacaaatact

SEQ ID NO: 2469544 - DNA, 18 bp, Homo sapiens
gcaaaattatagaagttt

SEQ ID NO: 2469545 - DNA, 19 bp, Homo sapiens
gcaaacccatcaacaaaaa

SEQ ID NO: 2469546 - DNA, 22 bp, Homo sapiens
gcaaactctttggtcgtttttt

SEQ ID NO: 2469547 - DNA, 23 bp, Homo sapiens
gcaaactctttggtcgttttttt

SEQ ID NO: 2469548 - DNA, 14 bp, Homo sapiens
gcaaactgcatgcc

SEQ ID NO: 2469549 - DNA, 19 bp, Homo sapiens
gcaaactgcatgcccagag

SEQ ID NO: 2469550 - DNA, 17 bp, Homo sapiens
gcaaactgggaacccct

SEQ ID NO: 2469551 - DNA, 20 bp, Homo sapiens
gcaaactgggaacccctttc

SEQ ID NO: 2469552 - DNA, 23 bp, Homo sapiens
gcaaactgggaacccctttccca

SEQ ID NO: 2469553 - DNA, 13 bp, Homo sapiens
gcaaagcacagag

SEQ ID NO: 2469554 - DNA, 15 bp, Homo sapiens
gcaaagcccccagag

SEQ ID NO: 2469555 - DNA, 11 bp, Homo sapiens
gcaaagcctgt

SEQ ID NO: 2469556 - DNA, 19 bp, Homo sapiens
gcaaagcctgttcatggca

SEQ ID NO: 2469557 - DNA, 20 bp, Homo sapiens
gcaaaggaaggtggatggcc

SEQ ID NO: 2469558 - DNA, 17 bp, Homo sapiens
gcaaataacaaatgcca

SEQ ID NO: 2469559 - DNA, 22 bp, Homo sapiens
gcaaatcgaatgaaattaactg

SEQ ID NO: 2469560 - DNA, 23 bp, Homo sapiens
gcaaatgtagtatggcctgtgtc

SEQ ID NO: 2469561 - DNA, 18 bp, Homo sapiens
gcaaatgtcatgctgcct

SEQ ID NO: 2469562 - DNA, 19 bp, Homo sapiens
gcaaatttgcattaaatta

SEQ ID NO: 2469563 - DNA, 16 bp, Homo sapiens
gcaacagatcagtaaa

SEQ ID NO: 2469564 - DNA, 17 bp, Homo sapiens
gcaacatccaaaatagt

SEQ ID NO: 2469565 - DNA, 22 bp, Homo sapiens
gcaacatgatgaggtagtacct

SEQ ID NO: 2469566 - DNA, 20 bp, Homo sapiens
gcaaccgtggcccttcctgg

SEQ ID NO: 2469567 - DNA, 22 bp, Homo sapiens
gcaactatcagactaagccagc

SEQ ID NO: 2469568 - DNA, 23 bp, Homo sapiens
gcaactatcagactaagccagca

SEQ ID NO: 2469569 - DNA, 21 bp, Homo sapiens
gcaacttgtcctagcacagat

SEQ ID NO: 2469570 - DNA, 22 bp, Homo sapiens
gcaacttgtcctagcacagatg

SEQ ID NO: 2469571 - DNA, 15 bp, Homo sapiens
gcaagaccagttgaa

SEQ ID NO: 2469572 - DNA, 14 bp, Homo sapiens
gcaagcaagaggcc

SEQ ID NO: 2469573 - DNA, 14 bp, Homo sapiens
gcaagcacatctgc

SEQ ID NO: 2469574 - DNA, 16 bp, Homo sapiens
gcaaggaaaaacaggt

SEQ ID NO: 2469575 - DNA, 16 bp, Homo sapiens
gcaaggactttgtaca

SEQ ID NO: 2469576 - DNA, 19 bp, Homo sapiens
gcaaggactttgtacattt

SEQ ID NO: 2469577 - DNA, 13 bp, Homo sapiens
gcaaggcagccgt

SEQ ID NO: 2469578 - DNA, 17 bp, Homo sapiens
gcaaggcccgagcagct

SEQ ID NO: 2469579 - DNA, 19 bp, Homo sapiens
gcaaggcccgagcagctga

SEQ ID NO: 2469580 - DNA, 13 bp, Homo sapiens
gcaagttcccagt

SEQ ID NO: 2469581 - DNA, 15 bp, Homo sapiens
gcaagttcccagttg

SEQ ID NO: 2469582 - DNA, 21 bp, Homo sapiens
gcaatgccacagccctgtcag

SEQ ID NO: 2469583 - DNA, 22 bp, Homo sapiens
gcaatgccacagccctgtcagc

SEQ ID NO: 2469584 - DNA, 15 bp, Homo sapiens
gcaatgccatcatct

SEQ ID NO: 2469585 - DNA, 19 bp, Homo sapiens
gcaatgccatcatctcctg

SEQ ID NO: 2469586 - DNA, 17 bp, Homo sapiens
gcaatgtgtataaacaa

SEQ ID NO: 2469587 - DNA, 23 bp, Homo sapiens
gcaatgtgtataaacaagaaaaa

SEQ ID NO: 2469588 - DNA, 14 bp, Homo sapiens
gcaatgtgtgtata

SEQ ID NO: 2469589 - DNA, 19 bp, Homo sapiens
gcaatgtgtgtatatggac

SEQ ID NO: 2469590 - DNA, 14 bp, Homo sapiens
gcaattttgtggtt

SEQ ID NO: 2469591 - DNA, 16 bp, Homo sapiens
gcaatttttatattaa

SEQ ID NO: 2469592 - DNA, 17 bp, Homo sapiens
gcacaaagaccctggct

SEQ ID NO: 2469593 - DNA, 19 bp, Homo sapiens
gcacaaattagttatatat

SEQ ID NO: 2469594 - DNA, 14 bp, Homo sapiens
gcacaagaatggat

SEQ ID NO: 2469595 - DNA, 19 bp, Homo sapiens
gcacaataactcctcccag

SEQ ID NO: 2469596 - DNA, 14 bp, Homo sapiens
gcacaccccactcc

SEQ ID NO: 2469597 - DNA, 20 bp, Homo sapiens
gcagagttacagttctgtgg

SEQ ID NO: 2469598 - DNA, 14 bp, Homo sapiens
gcagatccaggact

SEQ ID NO: 2469599 - DNA, 15 bp, Homo sapiens
gcagatccaggacta

SEQ ID NO: 2469600 - DNA, 19 bp, Homo sapiens
gcagatgtaggagggactg

SEQ ID NO: 2469601 - DNA, 22 bp, Homo sapiens
gcagcaacttgtcctagcacag

SEQ ID NO: 2469602 - DNA, 21 bp, Homo sapiens
gcagcaaggcccgagcagctg

SEQ ID NO: 2469603 - DNA, 15 bp, Homo sapiens
gcagcacaggagggc

SEQ ID NO: 2469604 - DNA, 17 bp, Homo sapiens
gcagcaccgttctgtgc

SEQ ID NO: 2469605 - DNA, 19 bp, Homo sapiens
gcagcaccgttctgtgcac

SEQ ID NO: 2469606 - DNA, 16 bp, Homo sapiens
gcagcacctcctcagc

SEQ ID NO: 2469607 - DNA, 19 bp, Homo sapiens
gcagcacctcctcagcctg

SEQ ID NO: 2469608 - DNA, 16 bp, Homo sapiens
gcagcagccagccctg

SEQ ID NO: 2469609 - DNA, 22 bp, Homo sapiens
gcagcagcctcgcccctggcag

SEQ ID NO: 2469610 - DNA, 22 bp, Homo sapiens
gcagcagtgtgaggccagggca

SEQ ID NO: 2469611 - DNA, 23 bp, Homo sapiens
gcagcagtgtgaggccagggcag

SEQ ID NO: 2469612 - DNA, 21 bp, Homo sapiens
gcagccacacttctcaggaca

SEQ ID NO: 2469613 - DNA, 17 bp, Homo sapiens
gcagccaccctgaggag

SEQ ID NO: 2469614 - DNA, 19 bp, Homo sapiens
gcagccagcatctgggcct

SEQ ID NO: 2469615 - DNA, 20 bp, Homo sapiens
gcagccagccctgcctggag

SEQ ID NO: 2469616 - DNA, 12 bp, Homo sapiens
gcagccagggag

SEQ ID NO: 2469617 - DNA, 15 bp, Homo sapiens
gcagccagggagagc

SEQ ID NO: 2469618 - DNA, 16 bp, Homo sapiens
gcagccagggagagcc

SEQ ID NO: 2469619 - DNA, 19 bp, Homo sapiens
gcagccagggagagcccag

SEQ ID NO: 2469620 - DNA, 17 bp, Homo sapiens
gcagccagtgccctgag

SEQ ID NO: 2469621 - DNA, 13 bp, Homo sapiens
gcagcccagccag

SEQ ID NO: 2469622 - DNA, 12 bp, Homo sapiens
gcagccccaggc

SEQ ID NO: 2469623 - DNA, 14 bp, Homo sapiens
gcagcccccagctc

SEQ ID NO: 2469624 - DNA, 13 bp, Homo sapiens
gcagcctcaggac

SEQ ID NO: 2469625 - DNA, 15 bp, Homo sapiens
gcagcctcaggactg

SEQ ID NO: 2469626 - DNA, 19 bp, Homo sapiens
gcagcctcaggactgggag

SEQ ID NO: 2469627 - DNA, 18 bp, Homo sapiens
gcagcctcccatccaggg

SEQ ID NO: 2469628 - DNA, 20 bp, Homo sapiens
gcagcctcccatccagggcc

SEQ ID NO: 2469629 - DNA, 14 bp, Homo sapiens
gcagcctctggggg

SEQ ID NO: 2469630 - DNA, 23 bp, Homo sapiens
gcagcctctggggggtggccagg

SEQ ID NO: 2469631 - DNA, 14 bp, Homo sapiens
gcagcctggggctg

SEQ ID NO: 2469632 - DNA, 14 bp, Homo sapiens
gcagcgaccgcccc

SEQ ID NO: 2469633 - DNA, 22 bp, Homo sapiens
gcagcgaccgccccctcctcta

SEQ ID NO: 2469634 - DNA, 12 bp, Homo sapiens
gcagcgagcctg

SEQ ID NO: 2469635 - DNA, 21 bp, Homo sapiens
gcagctgagcagggccgggga

SEQ ID NO: 2469636 - DNA, 21 bp, Homo sapiens
gcagctgccaggagcacggct

SEQ ID NO: 2469637 - DNA, 16 bp, Homo sapiens
gcagcttctgccccct

SEQ ID NO: 2469638 - DNA, 20 bp, Homo sapiens
gcagcttctgccccctgcag

SEQ ID NO: 2469639 - DNA, 20 bp, Homo sapiens
gcagcttgtagccagccggg

SEQ ID NO: 2469640 - DNA, 21 bp, Homo sapiens
gcaggaaatgaaaatgtcttg

SEQ ID NO: 2469641 - DNA, 13 bp, Homo sapiens
gcaggaaggagct

SEQ ID NO: 2469642 - DNA, 16 bp, Homo sapiens
gcaggaaggagctgcc

SEQ ID NO: 2469643 - DNA, 22 bp, Homo sapiens
gcaggaaggagctgcctggacc

SEQ ID NO: 2469644 - DNA, 20 bp, Homo sapiens
gcaggaccttcgggctgtgc

SEQ ID NO: 2469645 - DNA, 17 bp, Homo sapiens
gcaggactccaggccca

SEQ ID NO: 2469646 - DNA, 18 bp, Homo sapiens
gcaggactccaggcccaa

SEQ ID NO: 2469647 - DNA, 22 bp, Homo sapiens
gcaggactccaggcccaaggct

SEQ ID NO: 2469648 - DNA, 18 bp, Homo sapiens
gcaggaggggggagggaa

SEQ ID NO: 2469649 - DNA, 17 bp, Homo sapiens
gcaggagtagctgagct

SEQ ID NO: 2469650 - DNA, 18 bp, Homo sapiens
gcaggagtagctgagctc

SEQ ID NO: 2469651 - DNA, 18 bp, Homo sapiens
gcaggatctcaccaggca

SEQ ID NO: 2469652 - DNA, 19 bp, Homo sapiens
gcaggatctcaccaggcag

SEQ ID NO: 2469653 - DNA, 22 bp, Homo sapiens
gcaggatctcaccaggcagcct

SEQ ID NO: 2469654 - DNA, 14 bp, Homo sapiens
gcaggattgaaaat

SEQ ID NO: 2469655 - DNA, 21 bp, Homo sapiens
gcaggattggggaagagagcc

SEQ ID NO: 2469656 - DNA, 16 bp, Homo sapiens
gcaggcagaggcccag

SEQ ID NO: 2469657 - DNA, 18 bp, Homo sapiens
gcaggcaggctcccaggg

SEQ ID NO: 2469658 - DNA, 12 bp, Homo sapiens
gcaggcagggct

SEQ ID NO: 2469659 - DNA, 13 bp, Homo sapiens
gcaggcagggctc

SEQ ID NO: 2469660 - DNA, 14 bp, Homo sapiens
gcaggcagggctct

SEQ ID NO: 2469661 - DNA, 22 bp, Homo sapiens
gcaggcagggctctcctggctt

SEQ ID NO: 2469662 - DNA, 17 bp, Homo sapiens
gcaggccacctggctct

SEQ ID NO: 2469663 - DNA, 21 bp, Homo sapiens
gcaggccacctggctctcacc

SEQ ID NO: 2469664 - DNA, 19 bp, Homo sapiens
gcaggccgtgacgtctggg

SEQ ID NO: 2469665 - DNA, 19 bp, Homo sapiens
gcaggctgagtgcatttgg

SEQ ID NO: 2469666 - DNA, 12 bp, Homo sapiens
gcaggctggcca

SEQ ID NO: 2469667 - DNA, 14 bp, Homo sapiens
gcaggctgggccat

SEQ ID NO: 2469668 - DNA, 15 bp, Homo sapiens
gcaggctgggccatg

SEQ ID NO: 2469669 - DNA, 23 bp, Homo sapiens
gcaggctgggccatgtccaaaga

SEQ ID NO: 2469670 - DNA, 20 bp, Homo sapiens
gcagggccggggaactggcc

SEQ ID NO: 2469671 - DNA, 21 bp, Homo sapiens
gcagggctaccctgagctgag

SEQ ID NO: 2469672 - DNA, 18 bp, Homo sapiens
gcagggctctcctggctt

SEQ ID NO: 2469673 - DNA, 15 bp, Homo sapiens
gcaggggcctccatg

SEQ ID NO: 2469674 - DNA, 13 bp, Homo sapiens
gcaggggcctgga

SEQ ID NO: 2469675 - DNA, 15 bp, Homo sapiens
gcaggggcttcctgg

SEQ ID NO: 2469676 - DNA, 16 bp, Homo sapiens
gcagggggctgctgct

SEQ ID NO: 2469677 - DNA, 19 bp, Homo sapiens
gcaggtggatctatttcat

SEQ ID NO: 2469678 - DNA, 20 bp, Homo sapiens
gcaggtggatctatttcatg

SEQ ID NO: 2469679 - DNA, 21 bp, Homo sapiens
gcaggtggatctatttcatgt

SEQ ID NO: 2469680 - DNA, 19 bp, Homo sapiens
gcaggttcccaagctcaga

SEQ ID NO: 2469681 - DNA, 15 bp, Homo sapiens
gcagtacctgagggt

SEQ ID NO: 2469682 - DNA, 21 bp, Homo sapiens
gcagtccccttccctccaaga

SEQ ID NO: 2469683 - DNA, 23 bp, Homo sapiens
gcagtccccttccctccaagaag

SEQ ID NO: 2469684 - DNA, 16 bp, Homo sapiens
gcagtcctgggtcctc

SEQ ID NO: 2469685 - DNA, 15 bp, Homo sapiens
gcagtggcaggcaga

SEQ ID NO: 2469686 - DNA, 22 bp, Homo sapiens
gcagtggcaggcagaggcccag

SEQ ID NO: 2469687 - DNA, 19 bp, Homo sapiens
gcagtggctggtccagggc

SEQ ID NO: 2469688 - DNA, 21 bp, Homo sapiens
gcagtgtgaggccagggcaga

SEQ ID NO: 2469689 - DNA, 11 bp, Homo sapiens
gcagttatatt

SEQ ID NO: 2469690 - DNA, 21 bp, Homo sapiens
gcagttcccacattaaagaag

SEQ ID NO: 2469691 - DNA, 19 bp, Homo sapiens
gcagttcgcagccaccctg

SEQ ID NO: 2469692 - DNA, 20 bp, Homo sapiens
gcagttcgcagccaccctga

SEQ ID NO: 2469693 - DNA, 22 bp, Homo sapiens
gcagttcgcagccaccctgagg

SEQ ID NO: 2469694 - DNA, 23 bp, Homo sapiens
gcagttcgcagccaccctgagga

SEQ ID NO: 2469695 - DNA, 14 bp, Homo sapiens
gcagttgtctctgt

SEQ ID NO: 2469696 - DNA, 15 bp, Homo sapiens
gcagttgtctctgtt

SEQ ID NO: 2469697 - DNA, 11 bp, Homo sapiens
gcagttttttt

SEQ ID NO: 2469698 - DNA, 13 bp, Homo sapiens
gcataaattattg

SEQ ID NO: 2469699 - DNA, 23 bp, Homo sapiens
gcataccaggttttacacttgca

SEQ ID NO: 2469700 - DNA, 22 bp, Homo sapiens
gccaccaagagggacgcctggg

SEQ ID NO: 2469701 - DNA, 15 bp, Homo sapiens
gccaccaggccacct

SEQ ID NO: 2469702 - DNA, 14 bp, Homo sapiens
gccaccatggccag

SEQ ID NO: 2469703 - DNA, 18 bp, Homo sapiens
gccaccatggccagccaa

SEQ ID NO: 2469704 - DNA, 14 bp, Homo sapiens
gccacccagcccca

SEQ ID NO: 2469705 - DNA, 15 bp, Homo sapiens
gccacccagccccag

SEQ ID NO: 2469706 - DNA, 13 bp, Homo sapiens
gccaccctgagga

SEQ ID NO: 2469707 - DNA, 14 bp, Homo sapiens
gccaccctgaggag

SEQ ID NO: 2469708 - DNA, 16 bp, Homo sapiens
gccaccctgaggagtc

SEQ ID NO: 2469709 - DNA, 18 bp, Homo sapiens
gccaccgagtgccttcaa

SEQ ID NO: 2469710 - DNA, 24 bp, Homo sapiens
gccaccgtttcttcctgccagcag

SEQ ID NO: 2469711 - DNA, 12 bp, Homo sapiens
gccacctggacc

SEQ ID NO: 2469712 - DNA, 13 bp, Homo sapiens
gccacgctccagc

SEQ ID NO: 2469713 - DNA, 16 bp, Homo sapiens
gccacgctccagctgc

SEQ ID NO: 2469714 - DNA, 23 bp, Homo sapiens
gccacgtgtttgtgctgtggtgt

SEQ ID NO: 2469715 - DNA, 23 bp, Homo sapiens
gccactaaccttgcctggtacag

SEQ ID NO: 2469716 - DNA, 19 bp, Homo sapiens
gccactcactaggccccca

SEQ ID NO: 2469717 - DNA, 14 bp, Homo sapiens
gccactcctctgac

SEQ ID NO: 2469718 - DNA, 15 bp, Homo sapiens
gccactcctctgact

SEQ ID NO: 2469719 - DNA, 14 bp, Homo sapiens
gccactccttcctg

SEQ ID NO: 2469720 - DNA, 18 bp, Homo sapiens
gccactccttcctgcccc

SEQ ID NO: 2469721 - DNA, 19 bp, Homo sapiens
gccactgccattaaagaat

SEQ ID NO: 2469722 - DNA, 22 bp, Homo sapiens
gccactgccttcgcttcttgcc

SEQ ID NO: 2469723 - DNA, 15 bp, Homo sapiens
gccactgtgttcctt

SEQ ID NO: 2469724 - DNA, 18 bp, Homo sapiens
gccacttaaaatgttcac

SEQ ID NO: 2469725 - DNA, 13 bp, Homo sapiens
gccacttaatgta

SEQ ID NO: 2469726 - DNA, 18 bp, Homo sapiens
gccacttaatgtatgtta

SEQ ID NO: 2469727 - DNA, 19 bp, Homo sapiens
gccacttaatgtatgttac

SEQ ID NO: 2469728 - DNA, 16 bp, Homo sapiens
gccagagatccaaaag

SEQ ID NO: 2469729 - DNA, 20 bp, Homo sapiens
gccagagatccaaaagaagc

SEQ ID NO: 2469730 - DNA, 12 bp, Homo sapiens
gccagagccagg

SEQ ID NO: 2469731 - DNA, 15 bp, Homo sapiens
gccagagcccactcc

SEQ ID NO: 2469732 - DNA, 16 bp, Homo sapiens
gccagagcccactcca

SEQ ID NO: 2469733 - DNA, 23 bp, Homo sapiens
gccagagcccactccatctggta

SEQ ID NO: 2469734 - DNA, 12 bp, Homo sapiens
gccagagcctgg

SEQ ID NO: 2469735 - DNA, 13 bp, Homo sapiens
gccagagcctggg

SEQ ID NO: 2469736 - DNA, 14 bp, Homo sapiens
gccagagcctgggg

SEQ ID NO: 2469737 - DNA, 18 bp, Homo sapiens
gccagagcctggggctct

SEQ ID NO: 2469738 - DNA, 16 bp, Homo sapiens
gccagaggcccccagc

SEQ ID NO: 2469739 - DNA, 22 bp, Homo sapiens
gccagaggctcgttgactggct

SEQ ID NO: 2469740 - DNA, 17 bp, Homo sapiens
gccagatccagcctggg

SEQ ID NO: 2469741 - DNA, 20 bp, Homo sapiens
gccagatccagcctggggtc

SEQ ID NO: 2469742 - DNA, 21 bp, Homo sapiens
gccagcaccggaccagcctgg

SEQ ID NO: 2469743 - DNA, 22 bp, Homo sapiens
gccagcaccggaccagcctggc

SEQ ID NO: 2469744 - DNA, 19 bp, Homo sapiens
gccagcacttgtccagctg

SEQ ID NO: 2469745 - DNA, 16 bp, Homo sapiens
gccagcagcacctgcc

SEQ ID NO: 2469746 - DNA, 13 bp, Homo sapiens
gccagcatctggg

SEQ ID NO: 2469747 - DNA, 16 bp, Homo sapiens
gccagccaagctctgc

SEQ ID NO: 2469748 - DNA, 19 bp, Homo sapiens
gccagccaagctctgcagt

SEQ ID NO: 2469749 - DNA, 14 bp, Homo sapiens
gccagcccctggcc

SEQ ID NO: 2469750 - DNA, 19 bp, Homo sapiens
gccagccccttagacagag

SEQ ID NO: 2469751 - DNA, 20 bp, Homo sapiens
gccagccccttagacagagg

SEQ ID NO: 2469752 - DNA, 22 bp, Homo sapiens
gccagccccttagacagaggcc

SEQ ID NO: 2469753 - DNA, 13 bp, Homo sapiens
gccagccctgcct

SEQ ID NO: 2469754 - DNA, 14 bp, Homo sapiens
gccagccctgcctg

SEQ ID NO: 2469755 - DNA, 16 bp, Homo sapiens
gccagccctgcctgga

SEQ ID NO: 2469756 - DNA, 16 bp, Homo sapiens
gccagcctggcctcct

SEQ ID NO: 2469757 - DNA, 17 bp, Homo sapiens
gccagcctggcctcctg

SEQ ID NO: 2469758 - DNA, 22 bp, Homo sapiens
gccagcgtcctcctctgtgacc

SEQ ID NO: 2469759 - DNA, 22 bp, Homo sapiens
gccagctaaggggtggggctgc

SEQ ID NO: 2469760 - DNA, 14 bp, Homo sapiens
gccagctggaggca

SEQ ID NO: 2469761 - DNA, 15 bp, Homo sapiens
gccagctggaggcag

SEQ ID NO: 2469762 - DNA, 20 bp, Homo sapiens
gccagctgtggttttctttt

SEQ ID NO: 2469763 - DNA, 23 bp, Homo sapiens
gccagcttgtttacatgcttatt

SEQ ID NO: 2469764 - DNA, 22 bp, Homo sapiens
gccaggaagctttggtgagaac

SEQ ID NO: 2469765 - DNA, 22 bp, Homo sapiens
gccaggaccagtcaacctgggc

SEQ ID NO: 2469766 - DNA, 15 bp, Homo sapiens
gccaggactctgcag

SEQ ID NO: 2469767 - DNA, 18 bp, Homo sapiens
gccaggactctgcagcct

SEQ ID NO: 2469768 - DNA, 12 bp, Homo sapiens
gccaggagaagc

SEQ ID NO: 2469769 - DNA, 19 bp, Homo sapiens
gccaggagcacggctctgt

SEQ ID NO: 2469770 - DNA, 17 bp, Homo sapiens
gccaggaggtgccactg

SEQ ID NO: 2469771 - DNA, 13 bp, Homo sapiens
gccaggcagatga

SEQ ID NO: 2469772 - DNA, 14 bp, Homo sapiens
gccaggcatgtggc

SEQ ID NO: 2469773 - DNA, 15 bp, Homo sapiens
gccaggctaattttt

SEQ ID NO: 2469774 - DNA, 16 bp, Homo sapiens
gccaggctgaccacag

SEQ ID NO: 2469775 - DNA, 20 bp, Homo sapiens
gccaggctgaccacagcaca

SEQ ID NO: 2469776 - DNA, 22 bp, Homo sapiens
gccaggctgaccacagcacagc

SEQ ID NO: 2469777 - DNA, 20 bp, Homo sapiens
gccagggccacgctccagct

SEQ ID NO: 2469778 - DNA, 14 bp, Homo sapiens
gccagggcccctct

SEQ ID NO: 2469779 - DNA, 15 bp, Homo sapiens
gccagggcccctctc

SEQ ID NO: 2469780 - DNA, 23 bp, Homo sapiens
gccagggcccctctccccaggga

SEQ ID NO: 2469781 - DNA, 20 bp, Homo sapiens
gccaggggagcagaggggca

SEQ ID NO: 2469782 - DNA, 22 bp, Homo sapiens
gccagggggagctgggcctggt

SEQ ID NO: 2469783 - DNA, 19 bp, Homo sapiens
gccaggggggtgaggagct

SEQ ID NO: 2469784 - DNA, 15 bp, Homo sapiens
gccagggtctccaga

SEQ ID NO: 2469785 - DNA, 22 bp, Homo sapiens
gccaggtcaccctttgctgtga

SEQ ID NO: 2469786 - DNA, 13 bp, Homo sapiens
gccaggtccctct

SEQ ID NO: 2469787 - DNA, 20 bp, Homo sapiens
gccagtaacgcgtcttcctg

SEQ ID NO: 2469788 - DNA, 14 bp, Homo sapiens
gccagtattttaaa

SEQ ID NO: 2469789 - DNA, 15 bp, Homo sapiens
gccagtattttaaaa

SEQ ID NO: 2469790 - DNA, 14 bp, Homo sapiens
gccagtccaggctg

SEQ ID NO: 2469791 - DNA, 14 bp, Homo sapiens
gccagtcctgtcct

SEQ ID NO: 2469792 - DNA, 13 bp, Homo sapiens
gccagtctgtgga

SEQ ID NO: 2469793 - DNA, 14 bp, Homo sapiens
gccagtgacagaca

SEQ ID NO: 2469794 - DNA, 17 bp, Homo sapiens
gccagtgccctgagcca

SEQ ID NO: 2469795 - DNA, 22 bp, Homo sapiens
gccataaaacaggtaatataaa

SEQ ID NO: 2469796 - DNA, 14 bp, Homo sapiens
gccatactgtgtcc

SEQ ID NO: 2469797 - DNA, 16 bp, Homo sapiens
gccatatgatttacat

SEQ ID NO: 2469798 - DNA, 20 bp, Homo sapiens
gccatattaaattttttgtt

SEQ ID NO: 2469799 - DNA, 23 bp, Homo sapiens
gccatattaaattttttgttgac

SEQ ID NO: 2469800 - DNA, 20 bp, Homo sapiens
gccatatttacctcagcctg

SEQ ID NO: 2469801 - DNA, 18 bp, Homo sapiens
gccatatttgtaaaatga

SEQ ID NO: 2469802 - DNA, 20 bp, Homo sapiens
gccatatttgtaaaatgaca

SEQ ID NO: 2469803 - DNA, 18 bp, Homo sapiens
gccatcaaaatgcttttt

SEQ ID NO: 2469804 - DNA, 20 bp, Homo sapiens
gcccccctggtcccctcctt

SEQ ID NO: 2469805 - DNA, 19 bp, Homo sapiens
gccccctcctctagctgtg

SEQ ID NO: 2469806 - DNA, 20 bp, Homo sapiens
gccccctcctctagctgtgg

SEQ ID NO: 2469807 - DNA, 12 bp, Homo sapiens
gccccctgcagg

SEQ ID NO: 2469808 - DNA, 16 bp, Homo sapiens
gccccctgcaggaagg

SEQ ID NO: 2469809 - DNA, 20 bp, Homo sapiens
gccccctgcaggaaggagct

SEQ ID NO: 2469810 - DNA, 24 bp, Homo sapiens
gccccctgcaggaaggagctgcct

SEQ ID NO: 2469811 - DNA, 13 bp, Homo sapiens
gccccctgccccc

SEQ ID NO: 2469812 - DNA, 15 bp, Homo sapiens
gccccgccctgcccc

SEQ ID NO: 2469813 - DNA, 18 bp, Homo sapiens
gcccctccctcccagagc

SEQ ID NO: 2469814 - DNA, 15 bp, Homo sapiens
gcccctctcagccct

SEQ ID NO: 2469815 - DNA, 12 bp, Homo sapiens
gcccctctccct

SEQ ID NO: 2469816 - DNA, 21 bp, Homo sapiens
gcccctctcccttgggctctg

SEQ ID NO: 2469817 - DNA, 23 bp, Homo sapiens
gcccctctcccttgggctctgat

SEQ ID NO: 2469818 - DNA, 17 bp, Homo sapiens
gcccctctccttcttag

SEQ ID NO: 2469819 - DNA, 19 bp, Homo sapiens
gcccctctggtcgctcctg

SEQ ID NO: 2469820 - DNA, 13 bp, Homo sapiens
gcccctggcagag

SEQ ID NO: 2469821 - DNA, 17 bp, Homo sapiens
gcccctggcagagatgc

SEQ ID NO: 2469822 - DNA, 22 bp, Homo sapiens
gcccctggcagagatgcctccc

SEQ ID NO: 2469823 - DNA, 12 bp, Homo sapiens
gcccctggctgg

SEQ ID NO: 2469824 - DNA, 16 bp, Homo sapiens
gcccctggctgggacg

SEQ ID NO: 2469825 - DNA, 21 bp, Homo sapiens
gcccctggggtggccaccagt

SEQ ID NO: 2469826 - DNA, 17 bp, Homo sapiens
gccccttccgccactgg

SEQ ID NO: 2469827 - DNA, 19 bp, Homo sapiens
gccccttccgccactgggg

SEQ ID NO: 2469828 - DNA, 19 bp, Homo sapiens
gccccttgacaactggcag

SEQ ID NO: 2469829 - DNA, 17 bp, Homo sapiens
gcccgagcagctgagca

SEQ ID NO: 2469830 - DNA, 21 bp, Homo sapiens
gcccgcgatgtggaactgctg

SEQ ID NO: 2469831 - DNA, 24 bp, Homo sapiens
gcccgcgatgtggaactgctgcca

SEQ ID NO: 2469832 - DNA, 13 bp, Homo sapiens
gcccgtcctgcct

SEQ ID NO: 2469833 - DNA, 13 bp, Homo sapiens
gcccgtctcagtg

SEQ ID NO: 2469834 - DNA, 14 bp, Homo sapiens
gcccgtctcagtgt

SEQ ID NO: 2469835 - DNA, 15 bp, Homo sapiens
gccctaagcagaaag

SEQ ID NO: 2469836 - DNA, 16 bp, Homo sapiens
gccctaagcagaaagt

SEQ ID NO: 2469837 - DNA, 21 bp, Homo sapiens
gccctaagcagaaagtgcctt

SEQ ID NO: 2469838 - DNA, 16 bp, Homo sapiens
gccctacctgccccac

SEQ ID NO: 2469839 - DNA, 21 bp, Homo sapiens
gccctatttagatgataaaga

SEQ ID NO: 2469840 - DNA, 16 bp, Homo sapiens
gccctcacacaccctg

SEQ ID NO: 2469841 - DNA, 19 bp, Homo sapiens
gccctcagtagtccctgca

SEQ ID NO: 2469842 - DNA, 23 bp, Homo sapiens
gccctcagtagtccctgcacagt

SEQ ID NO: 2469843 - DNA, 12 bp, Homo sapiens
gccctcatcccg

SEQ ID NO: 2469844 - DNA, 18 bp, Homo sapiens
gccctcatggcccctctg

SEQ ID NO: 2469845 - DNA, 19 bp, Homo sapiens
gccctccacacctgcggcc

SEQ ID NO: 2469846 - DNA, 14 bp, Homo sapiens
gccctccaggcttt

SEQ ID NO: 2469847 - DNA, 22 bp, Homo sapiens
gccctccctgttccccagagaa

SEQ ID NO: 2469848 - DNA, 16 bp, Homo sapiens
gccctcctctgcactc

SEQ ID NO: 2469849 - DNA, 19 bp, Homo sapiens
gccctcctgtgctcagccc

SEQ ID NO: 2469850 - DNA, 21 bp, Homo sapiens
gccctcctgtgctcagccctg

SEQ ID NO: 2469851 - DNA, 17 bp, Homo sapiens
gccctccttcctaaatt

SEQ ID NO: 2469852 - DNA, 17 bp, Homo sapiens
gccctcgctgccagctc

SEQ ID NO: 2469853 - DNA, 17 bp, Homo sapiens
gccctcgtggtggaaac

SEQ ID NO: 2469854 - DNA, 17 bp, Homo sapiens
gccctctcccctcagcc

SEQ ID NO: 2469855 - DNA, 14 bp, Homo sapiens
gccctctcccctgc

SEQ ID NO: 2469856 - DNA, 21 bp, Homo sapiens
gccctgaggacagatgcctcc

SEQ ID NO: 2469857 - DNA, 17 bp, Homo sapiens
gccctgcaccatgctgc

SEQ ID NO: 2469858 - DNA, 15 bp, Homo sapiens
gccctgcagcatccc

SEQ ID NO: 2469859 - DNA, 12 bp, Homo sapiens
gccctgccactc

SEQ ID NO: 2469860 - DNA, 20 bp, Homo sapiens
gccctgccactcactaggcc

SEQ ID NO: 2469861 - DNA, 13 bp, Homo sapiens
gccctgcctggag

SEQ ID NO: 2469862 - DNA, 14 bp, Homo sapiens
gccctgcctggagg

SEQ ID NO: 2469863 - DNA, 15 bp, Homo sapiens
gccctgcctggagga

SEQ ID NO: 2469864 - DNA, 19 bp, Homo sapiens
gccctgcctggaggacctg

SEQ ID NO: 2469865 - DNA, 20 bp, Homo sapiens
gccctgcctggaggacctga

SEQ ID NO: 2469866 - DNA, 15 bp, Homo sapiens
gccctgcttcctgct

SEQ ID NO: 2469867 - DNA, 22 bp, Homo sapiens
gccctgcttcctgcttgccaag

SEQ ID NO: 2469868 - DNA, 17 bp, Homo sapiens
gccctggatcagcgtgg

SEQ ID NO: 2469869 - DNA, 15 bp, Homo sapiens
gccctggcatgtcaa

SEQ ID NO: 2469870 - DNA, 16 bp, Homo sapiens
gccctggcctcccctg

SEQ ID NO: 2469871 - DNA, 20 bp, Homo sapiens
gccctggcctcccctgccac

SEQ ID NO: 2469872 - DNA, 21 bp, Homo sapiens
gccctggcctcccctgccacc

SEQ ID NO: 2469873 - DNA, 20 bp, Homo sapiens
gccctgggaccgctacacca

SEQ ID NO: 2469874 - DNA, 22 bp, Homo sapiens
gccctgggaccgctacaccact

SEQ ID NO: 2469875 - DNA, 16 bp, Homo sapiens
gccctgggctggaatc

SEQ ID NO: 2469876 - DNA, 20 bp, Homo sapiens
gccctggtggccctctcccc

SEQ ID NO: 2469877 - DNA, 20 bp, Homo sapiens
gccctgtcagcatgaatttg

SEQ ID NO: 2469878 - DNA, 17 bp, Homo sapiens
gccctgtcctggtggta

SEQ ID NO: 2469879 - DNA, 20 bp, Homo sapiens
gccctgtgccccttgacaac

SEQ ID NO: 2469880 - DNA, 15 bp, Homo sapiens
gcccttccaaactct

SEQ ID NO: 2469881 - DNA, 13 bp, Homo sapiens
gcccttcctggac

SEQ ID NO: 2469882 - DNA, 15 bp, Homo sapiens
gcccttcctggacag

SEQ ID NO: 2469883 - DNA, 12 bp, Homo sapiens
gcccttctttct

SEQ ID NO: 2469884 - DNA, 13 bp, Homo sapiens
gcccttctttcta

SEQ ID NO: 2469885 - DNA, 18 bp, Homo sapiens
gcccttgcttacctctca

SEQ ID NO: 2469886 - DNA, 20 bp, Homo sapiens
gcccttgtttggggcaggag

SEQ ID NO: 2469887 - DNA, 21 bp, Homo sapiens
gcccttgtttggggcaggagt

SEQ ID NO: 2469888 - DNA, 14 bp, Homo sapiens
gccgaagctaacag

SEQ ID NO: 2469889 - DNA, 18 bp, Homo sapiens
gccgacgcttgcacgacc

SEQ ID NO: 2469890 - DNA, 14 bp, Homo sapiens
gccgagcaggaggc

SEQ ID NO: 2469891 - DNA, 22 bp, Homo sapiens
gccgatatactctagatgaagt

SEQ ID NO: 2469892 - DNA, 14 bp, Homo sapiens
gccgatgcccagag

SEQ ID NO: 2469893 - DNA, 13 bp, Homo sapiens
gccgctgtgccag

SEQ ID NO: 2469894 - DNA, 15 bp, Homo sapiens
gccggacgcatctca

SEQ ID NO: 2469895 - DNA, 12 bp, Homo sapiens
gccggccagccc

SEQ ID NO: 2469896 - DNA, 13 bp, Homo sapiens
gccggctccttgg

SEQ ID NO: 2469897 - DNA, 16 bp, Homo sapiens
gccgggcggtcacagc

SEQ ID NO: 2469898 - DNA, 16 bp, Homo sapiens
gccggggaactggcca

SEQ ID NO: 2469899 - DNA, 22 bp, Homo sapiens
gccggggaactggccaagctga

SEQ ID NO: 2469900 - DNA, 15 bp, Homo sapiens
gccggggcagccccc

SEQ ID NO: 2469901 - DNA, 23 bp, Homo sapiens
gccggggtggggtggctgcagcc

SEQ ID NO: 2469902 - DNA, 21 bp, Homo sapiens
gccggtcgccctttgctgcat

SEQ ID NO: 2469903 - DNA, 24 bp, Homo sapiens
gccggtcgccctttgctgcatggc

SEQ ID NO: 2469904 - DNA, 17 bp, Homo sapiens
gccgtcagtgctgtgct

SEQ ID NO: 2469905 - DNA, 20 bp, Homo sapiens
gccgtcccctagagtcccag

SEQ ID NO: 2469906 - DNA, 16 bp, Homo sapiens
gccgtgaatgggtgcc

SEQ ID NO: 2469907 - DNA, 17 bp, Homo sapiens
gccgtgctcgccccagc

SEQ ID NO: 2469908 - DNA, 20 bp, Homo sapiens
gcctggagatcctcctgcag

SEQ ID NO: 2469909 - DNA, 21 bp, Homo sapiens
gcctggagatgacttgaggcc

SEQ ID NO: 2469910 - DNA, 14 bp, Homo sapiens
gcctggaggacctg

SEQ ID NO: 2469911 - DNA, 17 bp, Homo sapiens
gcctggaggacctgagc

SEQ ID NO: 2469912 - DNA, 19 bp, Homo sapiens
gcctggaggacctgagcct

SEQ ID NO: 2469913 - DNA, 24 bp, Homo sapiens
gcctggagtgtatgactgcacatg

SEQ ID NO: 2469914 - DNA, 20 bp, Homo sapiens
gcctggatgcggatggccgg

SEQ ID NO: 2469915 - DNA, 15 bp, Homo sapiens
gcctggccagtgccc

SEQ ID NO: 2469916 - DNA, 16 bp, Homo sapiens
gcctggccccatggtc

SEQ ID NO: 2469917 - DNA, 14 bp, Homo sapiens
gcctggcctcctgc

SEQ ID NO: 2469918 - DNA, 15 bp, Homo sapiens
gcctggcctcctgcc

SEQ ID NO: 2469919 - DNA, 12 bp, Homo sapiens
gcctggctggct

SEQ ID NO: 2469920 - DNA, 18 bp, Homo sapiens
gcctggctggctgagggc

SEQ ID NO: 2469921 - DNA, 16 bp, Homo sapiens
gcctgggaaagcccct

SEQ ID NO: 2469922 - DNA, 18 bp, Homo sapiens
gcctgggaaagcccctgc

SEQ ID NO: 2469923 - DNA, 16 bp, Homo sapiens
gcctgggacaactgct

SEQ ID NO: 2469924 - DNA, 14 bp, Homo sapiens
gcctgggcagtgga

SEQ ID NO: 2469925 - DNA, 17 bp, Homo sapiens
gcctggggctggcctcc

SEQ ID NO: 2469926 - DNA, 18 bp, Homo sapiens
gcctgggggcctggctgg

SEQ ID NO: 2469927 - DNA, 14 bp, Homo sapiens
gcctggggtctgga

SEQ ID NO: 2469928 - DNA, 19 bp, Homo sapiens
gcctggggtgacccggcac

SEQ ID NO: 2469929 - DNA, 18 bp, Homo sapiens
gcctggtctcaccctgga

SEQ ID NO: 2469930 - DNA, 19 bp, Homo sapiens
gcctggtctcaccctggag

SEQ ID NO: 2469931 - DNA, 20 bp, Homo sapiens
gcctggtctcaccctggagg

SEQ ID NO: 2469932 - DNA, 20 bp, Homo sapiens
gcctggtgcccagcacatgt

SEQ ID NO: 2469933 - DNA, 20 bp, Homo sapiens
gcctgtaccggtttggctgg

SEQ ID NO: 2469934 - DNA, 14 bp, Homo sapiens
gcctgtactgcctg

SEQ ID NO: 2469935 - DNA, 15 bp, Homo sapiens
gcctgtactgcctgc

SEQ ID NO: 2469936 - DNA, 16 bp, Homo sapiens
gcctgtactgcctgct

SEQ ID NO: 2469937 - DNA, 20 bp, Homo sapiens
gcctgtactgcctgcttggg

SEQ ID NO: 2469938 - DNA, 15 bp, Homo sapiens
gcctgtcagatccag

SEQ ID NO: 2469939 - DNA, 19 bp, Homo sapiens
gcctgtcagatccaggagc

SEQ ID NO: 2469940 - DNA, 18 bp, Homo sapiens
gcctgtccacaggcttct

SEQ ID NO: 2469941 - DNA, 23 bp, Homo sapiens
gcctgtccacaggcttctgagca

SEQ ID NO: 2469942 - DNA, 12 bp, Homo sapiens
gcctgtcctgcc

SEQ ID NO: 2469943 - DNA, 14 bp, Homo sapiens
gcctgtcctgcctg

SEQ ID NO: 2469944 - DNA, 14 bp, Homo sapiens
gcctgtgccaggtg

SEQ ID NO: 2469945 - DNA, 23 bp, Homo sapiens
gcctgtggcgccgtctccagggg

SEQ ID NO: 2469946 - DNA, 16 bp, Homo sapiens
gcctgtggttctgaga

SEQ ID NO: 2469947 - DNA, 16 bp, Homo sapiens
gcctgtgtagctgtga

SEQ ID NO: 2469948 - DNA, 20 bp, Homo sapiens
gcctgtgtagctgtgacctg

SEQ ID NO: 2469949 - DNA, 21 bp, Homo sapiens
gcctgtgtagctgtgacctgc

SEQ ID NO: 2469950 - DNA, 22 bp, Homo sapiens
gcctgtgtagctgtgacctgct

SEQ ID NO: 2469951 - DNA, 17 bp, Homo sapiens
gcctgtgttcttcctgg

SEQ ID NO: 2469952 - DNA, 20 bp, Homo sapiens
gcctgtgttcttcctggccg

SEQ ID NO: 2469953 - DNA, 19 bp, Homo sapiens
gcgcgtgcatgtgtgcgtg

SEQ ID NO: 2469954 - DNA, 14 bp, Homo sapiens
gcgctgctggtgtt

SEQ ID NO: 2469955 - DNA, 17 bp, Homo sapiens
gcgctggtcctttcttc

SEQ ID NO: 2469956 - DNA, 20 bp, Homo sapiens
gcggaacaaggagtcagaca

SEQ ID NO: 2469957 - DNA, 10 bp, Homo sapiens
gcggacacac

SEQ ID NO: 2469958 - DNA, 15 bp, Homo sapiens
gcggcaggggcctgg

SEQ ID NO: 2469959 - DNA, 19 bp, Homo sapiens
gcggcaggggcctggagat

SEQ ID NO: 2469960 - DNA, 22 bp, Homo sapiens
gcggcccaatccaaggtggggt

SEQ ID NO: 2469961 - DNA, 13 bp, Homo sapiens
gcggccggccagc

SEQ ID NO: 2469962 - DNA, 19 bp, Homo sapiens
gcggcctatgacttgggca

SEQ ID NO: 2469963 - DNA, 23 bp, Homo sapiens
gcggcctatgacttgggcacccc

SEQ ID NO: 2469964 - DNA, 19 bp, Homo sapiens
gcggctggccatggagaaa

SEQ ID NO: 2469965 - DNA, 20 bp, Homo sapiens
gcggctggccatggagaaag

SEQ ID NO: 2469966 - DNA, 16 bp, Homo sapiens
gcggctggggtcccag

SEQ ID NO: 2469967 - DNA, 21 bp, Homo sapiens
gcggctggggtcccagcagct

SEQ ID NO: 2469968 - DNA, 16 bp, Homo sapiens
gcgggatggggctccc

SEQ ID NO: 2469969 - DNA, 15 bp, Homo sapiens
gcgggcagagggctg

SEQ ID NO: 2469970 - DNA, 18 bp, Homo sapiens
gcgggcagagggctggag

SEQ ID NO: 2469971 - DNA, 19 bp, Homo sapiens
gcgggcagagggctggagg

SEQ ID NO: 2469972 - DNA, 15 bp, Homo sapiens
gcgggcgcgtgagtg

SEQ ID NO: 2469973 - DNA, 23 bp, Homo sapiens
gcgggggttccgtgtccaccccc

SEQ ID NO: 2469974 - DNA, 15 bp, Homo sapiens
gcgggtctgctccca

SEQ ID NO: 2469975 - DNA, 17 bp, Homo sapiens
gcgggtctgctcccaag

SEQ ID NO: 2469976 - DNA, 21 bp, Homo sapiens
gcgggtgaacaaagcagccac

SEQ ID NO: 2469977 - DNA, 22 bp, Homo sapiens
gcgggtgaacaaagcagccacg

SEQ ID NO: 2469978 - DNA, 23 bp, Homo sapiens
gcggtagccagcacacagggcag

SEQ ID NO: 2469979 - DNA, 20 bp, Homo sapiens
gcggtgggacctagggaggc

SEQ ID NO: 2469980 - DNA, 18 bp, Homo sapiens
gcggttataaaaaatggt

SEQ ID NO: 2469981 - DNA, 21 bp, Homo sapiens
gcggtttggtttgcagcgact

SEQ ID NO: 2469982 - DNA, 14 bp, Homo sapiens
gcgtaagtacagag

SEQ ID NO: 2469983 - DNA, 15 bp, Homo sapiens
gcgtaagtacagaga

SEQ ID NO: 2469984 - DNA, 18 bp, Homo sapiens
gcgtaggctacagagaag

SEQ ID NO: 2469985 - DNA, 14 bp, Homo sapiens
gcgtcctcctctgt

SEQ ID NO: 2469986 - DNA, 15 bp, Homo sapiens
gcgtcctcctctgtg

SEQ ID NO: 2469987 - DNA, 16 bp, Homo sapiens
gcgtcctcctctgtga

SEQ ID NO: 2469988 - DNA, 14 bp, Homo sapiens
gcgtctaccctggg

SEQ ID NO: 2469989 - DNA, 15 bp, Homo sapiens
gcgtctaccctggga

SEQ ID NO: 2469990 - DNA, 16 bp, Homo sapiens
gcgtctaccctgggat

SEQ ID NO: 2469991 - DNA, 14 bp, Homo sapiens
gcgtcttcctgagt

SEQ ID NO: 2469992 - DNA, 22 bp, Homo sapiens
gcgtggaggggtaggggctggg

SEQ ID NO: 2469993 - DNA, 21 bp, Homo sapiens
gcgtggccttgttctgtcacc

SEQ ID NO: 2469994 - DNA, 12 bp, Homo sapiens
gcgtggctgact

SEQ ID NO: 2469995 - DNA, 16 bp, Homo sapiens
gcgtggtggtccctgg

SEQ ID NO: 2469996 - DNA, 15 bp, Homo sapiens
gcgttcctttctttt

SEQ ID NO: 2469997 - DNA, 16 bp, Homo sapiens
gcgttcctttcttttc

SEQ ID NO: 2469998 - DNA, 17 bp, Homo sapiens
gcgttcttgtaatttta

SEQ ID NO: 2469999 - DNA, 17 bp, Homo sapiens
gctaaaacaatgaataa

SEQ ID NO: 2470000 - DNA, 15 bp, Homo sapiens
gctaaaagaaacttt

SEQ ID NO: 2470001 - DNA, 19 bp, Homo sapiens
gctaaatcctttactgtta

SEQ ID NO: 2470002 - DNA, 15 bp, Homo sapiens
gctaacagggaaggc

SEQ ID NO: 2470003 - DNA, 22 bp, Homo sapiens
gctaacagggaaggcaggcagg

SEQ ID NO: 2470004 - DNA, 13 bp, Homo sapiens
gctaagagaagta

SEQ ID NO: 2470005 - DNA, 14 bp, Homo sapiens
gctaagagaagtag

SEQ ID NO: 2470006 - DNA, 20 bp, Homo sapiens
gctaagctcacgtcctgaga

SEQ ID NO: 2470007 - DNA, 22 bp, Homo sapiens
gctaagctcacgtcctgagaaa

SEQ ID NO: 2470008 - DNA, 16 bp, Homo sapiens
gctaaggggtggggct

SEQ ID NO: 2470009 - DNA, 15 bp, Homo sapiens
gctaaggttctaagg

SEQ ID NO: 2470010 - DNA, 21 bp, Homo sapiens
gctaataaaaagcttttgtct

SEQ ID NO: 2470011 - DNA, 18 bp, Homo sapiens
gctacaccactctggcag

SEQ ID NO: 2470012 - DNA, 21 bp, Homo sapiens
gctacaccactctggcagcca

SEQ ID NO: 2470013 - DNA, 17 bp, Homo sapiens
gctacacccttttccag

SEQ ID NO: 2470014 - DNA, 19 bp, Homo sapiens
gctacacccttttccagct

SEQ ID NO: 2470015 - DNA, 11 bp, Homo sapiens
gctacagagaa

SEQ ID NO: 2470016 - DNA, 17 bp, Homo sapiens
gctacagagaaaccagc

SEQ ID NO: 2470017 - DNA, 19 bp, Homo sapiens
gctacagagaaaccagctt

SEQ ID NO: 2470018 - DNA, 12 bp, Homo sapiens
gctacagagaag

SEQ ID NO: 2470019 - DNA, 14 bp, Homo sapiens
gctacagagaagcc

SEQ ID NO: 2470020 - DNA, 16 bp, Homo sapiens
gctacagagaagcctt

SEQ ID NO: 2470021 - DNA, 21 bp, Homo sapiens
gctaccagtatttagaagcca

SEQ ID NO: 2470022 - DNA, 20 bp, Homo sapiens
gctaccctgagctgaggcag

SEQ ID NO: 2470023 - DNA, 17 bp, Homo sapiens
gctacctgtgtggacag

SEQ ID NO: 2470024 - DNA, 19 bp, Homo sapiens
gctacctgtgtggacagga

SEQ ID NO: 2470025 - DNA, 23 bp, Homo sapiens
gctactctccccacgagggctgg

SEQ ID NO: 2470026 - DNA, 13 bp, Homo sapiens
gctactctgtgcc

SEQ ID NO: 2470027 - DNA, 16 bp, Homo sapiens
gctactctgtgccaga

SEQ ID NO: 2470028 - DNA, 15 bp, Homo sapiens
gctactgtgtgtgtg

SEQ ID NO: 2470029 - DNA, 19 bp, Homo sapiens
gctactgtgtgtgtgaatg

SEQ ID NO: 2470030 - DNA, 18 bp, Homo sapiens
gctacttcggggctggga

SEQ ID NO: 2470031 - DNA, 16 bp, Homo sapiens
gctactttgctgctat

SEQ ID NO: 2470032 - DNA, 21 bp, Homo sapiens
gctagaattgagtgtttaaag

SEQ ID NO: 2470033 - DNA, 13 bp, Homo sapiens
gctagagctcctc

SEQ ID NO: 2470034 - DNA, 15 bp, Homo sapiens
gctagagctcctccc

SEQ ID NO: 2470035 - DNA, 16 bp, Homo sapiens
gctagagctcctccct

SEQ ID NO: 2470036 - DNA, 17 bp, Homo sapiens
gctagagctcctccctc

SEQ ID NO: 2470037 - DNA, 20 bp, Homo sapiens
gctaggaagagcaggactcc

SEQ ID NO: 2470038 - DNA, 12 bp, Homo sapiens
gctaggaagagg

SEQ ID NO: 2470039 - DNA, 19 bp, Homo sapiens
gctaggagcaaagcctgtt

SEQ ID NO: 2470040 - DNA, 16 bp, Homo sapiens
gctaggccagcagggg

SEQ ID NO: 2470041 - DNA, 17 bp, Homo sapiens
gctagtcttttgctttt

SEQ ID NO: 2470042 - DNA, 22 bp, Homo sapiens
gctagtcttttgcttttgccca

SEQ ID NO: 2470043 - DNA, 14 bp, Homo sapiens
gctagtgacttgtg

SEQ ID NO: 2470044 - DNA, 16 bp, Homo sapiens
gctatagatgtctttt

SEQ ID NO: 2470045 - DNA, 20 bp, Homo sapiens
gctatagatgtcttttccca

SEQ ID NO: 2470046 - DNA, 18 bp, Homo sapiens
gctatggtgctctgtcta

SEQ ID NO: 2470047 - DNA, 18 bp, Homo sapiens
gctatgtttttaatgtat

SEQ ID NO: 2470048 - DNA, 19 bp, Homo sapiens
gctatttgatgtaatactt

SEQ ID NO: 2470049 - DNA, 15 bp, Homo sapiens
gctatttgtaaatct

SEQ ID NO: 2470050 - DNA, 14 bp, Homo sapiens
gctatttgtcatct

SEQ ID NO: 2470051 - DNA, 13 bp, Homo sapiens
gctatttttctaa

SEQ ID NO: 2470052 - DNA, 21 bp, Homo sapiens
gctatttttctaactacaaag

SEQ ID NO: 2470053 - DNA, 22 bp, Homo sapiens
gctcaagcagcgaccgccccct

SEQ ID NO: 2470054 - DNA, 23 bp, Homo sapiens
gctcaagcagcgaccgccccctc

SEQ ID NO: 2470055 - DNA, 18 bp, Homo sapiens
gctcaagcgattctcctg

SEQ ID NO: 2470056 - DNA, 20 bp, Homo sapiens
gctcaatgagcatgtttaga

SEQ ID NO: 2470057 - DNA, 14 bp, Homo sapiens
gctcacaaggcagc

SEQ ID NO: 2470058 - DNA, 19 bp, Homo sapiens
gctcacaaggcagcaaggc

SEQ ID NO: 2470059 - DNA, 13 bp, Homo sapiens
gctcacacacctg

SEQ ID NO: 2470060 - DNA, 13 bp, Homo sapiens
gctcacccagtgc

SEQ ID NO: 2470061 - DNA, 22 bp, Homo sapiens
gctcacccccttctccatccac

SEQ ID NO: 2470062 - DNA, 15 bp, Homo sapiens
gctcactcagccacc

SEQ ID NO: 2470063 - DNA, 20 bp, Homo sapiens
gctcagatcggccacagggc

SEQ ID NO: 2470064 - DNA, 13 bp, Homo sapiens
gctcagccagcac

SEQ ID NO: 2470065 - DNA, 21 bp, Homo sapiens
gctcagccatcccgtcttctc

SEQ ID NO: 2470066 - DNA, 21 bp, Homo sapiens
gctcagccccaccccagggca

SEQ ID NO: 2470067 - DNA, 12 bp, Homo sapiens
gctcagccctgc

SEQ ID NO: 2470068 - DNA, 16 bp, Homo sapiens
gctcagctctgggcca

SEQ ID NO: 2470069 - DNA, 20 bp, Homo sapiens
gctcaggatgagggaaaaga

SEQ ID NO: 2470070 - DNA, 18 bp, Homo sapiens
gctcagggaccatggctt

SEQ ID NO: 2470071 - DNA, 20 bp, Homo sapiens
gctcagtgaagttgctgctt

SEQ ID NO: 2470072 - DNA, 19 bp, Homo sapiens
gctcatcattctctgtctc

SEQ ID NO: 2470073 - DNA, 13 bp, Homo sapiens
gctcatctgctgg

SEQ ID NO: 2470074 - DNA, 23 bp, Homo sapiens
gctcatctgctggtccgtgggac

SEQ ID NO: 2470075 - DNA, 14 bp, Homo sapiens
gctccaagattcta

SEQ ID NO: 2470076 - DNA, 15 bp, Homo sapiens
gctccaagattctag

SEQ ID NO: 2470077 - DNA, 16 bp, Homo sapiens
gctccaagccccatct

SEQ ID NO: 2470078 - DNA, 19 bp, Homo sapiens
gctccaccctggccgagtc

SEQ ID NO: 2470079 - DNA, 21 bp, Homo sapiens
gctccagacctgatcctggag

SEQ ID NO: 2470080 - DNA, 23 bp, Homo sapiens
gctccagacctgatcctggaggc

SEQ ID NO: 2470081 - DNA, 21 bp, Homo sapiens
gctccagagggcactctgctt

SEQ ID NO: 2470082 - DNA, 21 bp, Homo sapiens
gctccagatgcagggcagtca

SEQ ID NO: 2470083 - DNA, 17 bp, Homo sapiens
gctccagcctgacatca

SEQ ID NO: 2470084 - DNA, 16 bp, Homo sapiens
gctcccaaggggcctg

SEQ ID NO: 2470085 - DNA, 21 bp, Homo sapiens
gctcccaaggggcctgagcag

SEQ ID NO: 2470086 - DNA, 15 bp, Homo sapiens
gctcccacaagcctc

SEQ ID NO: 2470087 - DNA, 18 bp, Homo sapiens
gctcccacaagcctgagg

SEQ ID NO: 2470088 - DNA, 22 bp, Homo sapiens
gctcccacctcctgacaccctt

SEQ ID NO: 2470089 - DNA, 11 bp, Homo sapiens
gctcccagggc

SEQ ID NO: 2470090 - DNA, 20 bp, Homo sapiens
gctcccaggggctccctccg

SEQ ID NO: 2470091 - DNA, 21 bp, Homo sapiens
gctcccaggggctccctccgc

SEQ ID NO: 2470092 - DNA, 20 bp, Homo sapiens
gctccccactctgctctgat

SEQ ID NO: 2470093 - DNA, 21 bp, Homo sapiens
gctccccccagccccctaaga

SEQ ID NO: 2470094 - DNA, 12 bp, Homo sapiens
gctccctcagac

SEQ ID NO: 2470095 - DNA, 16 bp, Homo sapiens
gctccctccgccccca

SEQ ID NO: 2470096 - DNA, 19 bp, Homo sapiens
gctccctccgcccccaggt

SEQ ID NO: 2470097 - DNA, 16 bp, Homo sapiens
gctccctgactgggag

SEQ ID NO: 2470098 - DNA, 16 bp, Homo sapiens
gctccgaggacccagg

SEQ ID NO: 2470099 - DNA, 17 bp, Homo sapiens
gctccgcctggcctggc

SEQ ID NO: 2470100 - DNA, 21 bp, Homo sapiens
gctcctcaacccctcccctcc

SEQ ID NO: 2470101 - DNA, 20 bp, Homo sapiens
gctcctccagggtgtgtgct

SEQ ID NO: 2470102 - DNA, 17 bp, Homo sapiens
gctcctccttctgctgc

SEQ ID NO: 2470103 - DNA, 15 bp, Homo sapiens
gctcctctccccagc

SEQ ID NO: 2470104 - DNA, 18 bp, Homo sapiens
gctcctctccccagccca

SEQ ID NO: 2470105 - DNA, 20 bp, Homo sapiens
gctcctctccccagcccaga

SEQ ID NO: 2470106 - DNA, 22 bp, Homo sapiens
gctcctctccccagcccagaga

SEQ ID NO: 2470107 - DNA, 23 bp, Homo sapiens
gctcctctccccagcccagagac

SEQ ID NO: 2470108 - DNA, 22 bp, Homo sapiens
gctcctcttccatgctgtgcgc

SEQ ID NO: 2470109 - DNA, 14 bp, Homo sapiens
gctcctcttcccca

SEQ ID NO: 2470110 - DNA, 11 bp, Homo sapiens
gctcctgcagc

SEQ ID NO: 2470111 - DNA, 23 bp, Homo sapiens
gctcctgctaacggtgctcaggg

SEQ ID NO: 2470112 - DNA, 14 bp, Homo sapiens
gctcctgtcccctg

SEQ ID NO: 2470113 - DNA, 17 bp, Homo sapiens
gctcctgtcccctgcta

SEQ ID NO: 2470114 - DNA, 22 bp, Homo sapiens
gctcctgttttgcacagccaaa

SEQ ID NO: 2470115 - DNA, 14 bp, Homo sapiens
gctccttgggccct

SEQ ID NO: 2470116 - DNA, 15 bp, Homo sapiens
gctccttgtgggcct

SEQ ID NO: 2470117 - DNA, 18 bp, Homo sapiens
gctccttgtgggcctggg

SEQ ID NO: 2470118 - DNA, 19 bp, Homo sapiens
gctcgaatctctgtgcctt

SEQ ID NO: 2470119 - DNA, 17 bp, Homo sapiens
gctcgagcagtcctgcc

SEQ ID NO: 2470120 - DNA, 16 bp, Homo sapiens
gctcgaggggtgggct

SEQ ID NO: 2470121 - DNA, 15 bp, Homo sapiens
gctcggaggaagccc

SEQ ID NO: 2470122 - DNA, 15 bp, Homo sapiens
gctcggcctgccccc

SEQ ID NO: 2470123 - DNA, 21 bp, Homo sapiens
gctcggcctgcccccacccca

SEQ ID NO: 2470124 - DNA, 20 bp, Homo sapiens
gctcggggtgcacaggaggg

SEQ ID NO: 2470125 - DNA, 13 bp, Homo sapiens
gctctaacgcctg

SEQ ID NO: 2470126 - DNA, 17 bp, Homo sapiens
gctctaacgcctgagcc

SEQ ID NO: 2470127 - DNA, 22 bp, Homo sapiens
gctctaacgcctgagcccaggg

SEQ ID NO: 2470128 - DNA, 23 bp, Homo sapiens
gctctaacgcctgagcccaggga

SEQ ID NO: 2470129 - DNA, 16 bp, Homo sapiens
gctctaattcacagtg

SEQ ID NO: 2470130 - DNA, 18 bp, Homo sapiens
gctctaattcacagtgct

SEQ ID NO: 2470131 - DNA, 17 bp, Homo sapiens
gctctacatcttctgcc

SEQ ID NO: 2470132 - DNA, 19 bp, Homo sapiens
gctctacatcttctgcctt

SEQ ID NO: 2470133 - DNA, 22 bp, Homo sapiens
gctctagatcataaggcttcaa

SEQ ID NO: 2470134 - DNA, 18 bp, Homo sapiens
gctctatgagtctagatg

SEQ ID NO: 2470135 - DNA, 21 bp, Homo sapiens
gctctattatgaatgtgaagc

SEQ ID NO: 2470136 - DNA, 23 bp, Homo sapiens
gctctattatgaatgtgaagcct

SEQ ID NO: 2470137 - DNA, 23 bp, Homo sapiens
gctctcacggccacacagctgcc

SEQ ID NO: 2470138 - DNA, 17 bp, Homo sapiens
gctctccattctgctcc

SEQ ID NO: 2470139 - DNA, 18 bp, Homo sapiens
gctctccattctgctcct

SEQ ID NO: 2470140 - DNA, 14 bp, Homo sapiens
gctctcctggccct

SEQ ID NO: 2470141 - DNA, 19 bp, Homo sapiens
gctctcgcacacctctgca

SEQ ID NO: 2470142 - DNA, 20 bp, Homo sapiens
gctctctccaggcaggtctg

SEQ ID NO: 2470143 - DNA, 14 bp, Homo sapiens
gctctctttctgtc

SEQ ID NO: 2470144 - DNA, 16 bp, Homo sapiens
gctctgaaaccagtgt

SEQ ID NO: 2470145 - DNA, 17 bp, Homo sapiens
gctctgagaggccctgg

SEQ ID NO: 2470146 - DNA, 20 bp, Homo sapiens
gctctgagaggccctggatc

SEQ ID NO: 2470147 - DNA, 23 bp, Homo sapiens
gctctgagaggccctggatcagc

SEQ ID NO: 2470148 - DNA, 18 bp, Homo sapiens
gctctgagagtctagatt

SEQ ID NO: 2470149 - DNA, 20 bp, Homo sapiens
gctctgaggcgccccaaccc

SEQ ID NO: 2470150 - DNA, 16 bp, Homo sapiens
gctctgatgcatcaga

SEQ ID NO: 2470151 - DNA, 13 bp, Homo sapiens
gctctgccagtcc

SEQ ID NO: 2470152 - DNA, 20 bp, Homo sapiens
gctctggacagccccaccct

SEQ ID NO: 2470153 - DNA, 16 bp, Homo sapiens
gctctggaggggaggg

SEQ ID NO: 2470154 - DNA, 18 bp, Homo sapiens
gctctggataacaagact

SEQ ID NO: 2470155 - DNA, 20 bp, Homo sapiens
gctctgggccattctccaca

SEQ ID NO: 2470156 - DNA, 23 bp, Homo sapiens
gctctgggccattctccacagca

SEQ ID NO: 2470157 - DNA, 20 bp, Homo sapiens
gctctggttgtttctgttcc

SEQ ID NO: 2470158 - DNA, 18 bp, Homo sapiens
gctctgtatcaggaccca

SEQ ID NO: 2470159 - DNA, 22 bp, Homo sapiens
gctctgtatcaggacccagagg

SEQ ID NO: 2470160 - DNA, 19 bp, Homo sapiens
gctggagtgcagtggtgca

SEQ ID NO: 2470161 - DNA, 20 bp, Homo sapiens
gctggagtgcagtggtgtga

SEQ ID NO: 2470162 - DNA, 21 bp, Homo sapiens
gctggagttagggactgacca

SEQ ID NO: 2470163 - DNA, 16 bp, Homo sapiens
gctggagtttcatgta

SEQ ID NO: 2470164 - DNA, 16 bp, Homo sapiens
gctggcatttgcacct

SEQ ID NO: 2470165 - DNA, 16 bp, Homo sapiens
gctggccagtccaggc

SEQ ID NO: 2470166 - DNA, 17 bp, Homo sapiens
gctggccagtccaggct

SEQ ID NO: 2470167 - DNA, 15 bp, Homo sapiens
gctggccatggagaa

SEQ ID NO: 2470168 - DNA, 14 bp, Homo sapiens
gctggcccagccaa

SEQ ID NO: 2470169 - DNA, 13 bp, Homo sapiens
gctggcccagggc

SEQ ID NO: 2470170 - DNA, 21 bp, Homo sapiens
gctggcccagggcccagagcc

SEQ ID NO: 2470171 - DNA, 18 bp, Homo sapiens
gctggccgcccccagccc

SEQ ID NO: 2470172 - DNA, 20 bp, Homo sapiens
gctggccgctgtgccaggcg

SEQ ID NO: 2470173 - DNA, 14 bp, Homo sapiens
gctggctggcctca

SEQ ID NO: 2470174 - DNA, 18 bp, Homo sapiens
gctggcttgtttgatttc

SEQ ID NO: 2470175 - DNA, 19 bp, Homo sapiens
gctggcttgtttgatttca

SEQ ID NO: 2470176 - DNA, 19 bp, Homo sapiens
gctgggacgtggctcagcc

SEQ ID NO: 2470177 - DNA, 22 bp, Homo sapiens
gctgggacgtggctcagccagc

SEQ ID NO: 2470178 - DNA, 14 bp, Homo sapiens
gctgggactcagcc

SEQ ID NO: 2470179 - DNA, 19 bp, Homo sapiens
gctgggactcagccttcag

SEQ ID NO: 2470180 - DNA, 23 bp, Homo sapiens
gctgggactcagccttcagacag

SEQ ID NO: 2470181 - DNA, 14 bp, Homo sapiens
gctgggagaggcag

SEQ ID NO: 2470182 - DNA, 23 bp, Homo sapiens
gctgggagaggcagcccaggaag

SEQ ID NO: 2470183 - DNA, 14 bp, Homo sapiens
gctgggagctccac

SEQ ID NO: 2470184 - DNA, 16 bp, Homo sapiens
gctgggagctccactc

SEQ ID NO: 2470185 - DNA, 18 bp, Homo sapiens
gctgggagctccactctg

SEQ ID NO: 2470186 - DNA, 20 bp, Homo sapiens
gctgggagctccactctgct

SEQ ID NO: 2470187 - DNA, 21 bp, Homo sapiens
gctgggagctccactctgctt

SEQ ID NO: 2470188 - DNA, 19 bp, Homo sapiens
gctgggccatgtccaaaga

SEQ ID NO: 2470189 - DNA, 12 bp, Homo sapiens
gctgggcctggt

SEQ ID NO: 2470190 - DNA, 16 bp, Homo sapiens
gctggggacctggtac

SEQ ID NO: 2470191 - DNA, 12 bp, Homo sapiens
gctggggtgcag

SEQ ID NO: 2470192 - DNA, 14 bp, Homo sapiens
gctgggtcaggcag

SEQ ID NO: 2470193 - DNA, 15 bp, Homo sapiens
gctgggtcaggcagg

SEQ ID NO: 2470194 - DNA, 16 bp, Homo sapiens
gctgggtcaggcaggg

SEQ ID NO: 2470195 - DNA, 18 bp, Homo sapiens
gctggtatctcagaaagt

SEQ ID NO: 2470196 - DNA, 14 bp, Homo sapiens
gctggtccagggct

SEQ ID NO: 2470197 - DNA, 15 bp, Homo sapiens
gctggtccgtgggac

SEQ ID NO: 2470198 - DNA, 18 bp, Homo sapiens
gctggtctagtcacgcat

SEQ ID NO: 2470199 - DNA, 15 bp, Homo sapiens
gctggtgcggctggc

SEQ ID NO: 2470200 - DNA, 18 bp, Homo sapiens
gctggtgtagctacagag

SEQ ID NO: 2470201 - DNA, 19 bp, Homo sapiens
gctggtgtagctacagaga

SEQ ID NO: 2470202 - DNA, 22 bp, Homo sapiens
gctggtgtagctacagagaaac

SEQ ID NO: 2470203 - DNA, 18 bp, Homo sapiens
gctggtgtggtacagaga

SEQ ID NO: 2470204 - DNA, 19 bp, Homo sapiens
gctggtgtggtacagagaa

SEQ ID NO: 2470205 - DNA, 20 bp, Homo sapiens
gctggtgtggtacagagaag

SEQ ID NO: 2470206 - DNA, 22 bp, Homo sapiens
gctggtgtggtacagagaagcc

SEQ ID NO: 2470207 - DNA, 23 bp, Homo sapiens
gctgtaaggatccggaaagaaga

SEQ ID NO: 2470208 - DNA, 17 bp, Homo sapiens
gctgtaaggctctagat

SEQ ID NO: 2470209 - DNA, 16 bp, Homo sapiens
gctgtacatctatttt

SEQ ID NO: 2470210 - DNA, 20 bp, Homo sapiens
gctgtacatctattttggat

SEQ ID NO: 2470211 - DNA, 13 bp, Homo sapiens
gctgtacccagtt

SEQ ID NO: 2470212 - DNA, 13 bp, Homo sapiens
gctgtagaaaaaa

SEQ ID NO: 2470213 - DNA, 14 bp, Homo sapiens
gctgtattgtctga

SEQ ID NO: 2470214 - DNA, 14 bp, Homo sapiens
gctgtcatctgtgc

SEQ ID NO: 2470215 - DNA, 18 bp, Homo sapiens
gctgtccagaaaggtttg

SEQ ID NO: 2470216 - DNA, 13 bp, Homo sapiens
gctgtccctcact

SEQ ID NO: 2470217 - DNA, 17 bp, Homo sapiens
gctgtctgggtgctact

SEQ ID NO: 2470218 - DNA, 22 bp, Homo sapiens
gctgtctgggtgctactgggga

SEQ ID NO: 2470219 - DNA, 20 bp, Homo sapiens
gctgtgacctgctgagctct

SEQ ID NO: 2470220 - DNA, 12 bp, Homo sapiens
gctgtgaggctg

SEQ ID NO: 2470221 - DNA, 13 bp, Homo sapiens
gctgtgaggctgt

SEQ ID NO: 2470222 - DNA, 20 bp, Homo sapiens
gctgtgagtctttggttcta

SEQ ID NO: 2470223 - DNA, 15 bp, Homo sapiens
gctgtgcctcgctcc

SEQ ID NO: 2470224 - DNA, 18 bp, Homo sapiens
gctgtgcgcccagggctg

SEQ ID NO: 2470225 - DNA, 14 bp, Homo sapiens
gctgtggcaggcca

SEQ ID NO: 2470226 - DNA, 15 bp, Homo sapiens
gctgtgggaaatggt

SEQ ID NO: 2470227 - DNA, 14 bp, Homo sapiens
gctgtggttttctt

SEQ ID NO: 2470228 - DNA, 22 bp, Homo sapiens
gctgtggttttcttttgccatg

SEQ ID NO: 2470229 - DNA, 18 bp, Homo sapiens
gctgtgtgctttttttgt

SEQ ID NO: 2470230 - DNA, 23 bp, Homo sapiens
gctgttaaatacaggaaacagtt

SEQ ID NO: 2470231 - DNA, 23 bp, Homo sapiens
gctgttaggggttattggtgtaa

SEQ ID NO: 2470232 - DNA, 19 bp, Homo sapiens
gctgtttgagattctcaaa

SEQ ID NO: 2470233 - DNA, 16 bp, Homo sapiens
gctgttttaaacatta

SEQ ID NO: 2470234 - DNA, 16 bp, Homo sapiens
gctgttttgttatata

SEQ ID NO: 2470235 - DNA, 23 bp, Homo sapiens
gctgttttgttatataatttaga

SEQ ID NO: 2470236 - DNA, 14 bp, Homo sapiens
gctgttttgttgac

SEQ ID NO: 2470237 - DNA, 13 bp, Homo sapiens
gcttaaaactttg

SEQ ID NO: 2470238 - DNA, 14 bp, Homo sapiens
gcttaaaatacaag

SEQ ID NO: 2470239 - DNA, 19 bp, Homo sapiens
gcttagcagtccccttccc

SEQ ID NO: 2470240 - DNA, 20 bp, Homo sapiens
gcttagctcaattagtgtgg

SEQ ID NO: 2470241 - DNA, 12 bp, Homo sapiens
gcttagtttgtg

SEQ ID NO: 2470242 - DNA, 16 bp, Homo sapiens
gcttagtttgtgtgtt

SEQ ID NO: 2470243 - DNA, 18 bp, Homo sapiens
gcttatacgaaataattg

SEQ ID NO: 2470244 - DNA, 15 bp, Homo sapiens
gcttatgctcttaat

SEQ ID NO: 2470245 - DNA, 19 bp, Homo sapiens
gcttattccatgactgctt

SEQ ID NO: 2470246 - DNA, 15 bp, Homo sapiens
gcttatttattgtat

SEQ ID NO: 2470247 - DNA, 22 bp, Homo sapiens
gcttatttttttaagaaaaaag

SEQ ID NO: 2470248 - DNA, 21 bp, Homo sapiens
gcttcaggtccaggctgtgtt

SEQ ID NO: 2470249 - DNA, 17 bp, Homo sapiens
gcttcatggcagaaggc

SEQ ID NO: 2470250 - DNA, 22 bp, Homo sapiens
gcttccagattgacgacaagtg

SEQ ID NO: 2470251 - DNA, 23 bp, Homo sapiens
gcttccagattgacgacaagtgc

SEQ ID NO: 2470252 - DNA, 18 bp, Homo sapiens
gcttccatgattctattt

SEQ ID NO: 2470253 - DNA, 14 bp, Homo sapiens
gcttccctaatcta

SEQ ID NO: 2470254 - DNA, 21 bp, Homo sapiens
gcttcctcctccccaactgtg

SEQ ID NO: 2470255 - DNA, 13 bp, Homo sapiens
gcttcctcctgga

SEQ ID NO: 2470256 - DNA, 17 bp, Homo sapiens
gcttccttcagagagca

SEQ ID NO: 2470257 - DNA, 20 bp, Homo sapiens
gcttccttcagagagcagtg

SEQ ID NO: 2470258 - DNA, 22 bp, Homo sapiens
gcttccttcagagagcagtgct

SEQ ID NO: 2470259 - DNA, 13 bp, Homo sapiens
gcttctcccaggc

SEQ ID NO: 2470260 - DNA, 14 bp, Homo sapiens
gcttctcccaggca

SEQ ID NO: 2470261 - DNA, 17 bp, Homo sapiens
gcttctcccaggcaagg

SEQ ID NO: 2470262 - DNA, 18 bp, Homo sapiens
gcttctcccaggcaaggc

SEQ ID NO: 2470263 - DNA, 14 bp, Homo sapiens
gcttctctctgtgg

SEQ ID NO: 2470264 - DNA, 18 bp, Homo sapiens
ggaaggagctgcctggac

SEQ ID NO: 2470265 - DNA, 22 bp, Homo sapiens
ggaaggagctgcctggacccgt

SEQ ID NO: 2470266 - DNA, 13 bp, Homo sapiens
ggaaggaggagcc

SEQ ID NO: 2470267 - DNA, 18 bp, Homo sapiens
ggaaggcaggcagggctc

SEQ ID NO: 2470268 - DNA, 19 bp, Homo sapiens
ggaaggcaggcagggctct

SEQ ID NO: 2470269 - DNA, 11 bp, Homo sapiens
ggaagggagcc

SEQ ID NO: 2470270 - DNA, 13 bp, Homo sapiens
ggaagggagccaa

SEQ ID NO: 2470271 - DNA, 16 bp, Homo sapiens
ggaagtaggaagtaaa

SEQ ID NO: 2470272 - DNA, 16 bp, Homo sapiens
ggaagtccggccccag

SEQ ID NO: 2470273 - DNA, 23 bp, Homo sapiens
ggaagtcgtccttactcctgtgg

SEQ ID NO: 2470274 - DNA, 16 bp, Homo sapiens
ggaagtttagctctga

SEQ ID NO: 2470275 - DNA, 18 bp, Homo sapiens
ggaagtttagctctgaga

SEQ ID NO: 2470276 - DNA, 15 bp, Homo sapiens
ggaatataattgttt

SEQ ID NO: 2470277 - DNA, 19 bp, Homo sapiens
ggaatggatttttctttaa

SEQ ID NO: 2470278 - DNA, 20 bp, Homo sapiens
ggaatggatttttctttaac

SEQ ID NO: 2470279 - DNA, 22 bp, Homo sapiens
ggaatggatttttctttaactg

SEQ ID NO: 2470280 - DNA, 15 bp, Homo sapiens
ggaattgatttgcat

SEQ ID NO: 2470281 - DNA, 17 bp, Homo sapiens
ggaattgatttgcattg

SEQ ID NO: 2470282 - DNA, 16 bp, Homo sapiens
ggaatttcccaggacc

SEQ ID NO: 2470283 - DNA, 20 bp, Homo sapiens
ggacaaaaccccccagatat

SEQ ID NO: 2470284 - DNA, 13 bp, Homo sapiens
ggacaaagaacct

SEQ ID NO: 2470285 - DNA, 13 bp, Homo sapiens
ggacaaaggagcc

SEQ ID NO: 2470286 - DNA, 15 bp, Homo sapiens
ggacaaaggagcctg

SEQ ID NO: 2470287 - DNA, 17 bp, Homo sapiens
ggacaaaggagcctgtg

SEQ ID NO: 2470288 - DNA, 18 bp, Homo sapiens
ggacaaaggagcctgtga

SEQ ID NO: 2470289 - DNA, 21 bp, Homo sapiens
ggacaaatcacatattttaaa

SEQ ID NO: 2470290 - DNA, 13 bp, Homo sapiens
ggacaagcatggt

SEQ ID NO: 2470291 - DNA, 18 bp, Homo sapiens
ggacaagcttctgagacg

SEQ ID NO: 2470292 - DNA, 13 bp, Homo sapiens
ggacacaggcctg

SEQ ID NO: 2470293 - DNA, 16 bp, Homo sapiens
ggacacaggcctgtgt

SEQ ID NO: 2470294 - DNA, 23 bp, Homo sapiens
ggacacaggcctgtgtagctgtg

SEQ ID NO: 2470295 - DNA, 23 bp, Homo sapiens
ggacacgggcctgtccacaggct

SEQ ID NO: 2470296 - DNA, 16 bp, Homo sapiens
ggacagaggccccagc

SEQ ID NO: 2470297 - DNA, 17 bp, Homo sapiens
ggacagaggccccagcc

SEQ ID NO: 2470298 - DNA, 18 bp, Homo sapiens
ggacagaggccccagcct

SEQ ID NO: 2470299 - DNA, 19 bp, Homo sapiens
ggacagcaactatcagact

SEQ ID NO: 2470300 - DNA, 16 bp, Homo sapiens
ggacagccccaccctg

SEQ ID NO: 2470301 - DNA, 13 bp, Homo sapiens
ggacaggctggct

SEQ ID NO: 2470302 - DNA, 22 bp, Homo sapiens
ggacagttccagaagtgtgact

SEQ ID NO: 2470303 - DNA, 23 bp, Homo sapiens
ggacagtttaccagttgcctttt

SEQ ID NO: 2470304 - DNA, 13 bp, Homo sapiens
ggacatcctcctc

SEQ ID NO: 2470305 - DNA, 15 bp, Homo sapiens
ggaccacaggctcag

SEQ ID NO: 2470306 - DNA, 15 bp, Homo sapiens
ggaccaccctgagcc

SEQ ID NO: 2470307 - DNA, 16 bp, Homo sapiens
ggaccaccctgagccg

SEQ ID NO: 2470308 - DNA, 12 bp, Homo sapiens
ggaccagcctgg

SEQ ID NO: 2470309 - DNA, 22 bp, Homo sapiens
ggaccagctcaggacagatgcc

SEQ ID NO: 2470310 - DNA, 15 bp, Homo sapiens
ggaccaggctgtagg

SEQ ID NO: 2470311 - DNA, 22 bp, Homo sapiens
ggaccatggagtggcagcccag

SEQ ID NO: 2470312 - DNA, 16 bp, Homo sapiens
ggacccagccaggccc

SEQ ID NO: 2470313 - DNA, 23 bp, Homo sapiens
ggacccccctttcacaggcagcc

SEQ ID NO: 2470314 - DNA, 11 bp, Homo sapiens
ggacccctgca

SEQ ID NO: 2470315 - DNA, 12 bp, Homo sapiens
ggacccctgcat

SEQ ID NO: 2470316 - DNA, 23 bp, Homo sapiens
ggacccctgcattggaactggag

SEQ ID NO: 2470317 - DNA, 19 bp, Homo sapiens
ggacccgttcatgggggag

SEQ ID NO: 2470318 - DNA, 13 bp, Homo sapiens
ggaccctgaaggg

SEQ ID NO: 2470319 - DNA, 18 bp, Homo sapiens
ggaccgccccctgtctct

SEQ ID NO: 2470320 - DNA, 22 bp, Homo sapiens
ggaccgctacaccactctggca

SEQ ID NO: 2470321 - DNA, 17 bp, Homo sapiens
ggaccggagagtggggg

SEQ ID NO: 2470322 - DNA, 17 bp, Homo sapiens
ggacctagggaggcatg

SEQ ID NO: 2470323 - DNA, 23 bp, Homo sapiens
ggacctagggaggcatggtctgc

SEQ ID NO: 2470324 - DNA, 12 bp, Homo sapiens
ggacctctgaca

SEQ ID NO: 2470325 - DNA, 17 bp, Homo sapiens
ggacctctgacagcagc

SEQ ID NO: 2470326 - DNA, 12 bp, Homo sapiens
ggacctgagcct

SEQ ID NO: 2470327 - DNA, 13 bp, Homo sapiens
ggacctgagcctg

SEQ ID NO: 2470328 - DNA, 23 bp, Homo sapiens
ggacctgagcctgccgagcaacc

SEQ ID NO: 2470329 - DNA, 17 bp, Homo sapiens
ggacctggtaccctcct

SEQ ID NO: 2470330 - DNA, 17 bp, Homo sapiens
ggacctggtgctgcctc

SEQ ID NO: 2470331 - DNA, 20 bp, Homo sapiens
ggacctttccaccacagcca

SEQ ID NO: 2470332 - DNA, 23 bp, Homo sapiens
ggacgacacggtcggggcatctg

SEQ ID NO: 2470333 - DNA, 14 bp, Homo sapiens
ggacgcactgagca

SEQ ID NO: 2470334 - DNA, 21 bp, Homo sapiens
ggacggtgcccaagccagagg

SEQ ID NO: 2470335 - DNA, 19 bp, Homo sapiens
ggactaacactcagaagcc

SEQ ID NO: 2470336 - DNA, 20 bp, Homo sapiens
ggactaacactcagaagcct

SEQ ID NO: 2470337 - DNA, 20 bp, Homo sapiens
ggactatatttgggcctgct

SEQ ID NO: 2470338 - DNA, 21 bp, Homo sapiens
ggactcagccttcagacagag

SEQ ID NO: 2470339 - DNA, 14 bp, Homo sapiens
ggactccaggccca

SEQ ID NO: 2470340 - DNA, 15 bp, Homo sapiens
ggactccaggcccaa

SEQ ID NO: 2470341 - DNA, 22 bp, Homo sapiens
ggactccaggcccaaggctccc

SEQ ID NO: 2470342 - DNA, 16 bp, Homo sapiens
ggactcctgaaaaaaa

SEQ ID NO: 2470343 - DNA, 16 bp, Homo sapiens
ggactgatgtctccta

SEQ ID NO: 2470344 - DNA, 20 bp, Homo sapiens
ggactgtcgctgcttcgtgg

SEQ ID NO: 2470345 - DNA, 11 bp, Homo sapiens
ggacttcctgt

SEQ ID NO: 2470346 - DNA, 18 bp, Homo sapiens
ggacttcctgtccagctc

SEQ ID NO: 2470347 - DNA, 19 bp, Homo sapiens
ggacttcctgtccagctcc

SEQ ID NO: 2470348 - DNA, 20 bp, Homo sapiens
ggacttcctgtccagctcca

SEQ ID NO: 2470349 - DNA, 13 bp, Homo sapiens
ggacttggcctct

SEQ ID NO: 2470350 - DNA, 16 bp, Homo sapiens
ggactttgcagccggc

SEQ ID NO: 2470351 - DNA, 13 bp, Homo sapiens
ggacttttctgca

SEQ ID NO: 2470352 - DNA, 16 bp, Homo sapiens
ggagaaagggccctgg

SEQ ID NO: 2470353 - DNA, 20 bp, Homo sapiens
ggagaaccaaatctggaagc

SEQ ID NO: 2470354 - DNA, 12 bp, Homo sapiens
ggagaagccagg

SEQ ID NO: 2470355 - DNA, 15 bp, Homo sapiens
ggagaagccaggaat

SEQ ID NO: 2470356 - DNA, 18 bp, Homo sapiens
ggagaagcccgtgtgaga

SEQ ID NO: 2470357 - DNA, 18 bp, Homo sapiens
ggagaagtgacattgcat

SEQ ID NO: 2470358 - DNA, 14 bp, Homo sapiens
ggagacatgtgaca

SEQ ID NO: 2470359 - DNA, 15 bp, Homo sapiens
ggagacatgtgacat

SEQ ID NO: 2470360 - DNA, 19 bp, Homo sapiens
ggagacatgtgacatttat

SEQ ID NO: 2470361 - DNA, 17 bp, Homo sapiens
ggagaccggcctgccag

SEQ ID NO: 2470362 - DNA, 20 bp, Homo sapiens
ggagaccggcctgccaggag

SEQ ID NO: 2470363 - DNA, 22 bp, Homo sapiens
ggagagccaccaagagggacgc

SEQ ID NO: 2470364 - DNA, 12 bp, Homo sapiens
ggagagcccagg

SEQ ID NO: 2470365 - DNA, 20 bp, Homo sapiens
ggagagcccaggagctcccc

SEQ ID NO: 2470366 - DNA, 11 bp, Homo sapiens
ggagagccctg

SEQ ID NO: 2470367 - DNA, 12 bp, Homo sapiens
ggagagccctgg

SEQ ID NO: 2470368 - DNA, 16 bp, Homo sapiens
ggatgcggatggccgg

SEQ ID NO: 2470369 - DNA, 13 bp, Homo sapiens
ggatggacatctt

SEQ ID NO: 2470370 - DNA, 14 bp, Homo sapiens
ggatggccccagca

SEQ ID NO: 2470371 - DNA, 13 bp, Homo sapiens
ggatggggctccc

SEQ ID NO: 2470372 - DNA, 17 bp, Homo sapiens
ggatgggggaactcaga

SEQ ID NO: 2470373 - DNA, 21 bp, Homo sapiens
ggatgggggaactcagatcca

SEQ ID NO: 2470374 - DNA, 13 bp, Homo sapiens
ggatgtccccagc

SEQ ID NO: 2470375 - DNA, 14 bp, Homo sapiens
ggatgtccccagca

SEQ ID NO: 2470376 - DNA, 12 bp, Homo sapiens
ggatgtccctgg

SEQ ID NO: 2470377 - DNA, 20 bp, Homo sapiens
ggatgttcagcactgtccct

SEQ ID NO: 2470378 - DNA, 19 bp, Homo sapiens
ggattcaggaaaaggcctg

SEQ ID NO: 2470379 - DNA, 18 bp, Homo sapiens
ggattctgctggcctctg

SEQ ID NO: 2470380 - DNA, 18 bp, Homo sapiens
ggattctggttccagggt

SEQ ID NO: 2470381 - DNA, 12 bp, Homo sapiens
ggattctttaaa

SEQ ID NO: 2470382 - DNA, 18 bp, Homo sapiens
ggattgcacgtggcctct

SEQ ID NO: 2470383 - DNA, 18 bp, Homo sapiens
ggattgcgagagatgtgt

SEQ ID NO: 2470384 - DNA, 14 bp, Homo sapiens
ggatttatttaaaa

SEQ ID NO: 2470385 - DNA, 23 bp, Homo sapiens
ggatttcctgctttgggaagccg

SEQ ID NO: 2470386 - DNA, 11 bp, Homo sapiens
ggcaaaagctt

SEQ ID NO: 2470387 - DNA, 11 bp, Homo sapiens
ggcaaagccag

SEQ ID NO: 2470388 - DNA, 20 bp, Homo sapiens
ggcaacagatcagtaaagaa

SEQ ID NO: 2470389 - DNA, 16 bp, Homo sapiens
ggcaaggctgtggacc

SEQ ID NO: 2470390 - DNA, 18 bp, Homo sapiens
ggcaatgccacagccctg

SEQ ID NO: 2470391 - DNA, 15 bp, Homo sapiens
ggcaattttgtggtt

SEQ ID NO: 2470392 - DNA, 14 bp, Homo sapiens
ggcacaagactgac

SEQ ID NO: 2470393 - DNA, 13 bp, Homo sapiens
ggcacaggagcta

SEQ ID NO: 2470394 - DNA, 20 bp, Homo sapiens
ggcacaggagctacctgtgt

SEQ ID NO: 2470395 - DNA, 19 bp, Homo sapiens
ggcacagggtctgctcttt

SEQ ID NO: 2470396 - DNA, 16 bp, Homo sapiens
ggcaccagacacccag

SEQ ID NO: 2470397 - DNA, 18 bp, Homo sapiens
ggcaccagacacccagga

SEQ ID NO: 2470398 - DNA, 14 bp, Homo sapiens
ggcacccccagcct

SEQ ID NO: 2470399 - DNA, 17 bp, Homo sapiens
ggcacccccagcctggg

SEQ ID NO: 2470400 - DNA, 21 bp, Homo sapiens
ggcacccccagcctgggccta

SEQ ID NO: 2470401 - DNA, 17 bp, Homo sapiens
ggcacccccgtcaagag

SEQ ID NO: 2470402 - DNA, 16 bp, Homo sapiens
ggcaccccctgcagct

SEQ ID NO: 2470403 - DNA, 18 bp, Homo sapiens
ggcacctaatccaggcag

SEQ ID NO: 2470404 - DNA, 16 bp, Homo sapiens
ggcacctgggccctgg

SEQ ID NO: 2470405 - DNA, 17 bp, Homo sapiens
ggcacctgggccctggg

SEQ ID NO: 2470406 - DNA, 19 bp, Homo sapiens
ggcacctgggccctggggc

SEQ ID NO: 2470407 - DNA, 22 bp, Homo sapiens
ggcacctgggccctggggcctg

SEQ ID NO: 2470408 - DNA, 23 bp, Homo sapiens
ggcactaacgttgagcccctgga

SEQ ID NO: 2470409 - DNA, 13 bp, Homo sapiens
ggcactctagatt

SEQ ID NO: 2470410 - DNA, 14 bp, Homo sapiens
ggcactgccctggt

SEQ ID NO: 2470411 - DNA, 20 bp, Homo sapiens
ggcactgccctggtggccct

SEQ ID NO: 2470412 - DNA, 16 bp, Homo sapiens
ggcactgggcatgagg

SEQ ID NO: 2470413 - DNA, 17 bp, Homo sapiens
ggcactgtagttctaag

SEQ ID NO: 2470414 - DNA, 20 bp, Homo sapiens
ggcactgtagttctaagact

SEQ ID NO: 2470415 - DNA, 19 bp, Homo sapiens
ggcagactctttatgcttg

SEQ ID NO: 2470416 - DNA, 19 bp, Homo sapiens
ggcagagctggctctgagc

SEQ ID NO: 2470417 - DNA, 14 bp, Homo sapiens
ggcagagctggtgc

SEQ ID NO: 2470418 - DNA, 20 bp, Homo sapiens
ggcagaggaccaggctgtag

SEQ ID NO: 2470419 - DNA, 17 bp, Homo sapiens
ggcagaggcctgggctg

SEQ ID NO: 2470420 - DNA, 22 bp, Homo sapiens
ggcagaggcctgggctgggaaa

SEQ ID NO: 2470421 - DNA, 21 bp, Homo sapiens
ggcagagggctggaggcccag

SEQ ID NO: 2470422 - DNA, 19 bp, Homo sapiens
ggcagagttacagttctgt

SEQ ID NO: 2470423 - DNA, 15 bp, Homo sapiens
ggcagatggggagac

SEQ ID NO: 2470424 - DNA, 18 bp, Homo sapiens
ggcagcaaggcccgagca

SEQ ID NO: 2470425 - DNA, 19 bp, Homo sapiens
ggcagcaaggcccgagcag

SEQ ID NO: 2470426 - DNA, 13 bp, Homo sapiens
ggcagcagccagc

SEQ ID NO: 2470427 - DNA, 16 bp, Homo sapiens
ggcagcagccagccct

SEQ ID NO: 2470428 - DNA, 17 bp, Homo sapiens
ggcagcagccagccctg

SEQ ID NO: 2470429 - DNA, 20 bp, Homo sapiens
ggcagcagccagccctgcct

SEQ ID NO: 2470430 - DNA, 21 bp, Homo sapiens
ggcagcagccagccctgcctg

SEQ ID NO: 2470431 - DNA, 23 bp, Homo sapiens
ggcagcagccagccctgcctgga

SEQ ID NO: 2470432 - DNA, 15 bp, Homo sapiens
ggcagcagcccccag

SEQ ID NO: 2470433 - DNA, 21 bp, Homo sapiens
ggcagcagggctaccctgagc

SEQ ID NO: 2470434 - DNA, 22 bp, Homo sapiens
ggcagcaggggttggggaaaca

SEQ ID NO: 2470435 - DNA, 19 bp, Homo sapiens
ggcagcagtgtgaggccag

SEQ ID NO: 2470436 - DNA, 20 bp, Homo sapiens
ggcagcagtgtgaggccagg

SEQ ID NO: 2470437 - DNA, 21 bp, Homo sapiens
ggcagccacacttctcaggac

SEQ ID NO: 2470438 - DNA, 12 bp, Homo sapiens
ggcagccaggga

SEQ ID NO: 2470439 - DNA, 20 bp, Homo sapiens
ggcagccagtgccctgagcc

SEQ ID NO: 2470440 - DNA, 22 bp, Homo sapiens
ggcagccagtgccctgagccag

SEQ ID NO: 2470441 - DNA, 13 bp, Homo sapiens
ggcagcccagcca

SEQ ID NO: 2470442 - DNA, 15 bp, Homo sapiens
ggcagcccagccagc

SEQ ID NO: 2470443 - DNA, 18 bp, Homo sapiens
ggcagccccaggccaaag

SEQ ID NO: 2470444 - DNA, 13 bp, Homo sapiens
ggcagcctctggg

SEQ ID NO: 2470445 - DNA, 14 bp, Homo sapiens
ggcagccttgtgat

SEQ ID NO: 2470446 - DNA, 22 bp, Homo sapiens
ggcagcgccaggctgaccacag

SEQ ID NO: 2470447 - DNA, 13 bp, Homo sapiens
ggcagctcctctg

SEQ ID NO: 2470448 - DNA, 20 bp, Homo sapiens
ggcagcttctgccccctgca

SEQ ID NO: 2470449 - DNA, 23 bp, Homo sapiens
ggcagcttctgccccctgcagaa

SEQ ID NO: 2470450 - DNA, 23 bp, Homo sapiens
ggcaggaagcccaattgctggag

SEQ ID NO: 2470451 - DNA, 22 bp, Homo sapiens
ggcaggattggggaagagagcc

SEQ ID NO: 2470452 - DNA, 23 bp, Homo sapiens
ggcaggcagaggcccaggctgcc

SEQ ID NO: 2470453 - DNA, 10 bp, Homo sapiens
ggcaggctgg

SEQ ID NO: 2470454 - DNA, 13 bp, Homo sapiens
ggcaggctggcca

SEQ ID NO: 2470455 - DNA, 13 bp, Homo sapiens
ggcaggctgggcc

SEQ ID NO: 2470456 - DNA, 16 bp, Homo sapiens
ggcagggccccaggca

SEQ ID NO: 2470457 - DNA, 21 bp, Homo sapiens
ggcagggcgggcagagggctg

SEQ ID NO: 2470458 - DNA, 23 bp, Homo sapiens
ggcagggcgggcagagggctgga

SEQ ID NO: 2470459 - DNA, 17 bp, Homo sapiens
ggcagggctctcctggc

SEQ ID NO: 2470460 - DNA, 19 bp, Homo sapiens
ggcagggctctcctggctt

SEQ ID NO: 2470461 - DNA, 14 bp, Homo sapiens
ggcaggggacagga

SEQ ID NO: 2470462 - DNA, 14 bp, Homo sapiens
ggcagggggctgct

SEQ ID NO: 2470463 - DNA, 15 bp, Homo sapiens
ggcagggggctgctg

SEQ ID NO: 2470464 - DNA, 22 bp, Homo sapiens
ggcagggggctgctgctgggct

SEQ ID NO: 2470465 - DNA, 20 bp, Homo sapiens
ggcagtcattggctgtctcc

SEQ ID NO: 2470466 - DNA, 15 bp, Homo sapiens
ggcagtccgtgggac

SEQ ID NO: 2470467 - DNA, 16 bp, Homo sapiens
ggcagtgagggagggc

SEQ ID NO: 2470468 - DNA, 24 bp, Homo sapiens
ggcagttaccattaaaccatctcc

SEQ ID NO: 2470469 - DNA, 12 bp, Homo sapiens
ggcagttatatt

SEQ ID NO: 2470470 - DNA, 16 bp, Homo sapiens
ggcagttatattttgc

SEQ ID NO: 2470471 - DNA, 23 bp, Homo sapiens
ggcagttcgcagccaccctgagg

SEQ ID NO: 2470472 - DNA, 10 bp, Homo sapiens
ggcagttttt

SEQ ID NO: 2470473 - DNA, 14 bp, Homo sapiens
ggcatctctgggct

SEQ ID NO: 2470474 - DNA, 17 bp, Homo sapiens
ggcatctctgggctgga

SEQ ID NO: 2470475 - DNA, 18 bp, Homo sapiens
ggcatctggcctggccag

SEQ ID NO: 2470476 - DNA, 21 bp, Homo sapiens
ggcatctggcctggccagtgc

SEQ ID NO: 2470477 - DNA, 13 bp, Homo sapiens
ggcatgagaaata

SEQ ID NO: 2470478 - DNA, 16 bp, Homo sapiens
ggcatggtgttctcct

SEQ ID NO: 2470479 - DNA, 22 bp, Homo sapiens
ggcatggtgttctcctgctgct

SEQ ID NO: 2470480 - DNA, 23 bp, Homo sapiens
ggcatgttagcccttcctccaat

SEQ ID NO: 2470481 - DNA, 17 bp, Homo sapiens
ggcatttgtttctttct

SEQ ID NO: 2470482 - DNA, 19 bp, Homo sapiens
ggccaaaggggacctggaa

SEQ ID NO: 2470483 - DNA, 23 bp, Homo sapiens
ggccaagctgaggtgcccaggag

SEQ ID NO: 2470484 - DNA, 15 bp, Homo sapiens
ggccaaggacctgag

SEQ ID NO: 2470485 - DNA, 13 bp, Homo sapiens
ggccaagttcctc

SEQ ID NO: 2470486 - DNA, 14 bp, Homo sapiens
ggccacacagctgc

SEQ ID NO: 2470487 - DNA, 16 bp, Homo sapiens
ggccacacagctgccg

SEQ ID NO: 2470488 - DNA, 16 bp, Homo sapiens
ggccacactcagcaca

SEQ ID NO: 2470489 - DNA, 20 bp, Homo sapiens
ggccacagtagtcttgatga

SEQ ID NO: 2470490 - DNA, 16 bp, Homo sapiens
ggccacatcaaagagg

SEQ ID NO: 2470491 - DNA, 16 bp, Homo sapiens
ggccacctccccagca

SEQ ID NO: 2470492 - DNA, 17 bp, Homo sapiens
ggccacctccccagcat

SEQ ID NO: 2470493 - DNA, 14 bp, Homo sapiens
ggccacgctccagc

SEQ ID NO: 2470494 - DNA, 13 bp, Homo sapiens
ggccactccgaga

SEQ ID NO: 2470495 - DNA, 14 bp, Homo sapiens
ggccactccttcct

SEQ ID NO: 2470496 - DNA, 15 bp, Homo sapiens
ggccactccttcctg

SEQ ID NO: 2470497 - DNA, 19 bp, Homo sapiens
ggccactccttcctgcccc

SEQ ID NO: 2470498 - DNA, 20 bp, Homo sapiens
ggccactgtttggaaataaa

SEQ ID NO: 2470499 - DNA, 13 bp, Homo sapiens
ggccagagcccac

SEQ ID NO: 2470500 - DNA, 17 bp, Homo sapiens
ggccagagcccactcca

SEQ ID NO: 2470501 - DNA, 16 bp, Homo sapiens
ggccagaggcccccag

SEQ ID NO: 2470502 - DNA, 19 bp, Homo sapiens
ggccagaggcccccagccc

SEQ ID NO: 2470503 - DNA, 13 bp, Homo sapiens
ggccagatccagc

SEQ ID NO: 2470504 - DNA, 18 bp, Homo sapiens
ggccagatccagcctggg

SEQ ID NO: 2470505 - DNA, 13 bp, Homo sapiens
ggccagcctggcc

SEQ ID NO: 2470506 - DNA, 18 bp, Homo sapiens
ggccagcctggcctcctg

SEQ ID NO: 2470507 - DNA, 18 bp, Homo sapiens
ggccagctgtggttttct

SEQ ID NO: 2470508 - DNA, 15 bp, Homo sapiens
ggccagcttttcaaa

SEQ ID NO: 2470509 - DNA, 21 bp, Homo sapiens
ggccaggactctgcagcctca

SEQ ID NO: 2470510 - DNA, 13 bp, Homo sapiens
ggccaggaggtgc

SEQ ID NO: 2470511 - DNA, 15 bp, Homo sapiens
ggccagtccaggctg

SEQ ID NO: 2470512 - DNA, 21 bp, Homo sapiens
ggccagtccaggctgccgtgg

SEQ ID NO: 2470513 - DNA, 13 bp, Homo sapiens
ggccagtctgtgg

SEQ ID NO: 2470514 - DNA, 14 bp, Homo sapiens
ggccagtctgtgga

SEQ ID NO: 2470515 - DNA, 23 bp, Homo sapiens
ggccagtctgtggatcagagatg

SEQ ID NO: 2470516 - DNA, 19 bp, Homo sapiens
ggccagtgtttaaaacttc

SEQ ID NO: 2470517 - DNA, 20 bp, Homo sapiens
ggccatatttacctcagcct

SEQ ID NO: 2470518 - DNA, 21 bp, Homo sapiens
ggccatatttacctcagcctg

SEQ ID NO: 2470519 - DNA, 22 bp, Homo sapiens
ggccatatttacctcagcctgg

SEQ ID NO: 2470520 - DNA, 14 bp, Homo sapiens
ggccatctgctcct

SEQ ID NO: 2470521 - DNA, 22 bp, Homo sapiens
ggccatctgggctcctccaggg

SEQ ID NO: 2470522 - DNA, 17 bp, Homo sapiens
ggccatgaccctgcctc

SEQ ID NO: 2470523 - DNA, 20 bp, Homo sapiens
ggccatgaccctgcctctcc

SEQ ID NO: 2470524 - DNA, 15 bp, Homo sapiens
ggccatgatggcaac

SEQ ID NO: 2470525 - DNA, 22 bp, Homo sapiens
ggccatgatggcaacagatctg

SEQ ID NO: 2470526 - DNA, 21 bp, Homo sapiens
ggccatgctcctcttccccag

SEQ ID NO: 2470527 - DNA, 15 bp, Homo sapiens
ggccatgctgaggcc

SEQ ID NO: 2470528 - DNA, 19 bp, Homo sapiens
ggccatgctgaggcctggg

SEQ ID NO: 2470529 - DNA, 21 bp, Homo sapiens
ggccatggactctgtcctgaa

SEQ ID NO: 2470530 - DNA, 21 bp, Homo sapiens
ggccatggagaaagctgactt

SEQ ID NO: 2470531 - DNA, 13 bp, Homo sapiens
ggccatggcctgc

SEQ ID NO: 2470532 - DNA, 14 bp, Homo sapiens
ggccatggcctgca

SEQ ID NO: 2470533 - DNA, 13 bp, Homo sapiens
ggccatgtccaaa

SEQ ID NO: 2470534 - DNA, 23 bp, Homo sapiens
ggccatgtccaaagaggctgccc

SEQ ID NO: 2470535 - DNA, 16 bp, Homo sapiens
ggcccacattggaaga

SEQ ID NO: 2470536 - DNA, 22 bp, Homo sapiens
ggcccaccccacccacttctgc

SEQ ID NO: 2470537 - DNA, 13 bp, Homo sapiens
ggcccactgtgcc

SEQ ID NO: 2470538 - DNA, 15 bp, Homo sapiens
ggcccagagcccagc

SEQ ID NO: 2470539 - DNA, 18 bp, Homo sapiens
ggcccagagcccagctcc

SEQ ID NO: 2470540 - DNA, 18 bp, Homo sapiens
ggcccagccgaccccctc

SEQ ID NO: 2470541 - DNA, 12 bp, Homo sapiens
ggcccagccttt

SEQ ID NO: 2470542 - DNA, 11 bp, Homo sapiens
ggcccaggctg

SEQ ID NO: 2470543 - DNA, 15 bp, Homo sapiens
ggcccaggctgccgt

SEQ ID NO: 2470544 - DNA, 17 bp, Homo sapiens
ggcccagggcccagagc

SEQ ID NO: 2470545 - DNA, 22 bp, Homo sapiens
ggcccagggcccagagcccagc

SEQ ID NO: 2470546 - DNA, 20 bp, Homo sapiens
ggcccaggtcagccactgtt

SEQ ID NO: 2470547 - DNA, 24 bp, Homo sapiens
ggcccatatctgtgaaatgctggc

SEQ ID NO: 2470548 - DNA, 19 bp, Homo sapiens
ggccccaaccctgtcctcc

SEQ ID NO: 2470549 - DNA, 13 bp, Homo sapiens
ggccccaccctgg

SEQ ID NO: 2470550 - DNA, 18 bp, Homo sapiens
ggccccagcacagcttga

SEQ ID NO: 2470551 - DNA, 13 bp, Homo sapiens
ggccccagcctcc

SEQ ID NO: 2470552 - DNA, 14 bp, Homo sapiens
ggccccatgacctc

SEQ ID NO: 2470553 - DNA, 16 bp, Homo sapiens
ggcccccacttgcctc

SEQ ID NO: 2470554 - DNA, 20 bp, Homo sapiens
ggcccccagcccagggctcc

SEQ ID NO: 2470555 - DNA, 21 bp, Homo sapiens
ggcccccatctcatgcccctg

SEQ ID NO: 2470556 - DNA, 18 bp, Homo sapiens
ggccccgtttctggtggt

SEQ ID NO: 2470557 - DNA, 19 bp, Homo sapiens
ggcccctcaccctgcctta

SEQ ID NO: 2470558 - DNA, 22 bp, Homo sapiens
ggcccctcaccctgccttatct

SEQ ID NO: 2470559 - DNA, 16 bp, Homo sapiens
ggcccctccccctgag

SEQ ID NO: 2470560 - DNA, 17 bp, Homo sapiens
ggcccctcccctccaaa

SEQ ID NO: 2470561 - DNA, 18 bp, Homo sapiens
ggcccgagcagctgagca

SEQ ID NO: 2470562 - DNA, 23 bp, Homo sapiens
ggcccgagcagctgagcagggcc

SEQ ID NO: 2470563 - DNA, 23 bp, Homo sapiens
ggcccgcgatgtggaactgctgc

SEQ ID NO: 2470564 - DNA, 14 bp, Homo sapiens
ggcccggcagggcg

SEQ ID NO: 2470565 - DNA, 21 bp, Homo sapiens
ggccctcagtagtccctgcac

SEQ ID NO: 2470566 - DNA, 21 bp, Homo sapiens
ggccctccacacctgcggccc

SEQ ID NO: 2470567 - DNA, 22 bp, Homo sapiens
ggccctccctgttccccagaga

SEQ ID NO: 2470568 - DNA, 19 bp, Homo sapiens
ggccctcgctgccagctct

SEQ ID NO: 2470569 - DNA, 18 bp, Homo sapiens
ggccctgcttcctgcttg

SEQ ID NO: 2470570 - DNA, 17 bp, Homo sapiens
ggccctggatcagcgtg

SEQ ID NO: 2470571 - DNA, 18 bp, Homo sapiens
ggccctggatcagcgtgg

SEQ ID NO: 2470572 - DNA, 22 bp, Homo sapiens
ggccctggatcagcgtggcctt

SEQ ID NO: 2470573 - DNA, 17 bp, Homo sapiens
ggccctggcctcccctg

SEQ ID NO: 2470574 - DNA, 23 bp, Homo sapiens
ggccctgggcctgcctcaccacg

SEQ ID NO: 2470575 - DNA, 15 bp, Homo sapiens
ggccctggggcctgt

SEQ ID NO: 2470576 - DNA, 12 bp, Homo sapiens
ggctcctttcca

SEQ ID NO: 2470577 - DNA, 15 bp, Homo sapiens
ggctcgaatctctgt

SEQ ID NO: 2470578 - DNA, 17 bp, Homo sapiens
ggctcgaatctctgtgc

SEQ ID NO: 2470579 - DNA, 16 bp, Homo sapiens
ggctctaacgcctgag

SEQ ID NO: 2470580 - DNA, 19 bp, Homo sapiens
ggctctaacgcctgagccc

SEQ ID NO: 2470581 - DNA, 22 bp, Homo sapiens
ggctctaacgcctgagcccagg

SEQ ID NO: 2470582 - DNA, 19 bp, Homo sapiens
ggctctaattcacagtgct

SEQ ID NO: 2470583 - DNA, 23 bp, Homo sapiens
ggctctatgagtctagatgttta

SEQ ID NO: 2470584 - DNA, 12 bp, Homo sapiens
ggctctcctggc

SEQ ID NO: 2470585 - DNA, 17 bp, Homo sapiens
ggctctcctggcttccc

SEQ ID NO: 2470586 - DNA, 18 bp, Homo sapiens
ggctctgagagtctagat

SEQ ID NO: 2470587 - DNA, 22 bp, Homo sapiens
ggctctgagagtctagattctc

SEQ ID NO: 2470588 - DNA, 14 bp, Homo sapiens
ggctctgagcgcct

SEQ ID NO: 2470589 - DNA, 12 bp, Homo sapiens
ggctctgaggcg

SEQ ID NO: 2470590 - DNA, 23 bp, Homo sapiens
ggctctgaggtgcctgtcccacc

SEQ ID NO: 2470591 - DNA, 12 bp, Homo sapiens
ggctctgccagt

SEQ ID NO: 2470592 - DNA, 16 bp, Homo sapiens
ggctctgccagtcctg

SEQ ID NO: 2470593 - DNA, 14 bp, Homo sapiens
ggctctgtccccag

SEQ ID NO: 2470594 - DNA, 21 bp, Homo sapiens
ggctcttagcagcttccagat

SEQ ID NO: 2470595 - DNA, 19 bp, Homo sapiens
ggctcttgatacccccctc

SEQ ID NO: 2470596 - DNA, 17 bp, Homo sapiens
ggctgaaattctcctgg

SEQ ID NO: 2470597 - DNA, 21 bp, Homo sapiens
ggctgaaattctcctggaggt

SEQ ID NO: 2470598 - DNA, 13 bp, Homo sapiens
ggctgaccacagc

SEQ ID NO: 2470599 - DNA, 15 bp, Homo sapiens
ggctgaccacagcac

SEQ ID NO: 2470600 - DNA, 19 bp, Homo sapiens
ggctgaccacagcacagcc

SEQ ID NO: 2470601 - DNA, 13 bp, Homo sapiens
ggctgaggccacc

SEQ ID NO: 2470602 - DNA, 14 bp, Homo sapiens
ggctgaggctggca

SEQ ID NO: 2470603 - DNA, 18 bp, Homo sapiens
ggctgcagaggccagagg

SEQ ID NO: 2470604 - DNA, 15 bp, Homo sapiens
ggctgcagcctcagg

SEQ ID NO: 2470605 - DNA, 19 bp, Homo sapiens
ggctgcagcctcaggactg

SEQ ID NO: 2470606 - DNA, 21 bp, Homo sapiens
ggctgcattgaaaagagctga

SEQ ID NO: 2470607 - DNA, 21 bp, Homo sapiens
ggctgctgatcgccttcccca

SEQ ID NO: 2470608 - DNA, 22 bp, Homo sapiens
ggctgctgctgctcttggctgg

SEQ ID NO: 2470609 - DNA, 14 bp, Homo sapiens
ggctgctgctgggc

SEQ ID NO: 2470610 - DNA, 18 bp, Homo sapiens
ggctgctgctgggctcag

SEQ ID NO: 2470611 - DNA, 17 bp, Homo sapiens
ggctgctgtgggaaatg

SEQ ID NO: 2470612 - DNA, 18 bp, Homo sapiens
ggctgcttcctcctggaa

SEQ ID NO: 2470613 - DNA, 12 bp, Homo sapiens
ggctggacccag

SEQ ID NO: 2470614 - DNA, 14 bp, Homo sapiens
ggctggaggagccc

SEQ ID NO: 2470615 - DNA, 19 bp, Homo sapiens
ggctggaggcccaggctgg

SEQ ID NO: 2470616 - DNA, 20 bp, Homo sapiens
ggctggagtgcagtggtgca

SEQ ID NO: 2470617 - DNA, 23 bp, Homo sapiens
ggctggagttagggactgaccag

SEQ ID NO: 2470618 - DNA, 16 bp, Homo sapiens
ggctggccagtccagg

SEQ ID NO: 2470619 - DNA, 24 bp, Homo sapiens
ggctggctccagatgcagggcagt

SEQ ID NO: 2470620 - DNA, 12 bp, Homo sapiens
ggctggctgagg

SEQ ID NO: 2470621 - DNA, 20 bp, Homo sapiens
ggctgggccatgtccaaaga

SEQ ID NO: 2470622 - DNA, 23 bp, Homo sapiens
ggctggtccagggctagtgactt

SEQ ID NO: 2470623 - DNA, 15 bp, Homo sapiens
ggctggtgtggtaca

SEQ ID NO: 2470624 - DNA, 22 bp, Homo sapiens
ggctggtgtggtacagagaagc

SEQ ID NO: 2470625 - DNA, 23 bp, Homo sapiens
ggctggtgtggtacagagaagcc

SEQ ID NO: 2470626 - DNA, 16 bp, Homo sapiens
ggctggtgttaacaga

SEQ ID NO: 2470627 - DNA, 17 bp, Homo sapiens
ggctggtgttaacagaa

SEQ ID NO: 2470628 - DNA, 15 bp, Homo sapiens
ggctgtaactgccag

SEQ ID NO: 2470629 - DNA, 16 bp, Homo sapiens
ggctgtaactgccagg

SEQ ID NO: 2470630 - DNA, 17 bp, Homo sapiens
ggctgtcatctgtgcac

SEQ ID NO: 2470631 - DNA, 15 bp, Homo sapiens
ggctgtcccggaggc

SEQ ID NO: 2470632 - DNA, 18 bp, Homo sapiens
ggctgtgcagtcctgggt

SEQ ID NO: 2470633 - DNA, 15 bp, Homo sapiens
ggctgtggtcacagc

SEQ ID NO: 2470634 - DNA, 23 bp, Homo sapiens
ggcttaaacccatattgtaaaac

SEQ ID NO: 2470635 - DNA, 14 bp, Homo sapiens
ggcttacctggccc

SEQ ID NO: 2470636 - DNA, 16 bp, Homo sapiens
ggcttataattctttc

SEQ ID NO: 2470637 - DNA, 16 bp, Homo sapiens
ggcttcagctgccagt

SEQ ID NO: 2470638 - DNA, 15 bp, Homo sapiens
ggcttcatgccagct

SEQ ID NO: 2470639 - DNA, 16 bp, Homo sapiens
ggcttcatgccagcta

SEQ ID NO: 2470640 - DNA, 14 bp, Homo sapiens
ggcttcctggtgct

SEQ ID NO: 2470641 - DNA, 17 bp, Homo sapiens
ggcttcctggtgctgga

SEQ ID NO: 2470642 - DNA, 18 bp, Homo sapiens
ggcttcctggtgctggag

SEQ ID NO: 2470643 - DNA, 21 bp, Homo sapiens
ggcttctgctggggcctggga

SEQ ID NO: 2470644 - DNA, 18 bp, Homo sapiens
ggcttggccacagccagg

SEQ ID NO: 2470645 - DNA, 19 bp, Homo sapiens
ggcttggccacagccaggg

SEQ ID NO: 2470646 - DNA, 18 bp, Homo sapiens
ggcttgtggggcctggga

SEQ ID NO: 2470647 - DNA, 20 bp, Homo sapiens
ggctttatgataatagattc

SEQ ID NO: 2470648 - DNA, 22 bp, Homo sapiens
ggctttatgataatagattctc

SEQ ID NO: 2470649 - DNA, 20 bp, Homo sapiens
ggctttcattttctctcagg

SEQ ID NO: 2470650 - DNA, 19 bp, Homo sapiens
ggcttttattaatgcactt

SEQ ID NO: 2470651 - DNA, 20 bp, Homo sapiens
gggaaaaactttggaaccag

SEQ ID NO: 2470652 - DNA, 18 bp, Homo sapiens
gggaaaattatttgcata

SEQ ID NO: 2470653 - DNA, 22 bp, Homo sapiens
gggaaacagcatctccaagcag

SEQ ID NO: 2470654 - DNA, 21 bp, Homo sapiens
gggaaatggtactgtacagct

SEQ ID NO: 2470655 - DNA, 14 bp, Homo sapiens
gggaacccctttcc

SEQ ID NO: 2470656 - DNA, 16 bp, Homo sapiens
gggaactggccaagct

SEQ ID NO: 2470657 - DNA, 21 bp, Homo sapiens
gggaactggccaagctgaggt

SEQ ID NO: 2470658 - DNA, 11 bp, Homo sapiens
gggaagacagt

SEQ ID NO: 2470659 - DNA, 16 bp, Homo sapiens
gggaagacagtggccc

SEQ ID NO: 2470660 - DNA, 15 bp, Homo sapiens
gggaaggcaggcagg

SEQ ID NO: 2470661 - DNA, 21 bp, Homo sapiens
gggaaggctacttcggggctg

SEQ ID NO: 2470662 - DNA, 16 bp, Homo sapiens
gggaagggagccaagg

SEQ ID NO: 2470663 - DNA, 14 bp, Homo sapiens
gggaatggcagcag

SEQ ID NO: 2470664 - DNA, 15 bp, Homo sapiens
gggacaaaggagcct

SEQ ID NO: 2470665 - DNA, 18 bp, Homo sapiens
gggacaaaggagcctgtg

SEQ ID NO: 2470666 - DNA, 22 bp, Homo sapiens
gggacaagtggactcagggcag

SEQ ID NO: 2470667 - DNA, 19 bp, Homo sapiens
gggacatgcttagcagtcc

SEQ ID NO: 2470668 - DNA, 18 bp, Homo sapiens
gggaccaggagtgggtgg

SEQ ID NO: 2470669 - DNA, 21 bp, Homo sapiens
gggaccgctacaccactctgg

SEQ ID NO: 2470670 - DNA, 21 bp, Homo sapiens
gggacctggtaccctcctggc

SEQ ID NO: 2470671 - DNA, 21 bp, Homo sapiens
gggacgcctgggggtgccagg

SEQ ID NO: 2470672 - DNA, 22 bp, Homo sapiens
gggacgtggctcagccagcact

SEQ ID NO: 2470673 - DNA, 17 bp, Homo sapiens
gggactaaatgccctgc

SEQ ID NO: 2470674 - DNA, 13 bp, Homo sapiens
gggactgtaagtt

SEQ ID NO: 2470675 - DNA, 23 bp, Homo sapiens
gggagaaatagtcggtgaagaaa

SEQ ID NO: 2470676 - DNA, 14 bp, Homo sapiens
gggagacactggcc

SEQ ID NO: 2470677 - DNA, 12 bp, Homo sapiens
gggagacagcat

SEQ ID NO: 2470678 - DNA, 21 bp, Homo sapiens
gggagaccggcctgccaggag

SEQ ID NO: 2470679 - DNA, 19 bp, Homo sapiens
gggagacctcagaagtaaa

SEQ ID NO: 2470680 - DNA, 11 bp, Homo sapiens
gggcttgggcc

SEQ ID NO: 2470681 - DNA, 17 bp, Homo sapiens
ggggaaaggcaaggtcc

SEQ ID NO: 2470682 - DNA, 22 bp, Homo sapiens
ggggaaaggcaaggtccggccc

SEQ ID NO: 2470683 - DNA, 21 bp, Homo sapiens
ggggaactcagatccagggac

SEQ ID NO: 2470684 - DNA, 16 bp, Homo sapiens
ggggaagacagtggcc

SEQ ID NO: 2470685 - DNA, 19 bp, Homo sapiens
ggggaagagagcctgcagg

SEQ ID NO: 2470686 - DNA, 17 bp, Homo sapiens
ggggacacatgtatttg

SEQ ID NO: 2470687 - DNA, 16 bp, Homo sapiens
ggggacctggaaggga

SEQ ID NO: 2470688 - DNA, 18 bp, Homo sapiens
ggggacttggcctctctc

SEQ ID NO: 2470689 - DNA, 17 bp, Homo sapiens
ggggagggaagggagcc

SEQ ID NO: 2470690 - DNA, 18 bp, Homo sapiens
ggggagggaagggagcca

SEQ ID NO: 2470691 - DNA, 15 bp, Homo sapiens
ggggagggattctgg

SEQ ID NO: 2470692 - DNA, 15 bp, Homo sapiens
ggggagggggatccg

SEQ ID NO: 2470693 - DNA, 23 bp, Homo sapiens
ggggcagaggcagtacctgggca

SEQ ID NO: 2470694 - DNA, 12 bp, Homo sapiens
ggggcagccccc

SEQ ID NO: 2470695 - DNA, 15 bp, Homo sapiens
ggggcaggctgggcc

SEQ ID NO: 2470696 - DNA, 12 bp, Homo sapiens
ggggccagaggc

SEQ ID NO: 2470697 - DNA, 17 bp, Homo sapiens
ggggcccctctcagccc

SEQ ID NO: 2470698 - DNA, 21 bp, Homo sapiens
ggggcccgcgatgtggaactg

SEQ ID NO: 2470699 - DNA, 17 bp, Homo sapiens
ggggcctgagcagtcct

SEQ ID NO: 2470700 - DNA, 19 bp, Homo sapiens
ggggcctgccacctggacc

SEQ ID NO: 2470701 - DNA, 19 bp, Homo sapiens
ggggcctgtactgcctgct

SEQ ID NO: 2470702 - DNA, 11 bp, Homo sapiens
ggggctcagag

SEQ ID NO: 2470703 - DNA, 18 bp, Homo sapiens
ggggctctaacgcctgag

SEQ ID NO: 2470704 - DNA, 21 bp, Homo sapiens
ggggctctaacgcctgagccc

SEQ ID NO: 2470705 - DNA, 16 bp, Homo sapiens
ggggctgcttcctcct

SEQ ID NO: 2470706 - DNA, 18 bp, Homo sapiens
ggggctgcttcctcctgg

SEQ ID NO: 2470707 - DNA, 16 bp, Homo sapiens
ggggctggaggagccc

SEQ ID NO: 2470708 - DNA, 17 bp, Homo sapiens
ggggctggaggagccca

SEQ ID NO: 2470709 - DNA, 23 bp, Homo sapiens
ggggctggaggagcccaggccag

SEQ ID NO: 2470710 - DNA, 11 bp, Homo sapiens
ggggcttcctg

SEQ ID NO: 2470711 - DNA, 13 bp, Homo sapiens
ggggcttcctggt

SEQ ID NO: 2470712 - DNA, 16 bp, Homo sapiens
gggggcacaagactga

SEQ ID NO: 2470713 - DNA, 11 bp, Homo sapiens
gggggcctggc

SEQ ID NO: 2470714 - DNA, 12 bp, Homo sapiens
gggggcctggct

SEQ ID NO: 2470715 - DNA, 13 bp, Homo sapiens
gggggcctggctg

SEQ ID NO: 2470716 - DNA, 15 bp, Homo sapiens
gggggcgcctgtggt

SEQ ID NO: 2470717 - DNA, 15 bp, Homo sapiens
gggggcggcctatga

SEQ ID NO: 2470718 - DNA, 16 bp, Homo sapiens
gggggctgaggagcag

SEQ ID NO: 2470719 - DNA, 12 bp, Homo sapiens
gggggtctggct

SEQ ID NO: 2470720 - DNA, 16 bp, Homo sapiens
gggggtctggctggtg

SEQ ID NO: 2470721 - DNA, 22 bp, Homo sapiens
gggggtctggctggtgttaaca

SEQ ID NO: 2470722 - DNA, 13 bp, Homo sapiens
gggggtggccgct

SEQ ID NO: 2470723 - DNA, 13 bp, Homo sapiens
ggggtagggggct

SEQ ID NO: 2470724 - DNA, 12 bp, Homo sapiens
ggggtcccagca

SEQ ID NO: 2470725 - DNA, 21 bp, Homo sapiens
ggggtctggagttgatctgga

SEQ ID NO: 2470726 - DNA, 15 bp, Homo sapiens
ggggtgaggagctgg

SEQ ID NO: 2470727 - DNA, 17 bp, Homo sapiens
ggggtgatgagggcagc

SEQ ID NO: 2470728 - DNA, 13 bp, Homo sapiens
ggggtgcacagga

SEQ ID NO: 2470729 - DNA, 15 bp, Homo sapiens
ggggtgcacaggagg

SEQ ID NO: 2470730 - DNA, 16 bp, Homo sapiens
ggggtgcacaggaggg

SEQ ID NO: 2470731 - DNA, 11 bp, Homo sapiens
gggtaaacaat

SEQ ID NO: 2470732 - DNA, 18 bp, Homo sapiens
gggtagggggctggagga

SEQ ID NO: 2470733 - DNA, 23 bp, Homo sapiens
gggtataaaactttcctcgcctg

SEQ ID NO: 2470734 - DNA, 22 bp, Homo sapiens
gggtataggtctcatctcttca

SEQ ID NO: 2470735 - DNA, 13 bp, Homo sapiens
gggtcaagttatt

SEQ ID NO: 2470736 - DNA, 12 bp, Homo sapiens
gggtcacaggaa

SEQ ID NO: 2470737 - DNA, 12 bp, Homo sapiens
gggtcaggcctt

SEQ ID NO: 2470738 - DNA, 12 bp, Homo sapiens
gggtccaggagg

SEQ ID NO: 2470739 - DNA, 20 bp, Homo sapiens
gggtcctcctccagggacag

SEQ ID NO: 2470740 - DNA, 23 bp, Homo sapiens
gggtctgctcccaaggggcctga

SEQ ID NO: 2470741 - DNA, 20 bp, Homo sapiens
gggtctgctctttctctgcc

SEQ ID NO: 2470742 - DNA, 12 bp, Homo sapiens
gggtctggctgg

SEQ ID NO: 2470743 - DNA, 15 bp, Homo sapiens
gggtctggctggtgt

SEQ ID NO: 2470744 - DNA, 17 bp, Homo sapiens
gggtgatgagggcagca

SEQ ID NO: 2470745 - DNA, 19 bp, Homo sapiens
gggtgatgagggcagcagc

SEQ ID NO: 2470746 - DNA, 23 bp, Homo sapiens
gggtgcagtatcatgccctgtgc

SEQ ID NO: 2470747 - DNA, 15 bp, Homo sapiens
gggtgctactgggga

SEQ ID NO: 2470748 - DNA, 12 bp, Homo sapiens
gggtggccaggc

SEQ ID NO: 2470749 - DNA, 14 bp, Homo sapiens
gggtggccaggccg

SEQ ID NO: 2470750 - DNA, 20 bp, Homo sapiens
gggtggctactctgtgccag

SEQ ID NO: 2470751 - DNA, 20 bp, Homo sapiens
gggtggggcccaggcccgga

SEQ ID NO: 2470752 - DNA, 16 bp, Homo sapiens
gggtggggtggctgca

SEQ ID NO: 2470753 - DNA, 20 bp, Homo sapiens
gggtgtccccaacagcgccc

SEQ ID NO: 2470754 - DNA, 23 bp, Homo sapiens
gggtgtcttgggcagagctggct

SEQ ID NO: 2470755 - DNA, 21 bp, Homo sapiens
gggttccgtgtccacccccat

SEQ ID NO: 2470756 - DNA, 17 bp, Homo sapiens
gggttcctcccctccag

SEQ ID NO: 2470757 - DNA, 20 bp, Homo sapiens
gggttctgcctgccagctgc

SEQ ID NO: 2470758 - DNA, 20 bp, Homo sapiens
gggtttcaccatgttagcca

SEQ ID NO: 2470759 - DNA, 24 bp, Homo sapiens
ggtaacttttgtgaattaggctgt

SEQ ID NO: 2470760 - DNA, 13 bp, Homo sapiens
ggtacagagaagc

SEQ ID NO: 2470761 - DNA, 15 bp, Homo sapiens
ggtacagagaagcca

SEQ ID NO: 2470762 - DNA, 21 bp, Homo sapiens
ggtacagagaagccagcttgt

SEQ ID NO: 2470763 - DNA, 13 bp, Homo sapiens
ggtaccctctgga

SEQ ID NO: 2470764 - DNA, 18 bp, Homo sapiens
ggtactgtacagctggct

SEQ ID NO: 2470765 - DNA, 19 bp, Homo sapiens
ggtacttcttgaaggtgct

SEQ ID NO: 2470766 - DNA, 13 bp, Homo sapiens
ggtagccagcaca

SEQ ID NO: 2470767 - DNA, 23 bp, Homo sapiens
ggtaggccaaggtgtcctacaga

SEQ ID NO: 2470768 - DNA, 18 bp, Homo sapiens
ggtaggggcccctctcag

SEQ ID NO: 2470769 - DNA, 19 bp, Homo sapiens
ggtaggggcccctctcagc

SEQ ID NO: 2470770 - DNA, 13 bp, Homo sapiens
ggtaggggctggg

SEQ ID NO: 2470771 - DNA, 17 bp, Homo sapiens
ggtagggggctggagga

SEQ ID NO: 2470772 - DNA, 14 bp, Homo sapiens
ggtagggtaaatca

SEQ ID NO: 2470773 - DNA, 15 bp, Homo sapiens
ggtagggtaaatcag

SEQ ID NO: 2470774 - DNA, 16 bp, Homo sapiens
ggtagggtaaatcagt

SEQ ID NO: 2470775 - DNA, 21 bp, Homo sapiens
ggtataaaactttcctcgcct

SEQ ID NO: 2470776 - DNA, 22 bp, Homo sapiens
ggtataaaactttcctcgcctg

SEQ ID NO: 2470777 - DNA, 13 bp, Homo sapiens
ggtataggtctca

SEQ ID NO: 2470778 - DNA, 15 bp, Homo sapiens
ggtatctcagaaagt

SEQ ID NO: 2470779 - DNA, 19 bp, Homo sapiens
ggtatctcagaaagtgcct

SEQ ID NO: 2470780 - DNA, 20 bp, Homo sapiens
ggtatggcgtaagtacagag

SEQ ID NO: 2470781 - DNA, 22 bp, Homo sapiens
ggtcaacagttttcctatgctt

SEQ ID NO: 2470782 - DNA, 20 bp, Homo sapiens
ggtcacctaggaagcctcag

SEQ ID NO: 2470783 - DNA, 18 bp, Homo sapiens
ggtccaatgagctttctg

SEQ ID NO: 2470784 - DNA, 19 bp, Homo sapiens
ggtccaatgagctttctga

SEQ ID NO: 2470785 - DNA, 16 bp, Homo sapiens
gtaaaagcattttgta

SEQ ID NO: 2470786 - DNA, 19 bp, Homo sapiens
gtaaaatattttgaatcaa

SEQ ID NO: 2470787 - DNA, 21 bp, Homo sapiens
gtaaaatcttgtcatgtgtat

SEQ ID NO: 2470788 - DNA, 23 bp, Homo sapiens
gtaaaatcttgtcatgtgtataa

SEQ ID NO: 2470789 - DNA, 21 bp, Homo sapiens
gtaaaatgacaatcatgtgtg

SEQ ID NO: 2470790 - DNA, 23 bp, Homo sapiens
gtaaaatgtgggattatgggtca

SEQ ID NO: 2470791 - DNA, 19 bp, Homo sapiens
gtaaacagatggcactttg

SEQ ID NO: 2470792 - DNA, 23 bp, Homo sapiens
gtaaaccaatcctatgcatggtt

SEQ ID NO: 2470793 - DNA, 12 bp, Homo sapiens
gtaaaccactga

SEQ ID NO: 2470794 - DNA, 22 bp, Homo sapiens
gtaaaccactgaaaaaatatat

SEQ ID NO: 2470795 - DNA, 16 bp, Homo sapiens
gtaaactttttgtgct

SEQ ID NO: 2470796 - DNA, 15 bp, Homo sapiens
gtaaagaattatttt

SEQ ID NO: 2470797 - DNA, 23 bp, Homo sapiens
gtaaagtatgtattatttacatt

SEQ ID NO: 2470798 - DNA, 15 bp, Homo sapiens
gtaaagtcaaggaga

SEQ ID NO: 2470799 - DNA, 13 bp, Homo sapiens
gtaaataaaaaga

SEQ ID NO: 2470800 - DNA, 12 bp, Homo sapiens
gtaaataatgct

SEQ ID NO: 2470801 - DNA, 13 bp, Homo sapiens
gtaaatacaattt

SEQ ID NO: 2470802 - DNA, 19 bp, Homo sapiens
gtaaatacaatttttttta

SEQ ID NO: 2470803 - DNA, 16 bp, Homo sapiens
gtaaatacccatatgt

SEQ ID NO: 2470804 - DNA, 14 bp, Homo sapiens
gtaaataggaattg

SEQ ID NO: 2470805 - DNA, 23 bp, Homo sapiens
gtaaatataaagacgttttataa

SEQ ID NO: 2470806 - DNA, 14 bp, Homo sapiens
gtaaatattttaaa

SEQ ID NO: 2470807 - DNA, 12 bp, Homo sapiens
gtaaatctgcca

SEQ ID NO: 2470808 - DNA, 14 bp, Homo sapiens
gtaaatctgccaca

SEQ ID NO: 2470809 - DNA, 15 bp, Homo sapiens
gtaaatctgccacaa

SEQ ID NO: 2470810 - DNA, 14 bp, Homo sapiens
gtaaatcttttaca

SEQ ID NO: 2470811 - DNA, 16 bp, Homo sapiens
gtaaatggtatgtcat

SEQ ID NO: 2470812 - DNA, 22 bp, Homo sapiens
gtaaattggcatggaaatttaa

SEQ ID NO: 2470813 - DNA, 17 bp, Homo sapiens
gtaacaatacaaatgga

SEQ ID NO: 2470814 - DNA, 17 bp, Homo sapiens
gtaacactaatatattt

SEQ ID NO: 2470815 - DNA, 23 bp, Homo sapiens
gtaacatgtgttaagtattttca

SEQ ID NO: 2470816 - DNA, 17 bp, Homo sapiens
gtaacgcgtcttcctga

SEQ ID NO: 2470817 - DNA, 13 bp, Homo sapiens
gtaactaaaataa

SEQ ID NO: 2470818 - DNA, 20 bp, Homo sapiens
gtaactaaaataattttgta

SEQ ID NO: 2470819 - DNA, 22 bp, Homo sapiens
gtaactaaaataattttgtaat

SEQ ID NO: 2470820 - DNA, 19 bp, Homo sapiens
gtaactaactgcatacact

SEQ ID NO: 2470821 - DNA, 16 bp, Homo sapiens
gtaactgcctagaaac

SEQ ID NO: 2470822 - DNA, 20 bp, Homo sapiens
gtaactgcctagaaacaaca

SEQ ID NO: 2470823 - DNA, 20 bp, Homo sapiens
gtaactgctttctgttccaa

SEQ ID NO: 2470824 - DNA, 16 bp, Homo sapiens
gtaactgttttttaag

SEQ ID NO: 2470825 - DNA, 22 bp, Homo sapiens
gtaacttgatccatttctaatt

SEQ ID NO: 2470826 - DNA, 23 bp, Homo sapiens
gtaacttgatccatttctaatta

SEQ ID NO: 2470827 - DNA, 14 bp, Homo sapiens
gtaacttttgtgaa

SEQ ID NO: 2470828 - DNA, 21 bp, Homo sapiens
gtaagattatagattctaaag

SEQ ID NO: 2470829 - DNA, 17 bp, Homo sapiens
gtaagatttgtttttaa

SEQ ID NO: 2470830 - DNA, 16 bp, Homo sapiens
gtaagcactgactggg

SEQ ID NO: 2470831 - DNA, 16 bp, Homo sapiens
gtaagtacagagaagc

SEQ ID NO: 2470832 - DNA, 19 bp, Homo sapiens
gtaagtacagagaagccat

SEQ ID NO: 2470833 - DNA, 17 bp, Homo sapiens
gtaagttgggcttgcta

SEQ ID NO: 2470834 - DNA, 19 bp, Homo sapiens
gtaagttgggcttgctatt

SEQ ID NO: 2470835 - DNA, 12 bp, Homo sapiens
gtaataataaag

SEQ ID NO: 2470836 - DNA, 19 bp, Homo sapiens
gtaatattgacttgtatat

SEQ ID NO: 2470837 - DNA, 18 bp, Homo sapiens
gtaatccctgctttttgt

SEQ ID NO: 2470838 - DNA, 22 bp, Homo sapiens
gtaatcctcaagaaataaaagg

SEQ ID NO: 2470839 - DNA, 23 bp, Homo sapiens
gtaatggtactgactttgcttgc

SEQ ID NO: 2470840 - DNA, 22 bp, Homo sapiens
gtaatgttaatattgatttatt

SEQ ID NO: 2470841 - DNA, 20 bp, Homo sapiens
gtaattagtgccacttaatg

SEQ ID NO: 2470842 - DNA, 23 bp, Homo sapiens
gtaattatttatgtatggtgcaa

SEQ ID NO: 2470843 - DNA, 14 bp, Homo sapiens
gtacactctgctgt

SEQ ID NO: 2470844 - DNA, 16 bp, Homo sapiens
gtacagagaagccagc

SEQ ID NO: 2470845 - DNA, 18 bp, Homo sapiens
gtacagagaagccatcac

SEQ ID NO: 2470846 - DNA, 16 bp, Homo sapiens
gtacagggttatctgc

SEQ ID NO: 2470847 - DNA, 24 bp, Homo sapiens
gtacagtatgggggttgtaaattg

SEQ ID NO: 2470848 - DNA, 14 bp, Homo sapiens
gtacagtgtctttt

SEQ ID NO: 2470849 - DNA, 20 bp, Homo sapiens
gtacagtgtctttttttgta

SEQ ID NO: 2470850 - DNA, 22 bp, Homo sapiens
gtacagtgtctttttttgtata

SEQ ID NO: 2470851 - DNA, 16 bp, Homo sapiens
gtacatatgtgctgga

SEQ ID NO: 2470852 - DNA, 14 bp, Homo sapiens
gtacatctggcctt

SEQ ID NO: 2470853 - DNA, 16 bp, Homo sapiens
gtacatttctcaggct

SEQ ID NO: 2470854 - DNA, 21 bp, Homo sapiens
gtaccaagaatcttggtttgc

SEQ ID NO: 2470855 - DNA, 14 bp, Homo sapiens
gtaccaatcatttt

SEQ ID NO: 2470856 - DNA, 13 bp, Homo sapiens
gtaccattttaaa

SEQ ID NO: 2470857 - DNA, 19 bp, Homo sapiens
gtacccaccgggccactcc

SEQ ID NO: 2470858 - DNA, 15 bp, Homo sapiens
gtacccccaggacca

SEQ ID NO: 2470859 - DNA, 16 bp, Homo sapiens
gtacccccaggaccag

SEQ ID NO: 2470860 - DNA, 17 bp, Homo sapiens
gtaccctctcagctcca

SEQ ID NO: 2470861 - DNA, 18 bp, Homo sapiens
gtaccctctcagctccag

SEQ ID NO: 2470862 - DNA, 14 bp, Homo sapiens
gtacctgagggtct

SEQ ID NO: 2470863 - DNA, 15 bp, Homo sapiens
gtacctgagggtctg

SEQ ID NO: 2470864 - DNA, 17 bp, Homo sapiens
gtacctgcccccaatcc

SEQ ID NO: 2470865 - DNA, 23 bp, Homo sapiens
gtacgaacctacagttttaactg

SEQ ID NO: 2470866 - DNA, 15 bp, Homo sapiens
gtactatttaactga

SEQ ID NO: 2470867 - DNA, 19 bp, Homo sapiens
gtactccacactgcacaat

SEQ ID NO: 2470868 - DNA, 21 bp, Homo sapiens
gtactccacactgcacaataa

SEQ ID NO: 2470869 - DNA, 15 bp, Homo sapiens
gtactccctctcagg

SEQ ID NO: 2470870 - DNA, 16 bp, Homo sapiens
gtactgagccttgtaa

SEQ ID NO: 2470871 - DNA, 13 bp, Homo sapiens
gtactgcctgctt

SEQ ID NO: 2470872 - DNA, 15 bp, Homo sapiens
gtactgtacagctgg

SEQ ID NO: 2470873 - DNA, 19 bp, Homo sapiens
gtactgtacagctggctct

SEQ ID NO: 2470874 - DNA, 21 bp, Homo sapiens
gtacttggagtattggggtct

SEQ ID NO: 2470875 - DNA, 22 bp, Homo sapiens
gtactttcatattttaaacaga

SEQ ID NO: 2470876 - DNA, 20 bp, Homo sapiens
gtagaaaaaaaaattcacat

SEQ ID NO: 2470877 - DNA, 18 bp, Homo sapiens
gtagaacactaattcata

SEQ ID NO: 2470878 - DNA, 18 bp, Homo sapiens
gtagaagggaaagcccat

SEQ ID NO: 2470879 - DNA, 22 bp, Homo sapiens
gtagaattatctaatttataaa

SEQ ID NO: 2470880 - DNA, 14 bp, Homo sapiens
gtagaattgcattg

SEQ ID NO: 2470881 - DNA, 15 bp, Homo sapiens
gtagaccactgccat

SEQ ID NO: 2470882 - DNA, 21 bp, Homo sapiens
gtagaccttgttacttctgag

SEQ ID NO: 2470883 - DNA, 21 bp, Homo sapiens
gtagataagtgttctgtctga

SEQ ID NO: 2470884 - DNA, 22 bp, Homo sapiens
gtagatgcatttgggtccagga

SEQ ID NO: 2470885 - DNA, 23 bp, Homo sapiens
gtagattgcagaaaattctgtgc

SEQ ID NO: 2470886 - DNA, 17 bp, Homo sapiens
gtagcatgcttgttgca

SEQ ID NO: 2470887 - DNA, 18 bp, Homo sapiens
gtagccagcacacagggc

SEQ ID NO: 2470888 - DNA, 14 bp, Homo sapiens
gtcatacagagaag

SEQ ID NO: 2470889 - DNA, 15 bp, Homo sapiens
gtcataccaatgaaa

SEQ ID NO: 2470890 - DNA, 14 bp, Homo sapiens
gtcatcttgctacc

SEQ ID NO: 2470891 - DNA, 13 bp, Homo sapiens
gtcatgctgcctt

SEQ ID NO: 2470892 - DNA, 23 bp, Homo sapiens
gtcatgggccactgcttttccct

SEQ ID NO: 2470893 - DNA, 11 bp, Homo sapiens
gtcatgtgacc

SEQ ID NO: 2470894 - DNA, 12 bp, Homo sapiens
gtcatgtgtata

SEQ ID NO: 2470895 - DNA, 16 bp, Homo sapiens
gtcattcgttctgtgg

SEQ ID NO: 2470896 - DNA, 22 bp, Homo sapiens
gtcatttgctgagcatgtactg

SEQ ID NO: 2470897 - DNA, 22 bp, Homo sapiens
gtcatttttacaatgtaattat

SEQ ID NO: 2470898 - DNA, 23 bp, Homo sapiens
gtcattttttttctttgaataaa

SEQ ID NO: 2470899 - DNA, 23 bp, Homo sapiens
gtccaaaaccgccagctctgttc

SEQ ID NO: 2470900 - DNA, 20 bp, Homo sapiens
gtccaaggtttaaagagtct

SEQ ID NO: 2470901 - DNA, 15 bp, Homo sapiens
gtccaatgagctttc

SEQ ID NO: 2470902 - DNA, 21 bp, Homo sapiens
gtccaatgagctttctgaaca

SEQ ID NO: 2470903 - DNA, 12 bp, Homo sapiens
gtccaatgtggc

SEQ ID NO: 2470904 - DNA, 15 bp, Homo sapiens
gtccacgactgtctc

SEQ ID NO: 2470905 - DNA, 21 bp, Homo sapiens
gtccagctctggaggggaggg

SEQ ID NO: 2470906 - DNA, 20 bp, Homo sapiens
gtccaggctgccgtggggcc

SEQ ID NO: 2470907 - DNA, 18 bp, Homo sapiens
gtccatgggcagagccca

SEQ ID NO: 2470908 - DNA, 21 bp, Homo sapiens
gtccattgtccaatcctatgt

SEQ ID NO: 2470909 - DNA, 16 bp, Homo sapiens
gtccatttacacgtat

SEQ ID NO: 2470910 - DNA, 14 bp, Homo sapiens
gtcccacagccacg

SEQ ID NO: 2470911 - DNA, 15 bp, Homo sapiens
gtcccacagccacgt

SEQ ID NO: 2470912 - DNA, 13 bp, Homo sapiens
gtcccacatccct

SEQ ID NO: 2470913 - DNA, 15 bp, Homo sapiens
gtcccacatccctgg

SEQ ID NO: 2470914 - DNA, 23 bp, Homo sapiens
gtcccacatccctgggcctgctg

SEQ ID NO: 2470915 - DNA, 19 bp, Homo sapiens
gtcccacccccacccccag

SEQ ID NO: 2470916 - DNA, 21 bp, Homo sapiens
gtcccacccccacccccagct

SEQ ID NO: 2470917 - DNA, 12 bp, Homo sapiens
gtcccagcagct

SEQ ID NO: 2470918 - DNA, 15 bp, Homo sapiens
gtcccagcagctgcc

SEQ ID NO: 2470919 - DNA, 19 bp, Homo sapiens
gtcccaggaatcagtttaa

SEQ ID NO: 2470920 - DNA, 17 bp, Homo sapiens
gtcccaggttggctctg

SEQ ID NO: 2470921 - DNA, 17 bp, Homo sapiens
gtccccatactcctatg

SEQ ID NO: 2470922 - DNA, 22 bp, Homo sapiens
gtccccccaccctcattctact

SEQ ID NO: 2470923 - DNA, 19 bp, Homo sapiens
gtccccctctgtccaggca

SEQ ID NO: 2470924 - DNA, 17 bp, Homo sapiens
gtcccctagagtcccag

SEQ ID NO: 2470925 - DNA, 13 bp, Homo sapiens
gtcccctgctaca

SEQ ID NO: 2470926 - DNA, 23 bp, Homo sapiens
gtccctccgggacctggtgctgc

SEQ ID NO: 2470927 - DNA, 12 bp, Homo sapiens
gtccctctgtgt

SEQ ID NO: 2470928 - DNA, 14 bp, Homo sapiens
gtccctctgtgtat

SEQ ID NO: 2470929 - DNA, 18 bp, Homo sapiens
gtccctgctgccagcttc

SEQ ID NO: 2470930 - DNA, 19 bp, Homo sapiens
gtcccttgtatcccctgca

SEQ ID NO: 2470931 - DNA, 15 bp, Homo sapiens
gtccgatctttgact

SEQ ID NO: 2470932 - DNA, 22 bp, Homo sapiens
gtccgctgggtggtaccctctg

SEQ ID NO: 2470933 - DNA, 18 bp, Homo sapiens
gtccggcagcttctgccc

SEQ ID NO: 2470934 - DNA, 14 bp, Homo sapiens
gtccggtgttctaa

SEQ ID NO: 2470935 - DNA, 15 bp, Homo sapiens
gtccggtgttctaag

SEQ ID NO: 2470936 - DNA, 19 bp, Homo sapiens
gtccgtgggacggtgccca

SEQ ID NO: 2470937 - DNA, 14 bp, Homo sapiens
gtcctacagaaaaa

SEQ ID NO: 2470938 - DNA, 16 bp, Homo sapiens
gtcctacagaaaaacc

SEQ ID NO: 2470939 - DNA, 20 bp, Homo sapiens
gtcctcagccttgccagaga

SEQ ID NO: 2470940 - DNA, 22 bp, Homo sapiens
gtcctccaacaccaagcacagc

SEQ ID NO: 2470941 - DNA, 21 bp, Homo sapiens
gtcctcccaatttcagactcc

SEQ ID NO: 2470942 - DNA, 16 bp, Homo sapiens
gtcctcccgagctcct

SEQ ID NO: 2470943 - DNA, 21 bp, Homo sapiens
gtcctcccgagctcctcttcc

SEQ ID NO: 2470944 - DNA, 18 bp, Homo sapiens
gtcctcgtttgtgttctg

SEQ ID NO: 2470945 - DNA, 20 bp, Homo sapiens
gtcctctgtcagtcacagcc

SEQ ID NO: 2470946 - DNA, 18 bp, Homo sapiens
gtcctcttccaccacaga

SEQ ID NO: 2470947 - DNA, 19 bp, Homo sapiens
gtcctcttccctctctgca

SEQ ID NO: 2470948 - DNA, 16 bp, Homo sapiens
gtcctctttcagctcc

SEQ ID NO: 2470949 - DNA, 13 bp, Homo sapiens
gtcctgagcactg

SEQ ID NO: 2470950 - DNA, 19 bp, Homo sapiens
gtcctgagcactgccagga

SEQ ID NO: 2470951 - DNA, 23 bp, Homo sapiens
gtcctgagcactgccaggaggga

SEQ ID NO: 2470952 - DNA, 17 bp, Homo sapiens
gtcctgccacccagccc

SEQ ID NO: 2470953 - DNA, 20 bp, Homo sapiens
gtcctgccacccagccccag

SEQ ID NO: 2470954 - DNA, 23 bp, Homo sapiens
gtcctgcccccaaggaggcagcc

SEQ ID NO: 2470955 - DNA, 17 bp, Homo sapiens
gtcctgcctcagcctcc

SEQ ID NO: 2470956 - DNA, 11 bp, Homo sapiens
gtcctgcctgt

SEQ ID NO: 2470957 - DNA, 14 bp, Homo sapiens
gtcctgggcctgca

SEQ ID NO: 2470958 - DNA, 18 bp, Homo sapiens
gtcctggtggggcagctc

SEQ ID NO: 2470959 - DNA, 20 bp, Homo sapiens
gtcctggtggggcagctcct

SEQ ID NO: 2470960 - DNA, 22 bp, Homo sapiens
gtcctggtggggcagctcctct

SEQ ID NO: 2470961 - DNA, 20 bp, Homo sapiens
gtcctggtggtattttcaat

SEQ ID NO: 2470962 - DNA, 17 bp, Homo sapiens
gtccttactcctgtggg

SEQ ID NO: 2470963 - DNA, 18 bp, Homo sapiens
gtccttactcctgtggga

SEQ ID NO: 2470964 - DNA, 23 bp, Homo sapiens
gtccttactcctgtgggagcctc

SEQ ID NO: 2470965 - DNA, 13 bp, Homo sapiens
gtccttagcctgg

SEQ ID NO: 2470966 - DNA, 16 bp, Homo sapiens
gtccttagcctggacc

SEQ ID NO: 2470967 - DNA, 23 bp, Homo sapiens
gtccttagcctggacctctgaca

SEQ ID NO: 2470968 - DNA, 22 bp, Homo sapiens
gtcctttctagagcactgccac

SEQ ID NO: 2470969 - DNA, 21 bp, Homo sapiens
gtccttttcataggtctgaaa

SEQ ID NO: 2470970 - DNA, 15 bp, Homo sapiens
gtccttttgacactg

SEQ ID NO: 2470971 - DNA, 16 bp, Homo sapiens
gtcctttttcctctcc

SEQ ID NO: 2470972 - DNA, 16 bp, Homo sapiens
gtcgaaagctctagaa

SEQ ID NO: 2470973 - DNA, 17 bp, Homo sapiens
gtcgccctttgctgcat

SEQ ID NO: 2470974 - DNA, 16 bp, Homo sapiens
gtcgctcatgtgtgca

SEQ ID NO: 2470975 - DNA, 11 bp, Homo sapiens
gtcgctcctgc

SEQ ID NO: 2470976 - DNA, 14 bp, Homo sapiens
gtcggggcatctgg

SEQ ID NO: 2470977 - DNA, 14 bp, Homo sapiens
gtcggtctgtgccc

SEQ ID NO: 2470978 - DNA, 14 bp, Homo sapiens
gtcgtaaagatttg

SEQ ID NO: 2470979 - DNA, 17 bp, Homo sapiens
gtcgtgcctgtgtccat

SEQ ID NO: 2470980 - DNA, 23 bp, Homo sapiens
gtcgtggacacacacagactatt

SEQ ID NO: 2470981 - DNA, 19 bp, Homo sapiens
gtcgtggagagctaggagc

SEQ ID NO: 2470982 - DNA, 17 bp, Homo sapiens
gtcgtggggtgtgctgg

SEQ ID NO: 2470983 - DNA, 21 bp, Homo sapiens
gtcgtggggtgtgctgggagc

SEQ ID NO: 2470984 - DNA, 15 bp, Homo sapiens
gtcgttcccagtgtg

SEQ ID NO: 2470985 - DNA, 22 bp, Homo sapiens
gtctaaagatggagtttctaag

SEQ ID NO: 2470986 - DNA, 21 bp, Homo sapiens
gtctaatctagatatcgactt

SEQ ID NO: 2470987 - DNA, 14 bp, Homo sapiens
gtctaccctgggat

SEQ ID NO: 2470988 - DNA, 15 bp, Homo sapiens
gtctacttgctcagg

SEQ ID NO: 2470989 - DNA, 15 bp, Homo sapiens
gtctagattcaaagg

SEQ ID NO: 2470990 - DNA, 21 bp, Homo sapiens
gtctagattcaaaggttctag

SEQ ID NO: 2470991 - DNA, 15 bp, Homo sapiens
gtctataaagcattt

SEQ ID NO: 2470992 - DNA, 17 bp, Homo sapiens
gtgagggagggctgtca

SEQ ID NO: 2470993 - DNA, 17 bp, Homo sapiens
gtgagggggggctccct

SEQ ID NO: 2470994 - DNA, 15 bp, Homo sapiens
gtgagggtcccatgt

SEQ ID NO: 2470995 - DNA, 22 bp, Homo sapiens
gtgatagtcttttgcttttggc

SEQ ID NO: 2470996 - DNA, 14 bp, Homo sapiens
gtgatatgcacaat

SEQ ID NO: 2470997 - DNA, 13 bp, Homo sapiens
gtgatattctaag

SEQ ID NO: 2470998 - DNA, 20 bp, Homo sapiens
gtgatcagaccataatgtta

SEQ ID NO: 2470999 - DNA, 16 bp, Homo sapiens
gtgatccatgtaactg

SEQ ID NO: 2471000 - DNA, 15 bp, Homo sapiens
gtgatctcagatcag

SEQ ID NO: 2471001 - DNA, 14 bp, Homo sapiens
gtgatgagggcagc

SEQ ID NO: 2471002 - DNA, 16 bp, Homo sapiens
gtgatgagggcagcag

SEQ ID NO: 2471003 - DNA, 17 bp, Homo sapiens
gtgatgagggcagcagc

SEQ ID NO: 2471004 - DNA, 16 bp, Homo sapiens
gtgatggagtgctgtt

SEQ ID NO: 2471005 - DNA, 15 bp, Homo sapiens
gtgatgggggagagg

SEQ ID NO: 2471006 - DNA, 16 bp, Homo sapiens
gtgatgggggagaggg

SEQ ID NO: 2471007 - DNA, 17 bp, Homo sapiens
gtgatgtcatacagaga

SEQ ID NO: 2471008 - DNA, 19 bp, Homo sapiens
gtgatgtcatacagagaag

SEQ ID NO: 2471009 - DNA, 20 bp, Homo sapiens
gtgatgtcatacagagaagt

SEQ ID NO: 2471010 - DNA, 12 bp, Homo sapiens
gtgatgttctaa

SEQ ID NO: 2471011 - DNA, 13 bp, Homo sapiens
gtgatgttctaag

SEQ ID NO: 2471012 - DNA, 18 bp, Homo sapiens
gtgatgttctaaggctct

SEQ ID NO: 2471013 - DNA, 22 bp, Homo sapiens
gtgatgttctaaggctctgaga

SEQ ID NO: 2471014 - DNA, 19 bp, Homo sapiens
gtgattgtggaatggagat

SEQ ID NO: 2471015 - DNA, 23 bp, Homo sapiens
gtgattgtggaatggagattcag

SEQ ID NO: 2471016 - DNA, 13 bp, Homo sapiens
gtgcaacactggt

SEQ ID NO: 2471017 - DNA, 19 bp, Homo sapiens
gtgcaataaatctgaccca

SEQ ID NO: 2471018 - DNA, 21 bp, Homo sapiens
gtgcaataaatctgacccagt

SEQ ID NO: 2471019 - DNA, 12 bp, Homo sapiens
gtgcaatagaag

SEQ ID NO: 2471020 - DNA, 13 bp, Homo sapiens
gtgcaatgtaaat

SEQ ID NO: 2471021 - DNA, 22 bp, Homo sapiens
gtgcaatgtaaatattttaaag

SEQ ID NO: 2471022 - DNA, 15 bp, Homo sapiens
gtgcaatgtgtataa

SEQ ID NO: 2471023 - DNA, 18 bp, Homo sapiens
gtgcacatctgtgtcttg

SEQ ID NO: 2471024 - DNA, 15 bp, Homo sapiens
gtgcactgcccatgg

SEQ ID NO: 2471025 - DNA, 18 bp, Homo sapiens
gtgcagccgctgagcgag

SEQ ID NO: 2471026 - DNA, 16 bp, Homo sapiens
gtgcagtcctgatcag

SEQ ID NO: 2471027 - DNA, 11 bp, Homo sapiens
gtgcatcaggc

SEQ ID NO: 2471028 - DNA, 20 bp, Homo sapiens
gtgccaagtccaggtcctgg

SEQ ID NO: 2471029 - DNA, 22 bp, Homo sapiens
gtgccaagtccaggtcctggtg

SEQ ID NO: 2471030 - DNA, 15 bp, Homo sapiens
gtgccacttaatgta

SEQ ID NO: 2471031 - DNA, 18 bp, Homo sapiens
gtgccacttaatgtatgt

SEQ ID NO: 2471032 - DNA, 14 bp, Homo sapiens
gtgccagaagctac

SEQ ID NO: 2471033 - DNA, 13 bp, Homo sapiens
gtgccagagcctg

SEQ ID NO: 2471034 - DNA, 13 bp, Homo sapiens
gtgccaggaccag

SEQ ID NO: 2471035 - DNA, 22 bp, Homo sapiens
gtgccaggtgaggtcagcacat

SEQ ID NO: 2471036 - DNA, 21 bp, Homo sapiens
gtgcccacaggccgccctgcg

SEQ ID NO: 2471037 - DNA, 22 bp, Homo sapiens
gtgcccagggttttgccccaag

SEQ ID NO: 2471038 - DNA, 16 bp, Homo sapiens
gtgcccagttaatctt

SEQ ID NO: 2471039 - DNA, 17 bp, Homo sapiens
gtgcccagttaatcttg

SEQ ID NO: 2471040 - DNA, 19 bp, Homo sapiens
gtgccccaggaccagctca

SEQ ID NO: 2471041 - DNA, 13 bp, Homo sapiens
gtgcccccactga

SEQ ID NO: 2471042 - DNA, 18 bp, Homo sapiens
gtgcccccactgaccaga

SEQ ID NO: 2471043 - DNA, 16 bp, Homo sapiens
gtgcccccagggtcct

SEQ ID NO: 2471044 - DNA, 22 bp, Homo sapiens
gtgcccccagggtcctgggagg

SEQ ID NO: 2471045 - DNA, 22 bp, Homo sapiens
gtgccccttccgccactggggc

SEQ ID NO: 2471046 - DNA, 18 bp, Homo sapiens
gtgccctctcccaccctc

SEQ ID NO: 2471047 - DNA, 22 bp, Homo sapiens
gtgccctctcccaccctcttcc

SEQ ID NO: 2471048 - DNA, 16 bp, Homo sapiens
gtgccctctgggctct

SEQ ID NO: 2471049 - DNA, 17 bp, Homo sapiens
gtgccctctgggctctg

SEQ ID NO: 2471050 - DNA, 19 bp, Homo sapiens
gtgccctctgggctctgag

SEQ ID NO: 2471051 - DNA, 17 bp, Homo sapiens
gtgccctgagccagggt

SEQ ID NO: 2471052 - DNA, 14 bp, Homo sapiens
gtgcctaggcctgg

SEQ ID NO: 2471053 - DNA, 19 bp, Homo sapiens
gtgcctattgctagagctc

SEQ ID NO: 2471054 - DNA, 20 bp, Homo sapiens
gtgcctattgctagagctcc

SEQ ID NO: 2471055 - DNA, 20 bp, Homo sapiens
gtgcctcagagaccagggct

SEQ ID NO: 2471056 - DNA, 13 bp, Homo sapiens
gtgcctcctccct

SEQ ID NO: 2471057 - DNA, 15 bp, Homo sapiens
gtgcctgtcccaccc

SEQ ID NO: 2471058 - DNA, 20 bp, Homo sapiens
gtgcctgtcccacccccacc

SEQ ID NO: 2471059 - DNA, 16 bp, Homo sapiens
gtgcctttatttccac

SEQ ID NO: 2471060 - DNA, 18 bp, Homo sapiens
gtgcctttatttccactg

SEQ ID NO: 2471061 - DNA, 14 bp, Homo sapiens
gtgcgagcacacac

SEQ ID NO: 2471062 - DNA, 18 bp, Homo sapiens
gtgcgagggacccagcta

SEQ ID NO: 2471063 - DNA, 14 bp, Homo sapiens
gtgcgcccagggct

SEQ ID NO: 2471064 - DNA, 15 bp, Homo sapiens
gtgcgtggtggtccc

SEQ ID NO: 2471065 - DNA, 19 bp, Homo sapiens
gtgcgtggtggtccctggg

SEQ ID NO: 2471066 - DNA, 14 bp, Homo sapiens
gtgctaaggttcta

SEQ ID NO: 2471067 - DNA, 15 bp, Homo sapiens
gtgctaaggttctaa

SEQ ID NO: 2471068 - DNA, 17 bp, Homo sapiens
gtgctaaggttctaagg

SEQ ID NO: 2471069 - DNA, 18 bp, Homo sapiens
gtgctactggggaaactg

SEQ ID NO: 2471070 - DNA, 14 bp, Homo sapiens
gtgctaggaagagg

SEQ ID NO: 2471071 - DNA, 14 bp, Homo sapiens
gtgctatggtgctc

SEQ ID NO: 2471072 - DNA, 16 bp, Homo sapiens
gtgctcagccctgagg

SEQ ID NO: 2471073 - DNA, 14 bp, Homo sapiens
gtgctcgccccagc

SEQ ID NO: 2471074 - DNA, 14 bp, Homo sapiens
gtgctcgccctgcg

SEQ ID NO: 2471075 - DNA, 13 bp, Homo sapiens
gtgctctctttct

SEQ ID NO: 2471076 - DNA, 15 bp, Homo sapiens
gtgctctttgttttg

SEQ ID NO: 2471077 - DNA, 22 bp, Homo sapiens
gtgctctttgttttgtgtctct

SEQ ID NO: 2471078 - DNA, 23 bp, Homo sapiens
gtgctctttgttttgtgtctctt

SEQ ID NO: 2471079 - DNA, 21 bp, Homo sapiens
gtgctgaacagtggaggaaga

SEQ ID NO: 2471080 - DNA, 11 bp, Homo sapiens
gtgctgcctct

SEQ ID NO: 2471081 - DNA, 16 bp, Homo sapiens
gtgctgggagctccac

SEQ ID NO: 2471082 - DNA, 22 bp, Homo sapiens
gtgctgggagctccactctgct

SEQ ID NO: 2471083 - DNA, 20 bp, Homo sapiens
gtgctgggattacaggtgta

SEQ ID NO: 2471084 - DNA, 11 bp, Homo sapiens
gtgctgtgtgt

SEQ ID NO: 2471085 - DNA, 21 bp, Homo sapiens
gtgcttatgctcttaattgcc

SEQ ID NO: 2471086 - DNA, 18 bp, Homo sapiens
gtgcttgatagaaatgcc

SEQ ID NO: 2471087 - DNA, 23 bp, Homo sapiens
gtgcttttggcggggaggaggaa

SEQ ID NO: 2471088 - DNA, 16 bp, Homo sapiens
gtggaaaacttatgct

SEQ ID NO: 2471089 - DNA, 20 bp, Homo sapiens
gtggaaattaagactttatg

SEQ ID NO: 2471090 - DNA, 16 bp, Homo sapiens
gtggaacgaaaatgaa

SEQ ID NO: 2471091 - DNA, 15 bp, Homo sapiens
gtggaactgctgcca

SEQ ID NO: 2471092 - DNA, 16 bp, Homo sapiens
gtggactcagggcagc

SEQ ID NO: 2471093 - DNA, 12 bp, Homo sapiens
gtggactctggt

SEQ ID NO: 2471094 - DNA, 18 bp, Homo sapiens
gtggagagggaatgtgaa

SEQ ID NO: 2471095 - DNA, 14 bp, Homo sapiens
gtggaggaggaggg

SEQ ID NO: 2471096 - DNA, 17 bp, Homo sapiens
gtgtgttgatactgttg

SEQ ID NO: 2471097 - DNA, 16 bp, Homo sapiens
gtgtgtttgtgtgtgt

SEQ ID NO: 2471098 - DNA, 14 bp, Homo sapiens
gtgttaacagaagg

SEQ ID NO: 2471099 - DNA, 17 bp, Homo sapiens
gtgttaacattccaaga

SEQ ID NO: 2471100 - DNA, 16 bp, Homo sapiens
gtgttatcacctagct

SEQ ID NO: 2471101 - DNA, 20 bp, Homo sapiens
gtgttattttcattcaaagt

SEQ ID NO: 2471102 - DNA, 23 bp, Homo sapiens
gtgttattttgtttttccttcca

SEQ ID NO: 2471103 - DNA, 18 bp, Homo sapiens
gtgttccccttccactga

SEQ ID NO: 2471104 - DNA, 15 bp, Homo sapiens
gtgttccctatccaa

SEQ ID NO: 2471105 - DNA, 22 bp, Homo sapiens
gtgttctaagatgtgatattct

SEQ ID NO: 2471106 - DNA, 23 bp, Homo sapiens
gtgttctcctgctgctccctcag

SEQ ID NO: 2471107 - DNA, 19 bp, Homo sapiens
gtgttgagccttttccctc

SEQ ID NO: 2471108 - DNA, 15 bp, Homo sapiens
gtgttgatactgttg

SEQ ID NO: 2471109 - DNA, 18 bp, Homo sapiens
gtgttgatactgttgcac

SEQ ID NO: 2471110 - DNA, 21 bp, Homo sapiens
gtgttgatactgttgcacgtg

SEQ ID NO: 2471111 - DNA, 17 bp, Homo sapiens
gtgttgccaaatatgtc

SEQ ID NO: 2471112 - DNA, 20 bp, Homo sapiens
gtgttggacaagcttctgag

SEQ ID NO: 2471113 - DNA, 16 bp, Homo sapiens
gtgttgggtgtaccac

SEQ ID NO: 2471114 - DNA, 15 bp, Homo sapiens
gtgttgtctcttgag

SEQ ID NO: 2471115 - DNA, 21 bp, Homo sapiens
gtgtttaaagttcaacatgtt

SEQ ID NO: 2471116 - DNA, 15 bp, Homo sapiens
gtgtttatcctttca

SEQ ID NO: 2471117 - DNA, 17 bp, Homo sapiens
gtgtttatcctttcata

SEQ ID NO: 2471118 - DNA, 15 bp, Homo sapiens
gtgtttcttgcctca

SEQ ID NO: 2471119 - DNA, 14 bp, Homo sapiens
gtgtttgtgtgtgt

SEQ ID NO: 2471120 - DNA, 15 bp, Homo sapiens
gtgttttgaaagaat

SEQ ID NO: 2471121 - DNA, 21 bp, Homo sapiens
gtgttttgttcaccattataa

SEQ ID NO: 2471122 - DNA, 16 bp, Homo sapiens
gttaaatacaggaaac

SEQ ID NO: 2471123 - DNA, 20 bp, Homo sapiens
gttaaatacaggaaacagtt

SEQ ID NO: 2471124 - DNA, 21 bp, Homo sapiens
gttaacagaagggagggcaga

SEQ ID NO: 2471125 - DNA, 16 bp, Homo sapiens
gttaactgaataccac

SEQ ID NO: 2471126 - DNA, 15 bp, Homo sapiens
gttaagctctgctat

SEQ ID NO: 2471127 - DNA, 23 bp, Homo sapiens
gttaagttgagatagttttcatc

SEQ ID NO: 2471128 - DNA, 14 bp, Homo sapiens
gttaatagttcctg

SEQ ID NO: 2471129 - DNA, 18 bp, Homo sapiens
gttaatattgatttatta

SEQ ID NO: 2471130 - DNA, 21 bp, Homo sapiens
gttaatcttgctttctttgtt

SEQ ID NO: 2471131 - DNA, 14 bp, Homo sapiens
gttaatttttccaa

SEQ ID NO: 2471132 - DNA, 20 bp, Homo sapiens
gttaatttttccaactacta

SEQ ID NO: 2471133 - DNA, 21 bp, Homo sapiens
gttaccattaaaccatctccc

SEQ ID NO: 2471134 - DNA, 15 bp, Homo sapiens
gttaccttatagtta

SEQ ID NO: 2471135 - DNA, 13 bp, Homo sapiens
gttactgtaattc

SEQ ID NO: 2471136 - DNA, 14 bp, Homo sapiens
gttacttctgaggt

SEQ ID NO: 2471137 - DNA, 14 bp, Homo sapiens
gttagacctacagg

SEQ ID NO: 2471138 - DNA, 14 bp, Homo sapiens
gttagctcctgtgg

SEQ ID NO: 2471139 - DNA, 22 bp, Homo sapiens
gttagtcatttgctgagcatgt

SEQ ID NO: 2471140 - DNA, 16 bp, Homo sapiens
gttagttccactgaga

SEQ ID NO: 2471141 - DNA, 16 bp, Homo sapiens
gttagtttgtatatat

SEQ ID NO: 2471142 - DNA, 17 bp, Homo sapiens
gttagtttgtatatatt

SEQ ID NO: 2471143 - DNA, 16 bp, Homo sapiens
gttataaaaaatggtt

SEQ ID NO: 2471144 - DNA, 22 bp, Homo sapiens
gttataaaaaatggttcagaat

SEQ ID NO: 2471145 - DNA, 21 bp, Homo sapiens
gttatagtgaatactgctaca

SEQ ID NO: 2471146 - DNA, 12 bp, Homo sapiens
gttatataattt

SEQ ID NO: 2471147 - DNA, 22 bp, Homo sapiens
gttatatataaatatattatta

SEQ ID NO: 2471148 - DNA, 22 bp, Homo sapiens
gttatatatggggatggtagtt

SEQ ID NO: 2471149 - DNA, 19 bp, Homo sapiens
gttatattgaaaaaataga

SEQ ID NO: 2471150 - DNA, 13 bp, Homo sapiens
gttatcagtgctt

SEQ ID NO: 2471151 - DNA, 14 bp, Homo sapiens
gttatctctgtgtt

SEQ ID NO: 2471152 - DNA, 18 bp, Homo sapiens
gttatcttctcaagttct

SEQ ID NO: 2471153 - DNA, 19 bp, Homo sapiens
gttatcttctcaagttcta

SEQ ID NO: 2471154 - DNA, 22 bp, Homo sapiens
gttatcttctcaagttctaaga

SEQ ID NO: 2471155 - DNA, 22 bp, Homo sapiens
gttattagagattacctcctga

SEQ ID NO: 2471156 - DNA, 17 bp, Homo sapiens
gttattatctgggctta

SEQ ID NO: 2471157 - DNA, 23 bp, Homo sapiens
gttattgcagtttatcattcaag

SEQ ID NO: 2471158 - DNA, 16 bp, Homo sapiens
gttatttgtaatagat

SEQ ID NO: 2471159 - DNA, 17 bp, Homo sapiens
gttatttgtaatagatg

SEQ ID NO: 2471160 - DNA, 20 bp, Homo sapiens
gttattttgatgtaaagatg

SEQ ID NO: 2471161 - DNA, 12 bp, Homo sapiens
gttcaaagccag

SEQ ID NO: 2471162 - DNA, 13 bp, Homo sapiens
gttcaacaaagaa

SEQ ID NO: 2471163 - DNA, 18 bp, Homo sapiens
gttcaagcgattctcttg

SEQ ID NO: 2471164 - DNA, 14 bp, Homo sapiens
gttcagcactgtcc

SEQ ID NO: 2471165 - DNA, 19 bp, Homo sapiens
gttcaggcccggcagggcg

SEQ ID NO: 2471166 - DNA, 15 bp, Homo sapiens
gttcatgcagctgtg

SEQ ID NO: 2471167 - DNA, 16 bp, Homo sapiens
gttcatgcagctgtgg

SEQ ID NO: 2471168 - DNA, 16 bp, Homo sapiens
gttcattgcactttga

SEQ ID NO: 2471169 - DNA, 20 bp, Homo sapiens
gttccaaattcagtttcata

SEQ ID NO: 2471170 - DNA, 16 bp, Homo sapiens
gttccaagagtctaaa

SEQ ID NO: 2471171 - DNA, 20 bp, Homo sapiens
gttccaagagtctaaagatg

SEQ ID NO: 2471172 - DNA, 11 bp, Homo sapiens
gttccacagac

SEQ ID NO: 2471173 - DNA, 14 bp, Homo sapiens
gttccacagaggac

SEQ ID NO: 2471174 - DNA, 19 bp, Homo sapiens
gttcccaagctcagaggcg

SEQ ID NO: 2471175 - DNA, 18 bp, Homo sapiens
gttcccacattaaagaag

SEQ ID NO: 2471176 - DNA, 21 bp, Homo sapiens
gttcccacattaaagaagacc

SEQ ID NO: 2471177 - DNA, 13 bp, Homo sapiens
gttccccagagaa

SEQ ID NO: 2471178 - DNA, 14 bp, Homo sapiens
gttccccagagaaa

SEQ ID NO: 2471179 - DNA, 15 bp, Homo sapiens
gttccccttccactg

SEQ ID NO: 2471180 - DNA, 19 bp, Homo sapiens
gttcccgtttctccaccta

SEQ ID NO: 2471181 - DNA, 13 bp, Homo sapiens
gttccctcccaga

SEQ ID NO: 2471182 - DNA, 15 bp, Homo sapiens
gttccctctccctgt

SEQ ID NO: 2471183 - DNA, 15 bp, Homo sapiens
gttccggcatggaca

SEQ ID NO: 2471184 - DNA, 15 bp, Homo sapiens
gttcctgctgctgtc

SEQ ID NO: 2471185 - DNA, 17 bp, Homo sapiens
gttcctgctgctgtctg

SEQ ID NO: 2471186 - DNA, 22 bp, Homo sapiens
gttcctgctgctgtctgggtgc

SEQ ID NO: 2471187 - DNA, 14 bp, Homo sapiens
gttcctgtggctcc

SEQ ID NO: 2471188 - DNA, 12 bp, Homo sapiens
gttccttcccaa

SEQ ID NO: 2471189 - DNA, 15 bp, Homo sapiens
gttcgcagccaccct

SEQ ID NO: 2471190 - DNA, 17 bp, Homo sapiens
gttcgcagccaccctga

SEQ ID NO: 2471191 - DNA, 19 bp, Homo sapiens
gttcgcagccaccctgagg

SEQ ID NO: 2471192 - DNA, 12 bp, Homo sapiens
gttctaaagctc

SEQ ID NO: 2471193 - DNA, 16 bp, Homo sapiens
gttctaaagctctgac

SEQ ID NO: 2471194 - DNA, 17 bp, Homo sapiens
gttctaaagttctaaga

SEQ ID NO: 2471195 - DNA, 19 bp, Homo sapiens
gttctaaagttctaagatt

SEQ ID NO: 2471196 - DNA, 21 bp, Homo sapiens
gttctaaagttctaagattct

SEQ ID NO: 2471197 - DNA, 17 bp, Homo sapiens
gttctaagactcaaatg

SEQ ID NO: 2471198 - DNA, 21 bp, Homo sapiens
gttctaagactcaaatgttct

SEQ ID NO: 2471199 - DNA, 14 bp, Homo sapiens
gttctaagattcta

SEQ ID NO: 2471200 - DNA, 22 bp, Homo sapiens
gtttcaattccacctgcaatca

SEQ ID NO: 2471201 - DNA, 14 bp, Homo sapiens
gtttcacagaaaat

SEQ ID NO: 2471202 - DNA, 19 bp, Homo sapiens
gtttcacagtttgaaataa

SEQ ID NO: 2471203 - DNA, 20 bp, Homo sapiens
gtttcatttagtcatgtgac

SEQ ID NO: 2471204 - DNA, 16 bp, Homo sapiens
gtttccacagcctgca

SEQ ID NO: 2471205 - DNA, 18 bp, Homo sapiens
gtttccctactgaagccc

SEQ ID NO: 2471206 - DNA, 13 bp, Homo sapiens
gtttcctctgttc

SEQ ID NO: 2471207 - DNA, 23 bp, Homo sapiens
gtttcctctgttcaaagctgcct

SEQ ID NO: 2471208 - DNA, 15 bp, Homo sapiens
gtttctaagattcta

SEQ ID NO: 2471209 - DNA, 11 bp, Homo sapiens
gtttctaaggt

SEQ ID NO: 2471210 - DNA, 13 bp, Homo sapiens
gtttctgccctgc

SEQ ID NO: 2471211 - DNA, 14 bp, Homo sapiens
gtttctgttccaaa

SEQ ID NO: 2471212 - DNA, 15 bp, Homo sapiens
gtttctgttccaaat

SEQ ID NO: 2471213 - DNA, 17 bp, Homo sapiens
gtttcttaagggcacac

SEQ ID NO: 2471214 - DNA, 18 bp, Homo sapiens
gtttcttcctgccagcag

SEQ ID NO: 2471215 - DNA, 14 bp, Homo sapiens
gtttcttgcctcat

SEQ ID NO: 2471216 - DNA, 22 bp, Homo sapiens
gtttcttgcctcatttttttcc

SEQ ID NO: 2471217 - DNA, 20 bp, Homo sapiens
gtttctttctctgaggacaa

SEQ ID NO: 2471218 - DNA, 19 bp, Homo sapiens
gtttgatgaggccctccac

SEQ ID NO: 2471219 - DNA, 20 bp, Homo sapiens
gtttgatgaggccctccaca

SEQ ID NO: 2471220 - DNA, 15 bp, Homo sapiens
gtttgcacttcctct

SEQ ID NO: 2471221 - DNA, 22 bp, Homo sapiens
gtttgcaggtggccaagttcct

SEQ ID NO: 2471222 - DNA, 22 bp, Homo sapiens
gtttgcctccgtcccctgccca

SEQ ID NO: 2471223 - DNA, 20 bp, Homo sapiens
gtttgctttgcccttctttc

SEQ ID NO: 2471224 - DNA, 17 bp, Homo sapiens
gtttggagagagcagac

SEQ ID NO: 2471225 - DNA, 21 bp, Homo sapiens
gtttggagagagcagactggc

SEQ ID NO: 2471226 - DNA, 13 bp, Homo sapiens
gtttggctttcag

SEQ ID NO: 2471227 - DNA, 19 bp, Homo sapiens
gtttggggcagaaaggact

SEQ ID NO: 2471228 - DNA, 23 bp, Homo sapiens
gtttggggcaggagtagctgagc

SEQ ID NO: 2471229 - DNA, 19 bp, Homo sapiens
gtttgtgctgtaaagagtt

SEQ ID NO: 2471230 - DNA, 14 bp, Homo sapiens
gtttgtgtgtctta

SEQ ID NO: 2471231 - DNA, 18 bp, Homo sapiens
gtttgtttacaaaatcag

SEQ ID NO: 2471232 - DNA, 16 bp, Homo sapiens
gttttaactgtggata

SEQ ID NO: 2471233 - DNA, 13 bp, Homo sapiens
gttttaactttgt

SEQ ID NO: 2471234 - DNA, 21 bp, Homo sapiens
gttttaatttaaacacctcct

SEQ ID NO: 2471235 - DNA, 20 bp, Homo sapiens
gttttaatttagtaaaccaa

SEQ ID NO: 2471236 - DNA, 16 bp, Homo sapiens
gttttacaagttggag

SEQ ID NO: 2471237 - DNA, 13 bp, Homo sapiens
gttttaggttcta

SEQ ID NO: 2471238 - DNA, 17 bp, Homo sapiens
gttttaggttctaaagt

SEQ ID NO: 2471239 - DNA, 12 bp, Homo sapiens
gttttataagca

SEQ ID NO: 2471240 - DNA, 20 bp, Homo sapiens
gttttataagcatcattatt

SEQ ID NO: 2471241 - DNA, 14 bp, Homo sapiens
gttttcgaaaatca

SEQ ID NO: 2471242 - DNA, 18 bp, Homo sapiens
gttttctccaagagctac

SEQ ID NO: 2471243 - DNA, 17 bp, Homo sapiens
gttttcttttgccatga

SEQ ID NO: 2471244 - DNA, 18 bp, Homo sapiens
gttttgaagctactgtgt

SEQ ID NO: 2471245 - DNA, 21 bp, Homo sapiens
gttttgaaggcaaaattgcaa

SEQ ID NO: 2471246 - DNA, 22 bp, Homo sapiens
gttttgccccaagtcctcattt

SEQ ID NO: 2471247 - DNA, 21 bp, Homo sapiens
gttttgttcaccattataatg

SEQ ID NO: 2471248 - DNA, 17 bp, Homo sapiens
gttttgttgacattctg

SEQ ID NO: 2471249 - DNA, 14 bp, Homo sapiens
gttttgtttacaga

SEQ ID NO: 2471250 - DNA, 15 bp, Homo sapiens
gttttgtttttacaa

SEQ ID NO: 2471251 - DNA, 13 bp, Homo sapiens
gtttttaaactgt

SEQ ID NO: 2471252 - DNA, 16 bp, Homo sapiens
gtttttaaactgtaca

SEQ ID NO: 2471253 - DNA, 12 bp, Homo sapiens
gtttttaatgta

SEQ ID NO: 2471254 - DNA, 14 bp, Homo sapiens
gtttttactgctct

SEQ ID NO: 2471255 - DNA, 18 bp, Homo sapiens
gtttttcctttttttgta

SEQ ID NO: 2471256 - DNA, 12 bp, Homo sapiens
gtttttctatta

SEQ ID NO: 2471257 - DNA, 20 bp, Homo sapiens
gtttttggtcttttataatt

SEQ ID NO: 2471258 - DNA, 15 bp, Homo sapiens
gtttttgttcaaagc

SEQ ID NO: 2471259 - DNA, 22 bp, Homo sapiens
gttttttcatcttcagttgtct

SEQ ID NO: 2471260 - DNA, 14 bp, Homo sapiens
gttttttgccacag

SEQ ID NO: 2471261 - DNA, 12 bp, Homo sapiens
gtttttttctat

SEQ ID NO: 2471262 - DNA, 15 bp, Homo sapiens
taaaaaaataagaag

SEQ ID NO: 2471263 - DNA, 17 bp, Homo sapiens
taaaaaagatcccaaat

SEQ ID NO: 2471264 - DNA, 18 bp, Homo sapiens
taaaaaagcttaaaactt

SEQ ID NO: 2471265 - DNA, 20 bp, Homo sapiens
taaaaaagcttaaaactttg

SEQ ID NO: 2471266 - DNA, 14 bp, Homo sapiens
taaaaactcaagga

SEQ ID NO: 2471267 - DNA, 13 bp, Homo sapiens
taaaaagaaaggc

SEQ ID NO: 2471268 - DNA, 15 bp, Homo sapiens
taaaaagaagtgctg

SEQ ID NO: 2471269 - DNA, 15 bp, Homo sapiens
taaaaataagtcaac

SEQ ID NO: 2471270 - DNA, 16 bp, Homo sapiens
taaaaataagtcaaca

SEQ ID NO: 2471271 - DNA, 15 bp, Homo sapiens
taaaaatgatctaaa

SEQ ID NO: 2471272 - DNA, 23 bp, Homo sapiens
taaaaattaaattggaaagcagg

SEQ ID NO: 2471273 - DNA, 22 bp, Homo sapiens
taaaaattgttaatttttccta

SEQ ID NO: 2471274 - DNA, 21 bp, Homo sapiens
taaaacaggtagaattatcta

SEQ ID NO: 2471275 - DNA, 22 bp, Homo sapiens
taaaacaggtagaattatctaa

SEQ ID NO: 2471276 - DNA, 17 bp, Homo sapiens
taaaacatcattactat

SEQ ID NO: 2471277 - DNA, 15 bp, Homo sapiens
taaaacattaaaata

SEQ ID NO: 2471278 - DNA, 19 bp, Homo sapiens
taaaacattaaaatataat

SEQ ID NO: 2471279 - DNA, 12 bp, Homo sapiens
taaaacattaat

SEQ ID NO: 2471280 - DNA, 21 bp, Homo sapiens
taaaaccatgtagaaaatttg

SEQ ID NO: 2471281 - DNA, 17 bp, Homo sapiens
taaaacccgttgattac

SEQ ID NO: 2471282 - DNA, 21 bp, Homo sapiens
taaaactttgaagttagcttt

SEQ ID NO: 2471283 - DNA, 14 bp, Homo sapiens
taaaactttgctgc

SEQ ID NO: 2471284 - DNA, 16 bp, Homo sapiens
taaaactttgctgcca

SEQ ID NO: 2471285 - DNA, 14 bp, Homo sapiens
taaaagaaactttc

SEQ ID NO: 2471286 - DNA, 14 bp, Homo sapiens
taaaagactcatcc

SEQ ID NO: 2471287 - DNA, 12 bp, Homo sapiens
taaaagatgctt

SEQ ID NO: 2471288 - DNA, 15 bp, Homo sapiens
taaaagatgctttta

SEQ ID NO: 2471289 - DNA, 19 bp, Homo sapiens
taaaagcaaaaaagaaaac

SEQ ID NO: 2471290 - DNA, 15 bp, Homo sapiens
taaaagcaaatcatt

SEQ ID NO: 2471291 - DNA, 20 bp, Homo sapiens
taaaagcaaatcatttgttt

SEQ ID NO: 2471292 - DNA, 14 bp, Homo sapiens
taaaaggaagccaa

SEQ ID NO: 2471293 - DNA, 19 bp, Homo sapiens
taaaaggaagccaaagagt

SEQ ID NO: 2471294 - DNA, 22 bp, Homo sapiens
taaaagttttttattatgcatt

SEQ ID NO: 2471295 - DNA, 21 bp, Homo sapiens
taaaataattttgtaatgtat

SEQ ID NO: 2471296 - DNA, 16 bp, Homo sapiens
taaaatagcaaaagaa

SEQ ID NO: 2471297 - DNA, 21 bp, Homo sapiens
taaaatagcaaaagaagaagt

SEQ ID NO: 2471298 - DNA, 20 bp, Homo sapiens
taaaatagcgttcttgtaat

SEQ ID NO: 2471299 - DNA, 16 bp, Homo sapiens
taaaatattttgaatc

SEQ ID NO: 2471300 - DNA, 20 bp, Homo sapiens
taaaatcagctattttgtga

SEQ ID NO: 2471301 - DNA, 13 bp, Homo sapiens
taaaatctgtcac

SEQ ID NO: 2471302 - DNA, 13 bp, Homo sapiens
taaaatcttatag

SEQ ID NO: 2471303 - DNA, 21 bp, Homo sapiens
taaaatcttgtcatgtgtata

SEQ ID NO: 2471304 - DNA, 19 bp, Homo sapiens
taacaacatgtttccagca

SEQ ID NO: 2471305 - DNA, 20 bp, Homo sapiens
taacaacatgtttccagcat

SEQ ID NO: 2471306 - DNA, 14 bp, Homo sapiens
taacaatacaaatg

SEQ ID NO: 2471307 - DNA, 20 bp, Homo sapiens
taacaattaggcagactctt

SEQ ID NO: 2471308 - DNA, 14 bp, Homo sapiens
taacaattgtgtag

SEQ ID NO: 2471309 - DNA, 20 bp, Homo sapiens
taacaattgtgtagcctttt

SEQ ID NO: 2471310 - DNA, 23 bp, Homo sapiens
taacaattgtgtagcctttttgt

SEQ ID NO: 2471311 - DNA, 21 bp, Homo sapiens
taacacactaccgaatgtgtc

SEQ ID NO: 2471312 - DNA, 23 bp, Homo sapiens
taacacactaccgaatgtgtctt

SEQ ID NO: 2471313 - DNA, 21 bp, Homo sapiens
taacacagcattgtatatgtg

SEQ ID NO: 2471314 - DNA, 13 bp, Homo sapiens
taacactaatata

SEQ ID NO: 2471315 - DNA, 16 bp, Homo sapiens
taacactaatatattt

SEQ ID NO: 2471316 - DNA, 14 bp, Homo sapiens
taacactcagaagc

SEQ ID NO: 2471317 - DNA, 15 bp, Homo sapiens
taacagaaattgtat

SEQ ID NO: 2471318 - DNA, 22 bp, Homo sapiens
taacagaaattgtatattgtaa

SEQ ID NO: 2471319 - DNA, 21 bp, Homo sapiens
taacaggctcaaacaatgaca

SEQ ID NO: 2471320 - DNA, 17 bp, Homo sapiens
taacagggaaggcaggc

SEQ ID NO: 2471321 - DNA, 19 bp, Homo sapiens
taacagggaaggcaggcag

SEQ ID NO: 2471322 - DNA, 14 bp, Homo sapiens
taacatctaaaaat

SEQ ID NO: 2471323 - DNA, 13 bp, Homo sapiens
taacattccaaga

SEQ ID NO: 2471324 - DNA, 20 bp, Homo sapiens
taacattcctcatgaatgta

SEQ ID NO: 2471325 - DNA, 14 bp, Homo sapiens
taacatttgctgtt

SEQ ID NO: 2471326 - DNA, 22 bp, Homo sapiens
taacatttgctgttttaaacat

SEQ ID NO: 2471327 - DNA, 20 bp, Homo sapiens
taaccaagctgagtttccta

SEQ ID NO: 2471328 - DNA, 19 bp, Homo sapiens
taaccatgtgttatgtttt

SEQ ID NO: 2471329 - DNA, 17 bp, Homo sapiens
taaccctttgtgtgctc

SEQ ID NO: 2471330 - DNA, 22 bp, Homo sapiens
taaccgagatcagtatttaact

SEQ ID NO: 2471331 - DNA, 18 bp, Homo sapiens
taacctcatcttcttcac

SEQ ID NO: 2471332 - DNA, 21 bp, Homo sapiens
taaccttgcctggtacagtat

SEQ ID NO: 2471333 - DNA, 17 bp, Homo sapiens
taacgcaagttcccagt

SEQ ID NO: 2471334 - DNA, 19 bp, Homo sapiens
taacgcctgagcccaggga

SEQ ID NO: 2471335 - DNA, 15 bp, Homo sapiens
taacgcgtcttcctg

SEQ ID NO: 2471336 - DNA, 16 bp, Homo sapiens
taacgcgtcttcctga

SEQ ID NO: 2471337 - DNA, 19 bp, Homo sapiens
taactaaaataattttgta

SEQ ID NO: 2471338 - DNA, 23 bp, Homo sapiens
taactacaaaggtttaaatgaac

SEQ ID NO: 2471339 - DNA, 13 bp, Homo sapiens
taactactttata

SEQ ID NO: 2471340 - DNA, 15 bp, Homo sapiens
taactcctcccaggg

SEQ ID NO: 2471341 - DNA, 23 bp, Homo sapiens
taactgaacatccaaaatcttga

SEQ ID NO: 2471342 - DNA, 16 bp, Homo sapiens
taactgaataccactc

SEQ ID NO: 2471343 - DNA, 21 bp, Homo sapiens
taactgactattcttgatgta

SEQ ID NO: 2471344 - DNA, 14 bp, Homo sapiens
taactgcatacact

SEQ ID NO: 2471345 - DNA, 11 bp, Homo sapiens
taactgccagg

SEQ ID NO: 2471346 - DNA, 21 bp, Homo sapiens
taactgctttctgttccaaat

SEQ ID NO: 2471347 - DNA, 13 bp, Homo sapiens
taactggaaagaa

SEQ ID NO: 2471348 - DNA, 15 bp, Homo sapiens
taactggaaagaagt

SEQ ID NO: 2471349 - DNA, 17 bp, Homo sapiens
taactgggtaatgaaac

SEQ ID NO: 2471350 - DNA, 19 bp, Homo sapiens
taactgggtaatgaaacaa

SEQ ID NO: 2471351 - DNA, 23 bp, Homo sapiens
taactgtaaagatgtttatttca

SEQ ID NO: 2471352 - DNA, 18 bp, Homo sapiens
taactgtaaatgtgacat

SEQ ID NO: 2471353 - DNA, 12 bp, Homo sapiens
taactgtatttg

SEQ ID NO: 2471354 - DNA, 14 bp, Homo sapiens
taactgtatttgaa

SEQ ID NO: 2471355 - DNA, 14 bp, Homo sapiens
taacttaaatagta

SEQ ID NO: 2471356 - DNA, 20 bp, Homo sapiens
taacttccacagggtcccac

SEQ ID NO: 2471357 - DNA, 23 bp, Homo sapiens
taacttcttatggaattgatttg

SEQ ID NO: 2471358 - DNA, 15 bp, Homo sapiens
taacttcttgcttct

SEQ ID NO: 2471359 - DNA, 20 bp, Homo sapiens
taacttcttgcttctttcta

SEQ ID NO: 2471360 - DNA, 19 bp, Homo sapiens
taacttgatccatttctaa

SEQ ID NO: 2471361 - DNA, 20 bp, Homo sapiens
taacttgatccatttctaat

SEQ ID NO: 2471362 - DNA, 22 bp, Homo sapiens
taacttgatccatttctaatta

SEQ ID NO: 2471363 - DNA, 13 bp, Homo sapiens
taactttctgggt

SEQ ID NO: 2471364 - DNA, 16 bp, Homo sapiens
taacttttgtgaatta

SEQ ID NO: 2471365 - DNA, 20 bp, Homo sapiens
taagaaacaactctttgaga

SEQ ID NO: 2471366 - DNA, 21 bp, Homo sapiens
taagaaacttttttatttaaa

SEQ ID NO: 2471367 - DNA, 13 bp, Homo sapiens
taagaaagcctga

SEQ ID NO: 2471368 - DNA, 18 bp, Homo sapiens
taagaaaggaagcattgt

SEQ ID NO: 2471369 - DNA, 20 bp, Homo sapiens
taagaaaggaagcattgtaa

SEQ ID NO: 2471370 - DNA, 15 bp, Homo sapiens
taagaaattgaatac

SEQ ID NO: 2471371 - DNA, 17 bp, Homo sapiens
taagaaattgaatactt

SEQ ID NO: 2471372 - DNA, 23 bp, Homo sapiens
taagaagccttaatttgcacagt

SEQ ID NO: 2471373 - DNA, 17 bp, Homo sapiens
taagaaggcaaaaatgt

SEQ ID NO: 2471374 - DNA, 15 bp, Homo sapiens
taagaagttttaaaa

SEQ ID NO: 2471375 - DNA, 21 bp, Homo sapiens
taagaagttttaaaaagccag

SEQ ID NO: 2471376 - DNA, 21 bp, Homo sapiens
taagaatctagcaagaattga

SEQ ID NO: 2471377 - DNA, 12 bp, Homo sapiens
taagaattattt

SEQ ID NO: 2471378 - DNA, 17 bp, Homo sapiens
taagaattattttgatg

SEQ ID NO: 2471379 - DNA, 16 bp, Homo sapiens
taagaattcagacatc

SEQ ID NO: 2471380 - DNA, 18 bp, Homo sapiens
taagaattgagtaatggt

SEQ ID NO: 2471381 - DNA, 19 bp, Homo sapiens
taagacatgatttccttga

SEQ ID NO: 2471382 - DNA, 14 bp, Homo sapiens
taagacctactgtt

SEQ ID NO: 2471383 - DNA, 20 bp, Homo sapiens
taagacctactgttctaaag

SEQ ID NO: 2471384 - DNA, 22 bp, Homo sapiens
taagacctactgttctaaagct

SEQ ID NO: 2471385 - DNA, 20 bp, Homo sapiens
taagacttactctaagatct

SEQ ID NO: 2471386 - DNA, 18 bp, Homo sapiens
taagagaagtagaaatca

SEQ ID NO: 2471387 - DNA, 15 bp, Homo sapiens
taagagaagttgtaa

SEQ ID NO: 2471388 - DNA, 15 bp, Homo sapiens
taagagctcaggatg

SEQ ID NO: 2471389 - DNA, 17 bp, Homo sapiens
taagaggctgccctcct

SEQ ID NO: 2471390 - DNA, 18 bp, Homo sapiens
taagagtccaagaatcca

SEQ ID NO: 2471391 - DNA, 18 bp, Homo sapiens
taagattatagattctaa

SEQ ID NO: 2471392 - DNA, 13 bp, Homo sapiens
taagattctaaag

SEQ ID NO: 2471393 - DNA, 16 bp, Homo sapiens
taagattctaaaggtc

SEQ ID NO: 2471394 - DNA, 12 bp, Homo sapiens
taagattctaga

SEQ ID NO: 2471395 - DNA, 17 bp, Homo sapiens
taagattctgattttag

SEQ ID NO: 2471396 - DNA, 16 bp, Homo sapiens
taagcagaaagtgcct

SEQ ID NO: 2471397 - DNA, 19 bp, Homo sapiens
taagcagaaagtgcctttc

SEQ ID NO: 2471398 - DNA, 17 bp, Homo sapiens
taagcagaccactgata

SEQ ID NO: 2471399 - DNA, 20 bp, Homo sapiens
taagcatcattatttatgta

SEQ ID NO: 2471400 - DNA, 22 bp, Homo sapiens
taagcattgaatggctatgttt

SEQ ID NO: 2471401 - DNA, 16 bp, Homo sapiens
taagccaaaacaatgt

SEQ ID NO: 2471402 - DNA, 19 bp, Homo sapiens
taagccacttaaaatgttc

SEQ ID NO: 2471403 - DNA, 17 bp, Homo sapiens
taagccagcaccggacc

SEQ ID NO: 2471404 - DNA, 18 bp, Homo sapiens
taagctatttgatgtaat

SEQ ID NO: 2471405 - DNA, 16 bp, Homo sapiens
taagctatttttctaa

SEQ ID NO: 2471406 - DNA, 16 bp, Homo sapiens
taagcttttcttttct

SEQ ID NO: 2471407 - DNA, 13 bp, Homo sapiens
taattgcttattt

SEQ ID NO: 2471408 - DNA, 22 bp, Homo sapiens
taattgcttatttattgtattc

SEQ ID NO: 2471409 - DNA, 15 bp, Homo sapiens
taattggatttccta

SEQ ID NO: 2471410 - DNA, 17 bp, Homo sapiens
taattggatttcctaat

SEQ ID NO: 2471411 - DNA, 22 bp, Homo sapiens
taattgtaaagtaaaagctata

SEQ ID NO: 2471412 - DNA, 18 bp, Homo sapiens
taattgtactaaagccaa

SEQ ID NO: 2471413 - DNA, 14 bp, Homo sapiens
taattgtgtggatt

SEQ ID NO: 2471414 - DNA, 16 bp, Homo sapiens
taattgttctcagaat

SEQ ID NO: 2471415 - DNA, 19 bp, Homo sapiens
taattgttgttctgttaac

SEQ ID NO: 2471416 - DNA, 11 bp, Homo sapiens
taatttaaaca

SEQ ID NO: 2471417 - DNA, 19 bp, Homo sapiens
taatttaaacacctcctca

SEQ ID NO: 2471418 - DNA, 21 bp, Homo sapiens
taatttacaaaaatataaaat

SEQ ID NO: 2471419 - DNA, 16 bp, Homo sapiens
taatttagtttcatat

SEQ ID NO: 2471420 - DNA, 17 bp, Homo sapiens
taatttagtttcatata

SEQ ID NO: 2471421 - DNA, 13 bp, Homo sapiens
taatttataaaaa

SEQ ID NO: 2471422 - DNA, 14 bp, Homo sapiens
taatttatgcagaa

SEQ ID NO: 2471423 - DNA, 12 bp, Homo sapiens
taatttcaaaat

SEQ ID NO: 2471424 - DNA, 20 bp, Homo sapiens
taatttcaaaatgcttttta

SEQ ID NO: 2471425 - DNA, 16 bp, Homo sapiens
taatttgcattaaatt

SEQ ID NO: 2471426 - DNA, 13 bp, Homo sapiens
taattttaaattc

SEQ ID NO: 2471427 - DNA, 18 bp, Homo sapiens
taattttacacgcttttg

SEQ ID NO: 2471428 - DNA, 16 bp, Homo sapiens
taattttagtttttca

SEQ ID NO: 2471429 - DNA, 19 bp, Homo sapiens
taattttagtttttcatta

SEQ ID NO: 2471430 - DNA, 13 bp, Homo sapiens
taattttgtgtaa

SEQ ID NO: 2471431 - DNA, 20 bp, Homo sapiens
taattttgtgtaagaaatac

SEQ ID NO: 2471432 - DNA, 16 bp, Homo sapiens
taatttttacagaatt

SEQ ID NO: 2471433 - DNA, 17 bp, Homo sapiens
taatttttacagaattg

SEQ ID NO: 2471434 - DNA, 18 bp, Homo sapiens
taatttttatttcttcct

SEQ ID NO: 2471435 - DNA, 13 bp, Homo sapiens
taatttttccaac

SEQ ID NO: 2471436 - DNA, 14 bp, Homo sapiens
taatttttccaact

SEQ ID NO: 2471437 - DNA, 20 bp, Homo sapiens
taatttttgatactaagcat

SEQ ID NO: 2471438 - DNA, 20 bp, Homo sapiens
tacaaaaatataaaatatga

SEQ ID NO: 2471439 - DNA, 22 bp, Homo sapiens
tacaaaacaaactcattcatta

SEQ ID NO: 2471440 - DNA, 17 bp, Homo sapiens
tacaaatcagaagtcat

SEQ ID NO: 2471441 - DNA, 20 bp, Homo sapiens
tacaaatcagaagtcatctt

SEQ ID NO: 2471442 - DNA, 12 bp, Homo sapiens
tacaaatgaaaa

SEQ ID NO: 2471443 - DNA, 20 bp, Homo sapiens
tacaagactgccatattaaa

SEQ ID NO: 2471444 - DNA, 19 bp, Homo sapiens
tacaagtatttttaattaa

SEQ ID NO: 2471445 - DNA, 18 bp, Homo sapiens
tacaattaaaaaaaaaga

SEQ ID NO: 2471446 - DNA, 15 bp, Homo sapiens
tacaattaattatct

SEQ ID NO: 2471447 - DNA, 21 bp, Homo sapiens
tacaattaattatcttttcaa

SEQ ID NO: 2471448 - DNA, 23 bp, Homo sapiens
tacaattaattatcttttcaaag

SEQ ID NO: 2471449 - DNA, 21 bp, Homo sapiens
tacaattcattgtgttacctg

SEQ ID NO: 2471450 - DNA, 16 bp, Homo sapiens
tacacaatagaattat

SEQ ID NO: 2471451 - DNA, 18 bp, Homo sapiens
tacacaatagaattataa

SEQ ID NO: 2471452 - DNA, 16 bp, Homo sapiens
tacacacggtgccttt

SEQ ID NO: 2471453 - DNA, 13 bp, Homo sapiens
tacacagtcagct

SEQ ID NO: 2471454 - DNA, 20 bp, Homo sapiens
tacaccactctggcagccac

SEQ ID NO: 2471455 - DNA, 16 bp, Homo sapiens
tacacccttttccagc

SEQ ID NO: 2471456 - DNA, 16 bp, Homo sapiens
tacacctattatccca

SEQ ID NO: 2471457 - DNA, 19 bp, Homo sapiens
tacactcgtatgatacttc

SEQ ID NO: 2471458 - DNA, 15 bp, Homo sapiens
tacactctgctgttt

SEQ ID NO: 2471459 - DNA, 16 bp, Homo sapiens
tacactctttgtaaga

SEQ ID NO: 2471460 - DNA, 17 bp, Homo sapiens
tacactgtgtaaatacc

SEQ ID NO: 2471461 - DNA, 20 bp, Homo sapiens
tacagaaaaaccttgggtta

SEQ ID NO: 2471462 - DNA, 20 bp, Homo sapiens
tacagaaatttaattcagaa

SEQ ID NO: 2471463 - DNA, 19 bp, Homo sapiens
tacagaactctttcaaaac

SEQ ID NO: 2471464 - DNA, 15 bp, Homo sapiens
tacagaacttcagaa

SEQ ID NO: 2471465 - DNA, 15 bp, Homo sapiens
tacagaattactgta

SEQ ID NO: 2471466 - DNA, 23 bp, Homo sapiens
tacagaattactgtaactgatta

SEQ ID NO: 2471467 - DNA, 17 bp, Homo sapiens
tacagacgctgctgtca

SEQ ID NO: 2471468 - DNA, 19 bp, Homo sapiens
tacagactggatgtaccac

SEQ ID NO: 2471469 - DNA, 15 bp, Homo sapiens
tacagagaaaccagc

SEQ ID NO: 2471470 - DNA, 17 bp, Homo sapiens
tacagagaaaccagctt

SEQ ID NO: 2471471 - DNA, 17 bp, Homo sapiens
tacagagaagccagctt

SEQ ID NO: 2471472 - DNA, 20 bp, Homo sapiens
tacagagaagccagcttgtt

SEQ ID NO: 2471473 - DNA, 21 bp, Homo sapiens
tacagagaagccagcttgttt

SEQ ID NO: 2471474 - DNA, 15 bp, Homo sapiens
tacagagaagccatc

SEQ ID NO: 2471475 - DNA, 14 bp, Homo sapiens
tacagagaagcctt

SEQ ID NO: 2471476 - DNA, 16 bp, Homo sapiens
tacagagaagccttca

SEQ ID NO: 2471477 - DNA, 15 bp, Homo sapiens
tacagcctcagaaac

SEQ ID NO: 2471478 - DNA, 15 bp, Homo sapiens
tacagctggggtgca

SEQ ID NO: 2471479 - DNA, 18 bp, Homo sapiens
tacagggggtctggctgg

SEQ ID NO: 2471480 - DNA, 22 bp, Homo sapiens
tacagggggtctggctggtgtt

SEQ ID NO: 2471481 - DNA, 18 bp, Homo sapiens
tacagtaggagcccagct

SEQ ID NO: 2471482 - DNA, 21 bp, Homo sapiens
tacagtatgggggttgtaaat

SEQ ID NO: 2471483 - DNA, 15 bp, Homo sapiens
tacagtctaaagctg

SEQ ID NO: 2471484 - DNA, 14 bp, Homo sapiens
tacagtgtcttttt

SEQ ID NO: 2471485 - DNA, 13 bp, Homo sapiens
tacagttctgctc

SEQ ID NO: 2471486 - DNA, 14 bp, Homo sapiens
tacagttttaactg

SEQ ID NO: 2471487 - DNA, 20 bp, Homo sapiens
tacagttttaactgtggata

SEQ ID NO: 2471488 - DNA, 17 bp, Homo sapiens
tacataattcactctga

SEQ ID NO: 2471489 - DNA, 21 bp, Homo sapiens
tacatagggatatgcgtatta

SEQ ID NO: 2471490 - DNA, 21 bp, Homo sapiens
tacatagtgctgctgtgtgct

SEQ ID NO: 2471491 - DNA, 17 bp, Homo sapiens
tacatatgatctgtctg

SEQ ID NO: 2471492 - DNA, 13 bp, Homo sapiens
tacatcatttctt

SEQ ID NO: 2471493 - DNA, 20 bp, Homo sapiens
tacatcatttctttttggga

SEQ ID NO: 2471494 - DNA, 20 bp, Homo sapiens
tacatccaaagcagacagct

SEQ ID NO: 2471495 - DNA, 22 bp, Homo sapiens
tacatctattttggattgtata

SEQ ID NO: 2471496 - DNA, 23 bp, Homo sapiens
tacatctattttggattgtatat

SEQ ID NO: 2471497 - DNA, 21 bp, Homo sapiens
tacatgaggactctattcttt

SEQ ID NO: 2471498 - DNA, 22 bp, Homo sapiens
tacatgaggactctattcttta

SEQ ID NO: 2471499 - DNA, 22 bp, Homo sapiens
tacatgcattgagctctctcat

SEQ ID NO: 2471500 - DNA, 19 bp, Homo sapiens
tacatgctaagagaagtag

SEQ ID NO: 2471501 - DNA, 17 bp, Homo sapiens
tacatgcttattccatg

SEQ ID NO: 2471502 - DNA, 21 bp, Homo sapiens
tacatgcttattccatgactg

SEQ ID NO: 2471503 - DNA, 17 bp, Homo sapiens
tacatggtgctgggaga

SEQ ID NO: 2471504 - DNA, 19 bp, Homo sapiens
tacatgtattgcacattgt

SEQ ID NO: 2471505 - DNA, 14 bp, Homo sapiens
tacattccaactcg

SEQ ID NO: 2471506 - DNA, 20 bp, Homo sapiens
tacattttctaagaaacatt

SEQ ID NO: 2471507 - DNA, 17 bp, Homo sapiens
taccaaagatgaatgaa

SEQ ID NO: 2471508 - DNA, 22 bp, Homo sapiens
taccaatcattttaattattat

SEQ ID NO: 2471509 - DNA, 18 bp, Homo sapiens
taccaccagctgtgtcca

SEQ ID NO: 2471510 - DNA, 15 bp, Homo sapiens
taccactctgtaatt

SEQ ID NO: 2471511 - DNA, 17 bp, Homo sapiens
tactgttctgtgtcttt

SEQ ID NO: 2471512 - DNA, 15 bp, Homo sapiens
tactgttgcacgtgt

SEQ ID NO: 2471513 - DNA, 17 bp, Homo sapiens
tacttcaaaagtttgtt

SEQ ID NO: 2471514 - DNA, 20 bp, Homo sapiens
tacttcggggctgggaagtc

SEQ ID NO: 2471515 - DNA, 22 bp, Homo sapiens
tacttctgtaattgtgtggatt

SEQ ID NO: 2471516 - DNA, 14 bp, Homo sapiens
tacttcttgaaggt

SEQ ID NO: 2471517 - DNA, 19 bp, Homo sapiens
tacttgaacgttttctaat

SEQ ID NO: 2471518 - DNA, 16 bp, Homo sapiens
tacttgaagggccaga

SEQ ID NO: 2471519 - DNA, 23 bp, Homo sapiens
tacttgccttattagagtgtctt

SEQ ID NO: 2471520 - DNA, 17 bp, Homo sapiens
tacttgctcaggtactt

SEQ ID NO: 2471521 - DNA, 14 bp, Homo sapiens
tacttggatttagt

SEQ ID NO: 2471522 - DNA, 13 bp, Homo sapiens
tacttgtaaatat

SEQ ID NO: 2471523 - DNA, 15 bp, Homo sapiens
tacttgtaattatgg

SEQ ID NO: 2471524 - DNA, 17 bp, Homo sapiens
tactttagaagcctgca

SEQ ID NO: 2471525 - DNA, 18 bp, Homo sapiens
tactttccctaccctcta

SEQ ID NO: 2471526 - DNA, 18 bp, Homo sapiens
tactttgaatgtgtttca

SEQ ID NO: 2471527 - DNA, 20 bp, Homo sapiens
tactttggggctaatttaac

SEQ ID NO: 2471528 - DNA, 16 bp, Homo sapiens
tagaaaaacaggcact

SEQ ID NO: 2471529 - DNA, 15 bp, Homo sapiens
tagaaaactttaaag

SEQ ID NO: 2471530 - DNA, 16 bp, Homo sapiens
tagaaacaaaatacaa

SEQ ID NO: 2471531 - DNA, 17 bp, Homo sapiens
tagaaacaaaatacaat

SEQ ID NO: 2471532 - DNA, 17 bp, Homo sapiens
tagaaacaacactgtag

SEQ ID NO: 2471533 - DNA, 19 bp, Homo sapiens
tagaaacaacactgtagta

SEQ ID NO: 2471534 - DNA, 16 bp, Homo sapiens
tagaaatattttaaaa

SEQ ID NO: 2471535 - DNA, 19 bp, Homo sapiens
tagaaatattttaaaatca

SEQ ID NO: 2471536 - DNA, 16 bp, Homo sapiens
tagaaattacctgtgg

SEQ ID NO: 2471537 - DNA, 18 bp, Homo sapiens
tagaacactaattcataa

SEQ ID NO: 2471538 - DNA, 22 bp, Homo sapiens
tagaacagggaaaataggcagg

SEQ ID NO: 2471539 - DNA, 22 bp, Homo sapiens
tagaaccctctgttccttccct

SEQ ID NO: 2471540 - DNA, 23 bp, Homo sapiens
tagaactcaacctctacagggtt

SEQ ID NO: 2471541 - DNA, 18 bp, Homo sapiens
tagaaggctgtggtgagg

SEQ ID NO: 2471542 - DNA, 16 bp, Homo sapiens
tagaagtataaagaat

SEQ ID NO: 2471543 - DNA, 19 bp, Homo sapiens
tagaataaaggcagttttc

SEQ ID NO: 2471544 - DNA, 21 bp, Homo sapiens
tagaatcaaacattttgaaag

SEQ ID NO: 2471545 - DNA, 21 bp, Homo sapiens
tagaatcccagccccctgacc

SEQ ID NO: 2471546 - DNA, 22 bp, Homo sapiens
tagaatctgcaattcaaaagtt

SEQ ID NO: 2471547 - DNA, 19 bp, Homo sapiens
tagaattgagtgtttaaag

SEQ ID NO: 2471548 - DNA, 20 bp, Homo sapiens
tagacaaatagaaaatggtc

SEQ ID NO: 2471549 - DNA, 19 bp, Homo sapiens
tagacacatgaaggtaaat

SEQ ID NO: 2471550 - DNA, 14 bp, Homo sapiens
tagacaccaaagtt

SEQ ID NO: 2471551 - DNA, 17 bp, Homo sapiens
tagacaccaaagttcta

SEQ ID NO: 2471552 - DNA, 21 bp, Homo sapiens
tagacaccaaagttctaataa

SEQ ID NO: 2471553 - DNA, 15 bp, Homo sapiens
tagacagaggccctc

SEQ ID NO: 2471554 - DNA, 21 bp, Homo sapiens
tagacatggaggttctaaggc

SEQ ID NO: 2471555 - DNA, 23 bp, Homo sapiens
tagacatggaggttctaaggcct

SEQ ID NO: 2471556 - DNA, 12 bp, Homo sapiens
tagaccaataaa

SEQ ID NO: 2471557 - DNA, 15 bp, Homo sapiens
tagacctacaggggg

SEQ ID NO: 2471558 - DNA, 23 bp, Homo sapiens
tagacggagccctggcatgtcaa

SEQ ID NO: 2471559 - DNA, 23 bp, Homo sapiens
tagactaaggccattattgtact

SEQ ID NO: 2471560 - DNA, 16 bp, Homo sapiens
tagacttggattcttt

SEQ ID NO: 2471561 - DNA, 14 bp, Homo sapiens
tagagactggaaca

SEQ ID NO: 2471562 - DNA, 19 bp, Homo sapiens
tagagattacctcctgaga

SEQ ID NO: 2471563 - DNA, 14 bp, Homo sapiens
tagagcactgccac

SEQ ID NO: 2471564 - DNA, 17 bp, Homo sapiens
tagagcagactacagct

SEQ ID NO: 2471565 - DNA, 13 bp, Homo sapiens
tagagctcctccc

SEQ ID NO: 2471566 - DNA, 23 bp, Homo sapiens
tagaggcaggtagggggtccctc

SEQ ID NO: 2471567 - DNA, 13 bp, Homo sapiens
tagagtccaaggt

SEQ ID NO: 2471568 - DNA, 13 bp, Homo sapiens
tagagttgctgag

SEQ ID NO: 2471569 - DNA, 16 bp, Homo sapiens
tagagttgctgagagg

SEQ ID NO: 2471570 - DNA, 21 bp, Homo sapiens
tagataaaacatctttgaaat

SEQ ID NO: 2471571 - DNA, 23 bp, Homo sapiens
tagataaaacatctttgaaatta

SEQ ID NO: 2471572 - DNA, 19 bp, Homo sapiens
tagatgcatttgggtccag

SEQ ID NO: 2471573 - DNA, 13 bp, Homo sapiens
tagatgctggccc

SEQ ID NO: 2471574 - DNA, 16 bp, Homo sapiens
tagatgctggcccagg

SEQ ID NO: 2471575 - DNA, 22 bp, Homo sapiens
tagatgctggcccagggcccag

SEQ ID NO: 2471576 - DNA, 16 bp, Homo sapiens
tagatgtataactagg

SEQ ID NO: 2471577 - DNA, 20 bp, Homo sapiens
tagatgtcttttcccattta

SEQ ID NO: 2471578 - DNA, 18 bp, Homo sapiens
tagatgttccagtaatct

SEQ ID NO: 2471579 - DNA, 21 bp, Homo sapiens
tagatgttctaagtctttcca

SEQ ID NO: 2471580 - DNA, 21 bp, Homo sapiens
tagatgtttattcttctagag

SEQ ID NO: 2471581 - DNA, 15 bp, Homo sapiens
tagattcaaaggttc

SEQ ID NO: 2471582 - DNA, 18 bp, Homo sapiens
tagattcaaaggttctag

SEQ ID NO: 2471583 - DNA, 14 bp, Homo sapiens
tagattctaaagat

SEQ ID NO: 2471584 - DNA, 18 bp, Homo sapiens
tagattctaaagattcta

SEQ ID NO: 2471585 - DNA, 22 bp, Homo sapiens
tagattctctggctgtaaggct

SEQ ID NO: 2471586 - DNA, 19 bp, Homo sapiens
tagattctctgtgtctaag

SEQ ID NO: 2471587 - DNA, 21 bp, Homo sapiens
tagattctctgtgtctaagat

SEQ ID NO: 2471588 - DNA, 23 bp, Homo sapiens
tagattgcagaaaattctgtgcc

SEQ ID NO: 2471589 - DNA, 18 bp, Homo sapiens
tagattgtccttttgcaa

SEQ ID NO: 2471590 - DNA, 23 bp, Homo sapiens
tagatttaatataaagttttata

SEQ ID NO: 2471591 - DNA, 16 bp, Homo sapiens
tagatttcatagttca

SEQ ID NO: 2471592 - DNA, 18 bp, Homo sapiens
tagatttcatagttcaga

SEQ ID NO: 2471593 - DNA, 20 bp, Homo sapiens
tagatttcatagttcagaat

SEQ ID NO: 2471594 - DNA, 17 bp, Homo sapiens
tagattttaatcaaatt

SEQ ID NO: 2471595 - DNA, 21 bp, Homo sapiens
tagcaactacagtctaaagct

SEQ ID NO: 2471596 - DNA, 22 bp, Homo sapiens
tagcaactacagtctaaagctg

SEQ ID NO: 2471597 - DNA, 11 bp, Homo sapiens
tagcagacagg

SEQ ID NO: 2471598 - DNA, 13 bp, Homo sapiens
tagcagacaggcc

SEQ ID NO: 2471599 - DNA, 20 bp, Homo sapiens
tagcagcaccgttctgtgca

SEQ ID NO: 2471600 - DNA, 12 bp, Homo sapiens
tagcagcctttc

SEQ ID NO: 2471601 - DNA, 22 bp, Homo sapiens
tagcagcggaacaaggagtcag

SEQ ID NO: 2471602 - DNA, 18 bp, Homo sapiens
tagcattgtaaaagcatt

SEQ ID NO: 2471603 - DNA, 19 bp, Homo sapiens
tagcattgtaaaagcattt

SEQ ID NO: 2471604 - DNA, 21 bp, Homo sapiens
tagcattgtagtgctttgaga

SEQ ID NO: 2471605 - DNA, 21 bp, Homo sapiens
tagccaaaaatagctaaatac

SEQ ID NO: 2471606 - DNA, 22 bp, Homo sapiens
tagccaaacctcaccaactcct

SEQ ID NO: 2471607 - DNA, 18 bp, Homo sapiens
tagccagcacacagggca

SEQ ID NO: 2471608 - DNA, 21 bp, Homo sapiens
tagccccctggtaatagctgt

SEQ ID NO: 2471609 - DNA, 22 bp, Homo sapiens
tagcccctggggtggccaccag

SEQ ID NO: 2471610 - DNA, 17 bp, Homo sapiens
tagccctgtcctggtgg

SEQ ID NO: 2471611 - DNA, 21 bp, Homo sapiens
tagcctggacctctgacagca

SEQ ID NO: 2471612 - DNA, 22 bp, Homo sapiens
tagcctggacctctgacagcag

SEQ ID NO: 2471613 - DNA, 12 bp, Homo sapiens
tagcctgtcctg

SEQ ID NO: 2471614 - DNA, 20 bp, Homo sapiens
tcccctctgctgctgtccct

SEQ ID NO: 2471615 - DNA, 14 bp, Homo sapiens
tcccctgcactgta

SEQ ID NO: 2471616 - DNA, 15 bp, Homo sapiens
tcccctgcactgtaa

SEQ ID NO: 2471617 - DNA, 19 bp, Homo sapiens
tcccctgcactgtaaaatg

SEQ ID NO: 2471618 - DNA, 20 bp, Homo sapiens
tcccctgcaggctgagtgca

SEQ ID NO: 2471619 - DNA, 17 bp, Homo sapiens
tcccctgccaccaggcc

SEQ ID NO: 2471620 - DNA, 14 bp, Homo sapiens
tcccctgccagggc

SEQ ID NO: 2471621 - DNA, 13 bp, Homo sapiens
tcccctgccattt

SEQ ID NO: 2471622 - DNA, 12 bp, Homo sapiens
tcccctgccccc

SEQ ID NO: 2471623 - DNA, 22 bp, Homo sapiens
tccccttatcctccctgtaact

SEQ ID NO: 2471624 - DNA, 13 bp, Homo sapiens
tccccttccactg

SEQ ID NO: 2471625 - DNA, 17 bp, Homo sapiens
tccccttccactgaggg

SEQ ID NO: 2471626 - DNA, 14 bp, Homo sapiens
tccccttctcccct

SEQ ID NO: 2471627 - DNA, 20 bp, Homo sapiens
tccccttctcccctgcactg

SEQ ID NO: 2471628 - DNA, 13 bp, Homo sapiens
tccccttctctgt

SEQ ID NO: 2471629 - DNA, 17 bp, Homo sapiens
tccccttgaggtctcag

SEQ ID NO: 2471630 - DNA, 18 bp, Homo sapiens
tccccttgaggtctcagc

SEQ ID NO: 2471631 - DNA, 21 bp, Homo sapiens
tccccttgaggtctcagcccc

SEQ ID NO: 2471632 - DNA, 12 bp, Homo sapiens
tccccttgcctg

SEQ ID NO: 2471633 - DNA, 16 bp, Homo sapiens
tccccttgggcccaca

SEQ ID NO: 2471634 - DNA, 19 bp, Homo sapiens
tcccgcagtgggagcaaac

SEQ ID NO: 2471635 - DNA, 20 bp, Homo sapiens
tcccgtcacccctgtttctg

SEQ ID NO: 2471636 - DNA, 19 bp, Homo sapiens
tccctagaaacttccaaat

SEQ ID NO: 2471637 - DNA, 14 bp, Homo sapiens
tccctatactgctt

SEQ ID NO: 2471638 - DNA, 15 bp, Homo sapiens
tccctatactgcttg

SEQ ID NO: 2471639 - DNA, 17 bp, Homo sapiens
tccctatactgcttgga

SEQ ID NO: 2471640 - DNA, 20 bp, Homo sapiens
tccctatcactgaagctttt

SEQ ID NO: 2471641 - DNA, 13 bp, Homo sapiens
tccctcacaagtg

SEQ ID NO: 2471642 - DNA, 12 bp, Homo sapiens
tccctcacctgt

SEQ ID NO: 2471643 - DNA, 21 bp, Homo sapiens
tccctcaccttggcaccagac

SEQ ID NO: 2471644 - DNA, 20 bp, Homo sapiens
tccctcactcgtctccccca

SEQ ID NO: 2471645 - DNA, 21 bp, Homo sapiens
tccctcatctgtccctccggg

SEQ ID NO: 2471646 - DNA, 16 bp, Homo sapiens
tccctcccccccatgc

SEQ ID NO: 2471647 - DNA, 21 bp, Homo sapiens
tccctcccccccatgcactgt

SEQ ID NO: 2471648 - DNA, 12 bp, Homo sapiens
tccctccccctt

SEQ ID NO: 2471649 - DNA, 14 bp, Homo sapiens
tccctcccccttgt

SEQ ID NO: 2471650 - DNA, 15 bp, Homo sapiens
tccctccccttgcct

SEQ ID NO: 2471651 - DNA, 21 bp, Homo sapiens
tccctctacagagcttccctg

SEQ ID NO: 2471652 - DNA, 22 bp, Homo sapiens
tccctctacagagcttccctga

SEQ ID NO: 2471653 - DNA, 10 bp, Homo sapiens
tccctctcat

SEQ ID NO: 2471654 - DNA, 14 bp, Homo sapiens
tccctctcccaggc

SEQ ID NO: 2471655 - DNA, 15 bp, Homo sapiens
tccctctcccaggcc

SEQ ID NO: 2471656 - DNA, 15 bp, Homo sapiens
tccctctctcactcc

SEQ ID NO: 2471657 - DNA, 14 bp, Homo sapiens
tccctctctggaga

SEQ ID NO: 2471658 - DNA, 19 bp, Homo sapiens
tccctgactcattctgaag

SEQ ID NO: 2471659 - DNA, 15 bp, Homo sapiens
tccctgactgggagt

SEQ ID NO: 2471660 - DNA, 23 bp, Homo sapiens
tccctgagctagaaccctctgtt

SEQ ID NO: 2471661 - DNA, 17 bp, Homo sapiens
tccctgcacagtgactt

SEQ ID NO: 2471662 - DNA, 20 bp, Homo sapiens
tccctgcacagtgacttctg

SEQ ID NO: 2471663 - DNA, 13 bp, Homo sapiens
tccctgcatggca

SEQ ID NO: 2471664 - DNA, 20 bp, Homo sapiens
tccctgcatggcatcctcca

SEQ ID NO: 2471665 - DNA, 22 bp, Homo sapiens
tccctgcatggcatcctccagc

SEQ ID NO: 2471666 - DNA, 18 bp, Homo sapiens
tccctgcctcctgccggc

SEQ ID NO: 2471667 - DNA, 19 bp, Homo sapiens
tccctgctttttgtgtttt

SEQ ID NO: 2471668 - DNA, 13 bp, Homo sapiens
tccctgggcctgc

SEQ ID NO: 2471669 - DNA, 14 bp, Homo sapiens
tccctgggcctgct

SEQ ID NO: 2471670 - DNA, 17 bp, Homo sapiens
tccctgggcctgctgct

SEQ ID NO: 2471671 - DNA, 20 bp, Homo sapiens
tccctgggcctgctgctgag

SEQ ID NO: 2471672 - DNA, 13 bp, Homo sapiens
tccctgggccttg

SEQ ID NO: 2471673 - DNA, 14 bp, Homo sapiens
tccctgggccttgg

SEQ ID NO: 2471674 - DNA, 20 bp, Homo sapiens
tccctggggctagggggagc

SEQ ID NO: 2471675 - DNA, 20 bp, Homo sapiens
tccctgggtagcgggggagg

SEQ ID NO: 2471676 - DNA, 22 bp, Homo sapiens
tccctgtaacctcttcagaggc

SEQ ID NO: 2471677 - DNA, 19 bp, Homo sapiens
tccctgtgcctcctccctc

SEQ ID NO: 2471678 - DNA, 19 bp, Homo sapiens
tccctgtggtctacccgtg

SEQ ID NO: 2471679 - DNA, 17 bp, Homo sapiens
tccctgttccccagaga

SEQ ID NO: 2471680 - DNA, 17 bp, Homo sapiens
tcccttaacagttgtat

SEQ ID NO: 2471681 - DNA, 20 bp, Homo sapiens
tcccttcagtaccctctcag

SEQ ID NO: 2471682 - DNA, 21 bp, Homo sapiens
tcccttcagtaccctctcagc

SEQ ID NO: 2471683 - DNA, 14 bp, Homo sapiens
tcccttcatacttg

SEQ ID NO: 2471684 - DNA, 15 bp, Homo sapiens
tcccttcctgccagc

SEQ ID NO: 2471685 - DNA, 19 bp, Homo sapiens
tcccttcctgccagcccct

SEQ ID NO: 2471686 - DNA, 18 bp, Homo sapiens
tcccttgcccccctggcc

SEQ ID NO: 2471687 - DNA, 19 bp, Homo sapiens
ctgtgtctaagattctaga

SEQ ID NO: 2471688 - DNA, 13 bp, Homo sapiens
ctgtgtgcttttt

SEQ ID NO: 2471689 - DNA, 23 bp, Homo sapiens
ctgtgtggagagggaatgtgaaa

SEQ ID NO: 2471690 - DNA, 21 bp, Homo sapiens
ctgtgtgtccaaaactgcctc

SEQ ID NO: 2471691 - DNA, 18 bp, Homo sapiens
ctgtgtgtgccctctggg

SEQ ID NO: 2471692 - DNA, 12 bp, Homo sapiens
ctgtgtgtgtga

SEQ ID NO: 2471693 - DNA, 14 bp, Homo sapiens
ctgtgtgtgtgaat

SEQ ID NO: 2471694 - DNA, 21 bp, Homo sapiens
ctgtgtgtgtgaatgaacact

SEQ ID NO: 2471695 - DNA, 18 bp, Homo sapiens
ctgtgtgttaagctctgc

SEQ ID NO: 2471696 - DNA, 22 bp, Homo sapiens
ctgtgttactaaaaaaaagatg

SEQ ID NO: 2471697 - DNA, 14 bp, Homo sapiens
ctgtgttgtctcta

SEQ ID NO: 2471698 - DNA, 22 bp, Homo sapiens
ctgtgttgtctctagagcaggg

SEQ ID NO: 2471699 - DNA, 18 bp, Homo sapiens
ctgtgtttcttgcctcat

SEQ ID NO: 2471700 - DNA, 17 bp, Homo sapiens
ctgtgtttggctttcag

SEQ ID NO: 2471701 - DNA, 18 bp, Homo sapiens
ctgtgtttggctttcagg

SEQ ID NO: 2471702 - DNA, 22 bp, Homo sapiens
ctgtgtttggctttcagggagg

SEQ ID NO: 2471703 - DNA, 17 bp, Homo sapiens
ctgtgttttgaaagaat

SEQ ID NO: 2471704 - DNA, 18 bp, Homo sapiens
ctgtgttttgaaagaata

SEQ ID NO: 2471705 - DNA, 22 bp, Homo sapiens
ctgtgttttgaaagaatagaac

SEQ ID NO: 2471706 - DNA, 11 bp, Homo sapiens
ctgttaaatac

SEQ ID NO: 2471707 - DNA, 16 bp, Homo sapiens
ctgttaaatacaggaa

SEQ ID NO: 2471708 - DNA, 17 bp, Homo sapiens
ctgttaaatacaggaaa

SEQ ID NO: 2471709 - DNA, 14 bp, Homo sapiens
ctgttaactgaata

SEQ ID NO: 2471710 - DNA, 19 bp, Homo sapiens
ctgttatcaaaactttctt

SEQ ID NO: 2471711 - DNA, 23 bp, Homo sapiens
ctgttatcaaacaccaacataaa

SEQ ID NO: 2471712 - DNA, 16 bp, Homo sapiens
ctgttcaaagctgcct

SEQ ID NO: 2471713 - DNA, 14 bp, Homo sapiens
ctgttcatggcaga

SEQ ID NO: 2471714 - DNA, 23 bp, Homo sapiens
ctgttcatggcagatgtaggagg

SEQ ID NO: 2471715 - DNA, 17 bp, Homo sapiens
ctgttccaaattcagtt

SEQ ID NO: 2471716 - DNA, 15 bp, Homo sapiens
ctgttccccctgtgc

SEQ ID NO: 2471717 - DNA, 16 bp, Homo sapiens
ctgttccccctgtgca

SEQ ID NO: 2471718 - DNA, 17 bp, Homo sapiens
ctgttccccctgtgcag

SEQ ID NO: 2471719 - DNA, 17 bp, Homo sapiens
ctgttcctgctgctgtc

SEQ ID NO: 2471720 - DNA, 13 bp, Homo sapiens
ctgttccttccct

SEQ ID NO: 2471721 - DNA, 14 bp, Homo sapiens
ctgttccttttata

SEQ ID NO: 2471722 - DNA, 14 bp, Homo sapiens
ctgttctgtttcaa

SEQ ID NO: 2471723 - DNA, 21 bp, Homo sapiens
ctgttctgtttcaaggcactc

SEQ ID NO: 2471724 - DNA, 17 bp, Homo sapiens
ctgttgagcatcacaga

SEQ ID NO: 2471725 - DNA, 22 bp, Homo sapiens
ctgttgcacgtgtgtttttcta

SEQ ID NO: 2471726 - DNA, 15 bp, Homo sapiens
ctgttggcaggctgg

SEQ ID NO: 2471727 - DNA, 16 bp, Homo sapiens
ctgttggcaggctggc

SEQ ID NO: 2471728 - DNA, 18 bp, Homo sapiens
ctgtttaaaaaaccacat

SEQ ID NO: 2471729 - DNA, 15 bp, Homo sapiens
ctgtttactgcaagg

SEQ ID NO: 2471730 - DNA, 17 bp, Homo sapiens
ctgtttactgcaaggtt

SEQ ID NO: 2471731 - DNA, 20 bp, Homo sapiens
ctgtttagtagcagtgattg

SEQ ID NO: 2471732 - DNA, 14 bp, Homo sapiens
ctgtttattaatct

SEQ ID NO: 2471733 - DNA, 16 bp, Homo sapiens
ctgtttattaatctta

SEQ ID NO: 2471734 - DNA, 21 bp, Homo sapiens
ctgtttcaaggcactctagat

SEQ ID NO: 2471735 - DNA, 17 bp, Homo sapiens
ctgtttcttaagggcac

SEQ ID NO: 2471736 - DNA, 19 bp, Homo sapiens
ctgtttgacacctcttttt

SEQ ID NO: 2471737 - DNA, 22 bp, Homo sapiens
ctgtttgcatttgatacatttt

SEQ ID NO: 2471738 - DNA, 14 bp, Homo sapiens
ctgttttacaagtt

SEQ ID NO: 2471739 - DNA, 13 bp, Homo sapiens
ctgttttgttata

SEQ ID NO: 2471740 - DNA, 17 bp, Homo sapiens
ctgttttgttatataat

SEQ ID NO: 2471741 - DNA, 14 bp, Homo sapiens
ctgttttgttgaca

SEQ ID NO: 2471742 - DNA, 21 bp, Homo sapiens
cttaaaaattaaattggaaag

SEQ ID NO: 2471743 - DNA, 12 bp, Homo sapiens
cttaaaataagc

SEQ ID NO: 2471744 - DNA, 15 bp, Homo sapiens
cttaaaataagcagg

SEQ ID NO: 2471745 - DNA, 14 bp, Homo sapiens
cttaaaatacaaga

SEQ ID NO: 2471746 - DNA, 16 bp, Homo sapiens
cttaaaatacaagact

SEQ ID NO: 2471747 - DNA, 19 bp, Homo sapiens
cttaaaatacaagactgcc

SEQ ID NO: 2471748 - DNA, 15 bp, Homo sapiens
cttaaactaaatgtg

SEQ ID NO: 2471749 - DNA, 17 bp, Homo sapiens
cttaaataagaaacttt

SEQ ID NO: 2471750 - DNA, 17 bp, Homo sapiens
cttaacagttgtattta

SEQ ID NO: 2471751 - DNA, 16 bp, Homo sapiens
cttaactggtctcctt

SEQ ID NO: 2471752 - DNA, 16 bp, Homo sapiens
cttaatactaccttga

SEQ ID NO: 2471753 - DNA, 22 bp, Homo sapiens
cttaatactcaaatgagtaaca

SEQ ID NO: 2471754 - DNA, 14 bp, Homo sapiens
cttaatgtatgtta

SEQ ID NO: 2471755 - DNA, 17 bp, Homo sapiens
cttaatgtatgttacca

SEQ ID NO: 2471756 - DNA, 21 bp, Homo sapiens
cttaatgtatgttaccaaaaa

SEQ ID NO: 2471757 - DNA, 16 bp, Homo sapiens
cttaattgccacctct

SEQ ID NO: 2471758 - DNA, 18 bp, Homo sapiens
cttacaagcctaagaatc

SEQ ID NO: 2471759 - DNA, 13 bp, Homo sapiens
cttacagcaggca

SEQ ID NO: 2471760 - DNA, 20 bp, Homo sapiens
cttaccaggcaccaaaagaa

SEQ ID NO: 2471761 - DNA, 21 bp, Homo sapiens
cttacctggcccatcagggta

SEQ ID NO: 2471762 - DNA, 19 bp, Homo sapiens
cttacctgggcattcttgt

SEQ ID NO: 2471763 - DNA, 14 bp, Homo sapiens
cttactcctgtggg

SEQ ID NO: 2471764 - DNA, 13 bp, Homo sapiens
cttactctaagat

SEQ ID NO: 2471765 - DNA, 23 bp, Homo sapiens
cttacttaaacccagctcccttc

SEQ ID NO: 2471766 - DNA, 16 bp, Homo sapiens
cttactttttatatat

SEQ ID NO: 2471767 - DNA, 23 bp, Homo sapiens
cttagaaaaccagctcagcactg

SEQ ID NO: 2471768 - DNA, 21 bp, Homo sapiens
cttagatctggcatgttagcc

SEQ ID NO: 2471769 - DNA, 18 bp, Homo sapiens
cttagatgttctaagtct

SEQ ID NO: 2471770 - DNA, 22 bp, Homo sapiens
cttagattctctgtgtctaaga

SEQ ID NO: 2471771 - DNA, 13 bp, Homo sapiens
cttagatttcata

SEQ ID NO: 2471772 - DNA, 13 bp, Homo sapiens
cttagattttaca

SEQ ID NO: 2471773 - DNA, 18 bp, Homo sapiens
cttagcagtccccttccc

SEQ ID NO: 2471774 - DNA, 13 bp, Homo sapiens
cttagcctggacc

SEQ ID NO: 2471775 - DNA, 16 bp, Homo sapiens
cttagctcaatgagca

SEQ ID NO: 2471776 - DNA, 20 bp, Homo sapiens
cttagctcaatgagcatgtt

SEQ ID NO: 2471777 - DNA, 16 bp, Homo sapiens
cttagctttagaaaca

SEQ ID NO: 2471778 - DNA, 12 bp, Homo sapiens
cttagtctcagt

SEQ ID NO: 2471779 - DNA, 18 bp, Homo sapiens
cttagtctcagtttgtgt

SEQ ID NO: 2471780 - DNA, 21 bp, Homo sapiens
cttataattgttctcagaatc

SEQ ID NO: 2471781 - DNA, 19 bp, Homo sapiens
cttatagttactgtgtaat

SEQ ID NO: 2471782 - DNA, 21 bp, Homo sapiens
cttatagttactgtgtaatta

SEQ ID NO: 2471783 - DNA, 14 bp, Homo sapiens
cttatagttctagg

SEQ ID NO: 2471784 - DNA, 16 bp, Homo sapiens
cttatagttctaggca

SEQ ID NO: 2471785 - DNA, 15 bp, Homo sapiens
cttatataattgcca

SEQ ID NO: 2471786 - DNA, 15 bp, Homo sapiens
cttatcctccaccgt

SEQ ID NO: 2471787 - DNA, 18 bp, Homo sapiens
cttatcctccctgtaact

SEQ ID NO: 2471788 - DNA, 19 bp, Homo sapiens
cttatcctccctgtaactt

SEQ ID NO: 2471789 - DNA, 11 bp, Homo sapiens
cttatgaaaag

SEQ ID NO: 2471790 - DNA, 12 bp, Homo sapiens
cttatgctctta

SEQ ID NO: 2471791 - DNA, 15 bp, Homo sapiens
cttatgctcttaatt

SEQ ID NO: 2471792 - DNA, 22 bp, Homo sapiens
cttatgctcttaattgccacct

SEQ ID NO: 2471793 - DNA, 17 bp, Homo sapiens
cttatggaattgatttg

SEQ ID NO: 2471794 - DNA, 14 bp, Homo sapiens
cttatggatgtccc

SEQ ID NO: 2471795 - DNA, 19 bp, Homo sapiens
cttatggtaccagatgcag

SEQ ID NO: 2471796 - DNA, 21 bp, Homo sapiens
cttattaacaattaggcagac

SEQ ID NO: 2471797 - DNA, 17 bp, Homo sapiens
cttattagagtgtcttt

SEQ ID NO: 2471798 - DNA, 14 bp, Homo sapiens
cttattcccttcct

SEQ ID NO: 2471799 - DNA, 15 bp, Homo sapiens
cttattcccttcctg

SEQ ID NO: 2471800 - DNA, 19 bp, Homo sapiens
cttattgcctcacttcagg

SEQ ID NO: 2471801 - DNA, 16 bp, Homo sapiens
cttatttattgtattc

SEQ ID NO: 2471802 - DNA, 17 bp, Homo sapiens
cttatttattgtattct

SEQ ID NO: 2471803 - DNA, 19 bp, Homo sapiens
cttatttattgtattctgg

SEQ ID NO: 2471804 - DNA, 23 bp, Homo sapiens
cttcaaactagggccaagcccag

SEQ ID NO: 2471805 - DNA, 16 bp, Homo sapiens
cttcaacacagcttgt

SEQ ID NO: 2471806 - DNA, 22 bp, Homo sapiens
cttcaacacagcttgtctcttg

SEQ ID NO: 2471807 - DNA, 12 bp, Homo sapiens
cttcaagctctg

SEQ ID NO: 2471808 - DNA, 17 bp, Homo sapiens
cttcaagctctgaggga

SEQ ID NO: 2471809 - DNA, 21 bp, Homo sapiens
cttcacaatctgtcagttcta

SEQ ID NO: 2471810 - DNA, 19 bp, Homo sapiens
cttcacacctaccctcctt

SEQ ID NO: 2471811 - DNA, 17 bp, Homo sapiens
cttcaccttcaccttca

SEQ ID NO: 2471812 - DNA, 19 bp, Homo sapiens
cttcactcttcaaatgcct

SEQ ID NO: 2471813 - DNA, 11 bp, Homo sapiens
cttcagaaaga

SEQ ID NO: 2471814 - DNA, 19 bp, Homo sapiens
cttcagtaccctctcagct

SEQ ID NO: 2471815 - DNA, 22 bp, Homo sapiens
cttcagtaccctctcagctcca

SEQ ID NO: 2471816 - DNA, 15 bp, Homo sapiens
cttcataacaatttt

SEQ ID NO: 2471817 - DNA, 13 bp, Homo sapiens
cttcatacttgaa

SEQ ID NO: 2471818 - DNA, 17 bp, Homo sapiens
cttcatatcatccacac

SEQ ID NO: 2471819 - DNA, 11 bp, Homo sapiens
cttcatcctct

SEQ ID NO: 2471820 - DNA, 15 bp, Homo sapiens
cttcatcgaatctac

SEQ ID NO: 2471821 - DNA, 19 bp, Homo sapiens
cttcatctcccacctagca

SEQ ID NO: 2471822 - DNA, 23 bp, Homo sapiens
cttcatggatgggggaactcaga

SEQ ID NO: 2471823 - DNA, 15 bp, Homo sapiens
cttcatgtgtcccag

SEQ ID NO: 2471824 - DNA, 16 bp, Homo sapiens
cttcatgtgtcccaga

SEQ ID NO: 2471825 - DNA, 20 bp, Homo sapiens
cttcatgtgtcccagaagat

SEQ ID NO: 2471826 - DNA, 15 bp, Homo sapiens
cttccacagggtccc

SEQ ID NO: 2471827 - DNA, 15 bp, Homo sapiens
cttccactgagggca

SEQ ID NO: 2471828 - DNA, 16 bp, Homo sapiens
cttccagctagtgacc

SEQ ID NO: 2471829 - DNA, 22 bp, Homo sapiens
cttccagctagtgacccacatg

SEQ ID NO: 2471830 - DNA, 17 bp, Homo sapiens
cttccatgattctattt

SEQ ID NO: 2471831 - DNA, 14 bp, Homo sapiens
cttccatgctgtgc

SEQ ID NO: 2471832 - DNA, 14 bp, Homo sapiens
cttccatttgcaag

SEQ ID NO: 2471833 - DNA, 21 bp, Homo sapiens
cttcccagaggggcctgccac

SEQ ID NO: 2471834 - DNA, 18 bp, Homo sapiens
cttccccatcttctaaac

SEQ ID NO: 2471835 - DNA, 13 bp, Homo sapiens
cttccctgaagct

SEQ ID NO: 2471836 - DNA, 17 bp, Homo sapiens
cttccctgaagctccca

SEQ ID NO: 2471837 - DNA, 20 bp, Homo sapiens
cttccctgactcattctgaa

SEQ ID NO: 2471838 - DNA, 16 bp, Homo sapiens
cttccctgtgcctcct

SEQ ID NO: 2471839 - DNA, 22 bp, Homo sapiens
cttccctgtgtagtttgtgctg

SEQ ID NO: 2471840 - DNA, 14 bp, Homo sapiens
cttccgccactggg

SEQ ID NO: 2471841 - DNA, 22 bp, Homo sapiens
cttccgccactggggctcagag

SEQ ID NO: 2471842 - DNA, 19 bp, Homo sapiens
cttcctaaatattatgaga

SEQ ID NO: 2471843 - DNA, 16 bp, Homo sapiens
cttcctaaattttcct

SEQ ID NO: 2471844 - DNA, 17 bp, Homo sapiens
cttcctaccaagtcaaa

SEQ ID NO: 2471845 - DNA, 15 bp, Homo sapiens
cttcctcagccagcc

SEQ ID NO: 2471846 - DNA, 17 bp, Homo sapiens
cttcctcagccagcctc

SEQ ID NO: 2471847 - DNA, 18 bp, Homo sapiens
cttcctcatccaccccat

SEQ ID NO: 2471848 - DNA, 17 bp, Homo sapiens
cttcctcctccccactt

SEQ ID NO: 2471849 - DNA, 13 bp, Homo sapiens
cttcctcctggaa

SEQ ID NO: 2471850 - DNA, 17 bp, Homo sapiens
cttcctcttcccccaag

SEQ ID NO: 2471851 - DNA, 20 bp, Homo sapiens
cttcctgccagcccctgcca

SEQ ID NO: 2471852 - DNA, 12 bp, Homo sapiens
cttcctgcttgc

SEQ ID NO: 2471853 - DNA, 16 bp, Homo sapiens
cttcctggacagctgt

SEQ ID NO: 2471854 - DNA, 20 bp, Homo sapiens
cttcctggacagctgtgcct

SEQ ID NO: 2471855 - DNA, 12 bp, Homo sapiens
cttcctggagca

SEQ ID NO: 2471856 - DNA, 13 bp, Homo sapiens
cttcctggagcag

SEQ ID NO: 2471857 - DNA, 11 bp, Homo sapiens
cttcctggccg

SEQ ID NO: 2471858 - DNA, 23 bp, Homo sapiens
cttcctggtagaccactgccata

SEQ ID NO: 2471859 - DNA, 18 bp, Homo sapiens
cttcctgtccagctccaa

SEQ ID NO: 2471860 - DNA, 23 bp, Homo sapiens
cttcctgtgtgtccaaaactgcc

SEQ ID NO: 2471861 - DNA, 16 bp, Homo sapiens
cttccttcagagagca

SEQ ID NO: 2471862 - DNA, 17 bp, Homo sapiens
cttccttttatcagtag

SEQ ID NO: 2471863 - DNA, 16 bp, Homo sapiens
cttcgacactgttctt

SEQ ID NO: 2471864 - DNA, 15 bp, Homo sapiens
cttcgcttcttgcct

SEQ ID NO: 2471865 - DNA, 17 bp, Homo sapiens
cttcgcttcttgcctct

SEQ ID NO: 2471866 - DNA, 20 bp, Homo sapiens
cttcgcttcttgcctctgtg

SEQ ID NO: 2471867 - DNA, 14 bp, Homo sapiens
cttcgggctgtgcc

SEQ ID NO: 2471868 - DNA, 16 bp, Homo sapiens
cttcgggctgtgcccg

SEQ ID NO: 2471869 - DNA, 19 bp, Homo sapiens
cttctaaacttccccatct

SEQ ID NO: 2471870 - DNA, 23 bp, Homo sapiens
cttctaaatggcaaaggaaggtg

SEQ ID NO: 2471871 - DNA, 14 bp, Homo sapiens
cttctaagtaaata

SEQ ID NO: 2471872 - DNA, 18 bp, Homo sapiens
cttctaagtaaatacaat

SEQ ID NO: 2471873 - DNA, 21 bp, Homo sapiens
cttctacttttaagttgctga

SEQ ID NO: 2471874 - DNA, 13 bp, Homo sapiens
cttctagagttca

SEQ ID NO: 2471875 - DNA, 16 bp, Homo sapiens
cttctaggttctaaaa

SEQ ID NO: 2471876 - DNA, 18 bp, Homo sapiens
cttctcaagttctaagat

SEQ ID NO: 2471877 - DNA, 23 bp, Homo sapiens
cttctcaagttctaagattctaa

SEQ ID NO: 2471878 - DNA, 18 bp, Homo sapiens
cttctcaggacacaggcc

SEQ ID NO: 2471879 - DNA, 23 bp, Homo sapiens
cttctcaggacacaggcctgtgt

SEQ ID NO: 2471880 - DNA, 14 bp, Homo sapiens
cttctccatccaca

SEQ ID NO: 2471881 - DNA, 16 bp, Homo sapiens
cttctccatccacatg

SEQ ID NO: 2471882 - DNA, 12 bp, Homo sapiens
cttctcccactc

SEQ ID NO: 2471883 - DNA, 19 bp, Homo sapiens
cttctcccactctcctagg

SEQ ID NO: 2471884 - DNA, 14 bp, Homo sapiens
cttctcccaggcaa

SEQ ID NO: 2471885 - DNA, 18 bp, Homo sapiens
cttctccccagctcccag

SEQ ID NO: 2471886 - DNA, 20 bp, Homo sapiens
cttctccccagctcccagga

SEQ ID NO: 2471887 - DNA, 13 bp, Homo sapiens
cttctcccctgca

SEQ ID NO: 2471888 - DNA, 18 bp, Homo sapiens
cttctcccctgcactgta

SEQ ID NO: 2471889 - DNA, 19 bp, Homo sapiens
cttctcccctgcactgtaa

SEQ ID NO: 2471890 - DNA, 16 bp, Homo sapiens
cttctccctggaatga

SEQ ID NO: 2471891 - DNA, 16 bp, Homo sapiens
cttctcctctcctagc

SEQ ID NO: 2471892 - DNA, 17 bp, Homo sapiens
cttctctccagctgact

SEQ ID NO: 2471893 - DNA, 18 bp, Homo sapiens
cttctctccagctgacta

SEQ ID NO: 2471894 - DNA, 13 bp, Homo sapiens
cttctctctgtgg

SEQ ID NO: 2471895 - DNA, 16 bp, Homo sapiens
cttctctctgtgggat

SEQ ID NO: 2471896 - DNA, 17 bp, Homo sapiens
cttctctgacttctgcc

SEQ ID NO: 2471897 - DNA, 21 bp, Homo sapiens
cttctctgacttctgcctgga

SEQ ID NO: 2471898 - DNA, 15 bp, Homo sapiens
cttctctttgcctca

SEQ ID NO: 2471899 - DNA, 19 bp, Homo sapiens
cttctgacagcctcagtga

SEQ ID NO: 2471900 - DNA, 11 bp, Homo sapiens
cttctgagacg

SEQ ID NO: 2471901 - DNA, 20 bp, Homo sapiens
cttctgagcagcgagcctgc

SEQ ID NO: 2471902 - DNA, 21 bp, Homo sapiens
cttctgagcagcgagcctgct

SEQ ID NO: 2471903 - DNA, 22 bp, Homo sapiens
cttctgagcagcgagcctgcta

SEQ ID NO: 2471904 - DNA, 13 bp, Homo sapiens
cttctgagctcct

SEQ ID NO: 2471905 - DNA, 15 bp, Homo sapiens
cttctgagctcctgt

SEQ ID NO: 2471906 - DNA, 16 bp, Homo sapiens
cttctgccccctgcag

SEQ ID NO: 2471907 - DNA, 19 bp, Homo sapiens
cttctgccttagtctcagt

SEQ ID NO: 2471908 - DNA, 16 bp, Homo sapiens
cttctgctcagctctg

SEQ ID NO: 2471909 - DNA, 18 bp, Homo sapiens
cttctgctggggcctggg

SEQ ID NO: 2471910 - DNA, 12 bp, Homo sapiens
cttctggccagg

SEQ ID NO: 2471911 - DNA, 13 bp, Homo sapiens
cttctggccagga

SEQ ID NO: 2471912 - DNA, 17 bp, Homo sapiens
cttctggccaggaagct

SEQ ID NO: 2471913 - DNA, 15 bp, Homo sapiens
cttctgggagggcag

SEQ ID NO: 2471914 - DNA, 16 bp, Homo sapiens
cttctggggcaggctg

SEQ ID NO: 2471915 - DNA, 19 bp, Homo sapiens
cttctggggcaggctgggc

SEQ ID NO: 2471916 - DNA, 14 bp, Homo sapiens
cttcttaaagtatt

SEQ ID NO: 2471917 - DNA, 19 bp, Homo sapiens
cttcttaaagtattcttct

SEQ ID NO: 2471918 - DNA, 22 bp, Homo sapiens
cttcttacttggaactgaaggg

SEQ ID NO: 2471919 - DNA, 14 bp, Homo sapiens
cttcttcagggact

SEQ ID NO: 2471920 - DNA, 16 bp, Homo sapiens
cttcttgcctctgtgc

SEQ ID NO: 2471921 - DNA, 21 bp, Homo sapiens
cttcttgcttctttctagaaa

SEQ ID NO: 2471922 - DNA, 14 bp, Homo sapiens
cttctttagaacag

SEQ ID NO: 2471923 - DNA, 16 bp, Homo sapiens
cttctttctagaaaga

SEQ ID NO: 2471924 - DNA, 14 bp, Homo sapiens
cttgaaaaaaaaca

SEQ ID NO: 2471925 - DNA, 16 bp, Homo sapiens
cttgaaaaaaaacagt

SEQ ID NO: 2471926 - DNA, 18 bp, Homo sapiens
cttgaaaaaaaacagtgg

SEQ ID NO: 2471927 - DNA, 16 bp, Homo sapiens
cttgaacgttttctaa

SEQ ID NO: 2471928 - DNA, 17 bp, Homo sapiens
cttgaacgttttctaat

SEQ ID NO: 2471929 - DNA, 21 bp, Homo sapiens
cttgaacgttttctaattgct

SEQ ID NO: 2471930 - DNA, 22 bp, Homo sapiens
cttgaacgttttctaattgctt

SEQ ID NO: 2471931 - DNA, 20 bp, Homo sapiens
cttgaagaactgcaggccct

SEQ ID NO: 2471932 - DNA, 16 bp, Homo sapiens
cttgaaggactaatag

SEQ ID NO: 2471933 - DNA, 13 bp, Homo sapiens
cttgaagggccag

SEQ ID NO: 2471934 - DNA, 14 bp, Homo sapiens
cttgaagggccaga

SEQ ID NO: 2471935 - DNA, 19 bp, Homo sapiens
cttgaagggccagagccag

SEQ ID NO: 2471936 - DNA, 20 bp, Homo sapiens
cttgaagggccagagccagg

SEQ ID NO: 2471937 - DNA, 21 bp, Homo sapiens
cttgaagggccagagccaggg

SEQ ID NO: 2471938 - DNA, 14 bp, Homo sapiens
cttgaaggtgctga

SEQ ID NO: 2471939 - DNA, 22 bp, Homo sapiens
cttgaatgtggcttgagaaata

SEQ ID NO: 2471940 - DNA, 16 bp, Homo sapiens
cttgacaactggcagg

SEQ ID NO: 2471941 - DNA, 15 bp, Homo sapiens
cttgacacctgctga

SEQ ID NO: 2471942 - DNA, 14 bp, Homo sapiens
cttgaccctgagct

SEQ ID NO: 2471943 - DNA, 15 bp, Homo sapiens
cttgaccctgagctg

SEQ ID NO: 2471944 - DNA, 14 bp, Homo sapiens
cttgacctgaggct

SEQ ID NO: 2471945 - DNA, 23 bp, Homo sapiens
cttgacctgaggctgtggtcaca

SEQ ID NO: 2471946 - DNA, 22 bp, Homo sapiens
cttgagaaatatggacacttaa

SEQ ID NO: 2471947 - DNA, 16 bp, Homo sapiens
cttgagatggtgaggc

SEQ ID NO: 2471948 - DNA, 22 bp, Homo sapiens
cttgagatggtgaggctgtcag

SEQ ID NO: 2471949 - DNA, 16 bp, Homo sapiens
cttgagcagtggctgg

SEQ ID NO: 2471950 - DNA, 22 bp, Homo sapiens
cttgagcatgttactgacagag

SEQ ID NO: 2471951 - DNA, 13 bp, Homo sapiens
cttgagccagtaa

SEQ ID NO: 2471952 - DNA, 12 bp, Homo sapiens
cttgagctctat

SEQ ID NO: 2471953 - DNA, 15 bp, Homo sapiens
cttgagctctattat

SEQ ID NO: 2471954 - DNA, 18 bp, Homo sapiens
cttgagctctattatgaa

SEQ ID NO: 2471955 - DNA, 21 bp, Homo sapiens
cttgaggggaagctagtcttt

SEQ ID NO: 2471956 - DNA, 23 bp, Homo sapiens
cttgaggggaagctagtcttttg

SEQ ID NO: 2471957 - DNA, 18 bp, Homo sapiens
cttgaggggaccaggagt

SEQ ID NO: 2471958 - DNA, 21 bp, Homo sapiens
cttgagtggggttatctctgt

SEQ ID NO: 2471959 - DNA, 23 bp, Homo sapiens
cttgagtggggttatctctgtgt

SEQ ID NO: 2471960 - DNA, 16 bp, Homo sapiens
cttgatacccccctct

SEQ ID NO: 2471961 - DNA, 17 bp, Homo sapiens
cttgatacccccctctg

SEQ ID NO: 2471962 - DNA, 21 bp, Homo sapiens
cttgatacccccctctgtctt

SEQ ID NO: 2471963 - DNA, 14 bp, Homo sapiens
cttgatagaaatgc

SEQ ID NO: 2471964 - DNA, 16 bp, Homo sapiens
cttgatccatttctaa

SEQ ID NO: 2471965 - DNA, 19 bp, Homo sapiens
cttgatgggattctggaca

SEQ ID NO: 2471966 - DNA, 13 bp, Homo sapiens
cttgatgtaaaat

SEQ ID NO: 2471967 - DNA, 14 bp, Homo sapiens
cttgatgtaaaatc

SEQ ID NO: 2471968 - DNA, 17 bp, Homo sapiens
cttgatgtaaaatcttg

SEQ ID NO: 2471969 - DNA, 21 bp, Homo sapiens
cttgatgtaaggatgggcatg

SEQ ID NO: 2471970 - DNA, 13 bp, Homo sapiens
cttgattctgcag

SEQ ID NO: 2471971 - DNA, 21 bp, Homo sapiens
cttgattctgcagtaaatctt

SEQ ID NO: 2471972 - DNA, 21 bp, Homo sapiens
cttgatttatcacacaaagca

SEQ ID NO: 2471973 - DNA, 23 bp, Homo sapiens
cttgcacagtcactgctcttcag

SEQ ID NO: 2471974 - DNA, 22 bp, Homo sapiens
cttgcaccccaaagctttcctg

SEQ ID NO: 2471975 - DNA, 19 bp, Homo sapiens
cttgcacgaccgccccagt

SEQ ID NO: 2471976 - DNA, 23 bp, Homo sapiens
cttgcaggaaggactatgaaaag

SEQ ID NO: 2471977 - DNA, 17 bp, Homo sapiens
cttgccaaggcagaggc

SEQ ID NO: 2471978 - DNA, 19 bp, Homo sapiens
cttgccaaggcagaggcct

SEQ ID NO: 2471979 - DNA, 20 bp, Homo sapiens
cttgccaaggcagaggcctg

SEQ ID NO: 2471980 - DNA, 22 bp, Homo sapiens
cttgcccccctggcctccccca

SEQ ID NO: 2471981 - DNA, 18 bp, Homo sapiens
cttgccctaagcagaaag

SEQ ID NO: 2471982 - DNA, 18 bp, Homo sapiens
cttgcctcaacctcccaa

SEQ ID NO: 2471983 - DNA, 16 bp, Homo sapiens
cttgcctctgtgctgt

SEQ ID NO: 2471984 - DNA, 20 bp, Homo sapiens
cttgcctctgtgctgtgtgt

SEQ ID NO: 2471985 - DNA, 12 bp, Homo sapiens
cttgcctcttcc

SEQ ID NO: 2471986 - DNA, 16 bp, Homo sapiens
cttgcctgccactgtg

SEQ ID NO: 2471987 - DNA, 16 bp, Homo sapiens
cttgcctgcctttcca

SEQ ID NO: 2471988 - DNA, 16 bp, Homo sapiens
cttgcctggtacagta

SEQ ID NO: 2471989 - DNA, 15 bp, Homo sapiens
cttgcctgtgccagg

SEQ ID NO: 2471990 - DNA, 18 bp, Homo sapiens
cttgcctgtgccaggtga

SEQ ID NO: 2471991 - DNA, 20 bp, Homo sapiens
cttgcctgtttcccaggccc

SEQ ID NO: 2471992 - DNA, 20 bp, Homo sapiens
cttgccttattagagtgtct

SEQ ID NO: 2471993 - DNA, 21 bp, Homo sapiens
cttgccttattagagtgtctt

SEQ ID NO: 2471994 - DNA, 20 bp, Homo sapiens
cttgcggttccggcatggac

SEQ ID NO: 2471995 - DNA, 13 bp, Homo sapiens
cttgctattctgt

SEQ ID NO: 2471996 - DNA, 15 bp, Homo sapiens
cttgctattctgtcc

SEQ ID NO: 2471997 - DNA, 18 bp, Homo sapiens
cttgctcctccttctgct

SEQ ID NO: 2471998 - DNA, 19 bp, Homo sapiens
cttgctgctttagtcccga

SEQ ID NO: 2471999 - DNA, 15 bp, Homo sapiens
cttgcttacctctca

SEQ ID NO: 2472000 - DNA, 15 bp, Homo sapiens
cttgcttatttgaca

SEQ ID NO: 2472001 - DNA, 14 bp, Homo sapiens
cttgcttctttcta

SEQ ID NO: 2472002 - DNA, 18 bp, Homo sapiens
cttgcttggggaacttgt

SEQ ID NO: 2472003 - DNA, 18 bp, Homo sapiens
cttgcttttcatgcaaac

SEQ ID NO: 2472004 - DNA, 16 bp, Homo sapiens
cttggaacattggaat

SEQ ID NO: 2472005 - DNA, 15 bp, Homo sapiens
cttggaacttgcctg

SEQ ID NO: 2472006 - DNA, 16 bp, Homo sapiens
cttggacatcctcctc

SEQ ID NO: 2472007 - DNA, 21 bp, Homo sapiens
cttggacatcctcctcccacc

SEQ ID NO: 2472008 - DNA, 22 bp, Homo sapiens
cttggacatcctcctcccaccc

SEQ ID NO: 2472009 - DNA, 17 bp, Homo sapiens
cttggagaagtctcagc

SEQ ID NO: 2472010 - DNA, 17 bp, Homo sapiens
cttggagctgagcaaat

SEQ ID NO: 2472011 - DNA, 17 bp, Homo sapiens
cttggaggagatgggga

SEQ ID NO: 2472012 - DNA, 14 bp, Homo sapiens
cttggagggcccag

SEQ ID NO: 2472013 - DNA, 22 bp, Homo sapiens
cttggagtattggggtctgacc

SEQ ID NO: 2472014 - DNA, 18 bp, Homo sapiens
cttggatgtacctgcccc

SEQ ID NO: 2472015 - DNA, 17 bp, Homo sapiens
cttggattctttccatt

SEQ ID NO: 2472016 - DNA, 16 bp, Homo sapiens
cttggatttagtttca

SEQ ID NO: 2472017 - DNA, 16 bp, Homo sapiens
cttggcaccagacacc

SEQ ID NO: 2472018 - DNA, 18 bp, Homo sapiens
cttggccacagccagggg

SEQ ID NO: 2472019 - DNA, 15 bp, Homo sapiens
cttggcctcatgctg

SEQ ID NO: 2472020 - DNA, 14 bp, Homo sapiens
cttggcctggagca

SEQ ID NO: 2472021 - DNA, 14 bp, Homo sapiens
cttggctggaccca

SEQ ID NO: 2472022 - DNA, 15 bp, Homo sapiens
cttggctggacccag

SEQ ID NO: 2472023 - DNA, 17 bp, Homo sapiens
cttggctggacccagcc

SEQ ID NO: 2472024 - DNA, 18 bp, Homo sapiens
cttggctggacccagcca

SEQ ID NO: 2472025 - DNA, 11 bp, Homo sapiens
cttggctggtg

SEQ ID NO: 2472026 - DNA, 14 bp, Homo sapiens
cttggctggtgtgg

SEQ ID NO: 2472027 - DNA, 21 bp, Homo sapiens
cttggctggtgtggtacagag

SEQ ID NO: 2472028 - DNA, 22 bp, Homo sapiens
cttggctggtgtggtacagaga

SEQ ID NO: 2472029 - DNA, 13 bp, Homo sapiens
cttgggaatttta

SEQ ID NO: 2472030 - DNA, 13 bp, Homo sapiens
cttgggcagagct

SEQ ID NO: 2472031 - DNA, 23 bp, Homo sapiens
cttgggcagagctggctctgagc

SEQ ID NO: 2472032 - DNA, 15 bp, Homo sapiens
cttgggccagaagta

SEQ ID NO: 2472033 - DNA, 23 bp, Homo sapiens
cttgggctcagggaccatggctt

SEQ ID NO: 2472034 - DNA, 21 bp, Homo sapiens
cttggggagttaagacctggc

SEQ ID NO: 2472035 - DNA, 16 bp, Homo sapiens
cttggggctggagagg

SEQ ID NO: 2472036 - DNA, 19 bp, Homo sapiens
cttgggggggtggccgctg

SEQ ID NO: 2472037 - DNA, 22 bp, Homo sapiens
cttggggggtgatgagggcagc

SEQ ID NO: 2472038 - DNA, 24 bp, Homo sapiens
cttggggggtgatgagggcagcag

SEQ ID NO: 2472039 - DNA, 20 bp, Homo sapiens
cttgggggtcctcctccagg

SEQ ID NO: 2472040 - DNA, 21 bp, Homo sapiens
cttgggggtcctcctccaggg

SEQ ID NO: 2472041 - DNA, 23 bp, Homo sapiens
cttgggggtcctcctccagggac

SEQ ID NO: 2472042 - DNA, 18 bp, Homo sapiens
cttgggggttcaggcccg

SEQ ID NO: 2472043 - DNA, 15 bp, Homo sapiens
cttgggttagaccta

SEQ ID NO: 2472044 - DNA, 15 bp, Homo sapiens
cttggtccttgattt

SEQ ID NO: 2472045 - DNA, 13 bp, Homo sapiens
cttggttccccca

SEQ ID NO: 2472046 - DNA, 23 bp, Homo sapiens
cttggttcttgaggggaccagga

SEQ ID NO: 2472047 - DNA, 21 bp, Homo sapiens
cttggtttttactgctctgag

SEQ ID NO: 2472048 - DNA, 13 bp, Homo sapiens
cttgtaaatataa

SEQ ID NO: 2472049 - DNA, 16 bp, Homo sapiens
cttgtaaatataaaga

SEQ ID NO: 2472050 - DNA, 19 bp, Homo sapiens
cttgtaaatataaagacgt

SEQ ID NO: 2472051 - DNA, 16 bp, Homo sapiens
cttgtaactaaaataa

SEQ ID NO: 2472052 - DNA, 23 bp, Homo sapiens
cttgtaattctaaatgaatgttt

SEQ ID NO: 2472053 - DNA, 16 bp, Homo sapiens
cttgtagccagccggg

SEQ ID NO: 2472054 - DNA, 14 bp, Homo sapiens
cttgtagctcctcc

SEQ ID NO: 2472055 - DNA, 16 bp, Homo sapiens
cttgtagctcctcccc

SEQ ID NO: 2472056 - DNA, 19 bp, Homo sapiens
cttgtagctcctcccctgg

SEQ ID NO: 2472057 - DNA, 19 bp, Homo sapiens
cttgtataagatcctagat

SEQ ID NO: 2472058 - DNA, 23 bp, Homo sapiens
cttgtatattttaagaaataaca

SEQ ID NO: 2472059 - DNA, 18 bp, Homo sapiens
cttgtatcccctgcaggc

SEQ ID NO: 2472060 - DNA, 21 bp, Homo sapiens
cttgtcaggagtgtgtgtgag

SEQ ID NO: 2472061 - DNA, 18 bp, Homo sapiens
cttgtcattttttttctt

SEQ ID NO: 2472062 - DNA, 17 bp, Homo sapiens
cttgtcctagcacagat

SEQ ID NO: 2472063 - DNA, 16 bp, Homo sapiens
cttgtccttagcctgg

SEQ ID NO: 2472064 - DNA, 22 bp, Homo sapiens
cttgtctcttgcctgccactgt

SEQ ID NO: 2472065 - DNA, 20 bp, Homo sapiens
cttgtgatgtcatacagaga

SEQ ID NO: 2472066 - DNA, 22 bp, Homo sapiens
cttgtgatgtcatacagagaag

SEQ ID NO: 2472067 - DNA, 12 bp, Homo sapiens
cttgtggggcct

SEQ ID NO: 2472068 - DNA, 21 bp, Homo sapiens
cttgtgtgtatgcacatgaac

SEQ ID NO: 2472069 - DNA, 13 bp, Homo sapiens
cttgtgttggctg

SEQ ID NO: 2472070 - DNA, 14 bp, Homo sapiens
cttgtgttggctgt

SEQ ID NO: 2472071 - DNA, 19 bp, Homo sapiens
cttgttgagccgtgggcaa

SEQ ID NO: 2472072 - DNA, 16 bp, Homo sapiens
cttgtttacatgctta

SEQ ID NO: 2472073 - DNA, 21 bp, Homo sapiens
cttgtttacatgcttattcca

SEQ ID NO: 2472074 - DNA, 17 bp, Homo sapiens
cttgtttggggcaggag

SEQ ID NO: 2472075 - DNA, 19 bp, Homo sapiens
cttgtttggggcaggagta

SEQ ID NO: 2472076 - DNA, 17 bp, Homo sapiens
ctttaaaatatctacat

SEQ ID NO: 2472077 - DNA, 21 bp, Homo sapiens
ctttaaaatgtaaagccatgc

SEQ ID NO: 2472078 - DNA, 13 bp, Homo sapiens
ctttaaagttctt

SEQ ID NO: 2472079 - DNA, 13 bp, Homo sapiens
ctttaaattgtgt

SEQ ID NO: 2472080 - DNA, 15 bp, Homo sapiens
ctttaacaacatgtt

SEQ ID NO: 2472081 - DNA, 16 bp, Homo sapiens
ctttaacaacatgttt

SEQ ID NO: 2472082 - DNA, 19 bp, Homo sapiens
ctttaacaacatgtttcca

SEQ ID NO: 2472083 - DNA, 18 bp, Homo sapiens
ctttaacagaaactttca

SEQ ID NO: 2472084 - DNA, 17 bp, Homo sapiens
ctttaactcccattacc

SEQ ID NO: 2472085 - DNA, 23 bp, Homo sapiens
ctttaactgccgtaatttaactt

SEQ ID NO: 2472086 - DNA, 15 bp, Homo sapiens
ctttaacttaaatag

SEQ ID NO: 2472087 - DNA, 15 bp, Homo sapiens
ctttaagagtttaaa

SEQ ID NO: 2472088 - DNA, 14 bp, Homo sapiens
ctttaatataaatg

SEQ ID NO: 2472089 - DNA, 20 bp, Homo sapiens
ctttaatataaatgcaaata

SEQ ID NO: 2472090 - DNA, 16 bp, Homo sapiens
ctttaatgatatgctt

SEQ ID NO: 2472091 - DNA, 13 bp, Homo sapiens
ctttaatgttttt

SEQ ID NO: 2472092 - DNA, 21 bp, Homo sapiens
ctttaatgttttttgccacag

SEQ ID NO: 2472093 - DNA, 16 bp, Homo sapiens
ctttacaaaacaaact

SEQ ID NO: 2472094 - DNA, 16 bp, Homo sapiens
ctttaccaaagatgaa

SEQ ID NO: 2472095 - DNA, 21 bp, Homo sapiens
ctttactgtaatataaagtat

SEQ ID NO: 2472096 - DNA, 20 bp, Homo sapiens
ctttactgtgcttatttttt

SEQ ID NO: 2472097 - DNA, 23 bp, Homo sapiens
ctttagaaacagtgcaacactgg

SEQ ID NO: 2472098 - DNA, 14 bp, Homo sapiens
ctttagaagcctgc

SEQ ID NO: 2472099 - DNA, 15 bp, Homo sapiens
ctttagaagcctgca

SEQ ID NO: 2472100 - DNA, 15 bp, Homo sapiens
ctttagaatcccagc

SEQ ID NO: 2472101 - DNA, 22 bp, Homo sapiens
ctttagagaagtatacataagt

SEQ ID NO: 2472102 - DNA, 15 bp, Homo sapiens
ctttagatctctgaa

SEQ ID NO: 2472103 - DNA, 18 bp, Homo sapiens
ctttataactaacatgtc

SEQ ID NO: 2472104 - DNA, 18 bp, Homo sapiens
ctttataagaaagcctga

SEQ ID NO: 2472105 - DNA, 14 bp, Homo sapiens
ctttatacagctgt

SEQ ID NO: 2472106 - DNA, 20 bp, Homo sapiens
ctttcaagcagtcgtgcctg

SEQ ID NO: 2472107 - DNA, 18 bp, Homo sapiens
ctttcaatacagatatat

SEQ ID NO: 2472108 - DNA, 19 bp, Homo sapiens
ctttcaatacagatatatt

SEQ ID NO: 2472109 - DNA, 20 bp, Homo sapiens
ctttcactaaaacacacagg

SEQ ID NO: 2472110 - DNA, 14 bp, Homo sapiens
ctttcagaatatgt

SEQ ID NO: 2472111 - DNA, 21 bp, Homo sapiens
ctttcagaatatgtcagtgct

SEQ ID NO: 2472112 - DNA, 15 bp, Homo sapiens
ctttcagctcctgac

SEQ ID NO: 2472113 - DNA, 21 bp, Homo sapiens
ctttcagctcctgaccagttg

SEQ ID NO: 2472114 - DNA, 12 bp, Homo sapiens
ctttcagctgtc

SEQ ID NO: 2472115 - DNA, 22 bp, Homo sapiens
ctttcagctgtcttttggagga

SEQ ID NO: 2472116 - DNA, 13 bp, Homo sapiens
ctttcatatagtt

SEQ ID NO: 2472117 - DNA, 16 bp, Homo sapiens
ctttcatattttaaac

SEQ ID NO: 2472118 - DNA, 19 bp, Homo sapiens
ctttcatattttaaacaga

SEQ ID NO: 2472119 - DNA, 23 bp, Homo sapiens
ctttcatattttaaacagaggat

SEQ ID NO: 2472120 - DNA, 16 bp, Homo sapiens
ctttcatcacactggg

SEQ ID NO: 2472121 - DNA, 14 bp, Homo sapiens
ctttcatttgcttt

SEQ ID NO: 2472122 - DNA, 15 bp, Homo sapiens
ctttccaccacagcc

SEQ ID NO: 2472123 - DNA, 22 bp, Homo sapiens
ctttccaccacagccagcacct

SEQ ID NO: 2472124 - DNA, 20 bp, Homo sapiens
ctttccataaatccttgatg

SEQ ID NO: 2472125 - DNA, 22 bp, Homo sapiens
ctttccatccatggccagcagc

SEQ ID NO: 2472126 - DNA, 18 bp, Homo sapiens
ctttccattggatctcat

SEQ ID NO: 2472127 - DNA, 21 bp, Homo sapiens
ctttcccaccccaacctgctc

SEQ ID NO: 2472128 - DNA, 23 bp, Homo sapiens
ctttcccaccccaacctgctctc

SEQ ID NO: 2472129 - DNA, 22 bp, Homo sapiens
ctttcccaccccacgccttatc

SEQ ID NO: 2472130 - DNA, 19 bp, Homo sapiens
ctttccccaccagatgctg

SEQ ID NO: 2472131 - DNA, 22 bp, Homo sapiens
ctttccccaccagatgctgaaa

SEQ ID NO: 2472132 - DNA, 13 bp, Homo sapiens
ctttccctaccct

SEQ ID NO: 2472133 - DNA, 15 bp, Homo sapiens
ctttccctaccctct

SEQ ID NO: 2472134 - DNA, 13 bp, Homo sapiens
ctttccctctggg

SEQ ID NO: 2472135 - DNA, 13 bp, Homo sapiens
ctttccctggtcc

SEQ ID NO: 2472136 - DNA, 21 bp, Homo sapiens
ctttcctgcaactcaaggact

SEQ ID NO: 2472137 - DNA, 18 bp, Homo sapiens
ctttcctgccccaggcct

SEQ ID NO: 2472138 - DNA, 20 bp, Homo sapiens
ctttcctggacactcagacc

SEQ ID NO: 2472139 - DNA, 14 bp, Homo sapiens
ctttcgggccatgt

SEQ ID NO: 2472140 - DNA, 20 bp, Homo sapiens
ctttcgggccatgttgcccc

SEQ ID NO: 2472141 - DNA, 12 bp, Homo sapiens
ctttctctgagg

SEQ ID NO: 2472142 - DNA, 18 bp, Homo sapiens
ctttctctgccagtgaca

SEQ ID NO: 2472143 - DNA, 15 bp, Homo sapiens
ctttctgaacagctg

SEQ ID NO: 2472144 - DNA, 17 bp, Homo sapiens
ctttctgaacagctggt

SEQ ID NO: 2472145 - DNA, 18 bp, Homo sapiens
ctttctgaacagctggtg

SEQ ID NO: 2472146 - DNA, 20 bp, Homo sapiens
ctttctgaacagctggtgta

SEQ ID NO: 2472147 - DNA, 21 bp, Homo sapiens
ctttctgaacagctggtgtag

SEQ ID NO: 2472148 - DNA, 17 bp, Homo sapiens
ctttctgaattgcacat

SEQ ID NO: 2472149 - DNA, 11 bp, Homo sapiens
ctttctgcctg

SEQ ID NO: 2472150 - DNA, 13 bp, Homo sapiens
ctttctgttccaa

SEQ ID NO: 2472151 - DNA, 16 bp, Homo sapiens
ctttctgttccaaatt

SEQ ID NO: 2472152 - DNA, 15 bp, Homo sapiens
ctttctttattttga

SEQ ID NO: 2472153 - DNA, 13 bp, Homo sapiens
ctttctttcttta

SEQ ID NO: 2472154 - DNA, 18 bp, Homo sapiens
ctttctttgtttggctgg

SEQ ID NO: 2472155 - DNA, 22 bp, Homo sapiens
ctttcttttctggaatgtaatc

SEQ ID NO: 2472156 - DNA, 19 bp, Homo sapiens
ctttcttttttggccatct

SEQ ID NO: 2472157 - DNA, 20 bp, Homo sapiens
ctttgaaattatgtaaatta

SEQ ID NO: 2472158 - DNA, 11 bp, Homo sapiens
ctttgaataaa

SEQ ID NO: 2472159 - DNA, 14 bp, Homo sapiens
ctttgaatgtgttt

SEQ ID NO: 2472160 - DNA, 16 bp, Homo sapiens
ctttgaatgtgtttca

SEQ ID NO: 2472161 - DNA, 21 bp, Homo sapiens
ctttgacaattactcaggttt

SEQ ID NO: 2472162 - DNA, 13 bp, Homo sapiens
ctttgactcagga

SEQ ID NO: 2472163 - DNA, 21 bp, Homo sapiens
ctttgactcttttgccattaa

SEQ ID NO: 2472164 - DNA, 18 bp, Homo sapiens
ctttgagagagaaaggac

SEQ ID NO: 2472165 - DNA, 21 bp, Homo sapiens
ctttgagtgcagtcctgatca

SEQ ID NO: 2472166 - DNA, 14 bp, Homo sapiens
ctttgatgttcctt

SEQ ID NO: 2472167 - DNA, 22 bp, Homo sapiens
ctttgcacgtgctgtttgctgt

SEQ ID NO: 2472168 - DNA, 16 bp, Homo sapiens
ctttgcatctcagtat

SEQ ID NO: 2472169 - DNA, 16 bp, Homo sapiens
ctttgcccttctttct

SEQ ID NO: 2472170 - DNA, 15 bp, Homo sapiens
ctttgcgctcctggc

SEQ ID NO: 2472171 - DNA, 17 bp, Homo sapiens
ctttgctgtgaggctgt

SEQ ID NO: 2472172 - DNA, 16 bp, Homo sapiens
ctttgctttaatataa

SEQ ID NO: 2472173 - DNA, 18 bp, Homo sapiens
ctttgctttaatataaat

SEQ ID NO: 2472174 - DNA, 14 bp, Homo sapiens
ctttggaaccagac

SEQ ID NO: 2472175 - DNA, 16 bp, Homo sapiens
ctttggaaccagactc

SEQ ID NO: 2472176 - DNA, 20 bp, Homo sapiens
ctttggaagtttagctctga

SEQ ID NO: 2472177 - DNA, 21 bp, Homo sapiens
ctttggaagtttagctctgag

SEQ ID NO: 2472178 - DNA, 20 bp, Homo sapiens
ctttggacctaaatggcctc

SEQ ID NO: 2472179 - DNA, 14 bp, Homo sapiens
ctttggagtcccct

SEQ ID NO: 2472180 - DNA, 18 bp, Homo sapiens
ctttggagtcccctcacc

SEQ ID NO: 2472181 - DNA, 22 bp, Homo sapiens
ctttggagtcccctcacctcct

SEQ ID NO: 2472182 - DNA, 15 bp, Homo sapiens
ctttggctcccctgt

SEQ ID NO: 2472183 - DNA, 21 bp, Homo sapiens
ctttgggccagacatgccaca

SEQ ID NO: 2472184 - DNA, 18 bp, Homo sapiens
ctttgggcttcagctgcc

SEQ ID NO: 2472185 - DNA, 21 bp, Homo sapiens
ctttgggcttcagctgccagt

SEQ ID NO: 2472186 - DNA, 20 bp, Homo sapiens
ctttggtaccagataacttt

SEQ ID NO: 2472187 - DNA, 15 bp, Homo sapiens
ctttggtctcttgct

SEQ ID NO: 2472188 - DNA, 16 bp, Homo sapiens
ctttggttctaaggac

SEQ ID NO: 2472189 - DNA, 15 bp, Homo sapiens
ctttgtcccggggct

SEQ ID NO: 2472190 - DNA, 18 bp, Homo sapiens
ctttgtgcacatttattt

SEQ ID NO: 2472191 - DNA, 16 bp, Homo sapiens
ctttgttccccactgg

SEQ ID NO: 2472192 - DNA, 18 bp, Homo sapiens
ctttgttccccactggag

SEQ ID NO: 2472193 - DNA, 19 bp, Homo sapiens
ctttgttccccactggagc

SEQ ID NO: 2472194 - DNA, 22 bp, Homo sapiens
ctttgttccccactggagcaga

SEQ ID NO: 2472195 - DNA, 17 bp, Homo sapiens
ctttgttttgtgtctct

SEQ ID NO: 2472196 - DNA, 18 bp, Homo sapiens
ctttgttttgtgtctctt

SEQ ID NO: 2472197 - DNA, 15 bp, Homo sapiens
cttttaaaagatttt

SEQ ID NO: 2472198 - DNA, 15 bp, Homo sapiens
cttttaccctggccc

SEQ ID NO: 2472199 - DNA, 22 bp, Homo sapiens
cttttaccctggcccctctccc

SEQ ID NO: 2472200 - DNA, 21 bp, Homo sapiens
cttttagtaaagtcaaggaga

SEQ ID NO: 2472201 - DNA, 12 bp, Homo sapiens
cttttatactct

SEQ ID NO: 2472202 - DNA, 17 bp, Homo sapiens
cttttatactctttctg

SEQ ID NO: 2472203 - DNA, 20 bp, Homo sapiens
cttttatactctttctgtat

SEQ ID NO: 2472204 - DNA, 15 bp, Homo sapiens
cttttatactgacac

SEQ ID NO: 2472205 - DNA, 14 bp, Homo sapiens
cttttatatcccat

SEQ ID NO: 2472206 - DNA, 22 bp, Homo sapiens
cttttatcccaaagttgttgta

SEQ ID NO: 2472207 - DNA, 15 bp, Homo sapiens
cttttatgtagtaat

SEQ ID NO: 2472208 - DNA, 18 bp, Homo sapiens
cttttatgtagtaattga

SEQ ID NO: 2472209 - DNA, 22 bp, Homo sapiens
cttttatgtagtaattgacatg

SEQ ID NO: 2472210 - DNA, 14 bp, Homo sapiens
cttttcaaaggtac

SEQ ID NO: 2472211 - DNA, 19 bp, Homo sapiens
cttttcaaaggtacttgga

SEQ ID NO: 2472212 - DNA, 20 bp, Homo sapiens
cttttcataggtctgaaatt

SEQ ID NO: 2472213 - DNA, 22 bp, Homo sapiens
cttttcccaaaatgttgaaata

SEQ ID NO: 2472214 - DNA, 13 bp, Homo sapiens
cttttcccactcc

SEQ ID NO: 2472215 - DNA, 17 bp, Homo sapiens
cttttcccactccaagc

SEQ ID NO: 2472216 - DNA, 20 bp, Homo sapiens
cttttccctctttggctccc

SEQ ID NO: 2472217 - DNA, 13 bp, Homo sapiens
cttttctgtaatt

SEQ ID NO: 2472218 - DNA, 14 bp, Homo sapiens
cttttctgtaattc

SEQ ID NO: 2472219 - DNA, 17 bp, Homo sapiens
cttttctgttctagttt

SEQ ID NO: 2472220 - DNA, 17 bp, Homo sapiens
cttttgacaaaggcaag

SEQ ID NO: 2472221 - DNA, 23 bp, Homo sapiens
cttttgatatgcatatttgttta

SEQ ID NO: 2472222 - DNA, 13 bp, Homo sapiens
cttttgatattaa

SEQ ID NO: 2472223 - DNA, 18 bp, Homo sapiens
cttttgcaacttaatact

SEQ ID NO: 2472224 - DNA, 16 bp, Homo sapiens
cttttgcccattttga

SEQ ID NO: 2472225 - DNA, 17 bp, Homo sapiens
cttttgcccattttgaa

SEQ ID NO: 2472226 - DNA, 15 bp, Homo sapiens
cttttgcttttggca

SEQ ID NO: 2472227 - DNA, 19 bp, Homo sapiens
cttttgggtttctgccctg

SEQ ID NO: 2472228 - DNA, 21 bp, Homo sapiens
cttttggttatgaatactttg

SEQ ID NO: 2472229 - DNA, 12 bp, Homo sapiens
cttttgtattaa

SEQ ID NO: 2472230 - DNA, 19 bp, Homo sapiens
cttttgtgggggactgtaa

SEQ ID NO: 2472231 - DNA, 13 bp, Homo sapiens
cttttgttcgcat

SEQ ID NO: 2472232 - DNA, 19 bp, Homo sapiens
ctttttaaaaatagacact

SEQ ID NO: 2472233 - DNA, 16 bp, Homo sapiens
ctttttatttctgcat

SEQ ID NO: 2472234 - DNA, 21 bp, Homo sapiens
ctttttctccagctgggctct

SEQ ID NO: 2472235 - DNA, 16 bp, Homo sapiens
ctttttgaagtattta

SEQ ID NO: 2472236 - DNA, 13 bp, Homo sapiens
ctttttgctttcg

SEQ ID NO: 2472237 - DNA, 21 bp, Homo sapiens
ctttttgttctggtccttttt

SEQ ID NO: 2472238 - DNA, 12 bp, Homo sapiens
cttttttcccca

SEQ ID NO: 2472239 - DNA, 16 bp, Homo sapiens
ctttttttagagaagt

SEQ ID NO: 2472240 - DNA, 16 bp, Homo sapiens
ctttttttctgtacca

SEQ ID NO: 2472241 - DNA, 19 bp, Homo sapiens
ctttttttctgtaccagtt

SEQ ID NO: 2472242 - DNA, 12 bp, Homo sapiens
ctttttttgtat

SEQ ID NO: 2472243 - DNA, 17 bp, Homo sapiens
cttttttttctatttca

SEQ ID NO: 2472244 - DNA, 23 bp, Homo sapiens
cttttttttttctttataagaaa

SEQ ID NO: 2472245 - DNA, 21 bp, Homo sapiens
ctttttttttttttaataaat

SEQ ID NO: 2472246 - DNA, 16 bp, Homo sapiens
gaaaaaaattgaaatg

SEQ ID NO: 2472247 - DNA, 12 bp, Homo sapiens
gaaaaaatatat

SEQ ID NO: 2472248 - DNA, 13 bp, Homo sapiens
gaaaaacaggcac

SEQ ID NO: 2472249 - DNA, 11 bp, Homo sapiens
gaaaaacaggt

SEQ ID NO: 2472250 - DNA, 14 bp, Homo sapiens
gaaaaataaagaaa

SEQ ID NO: 2472251 - DNA, 16 bp, Homo sapiens
gaaaaatatgtaccaa

SEQ ID NO: 2472252 - DNA, 14 bp, Homo sapiens
gaaaacaaggaagt

SEQ ID NO: 2472253 - DNA, 14 bp, Homo sapiens
gaaaacactgtgca

SEQ ID NO: 2472254 - DNA, 15 bp, Homo sapiens
gaaaaccagctcagc

SEQ ID NO: 2472255 - DNA, 17 bp, Homo sapiens
gaaaacccttgggccag

SEQ ID NO: 2472256 - DNA, 20 bp, Homo sapiens
gaaaacccttgggccagaag

SEQ ID NO: 2472257 - DNA, 21 bp, Homo sapiens
gaaaacccttgggccagaagt

SEQ ID NO: 2472258 - DNA, 21 bp, Homo sapiens
gaaaagacacattttttagga

SEQ ID NO: 2472259 - DNA, 23 bp, Homo sapiens
gaaaagcatggcttgaataagga

SEQ ID NO: 2472260 - DNA, 23 bp, Homo sapiens
gaaaagcttagctttagaaacag

SEQ ID NO: 2472261 - DNA, 13 bp, Homo sapiens
gaaaaggcctggg

SEQ ID NO: 2472262 - DNA, 19 bp, Homo sapiens
gaaaataagagctcaggat

SEQ ID NO: 2472263 - DNA, 15 bp, Homo sapiens
gaaaatcaaatggta

SEQ ID NO: 2472264 - DNA, 16 bp, Homo sapiens
gaaaatgaattttttc

SEQ ID NO: 2472265 - DNA, 23 bp, Homo sapiens
gaaaatggtccaattagtttcct

SEQ ID NO: 2472266 - DNA, 22 bp, Homo sapiens
gaaaatggtcgagaaagaggca

SEQ ID NO: 2472267 - DNA, 17 bp, Homo sapiens
gaaaatgtccttgtgat

SEQ ID NO: 2472268 - DNA, 17 bp, Homo sapiens
gaaaatgttgagaatcc

SEQ ID NO: 2472269 - DNA, 14 bp, Homo sapiens
gaaaattagactgt

SEQ ID NO: 2472270 - DNA, 15 bp, Homo sapiens
gaaaattatttgcat

SEQ ID NO: 2472271 - DNA, 12 bp, Homo sapiens
gaaacaaagatg

SEQ ID NO: 2472272 - DNA, 16 bp, Homo sapiens
gaaacaaccatgtcat

SEQ ID NO: 2472273 - DNA, 13 bp, Homo sapiens
gaaacacagaaac

SEQ ID NO: 2472274 - DNA, 17 bp, Homo sapiens
gaaacagcatctccaag

SEQ ID NO: 2472275 - DNA, 13 bp, Homo sapiens
gaaaccagcttcc

SEQ ID NO: 2472276 - DNA, 17 bp, Homo sapiens
gaaaccagcttccttca

SEQ ID NO: 2472277 - DNA, 19 bp, Homo sapiens
gaaaccagcttccttcaga

SEQ ID NO: 2472278 - DNA, 21 bp, Homo sapiens
gaaaccagcttccttcagaga

SEQ ID NO: 2472279 - DNA, 23 bp, Homo sapiens
gaaaccagcttccttcagagagc

SEQ ID NO: 2472280 - DNA, 16 bp, Homo sapiens
gaaacccttgctgctt

SEQ ID NO: 2472281 - DNA, 18 bp, Homo sapiens
gaaacccttgctgcttta

SEQ ID NO: 2472282 - DNA, 19 bp, Homo sapiens
gaaacctactgcccaggca

SEQ ID NO: 2472283 - DNA, 21 bp, Homo sapiens
gaaacgagactttccattaca

SEQ ID NO: 2472284 - DNA, 23 bp, Homo sapiens
gaaacgagactttccattacaag

SEQ ID NO: 2472285 - DNA, 16 bp, Homo sapiens
gaaacgtcttctaaac

SEQ ID NO: 2472286 - DNA, 15 bp, Homo sapiens
gaaactccagatgcc

SEQ ID NO: 2472287 - DNA, 15 bp, Homo sapiens
gaaactgcagggaaa

SEQ ID NO: 2472288 - DNA, 17 bp, Homo sapiens
gaaacttttttatttaa

SEQ ID NO: 2472289 - DNA, 20 bp, Homo sapiens
gaaagaacgctgatttaaag

SEQ ID NO: 2472290 - DNA, 15 bp, Homo sapiens
gaaagacgcactttg

SEQ ID NO: 2472291 - DNA, 19 bp, Homo sapiens
gaaagacgcactttggctt

SEQ ID NO: 2472292 - DNA, 20 bp, Homo sapiens
gaaagaggctgaggcctgga

SEQ ID NO: 2472293 - DNA, 21 bp, Homo sapiens
gaaagaggctgaggcctggac

SEQ ID NO: 2472294 - DNA, 22 bp, Homo sapiens
gaaagaggctgaggcctggact

SEQ ID NO: 2472295 - DNA, 21 bp, Homo sapiens
gaaagaggtgaccccagggca

SEQ ID NO: 2472296 - DNA, 14 bp, Homo sapiens
gaaagataactagg

SEQ ID NO: 2472297 - DNA, 12 bp, Homo sapiens
gaaagcaaagca

SEQ ID NO: 2472298 - DNA, 15 bp, Homo sapiens
gaaagcaaagcacag

SEQ ID NO: 2472299 - DNA, 18 bp, Homo sapiens
gaaagcaaagcacagaga

SEQ ID NO: 2472300 - DNA, 18 bp, Homo sapiens
gaaagccccacccaggcc

SEQ ID NO: 2472301 - DNA, 21 bp, Homo sapiens
gaaagccccacccaggccagg

SEQ ID NO: 2472302 - DNA, 14 bp, Homo sapiens
gaaagcccctgccc

SEQ ID NO: 2472303 - DNA, 13 bp, Homo sapiens
gaaagctctagaa

SEQ ID NO: 2472304 - DNA, 16 bp, Homo sapiens
gaaagctgacttggct

SEQ ID NO: 2472305 - DNA, 19 bp, Homo sapiens
gaaagctgacttggctggt

SEQ ID NO: 2472306 - DNA, 23 bp, Homo sapiens
gaaaggaagcattgtaaaataat

SEQ ID NO: 2472307 - DNA, 22 bp, Homo sapiens
gaaaggctgttaaatacaggaa

SEQ ID NO: 2472308 - DNA, 15 bp, Homo sapiens
gaaagggagggctct

SEQ ID NO: 2472309 - DNA, 16 bp, Homo sapiens
gaaagggagggctctg

SEQ ID NO: 2472310 - DNA, 21 bp, Homo sapiens
gaaagggagggctctgaggcg

SEQ ID NO: 2472311 - DNA, 15 bp, Homo sapiens
gaaaggggagcccac

SEQ ID NO: 2472312 - DNA, 13 bp, Homo sapiens
gaaagtctgtcct

SEQ ID NO: 2472313 - DNA, 16 bp, Homo sapiens
gaaagtctgtccttga

SEQ ID NO: 2472314 - DNA, 23 bp, Homo sapiens
gaaagtctgtccttgaaggacta

SEQ ID NO: 2472315 - DNA, 21 bp, Homo sapiens
gaaagtgcctttcaggatcta

SEQ ID NO: 2472316 - DNA, 15 bp, Homo sapiens
gaaagtgtatttgga

SEQ ID NO: 2472317 - DNA, 23 bp, Homo sapiens
gaaagtgtatttggaaataaagt

SEQ ID NO: 2472318 - DNA, 17 bp, Homo sapiens
gaaataaaaggaagcca

SEQ ID NO: 2472319 - DNA, 23 bp, Homo sapiens
gaaataaaaggaagccaaagagt

SEQ ID NO: 2472320 - DNA, 15 bp, Homo sapiens
gaaataagctatttg

SEQ ID NO: 2472321 - DNA, 22 bp, Homo sapiens
gaaataattgttgttctgttaa

SEQ ID NO: 2472322 - DNA, 13 bp, Homo sapiens
gaaatacaaaaat

SEQ ID NO: 2472323 - DNA, 14 bp, Homo sapiens
gaaatacaaaaata

SEQ ID NO: 2472324 - DNA, 17 bp, Homo sapiens
gaaatactactgtgtaa

SEQ ID NO: 2472325 - DNA, 16 bp, Homo sapiens
gaaatagaattataac

SEQ ID NO: 2472326 - DNA, 19 bp, Homo sapiens
gaaatagcttatgaaaaga

SEQ ID NO: 2472327 - DNA, 11 bp, Homo sapiens
gaaatatatat

SEQ ID NO: 2472328 - DNA, 14 bp, Homo sapiens
gaaatatatattat

SEQ ID NO: 2472329 - DNA, 15 bp, Homo sapiens
gaaatattccctaga

SEQ ID NO: 2472330 - DNA, 14 bp, Homo sapiens
gaaatcccttcata

SEQ ID NO: 2472331 - DNA, 19 bp, Homo sapiens
gaaatcccttcatacttga

SEQ ID NO: 2472332 - DNA, 20 bp, Homo sapiens
gaaatcccttcatacttgaa

SEQ ID NO: 2472333 - DNA, 21 bp, Homo sapiens
gaaatctagttatttacagga

SEQ ID NO: 2472334 - DNA, 23 bp, Homo sapiens
gaaatctggcttctggccaggaa

SEQ ID NO: 2472335 - DNA, 20 bp, Homo sapiens
gaaatctgtgcctgagaaca

SEQ ID NO: 2472336 - DNA, 18 bp, Homo sapiens
gaaatggtactgtacagc

SEQ ID NO: 2472337 - DNA, 21 bp, Homo sapiens
gaaatgtttttaataaaagaa

SEQ ID NO: 2472338 - DNA, 15 bp, Homo sapiens
gaaattacctgtgga

SEQ ID NO: 2472339 - DNA, 17 bp, Homo sapiens
gaaattacctgtggata

SEQ ID NO: 2472340 - DNA, 19 bp, Homo sapiens
gaaattacctgtggatatt

SEQ ID NO: 2472341 - DNA, 14 bp, Homo sapiens
gaaattctcctgga

SEQ ID NO: 2472342 - DNA, 17 bp, Homo sapiens
gaaattctcctggaggt

SEQ ID NO: 2472343 - DNA, 22 bp, Homo sapiens
gaaattctttcccagtctgtcg

SEQ ID NO: 2472344 - DNA, 21 bp, Homo sapiens
gaaattgaacctttgtgccct

SEQ ID NO: 2472345 - DNA, 16 bp, Homo sapiens
gaaattgaatactttg

SEQ ID NO: 2472346 - DNA, 18 bp, Homo sapiens
gaaattgaatactttgaa

SEQ ID NO: 2472347 - DNA, 21 bp, Homo sapiens
gaaattgaatactttgaatgt

SEQ ID NO: 2472348 - DNA, 13 bp, Homo sapiens
gaaattgtatatt

SEQ ID NO: 2472349 - DNA, 14 bp, Homo sapiens
gaaatttaaactat

SEQ ID NO: 2472350 - DNA, 18 bp, Homo sapiens
gaaatttagcattgtagt

SEQ ID NO: 2472351 - DNA, 16 bp, Homo sapiens
gaacaaagcagccacg

SEQ ID NO: 2472352 - DNA, 19 bp, Homo sapiens
gaacaaagcagccacgagg

SEQ ID NO: 2472353 - DNA, 23 bp, Homo sapiens
gaacaaatgtttattaagcatca

SEQ ID NO: 2472354 - DNA, 13 bp, Homo sapiens
gaacaattgaagt

SEQ ID NO: 2472355 - DNA, 17 bp, Homo sapiens
gaacaattgaagtaaac

SEQ ID NO: 2472356 - DNA, 19 bp, Homo sapiens
gaacaatttggcaattttg

SEQ ID NO: 2472357 - DNA, 17 bp, Homo sapiens
gaacacaaactgtaaat

SEQ ID NO: 2472358 - DNA, 19 bp, Homo sapiens
gaacaccattgaaggctta

SEQ ID NO: 2472359 - DNA, 22 bp, Homo sapiens
gaacacggccacatcaaagagg

SEQ ID NO: 2472360 - DNA, 13 bp, Homo sapiens
gaacactggggac

SEQ ID NO: 2472361 - DNA, 19 bp, Homo sapiens
gaacagctggtgtagctac

SEQ ID NO: 2472362 - DNA, 15 bp, Homo sapiens
gaacagctgtaatct

SEQ ID NO: 2472363 - DNA, 17 bp, Homo sapiens
gaacagtgtgcaaggca

SEQ ID NO: 2472364 - DNA, 17 bp, Homo sapiens
gaacatccctttttcaa

SEQ ID NO: 2472365 - DNA, 16 bp, Homo sapiens
gaaccattaaccagat

SEQ ID NO: 2472366 - DNA, 19 bp, Homo sapiens
gaacccagactcagacatt

SEQ ID NO: 2472367 - DNA, 12 bp, Homo sapiens
gaacccaggaca

SEQ ID NO: 2472368 - DNA, 16 bp, Homo sapiens
gaacccaggacaagca

SEQ ID NO: 2472369 - DNA, 19 bp, Homo sapiens
gaacccaggacaagcatgg

SEQ ID NO: 2472370 - DNA, 20 bp, Homo sapiens
gaaccccggggtgcccacag

SEQ ID NO: 2472371 - DNA, 14 bp, Homo sapiens
gaacccctttccca

SEQ ID NO: 2472372 - DNA, 19 bp, Homo sapiens
gaaccctctgttccttccc

SEQ ID NO: 2472373 - DNA, 19 bp, Homo sapiens
gaacctacagttttaactg

SEQ ID NO: 2472374 - DNA, 13 bp, Homo sapiens
gaacctcagcctg

SEQ ID NO: 2472375 - DNA, 14 bp, Homo sapiens
gaacctcagcctgg

SEQ ID NO: 2472376 - DNA, 18 bp, Homo sapiens
gaacctcagcctggccag

SEQ ID NO: 2472377 - DNA, 11 bp, Homo sapiens
gaacctggcct

SEQ ID NO: 2472378 - DNA, 14 bp, Homo sapiens
gaacctggccttca

SEQ ID NO: 2472379 - DNA, 19 bp, Homo sapiens
gaacctttgtgccctatca

SEQ ID NO: 2472380 - DNA, 15 bp, Homo sapiens
gaacgttttctaatt

SEQ ID NO: 2472381 - DNA, 19 bp, Homo sapiens
gaactattttcaaagactt

SEQ ID NO: 2472382 - DNA, 22 bp, Homo sapiens
gaactcaaatggggccagatcc

SEQ ID NO: 2472383 - DNA, 23 bp, Homo sapiens
gaactcaaatggggccagatcca

SEQ ID NO: 2472384 - DNA, 13 bp, Homo sapiens
gaactcagatcca

SEQ ID NO: 2472385 - DNA, 16 bp, Homo sapiens
gaactcagatccaggg

SEQ ID NO: 2472386 - DNA, 18 bp, Homo sapiens
gaactcagatccagggac

SEQ ID NO: 2472387 - DNA, 21 bp, Homo sapiens
gaactcagatccagggacaga

SEQ ID NO: 2472388 - DNA, 14 bp, Homo sapiens
gaactctggtggca

SEQ ID NO: 2472389 - DNA, 13 bp, Homo sapiens
gaactcttaatca

SEQ ID NO: 2472390 - DNA, 12 bp, Homo sapiens
gaactgcaggcc

SEQ ID NO: 2472391 - DNA, 19 bp, Homo sapiens
gaactgcaggccctggcct

SEQ ID NO: 2472392 - DNA, 21 bp, Homo sapiens
gaactgcaggccctggcctcc

SEQ ID NO: 2472393 - DNA, 16 bp, Homo sapiens
gaactgctgccactga

SEQ ID NO: 2472394 - DNA, 16 bp, Homo sapiens
gaactggaggcaggga

SEQ ID NO: 2472395 - DNA, 16 bp, Homo sapiens
gaactggccaagctga

SEQ ID NO: 2472396 - DNA, 13 bp, Homo sapiens
gaacttcagaaag

SEQ ID NO: 2472397 - DNA, 23 bp, Homo sapiens
gaacttccaggtgttactgtaat

SEQ ID NO: 2472398 - DNA, 23 bp, Homo sapiens
gaacttgcattgtgattggcctg

SEQ ID NO: 2472399 - DNA, 16 bp, Homo sapiens
gaacttgcctgccttt

SEQ ID NO: 2472400 - DNA, 17 bp, Homo sapiens
gaacttgcctgcctttc

SEQ ID NO: 2472401 - DNA, 20 bp, Homo sapiens
gaagaaacaaggttttcagt

SEQ ID NO: 2472402 - DNA, 13 bp, Homo sapiens
gaagaactgcagg

SEQ ID NO: 2472403 - DNA, 14 bp, Homo sapiens
gaagaactgcaggc

SEQ ID NO: 2472404 - DNA, 16 bp, Homo sapiens
gaagaagggcacccta

SEQ ID NO: 2472405 - DNA, 20 bp, Homo sapiens
gaagaatgcacaagaatgga

SEQ ID NO: 2472406 - DNA, 16 bp, Homo sapiens
gaagacagaaccacag

SEQ ID NO: 2472407 - DNA, 18 bp, Homo sapiens
gaagacagaaccacaggg

SEQ ID NO: 2472408 - DNA, 20 bp, Homo sapiens
gaagacccattccttcccag

SEQ ID NO: 2472409 - DNA, 14 bp, Homo sapiens
gaagagcagcacct

SEQ ID NO: 2472410 - DNA, 18 bp, Homo sapiens
gaagagcagcacctcctc

SEQ ID NO: 2472411 - DNA, 23 bp, Homo sapiens
gaagagcaggactccaggcccaa

SEQ ID NO: 2472412 - DNA, 15 bp, Homo sapiens
gaagagccttccacc

SEQ ID NO: 2472413 - DNA, 18 bp, Homo sapiens
gaagaggaggggaagagg

SEQ ID NO: 2472414 - DNA, 23 bp, Homo sapiens
gaagagtttttgtgatgggggag

SEQ ID NO: 2472415 - DNA, 14 bp, Homo sapiens
gaagatcctgcggg

SEQ ID NO: 2472416 - DNA, 23 bp, Homo sapiens
gaagcaaatgtcatgctgcctta

SEQ ID NO: 2472417 - DNA, 20 bp, Homo sapiens
gaagcaacctcagtaattta

SEQ ID NO: 2472418 - DNA, 22 bp, Homo sapiens
gaagcagcctctccccaggtcc

SEQ ID NO: 2472419 - DNA, 12 bp, Homo sapiens
gaagcaggttcc

SEQ ID NO: 2472420 - DNA, 18 bp, Homo sapiens
gaagcattctcattggaa

SEQ ID NO: 2472421 - DNA, 20 bp, Homo sapiens
gaagccacgggtgccagaag

SEQ ID NO: 2472422 - DNA, 13 bp, Homo sapiens
gaagccagcttgt

SEQ ID NO: 2472423 - DNA, 23 bp, Homo sapiens
gaagccaggaatttcccaggacc

SEQ ID NO: 2472424 - DNA, 23 bp, Homo sapiens
gaagccatgagttccagaaagta

SEQ ID NO: 2472425 - DNA, 21 bp, Homo sapiens
gaagcccatcctgaccagctg

SEQ ID NO: 2472426 - DNA, 14 bp, Homo sapiens
gaagcccccagcta

SEQ ID NO: 2472427 - DNA, 17 bp, Homo sapiens
gaagcccccagctaaga

SEQ ID NO: 2472428 - DNA, 14 bp, Homo sapiens
gaagcccggctcct

SEQ ID NO: 2472429 - DNA, 13 bp, Homo sapiens
gaagccctcccag

SEQ ID NO: 2472430 - DNA, 15 bp, Homo sapiens
gaagccctcccaggt

SEQ ID NO: 2472431 - DNA, 21 bp, Homo sapiens
gaagcctgggggcctggctgg

SEQ ID NO: 2472432 - DNA, 19 bp, Homo sapiens
gaagccttaatttgcacag

SEQ ID NO: 2472433 - DNA, 20 bp, Homo sapiens
gaagccttaatttgcacagt

SEQ ID NO: 2472434 - DNA, 17 bp, Homo sapiens
gaagccttcaagctctg

SEQ ID NO: 2472435 - DNA, 19 bp, Homo sapiens
gaagccttcaagctctgag

SEQ ID NO: 2472436 - DNA, 23 bp, Homo sapiens
gaagccttccccttatcctccct

SEQ ID NO: 2472437 - DNA, 16 bp, Homo sapiens
gaagctaacagggaag

SEQ ID NO: 2472438 - DNA, 18 bp, Homo sapiens
gaagctaacagggaaggc

SEQ ID NO: 2472439 - DNA, 21 bp, Homo sapiens
gaagctaacagggaaggcagg

SEQ ID NO: 2472440 - DNA, 22 bp, Homo sapiens
gaagctaacagggaaggcaggc

SEQ ID NO: 2472441 - DNA, 14 bp, Homo sapiens
gaagctaatttgca

SEQ ID NO: 2472442 - DNA, 15 bp, Homo sapiens
gaagctaatttgcat

SEQ ID NO: 2472443 - DNA, 15 bp, Homo sapiens
gaagctactgtgtgt

SEQ ID NO: 2472444 - DNA, 16 bp, Homo sapiens
gaagctagtcttttgc

SEQ ID NO: 2472445 - DNA, 20 bp, Homo sapiens
gaagctcccccagcaaagcc

SEQ ID NO: 2472446 - DNA, 19 bp, Homo sapiens
gaagctcctctccccagcc

SEQ ID NO: 2472447 - DNA, 20 bp, Homo sapiens
gaagctcttggagctgtgag

SEQ ID NO: 2472448 - DNA, 19 bp, Homo sapiens
gaagcttggggaagaccca

SEQ ID NO: 2472449 - DNA, 21 bp, Homo sapiens
gaaggactatgaaaagctaga

SEQ ID NO: 2472450 - DNA, 21 bp, Homo sapiens
gaaggagccccattcctggga

SEQ ID NO: 2472451 - DNA, 18 bp, Homo sapiens
gaaggagctgcctggacc

SEQ ID NO: 2472452 - DNA, 22 bp, Homo sapiens
gaaggaggagcctgtcctgcct

SEQ ID NO: 2472453 - DNA, 16 bp, Homo sapiens
gaaggattctgctggc

SEQ ID NO: 2472454 - DNA, 15 bp, Homo sapiens
gaaggcaaagcacga

SEQ ID NO: 2472455 - DNA, 17 bp, Homo sapiens
gaaggcaggcagggctc

SEQ ID NO: 2472456 - DNA, 18 bp, Homo sapiens
gaaggcaggcagggctct

SEQ ID NO: 2472457 - DNA, 21 bp, Homo sapiens
gaaggctacttcggggctggg

SEQ ID NO: 2472458 - DNA, 17 bp, Homo sapiens
gaaggcttgggatttgc

SEQ ID NO: 2472459 - DNA, 22 bp, Homo sapiens
gaagggaataaggtacaagaag

SEQ ID NO: 2472460 - DNA, 14 bp, Homo sapiens
gaagggagccaagg

SEQ ID NO: 2472461 - DNA, 16 bp, Homo sapiens
gaagggagccaaggga

SEQ ID NO: 2472462 - DNA, 22 bp, Homo sapiens
gaagggagccaagggatggaca

SEQ ID NO: 2472463 - DNA, 14 bp, Homo sapiens
gaagggagggcaga

SEQ ID NO: 2472464 - DNA, 20 bp, Homo sapiens
gaagggagggcagagctggt

SEQ ID NO: 2472465 - DNA, 21 bp, Homo sapiens
gaagggagggcagagctggtg

SEQ ID NO: 2472466 - DNA, 16 bp, Homo sapiens
gaagggaggggctgtg

SEQ ID NO: 2472467 - DNA, 13 bp, Homo sapiens
gaagggccagagc

SEQ ID NO: 2472468 - DNA, 14 bp, Homo sapiens
gaagggccagagcc

SEQ ID NO: 2472469 - DNA, 22 bp, Homo sapiens
gaagggcctgcccagttgcact

SEQ ID NO: 2472470 - DNA, 14 bp, Homo sapiens
gaagggtaaacaat

SEQ ID NO: 2472471 - DNA, 19 bp, Homo sapiens
gaaggtgatgttgccatcc

SEQ ID NO: 2472472 - DNA, 21 bp, Homo sapiens
gaaggtgatttaagggcccag

SEQ ID NO: 2472473 - DNA, 18 bp, Homo sapiens
gaaggtgctgacggccag

SEQ ID NO: 2472474 - DNA, 19 bp, Homo sapiens
gaaggtgctgacggccagg

SEQ ID NO: 2472475 - DNA, 21 bp, Homo sapiens
gaaggtgctgacggccaggga

SEQ ID NO: 2472476 - DNA, 19 bp, Homo sapiens
gaagtaaaagcaaaaaaga

SEQ ID NO: 2472477 - DNA, 13 bp, Homo sapiens
gaagtaaactttt

SEQ ID NO: 2472478 - DNA, 14 bp, Homo sapiens
gaagtaccagacta

SEQ ID NO: 2472479 - DNA, 20 bp, Homo sapiens
gaagtagaaacaaaatacaa

SEQ ID NO: 2472480 - DNA, 15 bp, Homo sapiens
gaagtcaaagcaagg

SEQ ID NO: 2472481 - DNA, 15 bp, Homo sapiens
gaagtcacagggcag

SEQ ID NO: 2472482 - DNA, 16 bp, Homo sapiens
gaagtcacagggcagt

SEQ ID NO: 2472483 - DNA, 15 bp, Homo sapiens
gaagtcatcttgcta

SEQ ID NO: 2472484 - DNA, 14 bp, Homo sapiens
gaagtccaatgtgg

SEQ ID NO: 2472485 - DNA, 13 bp, Homo sapiens
gaagtctcagcta

SEQ ID NO: 2472486 - DNA, 18 bp, Homo sapiens
gaagtctcatctggggag

SEQ ID NO: 2472487 - DNA, 16 bp, Homo sapiens
gaagtgagcacagcct

SEQ ID NO: 2472488 - DNA, 15 bp, Homo sapiens
gaagtgtgactggct

SEQ ID NO: 2472489 - DNA, 20 bp, Homo sapiens
gaagtgtgccttctctctcc

SEQ ID NO: 2472490 - DNA, 12 bp, Homo sapiens
gaagttgctgct

SEQ ID NO: 2472491 - DNA, 11 bp, Homo sapiens
gaagtttcatc

SEQ ID NO: 2472492 - DNA, 14 bp, Homo sapiens
gaataaatgtcact

SEQ ID NO: 2472493 - DNA, 18 bp, Homo sapiens
gaataaatgtcacttttt

SEQ ID NO: 2472494 - DNA, 19 bp, Homo sapiens
gaataaggtacaagaagca

SEQ ID NO: 2472495 - DNA, 21 bp, Homo sapiens
gaataccactctgtaattgca

SEQ ID NO: 2472496 - DNA, 23 bp, Homo sapiens
gaataccactctgtaattgcaaa

SEQ ID NO: 2472497 - DNA, 17 bp, Homo sapiens
gaatactttgaatgtgt

SEQ ID NO: 2472498 - DNA, 18 bp, Homo sapiens
gaatactttgaatgtgtt

SEQ ID NO: 2472499 - DNA, 18 bp, Homo sapiens
gaatagaagctaaggttt

SEQ ID NO: 2472500 - DNA, 19 bp, Homo sapiens
gaatagatatgaaagctga

SEQ ID NO: 2472501 - DNA, 15 bp, Homo sapiens
gaatagccacatttg

SEQ ID NO: 2472502 - DNA, 23 bp, Homo sapiens
gaatagccacatttggaatactt

SEQ ID NO: 2472503 - DNA, 22 bp, Homo sapiens
gaatagctttaatgatatgctt

SEQ ID NO: 2472504 - DNA, 15 bp, Homo sapiens
gaatatctgtaatgg

SEQ ID NO: 2472505 - DNA, 17 bp, Homo sapiens
gaatcaagggtcaggcc

SEQ ID NO: 2472506 - DNA, 13 bp, Homo sapiens
gaatcatttagca

SEQ ID NO: 2472507 - DNA, 17 bp, Homo sapiens
gaatccacatttctaaa

SEQ ID NO: 2472508 - DNA, 18 bp, Homo sapiens
gaatccacatttctaaaa

SEQ ID NO: 2472509 - DNA, 22 bp, Homo sapiens
gaatcccagccccctgaccact

SEQ ID NO: 2472510 - DNA, 16 bp, Homo sapiens
gaatcccttaacagtt

SEQ ID NO: 2472511 - DNA, 16 bp, Homo sapiens
gaatcgctcctgcagc

SEQ ID NO: 2472512 - DNA, 22 bp, Homo sapiens
gaatctacccccagatccaagc

SEQ ID NO: 2472513 - DNA, 14 bp, Homo sapiens
gaatctctgtgcct

SEQ ID NO: 2472514 - DNA, 19 bp, Homo sapiens
gaatctttaaaagatgctt

SEQ ID NO: 2472515 - DNA, 19 bp, Homo sapiens
gaatgcacaagaatggatc

SEQ ID NO: 2472516 - DNA, 14 bp, Homo sapiens
gaatgccgtggatt

SEQ ID NO: 2472517 - DNA, 19 bp, Homo sapiens
gaatgctgggactcagcct

SEQ ID NO: 2472518 - DNA, 15 bp, Homo sapiens
gaatgctgtacatct

SEQ ID NO: 2472519 - DNA, 20 bp, Homo sapiens
gaatgctgtacatctatttt

SEQ ID NO: 2472520 - DNA, 14 bp, Homo sapiens
gaatgcttctaagt

SEQ ID NO: 2472521 - DNA, 19 bp, Homo sapiens
gaatggatcacaagatgga

SEQ ID NO: 2472522 - DNA, 16 bp, Homo sapiens
gaatgggtgcccacag

SEQ ID NO: 2472523 - DNA, 21 bp, Homo sapiens
gaatggtgtgggagagggatg

SEQ ID NO: 2472524 - DNA, 14 bp, Homo sapiens
gaatgtaaatttgt

SEQ ID NO: 2472525 - DNA, 17 bp, Homo sapiens
gaatgtaaatttgtact

SEQ ID NO: 2472526 - DNA, 18 bp, Homo sapiens
gaatgtaatcaatgtttc

SEQ ID NO: 2472527 - DNA, 15 bp, Homo sapiens
gaatgtgaagccttc

SEQ ID NO: 2472528 - DNA, 18 bp, Homo sapiens
gaatgtgataaggaaatc

SEQ ID NO: 2472529 - DNA, 12 bp, Homo sapiens
gaatgtgtcttt

SEQ ID NO: 2472530 - DNA, 14 bp, Homo sapiens
gaatgtgtctttag

SEQ ID NO: 2472531 - DNA, 16 bp, Homo sapiens
gaattaggctgtaact

SEQ ID NO: 2472532 - DNA, 13 bp, Homo sapiens
gaattataactgt

SEQ ID NO: 2472533 - DNA, 14 bp, Homo sapiens
gaattataactgta

SEQ ID NO: 2472534 - DNA, 16 bp, Homo sapiens
gaattattttttttct

SEQ ID NO: 2472535 - DNA, 17 bp, Homo sapiens
gaattcggtgtgcacca

SEQ ID NO: 2472536 - DNA, 19 bp, Homo sapiens
gaattcttggttgaggaaa

SEQ ID NO: 2472537 - DNA, 20 bp, Homo sapiens
gaattcttggttgaggaaac

SEQ ID NO: 2472538 - DNA, 14 bp, Homo sapiens
gaattgagtaatgg

SEQ ID NO: 2472539 - DNA, 19 bp, Homo sapiens
gaattgagtgtttaaagtt

SEQ ID NO: 2472540 - DNA, 17 bp, Homo sapiens
gaattgatttgcattga

SEQ ID NO: 2472541 - DNA, 22 bp, Homo sapiens
gaattgtggtttatatatttaa

SEQ ID NO: 2472542 - DNA, 17 bp, Homo sapiens
gaatttcccaggaccct

SEQ ID NO: 2472543 - DNA, 22 bp, Homo sapiens
gaatttcccaggaccctgaagg

SEQ ID NO: 2472544 - DNA, 13 bp, Homo sapiens
gaatttcttaact

SEQ ID NO: 2472545 - DNA, 18 bp, Homo sapiens
gaatttcttaacttcttg

SEQ ID NO: 2472546 - DNA, 14 bp, Homo sapiens
gaatttgcctgctg

SEQ ID NO: 2472547 - DNA, 19 bp, Homo sapiens
gaatttggggcttccaagt

SEQ ID NO: 2472548 - DNA, 20 bp, Homo sapiens
gaatttgtaatgtcttgagc

SEQ ID NO: 2472549 - DNA, 18 bp, Homo sapiens
gaattttatactttccct

SEQ ID NO: 2472550 - DNA, 21 bp, Homo sapiens
gaattttatactttccctacc

SEQ ID NO: 2472551 - DNA, 18 bp, Homo sapiens
gaattttattgacacagt

SEQ ID NO: 2472552 - DNA, 21 bp, Homo sapiens
gaattttgcaaagatttaatc

SEQ ID NO: 2472553 - DNA, 22 bp, Homo sapiens
gaattttgcaaagatttaatct

SEQ ID NO: 2472554 - DNA, 15 bp, Homo sapiens
gaattttttttaaca

SEQ ID NO: 2472555 - DNA, 13 bp, Homo sapiens
gacaaagaacctt

SEQ ID NO: 2472556 - DNA, 18 bp, Homo sapiens
gacaaaggagcctgtgaa

SEQ ID NO: 2472557 - DNA, 18 bp, Homo sapiens
gacaaatcacatatttta

SEQ ID NO: 2472558 - DNA, 22 bp, Homo sapiens
gacaacatttctatagccaaaa

SEQ ID NO: 2472559 - DNA, 19 bp, Homo sapiens
gacaactgctcccacctcc

SEQ ID NO: 2472560 - DNA, 15 bp, Homo sapiens
gacaactggcaggca

SEQ ID NO: 2472561 - DNA, 21 bp, Homo sapiens
gacaacttctaattgccatgt

SEQ ID NO: 2472562 - DNA, 16 bp, Homo sapiens
gacaagccagaacttg

SEQ ID NO: 2472563 - DNA, 12 bp, Homo sapiens
gacaagcttctg

SEQ ID NO: 2472564 - DNA, 14 bp, Homo sapiens
gacaataaaacatt

SEQ ID NO: 2472565 - DNA, 14 bp, Homo sapiens
gacaatcatgtgtg

SEQ ID NO: 2472566 - DNA, 16 bp, Homo sapiens
gacaattactcaggtt

SEQ ID NO: 2472567 - DNA, 18 bp, Homo sapiens
gacacactaaccaagctg

SEQ ID NO: 2472568 - DNA, 19 bp, Homo sapiens
gacacagaaaatgttgaga

SEQ ID NO: 2472569 - DNA, 14 bp, Homo sapiens
gacacaggcctgtg

SEQ ID NO: 2472570 - DNA, 17 bp, Homo sapiens
gacacaggcctgtgtag

SEQ ID NO: 2472571 - DNA, 21 bp, Homo sapiens
gacacaggcctgtgtagctgt

SEQ ID NO: 2472572 - DNA, 15 bp, Homo sapiens
gacaccaaagttcta

SEQ ID NO: 2472573 - DNA, 19 bp, Homo sapiens
gacacggtcggggcatctg

SEQ ID NO: 2472574 - DNA, 16 bp, Homo sapiens
gacactccccgaagtc

SEQ ID NO: 2472575 - DNA, 21 bp, Homo sapiens
gacactcccttgggctccctg

SEQ ID NO: 2472576 - DNA, 14 bp, Homo sapiens
gacactggcccctc

SEQ ID NO: 2472577 - DNA, 18 bp, Homo sapiens
gacactgttcttagctca

SEQ ID NO: 2472578 - DNA, 14 bp, Homo sapiens
gacacttgtacaat

SEQ ID NO: 2472579 - DNA, 15 bp, Homo sapiens
gacagacaggctctt

SEQ ID NO: 2472580 - DNA, 21 bp, Homo sapiens
gacagacaggctcttagcagc

SEQ ID NO: 2472581 - DNA, 16 bp, Homo sapiens
gacagagaggactgta

SEQ ID NO: 2472582 - DNA, 13 bp, Homo sapiens
gacagagccagga

SEQ ID NO: 2472583 - DNA, 16 bp, Homo sapiens
gacagagccaggagaa

SEQ ID NO: 2472584 - DNA, 19 bp, Homo sapiens
gacagaggccccagcctcc

SEQ ID NO: 2472585 - DNA, 19 bp, Homo sapiens
gacagatgaatgccgtgga

SEQ ID NO: 2472586 - DNA, 20 bp, Homo sapiens
gacagatgaggctttccatg

SEQ ID NO: 2472587 - DNA, 14 bp, Homo sapiens
gacagatgcctcct

SEQ ID NO: 2472588 - DNA, 16 bp, Homo sapiens
gacagcagcatctcta

SEQ ID NO: 2472589 - DNA, 19 bp, Homo sapiens
gacagcagcatctctacct

SEQ ID NO: 2472590 - DNA, 18 bp, Homo sapiens
gacagccaagcacctcca

SEQ ID NO: 2472591 - DNA, 11 bp, Homo sapiens
gacagcctccc

SEQ ID NO: 2472592 - DNA, 18 bp, Homo sapiens
gacagctccaccctggcc

SEQ ID NO: 2472593 - DNA, 20 bp, Homo sapiens
gacagcttgtaggggagggg

SEQ ID NO: 2472594 - DNA, 19 bp, Homo sapiens
gacaggactaacactcaga

SEQ ID NO: 2472595 - DNA, 19 bp, Homo sapiens
gacaggatgtgtttgcttt

SEQ ID NO: 2472596 - DNA, 19 bp, Homo sapiens
gacaggctcttagcagctt

SEQ ID NO: 2472597 - DNA, 14 bp, Homo sapiens
gacaggctggctcc

SEQ ID NO: 2472598 - DNA, 19 bp, Homo sapiens
gacagggcgggggtggcgg

SEQ ID NO: 2472599 - DNA, 21 bp, Homo sapiens
gacataaaggaaaagacacat

SEQ ID NO: 2472600 - DNA, 22 bp, Homo sapiens
gacataaagttgataaagattt

SEQ ID NO: 2472601 - DNA, 17 bp, Homo sapiens
gacataaccactgcttc

SEQ ID NO: 2472602 - DNA, 17 bp, Homo sapiens
gacatacttgaagggcc

SEQ ID NO: 2472603 - DNA, 19 bp, Homo sapiens
gacatacttgaagggccag

SEQ ID NO: 2472604 - DNA, 20 bp, Homo sapiens
gacatacttgaagggccaga

SEQ ID NO: 2472605 - DNA, 22 bp, Homo sapiens
gacatacttgaagggccagagc

SEQ ID NO: 2472606 - DNA, 23 bp, Homo sapiens
gacatacttgaagggccagagcc

SEQ ID NO: 2472607 - DNA, 18 bp, Homo sapiens
gacatcctcctcccaccc

SEQ ID NO: 2472608 - DNA, 20 bp, Homo sapiens
gacatgaagattctttccca

SEQ ID NO: 2472609 - DNA, 11 bp, Homo sapiens
gacatgaattt

SEQ ID NO: 2472610 - DNA, 21 bp, Homo sapiens
gacatgaattttagcttttgt

SEQ ID NO: 2472611 - DNA, 16 bp, Homo sapiens
gacatgatttccttga

SEQ ID NO: 2472612 - DNA, 17 bp, Homo sapiens
gacatgatttccttgaa

SEQ ID NO: 2472613 - DNA, 20 bp, Homo sapiens
gacatgatttccttgaatgt

SEQ ID NO: 2472614 - DNA, 22 bp, Homo sapiens
gacatgatttccttgaatgtgg

SEQ ID NO: 2472615 - DNA, 24 bp, Homo sapiens
gacatgatttccttgaatgtggct

SEQ ID NO: 2472616 - DNA, 18 bp, Homo sapiens
gacatgcggtagccagca

SEQ ID NO: 2472617 - DNA, 22 bp, Homo sapiens
gacatgcggtagccagcacaca

SEQ ID NO: 2472618 - DNA, 19 bp, Homo sapiens
gacatggaggttctaaggc

SEQ ID NO: 2472619 - DNA, 20 bp, Homo sapiens
gacatggaggttctaaggcc

SEQ ID NO: 2472620 - DNA, 14 bp, Homo sapiens
gacattcacctgcc

SEQ ID NO: 2472621 - DNA, 15 bp, Homo sapiens
gacattcacctgccc

SEQ ID NO: 2472622 - DNA, 12 bp, Homo sapiens
gacattctgaat

SEQ ID NO: 2472623 - DNA, 14 bp, Homo sapiens
gacattctgaatgc

SEQ ID NO: 2472624 - DNA, 19 bp, Homo sapiens
gacattctgaatgcttcta

SEQ ID NO: 2472625 - DNA, 14 bp, Homo sapiens
gacattgcgtttga

SEQ ID NO: 2472626 - DNA, 23 bp, Homo sapiens
gacatttgggagacatgtgacat

SEQ ID NO: 2472627 - DNA, 13 bp, Homo sapiens
gaccacaggctca

SEQ ID NO: 2472628 - DNA, 18 bp, Homo sapiens
gaccacaggctcaggcag

SEQ ID NO: 2472629 - DNA, 20 bp, Homo sapiens
gaccaccccgcctgccctca

SEQ ID NO: 2472630 - DNA, 19 bp, Homo sapiens
gaccaccctcactggctct

SEQ ID NO: 2472631 - DNA, 14 bp, Homo sapiens
gaccaccctgagcc

SEQ ID NO: 2472632 - DNA, 17 bp, Homo sapiens
gaccacgcccgtcctgc

SEQ ID NO: 2472633 - DNA, 19 bp, Homo sapiens
gaccacgcccgtcctgcct

SEQ ID NO: 2472634 - DNA, 13 bp, Homo sapiens
gaccacggctcga

SEQ ID NO: 2472635 - DNA, 17 bp, Homo sapiens
gaccagaagctccccca

SEQ ID NO: 2472636 - DNA, 20 bp, Homo sapiens
gaccagaagctcccccagca

SEQ ID NO: 2472637 - DNA, 20 bp, Homo sapiens
gaccagcagacagagccagg

SEQ ID NO: 2472638 - DNA, 15 bp, Homo sapiens
gaccagcctggccca

SEQ ID NO: 2472639 - DNA, 22 bp, Homo sapiens
gaccagctcaggacagatgcca

SEQ ID NO: 2472640 - DNA, 18 bp, Homo sapiens
gaccagctccccctccct

SEQ ID NO: 2472641 - DNA, 21 bp, Homo sapiens
gaccagctccccctccctccc

SEQ ID NO: 2472642 - DNA, 20 bp, Homo sapiens
gaccagctgctccgaggacc

SEQ ID NO: 2472643 - DNA, 15 bp, Homo sapiens
gaccaggctgcctcc

SEQ ID NO: 2472644 - DNA, 21 bp, Homo sapiens
gaccagggctccagcccctct

SEQ ID NO: 2472645 - DNA, 19 bp, Homo sapiens
gaccagttgcagtcactct

SEQ ID NO: 2472646 - DNA, 22 bp, Homo sapiens
gaccatgctcatctgctggtcc

SEQ ID NO: 2472647 - DNA, 20 bp, Homo sapiens
gaccatggagtggcagccca

SEQ ID NO: 2472648 - DNA, 22 bp, Homo sapiens
gaccatggagtggcagcccagc

SEQ ID NO: 2472649 - DNA, 16 bp, Homo sapiens
gacccagtgcccccac

SEQ ID NO: 2472650 - DNA, 14 bp, Homo sapiens
gacccattccttcc

SEQ ID NO: 2472651 - DNA, 13 bp, Homo sapiens
gaccccagggcac

SEQ ID NO: 2472652 - DNA, 14 bp, Homo sapiens
gaccccagggcaca

SEQ ID NO: 2472653 - DNA, 15 bp, Homo sapiens
gaccccagggcacag

SEQ ID NO: 2472654 - DNA, 17 bp, Homo sapiens
gaccccagggcacagga

SEQ ID NO: 2472655 - DNA, 18 bp, Homo sapiens
gaccccagggcacaggag

SEQ ID NO: 2472656 - DNA, 21 bp, Homo sapiens
gaccccagggcacaggagcta

SEQ ID NO: 2472657 - DNA, 13 bp, Homo sapiens
gacccccagctcc

SEQ ID NO: 2472658 - DNA, 23 bp, Homo sapiens
gacccccagctccggcctgtcct

SEQ ID NO: 2472659 - DNA, 19 bp, Homo sapiens
gacccccctttcacaggca

SEQ ID NO: 2472660 - DNA, 17 bp, Homo sapiens
gaccccctctccctgca

SEQ ID NO: 2472661 - DNA, 16 bp, Homo sapiens
gaccctgagctgacca

SEQ ID NO: 2472662 - DNA, 11 bp, Homo sapiens
gaccctgccct

SEQ ID NO: 2472663 - DNA, 13 bp, Homo sapiens
gaccctgcccttg

SEQ ID NO: 2472664 - DNA, 13 bp, Homo sapiens
gaccctggctcct

SEQ ID NO: 2472665 - DNA, 14 bp, Homo sapiens
gaccgccccctcct

SEQ ID NO: 2472666 - DNA, 17 bp, Homo sapiens
gaccggacttttctgca

SEQ ID NO: 2472667 - DNA, 16 bp, Homo sapiens
gaccggcctgccagga

SEQ ID NO: 2472668 - DNA, 19 bp, Homo sapiens
gaccggcctgccaggagga

SEQ ID NO: 2472669 - DNA, 15 bp, Homo sapiens
gaccggcggctcgga

SEQ ID NO: 2472670 - DNA, 20 bp, Homo sapiens
gacctaaatggcctcatgtg

SEQ ID NO: 2472671 - DNA, 16 bp, Homo sapiens
gacctcgtactcagga

SEQ ID NO: 2472672 - DNA, 19 bp, Homo sapiens
gacctcgtactcaggagcc

SEQ ID NO: 2472673 - DNA, 16 bp, Homo sapiens
gacctctgacagcagc

SEQ ID NO: 2472674 - DNA, 17 bp, Homo sapiens
gacctgaaattccaaag

SEQ ID NO: 2472675 - DNA, 19 bp, Homo sapiens
gacctgaaattccaaagtc

SEQ ID NO: 2472676 - DNA, 17 bp, Homo sapiens
gacctgagcctgccgag

SEQ ID NO: 2472677 - DNA, 18 bp, Homo sapiens
gacctgagcctgccgagc

SEQ ID NO: 2472678 - DNA, 13 bp, Homo sapiens
gacctgaggctgt

SEQ ID NO: 2472679 - DNA, 15 bp, Homo sapiens
gacctgaggctgtgg

SEQ ID NO: 2472680 - DNA, 19 bp, Homo sapiens
gacctgctaggccagagcc

SEQ ID NO: 2472681 - DNA, 19 bp, Homo sapiens
gacctgctgacctgtgcac

SEQ ID NO: 2472682 - DNA, 13 bp, Homo sapiens
gacctgctgagct

SEQ ID NO: 2472683 - DNA, 19 bp, Homo sapiens
gacctgctgagctctgaga

SEQ ID NO: 2472684 - DNA, 10 bp, Homo sapiens
gacctggcag

SEQ ID NO: 2472685 - DNA, 15 bp, Homo sapiens
gacctggcagctctg

SEQ ID NO: 2472686 - DNA, 22 bp, Homo sapiens
gacctggtgctgcctctacctg

SEQ ID NO: 2472687 - DNA, 12 bp, Homo sapiens
gacctgtaatca

SEQ ID NO: 2472688 - DNA, 17 bp, Homo sapiens
gacctgttagcagacag

SEQ ID NO: 2472689 - DNA, 18 bp, Homo sapiens
gacctgttagcagacagg

SEQ ID NO: 2472690 - DNA, 14 bp, Homo sapiens
gaccttcctcatcc

SEQ ID NO: 2472691 - DNA, 22 bp, Homo sapiens
gaccttcctcatccaccccatc

SEQ ID NO: 2472692 - DNA, 16 bp, Homo sapiens
gaccttcgggctgtgc

SEQ ID NO: 2472693 - DNA, 18 bp, Homo sapiens
gaccttcgggctgtgccc

SEQ ID NO: 2472694 - DNA, 13 bp, Homo sapiens
gacctttccacca

SEQ ID NO: 2472695 - DNA, 21 bp, Homo sapiens
gacctttccaccacagccagc

SEQ ID NO: 2472696 - DNA, 23 bp, Homo sapiens
gacctttccaccacagccagcac

SEQ ID NO: 2472697 - DNA, 18 bp, Homo sapiens
gacgcatctcaaaacaga

SEQ ID NO: 2472698 - DNA, 14 bp, Homo sapiens
gacgccagggtatg

SEQ ID NO: 2472699 - DNA, 14 bp, Homo sapiens
gacgcctgaggaac

SEQ ID NO: 2472700 - DNA, 16 bp, Homo sapiens
gacgtggctcagccag

SEQ ID NO: 2472701 - DNA, 22 bp, Homo sapiens
gacgttttataagcatcattat

SEQ ID NO: 2472702 - DNA, 18 bp, Homo sapiens
gactaaactttttttctg

SEQ ID NO: 2472703 - DNA, 23 bp, Homo sapiens
gactaactagacaccaaagttct

SEQ ID NO: 2472704 - DNA, 18 bp, Homo sapiens
gactaagccagcaccgga

SEQ ID NO: 2472705 - DNA, 16 bp, Homo sapiens
gactaatggcatgaga

SEQ ID NO: 2472706 - DNA, 20 bp, Homo sapiens
gactaatggcatgagaaata

SEQ ID NO: 2472707 - DNA, 14 bp, Homo sapiens
gactacaggcgtga

SEQ ID NO: 2472708 - DNA, 16 bp, Homo sapiens
gactagatgatggatg

SEQ ID NO: 2472709 - DNA, 22 bp, Homo sapiens
gactatatttgggcctgctcca

SEQ ID NO: 2472710 - DNA, 19 bp, Homo sapiens
gactatcttactatttcac

SEQ ID NO: 2472711 - DNA, 21 bp, Homo sapiens
gactattcttgatgtaaaatc

SEQ ID NO: 2472712 - DNA, 17 bp, Homo sapiens
gactcaaatgttctaag

SEQ ID NO: 2472713 - DNA, 19 bp, Homo sapiens
gactcaaatgttctaagtt

SEQ ID NO: 2472714 - DNA, 19 bp, Homo sapiens
gactcacaccactagcctc

SEQ ID NO: 2472715 - DNA, 18 bp, Homo sapiens
gactcagacattggcacc

SEQ ID NO: 2472716 - DNA, 12 bp, Homo sapiens
gactcagccttc

SEQ ID NO: 2472717 - DNA, 19 bp, Homo sapiens
gactcagccttcagacaga

SEQ ID NO: 2472718 - DNA, 15 bp, Homo sapiens
gactcaggagcctgt

SEQ ID NO: 2472719 - DNA, 12 bp, Homo sapiens
gactcagggcag

SEQ ID NO: 2472720 - DNA, 16 bp, Homo sapiens
gactcagggcagcgcc

SEQ ID NO: 2472721 - DNA, 13 bp, Homo sapiens
gactcagggctcc

SEQ ID NO: 2472722 - DNA, 12 bp, Homo sapiens
gactccaggccc

SEQ ID NO: 2472723 - DNA, 23 bp, Homo sapiens
gactcccattcctgaagaaccag

SEQ ID NO: 2472724 - DNA, 17 bp, Homo sapiens
gactccgttggccactc

SEQ ID NO: 2472725 - DNA, 15 bp, Homo sapiens
gactcctagctgtcc

SEQ ID NO: 2472726 - DNA, 16 bp, Homo sapiens
gactcctcctttttcc

SEQ ID NO: 2472727 - DNA, 13 bp, Homo sapiens
gactcggtttctc

SEQ ID NO: 2472728 - DNA, 14 bp, Homo sapiens
gactctaagaaaga

SEQ ID NO: 2472729 - DNA, 18 bp, Homo sapiens
gactctagagtccaaggt

SEQ ID NO: 2472730 - DNA, 14 bp, Homo sapiens
gactctattcttta

SEQ ID NO: 2472731 - DNA, 13 bp, Homo sapiens
gactctgcagcct

SEQ ID NO: 2472732 - DNA, 18 bp, Homo sapiens
gactctggtgcctccaga

SEQ ID NO: 2472733 - DNA, 14 bp, Homo sapiens
gactctgtgctggc

SEQ ID NO: 2472734 - DNA, 16 bp, Homo sapiens
gactctttatgcttgc

SEQ ID NO: 2472735 - DNA, 21 bp, Homo sapiens
gactgacagtttacagacgct

SEQ ID NO: 2472736 - DNA, 13 bp, Homo sapiens
gactgaccagcag

SEQ ID NO: 2472737 - DNA, 15 bp, Homo sapiens
gactgaccagcagct

SEQ ID NO: 2472738 - DNA, 14 bp, Homo sapiens
gactgagtgggaag

SEQ ID NO: 2472739 - DNA, 15 bp, Homo sapiens
gactgagtgggaagc

SEQ ID NO: 2472740 - DNA, 17 bp, Homo sapiens
gactgccatattaaatt

SEQ ID NO: 2472741 - DNA, 18 bp, Homo sapiens
gactgctaaataaaattt

SEQ ID NO: 2472742 - DNA, 21 bp, Homo sapiens
gactgcttgccctaagcagaa

SEQ ID NO: 2472743 - DNA, 23 bp, Homo sapiens
gactgcttgccctaagcagaaag

SEQ ID NO: 2472744 - DNA, 21 bp, Homo sapiens
gactgctttggacctaaatgg

SEQ ID NO: 2472745 - DNA, 20 bp, Homo sapiens
gactggaagctaatttgcat

SEQ ID NO: 2472746 - DNA, 18 bp, Homo sapiens
gactggcggggggcccat

SEQ ID NO: 2472747 - DNA, 21 bp, Homo sapiens
gactggcttttattaatgcac

SEQ ID NO: 2472748 - DNA, 20 bp, Homo sapiens
gactgggagcccccagcctg

SEQ ID NO: 2472749 - DNA, 16 bp, Homo sapiens
gactgggctgagggag

SEQ ID NO: 2472750 - DNA, 21 bp, Homo sapiens
gactgggctgagggagcctgg

SEQ ID NO: 2472751 - DNA, 13 bp, Homo sapiens
gactggggcaggg

SEQ ID NO: 2472752 - DNA, 21 bp, Homo sapiens
gactgtaagttgggcttgcta

SEQ ID NO: 2472753 - DNA, 18 bp, Homo sapiens
gactgtctccatggccct

SEQ ID NO: 2472754 - DNA, 15 bp, Homo sapiens
gactgtgattcagaa

SEQ ID NO: 2472755 - DNA, 21 bp, Homo sapiens
gactgtgtgtgccctctgggc

SEQ ID NO: 2472756 - DNA, 15 bp, Homo sapiens
gacttactctaagat

SEQ ID NO: 2472757 - DNA, 23 bp, Homo sapiens
gacttagaaaaccagctcagcac

SEQ ID NO: 2472758 - DNA, 21 bp, Homo sapiens
gacttcaagcatggctatttt

SEQ ID NO: 2472759 - DNA, 18 bp, Homo sapiens
gacttcctgtccagctcc

SEQ ID NO: 2472760 - DNA, 20 bp, Homo sapiens
gacttcctgtccagctccaa

SEQ ID NO: 2472761 - DNA, 21 bp, Homo sapiens
gacttcctgtccagctccaac

SEQ ID NO: 2472762 - DNA, 12 bp, Homo sapiens
gacttctgagat

SEQ ID NO: 2472763 - DNA, 13 bp, Homo sapiens
gacttctgagatc

SEQ ID NO: 2472764 - DNA, 15 bp, Homo sapiens
gacttctgcctggag

SEQ ID NO: 2472765 - DNA, 13 bp, Homo sapiens
gacttggcctctc

SEQ ID NO: 2472766 - DNA, 15 bp, Homo sapiens
gacttggcctctctc

SEQ ID NO: 2472767 - DNA, 22 bp, Homo sapiens
gacttggctggtgtggtacaga

SEQ ID NO: 2472768 - DNA, 23 bp, Homo sapiens
gacttggctggtgtggtacagag

SEQ ID NO: 2472769 - DNA, 14 bp, Homo sapiens
gacttgggcacccc

SEQ ID NO: 2472770 - DNA, 19 bp, Homo sapiens
gacttgggcacccccagcc

SEQ ID NO: 2472771 - DNA, 20 bp, Homo sapiens
gacttgggcacccccagcct

SEQ ID NO: 2472772 - DNA, 21 bp, Homo sapiens
gacttgggcacccccagcctg

SEQ ID NO: 2472773 - DNA, 22 bp, Homo sapiens
gacttgggcacccccagcctgg

SEQ ID NO: 2472774 - DNA, 23 bp, Homo sapiens
gacttgggcacccccagcctggg

SEQ ID NO: 2472775 - DNA, 17 bp, Homo sapiens
gacttggttggtagggt

SEQ ID NO: 2472776 - DNA, 16 bp, Homo sapiens
gacttgtttttgcaca

SEQ ID NO: 2472777 - DNA, 14 bp, Homo sapiens
gactttaacataag

SEQ ID NO: 2472778 - DNA, 20 bp, Homo sapiens
gactttccccaccagatgct

SEQ ID NO: 2472779 - DNA, 11 bp, Homo sapiens
gactttcctgc

SEQ ID NO: 2472780 - DNA, 12 bp, Homo sapiens
gactttcctgca

SEQ ID NO: 2472781 - DNA, 21 bp, Homo sapiens
gactttcttttttgatataga

SEQ ID NO: 2472782 - DNA, 18 bp, Homo sapiens
gactttgacaattactca

SEQ ID NO: 2472783 - DNA, 14 bp, Homo sapiens
gacttttctgcaaa

SEQ ID NO: 2472784 - DNA, 19 bp, Homo sapiens
gagaaacagttggtaactt

SEQ ID NO: 2472785 - DNA, 22 bp, Homo sapiens
gagaaacagttggtaacttttg

SEQ ID NO: 2472786 - DNA, 14 bp, Homo sapiens
gagaaaccagcttc

SEQ ID NO: 2472787 - DNA, 16 bp, Homo sapiens
gagaaaccagcttcct

SEQ ID NO: 2472788 - DNA, 17 bp, Homo sapiens
gagaaaccagcttcctt

SEQ ID NO: 2472789 - DNA, 19 bp, Homo sapiens
gagaaaccagcttccttca

SEQ ID NO: 2472790 - DNA, 21 bp, Homo sapiens
gagaaaccagcttccttcaga

SEQ ID NO: 2472791 - DNA, 23 bp, Homo sapiens
gagaaaccagcttccttcagaga

SEQ ID NO: 2472792 - DNA, 19 bp, Homo sapiens
gagaaagaggcaccaggaa

SEQ ID NO: 2472793 - DNA, 13 bp, Homo sapiens
gagaaagctgact

SEQ ID NO: 2472794 - DNA, 21 bp, Homo sapiens
gagaaagctgacttggctggt

SEQ ID NO: 2472795 - DNA, 18 bp, Homo sapiens
gagaaataagtgccctct

SEQ ID NO: 2472796 - DNA, 23 bp, Homo sapiens
gagaaatagcttatgaaaagaat

SEQ ID NO: 2472797 - DNA, 20 bp, Homo sapiens
gagaaatatggacacttaat

SEQ ID NO: 2472798 - DNA, 14 bp, Homo sapiens
gagaacctggcctt

SEQ ID NO: 2472799 - DNA, 16 bp, Homo sapiens
gagaacctggccttca

SEQ ID NO: 2472800 - DNA, 20 bp, Homo sapiens
gagaagcaaaccgccctgca

SEQ ID NO: 2472801 - DNA, 15 bp, Homo sapiens
gagaagccagcttgt

SEQ ID NO: 2472802 - DNA, 23 bp, Homo sapiens
gagaagccaggaatttcccagga

SEQ ID NO: 2472803 - DNA, 20 bp, Homo sapiens
gagaagccatcacctcagat

SEQ ID NO: 2472804 - DNA, 22 bp, Homo sapiens
gagaagccatcacctcagatgg

SEQ ID NO: 2472805 - DNA, 20 bp, Homo sapiens
gagaagccttcaagctctga

SEQ ID NO: 2472806 - DNA, 21 bp, Homo sapiens
gagaagccttcaagctctgag

SEQ ID NO: 2472807 - DNA, 22 bp, Homo sapiens
gagaagccttcaagctctgagg

SEQ ID NO: 2472808 - DNA, 17 bp, Homo sapiens
gagaagctcagctgcat

SEQ ID NO: 2472809 - DNA, 22 bp, Homo sapiens
gagaagctcctctccccagccc

SEQ ID NO: 2472810 - DNA, 22 bp, Homo sapiens
gagaaggataggccttcattaa

SEQ ID NO: 2472811 - DNA, 15 bp, Homo sapiens
gagaagtcacagggc

SEQ ID NO: 2472812 - DNA, 22 bp, Homo sapiens
gagaagtctcagctaagctcac

SEQ ID NO: 2472813 - DNA, 17 bp, Homo sapiens
gagaagtgaatgctggg

SEQ ID NO: 2472814 - DNA, 19 bp, Homo sapiens
gagaagtgaatgctgggac

SEQ ID NO: 2472815 - DNA, 20 bp, Homo sapiens
gagaagtgaatgctgggact

SEQ ID NO: 2472816 - DNA, 17 bp, Homo sapiens
gagacaacgtgctcttt

SEQ ID NO: 2472817 - DNA, 15 bp, Homo sapiens
gagacactggcccct

SEQ ID NO: 2472818 - DNA, 14 bp, Homo sapiens
gagacactggtggg

SEQ ID NO: 2472819 - DNA, 17 bp, Homo sapiens
gagacactggtggggat

SEQ ID NO: 2472820 - DNA, 9 bp, Homo sapiens
gagacagag

SEQ ID NO: 2472821 - DNA, 15 bp, Homo sapiens
gagacatacttgaag

SEQ ID NO: 2472822 - DNA, 20 bp, Homo sapiens
gagacatacttgaagggcca

SEQ ID NO: 2472823 - DNA, 13 bp, Homo sapiens
gagacatcagccc

SEQ ID NO: 2472824 - DNA, 12 bp, Homo sapiens
gagaccaccagg

SEQ ID NO: 2472825 - DNA, 19 bp, Homo sapiens
gagaccggcctgccaggag

SEQ ID NO: 2472826 - DNA, 14 bp, Homo sapiens
gagactgggaaggc

SEQ ID NO: 2472827 - DNA, 22 bp, Homo sapiens
gagactgggaaggcttgggatt

SEQ ID NO: 2472828 - DNA, 13 bp, Homo sapiens
gagactgggctga

SEQ ID NO: 2472829 - DNA, 15 bp, Homo sapiens
gagactgggctgagg

SEQ ID NO: 2472830 - DNA, 22 bp, Homo sapiens
gagactgtctggcccccctggt

SEQ ID NO: 2472831 - DNA, 21 bp, Homo sapiens
gagactttccattacaagtat

SEQ ID NO: 2472832 - DNA, 16 bp, Homo sapiens
gagagaaaggactcct

SEQ ID NO: 2472833 - DNA, 20 bp, Homo sapiens
gagagacttgttttggatgc

SEQ ID NO: 2472834 - DNA, 15 bp, Homo sapiens
gagagatcaaagatg

SEQ ID NO: 2472835 - DNA, 13 bp, Homo sapiens
gagagatgtgtgt

SEQ ID NO: 2472836 - DNA, 16 bp, Homo sapiens
gagagcagaggtctcc

SEQ ID NO: 2472837 - DNA, 13 bp, Homo sapiens
gagagcagtgctt

SEQ ID NO: 2472838 - DNA, 23 bp, Homo sapiens
gagagcccgaggaggtgtctcag

SEQ ID NO: 2472839 - DNA, 14 bp, Homo sapiens
gagagccctgggac

SEQ ID NO: 2472840 - DNA, 17 bp, Homo sapiens
gagagcctgcaggatct

SEQ ID NO: 2472841 - DNA, 14 bp, Homo sapiens
gagagctaggagca

SEQ ID NO: 2472842 - DNA, 20 bp, Homo sapiens
gagaggactgtagggagggc

SEQ ID NO: 2472843 - DNA, 21 bp, Homo sapiens
gagaggcagcccaggaagtct

SEQ ID NO: 2472844 - DNA, 12 bp, Homo sapiens
gagaggccctgg

SEQ ID NO: 2472845 - DNA, 16 bp, Homo sapiens
gagagggtgaaggagg

SEQ ID NO: 2472846 - DNA, 22 bp, Homo sapiens
gagaggtgggccagtctgtgga

SEQ ID NO: 2472847 - DNA, 15 bp, Homo sapiens
gagagtgggggtggg

SEQ ID NO: 2472848 - DNA, 13 bp, Homo sapiens
gagatcaaagatg

SEQ ID NO: 2472849 - DNA, 14 bp, Homo sapiens
gagatcaaagatga

SEQ ID NO: 2472850 - DNA, 15 bp, Homo sapiens
gagatcaaagatgaa

SEQ ID NO: 2472851 - DNA, 12 bp, Homo sapiens
gagatcctcctg

SEQ ID NO: 2472852 - DNA, 14 bp, Homo sapiens
gagatcctcctgca

SEQ ID NO: 2472853 - DNA, 17 bp, Homo sapiens
gagatcctcctgcagac

SEQ ID NO: 2472854 - DNA, 22 bp, Homo sapiens
gagatgatacatccaaagcaga

SEQ ID NO: 2472855 - DNA, 19 bp, Homo sapiens
gagatgctggcttgggcag

SEQ ID NO: 2472856 - DNA, 14 bp, Homo sapiens
gagatgggcttccc

SEQ ID NO: 2472857 - DNA, 16 bp, Homo sapiens
gagatgtcttggaaca

SEQ ID NO: 2472858 - DNA, 14 bp, Homo sapiens
gagattacaggcat

SEQ ID NO: 2472859 - DNA, 15 bp, Homo sapiens
gagattacctcctga

SEQ ID NO: 2472860 - DNA, 17 bp, Homo sapiens
gagattcagttttcatt

SEQ ID NO: 2472861 - DNA, 21 bp, Homo sapiens
gagattgcaccactgcactcc

SEQ ID NO: 2472862 - DNA, 19 bp, Homo sapiens
gagcaaactgcatgcccag

SEQ ID NO: 2472863 - DNA, 23 bp, Homo sapiens
gagcaaactgcatgcccagagac

SEQ ID NO: 2472864 - DNA, 14 bp, Homo sapiens
gagcaaagcctgtt

SEQ ID NO: 2472865 - DNA, 14 bp, Homo sapiens
gagcacctgctgtc

SEQ ID NO: 2472866 - DNA, 16 bp, Homo sapiens
gagcacctgctgtctg

SEQ ID NO: 2472867 - DNA, 22 bp, Homo sapiens
gagcacggctctgtccccagcc

SEQ ID NO: 2472868 - DNA, 13 bp, Homo sapiens
gagcactgccagg

SEQ ID NO: 2472869 - DNA, 14 bp, Homo sapiens
gagcactgccagga

SEQ ID NO: 2472870 - DNA, 17 bp, Homo sapiens
gagcactgccaggaggg

SEQ ID NO: 2472871 - DNA, 18 bp, Homo sapiens
gagcactgccaggaggga

SEQ ID NO: 2472872 - DNA, 23 bp, Homo sapiens
gagcagaaaacccttgggccaga

SEQ ID NO: 2472873 - DNA, 18 bp, Homo sapiens
gagcagaaggggagatgg

SEQ ID NO: 2472874 - DNA, 16 bp, Homo sapiens
gagcagaggggcagag

SEQ ID NO: 2472875 - DNA, 20 bp, Homo sapiens
gagcagaggggcagaggccc

SEQ ID NO: 2472876 - DNA, 16 bp, Homo sapiens
gagcagaggggctgaa

SEQ ID NO: 2472877 - DNA, 18 bp, Homo sapiens
gagcagcaggagggggga

SEQ ID NO: 2472878 - DNA, 14 bp, Homo sapiens
gagcagcgagcctg

SEQ ID NO: 2472879 - DNA, 17 bp, Homo sapiens
gagcagcgagcctgcta

SEQ ID NO: 2472880 - DNA, 19 bp, Homo sapiens
gagcaggactccaggccca

SEQ ID NO: 2472881 - DNA, 11 bp, Homo sapiens
gagcaggcagc

SEQ ID NO: 2472882 - DNA, 21 bp, Homo sapiens
gagcagggccggggaactggc

SEQ ID NO: 2472883 - DNA, 18 bp, Homo sapiens
gagcagtccttggcctgc

SEQ ID NO: 2472884 - DNA, 23 bp, Homo sapiens
gagcagtccttggcctgctaagg

SEQ ID NO: 2472885 - DNA, 21 bp, Homo sapiens
gagcagtgaatgattcagtgt

SEQ ID NO: 2472886 - DNA, 13 bp, Homo sapiens
gagcagtgctttt

SEQ ID NO: 2472887 - DNA, 14 bp, Homo sapiens
gagcagtggctggt

SEQ ID NO: 2472888 - DNA, 12 bp, Homo sapiens
gagcatcacaga

SEQ ID NO: 2472889 - DNA, 14 bp, Homo sapiens
gagcatcacagaat

SEQ ID NO: 2472890 - DNA, 14 bp, Homo sapiens
gagcatcatgcctc

SEQ ID NO: 2472891 - DNA, 22 bp, Homo sapiens
gagcatcatgcctctgaggcca

SEQ ID NO: 2472892 - DNA, 24 bp, Homo sapiens
gagcatcatgcctctgaggccagc

SEQ ID NO: 2472893 - DNA, 15 bp, Homo sapiens
gagcatgtcgtggac

SEQ ID NO: 2472894 - DNA, 15 bp, Homo sapiens
gagccaagggatgga

SEQ ID NO: 2472895 - DNA, 18 bp, Homo sapiens
gagccaagggatggacat

SEQ ID NO: 2472896 - DNA, 19 bp, Homo sapiens
gagccaagggatggacatc

SEQ ID NO: 2472897 - DNA, 18 bp, Homo sapiens
gagccaaggggcttcagg

SEQ ID NO: 2472898 - DNA, 13 bp, Homo sapiens
gagccaccagttc

SEQ ID NO: 2472899 - DNA, 15 bp, Homo sapiens
gagccactcctctga

SEQ ID NO: 2472900 - DNA, 19 bp, Homo sapiens
gagccagccgagcaggagg

SEQ ID NO: 2472901 - DNA, 21 bp, Homo sapiens
gagccagccgagcaggaggcc

SEQ ID NO: 2472902 - DNA, 15 bp, Homo sapiens
gagccaggagaagct

SEQ ID NO: 2472903 - DNA, 12 bp, Homo sapiens
gagccagggtct

SEQ ID NO: 2472904 - DNA, 17 bp, Homo sapiens
gagccagggtctccaga

SEQ ID NO: 2472905 - DNA, 17 bp, Homo sapiens
gagccatgcgccccctc

SEQ ID NO: 2472906 - DNA, 14 bp, Homo sapiens
aaaaaaaaatgttc

SEQ ID NO: 2472907 - DNA, 18 bp, Homo sapiens
aaaaaaacagtggatcac

SEQ ID NO: 2472908 - DNA, 22 bp, Homo sapiens
aaaaaacagccaccgtttcttc

SEQ ID NO: 2472909 - DNA, 18 bp, Homo sapiens
aaaaacagccaccgtttc

SEQ ID NO: 2472910 - DNA, 12 bp, Homo sapiens
aaaaacaggcac

SEQ ID NO: 2472911 - DNA, 18 bp, Homo sapiens
aaaaacaggtatatactt

SEQ ID NO: 2472912 - DNA, 22 bp, Homo sapiens
aaaaacctgagatttattaaag

SEQ ID NO: 2472913 - DNA, 19 bp, Homo sapiens
aaaaactacaaccaatgga

SEQ ID NO: 2472914 - DNA, 12 bp, Homo sapiens
aaaaagcttaaa

SEQ ID NO: 2472915 - DNA, 17 bp, Homo sapiens
aaaaagcttaaaacttt

SEQ ID NO: 2472916 - DNA, 20 bp, Homo sapiens
aaaaagcttaaaactttgaa

SEQ ID NO: 2472917 - DNA, 19 bp, Homo sapiens
aaaaagcttccatgattct

SEQ ID NO: 2472918 - DNA, 20 bp, Homo sapiens
aaaaagtgggttttttagtt

SEQ ID NO: 2472919 - DNA, 23 bp, Homo sapiens
aaaaagtgggttttttagttgaa

SEQ ID NO: 2472920 - DNA, 13 bp, Homo sapiens
aaaaagtttgttt

SEQ ID NO: 2472921 - DNA, 16 bp, Homo sapiens
aaaaagttttagtttt

SEQ ID NO: 2472922 - DNA, 12 bp, Homo sapiens
aaaaataaagaa

SEQ ID NO: 2472923 - DNA, 14 bp, Homo sapiens
aaaaatagtttgga

SEQ ID NO: 2472924 - DNA, 16 bp, Homo sapiens
aaaaatgtatatgcac

SEQ ID NO: 2472925 - DNA, 12 bp, Homo sapiens
aaaaatgtattt

SEQ ID NO: 2472926 - DNA, 13 bp, Homo sapiens
aaaaattgaaatg

SEQ ID NO: 2472927 - DNA, 22 bp, Homo sapiens
aaaaattgaaatgtaaggctgt

SEQ ID NO: 2472928 - DNA, 23 bp, Homo sapiens
aaaaattgctgactgtagctttg

SEQ ID NO: 2472929 - DNA, 18 bp, Homo sapiens
aaaacaggcactgccctg

SEQ ID NO: 2472930 - DNA, 23 bp, Homo sapiens
aaaacaggcactgccctggtggc

SEQ ID NO: 2472931 - DNA, 14 bp, Homo sapiens
aaaacatctttgaa

SEQ ID NO: 2472932 - DNA, 16 bp, Homo sapiens
aaaacatctttgaaat

SEQ ID NO: 2472933 - DNA, 20 bp, Homo sapiens
aaaaccacatggcacagaga

SEQ ID NO: 2472934 - DNA, 13 bp, Homo sapiens
aaaacccccaaac

SEQ ID NO: 2472935 - DNA, 17 bp, Homo sapiens
aaaaccccccagatatc

SEQ ID NO: 2472936 - DNA, 20 bp, Homo sapiens
aaaaccccccagatatcatc

SEQ ID NO: 2472937 - DNA, 22 bp, Homo sapiens
aaaacctgagatttattaaaga

SEQ ID NO: 2472938 - DNA, 14 bp, Homo sapiens
aaaaccttttgaaa

SEQ ID NO: 2472939 - DNA, 16 bp, Homo sapiens
aaaactaaaaactaga

SEQ ID NO: 2472940 - DNA, 21 bp, Homo sapiens
aaaactacaaatcaagtattt

SEQ ID NO: 2472941 - DNA, 12 bp, Homo sapiens
aaaactctactt

SEQ ID NO: 2472942 - DNA, 19 bp, Homo sapiens
aaaactctacttaatccaa

SEQ ID NO: 2472943 - DNA, 22 bp, Homo sapiens
aaaactgctcctcctcctgtat

SEQ ID NO: 2472944 - DNA, 21 bp, Homo sapiens
aaaacttatgctgatttattt

SEQ ID NO: 2472945 - DNA, 13 bp, Homo sapiens
aaaactttaaagc

SEQ ID NO: 2472946 - DNA, 19 bp, Homo sapiens
aaaactttggaaccagact

SEQ ID NO: 2472947 - DNA, 12 bp, Homo sapiens
aaaagaaacttt

SEQ ID NO: 2472948 - DNA, 11 bp, Homo sapiens
aaaagaaaggc

SEQ ID NO: 2472949 - DNA, 18 bp, Homo sapiens
aaaagaaaggctgttaaa

SEQ ID NO: 2472950 - DNA, 19 bp, Homo sapiens
aaaagaagcccggctcctg

SEQ ID NO: 2472951 - DNA, 11 bp, Homo sapiens
aaaagaagtaa

SEQ ID NO: 2472952 - DNA, 10 bp, Homo sapiens
aaaagactca

SEQ ID NO: 2472953 - DNA, 13 bp, Homo sapiens
aaaagactcatcc

SEQ ID NO: 2472954 - DNA, 22 bp, Homo sapiens
aaaagatgcactttgctttaat

SEQ ID NO: 2472955 - DNA, 11 bp, Homo sapiens
aaaagcctgct

SEQ ID NO: 2472956 - DNA, 16 bp, Homo sapiens
aaaagctaataccagt

SEQ ID NO: 2472957 - DNA, 14 bp, Homo sapiens
aaaagctagaattg

SEQ ID NO: 2472958 - DNA, 17 bp, Homo sapiens
aaaagctataaagcagt

SEQ ID NO: 2472959 - DNA, 21 bp, Homo sapiens
aaaagctataaagcagtattt

SEQ ID NO: 2472960 - DNA, 20 bp, Homo sapiens
aaaagctatttaaagcatct

SEQ ID NO: 2472961 - DNA, 14 bp, Homo sapiens
aaaagcttccatga

SEQ ID NO: 2472962 - DNA, 18 bp, Homo sapiens
aaaaggtttacagaattt

SEQ ID NO: 2472963 - DNA, 20 bp, Homo sapiens
aaaaggtttatgaaaaagaa

SEQ ID NO: 2472964 - DNA, 23 bp, Homo sapiens
aaaaggtttatgaaaaagaagaa

SEQ ID NO: 2472965 - DNA, 19 bp, Homo sapiens
aaatgtctttaatgcaata

SEQ ID NO: 2472966 - DNA, 22 bp, Homo sapiens
aaatgtgatgttctaaggctct

SEQ ID NO: 2472967 - DNA, 20 bp, Homo sapiens
aaatgtgggattatgggtca

SEQ ID NO: 2472968 - DNA, 16 bp, Homo sapiens
aaatgttattatctgg

SEQ ID NO: 2472969 - DNA, 16 bp, Homo sapiens
aaatgttcacttttga

SEQ ID NO: 2472970 - DNA, 21 bp, Homo sapiens
aaatgttctaagtttctaaga

SEQ ID NO: 2472971 - DNA, 15 bp, Homo sapiens
aaatgttctgtttgc

SEQ ID NO: 2472972 - DNA, 23 bp, Homo sapiens
aaatgttgaaatatgatgttaaa

SEQ ID NO: 2472973 - DNA, 11 bp, Homo sapiens
aaatgttgctg

SEQ ID NO: 2472974 - DNA, 12 bp, Homo sapiens
aaatgtttttgg

SEQ ID NO: 2472975 - DNA, 14 bp, Homo sapiens
aaattaaaaaagat

SEQ ID NO: 2472976 - DNA, 15 bp, Homo sapiens
aaattaaaaaagata

SEQ ID NO: 2472977 - DNA, 20 bp, Homo sapiens
aaattaaaaaagataaacac

SEQ ID NO: 2472978 - DNA, 20 bp, Homo sapiens
aaattaactgggtaatgaaa

SEQ ID NO: 2472979 - DNA, 14 bp, Homo sapiens
aaattactttgtga

SEQ ID NO: 2472980 - DNA, 13 bp, Homo sapiens
aaattagttatat

SEQ ID NO: 2472981 - DNA, 22 bp, Homo sapiens
aaattatcaggcaaatttgcat

SEQ ID NO: 2472982 - DNA, 12 bp, Homo sapiens
aaattatttaaa

SEQ ID NO: 2472983 - DNA, 13 bp, Homo sapiens
aaattatttaaac

SEQ ID NO: 2472984 - DNA, 13 bp, Homo sapiens
aaattatttgcat

SEQ ID NO: 2472985 - DNA, 17 bp, Homo sapiens
aaattcacaaactttta

SEQ ID NO: 2472986 - DNA, 12 bp, Homo sapiens
aaattccaaagt

SEQ ID NO: 2472987 - DNA, 21 bp, Homo sapiens
aaattccaaagtctctaattc

SEQ ID NO: 2472988 - DNA, 22 bp, Homo sapiens
aaattccaaagtctctaattct

SEQ ID NO: 2472989 - DNA, 15 bp, Homo sapiens
aaattcgtgtgtttt

SEQ ID NO: 2472990 - DNA, 14 bp, Homo sapiens
aaattctcctggag

SEQ ID NO: 2472991 - DNA, 16 bp, Homo sapiens
aaattctgtgccttgt

SEQ ID NO: 2472992 - DNA, 14 bp, Homo sapiens
aaattgaatacttt

SEQ ID NO: 2472993 - DNA, 20 bp, Homo sapiens
aaattgaatactttgaatgt

SEQ ID NO: 2472994 - DNA, 14 bp, Homo sapiens
aaattgaatgcaaa

SEQ ID NO: 2472995 - DNA, 23 bp, Homo sapiens
aaattgctgactgtagctttgga

SEQ ID NO: 2472996 - DNA, 16 bp, Homo sapiens
aaattggcatggaaat

SEQ ID NO: 2472997 - DNA, 21 bp, Homo sapiens
aaattggcatggaaatttaaa

SEQ ID NO: 2472998 - DNA, 15 bp, Homo sapiens
aaattgtatattgta

SEQ ID NO: 2472999 - DNA, 21 bp, Homo sapiens
aaattgtcccttaaacaaaaa

SEQ ID NO: 2473000 - DNA, 21 bp, Homo sapiens
aaatttaaagcaggttcttgt

SEQ ID NO: 2473001 - DNA, 16 bp, Homo sapiens
aaatttagcattgtag

SEQ ID NO: 2473002 - DNA, 21 bp, Homo sapiens
aaatttagcattgtagtgctt

SEQ ID NO: 2473003 - DNA, 10 bp, Homo sapiens
aaatttataa

SEQ ID NO: 2473004 - DNA, 16 bp, Homo sapiens
aaatttgacttttctg

SEQ ID NO: 2473005 - DNA, 17 bp, Homo sapiens
aaatttgattgatttga

SEQ ID NO: 2473006 - DNA, 12 bp, Homo sapiens
aaatttgtacta

SEQ ID NO: 2473007 - DNA, 19 bp, Homo sapiens
aaatttgtactatttaact

SEQ ID NO: 2473008 - DNA, 15 bp, Homo sapiens
aaatttgttcttgta

SEQ ID NO: 2473009 - DNA, 18 bp, Homo sapiens
aaatttgttcttgtattt

SEQ ID NO: 2473010 - DNA, 13 bp, Homo sapiens
aaatttgttgcat

SEQ ID NO: 2473011 - DNA, 15 bp, Homo sapiens
aaattttttgttgac

SEQ ID NO: 2473012 - DNA, 16 bp, Homo sapiens
aacaaactcgtttttt

SEQ ID NO: 2473013 - DNA, 20 bp, Homo sapiens
aacaaactgtgtaactgccc

SEQ ID NO: 2473014 - DNA, 19 bp, Homo sapiens
aacaaagagttcaagaaat

SEQ ID NO: 2473015 - DNA, 11 bp, Homo sapiens
aacaagaaaaa

SEQ ID NO: 2473016 - DNA, 18 bp, Homo sapiens
aacaagaaaaataaagaa

SEQ ID NO: 2473017 - DNA, 19 bp, Homo sapiens
aacaagaaaaataaagaaa

SEQ ID NO: 2473018 - DNA, 21 bp, Homo sapiens
aacaagaagccacagacctag

SEQ ID NO: 2473019 - DNA, 15 bp, Homo sapiens
aacaagagaagcatt

SEQ ID NO: 2473020 - DNA, 16 bp, Homo sapiens
aacaagagaagcattc

SEQ ID NO: 2473021 - DNA, 17 bp, Homo sapiens
aacaagagaagcattct

SEQ ID NO: 2473022 - DNA, 14 bp, Homo sapiens
aacaatacaaatgg

SEQ ID NO: 2473023 - DNA, 15 bp, Homo sapiens
aacaatacaaatgga

SEQ ID NO: 2473024 - DNA, 17 bp, Homo sapiens
aacaatacaaatggatt

SEQ ID NO: 2473025 - DNA, 14 bp, Homo sapiens
aacaatcttcctgt

SEQ ID NO: 2473026 - DNA, 15 bp, Homo sapiens
aacaatgacatttat

SEQ ID NO: 2473027 - DNA, 14 bp, Homo sapiens
aacaattctaaaat

SEQ ID NO: 2473028 - DNA, 23 bp, Homo sapiens
aacaattttaggaggaccagagc

SEQ ID NO: 2473029 - DNA, 16 bp, Homo sapiens
aacacaaactgtaaat

SEQ ID NO: 2473030 - DNA, 19 bp, Homo sapiens
aacacaagattggtgtttt

SEQ ID NO: 2473031 - DNA, 21 bp, Homo sapiens
aacacaagattggtgtttttt

SEQ ID NO: 2473032 - DNA, 14 bp, Homo sapiens
aacacacacaaaag

SEQ ID NO: 2473033 - DNA, 23 bp, Homo sapiens
aacacactaccgaatgtgtcttt

SEQ ID NO: 2473034 - DNA, 23 bp, Homo sapiens
aacacagcagttctgcagaggac

SEQ ID NO: 2473035 - DNA, 17 bp, Homo sapiens
aacaccaagcacagcag

SEQ ID NO: 2473036 - DNA, 19 bp, Homo sapiens
aacaccatgattcctttaa

SEQ ID NO: 2473037 - DNA, 20 bp, Homo sapiens
aacaccatgattcctttaac

SEQ ID NO: 2473038 - DNA, 16 bp, Homo sapiens
aacaccctatattttg

SEQ ID NO: 2473039 - DNA, 15 bp, Homo sapiens
aacacgcacctgcct

SEQ ID NO: 2473040 - DNA, 14 bp, Homo sapiens
aacactaatatatt

SEQ ID NO: 2473041 - DNA, 14 bp, Homo sapiens
aacactaattcata

SEQ ID NO: 2473042 - DNA, 16 bp, Homo sapiens
aacactcagaagcctg

SEQ ID NO: 2473043 - DNA, 17 bp, Homo sapiens
aacactcagaagcctgg

SEQ ID NO: 2473044 - DNA, 19 bp, Homo sapiens
aacactcagaagcctgggg

SEQ ID NO: 2473045 - DNA, 22 bp, Homo sapiens
aacactggtctgctgttccagt

SEQ ID NO: 2473046 - DNA, 23 bp, Homo sapiens
aacactggtctgctgttccagtg

SEQ ID NO: 2473047 - DNA, 22 bp, Homo sapiens
aacactgtagtaaataatgctt

SEQ ID NO: 2473048 - DNA, 20 bp, Homo sapiens
aacactgtgcacatctgtgt

SEQ ID NO: 2473049 - DNA, 12 bp, Homo sapiens
aacacttgtaat

SEQ ID NO: 2473050 - DNA, 13 bp, Homo sapiens
aacagaacactta

SEQ ID NO: 2473051 - DNA, 21 bp, Homo sapiens
aacagaatgtctcttcctggt

SEQ ID NO: 2473052 - DNA, 13 bp, Homo sapiens
aacagatctggaa

SEQ ID NO: 2473053 - DNA, 20 bp, Homo sapiens
aacagcaaatgcaaaaactc

SEQ ID NO: 2473054 - DNA, 10 bp, Homo sapiens
aacagcatct

SEQ ID NO: 2473055 - DNA, 15 bp, Homo sapiens
aacagcatctccaag

SEQ ID NO: 2473056 - DNA, 21 bp, Homo sapiens
aacagcatctccaagcagctt

SEQ ID NO: 2473057 - DNA, 17 bp, Homo sapiens
aacagccctcctctgca

SEQ ID NO: 2473058 - DNA, 19 bp, Homo sapiens
aacagccctcctctgcact

SEQ ID NO: 2473059 - DNA, 23 bp, Homo sapiens
aacagcgttcctagagaagacag

SEQ ID NO: 2473060 - DNA, 23 bp, Homo sapiens
aacagctggaccctgaccagctc

SEQ ID NO: 2473061 - DNA, 13 bp, Homo sapiens
aacagctggtgta

SEQ ID NO: 2473062 - DNA, 20 bp, Homo sapiens
aacagctggtgtagctacag

SEQ ID NO: 2473063 - DNA, 20 bp, Homo sapiens
aacaggaaactcctgtgacc

SEQ ID NO: 2473064 - DNA, 20 bp, Homo sapiens
aacagggaaggcaggcaggg

SEQ ID NO: 2473065 - DNA, 15 bp, Homo sapiens
aacaggtaatataaa

SEQ ID NO: 2473066 - DNA, 17 bp, Homo sapiens
aacagtaaaccactgaa

SEQ ID NO: 2473067 - DNA, 23 bp, Homo sapiens
aacagtaaaccactgaaaaaata

SEQ ID NO: 2473068 - DNA, 16 bp, Homo sapiens
aacagtgaagacagaa

SEQ ID NO: 2473069 - DNA, 15 bp, Homo sapiens
aagggtaaacaatat

SEQ ID NO: 2473070 - DNA, 16 bp, Homo sapiens
aagggtaaacaatata

SEQ ID NO: 2473071 - DNA, 21 bp, Homo sapiens
aagggtcgaaagctctagaat

SEQ ID NO: 2473072 - DNA, 22 bp, Homo sapiens
aagggtcgaaagctctagaatc

SEQ ID NO: 2473073 - DNA, 18 bp, Homo sapiens
aaggtacaagaagcattt

SEQ ID NO: 2473074 - DNA, 19 bp, Homo sapiens
aaggtacaagaagcatttt

SEQ ID NO: 2473075 - DNA, 19 bp, Homo sapiens
aaggtccggtgttctaaga

SEQ ID NO: 2473076 - DNA, 20 bp, Homo sapiens
aaggtcctctgtcagtcaca

SEQ ID NO: 2473077 - DNA, 20 bp, Homo sapiens
aaggtgacatcggaaaaata

SEQ ID NO: 2473078 - DNA, 20 bp, Homo sapiens
aaggtgtagccacaccagga

SEQ ID NO: 2473079 - DNA, 15 bp, Homo sapiens
aaggtgtcctacaga

SEQ ID NO: 2473080 - DNA, 16 bp, Homo sapiens
aaggtgtcctacagaa

SEQ ID NO: 2473081 - DNA, 20 bp, Homo sapiens
aaggtgtcctacagaaaaac

SEQ ID NO: 2473082 - DNA, 15 bp, Homo sapiens
aaggtgtgagactgg

SEQ ID NO: 2473083 - DNA, 18 bp, Homo sapiens
aaggttagagaataaatt

SEQ ID NO: 2473084 - DNA, 23 bp, Homo sapiens
aaggttccgcttggagcagaggg

SEQ ID NO: 2473085 - DNA, 16 bp, Homo sapiens
aaggttgggcagggtg

SEQ ID NO: 2473086 - DNA, 21 bp, Homo sapiens
aaggtttaaatgaacaagaga

SEQ ID NO: 2473087 - DNA, 18 bp, Homo sapiens
aaggtttggaaggagcag

SEQ ID NO: 2473088 - DNA, 23 bp, Homo sapiens
aaggttttaatttagtaaaccaa

SEQ ID NO: 2473089 - DNA, 15 bp, Homo sapiens
aaggttttaggttct

SEQ ID NO: 2473090 - DNA, 16 bp, Homo sapiens
aaggttttaggttcta

SEQ ID NO: 2473091 - DNA, 11 bp, Homo sapiens
aaggttttttt

SEQ ID NO: 2473092 - DNA, 21 bp, Homo sapiens
aagtaaaagcaaaaaagaaaa

SEQ ID NO: 2473093 - DNA, 12 bp, Homo sapiens
aagtaaactttt

SEQ ID NO: 2473094 - DNA, 17 bp, Homo sapiens
aagtaaatacaattttt

SEQ ID NO: 2473095 - DNA, 16 bp, Homo sapiens
aagtaatacaaactaa

SEQ ID NO: 2473096 - DNA, 14 bp, Homo sapiens
aagtacagagaagc

SEQ ID NO: 2473097 - DNA, 13 bp, Homo sapiens
aagtaccagacta

SEQ ID NO: 2473098 - DNA, 16 bp, Homo sapiens
aagtagaaacaaaata

SEQ ID NO: 2473099 - DNA, 17 bp, Homo sapiens
aagtattcaacaatttc

SEQ ID NO: 2473100 - DNA, 21 bp, Homo sapiens
aagtattcaacaatttcaata

SEQ ID NO: 2473101 - DNA, 13 bp, Homo sapiens
aagtatttcaaat

SEQ ID NO: 2473102 - DNA, 13 bp, Homo sapiens
aagtatttgggaa

SEQ ID NO: 2473103 - DNA, 15 bp, Homo sapiens
aagtatttttaatta

SEQ ID NO: 2473104 - DNA, 18 bp, Homo sapiens
aagtatttttaattaatt

SEQ ID NO: 2473105 - DNA, 16 bp, Homo sapiens
aagtattttttcagta

SEQ ID NO: 2473106 - DNA, 16 bp, Homo sapiens
aagtcaacctgcctga

SEQ ID NO: 2473107 - DNA, 15 bp, Homo sapiens
aagtcacagggcagt

SEQ ID NO: 2473108 - DNA, 12 bp, Homo sapiens
aagtccaatgtg

SEQ ID NO: 2473109 - DNA, 17 bp, Homo sapiens
aagtccaggtcctggtg

SEQ ID NO: 2473110 - DNA, 19 bp, Homo sapiens
aagtccaggtcctggtggg

SEQ ID NO: 2473111 - DNA, 18 bp, Homo sapiens
aagtccggccccagtaca

SEQ ID NO: 2473112 - DNA, 21 bp, Homo sapiens
aagtcgtccttactcctgtgg

SEQ ID NO: 2473113 - DNA, 15 bp, Homo sapiens
aagtctctaattcta

SEQ ID NO: 2473114 - DNA, 18 bp, Homo sapiens
aagtctctaattctatta

SEQ ID NO: 2473115 - DNA, 16 bp, Homo sapiens
aagtctctgctggccc

SEQ ID NO: 2473116 - DNA, 21 bp, Homo sapiens
aagtctctgctggcccagcca

SEQ ID NO: 2473117 - DNA, 16 bp, Homo sapiens
aagtctgtccttgaag

SEQ ID NO: 2473118 - DNA, 20 bp, Homo sapiens
aagtctgttgattaaagatg

SEQ ID NO: 2473119 - DNA, 13 bp, Homo sapiens
aagtctgtttact

SEQ ID NO: 2473120 - DNA, 16 bp, Homo sapiens
aagtctgtttactgca

SEQ ID NO: 2473121 - DNA, 12 bp, Homo sapiens
aagtgaaaactt

SEQ ID NO: 2473122 - DNA, 14 bp, Homo sapiens
aagtgaaaatggtc

SEQ ID NO: 2473123 - DNA, 11 bp, Homo sapiens
aagtgaaataa

SEQ ID NO: 2473124 - DNA, 13 bp, Homo sapiens
aagtgaagactgg

SEQ ID NO: 2473125 - DNA, 21 bp, Homo sapiens
aagtgagggctcactcagcca

SEQ ID NO: 2473126 - DNA, 17 bp, Homo sapiens
aagtgagtctctctggg

SEQ ID NO: 2473127 - DNA, 19 bp, Homo sapiens
aagtgccctctcccaccct

SEQ ID NO: 2473128 - DNA, 23 bp, Homo sapiens
aagtgccctctcccaccctcttc

SEQ ID NO: 2473129 - DNA, 14 bp, Homo sapiens
aagtgcctttcagg

SEQ ID NO: 2473130 - DNA, 20 bp, Homo sapiens
aagtgcctttcaggatctat

SEQ ID NO: 2473131 - DNA, 15 bp, Homo sapiens
aagtgctaaggttct

SEQ ID NO: 2473132 - DNA, 16 bp, Homo sapiens
aagtgctaaggttcta

SEQ ID NO: 2473133 - DNA, 20 bp, Homo sapiens
aagtgctaaggttctaaggc

SEQ ID NO: 2473134 - DNA, 15 bp, Homo sapiens
aagtgctgcactcaa

SEQ ID NO: 2473135 - DNA, 21 bp, Homo sapiens
aagtgctgtttattaatctta

SEQ ID NO: 2473136 - DNA, 22 bp, Homo sapiens
aagtgctgtttattaatcttag

SEQ ID NO: 2473137 - DNA, 18 bp, Homo sapiens
aagtggacaaattttgag

SEQ ID NO: 2473138 - DNA, 17 bp, Homo sapiens
aagtggactcagggcag

SEQ ID NO: 2473139 - DNA, 15 bp, Homo sapiens
aagtgggtaccccca

SEQ ID NO: 2473140 - DNA, 19 bp, Homo sapiens
aagtgggtacccccaggac

SEQ ID NO: 2473141 - DNA, 17 bp, Homo sapiens
aagtgggttttttagtt

SEQ ID NO: 2473142 - DNA, 15 bp, Homo sapiens
aagtgtatttggaaa

SEQ ID NO: 2473143 - DNA, 20 bp, Homo sapiens
aagtgtggggattttcactg

SEQ ID NO: 2473144 - DNA, 14 bp, Homo sapiens
aagtgttcattgtt

SEQ ID NO: 2473145 - DNA, 16 bp, Homo sapiens
aagttagtatcttttg

SEQ ID NO: 2473146 - DNA, 19 bp, Homo sapiens
aagttagtatcttttgata

SEQ ID NO: 2473147 - DNA, 23 bp, Homo sapiens
aagttagtttgtatatattatta

SEQ ID NO: 2473148 - DNA, 22 bp, Homo sapiens
aagttcaatataagcttttctt

SEQ ID NO: 2473149 - DNA, 20 bp, Homo sapiens
aagttccaagagtctaaaga

SEQ ID NO: 2473150 - DNA, 18 bp, Homo sapiens
aagttcccagttggagct

SEQ ID NO: 2473151 - DNA, 15 bp, Homo sapiens
aagttcgtctgttgt

SEQ ID NO: 2473152 - DNA, 11 bp, Homo sapiens
aagttctaaga

SEQ ID NO: 2473153 - DNA, 12 bp, Homo sapiens
aagttctaagat

SEQ ID NO: 2473154 - DNA, 16 bp, Homo sapiens
aagttctaagattcta

SEQ ID NO: 2473155 - DNA, 19 bp, Homo sapiens
aagttctaataatttctaa

SEQ ID NO: 2473156 - DNA, 19 bp, Homo sapiens
aagttgcagctgttttgtt

SEQ ID NO: 2473157 - DNA, 21 bp, Homo sapiens
aagttgctgcttctcccaggc

SEQ ID NO: 2473158 - DNA, 23 bp, Homo sapiens
aagttgctgcttctcccaggcaa

SEQ ID NO: 2473159 - DNA, 23 bp, Homo sapiens
aagttggagttttgtttcctctg

SEQ ID NO: 2473160 - DNA, 17 bp, Homo sapiens
aagttgtaaagtatgta

SEQ ID NO: 2473161 - DNA, 18 bp, Homo sapiens
aagttgttgtaacctgct

SEQ ID NO: 2473162 - DNA, 16 bp, Homo sapiens
aagtttagctctgaga

SEQ ID NO: 2473163 - DNA, 23 bp, Homo sapiens
aagtttcattctccctttcacta

SEQ ID NO: 2473164 - DNA, 11 bp, Homo sapiens
aagtttctaag

SEQ ID NO: 2473165 - DNA, 12 bp, Homo sapiens
aagtttctaaga

SEQ ID NO: 2473166 - DNA, 15 bp, Homo sapiens
aagtttgatttcatt

SEQ ID NO: 2473167 - DNA, 16 bp, Homo sapiens
aagtttgatttcatta

SEQ ID NO: 2473168 - DNA, 20 bp, Homo sapiens
aagtttgcactatctttcag

SEQ ID NO: 2473169 - DNA, 17 bp, Homo sapiens
aagttttaaaaagccag

SEQ ID NO: 2473170 - DNA, 15 bp, Homo sapiens
aataaaaagaaaggc

SEQ ID NO: 2473171 - DNA, 16 bp, Homo sapiens
aataaaaagcttttgt

SEQ ID NO: 2473172 - DNA, 18 bp, Homo sapiens
aataaaaagcttttgtct

SEQ ID NO: 2473173 - DNA, 16 bp, Homo sapiens
acaaactgtaatacaa

SEQ ID NO: 2473174 - DNA, 13 bp, Homo sapiens
acaaactttgcat

SEQ ID NO: 2473175 - DNA, 13 bp, Homo sapiens
acaaacttttata

SEQ ID NO: 2473176 - DNA, 17 bp, Homo sapiens
acaaagaaacaaagatg

SEQ ID NO: 2473177 - DNA, 20 bp, Homo sapiens
acaaagaaacaaagatgtta

SEQ ID NO: 2473178 - DNA, 18 bp, Homo sapiens
acaaagagttcaagaaat

SEQ ID NO: 2473179 - DNA, 19 bp, Homo sapiens
acaaagagttcaagaaata

SEQ ID NO: 2473180 - DNA, 14 bp, Homo sapiens
acaaagcagccacg

SEQ ID NO: 2473181 - DNA, 15 bp, Homo sapiens
acaaaggagcctgtg

SEQ ID NO: 2473182 - DNA, 16 bp, Homo sapiens
acaaaggtttaaatga

SEQ ID NO: 2473183 - DNA, 18 bp, Homo sapiens
acaaaggtttaaatgaac

SEQ ID NO: 2473184 - DNA, 19 bp, Homo sapiens
acaaagtttaccagaaagc

SEQ ID NO: 2473185 - DNA, 19 bp, Homo sapiens
acaaataggatgcttggga

SEQ ID NO: 2473186 - DNA, 21 bp, Homo sapiens
acaaatagtcggattagaaat

SEQ ID NO: 2473187 - DNA, 14 bp, Homo sapiens
acaaatcagaagtc

SEQ ID NO: 2473188 - DNA, 23 bp, Homo sapiens
acaaatcagaagtcatcttgcta

SEQ ID NO: 2473189 - DNA, 20 bp, Homo sapiens
acaaatgttaaaatgtgttg

SEQ ID NO: 2473190 - DNA, 17 bp, Homo sapiens
acaaattattaatgaaa

SEQ ID NO: 2473191 - DNA, 14 bp, Homo sapiens
acaacactgtagta

SEQ ID NO: 2473192 - DNA, 23 bp, Homo sapiens
acaacagttacataattcactct

SEQ ID NO: 2473193 - DNA, 21 bp, Homo sapiens
acaacatgaggccactggaga

SEQ ID NO: 2473194 - DNA, 16 bp, Homo sapiens
acaacatgtttccagc

SEQ ID NO: 2473195 - DNA, 21 bp, Homo sapiens
acaacatgtttccagcattcc

SEQ ID NO: 2473196 - DNA, 22 bp, Homo sapiens
acaacatttctatagccaaaaa

SEQ ID NO: 2473197 - DNA, 16 bp, Homo sapiens
acaactattttcagat

SEQ ID NO: 2473198 - DNA, 19 bp, Homo sapiens
acaactggcaggcaggctc

SEQ ID NO: 2473199 - DNA, 17 bp, Homo sapiens
acaagaaaaataaagaa

SEQ ID NO: 2473200 - DNA, 22 bp, Homo sapiens
acaagactgacgccagggtatg

SEQ ID NO: 2473201 - DNA, 21 bp, Homo sapiens
acaagagcactacattcattt

SEQ ID NO: 2473202 - DNA, 18 bp, Homo sapiens
acaagatggaatttatca

SEQ ID NO: 2473203 - DNA, 17 bp, Homo sapiens
acaagattggtgttttt

SEQ ID NO: 2473204 - DNA, 18 bp, Homo sapiens
acaagattggtgtttttt

SEQ ID NO: 2473205 - DNA, 22 bp, Homo sapiens
acaagattggtgtttttttcta

SEQ ID NO: 2473206 - DNA, 23 bp, Homo sapiens
acaagcatggtcccacatccctg

SEQ ID NO: 2473207 - DNA, 14 bp, Homo sapiens
acaagccagaactt

SEQ ID NO: 2473208 - DNA, 13 bp, Homo sapiens
acaagcttctgag

SEQ ID NO: 2473209 - DNA, 16 bp, Homo sapiens
acaagcttctgagacg

SEQ ID NO: 2473210 - DNA, 21 bp, Homo sapiens
acaaggaagtcaaagcaagga

SEQ ID NO: 2473211 - DNA, 21 bp, Homo sapiens
acaaggatagatgctggccca

SEQ ID NO: 2473212 - DNA, 21 bp, Homo sapiens
acaaggcagcaaggcccgagc

SEQ ID NO: 2473213 - DNA, 18 bp, Homo sapiens
acaaggccatctgggctc

SEQ ID NO: 2473214 - DNA, 22 bp, Homo sapiens
acaagtatttgttaatttagaa

SEQ ID NO: 2473215 - DNA, 18 bp, Homo sapiens
acaagtggactcagggca

SEQ ID NO: 2473216 - DNA, 16 bp, Homo sapiens
acaagttggagtcact

SEQ ID NO: 2473217 - DNA, 15 bp, Homo sapiens
acaatacaaatggat

SEQ ID NO: 2473218 - DNA, 15 bp, Homo sapiens
acaatcatgtgtgtt

SEQ ID NO: 2473219 - DNA, 21 bp, Homo sapiens
acaatcatgtgtgttaaccca

SEQ ID NO: 2473220 - DNA, 21 bp, Homo sapiens
acaatgaaaactctttgctgc

SEQ ID NO: 2473221 - DNA, 23 bp, Homo sapiens
acaatgaataaaaactcaaggag

SEQ ID NO: 2473222 - DNA, 17 bp, Homo sapiens
acaatgtttaaaccttt

SEQ ID NO: 2473223 - DNA, 15 bp, Homo sapiens
acaattactcaggtt

SEQ ID NO: 2473224 - DNA, 21 bp, Homo sapiens
acaattaggcagactctttat

SEQ ID NO: 2473225 - DNA, 23 bp, Homo sapiens
acaattcctctactaacaatcag

SEQ ID NO: 2473226 - DNA, 12 bp, Homo sapiens
acaattctaaaa

SEQ ID NO: 2473227 - DNA, 23 bp, Homo sapiens
acaattctaaaatgattgtagta

SEQ ID NO: 2473228 - DNA, 22 bp, Homo sapiens
acaattgaagtaaactttttgt

SEQ ID NO: 2473229 - DNA, 16 bp, Homo sapiens
acaattgtgtagcctt

SEQ ID NO: 2473230 - DNA, 17 bp, Homo sapiens
acaattgtgtagccttt

SEQ ID NO: 2473231 - DNA, 18 bp, Homo sapiens
acaattgtgtagcctttt

SEQ ID NO: 2473232 - DNA, 18 bp, Homo sapiens
acaatttggcaattttgt

SEQ ID NO: 2473233 - DNA, 15 bp, Homo sapiens
acacaaactgtaaat

SEQ ID NO: 2473234 - DNA, 19 bp, Homo sapiens
acacaaactgtaaataaaa

SEQ ID NO: 2473235 - DNA, 16 bp, Homo sapiens
acacaagattggtgtt

SEQ ID NO: 2473236 - DNA, 11 bp, Homo sapiens
acacacctgta

SEQ ID NO: 2473237 - DNA, 15 bp, Homo sapiens
acacactgatgctta

SEQ ID NO: 2473238 - DNA, 19 bp, Homo sapiens
acacagaaacctttttaaa

SEQ ID NO: 2473239 - DNA, 14 bp, Homo sapiens
acacagactatttt

SEQ ID NO: 2473240 - DNA, 17 bp, Homo sapiens
acacagcattgtatatg

SEQ ID NO: 2473241 - DNA, 12 bp, Homo sapiens
acacagctgccg

SEQ ID NO: 2473242 - DNA, 22 bp, Homo sapiens
acacagcttgtctcttgcctgc

SEQ ID NO: 2473243 - DNA, 20 bp, Homo sapiens
acacaggcatttcctgggtg

SEQ ID NO: 2473244 - DNA, 13 bp, Homo sapiens
acacaggccctcc

SEQ ID NO: 2473245 - DNA, 16 bp, Homo sapiens
acacaggccctccctg

SEQ ID NO: 2473246 - DNA, 19 bp, Homo sapiens
acacatactcatttttcat

SEQ ID NO: 2473247 - DNA, 19 bp, Homo sapiens
acacatgaaggtaaataaa

SEQ ID NO: 2473248 - DNA, 17 bp, Homo sapiens
acacatttgctttttgt

SEQ ID NO: 2473249 - DNA, 16 bp, Homo sapiens
acacattttttaggaa

SEQ ID NO: 2473250 - DNA, 19 bp, Homo sapiens
acacattttttaggaaatg

SEQ ID NO: 2473251 - DNA, 16 bp, Homo sapiens
acaccaagcacagcag

SEQ ID NO: 2473252 - DNA, 18 bp, Homo sapiens
acaccaagcacagcagcc

SEQ ID NO: 2473253 - DNA, 19 bp, Homo sapiens
acaccaagcacagcagcct

SEQ ID NO: 2473254 - DNA, 21 bp, Homo sapiens
acaccaagcacagcagcctgg

SEQ ID NO: 2473255 - DNA, 16 bp, Homo sapiens
acaccactctggcagc

SEQ ID NO: 2473256 - DNA, 14 bp, Homo sapiens
acaccagggccagc

SEQ ID NO: 2473257 - DNA, 16 bp, Homo sapiens
acaccatgattccttt

SEQ ID NO: 2473258 - DNA, 20 bp, Homo sapiens
acaccatgattcctttaaca

SEQ ID NO: 2473259 - DNA, 15 bp, Homo sapiens
acacccacactcaga

SEQ ID NO: 2473260 - DNA, 22 bp, Homo sapiens
acacctattatcccagctgcct

SEQ ID NO: 2473261 - DNA, 20 bp, Homo sapiens
acacctgtagcacttactgg

SEQ ID NO: 2473262 - DNA, 20 bp, Homo sapiens
acaccttccagctcctgtaa

SEQ ID NO: 2473263 - DNA, 21 bp, Homo sapiens
acaccttttattgacacagaa

SEQ ID NO: 2473264 - DNA, 23 bp, Homo sapiens
acaccttttattgacacagaaaa

SEQ ID NO: 2473265 - DNA, 12 bp, Homo sapiens
acacgcttttgt

SEQ ID NO: 2473266 - DNA, 13 bp, Homo sapiens
acacgggcctgtc

SEQ ID NO: 2473267 - DNA, 15 bp, Homo sapiens
acacgggcctgtcca

SEQ ID NO: 2473268 - DNA, 19 bp, Homo sapiens
acacgtatttgaatggcct

SEQ ID NO: 2473269 - DNA, 23 bp, Homo sapiens
acactaaccaagctgagtttcct

SEQ ID NO: 2473270 - DNA, 17 bp, Homo sapiens
acactaatatatttaaa

SEQ ID NO: 2473271 - DNA, 21 bp, Homo sapiens
acactaatatatttaaaaata

SEQ ID NO: 2473272 - DNA, 12 bp, Homo sapiens
acactaattcat

SEQ ID NO: 2473273 - DNA, 14 bp, Homo sapiens
acactcagaagcct

SEQ ID NO: 2473274 - DNA, 13 bp, Homo sapiens
acactcagcacaa

SEQ ID NO: 2473275 - DNA, 12 bp, Homo sapiens
acactctgctgt

SEQ ID NO: 2473276 - DNA, 18 bp, Homo sapiens
accgtgggcagggagcgg

SEQ ID NO: 2473277 - DNA, 14 bp, Homo sapiens
accgtgggctccct

SEQ ID NO: 2473278 - DNA, 14 bp, Homo sapiens
accgttctgtgcac

SEQ ID NO: 2473279 - DNA, 21 bp, Homo sapiens
acctaaaaggaaatctcaccc

SEQ ID NO: 2473280 - DNA, 21 bp, Homo sapiens
acctaagattacaaatcagaa

SEQ ID NO: 2473281 - DNA, 15 bp, Homo sapiens
acctaatccaggcag

SEQ ID NO: 2473282 - DNA, 22 bp, Homo sapiens
acctaatccaggcagatccagg

SEQ ID NO: 2473283 - DNA, 17 bp, Homo sapiens
acctacagggggtctgg

SEQ ID NO: 2473284 - DNA, 19 bp, Homo sapiens
acctacagggggtctggct

SEQ ID NO: 2473285 - DNA, 21 bp, Homo sapiens
acctacagggggtctggctgg

SEQ ID NO: 2473286 - DNA, 22 bp, Homo sapiens
acctacagggggtctggctggt

SEQ ID NO: 2473287 - DNA, 16 bp, Homo sapiens
acctacagttttaact

SEQ ID NO: 2473288 - DNA, 23 bp, Homo sapiens
acctactgttctaaagctctgac

SEQ ID NO: 2473289 - DNA, 21 bp, Homo sapiens
acctagatgtataactaggag

SEQ ID NO: 2473290 - DNA, 14 bp, Homo sapiens
acctagcagcaccg

SEQ ID NO: 2473291 - DNA, 18 bp, Homo sapiens
acctagctgaatgttttt

SEQ ID NO: 2473292 - DNA, 20 bp, Homo sapiens
acctagctgaatgtttttct

SEQ ID NO: 2473293 - DNA, 23 bp, Homo sapiens
acctagctgaatgtttttctaaa

SEQ ID NO: 2473294 - DNA, 17 bp, Homo sapiens
acctaggaagcctcaga

SEQ ID NO: 2473295 - DNA, 14 bp, Homo sapiens
acctatcccacctc

SEQ ID NO: 2473296 - DNA, 19 bp, Homo sapiens
acctcaatcagtctcagaa

SEQ ID NO: 2473297 - DNA, 19 bp, Homo sapiens
acctcaccaactcctagtt

SEQ ID NO: 2473298 - DNA, 17 bp, Homo sapiens
acctcagaccccggggt

SEQ ID NO: 2473299 - DNA, 22 bp, Homo sapiens
acctcagatggcagcttttaaa

SEQ ID NO: 2473300 - DNA, 13 bp, Homo sapiens
acctcagcctggc

SEQ ID NO: 2473301 - DNA, 15 bp, Homo sapiens
acctcagcctggcca

SEQ ID NO: 2473302 - DNA, 14 bp, Homo sapiens
acctcagcctgggc

SEQ ID NO: 2473303 - DNA, 15 bp, Homo sapiens
acctcagcctgggcg

SEQ ID NO: 2473304 - DNA, 15 bp, Homo sapiens
acctcaggcagctca

SEQ ID NO: 2473305 - DNA, 17 bp, Homo sapiens
acctcaggcagctcaag

SEQ ID NO: 2473306 - DNA, 21 bp, Homo sapiens
acctcagtaatttagaaatca

SEQ ID NO: 2473307 - DNA, 17 bp, Homo sapiens
acctcagttttatcatt

SEQ ID NO: 2473308 - DNA, 17 bp, Homo sapiens
acctccacctcctgggt

SEQ ID NO: 2473309 - DNA, 13 bp, Homo sapiens
acctccagctgtt

SEQ ID NO: 2473310 - DNA, 17 bp, Homo sapiens
acctccagctttcctgt

SEQ ID NO: 2473311 - DNA, 18 bp, Homo sapiens
acctccagctttcctgta

SEQ ID NO: 2473312 - DNA, 21 bp, Homo sapiens
acctccccagcattccagccc

SEQ ID NO: 2473313 - DNA, 23 bp, Homo sapiens
acctccccagcattccagcccct

SEQ ID NO: 2473314 - DNA, 13 bp, Homo sapiens
acctccccttggg

SEQ ID NO: 2473315 - DNA, 22 bp, Homo sapiens
acctccccttgggcccacacct

SEQ ID NO: 2473316 - DNA, 17 bp, Homo sapiens
acctccctatactgctt

SEQ ID NO: 2473317 - DNA, 23 bp, Homo sapiens
acctcctcagcctgaaccccagg

SEQ ID NO: 2473318 - DNA, 18 bp, Homo sapiens
acctcctgacacccttct

SEQ ID NO: 2473319 - DNA, 19 bp, Homo sapiens
acctcctgacacccttctc

SEQ ID NO: 2473320 - DNA, 22 bp, Homo sapiens
acctcctgacacccttctccca

SEQ ID NO: 2473321 - DNA, 15 bp, Homo sapiens
acctccttccctctc

SEQ ID NO: 2473322 - DNA, 16 bp, Homo sapiens
acctccttccctctct

SEQ ID NO: 2473323 - DNA, 15 bp, Homo sapiens
acctcgtactcagga

SEQ ID NO: 2473324 - DNA, 18 bp, Homo sapiens
acctcgtactcaggagcc

SEQ ID NO: 2473325 - DNA, 19 bp, Homo sapiens
acctcgtactcaggagccc

SEQ ID NO: 2473326 - DNA, 19 bp, Homo sapiens
acctctaacagcaccaaat

SEQ ID NO: 2473327 - DNA, 18 bp, Homo sapiens
acctctgggttgggatca

SEQ ID NO: 2473328 - DNA, 15 bp, Homo sapiens
acctcttcagaggcc

SEQ ID NO: 2473329 - DNA, 18 bp, Homo sapiens
acctcttcagaggccctc

SEQ ID NO: 2473330 - DNA, 19 bp, Homo sapiens
acctgaaaacactgtgcac

SEQ ID NO: 2473331 - DNA, 20 bp, Homo sapiens
acctgaaaacactgtgcaca

SEQ ID NO: 2473332 - DNA, 21 bp, Homo sapiens
acctgaaaacactgtgcacat

SEQ ID NO: 2473333 - DNA, 22 bp, Homo sapiens
acctgaaattccaaagtctcta

SEQ ID NO: 2473334 - DNA, 19 bp, Homo sapiens
acctgacacaccaggcgct

SEQ ID NO: 2473335 - DNA, 21 bp, Homo sapiens
acctgacacaccaggcgctaa

SEQ ID NO: 2473336 - DNA, 16 bp, Homo sapiens
acctgacactcccttg

SEQ ID NO: 2473337 - DNA, 19 bp, Homo sapiens
acctgacactcccttgggc

SEQ ID NO: 2473338 - DNA, 19 bp, Homo sapiens
acctgagatttattaaaga

SEQ ID NO: 2473339 - DNA, 13 bp, Homo sapiens
acctgagcctgcc

SEQ ID NO: 2473340 - DNA, 21 bp, Homo sapiens
acctgagcctgccgagcaacc

SEQ ID NO: 2473341 - DNA, 14 bp, Homo sapiens
acctgagggtctgt

SEQ ID NO: 2473342 - DNA, 19 bp, Homo sapiens
acctgagggtctgtaggtt

SEQ ID NO: 2473343 - DNA, 13 bp, Homo sapiens
acctgatcctgga

SEQ ID NO: 2473344 - DNA, 22 bp, Homo sapiens
acctgatcctggaggcccagtt

SEQ ID NO: 2473345 - DNA, 15 bp, Homo sapiens
acctgcaaagatctg

SEQ ID NO: 2473346 - DNA, 17 bp, Homo sapiens
acctgcactaacagagt

SEQ ID NO: 2473347 - DNA, 23 bp, Homo sapiens
acctgcactggggagcccgtctc

SEQ ID NO: 2473348 - DNA, 16 bp, Homo sapiens
acctgcctccagccgc

SEQ ID NO: 2473349 - DNA, 17 bp, Homo sapiens
acctgctcagccctgca

SEQ ID NO: 2473350 - DNA, 12 bp, Homo sapiens
acctgctctcct

SEQ ID NO: 2473351 - DNA, 18 bp, Homo sapiens
acctgctgacctgtgcac

SEQ ID NO: 2473352 - DNA, 12 bp, Homo sapiens
acctgctgagct

SEQ ID NO: 2473353 - DNA, 13 bp, Homo sapiens
acctgctgagctc

SEQ ID NO: 2473354 - DNA, 18 bp, Homo sapiens
acctgctgagctctgaga

SEQ ID NO: 2473355 - DNA, 20 bp, Homo sapiens
acctgctgtgatacgatgct

SEQ ID NO: 2473356 - DNA, 22 bp, Homo sapiens
acctggacttaagcatctggct

SEQ ID NO: 2473357 - DNA, 16 bp, Homo sapiens
acctggctgccatact

SEQ ID NO: 2473358 - DNA, 22 bp, Homo sapiens
acctgggagaaatctggcttct

SEQ ID NO: 2473359 - DNA, 17 bp, Homo sapiens
acctgggcaagctggcg

SEQ ID NO: 2473360 - DNA, 15 bp, Homo sapiens
acctgggccctgggg

SEQ ID NO: 2473361 - DNA, 19 bp, Homo sapiens
acctggtaccctcctggct

SEQ ID NO: 2473362 - DNA, 21 bp, Homo sapiens
acctggtactccctctcagga

SEQ ID NO: 2473363 - DNA, 11 bp, Homo sapiens
acctgtaatca

SEQ ID NO: 2473364 - DNA, 20 bp, Homo sapiens
acctgtaatgacaggcctgt

SEQ ID NO: 2473365 - DNA, 22 bp, Homo sapiens
acctgtgcttcgggcccttccc

SEQ ID NO: 2473366 - DNA, 19 bp, Homo sapiens
acctgtgtggacaggacta

SEQ ID NO: 2473367 - DNA, 21 bp, Homo sapiens
acctgtgtttcttgcctcatt

SEQ ID NO: 2473368 - DNA, 14 bp, Homo sapiens
acctgttgagcatc

SEQ ID NO: 2473369 - DNA, 18 bp, Homo sapiens
accttatagttactgtgt

SEQ ID NO: 2473370 - DNA, 19 bp, Homo sapiens
accttatagttactgtgta

SEQ ID NO: 2473371 - DNA, 22 bp, Homo sapiens
accttatagttactgtgtaatt

SEQ ID NO: 2473372 - DNA, 23 bp, Homo sapiens
accttatagttactgtgtaatta

SEQ ID NO: 2473373 - DNA, 19 bp, Homo sapiens
accttcaaactagggccaa

SEQ ID NO: 2473374 - DNA, 15 bp, Homo sapiens
accttcgggctgtgc

SEQ ID NO: 2473375 - DNA, 18 bp, Homo sapiens
accttcgggctgtgcccg

SEQ ID NO: 2473376 - DNA, 18 bp, Homo sapiens
accttctccccagctccc

SEQ ID NO: 2473377 - DNA, 15 bp, Homo sapiens
accttctgagtacag

SEQ ID NO: 2473378 - DNA, 18 bp, Homo sapiens
accttgaaaaaaaacagt

SEQ ID NO: 2473379 - DNA, 14 bp, Homo sapiens
actgagtgggaagc

SEQ ID NO: 2473380 - DNA, 15 bp, Homo sapiens
actgatgcttagatg

SEQ ID NO: 2473381 - DNA, 13 bp, Homo sapiens
actgatgtctcct

SEQ ID NO: 2473382 - DNA, 14 bp, Homo sapiens
actgatgtctccta

SEQ ID NO: 2473383 - DNA, 17 bp, Homo sapiens
actgatgttgtgttttt

SEQ ID NO: 2473384 - DNA, 15 bp, Homo sapiens
actgatttcagagtg

SEQ ID NO: 2473385 - DNA, 13 bp, Homo sapiens
actgcaacctcca

SEQ ID NO: 2473386 - DNA, 14 bp, Homo sapiens
actgcaacctccac

SEQ ID NO: 2473387 - DNA, 18 bp, Homo sapiens
actgcaacctccacctcc

SEQ ID NO: 2473388 - DNA, 21 bp, Homo sapiens
actgcacctgcctccagccgc

SEQ ID NO: 2473389 - DNA, 15 bp, Homo sapiens
actgcaggccctggc

SEQ ID NO: 2473390 - DNA, 16 bp, Homo sapiens
actgcaggccctggcc

SEQ ID NO: 2473391 - DNA, 10 bp, Homo sapiens
actgcaggga

SEQ ID NO: 2473392 - DNA, 23 bp, Homo sapiens
actgcagggaaaattatttgcat

SEQ ID NO: 2473393 - DNA, 12 bp, Homo sapiens
actgccaggagg

SEQ ID NO: 2473394 - DNA, 15 bp, Homo sapiens
actgccaggagggac

SEQ ID NO: 2473395 - DNA, 21 bp, Homo sapiens
actgccaggagggacaaagga

SEQ ID NO: 2473396 - DNA, 17 bp, Homo sapiens
actgccaggctctcttt

SEQ ID NO: 2473397 - DNA, 19 bp, Homo sapiens
actgccatatgatttacat

SEQ ID NO: 2473398 - DNA, 21 bp, Homo sapiens
actgccatattaaattttttg

SEQ ID NO: 2473399 - DNA, 16 bp, Homo sapiens
actgcccatggacagg

SEQ ID NO: 2473400 - DNA, 19 bp, Homo sapiens
actgcccatggacaggctg

SEQ ID NO: 2473401 - DNA, 18 bp, Homo sapiens
actgccgtcagtgctgtg

SEQ ID NO: 2473402 - DNA, 19 bp, Homo sapiens
actgcctagaaacaacact

SEQ ID NO: 2473403 - DNA, 22 bp, Homo sapiens
actgcctagaaacaacactgta

SEQ ID NO: 2473404 - DNA, 23 bp, Homo sapiens
actgcctagaaacaacactgtag

SEQ ID NO: 2473405 - DNA, 19 bp, Homo sapiens
actgcctcgaaacacagaa

SEQ ID NO: 2473406 - DNA, 13 bp, Homo sapiens
actgcctgctccc

SEQ ID NO: 2473407 - DNA, 21 bp, Homo sapiens
actgccttcgcttcttgcctc

SEQ ID NO: 2473408 - DNA, 15 bp, Homo sapiens
actgcgactttctgc

SEQ ID NO: 2473409 - DNA, 18 bp, Homo sapiens
actgcgactttctgcctg

SEQ ID NO: 2473410 - DNA, 13 bp, Homo sapiens
actgctaaataaa

SEQ ID NO: 2473411 - DNA, 14 bp, Homo sapiens
actgctaaataaaa

SEQ ID NO: 2473412 - DNA, 16 bp, Homo sapiens
actgctaaataaaatt

SEQ ID NO: 2473413 - DNA, 20 bp, Homo sapiens
actgctaaataaaatttgtt

SEQ ID NO: 2473414 - DNA, 15 bp, Homo sapiens
actgctcccacctcc

SEQ ID NO: 2473415 - DNA, 19 bp, Homo sapiens
actgctcccacctcctgac

SEQ ID NO: 2473416 - DNA, 13 bp, Homo sapiens
actgctcctcctc

SEQ ID NO: 2473417 - DNA, 18 bp, Homo sapiens
actgctgagatacataca

SEQ ID NO: 2473418 - DNA, 19 bp, Homo sapiens
actgctgagatacatacag

SEQ ID NO: 2473419 - DNA, 20 bp, Homo sapiens
actgctgagatacatacaga

SEQ ID NO: 2473420 - DNA, 16 bp, Homo sapiens
actgctggagaggccc

SEQ ID NO: 2473421 - DNA, 18 bp, Homo sapiens
actgctgtggccaggagg

SEQ ID NO: 2473422 - DNA, 16 bp, Homo sapiens
actgcttgccctaagc

SEQ ID NO: 2473423 - DNA, 20 bp, Homo sapiens
actgcttgccctaagcagaa

SEQ ID NO: 2473424 - DNA, 14 bp, Homo sapiens
actgctttctgttc

SEQ ID NO: 2473425 - DNA, 20 bp, Homo sapiens
actggaaaacagaacactta

SEQ ID NO: 2473426 - DNA, 12 bp, Homo sapiens
actggaaagaag

SEQ ID NO: 2473427 - DNA, 23 bp, Homo sapiens
actggaaagcttttctattttaa

SEQ ID NO: 2473428 - DNA, 19 bp, Homo sapiens
actggaagctaatttgcat

SEQ ID NO: 2473429 - DNA, 20 bp, Homo sapiens
actggaagctaatttgcatt

SEQ ID NO: 2473430 - DNA, 16 bp, Homo sapiens
actggagtgtgcgtgg

SEQ ID NO: 2473431 - DNA, 22 bp, Homo sapiens
actggccagggccacgctccag

SEQ ID NO: 2473432 - DNA, 17 bp, Homo sapiens
actggctctcctggccc

SEQ ID NO: 2473433 - DNA, 18 bp, Homo sapiens
actggcttttattaatgc

SEQ ID NO: 2473434 - DNA, 23 bp, Homo sapiens
actggcttttattaatgcacttt

SEQ ID NO: 2473435 - DNA, 16 bp, Homo sapiens
actgggaacccctttc

SEQ ID NO: 2473436 - DNA, 17 bp, Homo sapiens
actgggaacccctttcc

SEQ ID NO: 2473437 - DNA, 12 bp, Homo sapiens
actgggaaggct

SEQ ID NO: 2473438 - DNA, 20 bp, Homo sapiens
actgggaaggcttgggattt

SEQ ID NO: 2473439 - DNA, 18 bp, Homo sapiens
actgggagcccccagcct

SEQ ID NO: 2473440 - DNA, 20 bp, Homo sapiens
actgggagcccccagcctgt

SEQ ID NO: 2473441 - DNA, 15 bp, Homo sapiens
actgggcatgagggg

SEQ ID NO: 2473442 - DNA, 23 bp, Homo sapiens
actgggcatgaggggttcctccc

SEQ ID NO: 2473443 - DNA, 18 bp, Homo sapiens
actggggaaactggccat

SEQ ID NO: 2473444 - DNA, 18 bp, Homo sapiens
actggggacttggcctct

SEQ ID NO: 2473445 - DNA, 13 bp, Homo sapiens
actggggagcccg

SEQ ID NO: 2473446 - DNA, 17 bp, Homo sapiens
actggggagcccgtctc

SEQ ID NO: 2473447 - DNA, 18 bp, Homo sapiens
actgggtggtggcctggt

SEQ ID NO: 2473448 - DNA, 18 bp, Homo sapiens
actggtatgtaaaagaaa

SEQ ID NO: 2473449 - DNA, 12 bp, Homo sapiens
actggtctctct

SEQ ID NO: 2473450 - DNA, 15 bp, Homo sapiens
actggtctgtaggga

SEQ ID NO: 2473451 - DNA, 23 bp, Homo sapiens
actggtgcaagttgaggacttct

SEQ ID NO: 2473452 - DNA, 15 bp, Homo sapiens
actgtacagtgtctt

SEQ ID NO: 2473453 - DNA, 13 bp, Homo sapiens
actgtagggaggg

SEQ ID NO: 2473454 - DNA, 21 bp, Homo sapiens
actgtagtaaataatgctttg

SEQ ID NO: 2473455 - DNA, 16 bp, Homo sapiens
actgtagttctaagac

SEQ ID NO: 2473456 - DNA, 15 bp, Homo sapiens
actgtatctaggcaa

SEQ ID NO: 2473457 - DNA, 23 bp, Homo sapiens
actgtatctaggcaacatagtat

SEQ ID NO: 2473458 - DNA, 17 bp, Homo sapiens
actgtcctgggcctgca

SEQ ID NO: 2473459 - DNA, 13 bp, Homo sapiens
actgtcgctgctt

SEQ ID NO: 2473460 - DNA, 14 bp, Homo sapiens
actgtcgctgcttc

SEQ ID NO: 2473461 - DNA, 22 bp, Homo sapiens
actgtctggcccccctggtccc

SEQ ID NO: 2473462 - DNA, 20 bp, Homo sapiens
actgtctggggagcgggtct

SEQ ID NO: 2473463 - DNA, 15 bp, Homo sapiens
actgtgaaggaccct

SEQ ID NO: 2473464 - DNA, 21 bp, Homo sapiens
actgtgacccccagctccggc

SEQ ID NO: 2473465 - DNA, 21 bp, Homo sapiens
actgtgcacatctgtgtcttg

SEQ ID NO: 2473466 - DNA, 18 bp, Homo sapiens
actgtgcaccaagcagga

SEQ ID NO: 2473467 - DNA, 15 bp, Homo sapiens
actgtgcctcagaga

SEQ ID NO: 2473468 - DNA, 18 bp, Homo sapiens
actgtgcctcagagacca

SEQ ID NO: 2473469 - DNA, 19 bp, Homo sapiens
actgtgcctcagagaccag

SEQ ID NO: 2473470 - DNA, 15 bp, Homo sapiens
actgtggatattgtt

SEQ ID NO: 2473471 - DNA, 17 bp, Homo sapiens
actgtgtaactgcccaa

SEQ ID NO: 2473472 - DNA, 19 bp, Homo sapiens
actgtgtaagggccagaaa

SEQ ID NO: 2473473 - DNA, 13 bp, Homo sapiens
actgtgtaattag

SEQ ID NO: 2473474 - DNA, 17 bp, Homo sapiens
actgtgtgtgccctctg

SEQ ID NO: 2473475 - DNA, 19 bp, Homo sapiens
actgtgtgtgccctctggg

SEQ ID NO: 2473476 - DNA, 21 bp, Homo sapiens
actgtgtgtgccctctgggct

SEQ ID NO: 2473477 - DNA, 22 bp, Homo sapiens
actgtgtgtgtgaatgaacact

SEQ ID NO: 2473478 - DNA, 21 bp, Homo sapiens
actgtgttatgcaaaagcaag

SEQ ID NO: 2473479 - DNA, 14 bp, Homo sapiens
actgtgttccttcc

SEQ ID NO: 2473480 - DNA, 16 bp, Homo sapiens
actgttccccctgtgc

SEQ ID NO: 2473481 - DNA, 12 bp, Homo sapiens
actgttgcacgt

SEQ ID NO: 2473482 - DNA, 22 bp, Homo sapiens
actgttgcacgtgtgtttttct

SEQ ID NO: 2473483 - DNA, 17 bp, Homo sapiens
agactctagagtccaag

SEQ ID NO: 2473484 - DNA, 19 bp, Homo sapiens
agactctagagtccaaggt

SEQ ID NO: 2473485 - DNA, 14 bp, Homo sapiens
agactctttatgct

SEQ ID NO: 2473486 - DNA, 18 bp, Homo sapiens
agactcttttccttccct

SEQ ID NO: 2473487 - DNA, 24 bp, Homo sapiens
agactgaatagatatgaaagctga

SEQ ID NO: 2473488 - DNA, 22 bp, Homo sapiens
agactgacagtttacagacgct

SEQ ID NO: 2473489 - DNA, 18 bp, Homo sapiens
agactgctgtggccagga

SEQ ID NO: 2473490 - DNA, 18 bp, Homo sapiens
agactggaacactagaca

SEQ ID NO: 2473491 - DNA, 14 bp, Homo sapiens
agactggaagctaa

SEQ ID NO: 2473492 - DNA, 22 bp, Homo sapiens
agactggcttttattaatgcac

SEQ ID NO: 2473493 - DNA, 23 bp, Homo sapiens
agactggcttttattaatgcact

SEQ ID NO: 2473494 - DNA, 19 bp, Homo sapiens
agactgggaaggcttggga

SEQ ID NO: 2473495 - DNA, 22 bp, Homo sapiens
agactgggaaggcttgggattt

SEQ ID NO: 2473496 - DNA, 15 bp, Homo sapiens
agactgggctgaggg

SEQ ID NO: 2473497 - DNA, 16 bp, Homo sapiens
agactgtgattcagaa

SEQ ID NO: 2473498 - DNA, 18 bp, Homo sapiens
agactgtgtgtgccctct

SEQ ID NO: 2473499 - DNA, 18 bp, Homo sapiens
agacttaagcccagtgca

SEQ ID NO: 2473500 - DNA, 15 bp, Homo sapiens
agacttactctaaga

SEQ ID NO: 2473501 - DNA, 16 bp, Homo sapiens
agacttactctaagat

SEQ ID NO: 2473502 - DNA, 18 bp, Homo sapiens
agacttactctaagatct

SEQ ID NO: 2473503 - DNA, 16 bp, Homo sapiens
agacttctctttgcct

SEQ ID NO: 2473504 - DNA, 22 bp, Homo sapiens
agacttggttggtagggtggga

SEQ ID NO: 2473505 - DNA, 11 bp, Homo sapiens
agacttgttgg

SEQ ID NO: 2473506 - DNA, 16 bp, Homo sapiens
agacttgttggcgtag

SEQ ID NO: 2473507 - DNA, 21 bp, Homo sapiens
agacttgttggcgtaggctac

SEQ ID NO: 2473508 - DNA, 17 bp, Homo sapiens
agactttaacataagct

SEQ ID NO: 2473509 - DNA, 16 bp, Homo sapiens
agactttatgtagttt

SEQ ID NO: 2473510 - DNA, 17 bp, Homo sapiens
agactttatgtagtttt

SEQ ID NO: 2473511 - DNA, 22 bp, Homo sapiens
agactttccattacaagtattt

SEQ ID NO: 2473512 - DNA, 22 bp, Homo sapiens
agactttgctaaagacatgaag

SEQ ID NO: 2473513 - DNA, 13 bp, Homo sapiens
agagaaacagttg

SEQ ID NO: 2473514 - DNA, 16 bp, Homo sapiens
agagaaacagttggta

SEQ ID NO: 2473515 - DNA, 14 bp, Homo sapiens
agagaaaccagctt

SEQ ID NO: 2473516 - DNA, 22 bp, Homo sapiens
agagaaaccagcttccttcaga

SEQ ID NO: 2473517 - DNA, 18 bp, Homo sapiens
agagaaaggggagcccac

SEQ ID NO: 2473518 - DNA, 19 bp, Homo sapiens
agagaaaggggagcccact

SEQ ID NO: 2473519 - DNA, 23 bp, Homo sapiens
agagaaataagtgccctctccca

SEQ ID NO: 2473520 - DNA, 15 bp, Homo sapiens
agagaagacaggctg

SEQ ID NO: 2473521 - DNA, 22 bp, Homo sapiens
agagaagcattctcattggaaa

SEQ ID NO: 2473522 - DNA, 16 bp, Homo sapiens
agagaagccatcacct

SEQ ID NO: 2473523 - DNA, 23 bp, Homo sapiens
agagaagccttcaagctctgagg

SEQ ID NO: 2473524 - DNA, 16 bp, Homo sapiens
agagaagtagaaatca

SEQ ID NO: 2473525 - DNA, 15 bp, Homo sapiens
agagaagtcacaggg

SEQ ID NO: 2473526 - DNA, 12 bp, Homo sapiens
agagaagttgta

SEQ ID NO: 2473527 - DNA, 20 bp, Homo sapiens
agagaatcaacatttctcaa

SEQ ID NO: 2473528 - DNA, 14 bp, Homo sapiens
agagaccagggctc

SEQ ID NO: 2473529 - DNA, 19 bp, Homo sapiens
agagaccagggctccagcc

SEQ ID NO: 2473530 - DNA, 20 bp, Homo sapiens
agagaccagggctccagccc

SEQ ID NO: 2473531 - DNA, 16 bp, Homo sapiens
agagaccttccagaaa

SEQ ID NO: 2473532 - DNA, 16 bp, Homo sapiens
agagacttgttttgga

SEQ ID NO: 2473533 - DNA, 23 bp, Homo sapiens
agagagagggcctgctggagagc

SEQ ID NO: 2473534 - DNA, 14 bp, Homo sapiens
agagagcctgcagg

SEQ ID NO: 2473535 - DNA, 15 bp, Homo sapiens
agagagcctgcagga

SEQ ID NO: 2473536 - DNA, 14 bp, Homo sapiens
agagatcaaagatg

SEQ ID NO: 2473537 - DNA, 14 bp, Homo sapiens
agagatgcctccct

SEQ ID NO: 2473538 - DNA, 15 bp, Homo sapiens
agagatgcctccctg

SEQ ID NO: 2473539 - DNA, 12 bp, Homo sapiens
agagatgtgtgt

SEQ ID NO: 2473540 - DNA, 15 bp, Homo sapiens
agagatgtgtgttga

SEQ ID NO: 2473541 - DNA, 17 bp, Homo sapiens
agagatgtgtgttgata

SEQ ID NO: 2473542 - DNA, 18 bp, Homo sapiens
agagatgtgtgttgatac

SEQ ID NO: 2473543 - DNA, 20 bp, Homo sapiens
agagatgtgtgttgatactg

SEQ ID NO: 2473544 - DNA, 23 bp, Homo sapiens
agagatgtgtgttgatactgttg

SEQ ID NO: 2473545 - DNA, 16 bp, Homo sapiens
agagattacctcctga

SEQ ID NO: 2473546 - DNA, 23 bp, Homo sapiens
agagattctgaactaaagtgctg

SEQ ID NO: 2473547 - DNA, 14 bp, Homo sapiens
agagcactgccacc

SEQ ID NO: 2473548 - DNA, 17 bp, Homo sapiens
agagcagactacagctg

SEQ ID NO: 2473549 - DNA, 20 bp, Homo sapiens
agagcaggactccaggccca

SEQ ID NO: 2473550 - DNA, 22 bp, Homo sapiens
agagcaggactgatgtctccta

SEQ ID NO: 2473551 - DNA, 14 bp, Homo sapiens
agagcatcatgcct

SEQ ID NO: 2473552 - DNA, 21 bp, Homo sapiens
agagcatcatgcctctgaggc

SEQ ID NO: 2473553 - DNA, 23 bp, Homo sapiens
agagcatcatgcctctgaggcca

SEQ ID NO: 2473554 - DNA, 15 bp, Homo sapiens
agagccaccaagagg

SEQ ID NO: 2473555 - DNA, 15 bp, Homo sapiens
agagccactgccatt

SEQ ID NO: 2473556 - DNA, 21 bp, Homo sapiens
agagccagctaaggggtgggg

SEQ ID NO: 2473557 - DNA, 15 bp, Homo sapiens
agagccaggagaagc

SEQ ID NO: 2473558 - DNA, 23 bp, Homo sapiens
agagccaggggggtgaggagctg

SEQ ID NO: 2473559 - DNA, 22 bp, Homo sapiens
agagccatgtcttctccctgga

SEQ ID NO: 2473560 - DNA, 15 bp, Homo sapiens
agagcccagctccaa

SEQ ID NO: 2473561 - DNA, 19 bp, Homo sapiens
agagcccaggagctcccct

SEQ ID NO: 2473562 - DNA, 13 bp, Homo sapiens
agagcccaggctc

SEQ ID NO: 2473563 - DNA, 20 bp, Homo sapiens
agagcccaggctcggcctgc

SEQ ID NO: 2473564 - DNA, 21 bp, Homo sapiens
agagcccgaggaggtgtctca

SEQ ID NO: 2473565 - DNA, 22 bp, Homo sapiens
agagcccgaggaggtgtctcag

SEQ ID NO: 2473566 - DNA, 13 bp, Homo sapiens
agagccctgggac

SEQ ID NO: 2473567 - DNA, 17 bp, Homo sapiens
agagccctgggaccgct

SEQ ID NO: 2473568 - DNA, 23 bp, Homo sapiens
agagccggggtggggtggctgca

SEQ ID NO: 2473569 - DNA, 21 bp, Homo sapiens
agagcctcggccctagcattg

SEQ ID NO: 2473570 - DNA, 13 bp, Homo sapiens
agagcctgaggga

SEQ ID NO: 2473571 - DNA, 16 bp, Homo sapiens
agagcctgcaggatct

SEQ ID NO: 2473572 - DNA, 13 bp, Homo sapiens
agagcctggggct

SEQ ID NO: 2473573 - DNA, 16 bp, Homo sapiens
agagcctggggctcta

SEQ ID NO: 2473574 - DNA, 23 bp, Homo sapiens
agagcctggggctctaacgcctg

SEQ ID NO: 2473575 - DNA, 16 bp, Homo sapiens
agagcctgtaaacttt

SEQ ID NO: 2473576 - DNA, 16 bp, Homo sapiens
agagccttccacccag

SEQ ID NO: 2473577 - DNA, 20 bp, Homo sapiens
agagcgtgagctgagcaggc

SEQ ID NO: 2473578 - DNA, 11 bp, Homo sapiens
agagctacata

SEQ ID NO: 2473579 - DNA, 16 bp, Homo sapiens
agagctacataattta

SEQ ID NO: 2473580 - DNA, 18 bp, Homo sapiens
agagctaggagcaaagcc

SEQ ID NO: 2473581 - DNA, 20 bp, Homo sapiens
agagctaggagcaaagcctg

SEQ ID NO: 2473582 - DNA, 10 bp, Homo sapiens
agagctcagg

SEQ ID NO: 2473583 - DNA, 19 bp, Homo sapiens
agagctgaaggttgtggcc

SEQ ID NO: 2473584 - DNA, 20 bp, Homo sapiens
agagctgaaggttgtggcct

SEQ ID NO: 2473585 - DNA, 18 bp, Homo sapiens
agagctggtgcggctggc

SEQ ID NO: 2473586 - DNA, 19 bp, Homo sapiens
agccagcacacagggcagt

SEQ ID NO: 2473587 - DNA, 13 bp, Homo sapiens
agccagcacctgg

SEQ ID NO: 2473588 - DNA, 23 bp, Homo sapiens
agccagcacctggcatcgcacca

SEQ ID NO: 2473589 - DNA, 12 bp, Homo sapiens
agccagcatctg

SEQ ID NO: 2473590 - DNA, 16 bp, Homo sapiens
agccagcatctgggcc

SEQ ID NO: 2473591 - DNA, 17 bp, Homo sapiens
agccagcatctgggcct

SEQ ID NO: 2473592 - DNA, 13 bp, Homo sapiens
agccagccctgcc

SEQ ID NO: 2473593 - DNA, 14 bp, Homo sapiens
agccagccctgcct

SEQ ID NO: 2473594 - DNA, 16 bp, Homo sapiens
agccagccctgcctgg

SEQ ID NO: 2473595 - DNA, 17 bp, Homo sapiens
agccagccctgcctgga

SEQ ID NO: 2473596 - DNA, 19 bp, Homo sapiens
agccagccctgcctggagg

SEQ ID NO: 2473597 - DNA, 23 bp, Homo sapiens
agccagccctgcctggaggacct

SEQ ID NO: 2473598 - DNA, 10 bp, Homo sapiens
agccagcctc

SEQ ID NO: 2473599 - DNA, 18 bp, Homo sapiens
agccagcctcgcccatcc

SEQ ID NO: 2473600 - DNA, 12 bp, Homo sapiens
agccagcttgtt

SEQ ID NO: 2473601 - DNA, 20 bp, Homo sapiens
agccagcttgtttacatgct

SEQ ID NO: 2473602 - DNA, 14 bp, Homo sapiens
agccaggagaagct

SEQ ID NO: 2473603 - DNA, 20 bp, Homo sapiens
agccaggagaagctcagctg

SEQ ID NO: 2473604 - DNA, 14 bp, Homo sapiens
agccaggcccagcc

SEQ ID NO: 2473605 - DNA, 17 bp, Homo sapiens
agccaggggagcagagg

SEQ ID NO: 2473606 - DNA, 14 bp, Homo sapiens
agccagggtctcca

SEQ ID NO: 2473607 - DNA, 14 bp, Homo sapiens
agccatatttgtaa

SEQ ID NO: 2473608 - DNA, 21 bp, Homo sapiens
agccatatttgtaaaatgaca

SEQ ID NO: 2473609 - DNA, 15 bp, Homo sapiens
agccatcaaaatgct

SEQ ID NO: 2473610 - DNA, 18 bp, Homo sapiens
agccatcccgtcttctcc

SEQ ID NO: 2473611 - DNA, 23 bp, Homo sapiens
agccatgcgccccctccgccctg

SEQ ID NO: 2473612 - DNA, 15 bp, Homo sapiens
agccatgtttcacaa

SEQ ID NO: 2473613 - DNA, 22 bp, Homo sapiens
agccattggctatttaaaactt

SEQ ID NO: 2473614 - DNA, 12 bp, Homo sapiens
agccatttgaga

SEQ ID NO: 2473615 - DNA, 21 bp, Homo sapiens
agcccaagttcatgcagctgt

SEQ ID NO: 2473616 - DNA, 18 bp, Homo sapiens
agcccacgctcaccccct

SEQ ID NO: 2473617 - DNA, 16 bp, Homo sapiens
agcccactccatctgg

SEQ ID NO: 2473618 - DNA, 21 bp, Homo sapiens
agcccactccatctggtagaa

SEQ ID NO: 2473619 - DNA, 15 bp, Homo sapiens
agcccactgtcctgg

SEQ ID NO: 2473620 - DNA, 20 bp, Homo sapiens
agcccactgtcctgggcctg

SEQ ID NO: 2473621 - DNA, 11 bp, Homo sapiens
agcccagagac

SEQ ID NO: 2473622 - DNA, 20 bp, Homo sapiens
agcccagagggtctgggggc

SEQ ID NO: 2473623 - DNA, 21 bp, Homo sapiens
agcccagagggtctgggggca

SEQ ID NO: 2473624 - DNA, 15 bp, Homo sapiens
agcccagcactgctt

SEQ ID NO: 2473625 - DNA, 21 bp, Homo sapiens
agcccagcactgcttgaggaa

SEQ ID NO: 2473626 - DNA, 20 bp, Homo sapiens
agcccagctgggtcaggcag

SEQ ID NO: 2473627 - DNA, 15 bp, Homo sapiens
agcccaggccaggac

SEQ ID NO: 2473628 - DNA, 16 bp, Homo sapiens
agcccaggccaggact

SEQ ID NO: 2473629 - DNA, 20 bp, Homo sapiens
agcccaggccaggactctgc

SEQ ID NO: 2473630 - DNA, 16 bp, Homo sapiens
agcccagggctcctgc

SEQ ID NO: 2473631 - DNA, 23 bp, Homo sapiens
agcccagggctcctgcacttact

SEQ ID NO: 2473632 - DNA, 18 bp, Homo sapiens
agcccagtagaccttgtt

SEQ ID NO: 2473633 - DNA, 14 bp, Homo sapiens
agcccatcctgacc

SEQ ID NO: 2473634 - DNA, 15 bp, Homo sapiens
agcccatcctgacca

SEQ ID NO: 2473635 - DNA, 19 bp, Homo sapiens
agcccatggagattgacct

SEQ ID NO: 2473636 - DNA, 14 bp, Homo sapiens
agccccacccaggc

SEQ ID NO: 2473637 - DNA, 20 bp, Homo sapiens
agccccacccaggccaggca

SEQ ID NO: 2473638 - DNA, 22 bp, Homo sapiens
agccccaccccagggcagccag

SEQ ID NO: 2473639 - DNA, 17 bp, Homo sapiens
agccccaccctggccta

SEQ ID NO: 2473640 - DNA, 19 bp, Homo sapiens
agccccagcccagccccac

SEQ ID NO: 2473641 - DNA, 17 bp, Homo sapiens
agcccccaccctgttcc

SEQ ID NO: 2473642 - DNA, 22 bp, Homo sapiens
agcccccaccctgttcctgctg

SEQ ID NO: 2473643 - DNA, 19 bp, Homo sapiens
agcccccaccgtgggcagg

SEQ ID NO: 2473644 - DNA, 12 bp, Homo sapiens
agcccccagagc

SEQ ID NO: 2473645 - DNA, 13 bp, Homo sapiens
agcccccagagcc

SEQ ID NO: 2473646 - DNA, 14 bp, Homo sapiens
agcccccagagccc

SEQ ID NO: 2473647 - DNA, 13 bp, Homo sapiens
agcccccagcctg

SEQ ID NO: 2473648 - DNA, 20 bp, Homo sapiens
agcccccagctaagaacctg

SEQ ID NO: 2473649 - DNA, 22 bp, Homo sapiens
agcccccagctaagaacctgga

SEQ ID NO: 2473650 - DNA, 22 bp, Homo sapiens
agcccccagctcccacctcccc

SEQ ID NO: 2473651 - DNA, 14 bp, Homo sapiens
agccccctcacagt

SEQ ID NO: 2473652 - DNA, 22 bp, Homo sapiens
agccccctcacagtattgctca

SEQ ID NO: 2473653 - DNA, 21 bp, Homo sapiens
agccccctcctggtgccacct

SEQ ID NO: 2473654 - DNA, 13 bp, Homo sapiens
agcccctctggtc

SEQ ID NO: 2473655 - DNA, 21 bp, Homo sapiens
agcccctctggtcgctcctgc

SEQ ID NO: 2473656 - DNA, 15 bp, Homo sapiens
agcccctgtcatggt

SEQ ID NO: 2473657 - DNA, 21 bp, Homo sapiens
agcccctttcccttgtagctc

SEQ ID NO: 2473658 - DNA, 23 bp, Homo sapiens
agcccctttcccttgtagctcct

SEQ ID NO: 2473659 - DNA, 12 bp, Homo sapiens
agcccggctcct

SEQ ID NO: 2473660 - DNA, 15 bp, Homo sapiens
agcccggctcctggt

SEQ ID NO: 2473661 - DNA, 13 bp, Homo sapiens
agccctaaacatc

SEQ ID NO: 2473662 - DNA, 14 bp, Homo sapiens
agccctaaacatca

SEQ ID NO: 2473663 - DNA, 17 bp, Homo sapiens
agccctagggtggagag

SEQ ID NO: 2473664 - DNA, 20 bp, Homo sapiens
agccctagggtggagagcca

SEQ ID NO: 2473665 - DNA, 22 bp, Homo sapiens
agccctgaggacagatgcctcc

SEQ ID NO: 2473666 - DNA, 12 bp, Homo sapiens
agccctgcctgg

SEQ ID NO: 2473667 - DNA, 14 bp, Homo sapiens
agccctgcctggag

SEQ ID NO: 2473668 - DNA, 17 bp, Homo sapiens
agccctgcctggaggac

SEQ ID NO: 2473669 - DNA, 22 bp, Homo sapiens
agccctgcctggaggacctgag

SEQ ID NO: 2473670 - DNA, 14 bp, Homo sapiens
agccctgggaccgc

SEQ ID NO: 2473671 - DNA, 20 bp, Homo sapiens
agccctgggaccgctacacc

SEQ ID NO: 2473672 - DNA, 20 bp, Homo sapiens
agccctgtcagcatgaattt

SEQ ID NO: 2473673 - DNA, 23 bp, Homo sapiens
agccctgtcctggtggtattttc

SEQ ID NO: 2473674 - DNA, 21 bp, Homo sapiens
agcccttatgcggttaatttt

SEQ ID NO: 2473675 - DNA, 22 bp, Homo sapiens
agcccttatgcggttaattttg

SEQ ID NO: 2473676 - DNA, 21 bp, Homo sapiens
agccgacaccttttttcaaca

SEQ ID NO: 2473677 - DNA, 13 bp, Homo sapiens
agccgaccccctc

SEQ ID NO: 2473678 - DNA, 15 bp, Homo sapiens
agccgagcaggaggc

SEQ ID NO: 2473679 - DNA, 15 bp, Homo sapiens
agccgaggtccctgc

SEQ ID NO: 2473680 - DNA, 16 bp, Homo sapiens
agccggcacagggtct

SEQ ID NO: 2473681 - DNA, 24 bp, Homo sapiens
agccggggtggggtggctgcagcc

SEQ ID NO: 2473682 - DNA, 13 bp, Homo sapiens
agccgtgagcatg

SEQ ID NO: 2473683 - DNA, 18 bp, Homo sapiens
agccgtgctcgccccagc

SEQ ID NO: 2473684 - DNA, 19 bp, Homo sapiens
agcctaggcctagtcctgc

SEQ ID NO: 2473685 - DNA, 14 bp, Homo sapiens
agcctcagattcct

SEQ ID NO: 2473686 - DNA, 17 bp, Homo sapiens
agcctcagattccttcc

SEQ ID NO: 2473687 - DNA, 21 bp, Homo sapiens
agcctcaggactgggagcccc

SEQ ID NO: 2473688 - DNA, 21 bp, Homo sapiens
agcctcagtgaccctggctcc

SEQ ID NO: 2473689 - DNA, 19 bp, Homo sapiens
agcctcccctgccagggca

SEQ ID NO: 2473690 - DNA, 19 bp, Homo sapiens
aggagctaaggctctatga

SEQ ID NO: 2473691 - DNA, 14 bp, Homo sapiens
aggagctacctgtg

SEQ ID NO: 2473692 - DNA, 23 bp, Homo sapiens
aggagctacctgtgtggacagga

SEQ ID NO: 2473693 - DNA, 15 bp, Homo sapiens
aggagctcccctccc

SEQ ID NO: 2473694 - DNA, 17 bp, Homo sapiens
aggagctcccctcccca

SEQ ID NO: 2473695 - DNA, 20 bp, Homo sapiens
aggagctcccctccccaact

SEQ ID NO: 2473696 - DNA, 23 bp, Homo sapiens
aggagctcttaactacagtggct

SEQ ID NO: 2473697 - DNA, 16 bp, Homo sapiens
aggagctgcctggacc

SEQ ID NO: 2473698 - DNA, 16 bp, Homo sapiens
aggaggacccagggct

SEQ ID NO: 2473699 - DNA, 17 bp, Homo sapiens
aggaggacccagggctc

SEQ ID NO: 2473700 - DNA, 15 bp, Homo sapiens
aggaggagggaggcc

SEQ ID NO: 2473701 - DNA, 14 bp, Homo sapiens
aggaggcaggacct

SEQ ID NO: 2473702 - DNA, 13 bp, Homo sapiens
aggaggctccaga

SEQ ID NO: 2473703 - DNA, 17 bp, Homo sapiens
aggaggctccagagggc

SEQ ID NO: 2473704 - DNA, 18 bp, Homo sapiens
aggagggacaaaggagcc

SEQ ID NO: 2473705 - DNA, 18 bp, Homo sapiens
aggaggggaagaggcctg

SEQ ID NO: 2473706 - DNA, 17 bp, Homo sapiens
aggaggggggagggaag

SEQ ID NO: 2473707 - DNA, 20 bp, Homo sapiens
aggagggggtcgtggagagc

SEQ ID NO: 2473708 - DNA, 21 bp, Homo sapiens
aggagggggtcgtggagagct

SEQ ID NO: 2473709 - DNA, 19 bp, Homo sapiens
aggaggtgtctcaggctgc

SEQ ID NO: 2473710 - DNA, 14 bp, Homo sapiens
aggagtagctgagc

SEQ ID NO: 2473711 - DNA, 16 bp, Homo sapiens
aggagtagctgagctc

SEQ ID NO: 2473712 - DNA, 18 bp, Homo sapiens
aggagtatgcagggagct

SEQ ID NO: 2473713 - DNA, 16 bp, Homo sapiens
aggagtctgaggtcct

SEQ ID NO: 2473714 - DNA, 14 bp, Homo sapiens
aggagtttatgttc

SEQ ID NO: 2473715 - DNA, 23 bp, Homo sapiens
aggagtttatgttccattaaacg

SEQ ID NO: 2473716 - DNA, 14 bp, Homo sapiens
aggagtttggagga

SEQ ID NO: 2473717 - DNA, 14 bp, Homo sapiens
aggatagagactgg

SEQ ID NO: 2473718 - DNA, 15 bp, Homo sapiens
aggatagatgctggc

SEQ ID NO: 2473719 - DNA, 20 bp, Homo sapiens
aggatagatgctggcccagg

SEQ ID NO: 2473720 - DNA, 16 bp, Homo sapiens
aggatccggaaagaag

SEQ ID NO: 2473721 - DNA, 18 bp, Homo sapiens
aggatctatttttggagg

SEQ ID NO: 2473722 - DNA, 22 bp, Homo sapiens
aggatgagggaaaagaaaaaga

SEQ ID NO: 2473723 - DNA, 19 bp, Homo sapiens
aggatgctaacatctaaaa

SEQ ID NO: 2473724 - DNA, 23 bp, Homo sapiens
aggatgctaacatctaaaaatag

SEQ ID NO: 2473725 - DNA, 21 bp, Homo sapiens
aggatgtgatatataagtgta

SEQ ID NO: 2473726 - DNA, 17 bp, Homo sapiens
aggatgtgtttgctttc

SEQ ID NO: 2473727 - DNA, 14 bp, Homo sapiens
aggattctaaaatg

SEQ ID NO: 2473728 - DNA, 21 bp, Homo sapiens
aggattgaaaatgtccaggaa

SEQ ID NO: 2473729 - DNA, 19 bp, Homo sapiens
aggattgcgagagatgtgt

SEQ ID NO: 2473730 - DNA, 20 bp, Homo sapiens
aggattgcgagagatgtgtg

SEQ ID NO: 2473731 - DNA, 19 bp, Homo sapiens
aggatttcatgatttcatt

SEQ ID NO: 2473732 - DNA, 19 bp, Homo sapiens
aggcaaaattgcaaatctt

SEQ ID NO: 2473733 - DNA, 20 bp, Homo sapiens
aggcaaaattgcaaatcttg

SEQ ID NO: 2473734 - DNA, 22 bp, Homo sapiens
aggcaaacccatcaacaaaaat

SEQ ID NO: 2473735 - DNA, 22 bp, Homo sapiens
aggcaaatttgcattaaattac

SEQ ID NO: 2473736 - DNA, 12 bp, Homo sapiens
aggcaattagac

SEQ ID NO: 2473737 - DNA, 17 bp, Homo sapiens
aggcaccaaaagaagta

SEQ ID NO: 2473738 - DNA, 18 bp, Homo sapiens
aggcaccaaaagaagtaa

SEQ ID NO: 2473739 - DNA, 15 bp, Homo sapiens
aggcaccaggaagcc

SEQ ID NO: 2473740 - DNA, 21 bp, Homo sapiens
aggcacctacactcacctgca

SEQ ID NO: 2473741 - DNA, 20 bp, Homo sapiens
aggcacctcacaggccccag

SEQ ID NO: 2473742 - DNA, 19 bp, Homo sapiens
aggcactgcaaaccgccac

SEQ ID NO: 2473743 - DNA, 14 bp, Homo sapiens
aggcactgccctgg

SEQ ID NO: 2473744 - DNA, 16 bp, Homo sapiens
aggcactgggcatgag

SEQ ID NO: 2473745 - DNA, 14 bp, Homo sapiens
aggcactgggctcc

SEQ ID NO: 2473746 - DNA, 18 bp, Homo sapiens
aggcacttggcagccttg

SEQ ID NO: 2473747 - DNA, 21 bp, Homo sapiens
aggcagactctttatgcttgc

SEQ ID NO: 2473748 - DNA, 14 bp, Homo sapiens
aggcagaggcccag

SEQ ID NO: 2473749 - DNA, 11 bp, Homo sapiens
aggcagatcca

SEQ ID NO: 2473750 - DNA, 16 bp, Homo sapiens
aggcagatccaggact

SEQ ID NO: 2473751 - DNA, 17 bp, Homo sapiens
aggcagcaaggcccgag

SEQ ID NO: 2473752 - DNA, 18 bp, Homo sapiens
aggcagcaaggcccgagc

SEQ ID NO: 2473753 - DNA, 19 bp, Homo sapiens
aggcagcagtgtgaggcca

SEQ ID NO: 2473754 - DNA, 22 bp, Homo sapiens
aggcagcagtgtgaggccaggg

SEQ ID NO: 2473755 - DNA, 22 bp, Homo sapiens
aggcagccagtgccctgagcca

SEQ ID NO: 2473756 - DNA, 23 bp, Homo sapiens
aggcagccgtgggccccaccctc

SEQ ID NO: 2473757 - DNA, 13 bp, Homo sapiens
aggcagcctctgg

SEQ ID NO: 2473758 - DNA, 14 bp, Homo sapiens
aggcagcctctggg

SEQ ID NO: 2473759 - DNA, 16 bp, Homo sapiens
aggcagcctctggggg

SEQ ID NO: 2473760 - DNA, 21 bp, Homo sapiens
aggcaggaccttcgggctgtg

SEQ ID NO: 2473761 - DNA, 17 bp, Homo sapiens
aggcaggagaatcactt

SEQ ID NO: 2473762 - DNA, 18 bp, Homo sapiens
aggcaggattgaaaatgt

SEQ ID NO: 2473763 - DNA, 22 bp, Homo sapiens
aggcaggattgaaaatgtccag

SEQ ID NO: 2473764 - DNA, 15 bp, Homo sapiens
aggcaggctcccagg

SEQ ID NO: 2473765 - DNA, 16 bp, Homo sapiens
aggcaggctcccaggg

SEQ ID NO: 2473766 - DNA, 15 bp, Homo sapiens
aggcagggctctcct

SEQ ID NO: 2473767 - DNA, 17 bp, Homo sapiens
aggcagggctctcctgg

SEQ ID NO: 2473768 - DNA, 19 bp, Homo sapiens
aggcagggctctcctggct

SEQ ID NO: 2473769 - DNA, 21 bp, Homo sapiens
aggcagggctctcctggcttc

SEQ ID NO: 2473770 - DNA, 23 bp, Homo sapiens
aggcagggctctcctggcttccc

SEQ ID NO: 2473771 - DNA, 14 bp, Homo sapiens
aggcaggggcttcc

SEQ ID NO: 2473772 - DNA, 14 bp, Homo sapiens
aggcagggtgcagt

SEQ ID NO: 2473773 - DNA, 18 bp, Homo sapiens
aggcaggtagggggtccc

SEQ ID NO: 2473774 - DNA, 23 bp, Homo sapiens
aggcagttaccattaaaccatct

SEQ ID NO: 2473775 - DNA, 14 bp, Homo sapiens
aggcagtttgcaaa

SEQ ID NO: 2473776 - DNA, 19 bp, Homo sapiens
aggcatcgtcatgcacagt

SEQ ID NO: 2473777 - DNA, 23 bp, Homo sapiens
aggcatcgtcatgcacagtattt

SEQ ID NO: 2473778 - DNA, 20 bp, Homo sapiens
aggcattctggacctctggg

SEQ ID NO: 2473779 - DNA, 14 bp, Homo sapiens
aggcattgccaagg

SEQ ID NO: 2473780 - DNA, 13 bp, Homo sapiens
aggcattggatat

SEQ ID NO: 2473781 - DNA, 16 bp, Homo sapiens
aggcatttcctgggtg

SEQ ID NO: 2473782 - DNA, 17 bp, Homo sapiens
aggcatttcctgggtgg

SEQ ID NO: 2473783 - DNA, 21 bp, Homo sapiens
aggccaaagagtctccagttt

SEQ ID NO: 2473784 - DNA, 22 bp, Homo sapiens
aggccaaaggggacctggaagg

SEQ ID NO: 2473785 - DNA, 14 bp, Homo sapiens
aggccaaggtgtcc

SEQ ID NO: 2473786 - DNA, 18 bp, Homo sapiens
aggccacactcagcacaa

SEQ ID NO: 2473787 - DNA, 19 bp, Homo sapiens
aggccagcctggcctcctg

SEQ ID NO: 2473788 - DNA, 22 bp, Homo sapiens
aggccagcctggcctcctgcct

SEQ ID NO: 2473789 - DNA, 22 bp, Homo sapiens
aggccaggactctgcagcctca

SEQ ID NO: 2473790 - DNA, 19 bp, Homo sapiens
aggccatggactctgtcct

SEQ ID NO: 2473791 - DNA, 15 bp, Homo sapiens
aggcccaaggctccc

SEQ ID NO: 2473792 - DNA, 17 bp, Homo sapiens
aggcccacattggaaga

SEQ ID NO: 2473793 - DNA, 13 bp, Homo sapiens
agtatgtattatt

SEQ ID NO: 2473794 - DNA, 14 bp, Homo sapiens
agtatgttcaaagt

SEQ ID NO: 2473795 - DNA, 21 bp, Homo sapiens
agtatgttctaacctttacat

SEQ ID NO: 2473796 - DNA, 19 bp, Homo sapiens
agtattaaaatgtatgcat

SEQ ID NO: 2473797 - DNA, 12 bp, Homo sapiens
agtattgttgtc

SEQ ID NO: 2473798 - DNA, 13 bp, Homo sapiens
agtattgttgtcc

SEQ ID NO: 2473799 - DNA, 20 bp, Homo sapiens
agtattgttgtccttttcat

SEQ ID NO: 2473800 - DNA, 21 bp, Homo sapiens
agtattgttgtccttttcata

SEQ ID NO: 2473801 - DNA, 17 bp, Homo sapiens
agtatttaactaattat

SEQ ID NO: 2473802 - DNA, 21 bp, Homo sapiens
agtattttcctgttgtcaaga

SEQ ID NO: 2473803 - DNA, 19 bp, Homo sapiens
agtatttttatatttaaat

SEQ ID NO: 2473804 - DNA, 21 bp, Homo sapiens
agtatttttatatttaaatgt

SEQ ID NO: 2473805 - DNA, 16 bp, Homo sapiens
agtattttttcagtat

SEQ ID NO: 2473806 - DNA, 19 bp, Homo sapiens
agtcaaaacacttgtaatt

SEQ ID NO: 2473807 - DNA, 13 bp, Homo sapiens
agtcaacagtaaa

SEQ ID NO: 2473808 - DNA, 20 bp, Homo sapiens
agtcaagtgcgtccacgagc

SEQ ID NO: 2473809 - DNA, 12 bp, Homo sapiens
agtcaatacata

SEQ ID NO: 2473810 - DNA, 18 bp, Homo sapiens
agtcaatcaagtctgttt

SEQ ID NO: 2473811 - DNA, 18 bp, Homo sapiens
agtcaatgacatgaattt

SEQ ID NO: 2473812 - DNA, 11 bp, Homo sapiens
agtcacacagt

SEQ ID NO: 2473813 - DNA, 20 bp, Homo sapiens
agtcactctagtcaatgaca

SEQ ID NO: 2473814 - DNA, 22 bp, Homo sapiens
agtcactctagtcaatgacatg

SEQ ID NO: 2473815 - DNA, 17 bp, Homo sapiens
agtcaggcccaggcact

SEQ ID NO: 2473816 - DNA, 23 bp, Homo sapiens
agtcataccaatgaaaaaatgta

SEQ ID NO: 2473817 - DNA, 16 bp, Homo sapiens
agtcataggttaatat

SEQ ID NO: 2473818 - DNA, 22 bp, Homo sapiens
agtcataggttaatatttaaga

SEQ ID NO: 2473819 - DNA, 19 bp, Homo sapiens
agtcatcttgctaccagta

SEQ ID NO: 2473820 - DNA, 19 bp, Homo sapiens
agtcatgtttatctgctta

SEQ ID NO: 2473821 - DNA, 17 bp, Homo sapiens
agtcattcgttctgtgg

SEQ ID NO: 2473822 - DNA, 22 bp, Homo sapiens
agtcatttttacaatgtaatta

SEQ ID NO: 2473823 - DNA, 11 bp, Homo sapiens
agtccaagctg

SEQ ID NO: 2473824 - DNA, 13 bp, Homo sapiens
agtccaaggttta

SEQ ID NO: 2473825 - DNA, 14 bp, Homo sapiens
agtccactttgttt

SEQ ID NO: 2473826 - DNA, 14 bp, Homo sapiens
agtccaggctgccg

SEQ ID NO: 2473827 - DNA, 17 bp, Homo sapiens
agtccaggctgccgtgg

SEQ ID NO: 2473828 - DNA, 13 bp, Homo sapiens
agtccaggtcctg

SEQ ID NO: 2473829 - DNA, 17 bp, Homo sapiens
agtccaggtcctggtgg

SEQ ID NO: 2473830 - DNA, 18 bp, Homo sapiens
agtccaggtcctggtggg

SEQ ID NO: 2473831 - DNA, 14 bp, Homo sapiens
agtcccaagcggtg

SEQ ID NO: 2473832 - DNA, 19 bp, Homo sapiens
agtcccaagcggtgtctct

SEQ ID NO: 2473833 - DNA, 18 bp, Homo sapiens
agtcccaggttggctctg

SEQ ID NO: 2473834 - DNA, 23 bp, Homo sapiens
agtcccaggttggctctgccagt

SEQ ID NO: 2473835 - DNA, 21 bp, Homo sapiens
agtccggccccagtacacagg

SEQ ID NO: 2473836 - DNA, 22 bp, Homo sapiens
agtcctatctgggcttcctgga

SEQ ID NO: 2473837 - DNA, 18 bp, Homo sapiens
agtcctgtgaatgccact

SEQ ID NO: 2473838 - DNA, 21 bp, Homo sapiens
agtcgtccttactcctgtggg

SEQ ID NO: 2473839 - DNA, 17 bp, Homo sapiens
agtcgtgacctgctagg

SEQ ID NO: 2473840 - DNA, 15 bp, Homo sapiens
agtcgtgcctgtgtc

SEQ ID NO: 2473841 - DNA, 14 bp, Homo sapiens
agtctagattcaaa

SEQ ID NO: 2473842 - DNA, 15 bp, Homo sapiens
agtctagattcaaag

SEQ ID NO: 2473843 - DNA, 18 bp, Homo sapiens
agtctagattcaaaggtt

SEQ ID NO: 2473844 - DNA, 14 bp, Homo sapiens
agtctagattctct

SEQ ID NO: 2473845 - DNA, 19 bp, Homo sapiens
agtctcagaatgtcatttt

SEQ ID NO: 2473846 - DNA, 13 bp, Homo sapiens
agtctcagctaag

SEQ ID NO: 2473847 - DNA, 20 bp, Homo sapiens
agtctcagtttgtgtgtctt

SEQ ID NO: 2473848 - DNA, 14 bp, Homo sapiens
agtctctcttctct

SEQ ID NO: 2473849 - DNA, 16 bp, Homo sapiens
agtctctgagcagtga

SEQ ID NO: 2473850 - DNA, 17 bp, Homo sapiens
agtctctgctggcccag

SEQ ID NO: 2473851 - DNA, 16 bp, Homo sapiens
agtctgaacagctgta

SEQ ID NO: 2473852 - DNA, 16 bp, Homo sapiens
agtctgaggtcctgag

SEQ ID NO: 2473853 - DNA, 19 bp, Homo sapiens
agtctgaggtcctgagcac

SEQ ID NO: 2473854 - DNA, 14 bp, Homo sapiens
agtctgtggatcag

SEQ ID NO: 2473855 - DNA, 17 bp, Homo sapiens
agtctgtggatcagaga

SEQ ID NO: 2473856 - DNA, 17 bp, Homo sapiens
agtcttccatttgcaag

SEQ ID NO: 2473857 - DNA, 19 bp, Homo sapiens
agtcttccatttgcaaggg

SEQ ID NO: 2473858 - DNA, 15 bp, Homo sapiens
agtctttctctttcc

SEQ ID NO: 2473859 - DNA, 19 bp, Homo sapiens
agtctttctctttccctgg

SEQ ID NO: 2473860 - DNA, 17 bp, Homo sapiens
agtctttggttctaagg

SEQ ID NO: 2473861 - DNA, 15 bp, Homo sapiens
agtgaaataatgtgt

SEQ ID NO: 2473862 - DNA, 16 bp, Homo sapiens
agtgaaataatgtgta

SEQ ID NO: 2473863 - DNA, 16 bp, Homo sapiens
agtgaagactggaagc

SEQ ID NO: 2473864 - DNA, 21 bp, Homo sapiens
agtgaaggcttctctctgtgg

SEQ ID NO: 2473865 - DNA, 15 bp, Homo sapiens
agtgaagttgctgct

SEQ ID NO: 2473866 - DNA, 17 bp, Homo sapiens
agtgaataaatgtcttg

SEQ ID NO: 2473867 - DNA, 14 bp, Homo sapiens
agtgaatgctggga

SEQ ID NO: 2473868 - DNA, 17 bp, Homo sapiens
agtgacagacaggctct

SEQ ID NO: 2473869 - DNA, 15 bp, Homo sapiens
agtgaccctggctcc

SEQ ID NO: 2473870 - DNA, 15 bp, Homo sapiens
agtgactaatggcat

SEQ ID NO: 2473871 - DNA, 17 bp, Homo sapiens
agtgactaatggcatga

SEQ ID NO: 2473872 - DNA, 14 bp, Homo sapiens
agtgacttctgaga

SEQ ID NO: 2473873 - DNA, 21 bp, Homo sapiens
agtgaggcagccgaggtccct

SEQ ID NO: 2473874 - DNA, 22 bp, Homo sapiens
agtgaggtgtgtcacaatgaga

SEQ ID NO: 2473875 - DNA, 17 bp, Homo sapiens
agtgagtaattttggat

SEQ ID NO: 2473876 - DNA, 17 bp, Homo sapiens
agtgagtctctctgggc

SEQ ID NO: 2473877 - DNA, 24 bp, Homo sapiens
agtgagtctctctgggccttagga

SEQ ID NO: 2473878 - DNA, 14 bp, Homo sapiens
agtgagtggccctt

SEQ ID NO: 2473879 - DNA, 19 bp, Homo sapiens
agtgagttttttagtgcgt

SEQ ID NO: 2473880 - DNA, 21 bp, Homo sapiens
agtgatagtcttttgcttttg

SEQ ID NO: 2473881 - DNA, 15 bp, Homo sapiens
agtgattgtcttaat

SEQ ID NO: 2473882 - DNA, 16 bp, Homo sapiens
agtgcaacactggtct

SEQ ID NO: 2473883 - DNA, 21 bp, Homo sapiens
agtgcaacactggtctgctgt

SEQ ID NO: 2473884 - DNA, 21 bp, Homo sapiens
agtgcaataaatctgacccag

SEQ ID NO: 2473885 - DNA, 21 bp, Homo sapiens
agtgcactgaaagtcacggct

SEQ ID NO: 2473886 - DNA, 19 bp, Homo sapiens
agtgcagaatgctcctcca

SEQ ID NO: 2473887 - DNA, 23 bp, Homo sapiens
agtgcatagctactaaaatcagt

SEQ ID NO: 2473888 - DNA, 19 bp, Homo sapiens
agtgcatctggagagaaca

SEQ ID NO: 2473889 - DNA, 21 bp, Homo sapiens
agtgcatctggagagaacagg

SEQ ID NO: 2473890 - DNA, 17 bp, Homo sapiens
agtgccactgttgtttt

SEQ ID NO: 2473891 - DNA, 14 bp, Homo sapiens
agtgccacttaatg

SEQ ID NO: 2473892 - DNA, 17 bp, Homo sapiens
agtgccacttaatgtat

SEQ ID NO: 2473893 - DNA, 20 bp, Homo sapiens
agtgccacttaatgtatgtt

SEQ ID NO: 2473894 - DNA, 23 bp, Homo sapiens
agtgccagtattttaaaatagcg

SEQ ID NO: 2473895 - DNA, 14 bp, Homo sapiens
agtgcccccactga

SEQ ID NO: 2473896 - DNA, 21 bp, Homo sapiens
agtgccctctcccaccctctt

SEQ ID NO: 2473897 - DNA, 19 bp, Homo sapiens
ataaggccataaaacaggt

SEQ ID NO: 2473898 - DNA, 16 bp, Homo sapiens
ataaggtaaaatgcca

SEQ ID NO: 2473899 - DNA, 13 bp, Homo sapiens
ataagtaagtttg

SEQ ID NO: 2473900 - DNA, 18 bp, Homo sapiens
ataagtcaacagtaaacc

SEQ ID NO: 2473901 - DNA, 17 bp, Homo sapiens
ataagtgttctgtctga

SEQ ID NO: 2473902 - DNA, 24 bp, Homo sapiens
ataagttattgcagtttatcattc

SEQ ID NO: 2473903 - DNA, 13 bp, Homo sapiens
ataataaagaata

SEQ ID NO: 2473904 - DNA, 13 bp, Homo sapiens
ataatagattctc

SEQ ID NO: 2473905 - DNA, 13 bp, Homo sapiens
ataatatattttc

SEQ ID NO: 2473906 - DNA, 19 bp, Homo sapiens
ataatcatcaagtaataca

SEQ ID NO: 2473907 - DNA, 17 bp, Homo sapiens
ataatcttataattgtt

SEQ ID NO: 2473908 - DNA, 17 bp, Homo sapiens
ataatgaacagaacata

SEQ ID NO: 2473909 - DNA, 14 bp, Homo sapiens
ataatgttgttatt

SEQ ID NO: 2473910 - DNA, 14 bp, Homo sapiens
ataattatatgttg

SEQ ID NO: 2473911 - DNA, 14 bp, Homo sapiens
ataattctcattaa

SEQ ID NO: 2473912 - DNA, 22 bp, Homo sapiens
ataattctcattaaaagaatat

SEQ ID NO: 2473913 - DNA, 20 bp, Homo sapiens
ataattctgagttttgtgtt

SEQ ID NO: 2473914 - DNA, 19 bp, Homo sapiens
ataattctttcaatacaga

SEQ ID NO: 2473915 - DNA, 17 bp, Homo sapiens
ataattgccaaaaagtg

SEQ ID NO: 2473916 - DNA, 22 bp, Homo sapiens
ataattgccaaaaagtgaaata

SEQ ID NO: 2473917 - DNA, 19 bp, Homo sapiens
ataattgttgttctgttaa

SEQ ID NO: 2473918 - DNA, 22 bp, Homo sapiens
ataattgttgttctgttaactg

SEQ ID NO: 2473919 - DNA, 21 bp, Homo sapiens
ataattgttttatctgaattt

SEQ ID NO: 2473920 - DNA, 14 bp, Homo sapiens
ataatttctaatgt

SEQ ID NO: 2473921 - DNA, 12 bp, Homo sapiens
ataattttgcct

SEQ ID NO: 2473922 - DNA, 12 bp, Homo sapiens
ataattttgtaa

SEQ ID NO: 2473923 - DNA, 13 bp, Homo sapiens
ataattttgtaat

SEQ ID NO: 2473924 - DNA, 18 bp, Homo sapiens
atacaaaaatactcagat

SEQ ID NO: 2473925 - DNA, 14 bp, Homo sapiens
atacaaatggattt

SEQ ID NO: 2473926 - DNA, 24 bp, Homo sapiens
atacacccaagatgggcatctttt

SEQ ID NO: 2473927 - DNA, 17 bp, Homo sapiens
atacactgtgtaaatac

SEQ ID NO: 2473928 - DNA, 18 bp, Homo sapiens
atacactgtgtaaatacc

SEQ ID NO: 2473929 - DNA, 16 bp, Homo sapiens
atacagaactctttca

SEQ ID NO: 2473930 - DNA, 22 bp, Homo sapiens
atacagcagagctaggtggaaa

SEQ ID NO: 2473931 - DNA, 14 bp, Homo sapiens
atacaggaaacagt

SEQ ID NO: 2473932 - DNA, 16 bp, Homo sapiens
atacaggaaacagttg

SEQ ID NO: 2473933 - DNA, 19 bp, Homo sapiens
atacagtcttccatttgca

SEQ ID NO: 2473934 - DNA, 21 bp, Homo sapiens
atacagttctgctctggttgt

SEQ ID NO: 2473935 - DNA, 12 bp, Homo sapiens
atacatacagaa

SEQ ID NO: 2473936 - DNA, 20 bp, Homo sapiens
ataccaaaatgttgctgaaa

SEQ ID NO: 2473937 - DNA, 19 bp, Homo sapiens
ataccactctgtaattgca

SEQ ID NO: 2473938 - DNA, 18 bp, Homo sapiens
ataccagcttagatttta

SEQ ID NO: 2473939 - DNA, 18 bp, Homo sapiens
atacgaaataattgttgt

SEQ ID NO: 2473940 - DNA, 19 bp, Homo sapiens
atacgagagcagaggtctc

SEQ ID NO: 2473941 - DNA, 13 bp, Homo sapiens
atacgtgcacagg

SEQ ID NO: 2473942 - DNA, 17 bp, Homo sapiens
atactaagcattgaatg

SEQ ID NO: 2473943 - DNA, 14 bp, Homo sapiens
atactatatttatg

SEQ ID NO: 2473944 - DNA, 19 bp, Homo sapiens
atactatgtggatgtgaca

SEQ ID NO: 2473945 - DNA, 22 bp, Homo sapiens
atactctttctgtatatacttt

SEQ ID NO: 2473946 - DNA, 19 bp, Homo sapiens
atactgcgactttctgcct

SEQ ID NO: 2473947 - DNA, 20 bp, Homo sapiens
atactgcgactttctgcctg

SEQ ID NO: 2473948 - DNA, 15 bp, Homo sapiens
atactgcttggagct

SEQ ID NO: 2473949 - DNA, 21 bp, Homo sapiens
atactgcttggagctgagcaa

SEQ ID NO: 2473950 - DNA, 15 bp, Homo sapiens
atactggcctggact

SEQ ID NO: 2473951 - DNA, 19 bp, Homo sapiens
atactgtattttgtattgt

SEQ ID NO: 2473952 - DNA, 18 bp, Homo sapiens
atactgttgcacgtgtgt

SEQ ID NO: 2473953 - DNA, 19 bp, Homo sapiens
atactgttgcacgtgtgtt

SEQ ID NO: 2473954 - DNA, 15 bp, Homo sapiens
atacttcgacactgt

SEQ ID NO: 2473955 - DNA, 19 bp, Homo sapiens
atacttcgacactgttctt

SEQ ID NO: 2473956 - DNA, 16 bp, Homo sapiens
atacttctcatttttt

SEQ ID NO: 2473957 - DNA, 16 bp, Homo sapiens
atacttcttgtgtgta

SEQ ID NO: 2473958 - DNA, 19 bp, Homo sapiens
atacttgaacgttttctaa

SEQ ID NO: 2473959 - DNA, 22 bp, Homo sapiens
atacttgaagggccagagccag

SEQ ID NO: 2473960 - DNA, 13 bp, Homo sapiens
atacttggattta

SEQ ID NO: 2473961 - DNA, 13 bp, Homo sapiens
atactttgaatgt

SEQ ID NO: 2473962 - DNA, 22 bp, Homo sapiens
atactttgaatgtgtttcacag

SEQ ID NO: 2473963 - DNA, 20 bp, Homo sapiens
atacttttactctgcctaca

SEQ ID NO: 2473964 - DNA, 13 bp, Homo sapiens
atactttttacaa

SEQ ID NO: 2473965 - DNA, 22 bp, Homo sapiens
atagaaaagtatgttctaacct

SEQ ID NO: 2473966 - DNA, 12 bp, Homo sapiens
atagaataaagg

SEQ ID NO: 2473967 - DNA, 17 bp, Homo sapiens
atagaataaaggcagtt

SEQ ID NO: 2473968 - DNA, 19 bp, Homo sapiens
atagaataaaggcagtttt

SEQ ID NO: 2473969 - DNA, 22 bp, Homo sapiens
atagaataaaggcagttttcta

SEQ ID NO: 2473970 - DNA, 22 bp, Homo sapiens
atagacactccccgaagtcttt

SEQ ID NO: 2473971 - DNA, 13 bp, Homo sapiens
atagacagaagaa

SEQ ID NO: 2473972 - DNA, 14 bp, Homo sapiens
atagacagaagaaa

SEQ ID NO: 2473973 - DNA, 13 bp, Homo sapiens
atagagcctgagg

SEQ ID NO: 2473974 - DNA, 15 bp, Homo sapiens
atagagcctgaggga

SEQ ID NO: 2473975 - DNA, 22 bp, Homo sapiens
atagaggatggtcttacagcag

SEQ ID NO: 2473976 - DNA, 14 bp, Homo sapiens
atagagtgttatca

SEQ ID NO: 2473977 - DNA, 20 bp, Homo sapiens
atagataaaacatctttgaa

SEQ ID NO: 2473978 - DNA, 20 bp, Homo sapiens
atagataagagtagaaactg

SEQ ID NO: 2473979 - DNA, 15 bp, Homo sapiens
atagatgctggccca

SEQ ID NO: 2473980 - DNA, 17 bp, Homo sapiens
atagatgctggcccagg

SEQ ID NO: 2473981 - DNA, 20 bp, Homo sapiens
atagatgctggcccagggcc

SEQ ID NO: 2473982 - DNA, 22 bp, Homo sapiens
atagatgggggaaagcaaagca

SEQ ID NO: 2473983 - DNA, 12 bp, Homo sapiens
atagattctaaa

SEQ ID NO: 2473984 - DNA, 14 bp, Homo sapiens
atagattgtccttt

SEQ ID NO: 2473985 - DNA, 14 bp, Homo sapiens
atagcaaagaattg

SEQ ID NO: 2473986 - DNA, 14 bp, Homo sapiens
atagcacaggctaa

SEQ ID NO: 2473987 - DNA, 19 bp, Homo sapiens
atagcagcctttctctctt

SEQ ID NO: 2473988 - DNA, 15 bp, Homo sapiens
atagccaaaaatagc

SEQ ID NO: 2473989 - DNA, 22 bp, Homo sapiens
atagccacatttggaatacttt

SEQ ID NO: 2473990 - DNA, 23 bp, Homo sapiens
atagccacatttggaatactttt

SEQ ID NO: 2473991 - DNA, 21 bp, Homo sapiens
atagccactaaccttgcctgg

SEQ ID NO: 2473992 - DNA, 16 bp, Homo sapiens
atagccatatttgtaa

SEQ ID NO: 2473993 - DNA, 15 bp, Homo sapiens
atagcccacttacat

SEQ ID NO: 2473994 - DNA, 18 bp, Homo sapiens
atagccctgtcctggtgg

SEQ ID NO: 2473995 - DNA, 23 bp, Homo sapiens
atagccctgtcctggtggtattt

SEQ ID NO: 2473996 - DNA, 15 bp, Homo sapiens
atagcctctgtctgg

SEQ ID NO: 2473997 - DNA, 16 bp, Homo sapiens
atagcctctgtctggc

SEQ ID NO: 2473998 - DNA, 23 bp, Homo sapiens
atagcctctgtctggcaatgcca

SEQ ID NO: 2473999 - DNA, 13 bp, Homo sapiens
atagcgttcttgt

SEQ ID NO: 2474000 - DNA, 17 bp, Homo sapiens
atagcgttcttgtaatt

SEQ ID NO: 2474001 - DNA, 14 bp, Homo sapiens
atctgtgtcttgtt

SEQ ID NO: 2474002 - DNA, 20 bp, Homo sapiens
atctgtgtgaaactttcatt

SEQ ID NO: 2474003 - DNA, 17 bp, Homo sapiens
atctgttttgaaggcaa

SEQ ID NO: 2474004 - DNA, 15 bp, Homo sapiens
atcttagattctctg

SEQ ID NO: 2474005 - DNA, 13 bp, Homo sapiens
atcttagtgtatg

SEQ ID NO: 2474006 - DNA, 16 bp, Homo sapiens
atcttagtgtatgatt

SEQ ID NO: 2474007 - DNA, 17 bp, Homo sapiens
atcttatagttctaggc

SEQ ID NO: 2474008 - DNA, 16 bp, Homo sapiens
atcttcagttgtctct

SEQ ID NO: 2474009 - DNA, 19 bp, Homo sapiens
atcttcagttgtctctgat

SEQ ID NO: 2474010 - DNA, 18 bp, Homo sapiens
atcttctcaagttctaag

SEQ ID NO: 2474011 - DNA, 23 bp, Homo sapiens
atcttgctaccagtatttagaag

SEQ ID NO: 2474012 - DNA, 16 bp, Homo sapiens
atcttggacaaatcac

SEQ ID NO: 2474013 - DNA, 23 bp, Homo sapiens
atcttgggggggtggccgctgag

SEQ ID NO: 2474014 - DNA, 21 bp, Homo sapiens
atcttggttgatgccaaaaaa

SEQ ID NO: 2474015 - DNA, 17 bp, Homo sapiens
atcttggtttgccttcc

SEQ ID NO: 2474016 - DNA, 21 bp, Homo sapiens
atcttggtttgccttccagaa

SEQ ID NO: 2474017 - DNA, 11 bp, Homo sapiens
atcttgtcatg

SEQ ID NO: 2474018 - DNA, 14 bp, Homo sapiens
atcttgtcatgtgt

SEQ ID NO: 2474019 - DNA, 19 bp, Homo sapiens
atcttgtcatgtgtataaa

SEQ ID NO: 2474020 - DNA, 14 bp, Homo sapiens
atctttaaaccaat

SEQ ID NO: 2474021 - DNA, 17 bp, Homo sapiens
atctttacaaaactaca

SEQ ID NO: 2474022 - DNA, 21 bp, Homo sapiens
atctttgaaaggttagagaat

SEQ ID NO: 2474023 - DNA, 20 bp, Homo sapiens
atctttgaaattatgtaaat

SEQ ID NO: 2474024 - DNA, 11 bp, Homo sapiens
atcttttacat

SEQ ID NO: 2474025 - DNA, 14 bp, Homo sapiens
atcttttattttgc

SEQ ID NO: 2474026 - DNA, 21 bp, Homo sapiens
atcttttcaaaggtacttgga

SEQ ID NO: 2474027 - DNA, 14 bp, Homo sapiens
atcttttcatacat

SEQ ID NO: 2474028 - DNA, 16 bp, Homo sapiens
atgaaaaaatgtatat

SEQ ID NO: 2474029 - DNA, 14 bp, Homo sapiens
atgaaaaagaagaa

SEQ ID NO: 2474030 - DNA, 16 bp, Homo sapiens
atgaaaaagaagaatc

SEQ ID NO: 2474031 - DNA, 19 bp, Homo sapiens
atgaaaacagaatgtctct

SEQ ID NO: 2474032 - DNA, 18 bp, Homo sapiens
atgaaaagctagaattga

SEQ ID NO: 2474033 - DNA, 14 bp, Homo sapiens
atgaaaatgtcttg

SEQ ID NO: 2474034 - DNA, 15 bp, Homo sapiens
atgaaaatgtcttgt

SEQ ID NO: 2474035 - DNA, 16 bp, Homo sapiens
atgaactcttaatcaa

SEQ ID NO: 2474036 - DNA, 17 bp, Homo sapiens
atgaaggtaaataaaaa

SEQ ID NO: 2474037 - DNA, 21 bp, Homo sapiens
atgaatgtaaatttgtactat

SEQ ID NO: 2474038 - DNA, 17 bp, Homo sapiens
atgacaatcatgtgtgt

SEQ ID NO: 2474039 - DNA, 18 bp, Homo sapiens
atgacaatcatgtgtgtt

SEQ ID NO: 2474040 - DNA, 17 bp, Homo sapiens
atgacagtgttccccga

SEQ ID NO: 2474041 - DNA, 22 bp, Homo sapiens
atgacatgaattttagcttttg

SEQ ID NO: 2474042 - DNA, 15 bp, Homo sapiens
atgaccaaagtcctt

SEQ ID NO: 2474043 - DNA, 21 bp, Homo sapiens
atgacctccagctttcctgta

SEQ ID NO: 2474044 - DNA, 21 bp, Homo sapiens
atgacctcgtactcaggagcc

SEQ ID NO: 2474045 - DNA, 13 bp, Homo sapiens
atgactgcacatg

SEQ ID NO: 2474046 - DNA, 16 bp, Homo sapiens
atgactgccaagactg

SEQ ID NO: 2474047 - DNA, 17 bp, Homo sapiens
atgactgcttgccctaa

SEQ ID NO: 2474048 - DNA, 20 bp, Homo sapiens
atgacttgggcacccccagc

SEQ ID NO: 2474049 - DNA, 22 bp, Homo sapiens
atgacttgggcacccccagcct

SEQ ID NO: 2474050 - DNA, 16 bp, Homo sapiens
atgagaaggaacttcc

SEQ ID NO: 2474051 - DNA, 13 bp, Homo sapiens
atgagattgaatt

SEQ ID NO: 2474052 - DNA, 21 bp, Homo sapiens
atgagctcccacaagcctgag

SEQ ID NO: 2474053 - DNA, 12 bp, Homo sapiens
atgagctttctg

SEQ ID NO: 2474054 - DNA, 15 bp, Homo sapiens
atgaggccctccaca

SEQ ID NO: 2474055 - DNA, 13 bp, Homo sapiens
atgaggctttcca

SEQ ID NO: 2474056 - DNA, 15 bp, Homo sapiens
atgagggaaaagaaa

SEQ ID NO: 2474057 - DNA, 17 bp, Homo sapiens
atgaggggttcctcccc

SEQ ID NO: 2474058 - DNA, 12 bp, Homo sapiens
atgagtctagat

SEQ ID NO: 2474059 - DNA, 13 bp, Homo sapiens
atgagtctagatg

SEQ ID NO: 2474060 - DNA, 18 bp, Homo sapiens
atgagttccagaaagtaa

SEQ ID NO: 2474061 - DNA, 19 bp, Homo sapiens
atgataatagattctcttg

SEQ ID NO: 2474062 - DNA, 15 bp, Homo sapiens
atgatacatccaaag

SEQ ID NO: 2474063 - DNA, 18 bp, Homo sapiens
atgataccacctttactg

SEQ ID NO: 2474064 - DNA, 20 bp, Homo sapiens
atgataccacctttactgtg

SEQ ID NO: 2474065 - DNA, 18 bp, Homo sapiens
atgatacttcgacactgt

SEQ ID NO: 2474066 - DNA, 17 bp, Homo sapiens
atgatatgcttgtaact

SEQ ID NO: 2474067 - DNA, 23 bp, Homo sapiens
atgatatgcttgtaactaaaata

SEQ ID NO: 2474068 - DNA, 18 bp, Homo sapiens
atgatccctgtgttgtct

SEQ ID NO: 2474069 - DNA, 20 bp, Homo sapiens
atgatccctgtgttgtctct

SEQ ID NO: 2474070 - DNA, 15 bp, Homo sapiens
atgatgaatgagaat

SEQ ID NO: 2474071 - DNA, 20 bp, Homo sapiens
atgatgatcaattatagttt

SEQ ID NO: 2474072 - DNA, 24 bp, Homo sapiens
atgattaaataagattctaacggt

SEQ ID NO: 2474073 - DNA, 22 bp, Homo sapiens
atgattactggcctttttcatt

SEQ ID NO: 2474074 - DNA, 17 bp, Homo sapiens
atgatttaatttgaaat

SEQ ID NO: 2474075 - DNA, 21 bp, Homo sapiens
atgatttcagttctaggaaaa

SEQ ID NO: 2474076 - DNA, 19 bp, Homo sapiens
atgatttccttgaatgtgg

SEQ ID NO: 2474077 - DNA, 21 bp, Homo sapiens
atgattttaagtttctctgca

SEQ ID NO: 2474078 - DNA, 17 bp, Homo sapiens
atgatttttctttacaa

SEQ ID NO: 2474079 - DNA, 13 bp, Homo sapiens
atgcaaactcttt

SEQ ID NO: 2474080 - DNA, 22 bp, Homo sapiens
atgcaaactctttggtcgtttt

SEQ ID NO: 2474081 - DNA, 21 bp, Homo sapiens
atgcacaatgtagataagtgt

SEQ ID NO: 2474082 - DNA, 21 bp, Homo sapiens
atgcacagtatttgtaattaa

SEQ ID NO: 2474083 - DNA, 15 bp, Homo sapiens
atgcaccaccaagcc

SEQ ID NO: 2474084 - DNA, 14 bp, Homo sapiens
atgcacctaaagaa

SEQ ID NO: 2474085 - DNA, 16 bp, Homo sapiens
atgcacctaaagaaaa

SEQ ID NO: 2474086 - DNA, 22 bp, Homo sapiens
atgcactgttccccctgtgcag

SEQ ID NO: 2474087 - DNA, 20 bp, Homo sapiens
atgcacttcaaattcaaata

SEQ ID NO: 2474088 - DNA, 12 bp, Homo sapiens
atgcactttgct

SEQ ID NO: 2474089 - DNA, 19 bp, Homo sapiens
atgcactttgctttaatat

SEQ ID NO: 2474090 - DNA, 14 bp, Homo sapiens
atgcatcagaaagg

SEQ ID NO: 2474091 - DNA, 12 bp, Homo sapiens
atgcatctgttt

SEQ ID NO: 2474092 - DNA, 16 bp, Homo sapiens
atgcatggtgccccag

SEQ ID NO: 2474093 - DNA, 18 bp, Homo sapiens
atgcatggtgccccagga

SEQ ID NO: 2474094 - DNA, 19 bp, Homo sapiens
atgcatggtgccccaggac

SEQ ID NO: 2474095 - DNA, 17 bp, Homo sapiens
atgcatttgggtccagg

SEQ ID NO: 2474096 - DNA, 18 bp, Homo sapiens
atgcatttgggtccagga

SEQ ID NO: 2474097 - DNA, 14 bp, Homo sapiens
atgccaaattaaaa

SEQ ID NO: 2474098 - DNA, 18 bp, Homo sapiens
atgccaaattaaaaaaga

SEQ ID NO: 2474099 - DNA, 19 bp, Homo sapiens
atgccaaattaaaaaagat

SEQ ID NO: 2474100 - DNA, 15 bp, Homo sapiens
atgccacagccctgt

SEQ ID NO: 2474101 - DNA, 19 bp, Homo sapiens
atgccacagccctgtcagc

SEQ ID NO: 2474102 - DNA, 21 bp, Homo sapiens
atgccagccaagctctgcagt

SEQ ID NO: 2474103 - DNA, 23 bp, Homo sapiens
atgccagtaacgcgtcttcctga

SEQ ID NO: 2474104 - DNA, 15 bp, Homo sapiens
atgccatcatctcct

SEQ ID NO: 2474105 - DNA, 21 bp, Homo sapiens
atggtactgactttgcttgct

SEQ ID NO: 2474106 - DNA, 17 bp, Homo sapiens
atggtaggcatttccta

SEQ ID NO: 2474107 - DNA, 14 bp, Homo sapiens
atggtagttttttc

SEQ ID NO: 2474108 - DNA, 15 bp, Homo sapiens
atggtcacacactga

SEQ ID NO: 2474109 - DNA, 16 bp, Homo sapiens
atggtcacacactgat

SEQ ID NO: 2474110 - DNA, 18 bp, Homo sapiens
atggtcacacactgatgc

SEQ ID NO: 2474111 - DNA, 18 bp, Homo sapiens
atggtccaggagaaggcc

SEQ ID NO: 2474112 - DNA, 20 bp, Homo sapiens
atggtcccacatccctgggc

SEQ ID NO: 2474113 - DNA, 23 bp, Homo sapiens
atggtcccacatccctgggcctg

SEQ ID NO: 2474114 - DNA, 15 bp, Homo sapiens
atggtcttacagcag

SEQ ID NO: 2474115 - DNA, 17 bp, Homo sapiens
atggtgaggctgtcagt

SEQ ID NO: 2474116 - DNA, 13 bp, Homo sapiens
atggtgctgggag

SEQ ID NO: 2474117 - DNA, 16 bp, Homo sapiens
atggtgtagaacacta

SEQ ID NO: 2474118 - DNA, 18 bp, Homo sapiens
atggtgtagaacactaat

SEQ ID NO: 2474119 - DNA, 19 bp, Homo sapiens
atggtgtagaacactaatt

SEQ ID NO: 2474120 - DNA, 22 bp, Homo sapiens
atggtgtagaacactaattcat

SEQ ID NO: 2474121 - DNA, 23 bp, Homo sapiens
atggttaagagtccaagaatcca

SEQ ID NO: 2474122 - DNA, 17 bp, Homo sapiens
atggttaccatgtcttt

SEQ ID NO: 2474123 - DNA, 22 bp, Homo sapiens
atggttaccatgtctttctctc

SEQ ID NO: 2474124 - DNA, 14 bp, Homo sapiens
atggtttcagcact

SEQ ID NO: 2474125 - DNA, 22 bp, Homo sapiens
atggtttcagcactagccaaac

SEQ ID NO: 2474126 - DNA, 14 bp, Homo sapiens
atggttttctccaa

SEQ ID NO: 2474127 - DNA, 13 bp, Homo sapiens
atgtaaaacattt

SEQ ID NO: 2474128 - DNA, 15 bp, Homo sapiens
atgtaaaacatttat

SEQ ID NO: 2474129 - DNA, 13 bp, Homo sapiens
atgtaaaatcttg

SEQ ID NO: 2474130 - DNA, 19 bp, Homo sapiens
atgtaaagacaaaaaacta

SEQ ID NO: 2474131 - DNA, 13 bp, Homo sapiens
atgtaaagccatg

SEQ ID NO: 2474132 - DNA, 12 bp, Homo sapiens
atgtaaatttgt

SEQ ID NO: 2474133 - DNA, 13 bp, Homo sapiens
atgtaaatttgta

SEQ ID NO: 2474134 - DNA, 17 bp, Homo sapiens
atgtaaatttgtactat

SEQ ID NO: 2474135 - DNA, 19 bp, Homo sapiens
atgtaaatttgtactattt

SEQ ID NO: 2474136 - DNA, 21 bp, Homo sapiens
atgtaaatttgtactatttaa

SEQ ID NO: 2474137 - DNA, 15 bp, Homo sapiens
atgtaactgcctaga

SEQ ID NO: 2474138 - DNA, 17 bp, Homo sapiens
atgtaactgcctagaaa

SEQ ID NO: 2474139 - DNA, 19 bp, Homo sapiens
atgtaactgcctagaaaca

SEQ ID NO: 2474140 - DNA, 15 bp, Homo sapiens
atgtaagattataga

SEQ ID NO: 2474141 - DNA, 21 bp, Homo sapiens
atgtaagattatagattctaa

SEQ ID NO: 2474142 - DNA, 22 bp, Homo sapiens
atgtaagattatagattctaaa

SEQ ID NO: 2474143 - DNA, 14 bp, Homo sapiens
atgtaataaacttt

SEQ ID NO: 2474144 - DNA, 16 bp, Homo sapiens
atgtaataaactttaa

SEQ ID NO: 2474145 - DNA, 16 bp, Homo sapiens
atgtaatcaatgtttc

SEQ ID NO: 2474146 - DNA, 19 bp, Homo sapiens
atgtaatcttgaattgtaa

SEQ ID NO: 2474147 - DNA, 17 bp, Homo sapiens
atgtaattatttatgta

SEQ ID NO: 2474148 - DNA, 21 bp, Homo sapiens
atgtaatttcaggaggaatac

SEQ ID NO: 2474149 - DNA, 17 bp, Homo sapiens
atgtaattttgtgtaag

SEQ ID NO: 2474150 - DNA, 14 bp, Homo sapiens
atgtacaagatgaa

SEQ ID NO: 2474151 - DNA, 17 bp, Homo sapiens
atgtacatttctcaggc

SEQ ID NO: 2474152 - DNA, 20 bp, Homo sapiens
atgtacccaccgggccactc

SEQ ID NO: 2474153 - DNA, 19 bp, Homo sapiens
atgtactgtatattacaga

SEQ ID NO: 2474154 - DNA, 14 bp, Homo sapiens
atgtagcatgcttg

SEQ ID NO: 2474155 - DNA, 21 bp, Homo sapiens
atgtagctctttgtcagggag

SEQ ID NO: 2474156 - DNA, 22 bp, Homo sapiens
atgtagctctttgtcagggagt

SEQ ID NO: 2474157 - DNA, 14 bp, Homo sapiens
atgtaggaagtagg

SEQ ID NO: 2474158 - DNA, 12 bp, Homo sapiens
atgtaggaggga

SEQ ID NO: 2474159 - DNA, 14 bp, Homo sapiens
atgtagtaacacta

SEQ ID NO: 2474160 - DNA, 16 bp, Homo sapiens
atgtagtaattgacat

SEQ ID NO: 2474161 - DNA, 17 bp, Homo sapiens
atgtagtaattgacatg

SEQ ID NO: 2474162 - DNA, 18 bp, Homo sapiens
atgtagtaattgacatgt

SEQ ID NO: 2474163 - DNA, 21 bp, Homo sapiens
atgtagtattttttgtataat

SEQ ID NO: 2474164 - DNA, 23 bp, Homo sapiens
atgtagtattttttgtataattg

SEQ ID NO: 2474165 - DNA, 16 bp, Homo sapiens
atgtatagtaaatcac

SEQ ID NO: 2474166 - DNA, 15 bp, Homo sapiens
atgtatgcatgttgt

SEQ ID NO: 2474167 - DNA, 19 bp, Homo sapiens
atgtatgggtagggtaaat

SEQ ID NO: 2474168 - DNA, 13 bp, Homo sapiens
atgtatgttacca

SEQ ID NO: 2474169 - DNA, 15 bp, Homo sapiens
atgtattgtgcaatg

SEQ ID NO: 2474170 - DNA, 19 bp, Homo sapiens
atgtattgtgcaatgtgta

SEQ ID NO: 2474171 - DNA, 20 bp, Homo sapiens
atgtattgtgcaatgtgtat

SEQ ID NO: 2474172 - DNA, 13 bp, Homo sapiens
atgtattttatgt

SEQ ID NO: 2474173 - DNA, 19 bp, Homo sapiens
atgtcaaatatttagatgt

SEQ ID NO: 2474174 - DNA, 16 bp, Homo sapiens
atgtcaatttctgtgt

SEQ ID NO: 2474175 - DNA, 16 bp, Homo sapiens
atgtcactaaagcagg

SEQ ID NO: 2474176 - DNA, 10 bp, Homo sapiens
atgtcacttt

SEQ ID NO: 2474177 - DNA, 20 bp, Homo sapiens
atgtcactttttgaggcaaa

SEQ ID NO: 2474178 - DNA, 21 bp, Homo sapiens
atgtcactttttgaggcaaaa

SEQ ID NO: 2474179 - DNA, 15 bp, Homo sapiens
atgtcagtgctgatg

SEQ ID NO: 2474180 - DNA, 15 bp, Homo sapiens
atgtcatacagagaa

SEQ ID NO: 2474181 - DNA, 13 bp, Homo sapiens
atgtcatgctgcc

SEQ ID NO: 2474182 - DNA, 15 bp, Homo sapiens
atgtccaaagaggct

SEQ ID NO: 2474183 - DNA, 16 bp, Homo sapiens
atgtccaacccgtctg

SEQ ID NO: 2474184 - DNA, 23 bp, Homo sapiens
atgtccttgtgatgtgcacgtaa

SEQ ID NO: 2474185 - DNA, 15 bp, Homo sapiens
atgtctcctaagcac

SEQ ID NO: 2474186 - DNA, 15 bp, Homo sapiens
atgtctcttcctggt

SEQ ID NO: 2474187 - DNA, 16 bp, Homo sapiens
atgtctcttcctggta

SEQ ID NO: 2474188 - DNA, 12 bp, Homo sapiens
atgtctggagac

SEQ ID NO: 2474189 - DNA, 12 bp, Homo sapiens
atgtctggggca

SEQ ID NO: 2474190 - DNA, 19 bp, Homo sapiens
atgtctggttctcaattcc

SEQ ID NO: 2474191 - DNA, 14 bp, Homo sapiens
atgtcttctccctg

SEQ ID NO: 2474192 - DNA, 23 bp, Homo sapiens
atgtcttgatgcatgcactgttc

SEQ ID NO: 2474193 - DNA, 16 bp, Homo sapiens
atgtctttaatgcaat

SEQ ID NO: 2474194 - DNA, 16 bp, Homo sapiens
atgtcttttcccattt

SEQ ID NO: 2474195 - DNA, 21 bp, Homo sapiens
atgtcttttcccatttatcta

SEQ ID NO: 2474196 - DNA, 22 bp, Homo sapiens
atgtgaaaatggtccaggagaa

SEQ ID NO: 2474197 - DNA, 12 bp, Homo sapiens
atgtgaaccatt

SEQ ID NO: 2474198 - DNA, 12 bp, Homo sapiens
atgtgaagccaa

SEQ ID NO: 2474199 - DNA, 13 bp, Homo sapiens
atgtgacatttat

SEQ ID NO: 2474200 - DNA, 19 bp, Homo sapiens
atgtgacatttatatattg

SEQ ID NO: 2474201 - DNA, 19 bp, Homo sapiens
atgtgaccactctgtcttg

SEQ ID NO: 2474202 - DNA, 18 bp, Homo sapiens
atgtgataaggaaatcaa

SEQ ID NO: 2474203 - DNA, 20 bp, Homo sapiens
atgtgataaggaaatcaact

SEQ ID NO: 2474204 - DNA, 15 bp, Homo sapiens
atgtgatatataagt

SEQ ID NO: 2474205 - DNA, 15 bp, Homo sapiens
atgtgatattctaag

SEQ ID NO: 2474206 - DNA, 15 bp, Homo sapiens
atgtgatgttctaag

SEQ ID NO: 2474207 - DNA, 21 bp, Homo sapiens
atgtgatgttctaaggctctg

SEQ ID NO: 2474208 - DNA, 17 bp, Homo sapiens
atgtgattgtggaatgg

SEQ ID NO: 2474209 - DNA, 14 bp, Homo sapiens
attggaactggagg

SEQ ID NO: 2474210 - DNA, 15 bp, Homo sapiens
attggatttcctaat

SEQ ID NO: 2474211 - DNA, 18 bp, Homo sapiens
attggcaccgaagcccag

SEQ ID NO: 2474212 - DNA, 15 bp, Homo sapiens
attggcatggaaatt

SEQ ID NO: 2474213 - DNA, 12 bp, Homo sapiens
attggcctgtag

SEQ ID NO: 2474214 - DNA, 22 bp, Homo sapiens
attggcctgtagagttgctgag

SEQ ID NO: 2474215 - DNA, 16 bp, Homo sapiens
attgggccagcttttc

SEQ ID NO: 2474216 - DNA, 12 bp, Homo sapiens
attggggttatt

SEQ ID NO: 2474217 - DNA, 19 bp, Homo sapiens
attgggtttttggacttct

SEQ ID NO: 2474218 - DNA, 22 bp, Homo sapiens
attgggtttttggacttctggg

SEQ ID NO: 2474219 - DNA, 19 bp, Homo sapiens
attgtaaaagcattttgta

SEQ ID NO: 2474220 - DNA, 20 bp, Homo sapiens
attgtaaaagcattttgtaa

SEQ ID NO: 2474221 - DNA, 21 bp, Homo sapiens
attgtaaaagcattttgtaat

SEQ ID NO: 2474222 - DNA, 23 bp, Homo sapiens
attgtaaaagcattttgtaataa

SEQ ID NO: 2474223 - DNA, 13 bp, Homo sapiens
attgtaaaataat

SEQ ID NO: 2474224 - DNA, 17 bp, Homo sapiens
attgtaaaataattctg

SEQ ID NO: 2474225 - DNA, 20 bp, Homo sapiens
attgtaaaattatttcatga

SEQ ID NO: 2474226 - DNA, 15 bp, Homo sapiens
attgtactaaagcca

SEQ ID NO: 2474227 - DNA, 20 bp, Homo sapiens
attgtagcgtctttcttttt

SEQ ID NO: 2474228 - DNA, 13 bp, Homo sapiens
attgtatattgta

SEQ ID NO: 2474229 - DNA, 15 bp, Homo sapiens
attgtatgtggtcat

SEQ ID NO: 2474230 - DNA, 18 bp, Homo sapiens
attgtccaatcctatgtt

SEQ ID NO: 2474231 - DNA, 23 bp, Homo sapiens
attgtctgaaaagtgaagacaga

SEQ ID NO: 2474232 - DNA, 16 bp, Homo sapiens
attgtgattagacaga

SEQ ID NO: 2474233 - DNA, 23 bp, Homo sapiens
attgtgattagacagaacaccta

SEQ ID NO: 2474234 - DNA, 17 bp, Homo sapiens
attgtgcaatgtaaata

SEQ ID NO: 2474235 - DNA, 15 bp, Homo sapiens
attgtgcaatgtgta

SEQ ID NO: 2474236 - DNA, 20 bp, Homo sapiens
attgtgcagtactttgtgca

SEQ ID NO: 2474237 - DNA, 21 bp, Homo sapiens
attgtggtttatatatttaaa

SEQ ID NO: 2474238 - DNA, 15 bp, Homo sapiens
attgtgtagcctttt

SEQ ID NO: 2474239 - DNA, 22 bp, Homo sapiens
attgtgtagcctttttgtataa

SEQ ID NO: 2474240 - DNA, 17 bp, Homo sapiens
attgtgtcagactgttt

SEQ ID NO: 2474241 - DNA, 19 bp, Homo sapiens
attgttgaaaaagtttgtt

SEQ ID NO: 2474242 - DNA, 20 bp, Homo sapiens
attgttgaaaaagtttgttt

SEQ ID NO: 2474243 - DNA, 14 bp, Homo sapiens
attgttgcattgct

SEQ ID NO: 2474244 - DNA, 16 bp, Homo sapiens
attgttgcattgcttt

SEQ ID NO: 2474245 - DNA, 18 bp, Homo sapiens
attgttgttctgttaact

SEQ ID NO: 2474246 - DNA, 13 bp, Homo sapiens
atttaaaaaacta

SEQ ID NO: 2474247 - DNA, 22 bp, Homo sapiens
atttaaaaataagtcaacagta

SEQ ID NO: 2474248 - DNA, 23 bp, Homo sapiens
atttaaaaataagtcaacagtaa

SEQ ID NO: 2474249 - DNA, 21 bp, Homo sapiens
atttaaaacattaaaatataa

SEQ ID NO: 2474250 - DNA, 11 bp, Homo sapiens
atttaaaactt

SEQ ID NO: 2474251 - DNA, 16 bp, Homo sapiens
atttaaaataattata

SEQ ID NO: 2474252 - DNA, 22 bp, Homo sapiens
atttaaaatagcaaaagaagaa

SEQ ID NO: 2474253 - DNA, 22 bp, Homo sapiens
atttaaaccgctaaaagaaact

SEQ ID NO: 2474254 - DNA, 20 bp, Homo sapiens
atttaaactataagcaagaa

SEQ ID NO: 2474255 - DNA, 11 bp, Homo sapiens
atttaaagcag

SEQ ID NO: 2474256 - DNA, 16 bp, Homo sapiens
atttaaagcaggttct

SEQ ID NO: 2474257 - DNA, 21 bp, Homo sapiens
atttaaatacagtcttccatt

SEQ ID NO: 2474258 - DNA, 22 bp, Homo sapiens
atttaacagaaattgtatattg

SEQ ID NO: 2474259 - DNA, 20 bp, Homo sapiens
atttaacccccctgtacaca

SEQ ID NO: 2474260 - DNA, 21 bp, Homo sapiens
atttaacccccctgtacacaa

SEQ ID NO: 2474261 - DNA, 23 bp, Homo sapiens
atttaacccccctgtacacaact

SEQ ID NO: 2474262 - DNA, 17 bp, Homo sapiens
atttaacttttagtaaa

SEQ ID NO: 2474263 - DNA, 15 bp, Homo sapiens
atttaataatctgta

SEQ ID NO: 2474264 - DNA, 23 bp, Homo sapiens
atttacaaaaatataaaatatga

SEQ ID NO: 2474265 - DNA, 15 bp, Homo sapiens
atttacaaactgaag

SEQ ID NO: 2474266 - DNA, 15 bp, Homo sapiens
atttacatttaatag

SEQ ID NO: 2474267 - DNA, 15 bp, Homo sapiens
atttacgctttgatt

SEQ ID NO: 2474268 - DNA, 17 bp, Homo sapiens
atttacgctttgattca

SEQ ID NO: 2474269 - DNA, 19 bp, Homo sapiens
atttacgctttgattcata

SEQ ID NO: 2474270 - DNA, 14 bp, Homo sapiens
atttagaaaacttt

SEQ ID NO: 2474271 - DNA, 21 bp, Homo sapiens
atttagaagccaactatgatt

SEQ ID NO: 2474272 - DNA, 19 bp, Homo sapiens
atttagacttggattcttt

SEQ ID NO: 2474273 - DNA, 23 bp, Homo sapiens
atttagacttggattctttccat

SEQ ID NO: 2474274 - DNA, 17 bp, Homo sapiens
atttagatgataaagag

SEQ ID NO: 2474275 - DNA, 14 bp, Homo sapiens
atttagatttgtgt

SEQ ID NO: 2474276 - DNA, 15 bp, Homo sapiens
atttagcatgttgtt

SEQ ID NO: 2474277 - DNA, 19 bp, Homo sapiens
atttagcattgtagtgctt

SEQ ID NO: 2474278 - DNA, 22 bp, Homo sapiens
atttagcattgtagtgctttga

SEQ ID NO: 2474279 - DNA, 14 bp, Homo sapiens
atttagcctgtcct

SEQ ID NO: 2474280 - DNA, 16 bp, Homo sapiens
atttagcctgtcctgt

SEQ ID NO: 2474281 - DNA, 23 bp, Homo sapiens
atttagctaaacggattccaaag

SEQ ID NO: 2474282 - DNA, 13 bp, Homo sapiens
atttagtgagcat

SEQ ID NO: 2474283 - DNA, 15 bp, Homo sapiens
atttagtgtatccat

SEQ ID NO: 2474284 - DNA, 12 bp, Homo sapiens
atttagtttcag

SEQ ID NO: 2474285 - DNA, 23 bp, Homo sapiens
atttagtttcagtagattgcaga

SEQ ID NO: 2474286 - DNA, 15 bp, Homo sapiens
atttagtttgattat

SEQ ID NO: 2474287 - DNA, 20 bp, Homo sapiens
atttataacgtgttcaatat

SEQ ID NO: 2474288 - DNA, 14 bp, Homo sapiens
atttatatattgaa

SEQ ID NO: 2474289 - DNA, 13 bp, Homo sapiens
atttatattgata

SEQ ID NO: 2474290 - DNA, 20 bp, Homo sapiens
atttatattgataagatctt

SEQ ID NO: 2474291 - DNA, 21 bp, Homo sapiens
atttatattgataagatcttt

SEQ ID NO: 2474292 - DNA, 22 bp, Homo sapiens
atttatattgataagatctttt

SEQ ID NO: 2474293 - DNA, 14 bp, Homo sapiens
atttatcacacaaa

SEQ ID NO: 2474294 - DNA, 17 bp, Homo sapiens
atttatcacacaaagca

SEQ ID NO: 2474295 - DNA, 19 bp, Homo sapiens
atttatcgctgggaaatga

SEQ ID NO: 2474296 - DNA, 15 bp, Homo sapiens
atttatctaaatatg

SEQ ID NO: 2474297 - DNA, 15 bp, Homo sapiens
atttatctataattt

SEQ ID NO: 2474298 - DNA, 15 bp, Homo sapiens
atttatggttgttaa

SEQ ID NO: 2474299 - DNA, 23 bp, Homo sapiens
atttatggttgttaaaaatgtca

SEQ ID NO: 2474300 - DNA, 12 bp, Homo sapiens
atttatgtattg

SEQ ID NO: 2474301 - DNA, 14 bp, Homo sapiens
atttatgtattgtg

SEQ ID NO: 2474302 - DNA, 17 bp, Homo sapiens
atttatgtattgtgcaa

SEQ ID NO: 2474303 - DNA, 14 bp, Homo sapiens
atttattaaagaaa

SEQ ID NO: 2474304 - DNA, 16 bp, Homo sapiens
atttattaaagaaaaa

SEQ ID NO: 2474305 - DNA, 22 bp, Homo sapiens
atttattaaagaaaaaaatgta

SEQ ID NO: 2474306 - DNA, 23 bp, Homo sapiens
atttattaaagaaaaaaatgtat

SEQ ID NO: 2474307 - DNA, 14 bp, Homo sapiens
atttattgactttg

SEQ ID NO: 2474308 - DNA, 21 bp, Homo sapiens
atttatttgaatgatttttct

SEQ ID NO: 2474309 - DNA, 12 bp, Homo sapiens
atttattttgac

SEQ ID NO: 2474310 - DNA, 16 bp, Homo sapiens
atttcaaaatgctttt

SEQ ID NO: 2474311 - DNA, 21 bp, Homo sapiens
atttcaaaatgctttttatta

SEQ ID NO: 2474312 - DNA, 17 bp, Homo sapiens
atttcactggagcacaa

SEQ ID NO: 2474313 - DNA, 14 bp, Homo sapiens
caagaaaaataaag

SEQ ID NO: 2474314 - DNA, 16 bp, Homo sapiens
caagaaaaataaagaa

SEQ ID NO: 2474315 - DNA, 19 bp, Homo sapiens
caagaaaaataaagaaaag

SEQ ID NO: 2474316 - DNA, 22 bp, Homo sapiens
caagaaaaataaagaaaagatg

SEQ ID NO: 2474317 - DNA, 22 bp, Homo sapiens
caagaaaacaggcactgccctg

SEQ ID NO: 2474318 - DNA, 20 bp, Homo sapiens
caagaaaataagagctcagg

SEQ ID NO: 2474319 - DNA, 13 bp, Homo sapiens
caagaagcagtgg

SEQ ID NO: 2474320 - DNA, 15 bp, Homo sapiens
caagaatcagagaag

SEQ ID NO: 2474321 - DNA, 14 bp, Homo sapiens
caagaatccacatt

SEQ ID NO: 2474322 - DNA, 19 bp, Homo sapiens
caagaatccacatttctaa

SEQ ID NO: 2474323 - DNA, 22 bp, Homo sapiens
caagaatggatcacaagatgga

SEQ ID NO: 2474324 - DNA, 14 bp, Homo sapiens
caagactctagagt

SEQ ID NO: 2474325 - DNA, 22 bp, Homo sapiens
caagactctttatgatctggcc

SEQ ID NO: 2474326 - DNA, 21 bp, Homo sapiens
caagactgctgtggccaggag

SEQ ID NO: 2474327 - DNA, 13 bp, Homo sapiens
caagagaagcatt

SEQ ID NO: 2474328 - DNA, 18 bp, Homo sapiens
caagagaagcattctcat

SEQ ID NO: 2474329 - DNA, 20 bp, Homo sapiens
caagagcatcatgcctctga

SEQ ID NO: 2474330 - DNA, 22 bp, Homo sapiens
caagagcatcatgcctctgagg

SEQ ID NO: 2474331 - DNA, 23 bp, Homo sapiens
caagagcatcatgcctctgaggc

SEQ ID NO: 2474332 - DNA, 16 bp, Homo sapiens
caagaggagcccccac

SEQ ID NO: 2474333 - DNA, 19 bp, Homo sapiens
caagagtgaattccctcac

SEQ ID NO: 2474334 - DNA, 21 bp, Homo sapiens
caagatattttaaaatctgtc

SEQ ID NO: 2474335 - DNA, 18 bp, Homo sapiens
caagatgaaggagaggca

SEQ ID NO: 2474336 - DNA, 20 bp, Homo sapiens
caagatgggcatcttttgta

SEQ ID NO: 2474337 - DNA, 13 bp, Homo sapiens
caagattctagat

SEQ ID NO: 2474338 - DNA, 17 bp, Homo sapiens
caagattgagctctctg

SEQ ID NO: 2474339 - DNA, 12 bp, Homo sapiens
caagcacagcag

SEQ ID NO: 2474340 - DNA, 20 bp, Homo sapiens
caagcacatctgcattttca

SEQ ID NO: 2474341 - DNA, 18 bp, Homo sapiens
caagcagtcgtgcctgtg

SEQ ID NO: 2474342 - DNA, 22 bp, Homo sapiens
caagcagttgggactacaggcg

SEQ ID NO: 2474343 - DNA, 18 bp, Homo sapiens
caagcatggctattttat

SEQ ID NO: 2474344 - DNA, 16 bp, Homo sapiens
caagcattcagaagaa

SEQ ID NO: 2474345 - DNA, 22 bp, Homo sapiens
caagcattcagaagaaaaagaa

SEQ ID NO: 2474346 - DNA, 13 bp, Homo sapiens
caagccagaggct

SEQ ID NO: 2474347 - DNA, 16 bp, Homo sapiens
caagccagaggctggg

SEQ ID NO: 2474348 - DNA, 17 bp, Homo sapiens
caagcccagcactgctt

SEQ ID NO: 2474349 - DNA, 17 bp, Homo sapiens
caagcctgagggaaagg

SEQ ID NO: 2474350 - DNA, 14 bp, Homo sapiens
caagctaagcactg

SEQ ID NO: 2474351 - DNA, 13 bp, Homo sapiens
caagctccaagcc

SEQ ID NO: 2474352 - DNA, 14 bp, Homo sapiens
caagctctgaggga

SEQ ID NO: 2474353 - DNA, 13 bp, Homo sapiens
caagctcttcctt

SEQ ID NO: 2474354 - DNA, 21 bp, Homo sapiens
caagctgaggtgcccaggaga

SEQ ID NO: 2474355 - DNA, 20 bp, Homo sapiens
caagctgagtattaaaatgt

SEQ ID NO: 2474356 - DNA, 14 bp, Homo sapiens
caagctgagtttcc

SEQ ID NO: 2474357 - DNA, 16 bp, Homo sapiens
caagctgagtttccta

SEQ ID NO: 2474358 - DNA, 19 bp, Homo sapiens
caagctgattaaatgacac

SEQ ID NO: 2474359 - DNA, 17 bp, Homo sapiens
caagcttctgtcctgcc

SEQ ID NO: 2474360 - DNA, 15 bp, Homo sapiens
caaggaaaaacaggt

SEQ ID NO: 2474361 - DNA, 16 bp, Homo sapiens
caaggaagtagaaaca

SEQ ID NO: 2474362 - DNA, 19 bp, Homo sapiens
caaggaagtagaaacaaaa

SEQ ID NO: 2474363 - DNA, 16 bp, Homo sapiens
caaggaatttcttaac

SEQ ID NO: 2474364 - DNA, 23 bp, Homo sapiens
caaggaatttcttaacttcttgc

SEQ ID NO: 2474365 - DNA, 15 bp, Homo sapiens
caaggactttgtaca

SEQ ID NO: 2474366 - DNA, 17 bp, Homo sapiens
caaggaggcagcctgga

SEQ ID NO: 2474367 - DNA, 15 bp, Homo sapiens
caaggatagatgctg

SEQ ID NO: 2474368 - DNA, 21 bp, Homo sapiens
caaggatagatgctggcccag

SEQ ID NO: 2474369 - DNA, 15 bp, Homo sapiens
caaggcactctagat

SEQ ID NO: 2474370 - DNA, 20 bp, Homo sapiens
caaggcagaggcctgggctg

SEQ ID NO: 2474371 - DNA, 12 bp, Homo sapiens
caaggcagccgt

SEQ ID NO: 2474372 - DNA, 19 bp, Homo sapiens
caaggcccgagcagctgag

SEQ ID NO: 2474373 - DNA, 22 bp, Homo sapiens
caaggccttattggaaagcagt

SEQ ID NO: 2474374 - DNA, 16 bp, Homo sapiens
caagggaacctgtgtc

SEQ ID NO: 2474375 - DNA, 18 bp, Homo sapiens
caagggcataaattattg

SEQ ID NO: 2474376 - DNA, 22 bp, Homo sapiens
caaggggcttcaggtccaggct

SEQ ID NO: 2474377 - DNA, 16 bp, Homo sapiens
caagggtcaggccttt

SEQ ID NO: 2474378 - DNA, 18 bp, Homo sapiens
caagggtcaggcctttga

SEQ ID NO: 2474379 - DNA, 14 bp, Homo sapiens
caaggtactctggt

SEQ ID NO: 2474380 - DNA, 21 bp, Homo sapiens
caaggtcctctgtcagtcaca

SEQ ID NO: 2474381 - DNA, 22 bp, Homo sapiens
caaggtcctctgtcagtcacag

SEQ ID NO: 2474382 - DNA, 19 bp, Homo sapiens
caaggtcgtttttttcatt

SEQ ID NO: 2474383 - DNA, 13 bp, Homo sapiens
caaggtctttaaa

SEQ ID NO: 2474384 - DNA, 16 bp, Homo sapiens
caaggtgtcctacaga

SEQ ID NO: 2474385 - DNA, 18 bp, Homo sapiens
caaggttcaacttattaa

SEQ ID NO: 2474386 - DNA, 15 bp, Homo sapiens
caaggttctccaaca

SEQ ID NO: 2474387 - DNA, 21 bp, Homo sapiens
caaggtttaaagagtctagat

SEQ ID NO: 2474388 - DNA, 23 bp, Homo sapiens
caagtagaatctcagttgatttt

SEQ ID NO: 2474389 - DNA, 20 bp, Homo sapiens
caagtatttgttaatttaga

SEQ ID NO: 2474390 - DNA, 16 bp, Homo sapiens
caagtccaggtcctgg

SEQ ID NO: 2474391 - DNA, 20 bp, Homo sapiens
caagtctttctctttccctg

SEQ ID NO: 2474392 - DNA, 19 bp, Homo sapiens
caagtgaggtgtgtcacaa

SEQ ID NO: 2474393 - DNA, 19 bp, Homo sapiens
caagtgatctgcccacctc

SEQ ID NO: 2474394 - DNA, 17 bp, Homo sapiens
caagtgctgaacagtgg

SEQ ID NO: 2474395 - DNA, 18 bp, Homo sapiens
caagtgctgaacagtgga

SEQ ID NO: 2474396 - DNA, 23 bp, Homo sapiens
caagtggactcagggcagcgcca

SEQ ID NO: 2474397 - DNA, 23 bp, Homo sapiens
caagtgtaaaatattttgaatca

SEQ ID NO: 2474398 - DNA, 14 bp, Homo sapiens
caagttaaatgtag

SEQ ID NO: 2474399 - DNA, 13 bp, Homo sapiens
caagttattaatt

SEQ ID NO: 2474400 - DNA, 16 bp, Homo sapiens
caagttcgtctgttgt

SEQ ID NO: 2474401 - DNA, 13 bp, Homo sapiens
caagttctaagat

SEQ ID NO: 2474402 - DNA, 15 bp, Homo sapiens
caagttctaagattc

SEQ ID NO: 2474403 - DNA, 20 bp, Homo sapiens
caagttctaagattctaatg

SEQ ID NO: 2474404 - DNA, 18 bp, Homo sapiens
caataaatctgacccagt

SEQ ID NO: 2474405 - DNA, 20 bp, Homo sapiens
caataaatctgacccagtgc

SEQ ID NO: 2474406 - DNA, 15 bp, Homo sapiens
caataacgtttaagc

SEQ ID NO: 2474407 - DNA, 16 bp, Homo sapiens
caataactcctcccag

SEQ ID NO: 2474408 - DNA, 16 bp, Homo sapiens
caataatatattttct

SEQ ID NO: 2474409 - DNA, 17 bp, Homo sapiens
caataatatattttctg

SEQ ID NO: 2474410 - DNA, 18 bp, Homo sapiens
caataatatattttctgt

SEQ ID NO: 2474411 - DNA, 21 bp, Homo sapiens
caatacaaatggattttggga

SEQ ID NO: 2474412 - DNA, 19 bp, Homo sapiens
caatacttggagggcccag

SEQ ID NO: 2474413 - DNA, 17 bp, Homo sapiens
caatagcacatatggaa

SEQ ID NO: 2474414 - DNA, 24 bp, Homo sapiens
caatagccactaaccttgcctggt

SEQ ID NO: 2474415 - DNA, 14 bp, Homo sapiens
caatagtgtcatcc

SEQ ID NO: 2474416 - DNA, 22 bp, Homo sapiens
cactcagaagcctgggggcctg

SEQ ID NO: 2474417 - DNA, 12 bp, Homo sapiens
cactcagacctg

SEQ ID NO: 2474418 - DNA, 16 bp, Homo sapiens
cactcagagacatgca

SEQ ID NO: 2474419 - DNA, 18 bp, Homo sapiens
cactcagatcctcctcat

SEQ ID NO: 2474420 - DNA, 13 bp, Homo sapiens
cactcagcacaag

SEQ ID NO: 2474421 - DNA, 18 bp, Homo sapiens
cactcagtctctcttctc

SEQ ID NO: 2474422 - DNA, 20 bp, Homo sapiens
cactcatcaatggggccagt

SEQ ID NO: 2474423 - DNA, 22 bp, Homo sapiens
cactcccacctgacacaccagg

SEQ ID NO: 2474424 - DNA, 14 bp, Homo sapiens
cactccccacatcc

SEQ ID NO: 2474425 - DNA, 13 bp, Homo sapiens
cactccctcacaa

SEQ ID NO: 2474426 - DNA, 20 bp, Homo sapiens
cactcccttgggctccctgt

SEQ ID NO: 2474427 - DNA, 19 bp, Homo sapiens
cactccgagaggtgggcca

SEQ ID NO: 2474428 - DNA, 12 bp, Homo sapiens
cactcctctgac

SEQ ID NO: 2474429 - DNA, 13 bp, Homo sapiens
cactcctctgctg

SEQ ID NO: 2474430 - DNA, 21 bp, Homo sapiens
cactcctctgctgacctgctg

SEQ ID NO: 2474431 - DNA, 14 bp, Homo sapiens
cactccttcctgcc

SEQ ID NO: 2474432 - DNA, 21 bp, Homo sapiens
cactcgctagcagtggcaggc

SEQ ID NO: 2474433 - DNA, 16 bp, Homo sapiens
cactcgtctcccccaa

SEQ ID NO: 2474434 - DNA, 14 bp, Homo sapiens
cactctagattcca

SEQ ID NO: 2474435 - DNA, 20 bp, Homo sapiens
cactctagtcaatgacatga

SEQ ID NO: 2474436 - DNA, 12 bp, Homo sapiens
cactctgcttct

SEQ ID NO: 2474437 - DNA, 14 bp, Homo sapiens
cactctgcttctct

SEQ ID NO: 2474438 - DNA, 15 bp, Homo sapiens
cactctgcttctctg

SEQ ID NO: 2474439 - DNA, 16 bp, Homo sapiens
cactctgcttctctga

SEQ ID NO: 2474440 - DNA, 21 bp, Homo sapiens
cactctgcttctctgacttct

SEQ ID NO: 2474441 - DNA, 13 bp, Homo sapiens
cactctggcagcc

SEQ ID NO: 2474442 - DNA, 16 bp, Homo sapiens
cactctggcagccaca

SEQ ID NO: 2474443 - DNA, 17 bp, Homo sapiens
cactctgtaattgcaaa

SEQ ID NO: 2474444 - DNA, 19 bp, Homo sapiens
cactcttatgctgtaccca

SEQ ID NO: 2474445 - DNA, 12 bp, Homo sapiens
cactctttgtaa

SEQ ID NO: 2474446 - DNA, 15 bp, Homo sapiens
cactcttttgcttta

SEQ ID NO: 2474447 - DNA, 13 bp, Homo sapiens
cactgaaaaaata

SEQ ID NO: 2474448 - DNA, 14 bp, Homo sapiens
cactgaaaaaatat

SEQ ID NO: 2474449 - DNA, 16 bp, Homo sapiens
cactgaaaaaatatat

SEQ ID NO: 2474450 - DNA, 17 bp, Homo sapiens
cactgaagctttttagt

SEQ ID NO: 2474451 - DNA, 14 bp, Homo sapiens
cactgactgggacc

SEQ ID NO: 2474452 - DNA, 22 bp, Homo sapiens
cactgagaggacagagagaaat

SEQ ID NO: 2474453 - DNA, 18 bp, Homo sapiens
cactgagataccagcgag

SEQ ID NO: 2474454 - DNA, 20 bp, Homo sapiens
cactgagcaacgctattcca

SEQ ID NO: 2474455 - DNA, 20 bp, Homo sapiens
cactgaggggggatccagtt

SEQ ID NO: 2474456 - DNA, 15 bp, Homo sapiens
cactgagttttccat

SEQ ID NO: 2474457 - DNA, 12 bp, Homo sapiens
cactgatgctgc

SEQ ID NO: 2474458 - DNA, 16 bp, Homo sapiens
cactgatgcttagatg

SEQ ID NO: 2474459 - DNA, 21 bp, Homo sapiens
cactgcaaaccgccacctccc

SEQ ID NO: 2474460 - DNA, 13 bp, Homo sapiens
cactgcaacatga

SEQ ID NO: 2474461 - DNA, 23 bp, Homo sapiens
cactgcacctgcctccagccgcc

SEQ ID NO: 2474462 - DNA, 14 bp, Homo sapiens
cactgccaggaggg

SEQ ID NO: 2474463 - DNA, 16 bp, Homo sapiens
cactgccaggagggac

SEQ ID NO: 2474464 - DNA, 17 bp, Homo sapiens
cactgccaggagggaca

SEQ ID NO: 2474465 - DNA, 21 bp, Homo sapiens
cactgccattaaagaatatga

SEQ ID NO: 2474466 - DNA, 20 bp, Homo sapiens
cactgccccctgctgccatg

SEQ ID NO: 2474467 - DNA, 19 bp, Homo sapiens
cactgcctgctcccatcct

SEQ ID NO: 2474468 - DNA, 17 bp, Homo sapiens
cactgcttccatttaat

SEQ ID NO: 2474469 - DNA, 13 bp, Homo sapiens
cactgcttgagga

SEQ ID NO: 2474470 - DNA, 15 bp, Homo sapiens
cactgcttgaggaaa

SEQ ID NO: 2474471 - DNA, 19 bp, Homo sapiens
cactggagacgcatatgag

SEQ ID NO: 2474472 - DNA, 14 bp, Homo sapiens
cactggagcagaag

SEQ ID NO: 2474473 - DNA, 23 bp, Homo sapiens
cactggagcagaaggggagatgg

SEQ ID NO: 2474474 - DNA, 13 bp, Homo sapiens
cactggcccctca

SEQ ID NO: 2474475 - DNA, 15 bp, Homo sapiens
cactggctctcctgg

SEQ ID NO: 2474476 - DNA, 16 bp, Homo sapiens
cactggggaaaactcc

SEQ ID NO: 2474477 - DNA, 19 bp, Homo sapiens
cactggggacttggcctct

SEQ ID NO: 2474478 - DNA, 21 bp, Homo sapiens
cactggggacttggcctctct

SEQ ID NO: 2474479 - DNA, 12 bp, Homo sapiens
cactggggctca

SEQ ID NO: 2474480 - DNA, 15 bp, Homo sapiens
cactggggctcagag

SEQ ID NO: 2474481 - DNA, 17 bp, Homo sapiens
cactggggctcagagcc

SEQ ID NO: 2474482 - DNA, 14 bp, Homo sapiens
cactgggtggtggc

SEQ ID NO: 2474483 - DNA, 15 bp, Homo sapiens
cactgggtggtggcc

SEQ ID NO: 2474484 - DNA, 18 bp, Homo sapiens
cactgggtggtggcctgg

SEQ ID NO: 2474485 - DNA, 22 bp, Homo sapiens
cactgggtggtggcctggtccc

SEQ ID NO: 2474486 - DNA, 14 bp, Homo sapiens
cactggtctgctgt

SEQ ID NO: 2474487 - DNA, 20 bp, Homo sapiens
cactggtctgtttgcatttg

SEQ ID NO: 2474488 - DNA, 13 bp, Homo sapiens
cactgtaaaatgt

SEQ ID NO: 2474489 - DNA, 22 bp, Homo sapiens
cactgtagtaaataatgctttg

SEQ ID NO: 2474490 - DNA, 18 bp, Homo sapiens
cactgtagttctaagact

SEQ ID NO: 2474491 - DNA, 21 bp, Homo sapiens
cactgtcaccaccctgctcat

SEQ ID NO: 2474492 - DNA, 12 bp, Homo sapiens
cactgtcccttg

SEQ ID NO: 2474493 - DNA, 17 bp, Homo sapiens
cactgtcccttgcctca

SEQ ID NO: 2474494 - DNA, 15 bp, Homo sapiens
cactgtgaaggaccc

SEQ ID NO: 2474495 - DNA, 20 bp, Homo sapiens
cactgtgacccccagctccg

SEQ ID NO: 2474496 - DNA, 22 bp, Homo sapiens
cactgtgacccccagctccggc

SEQ ID NO: 2474497 - DNA, 23 bp, Homo sapiens
cactgtgacccccagctccggcc

SEQ ID NO: 2474498 - DNA, 20 bp, Homo sapiens
cactgtgcacatctgtgtct

SEQ ID NO: 2474499 - DNA, 13 bp, Homo sapiens
cactgtgcctcag

SEQ ID NO: 2474500 - DNA, 21 bp, Homo sapiens
cactgtgcctcagagaccagg

SEQ ID NO: 2474501 - DNA, 22 bp, Homo sapiens
cactgtgcctcagagaccaggg

SEQ ID NO: 2474502 - DNA, 12 bp, Homo sapiens
cactgtgtgaat

SEQ ID NO: 2474503 - DNA, 15 bp, Homo sapiens
cactgtgttccttcc

SEQ ID NO: 2474504 - DNA, 19 bp, Homo sapiens
cactgtttatacactgtgt

SEQ ID NO: 2474505 - DNA, 15 bp, Homo sapiens
cacttaaacttgcat

SEQ ID NO: 2474506 - DNA, 23 bp, Homo sapiens
cacttaaccaagacaaaaagcca

SEQ ID NO: 2474507 - DNA, 20 bp, Homo sapiens
cacttaagttagttccactg

SEQ ID NO: 2474508 - DNA, 22 bp, Homo sapiens
cacttaagttagttccactgag

SEQ ID NO: 2474509 - DNA, 15 bp, Homo sapiens
cacttaatgtatgtt

SEQ ID NO: 2474510 - DNA, 21 bp, Homo sapiens
cacttactggtaggaccaagc

SEQ ID NO: 2474511 - DNA, 14 bp, Homo sapiens
cacttatagcctct

SEQ ID NO: 2474512 - DNA, 16 bp, Homo sapiens
cacttcaaactacttt

SEQ ID NO: 2474513 - DNA, 18 bp, Homo sapiens
cacttcaaattcaaataa

SEQ ID NO: 2474514 - DNA, 20 bp, Homo sapiens
cacttcaggtatacctcact

SEQ ID NO: 2474515 - DNA, 13 bp, Homo sapiens
cacttctcaggac

SEQ ID NO: 2474516 - DNA, 19 bp, Homo sapiens
cacttctcaggacacaggc

SEQ ID NO: 2474517 - DNA, 12 bp, Homo sapiens
cacttgcctctt

SEQ ID NO: 2474518 - DNA, 14 bp, Homo sapiens
cacttgcctcttcc

SEQ ID NO: 2474519 - DNA, 18 bp, Homo sapiens
cacttggcagccttgtga

SEQ ID NO: 2474520 - DNA, 13 bp, Homo sapiens
cagccggcacagg

SEQ ID NO: 2474521 - DNA, 17 bp, Homo sapiens
cagccggggcgagtggc

SEQ ID NO: 2474522 - DNA, 20 bp, Homo sapiens
cagccggggcgagtggcacg

SEQ ID NO: 2474523 - DNA, 13 bp, Homo sapiens
cagccgtgggccc

SEQ ID NO: 2474524 - DNA, 15 bp, Homo sapiens
cagccgtgggcccca

SEQ ID NO: 2474525 - DNA, 14 bp, Homo sapiens
cagcctcaggactg

SEQ ID NO: 2474526 - DNA, 21 bp, Homo sapiens
cagcctcaggactgggagccc

SEQ ID NO: 2474527 - DNA, 14 bp, Homo sapiens
cagcctcccaaagt

SEQ ID NO: 2474528 - DNA, 21 bp, Homo sapiens
cagcctcccaaagtgctgaga

SEQ ID NO: 2474529 - DNA, 22 bp, Homo sapiens
cagcctcccaaagtgctgagat

SEQ ID NO: 2474530 - DNA, 16 bp, Homo sapiens
cagcctcccaccccca

SEQ ID NO: 2474531 - DNA, 18 bp, Homo sapiens
cagcctcccacccccatc

SEQ ID NO: 2474532 - DNA, 23 bp, Homo sapiens
cagcctcccatccagggccccca

SEQ ID NO: 2474533 - DNA, 18 bp, Homo sapiens
cagcctcccctgccaggg

SEQ ID NO: 2474534 - DNA, 20 bp, Homo sapiens
cagcctcgcccctggcagag

SEQ ID NO: 2474535 - DNA, 23 bp, Homo sapiens
cagcctctccccaggtccagctc

SEQ ID NO: 2474536 - DNA, 23 bp, Homo sapiens
cagcctggaccactcctcatagc

SEQ ID NO: 2474537 - DNA, 18 bp, Homo sapiens
cagcctggccagacacag

SEQ ID NO: 2474538 - DNA, 20 bp, Homo sapiens
cagcctggcccaccccaccc

SEQ ID NO: 2474539 - DNA, 12 bp, Homo sapiens
cagcctgggcct

SEQ ID NO: 2474540 - DNA, 16 bp, Homo sapiens
cagcctgggcctatgg

SEQ ID NO: 2474541 - DNA, 21 bp, Homo sapiens
cagcctgggcctatggagagc

SEQ ID NO: 2474542 - DNA, 22 bp, Homo sapiens
cagcctgggcctatggagagcc

SEQ ID NO: 2474543 - DNA, 14 bp, Homo sapiens
cagcctgggcgctg

SEQ ID NO: 2474544 - DNA, 19 bp, Homo sapiens
cagcctgggcgctggtcct

SEQ ID NO: 2474545 - DNA, 18 bp, Homo sapiens
cagcctggggctggcctc

SEQ ID NO: 2474546 - DNA, 19 bp, Homo sapiens
cagcctggggtctggagtt

SEQ ID NO: 2474547 - DNA, 16 bp, Homo sapiens
cagcctgtcagatcca

SEQ ID NO: 2474548 - DNA, 13 bp, Homo sapiens
cagccttgccaga

SEQ ID NO: 2474549 - DNA, 15 bp, Homo sapiens
cagcctttgttcccc

SEQ ID NO: 2474550 - DNA, 20 bp, Homo sapiens
cagcctttgttccccactgg

SEQ ID NO: 2474551 - DNA, 18 bp, Homo sapiens
cagcctttttgtttcaat

SEQ ID NO: 2474552 - DNA, 17 bp, Homo sapiens
cagcgaccgccccctcc

SEQ ID NO: 2474553 - DNA, 12 bp, Homo sapiens
cagcgactggca

SEQ ID NO: 2474554 - DNA, 12 bp, Homo sapiens
cagcgagcctgc

SEQ ID NO: 2474555 - DNA, 16 bp, Homo sapiens
cagcgaggaggctcca

SEQ ID NO: 2474556 - DNA, 21 bp, Homo sapiens
cagcgattccctctcccaggc

SEQ ID NO: 2474557 - DNA, 18 bp, Homo sapiens
cagcgcccaaaggacgca

SEQ ID NO: 2474558 - DNA, 15 bp, Homo sapiens
cagcgcggaggagga

SEQ ID NO: 2474559 - DNA, 23 bp, Homo sapiens
cagcgctcctgctaacggtgctc

SEQ ID NO: 2474560 - DNA, 20 bp, Homo sapiens
cagcgctgtcaggattgcga

SEQ ID NO: 2474561 - DNA, 21 bp, Homo sapiens
cagcgctgtcaggattgcgag

SEQ ID NO: 2474562 - DNA, 22 bp, Homo sapiens
cagcggaggtgtggagccgagg

SEQ ID NO: 2474563 - DNA, 14 bp, Homo sapiens
cagcggcatcaggc

SEQ ID NO: 2474564 - DNA, 21 bp, Homo sapiens
cagcggcttgcctgcctgctc

SEQ ID NO: 2474565 - DNA, 15 bp, Homo sapiens
cagcgtcctcctctg

SEQ ID NO: 2474566 - DNA, 18 bp, Homo sapiens
cagcgtcctcctctgtga

SEQ ID NO: 2474567 - DNA, 19 bp, Homo sapiens
cagcgtcggtctgtgcccc

SEQ ID NO: 2474568 - DNA, 23 bp, Homo sapiens
cagcgtggaggggtaggggctgg

SEQ ID NO: 2474569 - DNA, 12 bp, Homo sapiens
cagctaaagcaa

SEQ ID NO: 2474570 - DNA, 19 bp, Homo sapiens
cagctaaggggtggggctg

SEQ ID NO: 2474571 - DNA, 14 bp, Homo sapiens
cagctaattctact

SEQ ID NO: 2474572 - DNA, 24 bp, Homo sapiens
cagctaccctttttctccagctgg

SEQ ID NO: 2474573 - DNA, 21 bp, Homo sapiens
cagctacttcctcctccccac

SEQ ID NO: 2474574 - DNA, 16 bp, Homo sapiens
cagctaggaagagcag

SEQ ID NO: 2474575 - DNA, 21 bp, Homo sapiens
cagctagtgacccacatgcca

SEQ ID NO: 2474576 - DNA, 21 bp, Homo sapiens
cagctatgttatattgaaaaa

SEQ ID NO: 2474577 - DNA, 14 bp, Homo sapiens
cagctattttgtga

SEQ ID NO: 2474578 - DNA, 15 bp, Homo sapiens
cagctcaagagatcc

SEQ ID NO: 2474579 - DNA, 15 bp, Homo sapiens
cagctcagcactgcc

SEQ ID NO: 2474580 - DNA, 21 bp, Homo sapiens
cagctcagcactgcctgctcc

SEQ ID NO: 2474581 - DNA, 19 bp, Homo sapiens
cagctcaggacagatgcca

SEQ ID NO: 2474582 - DNA, 17 bp, Homo sapiens
cagctccaggtggctct

SEQ ID NO: 2474583 - DNA, 21 bp, Homo sapiens
cagctccaggtggctctgagg

SEQ ID NO: 2474584 - DNA, 18 bp, Homo sapiens
cagctcccaggaccacag

SEQ ID NO: 2474585 - DNA, 14 bp, Homo sapiens
cagctccccctccc

SEQ ID NO: 2474586 - DNA, 14 bp, Homo sapiens
cagctccctgtgcc

SEQ ID NO: 2474587 - DNA, 22 bp, Homo sapiens
cagctccctgtgcccccagggt

SEQ ID NO: 2474588 - DNA, 14 bp, Homo sapiens
cagctcctctgtct

SEQ ID NO: 2474589 - DNA, 19 bp, Homo sapiens
cagctcctctgtctcgagc

SEQ ID NO: 2474590 - DNA, 19 bp, Homo sapiens
cagctcctgaccagttgca

SEQ ID NO: 2474591 - DNA, 16 bp, Homo sapiens
cagctccttcctggag

SEQ ID NO: 2474592 - DNA, 13 bp, Homo sapiens
cagctcctttggg

SEQ ID NO: 2474593 - DNA, 17 bp, Homo sapiens
cagctctggacagcccc

SEQ ID NO: 2474594 - DNA, 12 bp, Homo sapiens
cagctctgggcc

SEQ ID NO: 2474595 - DNA, 19 bp, Homo sapiens
cagctctgggccattctcc

SEQ ID NO: 2474596 - DNA, 16 bp, Homo sapiens
cagctctgttcttcct

SEQ ID NO: 2474597 - DNA, 23 bp, Homo sapiens
cagctctgttcttcctcagccag

SEQ ID NO: 2474598 - DNA, 20 bp, Homo sapiens
cagctgagcagggccgggga

SEQ ID NO: 2474599 - DNA, 18 bp, Homo sapiens
cagctgagcgccaggatg

SEQ ID NO: 2474600 - DNA, 16 bp, Homo sapiens
cagctgcattccgcag

SEQ ID NO: 2474601 - DNA, 19 bp, Homo sapiens
cagctgccaggagcacggc

SEQ ID NO: 2474602 - DNA, 14 bp, Homo sapiens
cagctggaggcagg

SEQ ID NO: 2474603 - DNA, 18 bp, Homo sapiens
cagctggctctacttccc

SEQ ID NO: 2474604 - DNA, 17 bp, Homo sapiens
cagctggggtgcaggga

SEQ ID NO: 2474605 - DNA, 18 bp, Homo sapiens
cagctggggtgcagggat

SEQ ID NO: 2474606 - DNA, 16 bp, Homo sapiens
cagctgggtcaggcag

SEQ ID NO: 2474607 - DNA, 11 bp, Homo sapiens
cagctggtgta

SEQ ID NO: 2474608 - DNA, 21 bp, Homo sapiens
cagctggtgtagctacagaga

SEQ ID NO: 2474609 - DNA, 23 bp, Homo sapiens
cagctggtgtagctacagagaaa

SEQ ID NO: 2474610 - DNA, 15 bp, Homo sapiens
cagctgtccccccac

SEQ ID NO: 2474611 - DNA, 17 bp, Homo sapiens
cagctgtcttttggagg

SEQ ID NO: 2474612 - DNA, 20 bp, Homo sapiens
cagctgtgcctcgctcccca

SEQ ID NO: 2474613 - DNA, 12 bp, Homo sapiens
cagctgtggcag

SEQ ID NO: 2474614 - DNA, 19 bp, Homo sapiens
cagctgtggcagagttaca

SEQ ID NO: 2474615 - DNA, 22 bp, Homo sapiens
cagctgtgtccaaaaccgccag

SEQ ID NO: 2474616 - DNA, 23 bp, Homo sapiens
cagctgttgagcccctcctagtt

SEQ ID NO: 2474617 - DNA, 19 bp, Homo sapiens
cagcttagatttcatagtt

SEQ ID NO: 2474618 - DNA, 13 bp, Homo sapiens
cagcttatacgaa

SEQ ID NO: 2474619 - DNA, 21 bp, Homo sapiens
cagcttatacgaaataattgt

SEQ ID NO: 2474620 - DNA, 14 bp, Homo sapiens
cagcttccttcaga

SEQ ID NO: 2474621 - DNA, 16 bp, Homo sapiens
cagcttctgccccctg

SEQ ID NO: 2474622 - DNA, 19 bp, Homo sapiens
cagcttctgccccctgcag

SEQ ID NO: 2474623 - DNA, 22 bp, Homo sapiens
cagttcgcagccaccctgagga

SEQ ID NO: 2474624 - DNA, 21 bp, Homo sapiens
cagttctttgggccagacatg

SEQ ID NO: 2474625 - DNA, 13 bp, Homo sapiens
cagttgcctttta

SEQ ID NO: 2474626 - DNA, 13 bp, Homo sapiens
cagttggactttt

SEQ ID NO: 2474627 - DNA, 15 bp, Homo sapiens
cagttggacttttta

SEQ ID NO: 2474628 - DNA, 20 bp, Homo sapiens
cagttggactttttaaaaat

SEQ ID NO: 2474629 - DNA, 17 bp, Homo sapiens
cagttggagctccagcc

SEQ ID NO: 2474630 - DNA, 14 bp, Homo sapiens
cagttggtaacttt

SEQ ID NO: 2474631 - DNA, 22 bp, Homo sapiens
cagttgtcccgattgtaactca

SEQ ID NO: 2474632 - DNA, 11 bp, Homo sapiens
cagttgtctct

SEQ ID NO: 2474633 - DNA, 13 bp, Homo sapiens
cagttgtctctga

SEQ ID NO: 2474634 - DNA, 14 bp, Homo sapiens
cagttgtctctgat

SEQ ID NO: 2474635 - DNA, 13 bp, Homo sapiens
cagttgtctctgt

SEQ ID NO: 2474636 - DNA, 15 bp, Homo sapiens
cagttgtctctgttt

SEQ ID NO: 2474637 - DNA, 21 bp, Homo sapiens
cagtttaatgaagatctaaat

SEQ ID NO: 2474638 - DNA, 14 bp, Homo sapiens
cagtttatatttaa

SEQ ID NO: 2474639 - DNA, 17 bp, Homo sapiens
cagtttatatttaactc

SEQ ID NO: 2474640 - DNA, 14 bp, Homo sapiens
cagtttatcattca

SEQ ID NO: 2474641 - DNA, 18 bp, Homo sapiens
cagtttatcattcaagtg

SEQ ID NO: 2474642 - DNA, 21 bp, Homo sapiens
cagtttcacagaaaataaggc

SEQ ID NO: 2474643 - DNA, 14 bp, Homo sapiens
cagtttccttggga

SEQ ID NO: 2474644 - DNA, 18 bp, Homo sapiens
cagtttctaaactggaga

SEQ ID NO: 2474645 - DNA, 19 bp, Homo sapiens
cagtttctaaactggagac

SEQ ID NO: 2474646 - DNA, 20 bp, Homo sapiens
cagtttgaaataagctattt

SEQ ID NO: 2474647 - DNA, 14 bp, Homo sapiens
cagtttgctttgcc

SEQ ID NO: 2474648 - DNA, 18 bp, Homo sapiens
cagtttgtagtgccactg

SEQ ID NO: 2474649 - DNA, 16 bp, Homo sapiens
cagtttgtgtgtctta

SEQ ID NO: 2474650 - DNA, 12 bp, Homo sapiens
cagttttaactg

SEQ ID NO: 2474651 - DNA, 15 bp, Homo sapiens
cagttttaactgtgg

SEQ ID NO: 2474652 - DNA, 21 bp, Homo sapiens
cagttttttttttcttgtcta

SEQ ID NO: 2474653 - DNA, 23 bp, Homo sapiens
cagttttttttttcttgtctata

SEQ ID NO: 2474654 - DNA, 15 bp, Homo sapiens
cataaaaatgatcta

SEQ ID NO: 2474655 - DNA, 21 bp, Homo sapiens
cataaacccagttgccatctg

SEQ ID NO: 2474656 - DNA, 14 bp, Homo sapiens
cataacaattcctc

SEQ ID NO: 2474657 - DNA, 15 bp, Homo sapiens
cataacaattcctct

SEQ ID NO: 2474658 - DNA, 16 bp, Homo sapiens
cataacaattcctcta

SEQ ID NO: 2474659 - DNA, 14 bp, Homo sapiens
cataaccactgctt

SEQ ID NO: 2474660 - DNA, 15 bp, Homo sapiens
cataaccactgcttc

SEQ ID NO: 2474661 - DNA, 12 bp, Homo sapiens
cataacctgtct

SEQ ID NO: 2474662 - DNA, 23 bp, Homo sapiens
cataacctgtctcacctggactt

SEQ ID NO: 2474663 - DNA, 14 bp, Homo sapiens
cataactgaacatc

SEQ ID NO: 2474664 - DNA, 16 bp, Homo sapiens
cataagctatttttct

SEQ ID NO: 2474665 - DNA, 15 bp, Homo sapiens
cataaggcttcaaaa

SEQ ID NO: 2474666 - DNA, 19 bp, Homo sapiens
cataaggcttcaaaatgtt

SEQ ID NO: 2474667 - DNA, 12 bp, Homo sapiens
cataagtttctg

SEQ ID NO: 2474668 - DNA, 17 bp, Homo sapiens
cataatgttacattatt

SEQ ID NO: 2474669 - DNA, 23 bp, Homo sapiens
cataatgtttctggatttcatac

SEQ ID NO: 2474670 - DNA, 23 bp, Homo sapiens
catacagaattactgtaactgat

SEQ ID NO: 2474671 - DNA, 15 bp, Homo sapiens
catacagagaagtca

SEQ ID NO: 2474672 - DNA, 14 bp, Homo sapiens
cataccaatgaaaa

SEQ ID NO: 2474673 - DNA, 18 bp, Homo sapiens
cataccccttacaaatga

SEQ ID NO: 2474674 - DNA, 15 bp, Homo sapiens
cataccctgacctgg

SEQ ID NO: 2474675 - DNA, 18 bp, Homo sapiens
cataccctgacctggccc

SEQ ID NO: 2474676 - DNA, 14 bp, Homo sapiens
catacgtgcacagg

SEQ ID NO: 2474677 - DNA, 15 bp, Homo sapiens
catactggcctggac

SEQ ID NO: 2474678 - DNA, 23 bp, Homo sapiens
catacttgaacgttttctaattg

SEQ ID NO: 2474679 - DNA, 14 bp, Homo sapiens
catacttgaagggc

SEQ ID NO: 2474680 - DNA, 17 bp, Homo sapiens
catacttgaagggccag

SEQ ID NO: 2474681 - DNA, 14 bp, Homo sapiens
catactttcctgta

SEQ ID NO: 2474682 - DNA, 21 bp, Homo sapiens
catagataaaacatctttgaa

SEQ ID NO: 2474683 - DNA, 16 bp, Homo sapiens
catagcaatacttgga

SEQ ID NO: 2474684 - DNA, 11 bp, Homo sapiens
catagcccagt

SEQ ID NO: 2474685 - DNA, 15 bp, Homo sapiens
catagcccagtagac

SEQ ID NO: 2474686 - DNA, 18 bp, Homo sapiens
catagcgggggcctaaaa

SEQ ID NO: 2474687 - DNA, 12 bp, Homo sapiens
catagctctggg

SEQ ID NO: 2474688 - DNA, 21 bp, Homo sapiens
cataggtctgaaatttttctt

SEQ ID NO: 2474689 - DNA, 22 bp, Homo sapiens
catagtaacttcttatggaatt

SEQ ID NO: 2474690 - DNA, 12 bp, Homo sapiens
catataaagtat

SEQ ID NO: 2474691 - DNA, 15 bp, Homo sapiens
catataattatatgt

SEQ ID NO: 2474692 - DNA, 18 bp, Homo sapiens
catatcatccacacatga

SEQ ID NO: 2474693 - DNA, 18 bp, Homo sapiens
catatgctaccaccagct

SEQ ID NO: 2474694 - DNA, 19 bp, Homo sapiens
catatgctaccaccagctg

SEQ ID NO: 2474695 - DNA, 17 bp, Homo sapiens
catatgttgaatacttt

SEQ ID NO: 2474696 - DNA, 19 bp, Homo sapiens
catatgttgaatacttttt

SEQ ID NO: 2474697 - DNA, 19 bp, Homo sapiens
catatttacctcagcctgg

SEQ ID NO: 2474698 - DNA, 13 bp, Homo sapiens
catatttgtaaaa

SEQ ID NO: 2474699 - DNA, 13 bp, Homo sapiens
catattttaaaat

SEQ ID NO: 2474700 - DNA, 18 bp, Homo sapiens
catattttaaacagagga

SEQ ID NO: 2474701 - DNA, 15 bp, Homo sapiens
catcaagactttgct

SEQ ID NO: 2474702 - DNA, 19 bp, Homo sapiens
catcaagttgtgccaaatt

SEQ ID NO: 2474703 - DNA, 19 bp, Homo sapiens
catcaatggggccagtcag

SEQ ID NO: 2474704 - DNA, 14 bp, Homo sapiens
catcacactgggtg

SEQ ID NO: 2474705 - DNA, 16 bp, Homo sapiens
catcacagcccagccc

SEQ ID NO: 2474706 - DNA, 20 bp, Homo sapiens
catcacctcagatggcagct

SEQ ID NO: 2474707 - DNA, 16 bp, Homo sapiens
catcactgagttttcc

SEQ ID NO: 2474708 - DNA, 20 bp, Homo sapiens
catcagaaaggaaaaacaaa

SEQ ID NO: 2474709 - DNA, 20 bp, Homo sapiens
catcagaaagggagggctct

SEQ ID NO: 2474710 - DNA, 23 bp, Homo sapiens
catcagaaagggagggctctgag

SEQ ID NO: 2474711 - DNA, 24 bp, Homo sapiens
catcagaaagggagggctctgagg

SEQ ID NO: 2474712 - DNA, 11 bp, Homo sapiens
catcaggcttt

SEQ ID NO: 2474713 - DNA, 15 bp, Homo sapiens
catcaggctttctta

SEQ ID NO: 2474714 - DNA, 19 bp, Homo sapiens
catcagggtaggctggagt

SEQ ID NO: 2474715 - DNA, 24 bp, Homo sapiens
catcagtgctccctcacatgtcag

SEQ ID NO: 2474716 - DNA, 18 bp, Homo sapiens
catcatcatggccagctg

SEQ ID NO: 2474717 - DNA, 18 bp, Homo sapiens
catcatgcctctgaggcc

SEQ ID NO: 2474718 - DNA, 19 bp, Homo sapiens
catcatgcctctgaggcca

SEQ ID NO: 2474719 - DNA, 19 bp, Homo sapiens
catcattatttatgtattg

SEQ ID NO: 2474720 - DNA, 12 bp, Homo sapiens
catcattctctg

SEQ ID NO: 2474721 - DNA, 24 bp, Homo sapiens
catcattctctgtctcatccatca

SEQ ID NO: 2474722 - DNA, 16 bp, Homo sapiens
catccaaagcagacag

SEQ ID NO: 2474723 - DNA, 17 bp, Homo sapiens
catccaaagcagacagc

SEQ ID NO: 2474724 - DNA, 14 bp, Homo sapiens
catccaagttaaat

SEQ ID NO: 2474725 - DNA, 14 bp, Homo sapiens
catccacacatgaa

SEQ ID NO: 2474726 - DNA, 22 bp, Homo sapiens
catccaggaggaataagctccc

SEQ ID NO: 2474727 - DNA, 21 bp, Homo sapiens
catccagggcccccatctcat

SEQ ID NO: 2474728 - DNA, 13 bp, Homo sapiens
ccagagagcccga

SEQ ID NO: 2474729 - DNA, 15 bp, Homo sapiens
ccagagagcccgagg

SEQ ID NO: 2474730 - DNA, 22 bp, Homo sapiens
ccagagccaggggggtgaggag

SEQ ID NO: 2474731 - DNA, 11 bp, Homo sapiens
ccagagcctgg

SEQ ID NO: 2474732 - DNA, 20 bp, Homo sapiens
ccagagcctggggctctaac

SEQ ID NO: 2474733 - DNA, 17 bp, Homo sapiens
ccagaggagccaccagt

SEQ ID NO: 2474734 - DNA, 14 bp, Homo sapiens
ccagaggcccccag

SEQ ID NO: 2474735 - DNA, 18 bp, Homo sapiens
ccagaggcccccagccca

SEQ ID NO: 2474736 - DNA, 15 bp, Homo sapiens
ccagaggctgggttc

SEQ ID NO: 2474737 - DNA, 16 bp, Homo sapiens
ccagaggctgggttca

SEQ ID NO: 2474738 - DNA, 17 bp, Homo sapiens
ccagaggggcctgccac

SEQ ID NO: 2474739 - DNA, 22 bp, Homo sapiens
ccagaggggcctgccacctgga

SEQ ID NO: 2474740 - DNA, 13 bp, Homo sapiens
ccagataactttt

SEQ ID NO: 2474741 - DNA, 18 bp, Homo sapiens
ccagatgcagggcagtca

SEQ ID NO: 2474742 - DNA, 17 bp, Homo sapiens
ccagatgcccctttctg

SEQ ID NO: 2474743 - DNA, 17 bp, Homo sapiens
ccagcaaagcccccaga

SEQ ID NO: 2474744 - DNA, 19 bp, Homo sapiens
ccagcaaagcccccagagc

SEQ ID NO: 2474745 - DNA, 20 bp, Homo sapiens
ccagcaagcggggatgtccc

SEQ ID NO: 2474746 - DNA, 16 bp, Homo sapiens
ccagcacacagggcag

SEQ ID NO: 2474747 - DNA, 19 bp, Homo sapiens
ccagcacagcttagatttc

SEQ ID NO: 2474748 - DNA, 17 bp, Homo sapiens
ccagcacagcttgacct

SEQ ID NO: 2474749 - DNA, 18 bp, Homo sapiens
ccagcaccggaccagcct

SEQ ID NO: 2474750 - DNA, 20 bp, Homo sapiens
ccagcaccggaccagcctgg

SEQ ID NO: 2474751 - DNA, 12 bp, Homo sapiens
ccagcactgctt

SEQ ID NO: 2474752 - DNA, 17 bp, Homo sapiens
ccagcacttccatggga

SEQ ID NO: 2474753 - DNA, 16 bp, Homo sapiens
ccagcagacagagcca

SEQ ID NO: 2474754 - DNA, 17 bp, Homo sapiens
ccagcagacagagccag

SEQ ID NO: 2474755 - DNA, 14 bp, Homo sapiens
ccagcagcacctgc

SEQ ID NO: 2474756 - DNA, 20 bp, Homo sapiens
ccagcagcacctgccctacc

SEQ ID NO: 2474757 - DNA, 23 bp, Homo sapiens
ccagcagctgccaggagcacggc

SEQ ID NO: 2474758 - DNA, 15 bp, Homo sapiens
ccagcaggtgctgac

SEQ ID NO: 2474759 - DNA, 18 bp, Homo sapiens
ccagcaggtgctgacttc

SEQ ID NO: 2474760 - DNA, 12 bp, Homo sapiens
ccagcatctggg

SEQ ID NO: 2474761 - DNA, 14 bp, Homo sapiens
ccagcatctgggcc

SEQ ID NO: 2474762 - DNA, 21 bp, Homo sapiens
ccagcatctgggccttggcct

SEQ ID NO: 2474763 - DNA, 15 bp, Homo sapiens
ccagcattccagccc

SEQ ID NO: 2474764 - DNA, 16 bp, Homo sapiens
ccagcattccagcccc

SEQ ID NO: 2474765 - DNA, 18 bp, Homo sapiens
ccagcattccagcccctc

SEQ ID NO: 2474766 - DNA, 15 bp, Homo sapiens
ccagcattcccaggt

SEQ ID NO: 2474767 - DNA, 19 bp, Homo sapiens
ccagcattcccaggtaggc

SEQ ID NO: 2474768 - DNA, 19 bp, Homo sapiens
ccagccaaaccctgtctga

SEQ ID NO: 2474769 - DNA, 14 bp, Homo sapiens
ccagccaagctctg

SEQ ID NO: 2474770 - DNA, 22 bp, Homo sapiens
ccagccagcgtcggtctgtgcc

SEQ ID NO: 2474771 - DNA, 20 bp, Homo sapiens
ccagccaggcccagccgacc

SEQ ID NO: 2474772 - DNA, 16 bp, Homo sapiens
ccagccatcaaaatgc

SEQ ID NO: 2474773 - DNA, 13 bp, Homo sapiens
ccagcccaccccc

SEQ ID NO: 2474774 - DNA, 14 bp, Homo sapiens
ccagcccacccccg

SEQ ID NO: 2474775 - DNA, 14 bp, Homo sapiens
ccagcccagggctc

SEQ ID NO: 2474776 - DNA, 15 bp, Homo sapiens
ccagcccagggctcc

SEQ ID NO: 2474777 - DNA, 17 bp, Homo sapiens
ccagcccagggctcctg

SEQ ID NO: 2474778 - DNA, 19 bp, Homo sapiens
ccagcccagggctcctgca

SEQ ID NO: 2474779 - DNA, 23 bp, Homo sapiens
ccagcccatggagattgacctgg

SEQ ID NO: 2474780 - DNA, 15 bp, Homo sapiens
ccagccccctcctgg

SEQ ID NO: 2474781 - DNA, 22 bp, Homo sapiens
ccagccccctgaccactcagag

SEQ ID NO: 2474782 - DNA, 22 bp, Homo sapiens
ccagcccctctggtcgctcctg

SEQ ID NO: 2474783 - DNA, 23 bp, Homo sapiens
ccagcccctggccccaggacctg

SEQ ID NO: 2474784 - DNA, 13 bp, Homo sapiens
ccagccctcatcc

SEQ ID NO: 2474785 - DNA, 14 bp, Homo sapiens
ccagccctcatccc

SEQ ID NO: 2474786 - DNA, 14 bp, Homo sapiens
ccagccgaccccct

SEQ ID NO: 2474787 - DNA, 18 bp, Homo sapiens
ccagccgaccccctctcc

SEQ ID NO: 2474788 - DNA, 21 bp, Homo sapiens
ccagccggggcgagtggcacg

SEQ ID NO: 2474789 - DNA, 17 bp, Homo sapiens
ccagcctccctgaagcc

SEQ ID NO: 2474790 - DNA, 15 bp, Homo sapiens
ccagcctggcctcct

SEQ ID NO: 2474791 - DNA, 19 bp, Homo sapiens
ccagcctggcctcctgcct

SEQ ID NO: 2474792 - DNA, 11 bp, Homo sapiens
ccagcctgggc

SEQ ID NO: 2474793 - DNA, 13 bp, Homo sapiens
ccagcctgggcct

SEQ ID NO: 2474794 - DNA, 19 bp, Homo sapiens
ccagcctgggcctatggag

SEQ ID NO: 2474795 - DNA, 10 bp, Homo sapiens
ccagcctgtc

SEQ ID NO: 2474796 - DNA, 16 bp, Homo sapiens
ccagcctttgttcccc

SEQ ID NO: 2474797 - DNA, 16 bp, Homo sapiens
ccagcgaggaggctcc

SEQ ID NO: 2474798 - DNA, 18 bp, Homo sapiens
ccagcgattccctctccc

SEQ ID NO: 2474799 - DNA, 13 bp, Homo sapiens
ccagcggacacac

SEQ ID NO: 2474800 - DNA, 17 bp, Homo sapiens
ccagcgtcctcctctgt

SEQ ID NO: 2474801 - DNA, 16 bp, Homo sapiens
ccagcgtcggtctgtg

SEQ ID NO: 2474802 - DNA, 17 bp, Homo sapiens
ccagcgtcggtctgtgc

SEQ ID NO: 2474803 - DNA, 19 bp, Homo sapiens
ccagcgtcggtctgtgccc

SEQ ID NO: 2474804 - DNA, 15 bp, Homo sapiens
ccagctaagaacctg

SEQ ID NO: 2474805 - DNA, 18 bp, Homo sapiens
ccagctaataactgatct

SEQ ID NO: 2474806 - DNA, 15 bp, Homo sapiens
ccagctacttcctcc

SEQ ID NO: 2474807 - DNA, 14 bp, Homo sapiens
ccagctagtgaccc

SEQ ID NO: 2474808 - DNA, 18 bp, Homo sapiens
ccagctagtgacccacat

SEQ ID NO: 2474809 - DNA, 19 bp, Homo sapiens
ccagctcaggacagatgcc

SEQ ID NO: 2474810 - DNA, 15 bp, Homo sapiens
ccagctccaacctgc

SEQ ID NO: 2474811 - DNA, 20 bp, Homo sapiens
ccagctccaacctgcaaaga

SEQ ID NO: 2474812 - DNA, 22 bp, Homo sapiens
ccagctccaaggggaatcagaa

SEQ ID NO: 2474813 - DNA, 15 bp, Homo sapiens
ccagctcccacctcc

SEQ ID NO: 2474814 - DNA, 21 bp, Homo sapiens
ccagctcccaggaccacaggc

SEQ ID NO: 2474815 - DNA, 22 bp, Homo sapiens
ccagctccctgtgcccccaggg

SEQ ID NO: 2474816 - DNA, 17 bp, Homo sapiens
ccagctcccttcttccc

SEQ ID NO: 2474817 - DNA, 14 bp, Homo sapiens
ccagctctggaggg

SEQ ID NO: 2474818 - DNA, 21 bp, Homo sapiens
ccagctctgtatcaggaccca

SEQ ID NO: 2474819 - DNA, 16 bp, Homo sapiens
ccagctctgttcttcc

SEQ ID NO: 2474820 - DNA, 20 bp, Homo sapiens
ccagctctgttcttcctcag

SEQ ID NO: 2474821 - DNA, 23 bp, Homo sapiens
ccagctctgttcttcctcagcca

SEQ ID NO: 2474822 - DNA, 15 bp, Homo sapiens
ccagctgagcgccag

SEQ ID NO: 2474823 - DNA, 13 bp, Homo sapiens
ccagctggaggca

SEQ ID NO: 2474824 - DNA, 17 bp, Homo sapiens
ccagctggaggcagggg

SEQ ID NO: 2474825 - DNA, 18 bp, Homo sapiens
ccagctggaggcaggggc

SEQ ID NO: 2474826 - DNA, 18 bp, Homo sapiens
ccagctgggctctgcaat

SEQ ID NO: 2474827 - DNA, 14 bp, Homo sapiens
ccagctgtgcttat

SEQ ID NO: 2474828 - DNA, 15 bp, Homo sapiens
ccagctgtggttttc

SEQ ID NO: 2474829 - DNA, 14 bp, Homo sapiens
ccagctgtgtccaa

SEQ ID NO: 2474830 - DNA, 16 bp, Homo sapiens
ccaggaagccgtcctg

SEQ ID NO: 2474831 - DNA, 14 bp, Homo sapiens
ccaggaatttccca

SEQ ID NO: 2474832 - DNA, 20 bp, Homo sapiens
ccaggaatttcccaggaccc

SEQ ID NO: 2474833 - DNA, 22 bp, Homo sapiens
cctgggccctggggcctgtact

SEQ ID NO: 2474834 - DNA, 19 bp, Homo sapiens
cctgggcctatggagagcc

SEQ ID NO: 2474835 - DNA, 13 bp, Homo sapiens
cctgggcctgcct

SEQ ID NO: 2474836 - DNA, 17 bp, Homo sapiens
cctgggcctgctgctga

SEQ ID NO: 2474837 - DNA, 13 bp, Homo sapiens
cctgggccttggg

SEQ ID NO: 2474838 - DNA, 14 bp, Homo sapiens
cctgggctggaatc

SEQ ID NO: 2474839 - DNA, 13 bp, Homo sapiens
cctggggcctgta

SEQ ID NO: 2474840 - DNA, 23 bp, Homo sapiens
cctggggcctgtactgcctgctt

SEQ ID NO: 2474841 - DNA, 12 bp, Homo sapiens
cctggggctcta

SEQ ID NO: 2474842 - DNA, 22 bp, Homo sapiens
cctggggctctaacgcctgagc

SEQ ID NO: 2474843 - DNA, 15 bp, Homo sapiens
cctgggggcctggct

SEQ ID NO: 2474844 - DNA, 17 bp, Homo sapiens
cctgggggcctggctgg

SEQ ID NO: 2474845 - DNA, 19 bp, Homo sapiens
cctgggggcctggctggct

SEQ ID NO: 2474846 - DNA, 21 bp, Homo sapiens
cctggggtataaaactttcct

SEQ ID NO: 2474847 - DNA, 14 bp, Homo sapiens
cctggggtctggag

SEQ ID NO: 2474848 - DNA, 22 bp, Homo sapiens
cctgggtcccaggaccctggac

SEQ ID NO: 2474849 - DNA, 13 bp, Homo sapiens
cctgggtgacatt

SEQ ID NO: 2474850 - DNA, 14 bp, Homo sapiens
cctgggtgacattt

SEQ ID NO: 2474851 - DNA, 15 bp, Homo sapiens
cctgggtggctactc

SEQ ID NO: 2474852 - DNA, 19 bp, Homo sapiens
cctgggttttgtattctct

SEQ ID NO: 2474853 - DNA, 17 bp, Homo sapiens
cctggtaccctcctggc

SEQ ID NO: 2474854 - DNA, 18 bp, Homo sapiens
cctggtcccctccttccc

SEQ ID NO: 2474855 - DNA, 19 bp, Homo sapiens
cctggtcccctccttccca

SEQ ID NO: 2474856 - DNA, 14 bp, Homo sapiens
cctggtgatcacgt

SEQ ID NO: 2474857 - DNA, 20 bp, Homo sapiens
cctggtgctgcctctacctg

SEQ ID NO: 2474858 - DNA, 15 bp, Homo sapiens
cctggtgctggaggt

SEQ ID NO: 2474859 - DNA, 16 bp, Homo sapiens
cctggtgcttctcctc

SEQ ID NO: 2474860 - DNA, 20 bp, Homo sapiens
cctggtgcttctcctctcct

SEQ ID NO: 2474861 - DNA, 20 bp, Homo sapiens
cctggtggccatgctcctct

SEQ ID NO: 2474862 - DNA, 24 bp, Homo sapiens
cctggtggccatgctcctcttccc

SEQ ID NO: 2474863 - DNA, 12 bp, Homo sapiens
cctggtggccct

SEQ ID NO: 2474864 - DNA, 13 bp, Homo sapiens
cctggtggggcag

SEQ ID NO: 2474865 - DNA, 21 bp, Homo sapiens
cctggtggggcagctcctctg

SEQ ID NO: 2474866 - DNA, 20 bp, Homo sapiens
cctgtaaactttatcactta

SEQ ID NO: 2474867 - DNA, 10 bp, Homo sapiens
cctgtaactt

SEQ ID NO: 2474868 - DNA, 22 bp, Homo sapiens
cctgtacagtagattttccaaa

SEQ ID NO: 2474869 - DNA, 22 bp, Homo sapiens
cctgtaccttttgaggagcccc

SEQ ID NO: 2474870 - DNA, 17 bp, Homo sapiens
cctgtactgttctgtgt

SEQ ID NO: 2474871 - DNA, 16 bp, Homo sapiens
cctgtagagttgctga

SEQ ID NO: 2474872 - DNA, 21 bp, Homo sapiens
cctgtagattcaggtaataca

SEQ ID NO: 2474873 - DNA, 19 bp, Homo sapiens
cctgtatacctcctccagc

SEQ ID NO: 2474874 - DNA, 15 bp, Homo sapiens
cctgtattcagacag

SEQ ID NO: 2474875 - DNA, 16 bp, Homo sapiens
cctgtatttgttccca

SEQ ID NO: 2474876 - DNA, 17 bp, Homo sapiens
cctgtcagatccaggag

SEQ ID NO: 2474877 - DNA, 19 bp, Homo sapiens
cctgtcagatccaggagct

SEQ ID NO: 2474878 - DNA, 20 bp, Homo sapiens
cctgtcagatccaggagctc

SEQ ID NO: 2474879 - DNA, 22 bp, Homo sapiens
cctgtcagatccaggagctcca

SEQ ID NO: 2474880 - DNA, 16 bp, Homo sapiens
cctgtcagcatgaatt

SEQ ID NO: 2474881 - DNA, 17 bp, Homo sapiens
cctgtcagcatgaattt

SEQ ID NO: 2474882 - DNA, 20 bp, Homo sapiens
cctgtcagcatgaatttgta

SEQ ID NO: 2474883 - DNA, 22 bp, Homo sapiens
cctgtcagcatgaatttgtaat

SEQ ID NO: 2474884 - DNA, 20 bp, Homo sapiens
cctgtcatggtgtccagaca

SEQ ID NO: 2474885 - DNA, 18 bp, Homo sapiens
cctgtccacaggcttctg

SEQ ID NO: 2474886 - DNA, 21 bp, Homo sapiens
cctgtccacaggcttctgagc

SEQ ID NO: 2474887 - DNA, 14 bp, Homo sapiens
cctgtccagctcca

SEQ ID NO: 2474888 - DNA, 11 bp, Homo sapiens
cctgtcccacc

SEQ ID NO: 2474889 - DNA, 13 bp, Homo sapiens
cctgtcccacccc

SEQ ID NO: 2474890 - DNA, 14 bp, Homo sapiens
cctgtcccctgcta

SEQ ID NO: 2474891 - DNA, 16 bp, Homo sapiens
cctgtcctctttcagc

SEQ ID NO: 2474892 - DNA, 18 bp, Homo sapiens
cctgtcctctttcagctc

SEQ ID NO: 2474893 - DNA, 13 bp, Homo sapiens
cctgtctcagcct

SEQ ID NO: 2474894 - DNA, 20 bp, Homo sapiens
cctgtctctcagggccaggc

SEQ ID NO: 2474895 - DNA, 21 bp, Homo sapiens
cctgtctctcagggccaggcc

SEQ ID NO: 2474896 - DNA, 14 bp, Homo sapiens
cctgtgaacccagg

SEQ ID NO: 2474897 - DNA, 17 bp, Homo sapiens
cctgtgaacccaggaca

SEQ ID NO: 2474898 - DNA, 16 bp, Homo sapiens
cctgtgaatgccactg

SEQ ID NO: 2474899 - DNA, 17 bp, Homo sapiens
cctgtgaatgccactgc

SEQ ID NO: 2474900 - DNA, 19 bp, Homo sapiens
cctgtgaatgccactgcct

SEQ ID NO: 2474901 - DNA, 15 bp, Homo sapiens
cctgtgaccacaaca

SEQ ID NO: 2474902 - DNA, 19 bp, Homo sapiens
cctgtgaccacaacatgag

SEQ ID NO: 2474903 - DNA, 20 bp, Homo sapiens
cctgtgagcccagctgggtc

SEQ ID NO: 2474904 - DNA, 14 bp, Homo sapiens
cctgtgctcagccc

SEQ ID NO: 2474905 - DNA, 15 bp, Homo sapiens
cctgtgctcagccct

SEQ ID NO: 2474906 - DNA, 18 bp, Homo sapiens
cctgtggccccaccctgg

SEQ ID NO: 2474907 - DNA, 21 bp, Homo sapiens
cctgtggcgccgtctccaggg

SEQ ID NO: 2474908 - DNA, 22 bp, Homo sapiens
cctgtggcgccgtctccagggg

SEQ ID NO: 2474909 - DNA, 15 bp, Homo sapiens
cctgtggttctgaga

SEQ ID NO: 2474910 - DNA, 19 bp, Homo sapiens
cctgtgtagctgtgacctg

SEQ ID NO: 2474911 - DNA, 21 bp, Homo sapiens
cctgtgtagctgtgacctgct

SEQ ID NO: 2474912 - DNA, 22 bp, Homo sapiens
cctgtgtagctgtgacctgctg

SEQ ID NO: 2474913 - DNA, 15 bp, Homo sapiens
cctgtgtggacagga

SEQ ID NO: 2474914 - DNA, 12 bp, Homo sapiens
cctgtgtggaga

SEQ ID NO: 2474915 - DNA, 16 bp, Homo sapiens
cctgtgtgttaagctc

SEQ ID NO: 2474916 - DNA, 16 bp, Homo sapiens
cctgttagcagacagg

SEQ ID NO: 2474917 - DNA, 18 bp, Homo sapiens
cctgttcatggcagatgt

SEQ ID NO: 2474918 - DNA, 15 bp, Homo sapiens
cctgttccccagaga

SEQ ID NO: 2474919 - DNA, 16 bp, Homo sapiens
cctgttccccagagaa

SEQ ID NO: 2474920 - DNA, 14 bp, Homo sapiens
cctgttcctgctgc

SEQ ID NO: 2474921 - DNA, 18 bp, Homo sapiens
cctgtttcagaggctcag

SEQ ID NO: 2474922 - DNA, 23 bp, Homo sapiens
cctgttttcccacgaggaatctg

SEQ ID NO: 2474923 - DNA, 23 bp, Homo sapiens
ccttaagacctactgttctaaag

SEQ ID NO: 2474924 - DNA, 17 bp, Homo sapiens
ccttacagtaggagccc

SEQ ID NO: 2474925 - DNA, 13 bp, Homo sapiens
ccttactcctgtg

SEQ ID NO: 2474926 - DNA, 15 bp, Homo sapiens
ccttactcctgtggg

SEQ ID NO: 2474927 - DNA, 19 bp, Homo sapiens
ccttactcctgtgggagcc

SEQ ID NO: 2474928 - DNA, 21 bp, Homo sapiens
ccttactcctgtgggagcctc

SEQ ID NO: 2474929 - DNA, 22 bp, Homo sapiens
ccttactcctgtgggagcctcg

SEQ ID NO: 2474930 - DNA, 21 bp, Homo sapiens
ccttagacagaggccctcaag

SEQ ID NO: 2474931 - DNA, 16 bp, Homo sapiens
ccttagactcttttcc

SEQ ID NO: 2474932 - DNA, 14 bp, Homo sapiens
ccttagatctggca

SEQ ID NO: 2474933 - DNA, 14 bp, Homo sapiens
ccttagcctggacc

SEQ ID NO: 2474934 - DNA, 15 bp, Homo sapiens
ccttagcctggacct

SEQ ID NO: 2474935 - DNA, 17 bp, Homo sapiens
ccttagcctggacctct

SEQ ID NO: 2474936 - DNA, 19 bp, Homo sapiens
ccttagcctggacctctga

SEQ ID NO: 2474937 - DNA, 21 bp, Homo sapiens
ctaagggtcgaaagctctaga

SEQ ID NO: 2474938 - DNA, 23 bp, Homo sapiens
ctaaggtcttggaacttgcctgc

SEQ ID NO: 2474939 - DNA, 13 bp, Homo sapiens
ctaaggttctaag

SEQ ID NO: 2474940 - DNA, 15 bp, Homo sapiens
ctaaggttctaaggc

SEQ ID NO: 2474941 - DNA, 14 bp, Homo sapiens
ctaagtaaatacaa

SEQ ID NO: 2474942 - DNA, 16 bp, Homo sapiens
ctaagtctttccattg

SEQ ID NO: 2474943 - DNA, 13 bp, Homo sapiens
ctaagtgatataa

SEQ ID NO: 2474944 - DNA, 17 bp, Homo sapiens
ctaagttataagactct

SEQ ID NO: 2474945 - DNA, 21 bp, Homo sapiens
ctaagtttctaagattctaaa

SEQ ID NO: 2474946 - DNA, 18 bp, Homo sapiens
ctaataaaaagcttttgt

SEQ ID NO: 2474947 - DNA, 18 bp, Homo sapiens
ctaatagaaaagtatgtt

SEQ ID NO: 2474948 - DNA, 14 bp, Homo sapiens
ctaatatatttaaa

SEQ ID NO: 2474949 - DNA, 15 bp, Homo sapiens
ctaatatatttaaaa

SEQ ID NO: 2474950 - DNA, 20 bp, Homo sapiens
ctaatatggccacagtagtc

SEQ ID NO: 2474951 - DNA, 17 bp, Homo sapiens
ctaatccaggcagatcc

SEQ ID NO: 2474952 - DNA, 18 bp, Homo sapiens
ctaatccaggcagatcca

SEQ ID NO: 2474953 - DNA, 16 bp, Homo sapiens
ctaatccccttctccc

SEQ ID NO: 2474954 - DNA, 20 bp, Homo sapiens
ctaatccccttctcccctgc

SEQ ID NO: 2474955 - DNA, 20 bp, Homo sapiens
ctaatctatggtcgggagac

SEQ ID NO: 2474956 - DNA, 16 bp, Homo sapiens
ctaatgcctcttcatt

SEQ ID NO: 2474957 - DNA, 14 bp, Homo sapiens
ctaatggcatgaga

SEQ ID NO: 2474958 - DNA, 18 bp, Homo sapiens
ctaatggcatgagaaata

SEQ ID NO: 2474959 - DNA, 17 bp, Homo sapiens
ctaattatgtagctctt

SEQ ID NO: 2474960 - DNA, 18 bp, Homo sapiens
ctaattcaaggaatttct

SEQ ID NO: 2474961 - DNA, 20 bp, Homo sapiens
ctaattcaaggaatttctta

SEQ ID NO: 2474962 - DNA, 15 bp, Homo sapiens
ctaattcacagtgct

SEQ ID NO: 2474963 - DNA, 14 bp, Homo sapiens
ctaattgcttattt

SEQ ID NO: 2474964 - DNA, 14 bp, Homo sapiens
ctaatttgcattaa

SEQ ID NO: 2474965 - DNA, 19 bp, Homo sapiens
ctaatttgttttggatata

SEQ ID NO: 2474966 - DNA, 14 bp, Homo sapiens
ctaatttttgtaat

SEQ ID NO: 2474967 - DNA, 13 bp, Homo sapiens
ctaatttttgtat

SEQ ID NO: 2474968 - DNA, 16 bp, Homo sapiens
ctaatttttttgtatt

SEQ ID NO: 2474969 - DNA, 17 bp, Homo sapiens
ctacaaaggtttaaatg

SEQ ID NO: 2474970 - DNA, 18 bp, Homo sapiens
ctacaaaggtttaaatga

SEQ ID NO: 2474971 - DNA, 20 bp, Homo sapiens
ctacaaaggtttaaatgaac

SEQ ID NO: 2474972 - DNA, 22 bp, Homo sapiens
ctacaaaggtttaaatgaacaa

SEQ ID NO: 2474973 - DNA, 15 bp, Homo sapiens
ctacaccactctggc

SEQ ID NO: 2474974 - DNA, 16 bp, Homo sapiens
ctacacctattatccc

SEQ ID NO: 2474975 - DNA, 12 bp, Homo sapiens
ctacagaaaaac

SEQ ID NO: 2474976 - DNA, 20 bp, Homo sapiens
ctacagaaaaaccttgggtt

SEQ ID NO: 2474977 - DNA, 17 bp, Homo sapiens
ctacagaacttcagaaa

SEQ ID NO: 2474978 - DNA, 19 bp, Homo sapiens
ctacagaacttcagaaaga

SEQ ID NO: 2474979 - DNA, 21 bp, Homo sapiens
ctacagagaaaccagcttcct

SEQ ID NO: 2474980 - DNA, 17 bp, Homo sapiens
ctacagagcttccctga

SEQ ID NO: 2474981 - DNA, 15 bp, Homo sapiens
ctacagggggtctgg

SEQ ID NO: 2474982 - DNA, 21 bp, Homo sapiens
ctacagggggtctggctggtg

SEQ ID NO: 2474983 - DNA, 18 bp, Homo sapiens
ctacagttttaactgtgg

SEQ ID NO: 2474984 - DNA, 15 bp, Homo sapiens
ctacataatttagtt

SEQ ID NO: 2474985 - DNA, 16 bp, Homo sapiens
ctacatcttctgcctt

SEQ ID NO: 2474986 - DNA, 13 bp, Homo sapiens
ctacatgtattgc

SEQ ID NO: 2474987 - DNA, 12 bp, Homo sapiens
ctacattcattt

SEQ ID NO: 2474988 - DNA, 14 bp, Homo sapiens
ctaccaccagctgt

SEQ ID NO: 2474989 - DNA, 17 bp, Homo sapiens
ctacccccagctgtgct

SEQ ID NO: 2474990 - DNA, 18 bp, Homo sapiens
ctacccccagctgtgctt

SEQ ID NO: 2474991 - DNA, 14 bp, Homo sapiens
ctaccctctagaga

SEQ ID NO: 2474992 - DNA, 12 bp, Homo sapiens
ctaccctgagct

SEQ ID NO: 2474993 - DNA, 17 bp, Homo sapiens
ctaccctgagctgaggc

SEQ ID NO: 2474994 - DNA, 18 bp, Homo sapiens
ctaccgaatgtgtcttta

SEQ ID NO: 2474995 - DNA, 18 bp, Homo sapiens
ctacctcaggcagctcaa

SEQ ID NO: 2474996 - DNA, 21 bp, Homo sapiens
ctacctgccccacttgtcctt

SEQ ID NO: 2474997 - DNA, 16 bp, Homo sapiens
ctaccttctccccagc

SEQ ID NO: 2474998 - DNA, 14 bp, Homo sapiens
ctaccttgaaaata

SEQ ID NO: 2474999 - DNA, 17 bp, Homo sapiens
ctactaatagaataaag

SEQ ID NO: 2475000 - DNA, 17 bp, Homo sapiens
ctactacctgtaatgac

SEQ ID NO: 2475001 - DNA, 22 bp, Homo sapiens
ctactcacacaggcatttcctg

SEQ ID NO: 2475002 - DNA, 15 bp, Homo sapiens
ctactcacttttccc

SEQ ID NO: 2475003 - DNA, 20 bp, Homo sapiens
ctactctccccacgagggct

SEQ ID NO: 2475004 - DNA, 13 bp, Homo sapiens
ctactctgtgcca

SEQ ID NO: 2475005 - DNA, 19 bp, Homo sapiens
ctactctgtgccagagcct

SEQ ID NO: 2475006 - DNA, 21 bp, Homo sapiens
ctactctgtgccagagcctgg

SEQ ID NO: 2475007 - DNA, 22 bp, Homo sapiens
ctactctgtgccagagcctggg

SEQ ID NO: 2475008 - DNA, 13 bp, Homo sapiens
ctactgaagccct

SEQ ID NO: 2475009 - DNA, 14 bp, Homo sapiens
ctactgaagccctt

SEQ ID NO: 2475010 - DNA, 15 bp, Homo sapiens
ctactgacatgtggg

SEQ ID NO: 2475011 - DNA, 20 bp, Homo sapiens
ctactgacatgtggggccag

SEQ ID NO: 2475012 - DNA, 15 bp, Homo sapiens
ctactgcccaggcac

SEQ ID NO: 2475013 - DNA, 21 bp, Homo sapiens
ctactgcccaggcactgcaaa

SEQ ID NO: 2475014 - DNA, 21 bp, Homo sapiens
ctactgccgtcagtgctgtgc

SEQ ID NO: 2475015 - DNA, 17 bp, Homo sapiens
ctactggggaaactggc

SEQ ID NO: 2475016 - DNA, 23 bp, Homo sapiens
ctacttccccatggccctgagcg

SEQ ID NO: 2475017 - DNA, 13 bp, Homo sapiens
ctacttcctcctc

SEQ ID NO: 2475018 - DNA, 17 bp, Homo sapiens
ctacttcctcctcccca

SEQ ID NO: 2475019 - DNA, 19 bp, Homo sapiens
ctacttcctcctccccact

SEQ ID NO: 2475020 - DNA, 20 bp, Homo sapiens
ctacttcctcctccccactt

SEQ ID NO: 2475021 - DNA, 18 bp, Homo sapiens
ctactttataactaacat

SEQ ID NO: 2475022 - DNA, 16 bp, Homo sapiens
ctactttccctctggg

SEQ ID NO: 2475023 - DNA, 17 bp, Homo sapiens
ctagaaaaacaggcact

SEQ ID NO: 2475024 - DNA, 16 bp, Homo sapiens
ctagaaacttccaaat

SEQ ID NO: 2475025 - DNA, 14 bp, Homo sapiens
ctagaaccctctgt

SEQ ID NO: 2475026 - DNA, 19 bp, Homo sapiens
ctagaatctgcaattcaaa

SEQ ID NO: 2475027 - DNA, 19 bp, Homo sapiens
ctagaattgagtgtttaaa

SEQ ID NO: 2475028 - DNA, 21 bp, Homo sapiens
ctagaattgagtgtttaaagt

SEQ ID NO: 2475029 - DNA, 14 bp, Homo sapiens
ctagacacatgaag

SEQ ID NO: 2475030 - DNA, 15 bp, Homo sapiens
ctagacaccaaagtt

SEQ ID NO: 2475031 - DNA, 18 bp, Homo sapiens
ctagacaccaaagttcta

SEQ ID NO: 2475032 - DNA, 17 bp, Homo sapiens
ctagacatggaggttct

SEQ ID NO: 2475033 - DNA, 18 bp, Homo sapiens
ctagacatggaggttcta

SEQ ID NO: 2475034 - DNA, 20 bp, Homo sapiens
ctagacatggaggttctaag

SEQ ID NO: 2475035 - DNA, 22 bp, Homo sapiens
ctagacatggaggttctaaggc

SEQ ID NO: 2475036 - DNA, 23 bp, Homo sapiens
ctagacatggaggttctaaggcc

SEQ ID NO: 2475037 - DNA, 18 bp, Homo sapiens
ctagaccagcagacagag

SEQ ID NO: 2475038 - DNA, 20 bp, Homo sapiens
ctagaccagcagacagagcc

SEQ ID NO: 2475039 - DNA, 23 bp, Homo sapiens
ctagaccagcagacagagccagg

SEQ ID NO: 2475040 - DNA, 17 bp, Homo sapiens
ctagacctccagctgtt

SEQ ID NO: 2475041 - DNA, 19 bp, Homo sapiens
ctccaggcccaaggctccc

SEQ ID NO: 2475042 - DNA, 14 bp, Homo sapiens
ctccagggacagca

SEQ ID NO: 2475043 - DNA, 23 bp, Homo sapiens
ctccagggacagcaactatcaga

SEQ ID NO: 2475044 - DNA, 15 bp, Homo sapiens
ctccaggggctgctt

SEQ ID NO: 2475045 - DNA, 22 bp, Homo sapiens
ctccaggggctgcttcctcctg

SEQ ID NO: 2475046 - DNA, 18 bp, Homo sapiens
ctccagtgtcctgagctc

SEQ ID NO: 2475047 - DNA, 20 bp, Homo sapiens
ctccagtgtcctgagctcag

SEQ ID NO: 2475048 - DNA, 18 bp, Homo sapiens
ctccatccaaggccaggt

SEQ ID NO: 2475049 - DNA, 18 bp, Homo sapiens
ctcccaaggggcctgagc

SEQ ID NO: 2475050 - DNA, 19 bp, Homo sapiens
ctcccaaggggcctgagca

SEQ ID NO: 2475051 - DNA, 22 bp, Homo sapiens
ctcccaagtagctgggattaca

SEQ ID NO: 2475052 - DNA, 20 bp, Homo sapiens
ctcccacagtcccatctgct

SEQ ID NO: 2475053 - DNA, 19 bp, Homo sapiens
ctcccacccccatctctcc

SEQ ID NO: 2475054 - DNA, 15 bp, Homo sapiens
ctcccaccctcttcc

SEQ ID NO: 2475055 - DNA, 15 bp, Homo sapiens
ctcccacctgacaca

SEQ ID NO: 2475056 - DNA, 17 bp, Homo sapiens
ctcccactctcctaggc

SEQ ID NO: 2475057 - DNA, 21 bp, Homo sapiens
ctcccagaggagccaccagtt

SEQ ID NO: 2475058 - DNA, 15 bp, Homo sapiens
ctcccaggaccacag

SEQ ID NO: 2475059 - DNA, 15 bp, Homo sapiens
ctcccaggcaaggct

SEQ ID NO: 2475060 - DNA, 15 bp, Homo sapiens
ctcccaggccccatg

SEQ ID NO: 2475061 - DNA, 16 bp, Homo sapiens
ctcccaggccccatga

SEQ ID NO: 2475062 - DNA, 17 bp, Homo sapiens
ctcccaggggctccctc

SEQ ID NO: 2475063 - DNA, 18 bp, Homo sapiens
ctcccaggggctccctcc

SEQ ID NO: 2475064 - DNA, 15 bp, Homo sapiens
ctcccagggttttaa

SEQ ID NO: 2475065 - DNA, 21 bp, Homo sapiens
ctcccagggttttaactttgt

SEQ ID NO: 2475066 - DNA, 22 bp, Homo sapiens
ctcccagggttttaactttgtt

SEQ ID NO: 2475067 - DNA, 14 bp, Homo sapiens
ctcccatccagggc

SEQ ID NO: 2475068 - DNA, 15 bp, Homo sapiens
ctcccattcctgaag

SEQ ID NO: 2475069 - DNA, 17 bp, Homo sapiens
ctcccattcctgaagaa

SEQ ID NO: 2475070 - DNA, 16 bp, Homo sapiens
ctcccattttggaatt

SEQ ID NO: 2475071 - DNA, 15 bp, Homo sapiens
ctccccaacccccaa

SEQ ID NO: 2475072 - DNA, 21 bp, Homo sapiens
ctccccactctgctctgatgc

SEQ ID NO: 2475073 - DNA, 22 bp, Homo sapiens
ctccccagcattccagcccctc

SEQ ID NO: 2475074 - DNA, 14 bp, Homo sapiens
ctccccagctccca

SEQ ID NO: 2475075 - DNA, 14 bp, Homo sapiens
ctccccagggaagc

SEQ ID NO: 2475076 - DNA, 20 bp, Homo sapiens
ctccccagggaagcagcagc

SEQ ID NO: 2475077 - DNA, 19 bp, Homo sapiens
ctccccaggtccagctctg

SEQ ID NO: 2475078 - DNA, 23 bp, Homo sapiens
ctccccaggtccagctctggagg

SEQ ID NO: 2475079 - DNA, 11 bp, Homo sapiens
ctccccagttc

SEQ ID NO: 2475080 - DNA, 13 bp, Homo sapiens
ctcccccactttc

SEQ ID NO: 2475081 - DNA, 19 bp, Homo sapiens
ctcccccactttctttctt

SEQ ID NO: 2475082 - DNA, 12 bp, Homo sapiens
ctcccccagcaa

SEQ ID NO: 2475083 - DNA, 13 bp, Homo sapiens
ctcccccccatgc

SEQ ID NO: 2475084 - DNA, 15 bp, Homo sapiens
ctcccccccatgcac

SEQ ID NO: 2475085 - DNA, 18 bp, Homo sapiens
ctcccccccatgcactgt

SEQ ID NO: 2475086 - DNA, 17 bp, Homo sapiens
ctccccccgcctgccac

SEQ ID NO: 2475087 - DNA, 13 bp, Homo sapiens
ctcccctcagcct

SEQ ID NO: 2475088 - DNA, 12 bp, Homo sapiens
ctcccctccagc

SEQ ID NO: 2475089 - DNA, 14 bp, Homo sapiens
ctcccctccatccc

SEQ ID NO: 2475090 - DNA, 15 bp, Homo sapiens
ctcccctccatccct

SEQ ID NO: 2475091 - DNA, 16 bp, Homo sapiens
ctcccctccatccctg

SEQ ID NO: 2475092 - DNA, 13 bp, Homo sapiens
ctcccctgcactg

SEQ ID NO: 2475093 - DNA, 17 bp, Homo sapiens
ctcccctgcactgtaaa

SEQ ID NO: 2475094 - DNA, 18 bp, Homo sapiens
ctcccctgccaccaggcc

SEQ ID NO: 2475095 - DNA, 23 bp, Homo sapiens
ctcccctgccaccaggccacctc

SEQ ID NO: 2475096 - DNA, 15 bp, Homo sapiens
ctcccctgccagggc

SEQ ID NO: 2475097 - DNA, 21 bp, Homo sapiens
ctcccctgccagggcagggcc

SEQ ID NO: 2475098 - DNA, 15 bp, Homo sapiens
ctcccctgccccctg

SEQ ID NO: 2475099 - DNA, 20 bp, Homo sapiens
ctcccctgccccctgcagga

SEQ ID NO: 2475100 - DNA, 23 bp, Homo sapiens
ctcccctgccccctgcaggaagg

SEQ ID NO: 2475101 - DNA, 14 bp, Homo sapiens
ctcccctgtacctt

SEQ ID NO: 2475102 - DNA, 12 bp, Homo sapiens
ctccccttctct

SEQ ID NO: 2475103 - DNA, 13 bp, Homo sapiens
ctccccttgcctg

SEQ ID NO: 2475104 - DNA, 21 bp, Homo sapiens
ctccctatactgcttggagct

SEQ ID NO: 2475105 - DNA, 18 bp, Homo sapiens
ctccctcccagagcacct

SEQ ID NO: 2475106 - DNA, 16 bp, Homo sapiens
ctccctccgcccccag

SEQ ID NO: 2475107 - DNA, 19 bp, Homo sapiens
ctccctcctaacctagaga

SEQ ID NO: 2475108 - DNA, 12 bp, Homo sapiens
ctccctcctcca

SEQ ID NO: 2475109 - DNA, 17 bp, Homo sapiens
ctccctctcaggatcca

SEQ ID NO: 2475110 - DNA, 19 bp, Homo sapiens
ctccctctccgactcacac

SEQ ID NO: 2475111 - DNA, 18 bp, Homo sapiens
ctccctgaagcctttgca

SEQ ID NO: 2475112 - DNA, 23 bp, Homo sapiens
ctccctggaatgagttgaggcca

SEQ ID NO: 2475113 - DNA, 12 bp, Homo sapiens
ctccctggatga

SEQ ID NO: 2475114 - DNA, 12 bp, Homo sapiens
ctccctggtgct

SEQ ID NO: 2475115 - DNA, 15 bp, Homo sapiens
ctccctggtgcttat

SEQ ID NO: 2475116 - DNA, 13 bp, Homo sapiens
ctccctgtaactt

SEQ ID NO: 2475117 - DNA, 19 bp, Homo sapiens
ctccctgttccccagagaa

SEQ ID NO: 2475118 - DNA, 14 bp, Homo sapiens
ctcccttgggctcc

SEQ ID NO: 2475119 - DNA, 18 bp, Homo sapiens
ctcccttgggctccctgt

SEQ ID NO: 2475120 - DNA, 21 bp, Homo sapiens
ctcccttgggctctgatgaaa

SEQ ID NO: 2475121 - DNA, 23 bp, Homo sapiens
ctcccttgggctctgatgaaaaa

SEQ ID NO: 2475122 - DNA, 15 bp, Homo sapiens
ctccctttcactaaa

SEQ ID NO: 2475123 - DNA, 13 bp, Homo sapiens
ctccgagaggtgg

SEQ ID NO: 2475124 - DNA, 15 bp, Homo sapiens
ctccgaggacccagg

SEQ ID NO: 2475125 - DNA, 17 bp, Homo sapiens
ctccgaggacccaggaa

SEQ ID NO: 2475126 - DNA, 23 bp, Homo sapiens
ctccgcagtgcctgcaggggagc

SEQ ID NO: 2475127 - DNA, 16 bp, Homo sapiens
ctccgccctgccactc

SEQ ID NO: 2475128 - DNA, 18 bp, Homo sapiens
ctccgtgtgggagaccgg

SEQ ID NO: 2475129 - DNA, 15 bp, Homo sapiens
ctccgttagctcctg

SEQ ID NO: 2475130 - DNA, 21 bp, Homo sapiens
ctccgttagctcctgtggccc

SEQ ID NO: 2475131 - DNA, 22 bp, Homo sapiens
ctccgttagctcctgtggcccc

SEQ ID NO: 2475132 - DNA, 14 bp, Homo sapiens
ctcctaagcacctg

SEQ ID NO: 2475133 - DNA, 22 bp, Homo sapiens
ctcctaagcacctgtaatgtgc

SEQ ID NO: 2475134 - DNA, 14 bp, Homo sapiens
ctcctagctgtcct

SEQ ID NO: 2475135 - DNA, 15 bp, Homo sapiens
ctcctaggcattctg

SEQ ID NO: 2475136 - DNA, 19 bp, Homo sapiens
ctcctatgatctgagtcag

SEQ ID NO: 2475137 - DNA, 16 bp, Homo sapiens
ctcctcactgtatcca

SEQ ID NO: 2475138 - DNA, 11 bp, Homo sapiens
ctcctcagcct

SEQ ID NO: 2475139 - DNA, 24 bp, Homo sapiens
ctcctcagcctgaaccccagggct

SEQ ID NO: 2475140 - DNA, 23 bp, Homo sapiens
ctcctcaggcacacagctactct

SEQ ID NO: 2475141 - DNA, 17 bp, Homo sapiens
ctcctcagggactcagg

SEQ ID NO: 2475142 - DNA, 11 bp, Homo sapiens
ctcctcatgta

SEQ ID NO: 2475143 - DNA, 18 bp, Homo sapiens
ctcctccatgggagaaaa

SEQ ID NO: 2475144 - DNA, 20 bp, Homo sapiens
ctcctcccacccggctgcag

SEQ ID NO: 2475145 - DNA, 15 bp, Homo sapiens
ctctggcagccacac

SEQ ID NO: 2475146 - DNA, 17 bp, Homo sapiens
ctctggcagccacactt

SEQ ID NO: 2475147 - DNA, 18 bp, Homo sapiens
ctctggcattagaattat

SEQ ID NO: 2475148 - DNA, 16 bp, Homo sapiens
ctctgggggctgagga

SEQ ID NO: 2475149 - DNA, 21 bp, Homo sapiens
ctctggggggtggccaggccg

SEQ ID NO: 2475150 - DNA, 15 bp, Homo sapiens
ctctggggtgggcag

SEQ ID NO: 2475151 - DNA, 13 bp, Homo sapiens
ctctggtgcctcc

SEQ ID NO: 2475152 - DNA, 17 bp, Homo sapiens
ctctggtggcacaggag

SEQ ID NO: 2475153 - DNA, 17 bp, Homo sapiens
ctctggttgtttctgtt

SEQ ID NO: 2475154 - DNA, 20 bp, Homo sapiens
ctctggttgtttctgttcca

SEQ ID NO: 2475155 - DNA, 17 bp, Homo sapiens
ctctgtcaattgtacgc

SEQ ID NO: 2475156 - DNA, 14 bp, Homo sapiens
ctctgtcagtcaca

SEQ ID NO: 2475157 - DNA, 16 bp, Homo sapiens
ctctgtcagtcacagc

SEQ ID NO: 2475158 - DNA, 17 bp, Homo sapiens
ctctgtcagtcacagcc

SEQ ID NO: 2475159 - DNA, 14 bp, Homo sapiens
ctctgtccaggcac

SEQ ID NO: 2475160 - DNA, 13 bp, Homo sapiens
ctctgtcctgaag

SEQ ID NO: 2475161 - DNA, 19 bp, Homo sapiens
ctctgtcctgaaggcctga

SEQ ID NO: 2475162 - DNA, 15 bp, Homo sapiens
ctctgtctcatccat

SEQ ID NO: 2475163 - DNA, 18 bp, Homo sapiens
ctctgtctcgagcgccct

SEQ ID NO: 2475164 - DNA, 23 bp, Homo sapiens
ctctgtctcgagcgccctgcaga

SEQ ID NO: 2475165 - DNA, 17 bp, Homo sapiens
ctctgtctggcaatgcc

SEQ ID NO: 2475166 - DNA, 20 bp, Homo sapiens
ctctgtctggcaatgccaca

SEQ ID NO: 2475167 - DNA, 14 bp, Homo sapiens
ctctgtgaccaatg

SEQ ID NO: 2475168 - DNA, 15 bp, Homo sapiens
ctctgtgaccaatgt

SEQ ID NO: 2475169 - DNA, 15 bp, Homo sapiens
ctctgtgccagagcc

SEQ ID NO: 2475170 - DNA, 20 bp, Homo sapiens
ctctgtgccagagcctgggg

SEQ ID NO: 2475171 - DNA, 15 bp, Homo sapiens
ctctgtgctggccag

SEQ ID NO: 2475172 - DNA, 13 bp, Homo sapiens
ctctgtgctgtgt

SEQ ID NO: 2475173 - DNA, 19 bp, Homo sapiens
ctctgtgtctaagattcta

SEQ ID NO: 2475174 - DNA, 21 bp, Homo sapiens
ctctgtgtctaagattctaga

SEQ ID NO: 2475175 - DNA, 22 bp, Homo sapiens
ctctgtgtctaagattctagat

SEQ ID NO: 2475176 - DNA, 15 bp, Homo sapiens
ctctgttcaaagctg

SEQ ID NO: 2475177 - DNA, 18 bp, Homo sapiens
ctctgttcttcctcagcc

SEQ ID NO: 2475178 - DNA, 19 bp, Homo sapiens
ctctgttcttcctcagcca

SEQ ID NO: 2475179 - DNA, 21 bp, Homo sapiens
ctctgttcttcctcagccagc

SEQ ID NO: 2475180 - DNA, 21 bp, Homo sapiens
ctctgttgtcgtaaagatttg

SEQ ID NO: 2475181 - DNA, 16 bp, Homo sapiens
ctctgttttacaagtt

SEQ ID NO: 2475182 - DNA, 12 bp, Homo sapiens
ctcttaattgcc

SEQ ID NO: 2475183 - DNA, 23 bp, Homo sapiens
ctcttaattgccacctctaacag

SEQ ID NO: 2475184 - DNA, 18 bp, Homo sapiens
ctcttagtctaggtcctt

SEQ ID NO: 2475185 - DNA, 13 bp, Homo sapiens
ctcttatgctgta

SEQ ID NO: 2475186 - DNA, 20 bp, Homo sapiens
ctcttattgcctcacttcag

SEQ ID NO: 2475187 - DNA, 15 bp, Homo sapiens
ctcttcaaatgcctg

SEQ ID NO: 2475188 - DNA, 13 bp, Homo sapiens
ctcttcagaggcc

SEQ ID NO: 2475189 - DNA, 13 bp, Homo sapiens
ctcttcatttttt

SEQ ID NO: 2475190 - DNA, 14 bp, Homo sapiens
ctcttccagtttgc

SEQ ID NO: 2475191 - DNA, 15 bp, Homo sapiens
ctcttccatgctgtg

SEQ ID NO: 2475192 - DNA, 12 bp, Homo sapiens
ctcttccccaga

SEQ ID NO: 2475193 - DNA, 14 bp, Homo sapiens
ctcttccccagacg

SEQ ID NO: 2475194 - DNA, 22 bp, Homo sapiens
ctcttccccagacgcctggctg

SEQ ID NO: 2475195 - DNA, 15 bp, Homo sapiens
ctcttcccccaccac

SEQ ID NO: 2475196 - DNA, 19 bp, Homo sapiens
ctcttccccctctcccagt

SEQ ID NO: 2475197 - DNA, 20 bp, Homo sapiens
ctcttccccctctcccagtt

SEQ ID NO: 2475198 - DNA, 22 bp, Homo sapiens
ctcttctactcacttttcccac

SEQ ID NO: 2475199 - DNA, 15 bp, Homo sapiens
ctcttctctccagct

SEQ ID NO: 2475200 - DNA, 15 bp, Homo sapiens
ctcttctgggcctga

SEQ ID NO: 2475201 - DNA, 20 bp, Homo sapiens
ctcttcttccaggtagctga

SEQ ID NO: 2475202 - DNA, 12 bp, Homo sapiens
ctcttctttaga

SEQ ID NO: 2475203 - DNA, 17 bp, Homo sapiens
ctcttctttagaacagg

SEQ ID NO: 2475204 - DNA, 18 bp, Homo sapiens
ctcttgagcagtggctgg

SEQ ID NO: 2475205 - DNA, 22 bp, Homo sapiens
ctcttgagcagtggctggtcca

SEQ ID NO: 2475206 - DNA, 21 bp, Homo sapiens
ctcttgattatccatattgag

SEQ ID NO: 2475207 - DNA, 20 bp, Homo sapiens
ctcttgcctcaacctcccaa

SEQ ID NO: 2475208 - DNA, 17 bp, Homo sapiens
ctcttgcctgccactgt

SEQ ID NO: 2475209 - DNA, 23 bp, Homo sapiens
ctcttgcctgccactgtgtgaat

SEQ ID NO: 2475210 - DNA, 13 bp, Homo sapiens
ctcttggagaagt

SEQ ID NO: 2475211 - DNA, 15 bp, Homo sapiens
ctcttggagctgtga

SEQ ID NO: 2475212 - DNA, 15 bp, Homo sapiens
ctcttggctggaccc

SEQ ID NO: 2475213 - DNA, 16 bp, Homo sapiens
ctcttggctggaccca

SEQ ID NO: 2475214 - DNA, 17 bp, Homo sapiens
ctcttggctggacccag

SEQ ID NO: 2475215 - DNA, 21 bp, Homo sapiens
ctcttgtataagatcctagat

SEQ ID NO: 2475216 - DNA, 14 bp, Homo sapiens
ctctttatacagct

SEQ ID NO: 2475217 - DNA, 12 bp, Homo sapiens
ctctttcaaaac

SEQ ID NO: 2475218 - DNA, 12 bp, Homo sapiens
ctctttcagctc

SEQ ID NO: 2475219 - DNA, 14 bp, Homo sapiens
ctctttcagctcct

SEQ ID NO: 2475220 - DNA, 14 bp, Homo sapiens
ctctttccctggtc

SEQ ID NO: 2475221 - DNA, 18 bp, Homo sapiens
ctctttctctgccagtga

SEQ ID NO: 2475222 - DNA, 14 bp, Homo sapiens
ctctttctgtatat

SEQ ID NO: 2475223 - DNA, 18 bp, Homo sapiens
ctctttgttttgtgtctc

SEQ ID NO: 2475224 - DNA, 15 bp, Homo sapiens
ctgaaaaaatatatg

SEQ ID NO: 2475225 - DNA, 19 bp, Homo sapiens
ctgaaaaatctaagtgata

SEQ ID NO: 2475226 - DNA, 15 bp, Homo sapiens
ctgaaaatataacca

SEQ ID NO: 2475227 - DNA, 22 bp, Homo sapiens
ctgaaaatataaccagccattg

SEQ ID NO: 2475228 - DNA, 16 bp, Homo sapiens
ctgaaaatgtccttgt

SEQ ID NO: 2475229 - DNA, 17 bp, Homo sapiens
ctgaaaatgtccttgtg

SEQ ID NO: 2475230 - DNA, 15 bp, Homo sapiens
ctgaaacaacttgga

SEQ ID NO: 2475231 - DNA, 16 bp, Homo sapiens
ctgaaacaacttggaa

SEQ ID NO: 2475232 - DNA, 20 bp, Homo sapiens
ctgaaacaacttggaaagat

SEQ ID NO: 2475233 - DNA, 15 bp, Homo sapiens
ctgaaattctcctgg

SEQ ID NO: 2475234 - DNA, 17 bp, Homo sapiens
ctgaaattctcctggag

SEQ ID NO: 2475235 - DNA, 16 bp, Homo sapiens
ctgaaatttttcttct

SEQ ID NO: 2475236 - DNA, 11 bp, Homo sapiens
ctgaacaccat

SEQ ID NO: 2475237 - DNA, 16 bp, Homo sapiens
ctgaacagctggtgta

SEQ ID NO: 2475238 - DNA, 20 bp, Homo sapiens
ctgaacatctgagtcctgga

SEQ ID NO: 2475239 - DNA, 16 bp, Homo sapiens
ctgaaccccagggctg

SEQ ID NO: 2475240 - DNA, 19 bp, Homo sapiens
ctgaactaaagtgctgcac

SEQ ID NO: 2475241 - DNA, 21 bp, Homo sapiens
ctgaactcctgccatagtctt

SEQ ID NO: 2475242 - DNA, 21 bp, Homo sapiens
ctgaagccctcccaggtgtta

SEQ ID NO: 2475243 - DNA, 13 bp, Homo sapiens
ctgaaggcctgag

SEQ ID NO: 2475244 - DNA, 15 bp, Homo sapiens
ctgaaggcctgaggt

SEQ ID NO: 2475245 - DNA, 15 bp, Homo sapiens
ctgaaggggccatga

SEQ ID NO: 2475246 - DNA, 21 bp, Homo sapiens
ctgaagggttgactttaccca

SEQ ID NO: 2475247 - DNA, 16 bp, Homo sapiens
ctgaaggttgtggcct

SEQ ID NO: 2475248 - DNA, 18 bp, Homo sapiens
ctgaagtgagcacagcct

SEQ ID NO: 2475249 - DNA, 19 bp, Homo sapiens
ctgaagtgagcacagccta

SEQ ID NO: 2475250 - DNA, 22 bp, Homo sapiens
ctgctcggggtgcacaggaggg

SEQ ID NO: 2475251 - DNA, 17 bp, Homo sapiens
ctgctctaacagccctc

SEQ ID NO: 2475252 - DNA, 18 bp, Homo sapiens
ctgctctcctcttctact

SEQ ID NO: 2475253 - DNA, 12 bp, Homo sapiens
ctgctctgatgc

SEQ ID NO: 2475254 - DNA, 18 bp, Homo sapiens
ctgctctgatgcatcaga

SEQ ID NO: 2475255 - DNA, 20 bp, Homo sapiens
ctgctctgcgtgtcacctgt

SEQ ID NO: 2475256 - DNA, 21 bp, Homo sapiens
ctgctctgcgtgtcacctgtg

SEQ ID NO: 2475257 - DNA, 22 bp, Homo sapiens
ctgctcttggctggacccagcc

SEQ ID NO: 2475258 - DNA, 14 bp, Homo sapiens
ctgctctttctctg

SEQ ID NO: 2475259 - DNA, 15 bp, Homo sapiens
ctgctctttctctgc

SEQ ID NO: 2475260 - DNA, 16 bp, Homo sapiens
ctgctctttctctgcc

SEQ ID NO: 2475261 - DNA, 18 bp, Homo sapiens
ctgctctttctctgccag

SEQ ID NO: 2475262 - DNA, 19 bp, Homo sapiens
ctgctctttctctgccagt

SEQ ID NO: 2475263 - DNA, 20 bp, Homo sapiens
ctgctctttctctgccagtg

SEQ ID NO: 2475264 - DNA, 22 bp, Homo sapiens
ctgctctttctctgccagtgac

SEQ ID NO: 2475265 - DNA, 13 bp, Homo sapiens
ctgctgacctgct

SEQ ID NO: 2475266 - DNA, 18 bp, Homo sapiens
ctgctgagaacctggcct

SEQ ID NO: 2475267 - DNA, 19 bp, Homo sapiens
ctgctgagaacctggcctt

SEQ ID NO: 2475268 - DNA, 19 bp, Homo sapiens
ctgctgagatacatacaga

SEQ ID NO: 2475269 - DNA, 19 bp, Homo sapiens
ctgctgagctctgagaggc

SEQ ID NO: 2475270 - DNA, 22 bp, Homo sapiens
ctgctgagctctgagaggccct

SEQ ID NO: 2475271 - DNA, 19 bp, Homo sapiens
ctgctgatcgccttcccca

SEQ ID NO: 2475272 - DNA, 11 bp, Homo sapiens
ctgctgccact

SEQ ID NO: 2475273 - DNA, 12 bp, Homo sapiens
ctgctgccactg

SEQ ID NO: 2475274 - DNA, 14 bp, Homo sapiens
ctgctgccactgag

SEQ ID NO: 2475275 - DNA, 20 bp, Homo sapiens
ctgctgccagcttcaggtga

SEQ ID NO: 2475276 - DNA, 17 bp, Homo sapiens
ctgctgcccatgtttca

SEQ ID NO: 2475277 - DNA, 12 bp, Homo sapiens
ctgctgctccct

SEQ ID NO: 2475278 - DNA, 14 bp, Homo sapiens
ctgctgctccctca

SEQ ID NO: 2475279 - DNA, 21 bp, Homo sapiens
ctgctgctccctcagactggg

SEQ ID NO: 2475280 - DNA, 23 bp, Homo sapiens
ctgctgctccctcagactggggc

SEQ ID NO: 2475281 - DNA, 20 bp, Homo sapiens
ctgctgctgagaacctggcc

SEQ ID NO: 2475282 - DNA, 12 bp, Homo sapiens
ctgctgctgggc

SEQ ID NO: 2475283 - DNA, 17 bp, Homo sapiens
ctgctgctgtctgggtg

SEQ ID NO: 2475284 - DNA, 22 bp, Homo sapiens
ctgctggcccagccaaaccctg

SEQ ID NO: 2475285 - DNA, 14 bp, Homo sapiens
ctgctgggctcagt

SEQ ID NO: 2475286 - DNA, 18 bp, Homo sapiens
ctgctgggctcagtgaag

SEQ ID NO: 2475287 - DNA, 17 bp, Homo sapiens
ctgctggggaagacagt

SEQ ID NO: 2475288 - DNA, 22 bp, Homo sapiens
ctgctggggaagacagtggccc

SEQ ID NO: 2475289 - DNA, 14 bp, Homo sapiens
ctgctggggcctgg

SEQ ID NO: 2475290 - DNA, 15 bp, Homo sapiens
ctgctggggcctggg

SEQ ID NO: 2475291 - DNA, 16 bp, Homo sapiens
ctgctggggcctggga

SEQ ID NO: 2475292 - DNA, 17 bp, Homo sapiens
ctgctggggcctgggac

SEQ ID NO: 2475293 - DNA, 19 bp, Homo sapiens
ctgctggggcctgggacaa

SEQ ID NO: 2475294 - DNA, 16 bp, Homo sapiens
ctgctggtccgtggga

SEQ ID NO: 2475295 - DNA, 14 bp, Homo sapiens
ctgctgtctgggtg

SEQ ID NO: 2475296 - DNA, 15 bp, Homo sapiens
ctgctgtctgggtgc

SEQ ID NO: 2475297 - DNA, 18 bp, Homo sapiens
ctgctgtggccaggaggt

SEQ ID NO: 2475298 - DNA, 22 bp, Homo sapiens
ctgctgtgtgctttttttgtgt

SEQ ID NO: 2475299 - DNA, 23 bp, Homo sapiens
ctgctgtgtgctttttttgtgtg

SEQ ID NO: 2475300 - DNA, 15 bp, Homo sapiens
ctgcttccctgaagc

SEQ ID NO: 2475301 - DNA, 16 bp, Homo sapiens
ctgcttccctgaagct

SEQ ID NO: 2475302 - DNA, 12 bp, Homo sapiens
ctgcttcctcct

SEQ ID NO: 2475303 - DNA, 13 bp, Homo sapiens
ctgcttcctcctg

SEQ ID NO: 2475304 - DNA, 13 bp, Homo sapiens
ctgcttcctgctt

SEQ ID NO: 2475305 - DNA, 15 bp, Homo sapiens
ctgcttcctgcttgc

SEQ ID NO: 2475306 - DNA, 15 bp, Homo sapiens
ctgcttctcccaggc

SEQ ID NO: 2475307 - DNA, 17 bp, Homo sapiens
ctgcttctcccaggcaa

SEQ ID NO: 2475308 - DNA, 18 bp, Homo sapiens
ctgcttctcccaggcaag

SEQ ID NO: 2475309 - DNA, 22 bp, Homo sapiens
ctgcttctcccaggcaaggctg

SEQ ID NO: 2475310 - DNA, 15 bp, Homo sapiens
ctgcttctctgactt

SEQ ID NO: 2475311 - DNA, 23 bp, Homo sapiens
ctgcttctctgacttctgcctgg

SEQ ID NO: 2475312 - DNA, 16 bp, Homo sapiens
ctgcttgccctaagca

SEQ ID NO: 2475313 - DNA, 20 bp, Homo sapiens
ctgcttgccctaagcagaaa

SEQ ID NO: 2475314 - DNA, 22 bp, Homo sapiens
ctgcttgccctaagcagaaagt

SEQ ID NO: 2475315 - DNA, 21 bp, Homo sapiens
ctgcttggggggtgatgaggg

SEQ ID NO: 2475316 - DNA, 14 bp, Homo sapiens
ctgctttctccttt

SEQ ID NO: 2475317 - DNA, 20 bp, Homo sapiens
ctgctttgggaagccgtgct

SEQ ID NO: 2475318 - DNA, 12 bp, Homo sapiens
ctgctttgggct

SEQ ID NO: 2475319 - DNA, 17 bp, Homo sapiens
ctggaaaacagaacact

SEQ ID NO: 2475320 - DNA, 18 bp, Homo sapiens
ctggaaaacagaacactt

SEQ ID NO: 2475321 - DNA, 20 bp, Homo sapiens
ctggaaaataatactgctga

SEQ ID NO: 2475322 - DNA, 23 bp, Homo sapiens
ctggaaagcttttctattttaat

SEQ ID NO: 2475323 - DNA, 15 bp, Homo sapiens
ctggaacctcagcct

SEQ ID NO: 2475324 - DNA, 14 bp, Homo sapiens
ctggaacttgggga

SEQ ID NO: 2475325 - DNA, 18 bp, Homo sapiens
ctggaagatcctgcgggt

SEQ ID NO: 2475326 - DNA, 13 bp, Homo sapiens
ctggaagatgggg

SEQ ID NO: 2475327 - DNA, 23 bp, Homo sapiens
ctggaagatggggaccagcagcc

SEQ ID NO: 2475328 - DNA, 17 bp, Homo sapiens
ctggaagctaatttgca

SEQ ID NO: 2475329 - DNA, 18 bp, Homo sapiens
ctggaagctaatttgcat

SEQ ID NO: 2475330 - DNA, 19 bp, Homo sapiens
ctggaagctaatttgcatt

SEQ ID NO: 2475331 - DNA, 15 bp, Homo sapiens
ctggaagggaggtgg

SEQ ID NO: 2475332 - DNA, 14 bp, Homo sapiens
ctggaatgtaatca

SEQ ID NO: 2475333 - DNA, 16 bp, Homo sapiens
ctggacactcagacct

SEQ ID NO: 2475334 - DNA, 17 bp, Homo sapiens
ctggacactcagacctg

SEQ ID NO: 2475335 - DNA, 14 bp, Homo sapiens
ctggacagccccac

SEQ ID NO: 2475336 - DNA, 15 bp, Homo sapiens
ctggacagccccacc

SEQ ID NO: 2475337 - DNA, 18 bp, Homo sapiens
ctggacagccccaccctg

SEQ ID NO: 2475338 - DNA, 13 bp, Homo sapiens
ctggacagctgtg

SEQ ID NO: 2475339 - DNA, 12 bp, Homo sapiens
ctggacccagcc

SEQ ID NO: 2475340 - DNA, 17 bp, Homo sapiens
ctggacccagccagaac

SEQ ID NO: 2475341 - DNA, 17 bp, Homo sapiens
ctggacccagccaggcc

SEQ ID NO: 2475342 - DNA, 21 bp, Homo sapiens
ctggacccagccaggcccagc

SEQ ID NO: 2475343 - DNA, 22 bp, Homo sapiens
ctggacccccctttcacaggca

SEQ ID NO: 2475344 - DNA, 23 bp, Homo sapiens
ctggacccctgcattggaactgg

SEQ ID NO: 2475345 - DNA, 20 bp, Homo sapiens
ctggacccgttcatggggga

SEQ ID NO: 2475346 - DNA, 13 bp, Homo sapiens
ctggaccctgacc

SEQ ID NO: 2475347 - DNA, 13 bp, Homo sapiens
ctggacctctgac

SEQ ID NO: 2475348 - DNA, 15 bp, Homo sapiens
ctggacctctgacag

SEQ ID NO: 2475349 - DNA, 14 bp, Homo sapiens
ctggactctcagtc

SEQ ID NO: 2475350 - DNA, 21 bp, Homo sapiens
ctggactctcagtctctgagc

SEQ ID NO: 2475351 - DNA, 23 bp, Homo sapiens
ctggacttaagcatctggctcta

SEQ ID NO: 2475352 - DNA, 15 bp, Homo sapiens
ctggagaccaccagg

SEQ ID NO: 2475353 - DNA, 15 bp, Homo sapiens
ctggagacttagggc

SEQ ID NO: 2475354 - DNA, 24 bp, Homo sapiens
ctggtcccttgtatcccctgcagg

SEQ ID NO: 2475355 - DNA, 16 bp, Homo sapiens
ctggtccgtgggacgg

SEQ ID NO: 2475356 - DNA, 17 bp, Homo sapiens
ctggtcctatggcctca

SEQ ID NO: 2475357 - DNA, 15 bp, Homo sapiens
ctggtcctttttggt

SEQ ID NO: 2475358 - DNA, 13 bp, Homo sapiens
ctggtcgctcctg

SEQ ID NO: 2475359 - DNA, 19 bp, Homo sapiens
ctggtctcaaactcctgac

SEQ ID NO: 2475360 - DNA, 18 bp, Homo sapiens
ctggtctcaccctggagg

SEQ ID NO: 2475361 - DNA, 24 bp, Homo sapiens
ctggtctctctatgcctctctaca

SEQ ID NO: 2475362 - DNA, 20 bp, Homo sapiens
ctggtgacatcaggtttttc

SEQ ID NO: 2475363 - DNA, 16 bp, Homo sapiens
ctggtgcctccagagg

SEQ ID NO: 2475364 - DNA, 14 bp, Homo sapiens
ctggtgcggctggc

SEQ ID NO: 2475365 - DNA, 19 bp, Homo sapiens
ctggtgcttatgctcttaa

SEQ ID NO: 2475366 - DNA, 22 bp, Homo sapiens
ctggtggggataggccagccgc

SEQ ID NO: 2475367 - DNA, 16 bp, Homo sapiens
ctggtggggcagctcc

SEQ ID NO: 2475368 - DNA, 20 bp, Homo sapiens
ctggtggggcagctcctctg

SEQ ID NO: 2475369 - DNA, 15 bp, Homo sapiens
ctggtggtattttca

SEQ ID NO: 2475370 - DNA, 16 bp, Homo sapiens
ctggtggtattttcaa

SEQ ID NO: 2475371 - DNA, 20 bp, Homo sapiens
ctggtggtctgttggcaggc

SEQ ID NO: 2475372 - DNA, 22 bp, Homo sapiens
ctggtggtctgttggcaggctg

SEQ ID NO: 2475373 - DNA, 12 bp, Homo sapiens
ctggtgtagcta

SEQ ID NO: 2475374 - DNA, 21 bp, Homo sapiens
ctggtgtagctacagagaaac

SEQ ID NO: 2475375 - DNA, 16 bp, Homo sapiens
ctggtgtggtacagag

SEQ ID NO: 2475376 - DNA, 17 bp, Homo sapiens
ctggtgtggtacagaga

SEQ ID NO: 2475377 - DNA, 23 bp, Homo sapiens
ctggtgtggtacagagaagccag

SEQ ID NO: 2475378 - DNA, 12 bp, Homo sapiens
ctggtgttaaca

SEQ ID NO: 2475379 - DNA, 13 bp, Homo sapiens
ctggtgttaacag

SEQ ID NO: 2475380 - DNA, 14 bp, Homo sapiens
ctggtgttaacaga

SEQ ID NO: 2475381 - DNA, 15 bp, Homo sapiens
ctggtgttaacagaa

SEQ ID NO: 2475382 - DNA, 17 bp, Homo sapiens
ctggtgttaacagaagg

SEQ ID NO: 2475383 - DNA, 20 bp, Homo sapiens
ctggtgttggacaagcttct

SEQ ID NO: 2475384 - DNA, 22 bp, Homo sapiens
ctggtgttggacaagcttctga

SEQ ID NO: 2475385 - DNA, 13 bp, Homo sapiens
ctggttccagggt

SEQ ID NO: 2475386 - DNA, 15 bp, Homo sapiens
ctggttccagggtcc

SEQ ID NO: 2475387 - DNA, 16 bp, Homo sapiens
ctggttccagggtccc

SEQ ID NO: 2475388 - DNA, 23 bp, Homo sapiens
ctggttccagggtccctctgtgt

SEQ ID NO: 2475389 - DNA, 21 bp, Homo sapiens
ctggttcccgtttctccacct

SEQ ID NO: 2475390 - DNA, 20 bp, Homo sapiens
ctggttcttgtgttggctgt

SEQ ID NO: 2475391 - DNA, 19 bp, Homo sapiens
ctggttgtttctgttccaa

SEQ ID NO: 2475392 - DNA, 14 bp, Homo sapiens
ctggtttaatgttt

SEQ ID NO: 2475393 - DNA, 17 bp, Homo sapiens
ctggttttcacattaga

SEQ ID NO: 2475394 - DNA, 20 bp, Homo sapiens
ctgtaaacctctcgagggca

SEQ ID NO: 2475395 - DNA, 18 bp, Homo sapiens
ctgtaaactttatcactt

SEQ ID NO: 2475396 - DNA, 12 bp, Homo sapiens
ctgtaaagatgt

SEQ ID NO: 2475397 - DNA, 22 bp, Homo sapiens
ctgtaaagatgtttatttcagg

SEQ ID NO: 2475398 - DNA, 19 bp, Homo sapiens
ctgtaacatactggcctgg

SEQ ID NO: 2475399 - DNA, 17 bp, Homo sapiens
ctgtaactactttataa

SEQ ID NO: 2475400 - DNA, 16 bp, Homo sapiens
ctgtaactgccaggct

SEQ ID NO: 2475401 - DNA, 23 bp, Homo sapiens
ctgtaacttgatccatttctaat

SEQ ID NO: 2475402 - DNA, 13 bp, Homo sapiens
ctgtaagaaacct

SEQ ID NO: 2475403 - DNA, 21 bp, Homo sapiens
ctgtaagaaacctactgccca

SEQ ID NO: 2475404 - DNA, 21 bp, Homo sapiens
ctgtaagttgggcttgctatt

SEQ ID NO: 2475405 - DNA, 19 bp, Homo sapiens
ctgtaatcatataataaat

SEQ ID NO: 2475406 - DNA, 15 bp, Homo sapiens
ctgtaatgttaatat

SEQ ID NO: 2475407 - DNA, 17 bp, Homo sapiens
ctgtaatgttaatattg

SEQ ID NO: 2475408 - DNA, 18 bp, Homo sapiens
ctgtaatgttaatattga

SEQ ID NO: 2475409 - DNA, 19 bp, Homo sapiens
ctgtaatgttaatattgat

SEQ ID NO: 2475410 - DNA, 22 bp, Homo sapiens
ctgtacacaactcactcctttt

SEQ ID NO: 2475411 - DNA, 18 bp, Homo sapiens
ctgtacagctggctctac

SEQ ID NO: 2475412 - DNA, 14 bp, Homo sapiens
ctgtacagtgtctt

SEQ ID NO: 2475413 - DNA, 15 bp, Homo sapiens
ctgtacagtgtcttt

SEQ ID NO: 2475414 - DNA, 14 bp, Homo sapiens
ctgtacatctattt

SEQ ID NO: 2475415 - DNA, 17 bp, Homo sapiens
ctgtaccagttaatttt

SEQ ID NO: 2475416 - DNA, 23 bp, Homo sapiens
ctgtaccttttgaggagccccag

SEQ ID NO: 2475417 - DNA, 13 bp, Homo sapiens
ctgtactgcctgc

SEQ ID NO: 2475418 - DNA, 14 bp, Homo sapiens
ctgtactgcctgct

SEQ ID NO: 2475419 - DNA, 19 bp, Homo sapiens
ctgtactgcctgcttgggg

SEQ ID NO: 2475420 - DNA, 23 bp, Homo sapiens
ctgtagaaaaaaaaattcacatg

SEQ ID NO: 2475421 - DNA, 18 bp, Homo sapiens
ctgtagacggctcagtat

SEQ ID NO: 2475422 - DNA, 15 bp, Homo sapiens
ctgtagagttgctga

SEQ ID NO: 2475423 - DNA, 14 bp, Homo sapiens
ctgtaggaaaccca

SEQ ID NO: 2475424 - DNA, 12 bp, Homo sapiens
ctgtaggcctca

SEQ ID NO: 2475425 - DNA, 13 bp, Homo sapiens
ctgtaggcctcag

SEQ ID NO: 2475426 - DNA, 17 bp, Homo sapiens
ctgtaggttgcacactt

SEQ ID NO: 2475427 - DNA, 19 bp, Homo sapiens
ctgtagttctaagactcaa

SEQ ID NO: 2475428 - DNA, 15 bp, Homo sapiens
ctgtataaatgtctt

SEQ ID NO: 2475429 - DNA, 13 bp, Homo sapiens
ctgtatatacttt

SEQ ID NO: 2475430 - DNA, 15 bp, Homo sapiens
ctgtatatacttttt

SEQ ID NO: 2475431 - DNA, 14 bp, Homo sapiens
ctgtatattcagga

SEQ ID NO: 2475432 - DNA, 23 bp, Homo sapiens
ctgtatccaggttccctcccaga

SEQ ID NO: 2475433 - DNA, 18 bp, Homo sapiens
ctgtatttgaaataagaa

SEQ ID NO: 2475434 - DNA, 17 bp, Homo sapiens
ctgtatttgttcccaag

SEQ ID NO: 2475435 - DNA, 18 bp, Homo sapiens
ctgtatttgttcccaaga

SEQ ID NO: 2475436 - DNA, 19 bp, Homo sapiens
ctgtatttgttcccaagag

SEQ ID NO: 2475437 - DNA, 14 bp, Homo sapiens
ctgtcaaggctcag

SEQ ID NO: 2475438 - DNA, 14 bp, Homo sapiens
ctgtcaattgtacg

SEQ ID NO: 2475439 - DNA, 23 bp, Homo sapiens
ctgtcagatccaggagctccagt

SEQ ID NO: 2475440 - DNA, 15 bp, Homo sapiens
ctgtcagcatgaatt

SEQ ID NO: 2475441 - DNA, 18 bp, Homo sapiens
ctgtcagtcacagccacc

SEQ ID NO: 2475442 - DNA, 16 bp, Homo sapiens
ctgtcatcatcatggc

SEQ ID NO: 2475443 - DNA, 17 bp, Homo sapiens
ctgtcatcatcatggcc

SEQ ID NO: 2475444 - DNA, 19 bp, Homo sapiens
ctgtcatcatcatggccag

SEQ ID NO: 2475445 - DNA, 22 bp, Homo sapiens
ctgtcatcctcaaagaaagtgt

SEQ ID NO: 2475446 - DNA, 12 bp, Homo sapiens
ctgtccagctcc

SEQ ID NO: 2475447 - DNA, 18 bp, Homo sapiens
ctgtccagctccaacctg

SEQ ID NO: 2475448 - DNA, 21 bp, Homo sapiens
ctgtccagctccaacctgcaa

SEQ ID NO: 2475449 - DNA, 16 bp, Homo sapiens
ctgtcccacccccacc

SEQ ID NO: 2475450 - DNA, 21 bp, Homo sapiens
ctgtcccctgctacacctatt

SEQ ID NO: 2475451 - DNA, 12 bp, Homo sapiens
ctgtccctcact

SEQ ID NO: 2475452 - DNA, 13 bp, Homo sapiens
ctgtccctcactg

SEQ ID NO: 2475453 - DNA, 15 bp, Homo sapiens
ctgtccctccccctt

SEQ ID NO: 2475454 - DNA, 17 bp, Homo sapiens
ctgtccctccgggacct

SEQ ID NO: 2475455 - DNA, 20 bp, Homo sapiens
ctgtcccttgcctcaatgcc

SEQ ID NO: 2475456 - DNA, 21 bp, Homo sapiens
ctgtccgttcacatgtgtggt

SEQ ID NO: 2475457 - DNA, 13 bp, Homo sapiens
ctgtcctcagcct

SEQ ID NO: 2475458 - DNA, 18 bp, Homo sapiens
ctgtgtgtgtgaatgaac

SEQ ID NO: 2475459 - DNA, 23 bp, Homo sapiens
ctgtgtgtgtgaatgaacactct

SEQ ID NO: 2475460 - DNA, 19 bp, Homo sapiens
ctgtgtgttaagctctgct

SEQ ID NO: 2475461 - DNA, 23 bp, Homo sapiens
ctgtgttactaaaaaaaagatga

SEQ ID NO: 2475462 - DNA, 21 bp, Homo sapiens
ctgtgttccttccgcttggag

SEQ ID NO: 2475463 - DNA, 13 bp, Homo sapiens
ctgtgttgccaag

SEQ ID NO: 2475464 - DNA, 16 bp, Homo sapiens
ctgtgttgccaagctc

SEQ ID NO: 2475465 - DNA, 17 bp, Homo sapiens
ctgtgttgccaagctcc

SEQ ID NO: 2475466 - DNA, 19 bp, Homo sapiens
ctgtgttgccaagctccaa

SEQ ID NO: 2475467 - DNA, 17 bp, Homo sapiens
ctgtgtttcttgcctca

SEQ ID NO: 2475468 - DNA, 12 bp, Homo sapiens
ctgttaactgaa

SEQ ID NO: 2475469 - DNA, 19 bp, Homo sapiens
ctgttaactgaataccact

SEQ ID NO: 2475470 - DNA, 19 bp, Homo sapiens
ctgttacactttttggaag

SEQ ID NO: 2475471 - DNA, 13 bp, Homo sapiens
ctgttagcagaca

SEQ ID NO: 2475472 - DNA, 15 bp, Homo sapiens
ctgttagcagacagg

SEQ ID NO: 2475473 - DNA, 11 bp, Homo sapiens
ctgttccaaat

SEQ ID NO: 2475474 - DNA, 22 bp, Homo sapiens
ctgttccaaattcagtttcata

SEQ ID NO: 2475475 - DNA, 13 bp, Homo sapiens
ctgttccccagag

SEQ ID NO: 2475476 - DNA, 15 bp, Homo sapiens
ctgttccccagagaa

SEQ ID NO: 2475477 - DNA, 14 bp, Homo sapiens
ctgttcctgctgct

SEQ ID NO: 2475478 - DNA, 12 bp, Homo sapiens
ctgttctaaagc

SEQ ID NO: 2475479 - DNA, 14 bp, Homo sapiens
ctgttctagttttt

SEQ ID NO: 2475480 - DNA, 16 bp, Homo sapiens
ctgttctatgccttta

SEQ ID NO: 2475481 - DNA, 19 bp, Homo sapiens
ctgttctatgcctttagtc

SEQ ID NO: 2475482 - DNA, 20 bp, Homo sapiens
ctgttctatgcctttagtca

SEQ ID NO: 2475483 - DNA, 15 bp, Homo sapiens
ctgttctcttgggaa

SEQ ID NO: 2475484 - DNA, 21 bp, Homo sapiens
ctgttctcttgggaactgaac

SEQ ID NO: 2475485 - DNA, 14 bp, Homo sapiens
ctgttctgtgtctt

SEQ ID NO: 2475486 - DNA, 16 bp, Homo sapiens
ctgttcttagctcaat

SEQ ID NO: 2475487 - DNA, 19 bp, Homo sapiens
ctgttcttagctcaatgag

SEQ ID NO: 2475488 - DNA, 16 bp, Homo sapiens
ctgttcttcctcagcc

SEQ ID NO: 2475489 - DNA, 19 bp, Homo sapiens
ctgttcttcctcagccagc

SEQ ID NO: 2475490 - DNA, 20 bp, Homo sapiens
ctgttcttcctcagccagcc

SEQ ID NO: 2475491 - DNA, 22 bp, Homo sapiens
ctgttcttcctcagccagcctc

SEQ ID NO: 2475492 - DNA, 15 bp, Homo sapiens
ctgttgcacgtgtgt

SEQ ID NO: 2475493 - DNA, 17 bp, Homo sapiens
ctgttgcacgtgtgttt

SEQ ID NO: 2475494 - DNA, 23 bp, Homo sapiens
ctgttgcacgtgtgtttttctat

SEQ ID NO: 2475495 - DNA, 23 bp, Homo sapiens
ctgttggaatggatttttcttta

SEQ ID NO: 2475496 - DNA, 18 bp, Homo sapiens
ctgttggcaggctggcca

SEQ ID NO: 2475497 - DNA, 19 bp, Homo sapiens
ctgttggcaggctggccag

SEQ ID NO: 2475498 - DNA, 22 bp, Homo sapiens
ctgtttattaaagtacaaccat

SEQ ID NO: 2475499 - DNA, 18 bp, Homo sapiens
ctgtttattaatcttagt

SEQ ID NO: 2475500 - DNA, 22 bp, Homo sapiens
ctgtttcaaggcactctagatt

SEQ ID NO: 2475501 - DNA, 16 bp, Homo sapiens
ctgtttcctagctgtg

SEQ ID NO: 2475502 - DNA, 18 bp, Homo sapiens
ctgtttgcatttgataca

SEQ ID NO: 2475503 - DNA, 13 bp, Homo sapiens
ctgtttgctgtgc

SEQ ID NO: 2475504 - DNA, 23 bp, Homo sapiens
ctgtttggaaataaatcttccta

SEQ ID NO: 2475505 - DNA, 21 bp, Homo sapiens
ctgttttacaagttggagtca

SEQ ID NO: 2475506 - DNA, 16 bp, Homo sapiens
ctgttttcccacgagg

SEQ ID NO: 2475507 - DNA, 12 bp, Homo sapiens
ctgttttccccc

SEQ ID NO: 2475508 - DNA, 21 bp, Homo sapiens
ctgttttctctcggctcccca

SEQ ID NO: 2475509 - DNA, 13 bp, Homo sapiens
ctgttttgttgac

SEQ ID NO: 2475510 - DNA, 21 bp, Homo sapiens
ctgttttgttgacattctgaa

SEQ ID NO: 2475511 - DNA, 23 bp, Homo sapiens
ctgttttgtttcgctctttgaga

SEQ ID NO: 2475512 - DNA, 22 bp, Homo sapiens
ctgtttttcatgcgatgacact

SEQ ID NO: 2475513 - DNA, 14 bp, Homo sapiens
cttaaaaagttata

SEQ ID NO: 2475514 - DNA, 12 bp, Homo sapiens
cttaaaactttg

SEQ ID NO: 2475515 - DNA, 12 bp, Homo sapiens
cttaaaatacaa

SEQ ID NO: 2475516 - DNA, 24 bp, Homo sapiens
cttaaaatgttcacttttgacaaa

SEQ ID NO: 2475517 - DNA, 19 bp, Homo sapiens
cttaaacaaaaattaaaat

SEQ ID NO: 2475518 - DNA, 15 bp, Homo sapiens
cttaaagctttcaga

SEQ ID NO: 2475519 - DNA, 16 bp, Homo sapiens
cttaaagtgccagtat

SEQ ID NO: 2475520 - DNA, 16 bp, Homo sapiens
cttaaatgttattatc

SEQ ID NO: 2475521 - DNA, 16 bp, Homo sapiens
cttaacggaccaaagc

SEQ ID NO: 2475522 - DNA, 17 bp, Homo sapiens
cttaacggaccaaagca

SEQ ID NO: 2475523 - DNA, 20 bp, Homo sapiens
cttaacggaccaaagcaaga

SEQ ID NO: 2475524 - DNA, 15 bp, Homo sapiens
cttaacttcttgctt

SEQ ID NO: 2475525 - DNA, 18 bp, Homo sapiens
cttaacttcttgcttctt

SEQ ID NO: 2475526 - DNA, 20 bp, Homo sapiens
cttaagacctactgttctaa

SEQ ID NO: 2475527 - DNA, 22 bp, Homo sapiens
cttaagcccagtgcactgaaag

SEQ ID NO: 2475528 - DNA, 14 bp, Homo sapiens
cttaaggtgtagcc

SEQ ID NO: 2475529 - DNA, 19 bp, Homo sapiens
cttaagttagttccactga

SEQ ID NO: 2475530 - DNA, 21 bp, Homo sapiens
cttaagttagttccactgaga

SEQ ID NO: 2475531 - DNA, 21 bp, Homo sapiens
cttaatcagatagatattcct

SEQ ID NO: 2475532 - DNA, 14 bp, Homo sapiens
cttaatctttgaaa

SEQ ID NO: 2475533 - DNA, 20 bp, Homo sapiens
cttaatggctgataatttta

SEQ ID NO: 2475534 - DNA, 11 bp, Homo sapiens
cttaattatta

SEQ ID NO: 2475535 - DNA, 12 bp, Homo sapiens
cttacagcaggc

SEQ ID NO: 2475536 - DNA, 12 bp, Homo sapiens
cttacctggccc

SEQ ID NO: 2475537 - DNA, 13 bp, Homo sapiens
cttacctggccca

SEQ ID NO: 2475538 - DNA, 12 bp, Homo sapiens
cttactcctgtg

SEQ ID NO: 2475539 - DNA, 15 bp, Homo sapiens
cttactcctgtggga

SEQ ID NO: 2475540 - DNA, 12 bp, Homo sapiens
cttactctaaga

SEQ ID NO: 2475541 - DNA, 20 bp, Homo sapiens
cttactctaagatcttagat

SEQ ID NO: 2475542 - DNA, 11 bp, Homo sapiens
cttactgcttg

SEQ ID NO: 2475543 - DNA, 14 bp, Homo sapiens
cttacttggaactg

SEQ ID NO: 2475544 - DNA, 17 bp, Homo sapiens
cttactttttatatata

SEQ ID NO: 2475545 - DNA, 18 bp, Homo sapiens
cttagaaaaccagctcag

SEQ ID NO: 2475546 - DNA, 19 bp, Homo sapiens
cttagaaaaccagctcagc

SEQ ID NO: 2475547 - DNA, 21 bp, Homo sapiens
cttagaaaaccagctcagcac

SEQ ID NO: 2475548 - DNA, 20 bp, Homo sapiens
cttagacagaggccctcaag

SEQ ID NO: 2475549 - DNA, 15 bp, Homo sapiens
cttagactcttttcc

SEQ ID NO: 2475550 - DNA, 20 bp, Homo sapiens
cttagattctctgtgtctaa

SEQ ID NO: 2475551 - DNA, 14 bp, Homo sapiens
cttagatttcatag

SEQ ID NO: 2475552 - DNA, 21 bp, Homo sapiens
cttagatttcatagttcagaa

SEQ ID NO: 2475553 - DNA, 15 bp, Homo sapiens
cttagcagcttccag

SEQ ID NO: 2475554 - DNA, 21 bp, Homo sapiens
cttagcctggacctctgacag

SEQ ID NO: 2475555 - DNA, 19 bp, Homo sapiens
cttagctcaatgagcatgt

SEQ ID NO: 2475556 - DNA, 22 bp, Homo sapiens
cttagctcaatgagcatgttta

SEQ ID NO: 2475557 - DNA, 19 bp, Homo sapiens
cttagctctcccaactctt

SEQ ID NO: 2475558 - DNA, 20 bp, Homo sapiens
cttaggaagagccttccacc

SEQ ID NO: 2475559 - DNA, 15 bp, Homo sapiens
cttagtctaggtcct

SEQ ID NO: 2475560 - DNA, 19 bp, Homo sapiens
cttagtctcagtttgtgtg

SEQ ID NO: 2475561 - DNA, 17 bp, Homo sapiens
cttagtttgtgtgttgt

SEQ ID NO: 2475562 - DNA, 13 bp, Homo sapiens
ctttcagctgtct

SEQ ID NO: 2475563 - DNA, 17 bp, Homo sapiens
ctttcagctgtcttttg

SEQ ID NO: 2475564 - DNA, 21 bp, Homo sapiens
ctttcaggatctatttttgga

SEQ ID NO: 2475565 - DNA, 17 bp, Homo sapiens
ctttcatgtaaactgtg

SEQ ID NO: 2475566 - DNA, 19 bp, Homo sapiens
ctttcatgtaaactgtgca

SEQ ID NO: 2475567 - DNA, 18 bp, Homo sapiens
ctttcattccttcagatt

SEQ ID NO: 2475568 - DNA, 17 bp, Homo sapiens
ctttcattttctctcag

SEQ ID NO: 2475569 - DNA, 17 bp, Homo sapiens
ctttccaccacagccag

SEQ ID NO: 2475570 - DNA, 21 bp, Homo sapiens
ctttccaccacagccagcacc

SEQ ID NO: 2475571 - DNA, 23 bp, Homo sapiens
ctttccaccacagccagcacctg

SEQ ID NO: 2475572 - DNA, 12 bp, Homo sapiens
ctttccattaca

SEQ ID NO: 2475573 - DNA, 15 bp, Homo sapiens
ctttcccaccccaac

SEQ ID NO: 2475574 - DNA, 15 bp, Homo sapiens
ctttcccagtctgtc

SEQ ID NO: 2475575 - DNA, 17 bp, Homo sapiens
ctttcccagtctgtcga

SEQ ID NO: 2475576 - DNA, 17 bp, Homo sapiens
ctttcccatggggaggg

SEQ ID NO: 2475577 - DNA, 18 bp, Homo sapiens
ctttccccaccagatgct

SEQ ID NO: 2475578 - DNA, 14 bp, Homo sapiens
ctttccctctggga

SEQ ID NO: 2475579 - DNA, 13 bp, Homo sapiens
ctttcctcgcctg

SEQ ID NO: 2475580 - DNA, 21 bp, Homo sapiens
ctttcctgccatgtttagtga

SEQ ID NO: 2475581 - DNA, 14 bp, Homo sapiens
ctttcctgccccag

SEQ ID NO: 2475582 - DNA, 19 bp, Homo sapiens
ctttcctgccccaggcctg

SEQ ID NO: 2475583 - DNA, 17 bp, Homo sapiens
ctttcggatccagggag

SEQ ID NO: 2475584 - DNA, 17 bp, Homo sapiens
ctttctagaccaataaa

SEQ ID NO: 2475585 - DNA, 16 bp, Homo sapiens
ctttctatcctctgta

SEQ ID NO: 2475586 - DNA, 22 bp, Homo sapiens
ctttctcactaaatcttttata

SEQ ID NO: 2475587 - DNA, 22 bp, Homo sapiens
ctttctctctttatacagctgt

SEQ ID NO: 2475588 - DNA, 14 bp, Homo sapiens
ctttctctgaggac

SEQ ID NO: 2475589 - DNA, 16 bp, Homo sapiens
ctttctctgccagtga

SEQ ID NO: 2475590 - DNA, 14 bp, Homo sapiens
ctttctgaacagct

SEQ ID NO: 2475591 - DNA, 16 bp, Homo sapiens
ctttctgaacagctgg

SEQ ID NO: 2475592 - DNA, 19 bp, Homo sapiens
ctttctgaacagctggtgt

SEQ ID NO: 2475593 - DNA, 23 bp, Homo sapiens
ctttctgaacagctggtgtagct

SEQ ID NO: 2475594 - DNA, 15 bp, Homo sapiens
ctttctgagggcccg

SEQ ID NO: 2475595 - DNA, 23 bp, Homo sapiens
ctttctgagggcccgtgtaaata

SEQ ID NO: 2475596 - DNA, 16 bp, Homo sapiens
ctttctgatcaaggcc

SEQ ID NO: 2475597 - DNA, 18 bp, Homo sapiens
ctttctgatcaaggcctt

SEQ ID NO: 2475598 - DNA, 13 bp, Homo sapiens
ctttctgtatata

SEQ ID NO: 2475599 - DNA, 19 bp, Homo sapiens
ctttctgtatatacttttt

SEQ ID NO: 2475600 - DNA, 16 bp, Homo sapiens
ctttctttttgtagct

SEQ ID NO: 2475601 - DNA, 22 bp, Homo sapiens
ctttctttttgtagctggggct

SEQ ID NO: 2475602 - DNA, 16 bp, Homo sapiens
ctttcttttttgatat

SEQ ID NO: 2475603 - DNA, 23 bp, Homo sapiens
ctttcttttttggccatctgctc

SEQ ID NO: 2475604 - DNA, 20 bp, Homo sapiens
ctttgaaaggttagagaata

SEQ ID NO: 2475605 - DNA, 20 bp, Homo sapiens
ctttgaaattgaacctttgt

SEQ ID NO: 2475606 - DNA, 16 bp, Homo sapiens
ctttgaaggggcctca

SEQ ID NO: 2475607 - DNA, 16 bp, Homo sapiens
ctttgaataaatgtca

SEQ ID NO: 2475608 - DNA, 18 bp, Homo sapiens
ctttgaatgtgtttcaca

SEQ ID NO: 2475609 - DNA, 12 bp, Homo sapiens
ctttgagagaga

SEQ ID NO: 2475610 - DNA, 12 bp, Homo sapiens
ctttgattcata

SEQ ID NO: 2475611 - DNA, 14 bp, Homo sapiens
ctttgcacgtgctg

SEQ ID NO: 2475612 - DNA, 16 bp, Homo sapiens
ctttgcactgatatat

SEQ ID NO: 2475613 - DNA, 22 bp, Homo sapiens
ctttgcatctcagtatgaatta

SEQ ID NO: 2475614 - DNA, 21 bp, Homo sapiens
ctttgccaggtgactgtctgg

SEQ ID NO: 2475615 - DNA, 19 bp, Homo sapiens
ctttgcccttctttctacc

SEQ ID NO: 2475616 - DNA, 12 bp, Homo sapiens
ctttgcctcaaa

SEQ ID NO: 2475617 - DNA, 21 bp, Homo sapiens
ctttgcgctcctggcccagcc

SEQ ID NO: 2475618 - DNA, 11 bp, Homo sapiens
ctttgctgcca

SEQ ID NO: 2475619 - DNA, 22 bp, Homo sapiens
ctttgctgtgaggctgtcctgt

SEQ ID NO: 2475620 - DNA, 22 bp, Homo sapiens
ctttggaagtttagctctgaga

SEQ ID NO: 2475621 - DNA, 13 bp, Homo sapiens
ctttgggccagac

SEQ ID NO: 2475622 - DNA, 14 bp, Homo sapiens
ctttgtcagggagt

SEQ ID NO: 2475623 - DNA, 23 bp, Homo sapiens
ctttgtctacttcaaaagtttgt

SEQ ID NO: 2475624 - DNA, 22 bp, Homo sapiens
ctttgtgaatagaactctgaaa

SEQ ID NO: 2475625 - DNA, 16 bp, Homo sapiens
ctttgtgcacatttat

SEQ ID NO: 2475626 - DNA, 23 bp, Homo sapiens
ctttgtgcacatttatttcctcc

SEQ ID NO: 2475627 - DNA, 14 bp, Homo sapiens
ctttgtgcattctg

SEQ ID NO: 2475628 - DNA, 17 bp, Homo sapiens
ctttgtgtgctctccat

SEQ ID NO: 2475629 - DNA, 12 bp, Homo sapiens
ctttgttcccca

SEQ ID NO: 2475630 - DNA, 16 bp, Homo sapiens
ctttgttgcccaggct

SEQ ID NO: 2475631 - DNA, 18 bp, Homo sapiens
ctttgtttcgtggggagg

SEQ ID NO: 2475632 - DNA, 15 bp, Homo sapiens
ctttgtttggctggg

SEQ ID NO: 2475633 - DNA, 16 bp, Homo sapiens
ctttgttttattttca

SEQ ID NO: 2475634 - DNA, 23 bp, Homo sapiens
cttttaaagaaaaaaattgaaat

SEQ ID NO: 2475635 - DNA, 12 bp, Homo sapiens
cttttaattcat

SEQ ID NO: 2475636 - DNA, 13 bp, Homo sapiens
cttttaattcatt

SEQ ID NO: 2475637 - DNA, 16 bp, Homo sapiens
cttttaccctggcccc

SEQ ID NO: 2475638 - DNA, 14 bp, Homo sapiens
cttttactctgcct

SEQ ID NO: 2475639 - DNA, 18 bp, Homo sapiens
cttttattgacacagaaa

SEQ ID NO: 2475640 - DNA, 18 bp, Homo sapiens
cttttcatacattttcta

SEQ ID NO: 2475641 - DNA, 21 bp, Homo sapiens
cttttcccatttatctaaata

SEQ ID NO: 2475642 - DNA, 19 bp, Homo sapiens
cttttcccccattaatcag

SEQ ID NO: 2475643 - DNA, 22 bp, Homo sapiens
cttttccctctttggctcccct

SEQ ID NO: 2475644 - DNA, 16 bp, Homo sapiens
cttttcctctctcccg

SEQ ID NO: 2475645 - DNA, 18 bp, Homo sapiens
cttttcctctctcccgga

SEQ ID NO: 2475646 - DNA, 22 bp, Homo sapiens
cttttccttcccttttctgttc

SEQ ID NO: 2475647 - DNA, 16 bp, Homo sapiens
cttttctaacagaaag

SEQ ID NO: 2475648 - DNA, 17 bp, Homo sapiens
cttttctctggtaatat

SEQ ID NO: 2475649 - DNA, 17 bp, Homo sapiens
cttttctcttttgcttt

SEQ ID NO: 2475650 - DNA, 18 bp, Homo sapiens
cttttctggaatgtaatc

SEQ ID NO: 2475651 - DNA, 16 bp, Homo sapiens
cttttctgtaattcag

SEQ ID NO: 2475652 - DNA, 16 bp, Homo sapiens
cttttgatattaaatt

SEQ ID NO: 2475653 - DNA, 14 bp, Homo sapiens
cttttgctttattc

SEQ ID NO: 2475654 - DNA, 24 bp, Homo sapiens
cttttgctttctgtttcttaaggg

SEQ ID NO: 2475655 - DNA, 16 bp, Homo sapiens
cttttgcttttgccca

SEQ ID NO: 2475656 - DNA, 17 bp, Homo sapiens
cttttgggtttctgccc

SEQ ID NO: 2475657 - DNA, 21 bp, Homo sapiens
cttttggtaaagactggcttt

SEQ ID NO: 2475658 - DNA, 11 bp, Homo sapiens
cttttgtatta

SEQ ID NO: 2475659 - DNA, 14 bp, Homo sapiens
cttttgtattaaga

SEQ ID NO: 2475660 - DNA, 20 bp, Homo sapiens
cttttgtgatggagtgctgt

SEQ ID NO: 2475661 - DNA, 21 bp, Homo sapiens
cttttgtgatggagtgctgtt

SEQ ID NO: 2475662 - DNA, 22 bp, Homo sapiens
cttttgtgatggagtgctgttt

SEQ ID NO: 2475663 - DNA, 21 bp, Homo sapiens
cttttgtgggggactgtaagt

SEQ ID NO: 2475664 - DNA, 15 bp, Homo sapiens
ctttttaatatgctt

SEQ ID NO: 2475665 - DNA, 16 bp, Homo sapiens
ctttttacctttcata

SEQ ID NO: 2475666 - DNA, 16 bp, Homo sapiens
gaatttcccaggaccc

SEQ ID NO: 2475667 - DNA, 14 bp, Homo sapiens
gaatttcttaactt

SEQ ID NO: 2475668 - DNA, 19 bp, Homo sapiens
gaatttcttaacttcttgc

SEQ ID NO: 2475669 - DNA, 19 bp, Homo sapiens
gaattttatactttcccta

SEQ ID NO: 2475670 - DNA, 20 bp, Homo sapiens
gaattttatactttccctac

SEQ ID NO: 2475671 - DNA, 22 bp, Homo sapiens
gaattttatactttccctaccc

SEQ ID NO: 2475672 - DNA, 19 bp, Homo sapiens
gaattttttttaacattcc

SEQ ID NO: 2475673 - DNA, 21 bp, Homo sapiens
gaattttttttaacattcctc

SEQ ID NO: 2475674 - DNA, 20 bp, Homo sapiens
gacaaaaccccccagatatc

SEQ ID NO: 2475675 - DNA, 23 bp, Homo sapiens
gacaaaaccccccagatatcatc

SEQ ID NO: 2475676 - DNA, 13 bp, Homo sapiens
gacaaaggagcct

SEQ ID NO: 2475677 - DNA, 14 bp, Homo sapiens
gacaaaggagcctg

SEQ ID NO: 2475678 - DNA, 13 bp, Homo sapiens
gacaaaggcaagc

SEQ ID NO: 2475679 - DNA, 17 bp, Homo sapiens
gacaaatagaaaatggt

SEQ ID NO: 2475680 - DNA, 15 bp, Homo sapiens
gacaaccactggtct

SEQ ID NO: 2475681 - DNA, 17 bp, Homo sapiens
gacaacgtttcagcgac

SEQ ID NO: 2475682 - DNA, 17 bp, Homo sapiens
gacaactgctcccacct

SEQ ID NO: 2475683 - DNA, 13 bp, Homo sapiens
gacaactggcagg

SEQ ID NO: 2475684 - DNA, 18 bp, Homo sapiens
gacaactggcaggcaggc

SEQ ID NO: 2475685 - DNA, 15 bp, Homo sapiens
gacaagacccccagc

SEQ ID NO: 2475686 - DNA, 16 bp, Homo sapiens
gacaagacccccagca

SEQ ID NO: 2475687 - DNA, 20 bp, Homo sapiens
gacaagtgctgaacagtgga

SEQ ID NO: 2475688 - DNA, 13 bp, Homo sapiens
gacaatcatgtgt

SEQ ID NO: 2475689 - DNA, 16 bp, Homo sapiens
gacaatggaccggaga

SEQ ID NO: 2475690 - DNA, 17 bp, Homo sapiens
gacacacacagactatt

SEQ ID NO: 2475691 - DNA, 17 bp, Homo sapiens
gacacaggccctccctg

SEQ ID NO: 2475692 - DNA, 13 bp, Homo sapiens
gacacaggcctgt

SEQ ID NO: 2475693 - DNA, 19 bp, Homo sapiens
gacacatactcatttttca

SEQ ID NO: 2475694 - DNA, 20 bp, Homo sapiens
gacacattttttaggaaatg

SEQ ID NO: 2475695 - DNA, 14 bp, Homo sapiens
gacaccaaagttct

SEQ ID NO: 2475696 - DNA, 14 bp, Homo sapiens
gacacccaggactt

SEQ ID NO: 2475697 - DNA, 15 bp, Homo sapiens
gacacccttctccca

SEQ ID NO: 2475698 - DNA, 12 bp, Homo sapiens
gacacctgggag

SEQ ID NO: 2475699 - DNA, 19 bp, Homo sapiens
gacaccttttttcaacagt

SEQ ID NO: 2475700 - DNA, 18 bp, Homo sapiens
gacacgggcctgtccaca

SEQ ID NO: 2475701 - DNA, 21 bp, Homo sapiens
gacacgggcctgtccacaggc

SEQ ID NO: 2475702 - DNA, 22 bp, Homo sapiens
gacacgggcctgtccacaggct

SEQ ID NO: 2475703 - DNA, 22 bp, Homo sapiens
gacacggtcggggcatctggcc

SEQ ID NO: 2475704 - DNA, 16 bp, Homo sapiens
gacactcatataatta

SEQ ID NO: 2475705 - DNA, 14 bp, Homo sapiens
gacactgctctaac

SEQ ID NO: 2475706 - DNA, 22 bp, Homo sapiens
gacactgttcttagctcaatga

SEQ ID NO: 2475707 - DNA, 13 bp, Homo sapiens
gacacttgtacaa

SEQ ID NO: 2475708 - DNA, 15 bp, Homo sapiens
gacagaagtttgcac

SEQ ID NO: 2475709 - DNA, 20 bp, Homo sapiens
gacagaagtttgcactatct

SEQ ID NO: 2475710 - DNA, 15 bp, Homo sapiens
gacagagaggactgt

SEQ ID NO: 2475711 - DNA, 16 bp, Homo sapiens
gacagagccctgtgag

SEQ ID NO: 2475712 - DNA, 23 bp, Homo sapiens
gacagagcgtgagctgagcaggc

SEQ ID NO: 2475713 - DNA, 13 bp, Homo sapiens
gacagaggcccca

SEQ ID NO: 2475714 - DNA, 18 bp, Homo sapiens
gacagaggccccagcctc

SEQ ID NO: 2475715 - DNA, 13 bp, Homo sapiens
gacagaggccctc

SEQ ID NO: 2475716 - DNA, 20 bp, Homo sapiens
gacagatgaatgccgtggat

SEQ ID NO: 2475717 - DNA, 12 bp, Homo sapiens
gacagcatgaga

SEQ ID NO: 2475718 - DNA, 14 bp, Homo sapiens
gacagccccaccct

SEQ ID NO: 2475719 - DNA, 16 bp, Homo sapiens
gacagcctcccacccc

SEQ ID NO: 2475720 - DNA, 15 bp, Homo sapiens
gacagctgtgcctcg

SEQ ID NO: 2475721 - DNA, 13 bp, Homo sapiens
gacaggctcttag

SEQ ID NO: 2475722 - DNA, 18 bp, Homo sapiens
gacaggctcttagcagct

SEQ ID NO: 2475723 - DNA, 20 bp, Homo sapiens
gacagggaattaggccccca

SEQ ID NO: 2475724 - DNA, 12 bp, Homo sapiens
gacagggtttca

SEQ ID NO: 2475725 - DNA, 15 bp, Homo sapiens
gacagtcaaaaccaa

SEQ ID NO: 2475726 - DNA, 19 bp, Homo sapiens
gacagtgatattggaactt

SEQ ID NO: 2475727 - DNA, 19 bp, Homo sapiens
gacagtttaccagttgcct

SEQ ID NO: 2475728 - DNA, 20 bp, Homo sapiens
gacataaagttgataaagat

SEQ ID NO: 2475729 - DNA, 14 bp, Homo sapiens
gacatacttgaagg

SEQ ID NO: 2475730 - DNA, 19 bp, Homo sapiens
gacatcaaaaaaggcagtt

SEQ ID NO: 2475731 - DNA, 17 bp, Homo sapiens
gacatcttgtcattttt

SEQ ID NO: 2475732 - DNA, 13 bp, Homo sapiens
gacatgaagccac

SEQ ID NO: 2475733 - DNA, 16 bp, Homo sapiens
gacatgaagctgttgt

SEQ ID NO: 2475734 - DNA, 19 bp, Homo sapiens
gacatgatttccttgaatg

SEQ ID NO: 2475735 - DNA, 14 bp, Homo sapiens
gacatggaggttct

SEQ ID NO: 2475736 - DNA, 16 bp, Homo sapiens
gacatgtgacatttat

SEQ ID NO: 2475737 - DNA, 23 bp, Homo sapiens
gacattatgtggttttagatttt

SEQ ID NO: 2475738 - DNA, 22 bp, Homo sapiens
gacattctgaatgcttctaagt

SEQ ID NO: 2475739 - DNA, 21 bp, Homo sapiens
gacattgcgtttgacctttta

SEQ ID NO: 2475740 - DNA, 23 bp, Homo sapiens
gacattggcacctaatccaggca

SEQ ID NO: 2475741 - DNA, 16 bp, Homo sapiens
gaccaaagggagtctg

SEQ ID NO: 2475742 - DNA, 21 bp, Homo sapiens
gaccaaagggagtctgccagg

SEQ ID NO: 2475743 - DNA, 14 bp, Homo sapiens
gaccacaacatgag

SEQ ID NO: 2475744 - DNA, 16 bp, Homo sapiens
gaccacaccctgtact

SEQ ID NO: 2475745 - DNA, 12 bp, Homo sapiens
gaccacagcaca

SEQ ID NO: 2475746 - DNA, 16 bp, Homo sapiens
gaccacagcacagcca

SEQ ID NO: 2475747 - DNA, 13 bp, Homo sapiens
gaccaccagggca

SEQ ID NO: 2475748 - DNA, 19 bp, Homo sapiens
gaccaccagggcatctctg

SEQ ID NO: 2475749 - DNA, 21 bp, Homo sapiens
gaccaccagggcatctctggg

SEQ ID NO: 2475750 - DNA, 22 bp, Homo sapiens
gaccacgcccgtcctgcctgtg

SEQ ID NO: 2475751 - DNA, 17 bp, Homo sapiens
gaccactcctcatagca

SEQ ID NO: 2475752 - DNA, 15 bp, Homo sapiens
gaccagcagacagag

SEQ ID NO: 2475753 - DNA, 22 bp, Homo sapiens
gaccagcagacagagccaggag

SEQ ID NO: 2475754 - DNA, 18 bp, Homo sapiens
gaccagccgtgagcatgt

SEQ ID NO: 2475755 - DNA, 22 bp, Homo sapiens
gaccagccgtgagcatgtttgg

SEQ ID NO: 2475756 - DNA, 12 bp, Homo sapiens
gaccagctcagg

SEQ ID NO: 2475757 - DNA, 13 bp, Homo sapiens
gaccagctccccc

SEQ ID NO: 2475758 - DNA, 19 bp, Homo sapiens
gaccagctccccctccctc

SEQ ID NO: 2475759 - DNA, 21 bp, Homo sapiens
gaccagctgctccgaggaccc

SEQ ID NO: 2475760 - DNA, 17 bp, Homo sapiens
gaccagtcaacctgggc

SEQ ID NO: 2475761 - DNA, 18 bp, Homo sapiens
gaccagtcaacctgggca

SEQ ID NO: 2475762 - DNA, 18 bp, Homo sapiens
gaccatggagtggcagcc

SEQ ID NO: 2475763 - DNA, 21 bp, Homo sapiens
gaccatggagtggcagcccag

SEQ ID NO: 2475764 - DNA, 12 bp, Homo sapiens
gacccacatgct

SEQ ID NO: 2475765 - DNA, 17 bp, Homo sapiens
gacccagccctcatccc

SEQ ID NO: 2475766 - DNA, 16 bp, Homo sapiens
gacccagcggacacac

SEQ ID NO: 2475767 - DNA, 21 bp, Homo sapiens
gacccaggaaaggcaggattg

SEQ ID NO: 2475768 - DNA, 17 bp, Homo sapiens
gacccagtgcccccact

SEQ ID NO: 2475769 - DNA, 23 bp, Homo sapiens
gaccccaaacaccttccagctcc

SEQ ID NO: 2475770 - DNA, 16 bp, Homo sapiens
gagcaggcagccagca

SEQ ID NO: 2475771 - DNA, 20 bp, Homo sapiens
gagcagggattaacctctgc

SEQ ID NO: 2475772 - DNA, 21 bp, Homo sapiens
gagcagggattaacctctgca

SEQ ID NO: 2475773 - DNA, 13 bp, Homo sapiens
gagcagtccttgg

SEQ ID NO: 2475774 - DNA, 14 bp, Homo sapiens
gagcagtccttggc

SEQ ID NO: 2475775 - DNA, 16 bp, Homo sapiens
gagcagtccttggcct

SEQ ID NO: 2475776 - DNA, 17 bp, Homo sapiens
gagcagtccttggcctg

SEQ ID NO: 2475777 - DNA, 21 bp, Homo sapiens
gagcagtgcttttggcgggga

SEQ ID NO: 2475778 - DNA, 23 bp, Homo sapiens
gagcagtgcttttggcggggagg

SEQ ID NO: 2475779 - DNA, 21 bp, Homo sapiens
gagcataggtgatccatgtaa

SEQ ID NO: 2475780 - DNA, 16 bp, Homo sapiens
gagcatcatgcctctg

SEQ ID NO: 2475781 - DNA, 18 bp, Homo sapiens
gagcatcatgcctctgag

SEQ ID NO: 2475782 - DNA, 20 bp, Homo sapiens
gagcatcatgcctctgaggc

SEQ ID NO: 2475783 - DNA, 18 bp, Homo sapiens
gagcatggaacacttcga

SEQ ID NO: 2475784 - DNA, 19 bp, Homo sapiens
gagcatggaacacttcgag

SEQ ID NO: 2475785 - DNA, 16 bp, Homo sapiens
gagccaagggatggac

SEQ ID NO: 2475786 - DNA, 22 bp, Homo sapiens
gagccaagggatggacatcttg

SEQ ID NO: 2475787 - DNA, 12 bp, Homo sapiens
gagccaccagtt

SEQ ID NO: 2475788 - DNA, 21 bp, Homo sapiens
gagccagctaaggggtggggc

SEQ ID NO: 2475789 - DNA, 13 bp, Homo sapiens
gagccaggagaag

SEQ ID NO: 2475790 - DNA, 22 bp, Homo sapiens
gagccatgtcttctccctggaa

SEQ ID NO: 2475791 - DNA, 12 bp, Homo sapiens
gagccatgtttc

SEQ ID NO: 2475792 - DNA, 14 bp, Homo sapiens
gagcccaagggaat

SEQ ID NO: 2475793 - DNA, 14 bp, Homo sapiens
gagcccactccatc

SEQ ID NO: 2475794 - DNA, 19 bp, Homo sapiens
gagcccactgtcctgggcc

SEQ ID NO: 2475795 - DNA, 13 bp, Homo sapiens
gagcccagctcca

SEQ ID NO: 2475796 - DNA, 21 bp, Homo sapiens
gagcccaggagctcccctccc

SEQ ID NO: 2475797 - DNA, 17 bp, Homo sapiens
gagcccaggccaggact

SEQ ID NO: 2475798 - DNA, 23 bp, Homo sapiens
gagcccaggccaggactctgcag

SEQ ID NO: 2475799 - DNA, 21 bp, Homo sapiens
gagcccaggctcggcctgccc

SEQ ID NO: 2475800 - DNA, 17 bp, Homo sapiens
gagcccagggaggccga

SEQ ID NO: 2475801 - DNA, 14 bp, Homo sapiens
gagccccagggaga

SEQ ID NO: 2475802 - DNA, 16 bp, Homo sapiens
gagccccattcctggg

SEQ ID NO: 2475803 - DNA, 15 bp, Homo sapiens
gagcccccaccctgt

SEQ ID NO: 2475804 - DNA, 23 bp, Homo sapiens
gagcccccaccctgttcctgctg

SEQ ID NO: 2475805 - DNA, 17 bp, Homo sapiens
gagccccttctgctcag

SEQ ID NO: 2475806 - DNA, 21 bp, Homo sapiens
gagccccttctgctcagctct

SEQ ID NO: 2475807 - DNA, 22 bp, Homo sapiens
gagccccttctgctcagctctg

SEQ ID NO: 2475808 - DNA, 22 bp, Homo sapiens
gagcccgaggaggtgtctcagg

SEQ ID NO: 2475809 - DNA, 24 bp, Homo sapiens
gagcccgatggggaacagtgttgg

SEQ ID NO: 2475810 - DNA, 22 bp, Homo sapiens
gagccgattgtcctatctccag

SEQ ID NO: 2475811 - DNA, 17 bp, Homo sapiens
gagccgggtctgcctct

SEQ ID NO: 2475812 - DNA, 22 bp, Homo sapiens
gagccgggtctgcctcttctgg

SEQ ID NO: 2475813 - DNA, 20 bp, Homo sapiens
gagcctcgcaacccgtgcca

SEQ ID NO: 2475814 - DNA, 20 bp, Homo sapiens
gagcctcggccctagcattg

SEQ ID NO: 2475815 - DNA, 12 bp, Homo sapiens
gagcctgaggga

SEQ ID NO: 2475816 - DNA, 13 bp, Homo sapiens
gagcctgcaggat

SEQ ID NO: 2475817 - DNA, 15 bp, Homo sapiens
gagcctgccgagcaa

SEQ ID NO: 2475818 - DNA, 21 bp, Homo sapiens
gagcctgccgagcaaccgtgg

SEQ ID NO: 2475819 - DNA, 23 bp, Homo sapiens
gagcctggggctctaacgcctga

SEQ ID NO: 2475820 - DNA, 12 bp, Homo sapiens
gagcctgtcctg

SEQ ID NO: 2475821 - DNA, 18 bp, Homo sapiens
gagcctgtgaacccagga

SEQ ID NO: 2475822 - DNA, 12 bp, Homo sapiens
gagcgccctgca

SEQ ID NO: 2475823 - DNA, 13 bp, Homo sapiens
gagcgccctgcag

SEQ ID NO: 2475824 - DNA, 23 bp, Homo sapiens
gagcgcctccatccaaggccagg

SEQ ID NO: 2475825 - DNA, 14 bp, Homo sapiens
gagctaaggctcta

SEQ ID NO: 2475826 - DNA, 15 bp, Homo sapiens
gagctacataattta

SEQ ID NO: 2475827 - DNA, 20 bp, Homo sapiens
gagctacctgtgtggacagg

SEQ ID NO: 2475828 - DNA, 17 bp, Homo sapiens
gagctaggagcaaagcc

SEQ ID NO: 2475829 - DNA, 13 bp, Homo sapiens
gagctattgctgt

SEQ ID NO: 2475830 - DNA, 17 bp, Homo sapiens
gagctcacaaggcagca

SEQ ID NO: 2475831 - DNA, 20 bp, Homo sapiens
gagctcacaaggcagcaagg

SEQ ID NO: 2475832 - DNA, 20 bp, Homo sapiens
gagctcagaaaatatccctc

SEQ ID NO: 2475833 - DNA, 23 bp, Homo sapiens
gagctcagaaaatatccctcctg

SEQ ID NO: 2475834 - DNA, 18 bp, Homo sapiens
gagctccactctgcttct

SEQ ID NO: 2475835 - DNA, 20 bp, Homo sapiens
gagctccagctcctttgggc

SEQ ID NO: 2475836 - DNA, 20 bp, Homo sapiens
gagctcccacaagcctgagg

SEQ ID NO: 2475837 - DNA, 17 bp, Homo sapiens
gagctcccctccccaac

SEQ ID NO: 2475838 - DNA, 23 bp, Homo sapiens
gagctcctccctctcaacaccca

SEQ ID NO: 2475839 - DNA, 13 bp, Homo sapiens
gagctcctcttcc

SEQ ID NO: 2475840 - DNA, 17 bp, Homo sapiens
gagctcctgtcccctgc

SEQ ID NO: 2475841 - DNA, 15 bp, Homo sapiens
gagctctctgccctt

SEQ ID NO: 2475842 - DNA, 19 bp, Homo sapiens
gagctctgagaggccctgg

SEQ ID NO: 2475843 - DNA, 20 bp, Homo sapiens
gagctctgagaggccctgga

SEQ ID NO: 2475844 - DNA, 20 bp, Homo sapiens
gagctgaaggttgtggcctt

SEQ ID NO: 2475845 - DNA, 22 bp, Homo sapiens
gagctgaaggttgtggcctttg

SEQ ID NO: 2475846 - DNA, 12 bp, Homo sapiens
gagctgcctgga

SEQ ID NO: 2475847 - DNA, 17 bp, Homo sapiens
gagctggctctgagcgc

SEQ ID NO: 2475848 - DNA, 13 bp, Homo sapiens
gagctgggcctgg

SEQ ID NO: 2475849 - DNA, 17 bp, Homo sapiens
gagctgggcctggtctc

SEQ ID NO: 2475850 - DNA, 21 bp, Homo sapiens
gagctgggcctggtctcaccc

SEQ ID NO: 2475851 - DNA, 17 bp, Homo sapiens
gagctgtttactaggga

SEQ ID NO: 2475852 - DNA, 16 bp, Homo sapiens
gagcttcatggcagaa

SEQ ID NO: 2475853 - DNA, 19 bp, Homo sapiens
gagcttcatggcagaaggc

SEQ ID NO: 2475854 - DNA, 17 bp, Homo sapiens
gagcttccctgactcat

SEQ ID NO: 2475855 - DNA, 22 bp, Homo sapiens
gagcttgaaacccgtggcgctt

SEQ ID NO: 2475856 - DNA, 19 bp, Homo sapiens
gagctttctgaacagctgg

SEQ ID NO: 2475857 - DNA, 15 bp, Homo sapiens
gaggaaatcccttca

SEQ ID NO: 2475858 - DNA, 17 bp, Homo sapiens
gaggaaatcccttcata

SEQ ID NO: 2475859 - DNA, 21 bp, Homo sapiens
gaggaataagctcccagggcc

SEQ ID NO: 2475860 - DNA, 21 bp, Homo sapiens
gaggaatctgtgggtctggga

SEQ ID NO: 2475861 - DNA, 16 bp, Homo sapiens
gaggacagatgcctcc

SEQ ID NO: 2475862 - DNA, 20 bp, Homo sapiens
gaggacagatgcctccttcc

SEQ ID NO: 2475863 - DNA, 18 bp, Homo sapiens
gaggacctgagcctgccg

SEQ ID NO: 2475864 - DNA, 18 bp, Homo sapiens
gaggagattctgcctttg

SEQ ID NO: 2475865 - DNA, 15 bp, Homo sapiens
gaggagcagcaggag

SEQ ID NO: 2475866 - DNA, 16 bp, Homo sapiens
gaggagcagcaggagg

SEQ ID NO: 2475867 - DNA, 18 bp, Homo sapiens
gaggagcccaggccagga

SEQ ID NO: 2475868 - DNA, 21 bp, Homo sapiens
gaggagcccaggccaggactc

SEQ ID NO: 2475869 - DNA, 15 bp, Homo sapiens
gaggagccccagcta

SEQ ID NO: 2475870 - DNA, 21 bp, Homo sapiens
gaggagcccccaccctgttcc

SEQ ID NO: 2475871 - DNA, 19 bp, Homo sapiens
gaggaggaaatcccttcat

SEQ ID NO: 2475872 - DNA, 18 bp, Homo sapiens
gaggaggctccagagggc

SEQ ID NO: 2475873 - DNA, 18 bp, Homo sapiens
gattctttccatttgcat

SEQ ID NO: 2475874 - DNA, 19 bp, Homo sapiens
gattctttccatttgcatt

SEQ ID NO: 2475875 - DNA, 20 bp, Homo sapiens
gattctttcccaattcacat

SEQ ID NO: 2475876 - DNA, 20 bp, Homo sapiens
gattgaaaatgtccaggaaa

SEQ ID NO: 2475877 - DNA, 19 bp, Homo sapiens
gattgatagagtgttatca

SEQ ID NO: 2475878 - DNA, 13 bp, Homo sapiens
gattgcgagagat

SEQ ID NO: 2475879 - DNA, 18 bp, Homo sapiens
gattgcgagagatgtgtg

SEQ ID NO: 2475880 - DNA, 11 bp, Homo sapiens
gattgtaactc

SEQ ID NO: 2475881 - DNA, 16 bp, Homo sapiens
gattgtccttttgcaa

SEQ ID NO: 2475882 - DNA, 17 bp, Homo sapiens
gattgtccttttgcaaa

SEQ ID NO: 2475883 - DNA, 15 bp, Homo sapiens
gattgtcttaatatt

SEQ ID NO: 2475884 - DNA, 16 bp, Homo sapiens
gatttaatttgaaata

SEQ ID NO: 2475885 - DNA, 16 bp, Homo sapiens
gatttagtttcagtag

SEQ ID NO: 2475886 - DNA, 13 bp, Homo sapiens
gatttattaaaga

SEQ ID NO: 2475887 - DNA, 14 bp, Homo sapiens
gatttattaaagaa

SEQ ID NO: 2475888 - DNA, 19 bp, Homo sapiens
gatttattaaagaaaaaaa

SEQ ID NO: 2475889 - DNA, 17 bp, Homo sapiens
gatttcatagttcagaa

SEQ ID NO: 2475890 - DNA, 13 bp, Homo sapiens
gatttcatgattt

SEQ ID NO: 2475891 - DNA, 21 bp, Homo sapiens
gatttcatttcaactgtttgc

SEQ ID NO: 2475892 - DNA, 22 bp, Homo sapiens
gatttcctgctttgggaagccg

SEQ ID NO: 2475893 - DNA, 17 bp, Homo sapiens
gatttccttgaatgtgg

SEQ ID NO: 2475894 - DNA, 15 bp, Homo sapiens
gatttgcattgaaca

SEQ ID NO: 2475895 - DNA, 20 bp, Homo sapiens
gatttggcttgacaaaggca

SEQ ID NO: 2475896 - DNA, 16 bp, Homo sapiens
gatttgtttttaaact

SEQ ID NO: 2475897 - DNA, 21 bp, Homo sapiens
gatttgtttttaaactgtaca

SEQ ID NO: 2475898 - DNA, 22 bp, Homo sapiens
gatttgtttttaaactgtacag

SEQ ID NO: 2475899 - DNA, 16 bp, Homo sapiens
gattttacatgaagta

SEQ ID NO: 2475900 - DNA, 20 bp, Homo sapiens
gattttacatgaagtatttt

SEQ ID NO: 2475901 - DNA, 15 bp, Homo sapiens
gattttcttttgcct

SEQ ID NO: 2475902 - DNA, 22 bp, Homo sapiens
gattttgggagtgactcaagaa

SEQ ID NO: 2475903 - DNA, 20 bp, Homo sapiens
gatttttctttacaaaacaa

SEQ ID NO: 2475904 - DNA, 17 bp, Homo sapiens
gattttttaataattta

SEQ ID NO: 2475905 - DNA, 21 bp, Homo sapiens
gattttttccttcaaagttta

SEQ ID NO: 2475906 - DNA, 15 bp, Homo sapiens
gcaaaagaagaagtt

SEQ ID NO: 2475907 - DNA, 23 bp, Homo sapiens
gcaaaattatagaagtttagatt

SEQ ID NO: 2475908 - DNA, 10 bp, Homo sapiens
gcaaactctt

SEQ ID NO: 2475909 - DNA, 15 bp, Homo sapiens
gcaaactgcatgccc

SEQ ID NO: 2475910 - DNA, 20 bp, Homo sapiens
gcaaagatctgtcctcagcc

SEQ ID NO: 2475911 - DNA, 21 bp, Homo sapiens
gcaaagatctgtcctcagcct

SEQ ID NO: 2475912 - DNA, 22 bp, Homo sapiens
gcaaagatctgtcctcagcctt

SEQ ID NO: 2475913 - DNA, 14 bp, Homo sapiens
gcaaagcacagaga

SEQ ID NO: 2475914 - DNA, 23 bp, Homo sapiens
gcaaagcccccagagcccaggct

SEQ ID NO: 2475915 - DNA, 20 bp, Homo sapiens
gcaaagcctgttcatggcag

SEQ ID NO: 2475916 - DNA, 12 bp, Homo sapiens
gcaaataaaagt

SEQ ID NO: 2475917 - DNA, 19 bp, Homo sapiens
gcaaataacaaatgccaaa

SEQ ID NO: 2475918 - DNA, 14 bp, Homo sapiens
gcaaatggcctcat

SEQ ID NO: 2475919 - DNA, 19 bp, Homo sapiens
gcaacactggtctgctgtt

SEQ ID NO: 2475920 - DNA, 15 bp, Homo sapiens
gcaacagatcagtaa

SEQ ID NO: 2475921 - DNA, 13 bp, Homo sapiens
gcaacagatctgg

SEQ ID NO: 2475922 - DNA, 17 bp, Homo sapiens
gcaacagatctggaacc

SEQ ID NO: 2475923 - DNA, 18 bp, Homo sapiens
gcaacagatctggaacct

SEQ ID NO: 2475924 - DNA, 16 bp, Homo sapiens
gcaacatgatgaggta

SEQ ID NO: 2475925 - DNA, 11 bp, Homo sapiens
gcaaccaggaa

SEQ ID NO: 2475926 - DNA, 17 bp, Homo sapiens
gcaaccaggaacagcaa

SEQ ID NO: 2475927 - DNA, 20 bp, Homo sapiens
gcaaccaggaacagcaaatg

SEQ ID NO: 2475928 - DNA, 14 bp, Homo sapiens
gcaaccatttgaaa

SEQ ID NO: 2475929 - DNA, 19 bp, Homo sapiens
gcaaccccaggctgaagca

SEQ ID NO: 2475930 - DNA, 18 bp, Homo sapiens
gcaacccgtgccaagtcc

SEQ ID NO: 2475931 - DNA, 19 bp, Homo sapiens
gcaaccgtggcccttcctg

SEQ ID NO: 2475932 - DNA, 21 bp, Homo sapiens
gcaaccgtggcccttcctgga

SEQ ID NO: 2475933 - DNA, 23 bp, Homo sapiens
gcaaccgtggcccttcctggaca

SEQ ID NO: 2475934 - DNA, 16 bp, Homo sapiens
gcaacctccacctcct

SEQ ID NO: 2475935 - DNA, 17 bp, Homo sapiens
gcaacctccacctcctg

SEQ ID NO: 2475936 - DNA, 23 bp, Homo sapiens
gcaacctcttggcctgatcagac

SEQ ID NO: 2475937 - DNA, 19 bp, Homo sapiens
gcaacttgtcctagcacag

SEQ ID NO: 2475938 - DNA, 20 bp, Homo sapiens
gcaacttgtcctagcacaga

SEQ ID NO: 2475939 - DNA, 23 bp, Homo sapiens
gcaagaaggcaaaaatagtttgg

SEQ ID NO: 2475940 - DNA, 21 bp, Homo sapiens
gcaagacttctctttgcctca

SEQ ID NO: 2475941 - DNA, 22 bp, Homo sapiens
gcaagacttctctttgcctcaa

SEQ ID NO: 2475942 - DNA, 22 bp, Homo sapiens
gcaagaggccgtggctgctgtg

SEQ ID NO: 2475943 - DNA, 15 bp, Homo sapiens
gcaagcaagaggccg

SEQ ID NO: 2475944 - DNA, 17 bp, Homo sapiens
gcaagctgattaaatga

SEQ ID NO: 2475945 - DNA, 17 bp, Homo sapiens
gcaagctggcggctggg

SEQ ID NO: 2475946 - DNA, 14 bp, Homo sapiens
gcaaggactttgta

SEQ ID NO: 2475947 - DNA, 16 bp, Homo sapiens
gcaaggcccgagcagc

SEQ ID NO: 2475948 - DNA, 23 bp, Homo sapiens
gcaaggcccgagcagctgagcag

SEQ ID NO: 2475949 - DNA, 24 bp, Homo sapiens
gcaaggcccgagcagctgagcagg

SEQ ID NO: 2475950 - DNA, 17 bp, Homo sapiens
gcaaggtactctggtga

SEQ ID NO: 2475951 - DNA, 18 bp, Homo sapiens
gcaaggtccggcccatcc

SEQ ID NO: 2475952 - DNA, 21 bp, Homo sapiens
gcaataaatctgacccagtgc

SEQ ID NO: 2475953 - DNA, 21 bp, Homo sapiens
gcaataacgtttaagccaaaa

SEQ ID NO: 2475954 - DNA, 20 bp, Homo sapiens
gcaatacttggagggcccag

SEQ ID NO: 2475955 - DNA, 20 bp, Homo sapiens
gcaatatactggaaagcttt

SEQ ID NO: 2475956 - DNA, 14 bp, Homo sapiens
gcaatgaacactta

SEQ ID NO: 2475957 - DNA, 17 bp, Homo sapiens
gcaatgatgaatgagaa

SEQ ID NO: 2475958 - DNA, 19 bp, Homo sapiens
gcaatgccacagccctgtc

SEQ ID NO: 2475959 - DNA, 18 bp, Homo sapiens
gcaatgccatcatctcct

SEQ ID NO: 2475960 - DNA, 13 bp, Homo sapiens
gcaatgtaaatat

SEQ ID NO: 2475961 - DNA, 20 bp, Homo sapiens
gcaatgtgtataaacaagaa

SEQ ID NO: 2475962 - DNA, 16 bp, Homo sapiens
gcaatgtgtgtatatg

SEQ ID NO: 2475963 - DNA, 20 bp, Homo sapiens
gcaatgtgtgtatatggaca

SEQ ID NO: 2475964 - DNA, 20 bp, Homo sapiens
gcaatgttaatttagtggaa

SEQ ID NO: 2475965 - DNA, 22 bp, Homo sapiens
gcaattcaaaagttccaagagt

SEQ ID NO: 2475966 - DNA, 21 bp, Homo sapiens
gcaattcccctctgctgctgt

SEQ ID NO: 2475967 - DNA, 13 bp, Homo sapiens
gcaatttcaaggt

SEQ ID NO: 2475968 - DNA, 18 bp, Homo sapiens
gcaatttcaaggttctaa

SEQ ID NO: 2475969 - DNA, 17 bp, Homo sapiens
gcaatttctaattttta

SEQ ID NO: 2475970 - DNA, 22 bp, Homo sapiens
gcaatttctaatttttaagaat

SEQ ID NO: 2475971 - DNA, 12 bp, Homo sapiens
gcaattttgtgg

SEQ ID NO: 2475972 - DNA, 23 bp, Homo sapiens
gcacaaaacccagacctgttagc

SEQ ID NO: 2475973 - DNA, 18 bp, Homo sapiens
gcacaaagaccctggctt

SEQ ID NO: 2475974 - DNA, 16 bp, Homo sapiens
gcacaagaatggatca

SEQ ID NO: 2475975 - DNA, 19 bp, Homo sapiens
gcacaagactgacgccagg

SEQ ID NO: 2475976 - DNA, 19 bp, Homo sapiens
gcatttgtttatgtaattt

SEQ ID NO: 2475977 - DNA, 22 bp, Homo sapiens
gcattttggagagtttcctgaa

SEQ ID NO: 2475978 - DNA, 22 bp, Homo sapiens
gccaaaaagtgaaataatgtgt

SEQ ID NO: 2475979 - DNA, 21 bp, Homo sapiens
gccaaattaaaaaagataaac

SEQ ID NO: 2475980 - DNA, 22 bp, Homo sapiens
gccaaattaaaaaagataaaca

SEQ ID NO: 2475981 - DNA, 15 bp, Homo sapiens
gccaacctaaaactc

SEQ ID NO: 2475982 - DNA, 15 bp, Homo sapiens
gccaactagcccctg

SEQ ID NO: 2475983 - DNA, 15 bp, Homo sapiens
gccaagaaacgtctt

SEQ ID NO: 2475984 - DNA, 14 bp, Homo sapiens
gccaagctgaggtg

SEQ ID NO: 2475985 - DNA, 18 bp, Homo sapiens
gccaagctgaggtgccca

SEQ ID NO: 2475986 - DNA, 14 bp, Homo sapiens
gccaaggcagaggc

SEQ ID NO: 2475987 - DNA, 22 bp, Homo sapiens
gccaagggcaacagatcagtaa

SEQ ID NO: 2475988 - DNA, 16 bp, Homo sapiens
gccaagggctttgttt

SEQ ID NO: 2475989 - DNA, 16 bp, Homo sapiens
gccaaggtgtcctaca

SEQ ID NO: 2475990 - DNA, 19 bp, Homo sapiens
gccaaggtgtcctacagaa

SEQ ID NO: 2475991 - DNA, 15 bp, Homo sapiens
gccaagtccaggtcc

SEQ ID NO: 2475992 - DNA, 19 bp, Homo sapiens
gccaagtccaggtcctggt

SEQ ID NO: 2475993 - DNA, 16 bp, Homo sapiens
gccaatagtgtcatcc

SEQ ID NO: 2475994 - DNA, 19 bp, Homo sapiens
gccaatgcacctaaagaaa

SEQ ID NO: 2475995 - DNA, 21 bp, Homo sapiens
gccaatgcacctaaagaaaaa

SEQ ID NO: 2475996 - DNA, 13 bp, Homo sapiens
gccaattcctata

SEQ ID NO: 2475997 - DNA, 15 bp, Homo sapiens
gccacaaaaacaggt

SEQ ID NO: 2475998 - DNA, 14 bp, Homo sapiens
gccacaaggacttc

SEQ ID NO: 2475999 - DNA, 18 bp, Homo sapiens
gccacaaggacttcctgt

SEQ ID NO: 2476000 - DNA, 19 bp, Homo sapiens
gccacaaggacttcctgtc

SEQ ID NO: 2476001 - DNA, 16 bp, Homo sapiens
gccacaccaggataga

SEQ ID NO: 2476002 - DNA, 16 bp, Homo sapiens
gccacactcagcacaa

SEQ ID NO: 2476003 - DNA, 16 bp, Homo sapiens
gccacacttctcagga

SEQ ID NO: 2476004 - DNA, 19 bp, Homo sapiens
gccacacttctcaggacac

SEQ ID NO: 2476005 - DNA, 12 bp, Homo sapiens
gccacagccagg

SEQ ID NO: 2476006 - DNA, 18 bp, Homo sapiens
gccacagcttttgcaact

SEQ ID NO: 2476007 - DNA, 15 bp, Homo sapiens
gccacatcaaagagg

SEQ ID NO: 2476008 - DNA, 19 bp, Homo sapiens
gccacatttggaatacttt

SEQ ID NO: 2476009 - DNA, 19 bp, Homo sapiens
gccaccaagagggacgcct

SEQ ID NO: 2476010 - DNA, 16 bp, Homo sapiens
gccaccacgtccagct

SEQ ID NO: 2476011 - DNA, 13 bp, Homo sapiens
gccaccatgcccg

SEQ ID NO: 2476012 - DNA, 16 bp, Homo sapiens
gccaccatggccagcc

SEQ ID NO: 2476013 - DNA, 12 bp, Homo sapiens
gccacccaggat

SEQ ID NO: 2476014 - DNA, 22 bp, Homo sapiens
gccaccctgaggagtctgaggt

SEQ ID NO: 2476015 - DNA, 14 bp, Homo sapiens
gccaccgtttcttc

SEQ ID NO: 2476016 - DNA, 14 bp, Homo sapiens
gccacctggacccc

SEQ ID NO: 2476017 - DNA, 15 bp, Homo sapiens
gccacctggacccct

SEQ ID NO: 2476018 - DNA, 19 bp, Homo sapiens
gccacctggacccctgcat

SEQ ID NO: 2476019 - DNA, 23 bp, Homo sapiens
gccacgggtgccagaagctactg

SEQ ID NO: 2476020 - DNA, 22 bp, Homo sapiens
gccacgttggagaagcccgtgt

SEQ ID NO: 2476021 - DNA, 18 bp, Homo sapiens
gccactcactaggccccc

SEQ ID NO: 2476022 - DNA, 21 bp, Homo sapiens
gccactccgagaggtgggcca

SEQ ID NO: 2476023 - DNA, 21 bp, Homo sapiens
gccactcctctgactcagggc

SEQ ID NO: 2476024 - DNA, 15 bp, Homo sapiens
gccactccttcctgc

SEQ ID NO: 2476025 - DNA, 17 bp, Homo sapiens
gccactccttcctgccc

SEQ ID NO: 2476026 - DNA, 20 bp, Homo sapiens
gccactgaggggggatccag

SEQ ID NO: 2476027 - DNA, 18 bp, Homo sapiens
gccactgccttcgcttct

SEQ ID NO: 2476028 - DNA, 12 bp, Homo sapiens
gccactggggct

SEQ ID NO: 2476029 - DNA, 17 bp, Homo sapiens
gccactggggctcagag

SEQ ID NO: 2476030 - DNA, 14 bp, Homo sapiens
gccactgtgtgaat

SEQ ID NO: 2476031 - DNA, 16 bp, Homo sapiens
gccactgtgttccttc

SEQ ID NO: 2476032 - DNA, 18 bp, Homo sapiens
gccactgtgttccttccg

SEQ ID NO: 2476033 - DNA, 20 bp, Homo sapiens
gccactgtgttccttccgct

SEQ ID NO: 2476034 - DNA, 14 bp, Homo sapiens
gccagaagctactg

SEQ ID NO: 2476035 - DNA, 17 bp, Homo sapiens
gccagaagtaccagact

SEQ ID NO: 2476036 - DNA, 18 bp, Homo sapiens
gccagaagtaccagacta

SEQ ID NO: 2476037 - DNA, 17 bp, Homo sapiens
gccagagaacccagccc

SEQ ID NO: 2476038 - DNA, 14 bp, Homo sapiens
gccagagccagggg

SEQ ID NO: 2476039 - DNA, 20 bp, Homo sapiens
gccagagcccactccatctg

SEQ ID NO: 2476040 - DNA, 19 bp, Homo sapiens
gccagagcctggggctcta

SEQ ID NO: 2476041 - DNA, 19 bp, Homo sapiens
gccagaggcccccagccca

SEQ ID NO: 2476042 - DNA, 23 bp, Homo sapiens
gccagaggcccccagcccagggc

SEQ ID NO: 2476043 - DNA, 24 bp, Homo sapiens
gccagaggcccccagcccagggct

SEQ ID NO: 2476044 - DNA, 12 bp, Homo sapiens
gccagcacacag

SEQ ID NO: 2476045 - DNA, 13 bp, Homo sapiens
gccagcacacagg

SEQ ID NO: 2476046 - DNA, 16 bp, Homo sapiens
gccagcacacagggca

SEQ ID NO: 2476047 - DNA, 17 bp, Homo sapiens
gccagcacacagggcag

SEQ ID NO: 2476048 - DNA, 22 bp, Homo sapiens
gccagcacacagggcagtgagg

SEQ ID NO: 2476049 - DNA, 15 bp, Homo sapiens
gccagcaccggacca

SEQ ID NO: 2476050 - DNA, 19 bp, Homo sapiens
gccagcaccggaccagcct

SEQ ID NO: 2476051 - DNA, 14 bp, Homo sapiens
gccagcacctggca

SEQ ID NO: 2476052 - DNA, 20 bp, Homo sapiens
gccagcacttgtccagctga

SEQ ID NO: 2476053 - DNA, 14 bp, Homo sapiens
gccagcagcacctg

SEQ ID NO: 2476054 - DNA, 20 bp, Homo sapiens
gccagcaggggctgcccgag

SEQ ID NO: 2476055 - DNA, 15 bp, Homo sapiens
gccagccaagctctg

SEQ ID NO: 2476056 - DNA, 10 bp, Homo sapiens
gccagcccct

SEQ ID NO: 2476057 - DNA, 15 bp, Homo sapiens
gccagccctgcctgg

SEQ ID NO: 2476058 - DNA, 17 bp, Homo sapiens
gccagccctgcctggag

SEQ ID NO: 2476059 - DNA, 20 bp, Homo sapiens
gccagccctgcctggaggac

SEQ ID NO: 2476060 - DNA, 21 bp, Homo sapiens
gccagccgagcaggaggccta

SEQ ID NO: 2476061 - DNA, 12 bp, Homo sapiens
gccagcctggcc

SEQ ID NO: 2476062 - DNA, 14 bp, Homo sapiens
gccagcctggcctc

SEQ ID NO: 2476063 - DNA, 20 bp, Homo sapiens
gccagcctggcctcctgcct

SEQ ID NO: 2476064 - DNA, 13 bp, Homo sapiens
gccagcgtcctcc

SEQ ID NO: 2476065 - DNA, 19 bp, Homo sapiens
gccagcgtcggtctgtgcc

SEQ ID NO: 2476066 - DNA, 15 bp, Homo sapiens
gccagctaaggggtg

SEQ ID NO: 2476067 - DNA, 23 bp, Homo sapiens
gccagctacttcctcctccccac

SEQ ID NO: 2476068 - DNA, 23 bp, Homo sapiens
gccagctctgtatcaggacccag

SEQ ID NO: 2476069 - DNA, 12 bp, Homo sapiens
gccagctctgtt

SEQ ID NO: 2476070 - DNA, 13 bp, Homo sapiens
gccagctctgttc

SEQ ID NO: 2476071 - DNA, 21 bp, Homo sapiens
gccagctctgttcttcctcag

SEQ ID NO: 2476072 - DNA, 22 bp, Homo sapiens
gccagctctgttcttcctcagc

SEQ ID NO: 2476073 - DNA, 17 bp, Homo sapiens
gccagctggaggcaggg

SEQ ID NO: 2476074 - DNA, 17 bp, Homo sapiens
gccagcttgtttacatg

SEQ ID NO: 2476075 - DNA, 14 bp, Homo sapiens
gccagcttttcaaa

SEQ ID NO: 2476076 - DNA, 13 bp, Homo sapiens
gccaggactctgc

SEQ ID NO: 2476077 - DNA, 14 bp, Homo sapiens
gccaggactctgca

SEQ ID NO: 2476078 - DNA, 13 bp, Homo sapiens
gccaggagaagct

SEQ ID NO: 2476079 - DNA, 19 bp, Homo sapiens
gccaggaggacccagggct

SEQ ID NO: 2476080 - DNA, 22 bp, Homo sapiens
gcctctccccaggtccagctct

SEQ ID NO: 2476081 - DNA, 14 bp, Homo sapiens
gcctctccctcctc

SEQ ID NO: 2476082 - DNA, 22 bp, Homo sapiens
gcctctccctcctccaggaagc

SEQ ID NO: 2476083 - DNA, 23 bp, Homo sapiens
gcctctccctcctccaggaagcc

SEQ ID NO: 2476084 - DNA, 23 bp, Homo sapiens
gcctctctatcctctcttcctct

SEQ ID NO: 2476085 - DNA, 21 bp, Homo sapiens
gcctctgaggccagcctggcc

SEQ ID NO: 2476086 - DNA, 23 bp, Homo sapiens
gcctctgaggccagcctggcctc

SEQ ID NO: 2476087 - DNA, 23 bp, Homo sapiens
gcctctgtctggcaatgccacag

SEQ ID NO: 2476088 - DNA, 18 bp, Homo sapiens
gcctctgtgctgtgtgtg

SEQ ID NO: 2476089 - DNA, 20 bp, Homo sapiens
gcctcttgaccaggctgcct

SEQ ID NO: 2476090 - DNA, 19 bp, Homo sapiens
gcctcttgagcagtggctg

SEQ ID NO: 2476091 - DNA, 16 bp, Homo sapiens
gcctgaaagaggctga

SEQ ID NO: 2476092 - DNA, 19 bp, Homo sapiens
gcctgaaccccagggctgt

SEQ ID NO: 2476093 - DNA, 20 bp, Homo sapiens
gcctgacaaccactggtctg

SEQ ID NO: 2476094 - DNA, 22 bp, Homo sapiens
gcctgacatttggagtgttccc

SEQ ID NO: 2476095 - DNA, 18 bp, Homo sapiens
gcctgagcaactcttgat

SEQ ID NO: 2476096 - DNA, 18 bp, Homo sapiens
gcctgagcagtccttggc

SEQ ID NO: 2476097 - DNA, 17 bp, Homo sapiens
gcctgagcccagggagg

SEQ ID NO: 2476098 - DNA, 20 bp, Homo sapiens
gcctgagcccagggaggccg

SEQ ID NO: 2476099 - DNA, 10 bp, Homo sapiens
gcctgaggga

SEQ ID NO: 2476100 - DNA, 15 bp, Homo sapiens
gcctgagggaaaggc

SEQ ID NO: 2476101 - DNA, 18 bp, Homo sapiens
gcctgagtcgtgacctgc

SEQ ID NO: 2476102 - DNA, 23 bp, Homo sapiens
gcctgcaggatctcaccaggcag

SEQ ID NO: 2476103 - DNA, 16 bp, Homo sapiens
gcctgcagggcctctg

SEQ ID NO: 2476104 - DNA, 17 bp, Homo sapiens
gcctgcagggcctctgt

SEQ ID NO: 2476105 - DNA, 21 bp, Homo sapiens
gcctgcagggcctctgtcaat

SEQ ID NO: 2476106 - DNA, 22 bp, Homo sapiens
gcctgcatccattctcctgagg

SEQ ID NO: 2476107 - DNA, 14 bp, Homo sapiens
gcctgccacctgga

SEQ ID NO: 2476108 - DNA, 18 bp, Homo sapiens
gcctgccactgtgtgaat

SEQ ID NO: 2476109 - DNA, 18 bp, Homo sapiens
gcctgccagctgcactga

SEQ ID NO: 2476110 - DNA, 18 bp, Homo sapiens
gcctgccaggaggaccca

SEQ ID NO: 2476111 - DNA, 20 bp, Homo sapiens
gcctgccaggaggacccagg

SEQ ID NO: 2476112 - DNA, 23 bp, Homo sapiens
gcctgccaggaggacccagggct

SEQ ID NO: 2476113 - DNA, 14 bp, Homo sapiens
gcctgccctggtga

SEQ ID NO: 2476114 - DNA, 16 bp, Homo sapiens
gcctgccgagcaaccg

SEQ ID NO: 2476115 - DNA, 23 bp, Homo sapiens
gcctgcctttccatccatggcca

SEQ ID NO: 2476116 - DNA, 12 bp, Homo sapiens
gcctgctccaga

SEQ ID NO: 2476117 - DNA, 13 bp, Homo sapiens
gcctgctccagac

SEQ ID NO: 2476118 - DNA, 14 bp, Homo sapiens
gcctgctccagacc

SEQ ID NO: 2476119 - DNA, 21 bp, Homo sapiens
gcctgctccagacctgatcct

SEQ ID NO: 2476120 - DNA, 15 bp, Homo sapiens
gcctgctgctgagaa

SEQ ID NO: 2476121 - DNA, 17 bp, Homo sapiens
gcctgctgctgagaacc

SEQ ID NO: 2476122 - DNA, 18 bp, Homo sapiens
gcctgctgctgagaacct

SEQ ID NO: 2476123 - DNA, 20 bp, Homo sapiens
gcctgctgctgagaacctgg

SEQ ID NO: 2476124 - DNA, 13 bp, Homo sapiens
gcctggacctctg

SEQ ID NO: 2476125 - DNA, 14 bp, Homo sapiens
gcctggactttcct

SEQ ID NO: 2476126 - DNA, 23 bp, Homo sapiens
gcctggagacttagggcaccagg

SEQ ID NO: 2476127 - DNA, 18 bp, Homo sapiens
gcctggagatcctcctgc

SEQ ID NO: 2476128 - DNA, 22 bp, Homo sapiens
gcctggagatcctcctgcagac

SEQ ID NO: 2476129 - DNA, 14 bp, Homo sapiens
gcctggagatgact

SEQ ID NO: 2476130 - DNA, 16 bp, Homo sapiens
gcctggaggacctgag

SEQ ID NO: 2476131 - DNA, 18 bp, Homo sapiens
gcctggaggacctgagcc

SEQ ID NO: 2476132 - DNA, 20 bp, Homo sapiens
gcctggaggacctgagcctg

SEQ ID NO: 2476133 - DNA, 14 bp, Homo sapiens
gcctggccagacac

SEQ ID NO: 2476134 - DNA, 16 bp, Homo sapiens
gcctggccagacacag

SEQ ID NO: 2476135 - DNA, 17 bp, Homo sapiens
gcctggccagacacagg

SEQ ID NO: 2476136 - DNA, 21 bp, Homo sapiens
gcctggccagacacaggccct

SEQ ID NO: 2476137 - DNA, 18 bp, Homo sapiens
gcctggcccaccccaccc

SEQ ID NO: 2476138 - DNA, 16 bp, Homo sapiens
gcctggcctcctgcct

SEQ ID NO: 2476139 - DNA, 14 bp, Homo sapiens
gcctggctggctga

SEQ ID NO: 2476140 - DNA, 15 bp, Homo sapiens
gcctggctggctgag

SEQ ID NO: 2476141 - DNA, 17 bp, Homo sapiens
gcctggctggctgaggg

SEQ ID NO: 2476142 - DNA, 20 bp, Homo sapiens
gcctggctggctgagggcag

SEQ ID NO: 2476143 - DNA, 10 bp, Homo sapiens
gcctgggagg

SEQ ID NO: 2476144 - DNA, 20 bp, Homo sapiens
gcctgggcctatggagagcc

SEQ ID NO: 2476145 - DNA, 21 bp, Homo sapiens
gcctgggcctatggagagccc

SEQ ID NO: 2476146 - DNA, 17 bp, Homo sapiens
gcctgggcgctggtcct

SEQ ID NO: 2476147 - DNA, 21 bp, Homo sapiens
gcctgggcgtacagagcacat

SEQ ID NO: 2476148 - DNA, 15 bp, Homo sapiens
gcctgggctcctgga

SEQ ID NO: 2476149 - DNA, 16 bp, Homo sapiens
gcctgggctcctggac

SEQ ID NO: 2476150 - DNA, 17 bp, Homo sapiens
gcctgggggcctggctg

SEQ ID NO: 2476151 - DNA, 19 bp, Homo sapiens
gcctgggggcctggctggc

SEQ ID NO: 2476152 - DNA, 20 bp, Homo sapiens
gcctgggggcctggctggct

SEQ ID NO: 2476153 - DNA, 17 bp, Homo sapiens
gcctgggggtgccagga

SEQ ID NO: 2476154 - DNA, 11 bp, Homo sapiens
gcctgtactgc

SEQ ID NO: 2476155 - DNA, 17 bp, Homo sapiens
gcctgtactgcctgctt

SEQ ID NO: 2476156 - DNA, 18 bp, Homo sapiens
gcctgtactgcctgcttg

SEQ ID NO: 2476157 - DNA, 15 bp, Homo sapiens
gcctgtccacaggct

SEQ ID NO: 2476158 - DNA, 20 bp, Homo sapiens
gcctgtccacaggcttctga

SEQ ID NO: 2476159 - DNA, 20 bp, Homo sapiens
gcctgtcccacccccacccc

SEQ ID NO: 2476160 - DNA, 16 bp, Homo sapiens
gcctgtcttaattttc

SEQ ID NO: 2476161 - DNA, 17 bp, Homo sapiens
gcctgtcttaattttct

SEQ ID NO: 2476162 - DNA, 15 bp, Homo sapiens
gcctgtgaacccagg

SEQ ID NO: 2476163 - DNA, 18 bp, Homo sapiens
gcctgtgaacccaggaca

SEQ ID NO: 2476164 - DNA, 21 bp, Homo sapiens
gcctgtgacataccccctccc

SEQ ID NO: 2476165 - DNA, 19 bp, Homo sapiens
gcctgtgccaggtgaggtc

SEQ ID NO: 2476166 - DNA, 22 bp, Homo sapiens
gcctgtgccaggtgaggtcagc

SEQ ID NO: 2476167 - DNA, 19 bp, Homo sapiens
gcctgtggcgccgtctcca

SEQ ID NO: 2476168 - DNA, 12 bp, Homo sapiens
gcctgtgtccat

SEQ ID NO: 2476169 - DNA, 19 bp, Homo sapiens
gcctgtgtccatgcgctca

SEQ ID NO: 2476170 - DNA, 20 bp, Homo sapiens
gcctgtgtccatgcgctcag

SEQ ID NO: 2476171 - DNA, 21 bp, Homo sapiens
gcctgtgtccatgcgctcagg

SEQ ID NO: 2476172 - DNA, 21 bp, Homo sapiens
gcctgtttggcctctctatcc

SEQ ID NO: 2476173 - DNA, 17 bp, Homo sapiens
gccttaatttgcacagt

SEQ ID NO: 2476174 - DNA, 20 bp, Homo sapiens
gccttcaagaaaacaggcac

SEQ ID NO: 2476175 - DNA, 16 bp, Homo sapiens
gccttcattctgcaag

SEQ ID NO: 2476176 - DNA, 12 bp, Homo sapiens
gccttccaccca

SEQ ID NO: 2476177 - DNA, 22 bp, Homo sapiens
gccttccccacccaccaaccct

SEQ ID NO: 2476178 - DNA, 20 bp, Homo sapiens
gccttccccttatcctccct

SEQ ID NO: 2476179 - DNA, 22 bp, Homo sapiens
gccttccccttatcctccctgt

SEQ ID NO: 2476180 - DNA, 14 bp, Homo sapiens
gccttcctcctggg

SEQ ID NO: 2476181 - DNA, 17 bp, Homo sapiens
gccttcctcctgggccc

SEQ ID NO: 2476182 - DNA, 17 bp, Homo sapiens
gccttgccagagatcca

SEQ ID NO: 2476183 - DNA, 17 bp, Homo sapiens
gctactctgtgccagag

SEQ ID NO: 2476184 - DNA, 21 bp, Homo sapiens
gctactctgtgccagagcctg

SEQ ID NO: 2476185 - DNA, 23 bp, Homo sapiens
gctactctgtgccagagcctggg

SEQ ID NO: 2476186 - DNA, 17 bp, Homo sapiens
gctactggggaaactgg

SEQ ID NO: 2476187 - DNA, 18 bp, Homo sapiens
gctactggggaaactggc

SEQ ID NO: 2476188 - DNA, 21 bp, Homo sapiens
gctactggggaaactggccat

SEQ ID NO: 2476189 - DNA, 18 bp, Homo sapiens
gctacttcctcctcccca

SEQ ID NO: 2476190 - DNA, 23 bp, Homo sapiens
gctactttgctgctatggttttc

SEQ ID NO: 2476191 - DNA, 14 bp, Homo sapiens
gctagaacatggtt

SEQ ID NO: 2476192 - DNA, 15 bp, Homo sapiens
gctagaaccctctgt

SEQ ID NO: 2476193 - DNA, 16 bp, Homo sapiens
gctagacacatgaagg

SEQ ID NO: 2476194 - DNA, 16 bp, Homo sapiens
gctagcagtggcaggc

SEQ ID NO: 2476195 - DNA, 17 bp, Homo sapiens
gctaggagcaaagcctg

SEQ ID NO: 2476196 - DNA, 19 bp, Homo sapiens
gctaggccagagcccactc

SEQ ID NO: 2476197 - DNA, 23 bp, Homo sapiens
gctaggctctgtctggaagatgg

SEQ ID NO: 2476198 - DNA, 19 bp, Homo sapiens
gctataaagcagtattttt

SEQ ID NO: 2476199 - DNA, 21 bp, Homo sapiens
gctatagatgtcttttcccat

SEQ ID NO: 2476200 - DNA, 12 bp, Homo sapiens
gctatctccctg

SEQ ID NO: 2476201 - DNA, 13 bp, Homo sapiens
gctatggttttct

SEQ ID NO: 2476202 - DNA, 19 bp, Homo sapiens
gctattctgtccctaggtg

SEQ ID NO: 2476203 - DNA, 15 bp, Homo sapiens
gctatttgatgtaat

SEQ ID NO: 2476204 - DNA, 19 bp, Homo sapiens
gctatttgtaaatctgcca

SEQ ID NO: 2476205 - DNA, 23 bp, Homo sapiens
gctattttatattacactacaca

SEQ ID NO: 2476206 - DNA, 13 bp, Homo sapiens
gctattttccagg

SEQ ID NO: 2476207 - DNA, 23 bp, Homo sapiens
gctcaaacaatgacaaagcagat

SEQ ID NO: 2476208 - DNA, 22 bp, Homo sapiens
gctcaaaggtttggaaggagca

SEQ ID NO: 2476209 - DNA, 23 bp, Homo sapiens
gctcaaaggtttggaaggagcag

SEQ ID NO: 2476210 - DNA, 23 bp, Homo sapiens
gctcaactctcttattgcctcac

SEQ ID NO: 2476211 - DNA, 15 bp, Homo sapiens
gctcaagcagcgacc

SEQ ID NO: 2476212 - DNA, 14 bp, Homo sapiens
gctcaaggccagct

SEQ ID NO: 2476213 - DNA, 20 bp, Homo sapiens
gctcaatccctgaggactga

SEQ ID NO: 2476214 - DNA, 14 bp, Homo sapiens
gctcaatgagcatg

SEQ ID NO: 2476215 - DNA, 19 bp, Homo sapiens
gctcaatgagcatgtttag

SEQ ID NO: 2476216 - DNA, 17 bp, Homo sapiens
gctcaatggactggaag

SEQ ID NO: 2476217 - DNA, 19 bp, Homo sapiens
gctcacccagtgccctctc

SEQ ID NO: 2476218 - DNA, 16 bp, Homo sapiens
gctcacccccttctcc

SEQ ID NO: 2476219 - DNA, 18 bp, Homo sapiens
gctcacccccttctccat

SEQ ID NO: 2476220 - DNA, 20 bp, Homo sapiens
gctcacccccttctccatcc

SEQ ID NO: 2476221 - DNA, 20 bp, Homo sapiens
gctcacgtcctgagaaagct

SEQ ID NO: 2476222 - DNA, 18 bp, Homo sapiens
gctcagaggcgcactgtg

SEQ ID NO: 2476223 - DNA, 20 bp, Homo sapiens
gctcagaggcgcactgtgac

SEQ ID NO: 2476224 - DNA, 19 bp, Homo sapiens
gctcagcactgcctgctcc

SEQ ID NO: 2476225 - DNA, 22 bp, Homo sapiens
gctcagcactgcctgctcccat

SEQ ID NO: 2476226 - DNA, 12 bp, Homo sapiens
gctcagccagca

SEQ ID NO: 2476227 - DNA, 14 bp, Homo sapiens
gctcagccagcact

SEQ ID NO: 2476228 - DNA, 15 bp, Homo sapiens
gctcagccagcactt

SEQ ID NO: 2476229 - DNA, 20 bp, Homo sapiens
gctcagccccaccccagggc

SEQ ID NO: 2476230 - DNA, 15 bp, Homo sapiens
gctcagccctgagga

SEQ ID NO: 2476231 - DNA, 16 bp, Homo sapiens
gctcagccctgcacca

SEQ ID NO: 2476232 - DNA, 19 bp, Homo sapiens
gctcagctgcattccgcag

SEQ ID NO: 2476233 - DNA, 20 bp, Homo sapiens
gctcaggacagatgccacac

SEQ ID NO: 2476234 - DNA, 24 bp, Homo sapiens
gctcaggcgatccacctgtctcag

SEQ ID NO: 2476235 - DNA, 20 bp, Homo sapiens
gctcagggccatgctgaggc

SEQ ID NO: 2476236 - DNA, 17 bp, Homo sapiens
gctcagggggcgcctgt

SEQ ID NO: 2476237 - DNA, 21 bp, Homo sapiens
gctcaggtcacataaaacttt

SEQ ID NO: 2476238 - DNA, 15 bp, Homo sapiens
gctcaggtccctggg

SEQ ID NO: 2476239 - DNA, 19 bp, Homo sapiens
gctcaggtccctggggcta

SEQ ID NO: 2476240 - DNA, 17 bp, Homo sapiens
gctcaggtgctggggcc

SEQ ID NO: 2476241 - DNA, 20 bp, Homo sapiens
gctcatcattctctgtctca

SEQ ID NO: 2476242 - DNA, 14 bp, Homo sapiens
gctcatctgctggt

SEQ ID NO: 2476243 - DNA, 15 bp, Homo sapiens
gctcatctgctggtc

SEQ ID NO: 2476244 - DNA, 17 bp, Homo sapiens
gctcatgtgtgcaacag

SEQ ID NO: 2476245 - DNA, 20 bp, Homo sapiens
gctcattctgtctcttttct

SEQ ID NO: 2476246 - DNA, 19 bp, Homo sapiens
gctccaaagtcataattgc

SEQ ID NO: 2476247 - DNA, 21 bp, Homo sapiens
gctccaacctgcaaagatctg

SEQ ID NO: 2476248 - DNA, 17 bp, Homo sapiens
gctccaagattctagat

SEQ ID NO: 2476249 - DNA, 18 bp, Homo sapiens
gctccaagattctagatg

SEQ ID NO: 2476250 - DNA, 13 bp, Homo sapiens
gctccactctgct

SEQ ID NO: 2476251 - DNA, 20 bp, Homo sapiens
gctccactctgcttctctga

SEQ ID NO: 2476252 - DNA, 21 bp, Homo sapiens
gctccactctgcttctctgac

SEQ ID NO: 2476253 - DNA, 22 bp, Homo sapiens
gctccagacctgatcctggagg

SEQ ID NO: 2476254 - DNA, 18 bp, Homo sapiens
gctccagatgcagggcag

SEQ ID NO: 2476255 - DNA, 21 bp, Homo sapiens
gctccagctgccccggcccct

SEQ ID NO: 2476256 - DNA, 20 bp, Homo sapiens
gctccagtgtcctgagctca

SEQ ID NO: 2476257 - DNA, 23 bp, Homo sapiens
gctccagtgtcctgagctcagcg

SEQ ID NO: 2476258 - DNA, 15 bp, Homo sapiens
gctcccaaggggcct

SEQ ID NO: 2476259 - DNA, 23 bp, Homo sapiens
gctcccacaagcctctgcccagg

SEQ ID NO: 2476260 - DNA, 17 bp, Homo sapiens
gctcccacaagcctgag

SEQ ID NO: 2476261 - DNA, 16 bp, Homo sapiens
gctcccacctcctgac

SEQ ID NO: 2476262 - DNA, 16 bp, Homo sapiens
gctcccaggaccacag

SEQ ID NO: 2476263 - DNA, 14 bp, Homo sapiens
gctccccactctgc

SEQ ID NO: 2476264 - DNA, 19 bp, Homo sapiens
gctcccctaaagcctcaaa

SEQ ID NO: 2476265 - DNA, 21 bp, Homo sapiens
gctcccctccccaactgacca

SEQ ID NO: 2476266 - DNA, 11 bp, Homo sapiens
gctccctcaga

SEQ ID NO: 2476267 - DNA, 18 bp, Homo sapiens
gctccctgactgggagtt

SEQ ID NO: 2476268 - DNA, 21 bp, Homo sapiens
gctcccttctacagcctcaga

SEQ ID NO: 2476269 - DNA, 14 bp, Homo sapiens
gctcccttcttccc

SEQ ID NO: 2476270 - DNA, 15 bp, Homo sapiens
gctccgaggacccag

SEQ ID NO: 2476271 - DNA, 15 bp, Homo sapiens
gctccgcctggcctg

SEQ ID NO: 2476272 - DNA, 23 bp, Homo sapiens
gctccggaggactcaccactgcc

SEQ ID NO: 2476273 - DNA, 20 bp, Homo sapiens
gctcctcagggactcaggtg

SEQ ID NO: 2476274 - DNA, 22 bp, Homo sapiens
gctcctccctctcaacacccag

SEQ ID NO: 2476275 - DNA, 19 bp, Homo sapiens
gctcctctccccagcccag

SEQ ID NO: 2476276 - DNA, 12 bp, Homo sapiens
gctcctctgctt

SEQ ID NO: 2476277 - DNA, 13 bp, Homo sapiens
gctcctctgtctc

SEQ ID NO: 2476278 - DNA, 23 bp, Homo sapiens
gctcctctgtctcgagcgccctg

SEQ ID NO: 2476279 - DNA, 19 bp, Homo sapiens
gctcctgaccagttgcagt

SEQ ID NO: 2476280 - DNA, 20 bp, Homo sapiens
gctcctgaccagttgcagtc

SEQ ID NO: 2476281 - DNA, 24 bp, Homo sapiens
gctcctgaccagttgcagtcactc

SEQ ID NO: 2476282 - DNA, 12 bp, Homo sapiens
gctcctgcactt

SEQ ID NO: 2476283 - DNA, 15 bp, Homo sapiens
gctcctggcccagcc

SEQ ID NO: 2476284 - DNA, 13 bp, Homo sapiens
gctcctgtggccc

SEQ ID NO: 2476285 - DNA, 13 bp, Homo sapiens
gctccttcccatc

SEQ ID NO: 2476286 - DNA, 18 bp, Homo sapiens
ggactgagtgggaagccc

SEQ ID NO: 2476287 - DNA, 19 bp, Homo sapiens
ggactgctaaataaaattt

SEQ ID NO: 2476288 - DNA, 19 bp, Homo sapiens
ggactgggagcccccagcc

SEQ ID NO: 2476289 - DNA, 23 bp, Homo sapiens
ggactgggagcccccagcctgtc

SEQ ID NO: 2476290 - DNA, 18 bp, Homo sapiens
ggactgtagggagggcgg

SEQ ID NO: 2476291 - DNA, 20 bp, Homo sapiens
ggactgtagggagggcggca

SEQ ID NO: 2476292 - DNA, 14 bp, Homo sapiens
ggactgtcgctgct

SEQ ID NO: 2476293 - DNA, 23 bp, Homo sapiens
ggacttaagcatctggctctaat

SEQ ID NO: 2476294 - DNA, 23 bp, Homo sapiens
ggacttcctgtccagctccaacc

SEQ ID NO: 2476295 - DNA, 22 bp, Homo sapiens
ggactttgcagccggcacaggg

SEQ ID NO: 2476296 - DNA, 13 bp, Homo sapiens
ggagaagccagga

SEQ ID NO: 2476297 - DNA, 17 bp, Homo sapiens
ggagacagcatcagggt

SEQ ID NO: 2476298 - DNA, 18 bp, Homo sapiens
ggagacagcatcagggtt

SEQ ID NO: 2476299 - DNA, 12 bp, Homo sapiens
ggagaccaccag

SEQ ID NO: 2476300 - DNA, 17 bp, Homo sapiens
ggagacctcagaagtaa

SEQ ID NO: 2476301 - DNA, 13 bp, Homo sapiens
ggagactgggctg

SEQ ID NO: 2476302 - DNA, 17 bp, Homo sapiens
ggagagacactggtggg

SEQ ID NO: 2476303 - DNA, 13 bp, Homo sapiens
ggagagcccagga

SEQ ID NO: 2476304 - DNA, 13 bp, Homo sapiens
ggagagccctggg

SEQ ID NO: 2476305 - DNA, 12 bp, Homo sapiens
ggagagctagga

SEQ ID NO: 2476306 - DNA, 15 bp, Homo sapiens
ggagagctaggagca

SEQ ID NO: 2476307 - DNA, 21 bp, Homo sapiens
ggagagctaggagcaaagcct

SEQ ID NO: 2476308 - DNA, 22 bp, Homo sapiens
ggagagctaggagcaaagcctg

SEQ ID NO: 2476309 - DNA, 13 bp, Homo sapiens
ggagagggcgcag

SEQ ID NO: 2476310 - DNA, 18 bp, Homo sapiens
ggagagtttcctgaaaca

SEQ ID NO: 2476311 - DNA, 13 bp, Homo sapiens
ggagattctgcct

SEQ ID NO: 2476312 - DNA, 19 bp, Homo sapiens
ggagcaaactgcatgccca

SEQ ID NO: 2476313 - DNA, 23 bp, Homo sapiens
ggagcaaactgcatgcccagaga

SEQ ID NO: 2476314 - DNA, 22 bp, Homo sapiens
ggagcaaagcctgttcatggca

SEQ ID NO: 2476315 - DNA, 23 bp, Homo sapiens
ggagcaaagcctgttcatggcag

SEQ ID NO: 2476316 - DNA, 17 bp, Homo sapiens
ggagcacaaagaccctg

SEQ ID NO: 2476317 - DNA, 21 bp, Homo sapiens
ggagcacaataaatggctgta

SEQ ID NO: 2476318 - DNA, 14 bp, Homo sapiens
ggagcagaagcagc

SEQ ID NO: 2476319 - DNA, 12 bp, Homo sapiens
ggagcagcagga

SEQ ID NO: 2476320 - DNA, 16 bp, Homo sapiens
ggagccaagggatgga

SEQ ID NO: 2476321 - DNA, 16 bp, Homo sapiens
ggagccactcctctga

SEQ ID NO: 2476322 - DNA, 22 bp, Homo sapiens
ggagccatgcgccccctccgcc

SEQ ID NO: 2476323 - DNA, 14 bp, Homo sapiens
ggagccatttgaga

SEQ ID NO: 2476324 - DNA, 22 bp, Homo sapiens
ggagcccactgtcctgggcctg

SEQ ID NO: 2476325 - DNA, 16 bp, Homo sapiens
ggagcccagctctgaa

SEQ ID NO: 2476326 - DNA, 24 bp, Homo sapiens
ggagcccaggccaggactctgcag

SEQ ID NO: 2476327 - DNA, 14 bp, Homo sapiens
ggagcccccagcct

SEQ ID NO: 2476328 - DNA, 16 bp, Homo sapiens
ggagcccccagcctgt

SEQ ID NO: 2476329 - DNA, 21 bp, Homo sapiens
ggagccccttctgctcagctc

SEQ ID NO: 2476330 - DNA, 16 bp, Homo sapiens
ggagcccgtctcagtg

SEQ ID NO: 2476331 - DNA, 17 bp, Homo sapiens
ggagccgcgggacagcc

SEQ ID NO: 2476332 - DNA, 18 bp, Homo sapiens
ggagccgggtctgcctct

SEQ ID NO: 2476333 - DNA, 20 bp, Homo sapiens
ggagcctgtcctgcctgtgg

SEQ ID NO: 2476334 - DNA, 19 bp, Homo sapiens
ggagcctgtgaacccagga

SEQ ID NO: 2476335 - DNA, 21 bp, Homo sapiens
ggagcctgtgaacccaggaca

SEQ ID NO: 2476336 - DNA, 18 bp, Homo sapiens
ggagcgggtctgctccca

SEQ ID NO: 2476337 - DNA, 23 bp, Homo sapiens
ggagctacctgtgtggacaggac

SEQ ID NO: 2476338 - DNA, 13 bp, Homo sapiens
ggagctccagcct

SEQ ID NO: 2476339 - DNA, 17 bp, Homo sapiens
ggagctccagtgtcctg

SEQ ID NO: 2476340 - DNA, 13 bp, Homo sapiens
ggagctgggcctg

SEQ ID NO: 2476341 - DNA, 16 bp, Homo sapiens
ggagctttgactcagg

SEQ ID NO: 2476342 - DNA, 11 bp, Homo sapiens
ggaggaagccc

SEQ ID NO: 2476343 - DNA, 12 bp, Homo sapiens
ggaggacccagg

SEQ ID NO: 2476344 - DNA, 16 bp, Homo sapiens
ggaggacccagggctc

SEQ ID NO: 2476345 - DNA, 19 bp, Homo sapiens
ggaggacccagggctctgt

SEQ ID NO: 2476346 - DNA, 13 bp, Homo sapiens
ggaggacctgagc

SEQ ID NO: 2476347 - DNA, 17 bp, Homo sapiens
ggaggacctgagcctgc

SEQ ID NO: 2476348 - DNA, 18 bp, Homo sapiens
ggaggacctgagcctgcc

SEQ ID NO: 2476349 - DNA, 22 bp, Homo sapiens
ggaggacctgagcctgccgagc

SEQ ID NO: 2476350 - DNA, 22 bp, Homo sapiens
ggaggagagacactggtgggga

SEQ ID NO: 2476351 - DNA, 13 bp, Homo sapiens
ggaggagcctgtc

SEQ ID NO: 2476352 - DNA, 16 bp, Homo sapiens
ggaggagcctgtcctg

SEQ ID NO: 2476353 - DNA, 21 bp, Homo sapiens
ggaggagcctgtcctgcctgt

SEQ ID NO: 2476354 - DNA, 15 bp, Homo sapiens
ggaggaggaaatccc

SEQ ID NO: 2476355 - DNA, 15 bp, Homo sapiens
ggaggagggaggccg

SEQ ID NO: 2476356 - DNA, 21 bp, Homo sapiens
ggaggcaggggcttcctggtg

SEQ ID NO: 2476357 - DNA, 14 bp, Homo sapiens
ggaggcccaggctg

SEQ ID NO: 2476358 - DNA, 19 bp, Homo sapiens
ggaggcccagttcaccctg

SEQ ID NO: 2476359 - DNA, 23 bp, Homo sapiens
ggaggccctgtgccccttgacaa

SEQ ID NO: 2476360 - DNA, 16 bp, Homo sapiens
ggaggctccagagggc

SEQ ID NO: 2476361 - DNA, 11 bp, Homo sapiens
ggaggctgctc

SEQ ID NO: 2476362 - DNA, 14 bp, Homo sapiens
ggaggctgctcggg

SEQ ID NO: 2476363 - DNA, 16 bp, Homo sapiens
ggagggaagctcttgg

SEQ ID NO: 2476364 - DNA, 18 bp, Homo sapiens
ggagggacaaaggagcct

SEQ ID NO: 2476365 - DNA, 22 bp, Homo sapiens
ggagggacaagtggactcaggg

SEQ ID NO: 2476366 - DNA, 15 bp, Homo sapiens
ggagggaggccaggc

SEQ ID NO: 2476367 - DNA, 13 bp, Homo sapiens
ggagggaggcgct

SEQ ID NO: 2476368 - DNA, 16 bp, Homo sapiens
ggagggaggctcaggt

SEQ ID NO: 2476369 - DNA, 22 bp, Homo sapiens
ggagggattctggttccagggt

SEQ ID NO: 2476370 - DNA, 19 bp, Homo sapiens
ggagggccacatgggaggc

SEQ ID NO: 2476371 - DNA, 14 bp, Homo sapiens
ggagggctctgagg

SEQ ID NO: 2476372 - DNA, 22 bp, Homo sapiens
ggagggctgtcatctgtgcact

SEQ ID NO: 2476373 - DNA, 18 bp, Homo sapiens
ggaggggctcctttccat

SEQ ID NO: 2476374 - DNA, 15 bp, Homo sapiens
ggaggggggagggaa

SEQ ID NO: 2476375 - DNA, 22 bp, Homo sapiens
ggagggggtcgtggagagctag

SEQ ID NO: 2476376 - DNA, 16 bp, Homo sapiens
ggaggtgccactggag

SEQ ID NO: 2476377 - DNA, 15 bp, Homo sapiens
ggaggtgggccgtgg

SEQ ID NO: 2476378 - DNA, 17 bp, Homo sapiens
ggaggtgtctcaggctg

SEQ ID NO: 2476379 - DNA, 15 bp, Homo sapiens
ggagtagctgagctc

SEQ ID NO: 2476380 - DNA, 15 bp, Homo sapiens
ggagtcccctcacct

SEQ ID NO: 2476381 - DNA, 22 bp, Homo sapiens
ggagtcgtggggtgtgctggga

SEQ ID NO: 2476382 - DNA, 13 bp, Homo sapiens
ggagtctgaggtc

SEQ ID NO: 2476383 - DNA, 19 bp, Homo sapiens
ggagtctgaggtcctgagc

SEQ ID NO: 2476384 - DNA, 20 bp, Homo sapiens
ggagtctgccacccaggatc

SEQ ID NO: 2476385 - DNA, 22 bp, Homo sapiens
ggagtctgccagggcccctctc

SEQ ID NO: 2476386 - DNA, 16 bp, Homo sapiens
ggagtggcagcccagc

SEQ ID NO: 2476387 - DNA, 23 bp, Homo sapiens
ggagtggggtggtgtcagaccct

SEQ ID NO: 2476388 - DNA, 14 bp, Homo sapiens
ggagtgggtgggga

SEQ ID NO: 2476389 - DNA, 15 bp, Homo sapiens
ggagtgggtggggag

SEQ ID NO: 2476390 - DNA, 19 bp, Homo sapiens
ggctcagtgaagttgctgc

SEQ ID NO: 2476391 - DNA, 13 bp, Homo sapiens
ggctccagagggc

SEQ ID NO: 2476392 - DNA, 17 bp, Homo sapiens
ggctccccatgtgtcct

SEQ ID NO: 2476393 - DNA, 21 bp, Homo sapiens
ggctccccatgtgtcctggtt

SEQ ID NO: 2476394 - DNA, 22 bp, Homo sapiens
ggctccccatgtgtcctggttc

SEQ ID NO: 2476395 - DNA, 16 bp, Homo sapiens
ggctcccccaggggct

SEQ ID NO: 2476396 - DNA, 14 bp, Homo sapiens
ggctccgtgtggga

SEQ ID NO: 2476397 - DNA, 15 bp, Homo sapiens
ggctccgtgtgggag

SEQ ID NO: 2476398 - DNA, 17 bp, Homo sapiens
ggctccgtgtgggagac

SEQ ID NO: 2476399 - DNA, 18 bp, Homo sapiens
ggctccgtgtgggagacc

SEQ ID NO: 2476400 - DNA, 23 bp, Homo sapiens
ggctcctggtcacctaggaagcc

SEQ ID NO: 2476401 - DNA, 14 bp, Homo sapiens
ggctcctgttttgc

SEQ ID NO: 2476402 - DNA, 19 bp, Homo sapiens
ggctccttgtgccagagaa

SEQ ID NO: 2476403 - DNA, 19 bp, Homo sapiens
ggctccttgtgggcctggg

SEQ ID NO: 2476404 - DNA, 22 bp, Homo sapiens
ggctccttgtgggcctgggctc

SEQ ID NO: 2476405 - DNA, 13 bp, Homo sapiens
ggctcgaatctct

SEQ ID NO: 2476406 - DNA, 19 bp, Homo sapiens
ggctcgaatctctgtgcct

SEQ ID NO: 2476407 - DNA, 21 bp, Homo sapiens
ggctcgagcagtcctgcctca

SEQ ID NO: 2476408 - DNA, 15 bp, Homo sapiens
ggctcggcctgcccc

SEQ ID NO: 2476409 - DNA, 14 bp, Homo sapiens
ggctctaacgcctg

SEQ ID NO: 2476410 - DNA, 18 bp, Homo sapiens
ggctctaacgcctgagcc

SEQ ID NO: 2476411 - DNA, 22 bp, Homo sapiens
ggctctagatcataaggcttca

SEQ ID NO: 2476412 - DNA, 13 bp, Homo sapiens
ggctctcctggct

SEQ ID NO: 2476413 - DNA, 17 bp, Homo sapiens
ggctctgaggtgcctgt

SEQ ID NO: 2476414 - DNA, 17 bp, Homo sapiens
ggctctgccagtcctgt

SEQ ID NO: 2476415 - DNA, 20 bp, Homo sapiens
ggctctgccagtcctgtcct

SEQ ID NO: 2476416 - DNA, 17 bp, Homo sapiens
ggctctgtccccagcct

SEQ ID NO: 2476417 - DNA, 20 bp, Homo sapiens
ggctcttgatacccccctct

SEQ ID NO: 2476418 - DNA, 19 bp, Homo sapiens
ggctgaaattctcctggag

SEQ ID NO: 2476419 - DNA, 22 bp, Homo sapiens
ggctgacatgaagctgttgtgt

SEQ ID NO: 2476420 - DNA, 15 bp, Homo sapiens
ggctgaccatgctca

SEQ ID NO: 2476421 - DNA, 16 bp, Homo sapiens
ggctgaggcctggact

SEQ ID NO: 2476422 - DNA, 18 bp, Homo sapiens
ggctgaggctggcacagg

SEQ ID NO: 2476423 - DNA, 15 bp, Homo sapiens
ggctgagggagcctg

SEQ ID NO: 2476424 - DNA, 21 bp, Homo sapiens
ggctgagggcagttcgcagcc

SEQ ID NO: 2476425 - DNA, 13 bp, Homo sapiens
ggctgcagaggcc

SEQ ID NO: 2476426 - DNA, 16 bp, Homo sapiens
ggctgcagaggccaga

SEQ ID NO: 2476427 - DNA, 14 bp, Homo sapiens
ggctgcagcctcag

SEQ ID NO: 2476428 - DNA, 17 bp, Homo sapiens
ggctgcagcctcaggac

SEQ ID NO: 2476429 - DNA, 18 bp, Homo sapiens
ggctgcagcctcaggact

SEQ ID NO: 2476430 - DNA, 20 bp, Homo sapiens
ggctgcagcctcaggactgg

SEQ ID NO: 2476431 - DNA, 22 bp, Homo sapiens
ggctgcagcctcaggactggga

SEQ ID NO: 2476432 - DNA, 20 bp, Homo sapiens
ggctgccctcctgtgctcag

SEQ ID NO: 2476433 - DNA, 15 bp, Homo sapiens
ggctgccggggcagc

SEQ ID NO: 2476434 - DNA, 15 bp, Homo sapiens
ggctgccgtccccta

SEQ ID NO: 2476435 - DNA, 23 bp, Homo sapiens
ggctgccgtggggccgccgcctc

SEQ ID NO: 2476436 - DNA, 14 bp, Homo sapiens
ggctgcgcactgtg

SEQ ID NO: 2476437 - DNA, 21 bp, Homo sapiens
ggctgctcggggtgcacagga

SEQ ID NO: 2476438 - DNA, 20 bp, Homo sapiens
ggctgctgctgggctcagtg

SEQ ID NO: 2476439 - DNA, 18 bp, Homo sapiens
ggctgcttccctgaagct

SEQ ID NO: 2476440 - DNA, 16 bp, Homo sapiens
ggctgcttcctcctgg

SEQ ID NO: 2476441 - DNA, 19 bp, Homo sapiens
ggctggaagatcctgcggg

SEQ ID NO: 2476442 - DNA, 14 bp, Homo sapiens
ggctggacccagcc

SEQ ID NO: 2476443 - DNA, 20 bp, Homo sapiens
ggctggacccagccaggccc

SEQ ID NO: 2476444 - DNA, 11 bp, Homo sapiens
ggctggaggag

SEQ ID NO: 2476445 - DNA, 17 bp, Homo sapiens
ggctggaggagcccagg

SEQ ID NO: 2476446 - DNA, 13 bp, Homo sapiens
ggctggaggccca

SEQ ID NO: 2476447 - DNA, 14 bp, Homo sapiens
ggctggaggcccag

SEQ ID NO: 2476448 - DNA, 19 bp, Homo sapiens
ggctggagtggagtggcgt

SEQ ID NO: 2476449 - DNA, 16 bp, Homo sapiens
ggctggatgagctccc

SEQ ID NO: 2476450 - DNA, 19 bp, Homo sapiens
ggctggatgagctcccaca

SEQ ID NO: 2476451 - DNA, 23 bp, Homo sapiens
ggctggatgagctcccacaagcc

SEQ ID NO: 2476452 - DNA, 21 bp, Homo sapiens
ggctggccagtccaggctgcc

SEQ ID NO: 2476453 - DNA, 22 bp, Homo sapiens
ggctggccagtccaggctgccg

SEQ ID NO: 2476454 - DNA, 22 bp, Homo sapiens
ggctggctccagatgcagggca

SEQ ID NO: 2476455 - DNA, 14 bp, Homo sapiens
ggctggctgagggc

SEQ ID NO: 2476456 - DNA, 13 bp, Homo sapiens
ggctggctggcct

SEQ ID NO: 2476457 - DNA, 17 bp, Homo sapiens
ggctgggccatgtccaa

SEQ ID NO: 2476458 - DNA, 21 bp, Homo sapiens
ggctgggccatgtccaaagag

SEQ ID NO: 2476459 - DNA, 18 bp, Homo sapiens
ggctggggtcccagcagc

SEQ ID NO: 2476460 - DNA, 21 bp, Homo sapiens
ggctggtcctatggcctcatg

SEQ ID NO: 2476461 - DNA, 13 bp, Homo sapiens
ggctggtctcaaa

SEQ ID NO: 2476462 - DNA, 23 bp, Homo sapiens
ggctggtgggtgcctaggcctgg

SEQ ID NO: 2476463 - DNA, 20 bp, Homo sapiens
ggctggtgtggtacagagaa

SEQ ID NO: 2476464 - DNA, 21 bp, Homo sapiens
ggctggtgtggtacagagaag

SEQ ID NO: 2476465 - DNA, 15 bp, Homo sapiens
ggctgtaaggctcta

SEQ ID NO: 2476466 - DNA, 14 bp, Homo sapiens
ggctgtcatctgtg

SEQ ID NO: 2476467 - DNA, 13 bp, Homo sapiens
ggctgtcctgtac

SEQ ID NO: 2476468 - DNA, 14 bp, Homo sapiens
ggctgtgcagtcct

SEQ ID NO: 2476469 - DNA, 22 bp, Homo sapiens
ggcttagtttgtgtgttgtctc

SEQ ID NO: 2476470 - DNA, 17 bp, Homo sapiens
ggcttcccatccccagc

SEQ ID NO: 2476471 - DNA, 14 bp, Homo sapiens
ggcttcctggagca

SEQ ID NO: 2476472 - DNA, 13 bp, Homo sapiens
ggcttctgagcag

SEQ ID NO: 2476473 - DNA, 14 bp, Homo sapiens
ggcttctgagcagc

SEQ ID NO: 2476474 - DNA, 18 bp, Homo sapiens
ggcttctggccaggaagc

SEQ ID NO: 2476475 - DNA, 21 bp, Homo sapiens
ggcttgagaaatatggacact

SEQ ID NO: 2476476 - DNA, 15 bp, Homo sapiens
ggcttgctattctgt

SEQ ID NO: 2476477 - DNA, 17 bp, Homo sapiens
ggcttggccacagccag

SEQ ID NO: 2476478 - DNA, 13 bp, Homo sapiens
ggcttgggcctag

SEQ ID NO: 2476479 - DNA, 16 bp, Homo sapiens
ggcttgggcctaggct

SEQ ID NO: 2476480 - DNA, 17 bp, Homo sapiens
ggcttgggcctaggctg

SEQ ID NO: 2476481 - DNA, 16 bp, Homo sapiens
ggctttgatgttcctt

SEQ ID NO: 2476482 - DNA, 12 bp, Homo sapiens
ggctttggattt

SEQ ID NO: 2476483 - DNA, 20 bp, Homo sapiens
ggcttttattaatgcacttt

SEQ ID NO: 2476484 - DNA, 21 bp, Homo sapiens
gggaaactggccatggcctgc

SEQ ID NO: 2476485 - DNA, 14 bp, Homo sapiens
gggaaagcaaagca

SEQ ID NO: 2476486 - DNA, 20 bp, Homo sapiens
gggaaagcaaagcacagaga

SEQ ID NO: 2476487 - DNA, 20 bp, Homo sapiens
gggaacagtgtgcaaggcag

SEQ ID NO: 2476488 - DNA, 12 bp, Homo sapiens
gggaacatgggg

SEQ ID NO: 2476489 - DNA, 23 bp, Homo sapiens
gggaaccctgcccactcccagga

SEQ ID NO: 2476490 - DNA, 13 bp, Homo sapiens
gggaacctgtgtc

SEQ ID NO: 2476491 - DNA, 14 bp, Homo sapiens
gggaacctgtgtcc

SEQ ID NO: 2476492 - DNA, 12 bp, Homo sapiens
gggaactggcca

SEQ ID NO: 2476493 - DNA, 13 bp, Homo sapiens
gggaactggccaa

SEQ ID NO: 2476494 - DNA, 22 bp, Homo sapiens
ggtctgctctttctctgccagt

SEQ ID NO: 2476495 - DNA, 12 bp, Homo sapiens
ggtctggctggt

SEQ ID NO: 2476496 - DNA, 20 bp, Homo sapiens
ggtctgggagtcacacagtg

SEQ ID NO: 2476497 - DNA, 18 bp, Homo sapiens
ggtctgggtggggcccag

SEQ ID NO: 2476498 - DNA, 18 bp, Homo sapiens
ggtctgtaggttgcacac

SEQ ID NO: 2476499 - DNA, 17 bp, Homo sapiens
ggtctgttctgtttcaa

SEQ ID NO: 2476500 - DNA, 16 bp, Homo sapiens
ggtctgttggcaggct

SEQ ID NO: 2476501 - DNA, 20 bp, Homo sapiens
ggtctgttggcaggctggcc

SEQ ID NO: 2476502 - DNA, 15 bp, Homo sapiens
ggtcttacagcaggc

SEQ ID NO: 2476503 - DNA, 22 bp, Homo sapiens
ggtgaagaggaggggaagaggc

SEQ ID NO: 2476504 - DNA, 14 bp, Homo sapiens
ggtgaccccagggc

SEQ ID NO: 2476505 - DNA, 15 bp, Homo sapiens
ggtgaccccagggca

SEQ ID NO: 2476506 - DNA, 17 bp, Homo sapiens
ggtgaccccagggcaca

SEQ ID NO: 2476507 - DNA, 21 bp, Homo sapiens
ggtgaccccagggcacaggag

SEQ ID NO: 2476508 - DNA, 20 bp, Homo sapiens
ggtgacccggcaccccctgc

SEQ ID NO: 2476509 - DNA, 21 bp, Homo sapiens
ggtgacccggcaccccctgca

SEQ ID NO: 2476510 - DNA, 17 bp, Homo sapiens
ggtgatgagggcagcag

SEQ ID NO: 2476511 - DNA, 13 bp, Homo sapiens
ggtgcaatttcaa

SEQ ID NO: 2476512 - DNA, 15 bp, Homo sapiens
ggtgcacaggagggg

SEQ ID NO: 2476513 - DNA, 13 bp, Homo sapiens
ggtgcactgggag

SEQ ID NO: 2476514 - DNA, 12 bp, Homo sapiens
ggtgccagaagc

SEQ ID NO: 2476515 - DNA, 17 bp, Homo sapiens
ggtgcccaagccagagg

SEQ ID NO: 2476516 - DNA, 22 bp, Homo sapiens
ggtgcccaagccagaggctggg

SEQ ID NO: 2476517 - DNA, 13 bp, Homo sapiens
ggtgcccacaggc

SEQ ID NO: 2476518 - DNA, 14 bp, Homo sapiens
ggtgcccaggagaa

SEQ ID NO: 2476519 - DNA, 13 bp, Homo sapiens
ggtgccccaggac

SEQ ID NO: 2476520 - DNA, 14 bp, Homo sapiens
ggtgccccaggacc

SEQ ID NO: 2476521 - DNA, 21 bp, Homo sapiens
ggtgccccaggaccagctcag

SEQ ID NO: 2476522 - DNA, 17 bp, Homo sapiens
ggtgcggctggccatgg

SEQ ID NO: 2476523 - DNA, 14 bp, Homo sapiens
ggtgctactgggga

SEQ ID NO: 2476524 - DNA, 21 bp, Homo sapiens
ggtgctactggggaaactggc

SEQ ID NO: 2476525 - DNA, 14 bp, Homo sapiens
ggtgctaggaagag

SEQ ID NO: 2476526 - DNA, 23 bp, Homo sapiens
ggtgctggaggttggatcttgat

SEQ ID NO: 2476527 - DNA, 18 bp, Homo sapiens
ggtgctgggagaggcagc

SEQ ID NO: 2476528 - DNA, 21 bp, Homo sapiens
ggtgcttgttccctctccctg

SEQ ID NO: 2476529 - DNA, 22 bp, Homo sapiens
ggtggatggccccagcacagct

SEQ ID NO: 2476530 - DNA, 11 bp, Homo sapiens
ggtggccaggc

SEQ ID NO: 2476531 - DNA, 13 bp, Homo sapiens
ggtggccaggccg

SEQ ID NO: 2476532 - DNA, 15 bp, Homo sapiens
ggtggccatgctcct

SEQ ID NO: 2476533 - DNA, 18 bp, Homo sapiens
ggtggccctctcccctgc

SEQ ID NO: 2476534 - DNA, 22 bp, Homo sapiens
ggtggccctctcccctgccccc

SEQ ID NO: 2476535 - DNA, 20 bp, Homo sapiens
ggtggcccttatgactgcca

SEQ ID NO: 2476536 - DNA, 20 bp, Homo sapiens
ggtggccgctgagtggcagg

SEQ ID NO: 2476537 - DNA, 21 bp, Homo sapiens
ggtggccgctgagtggcaggg

SEQ ID NO: 2476538 - DNA, 19 bp, Homo sapiens
ggtggctactctgtgccag

SEQ ID NO: 2476539 - DNA, 14 bp, Homo sapiens
ggtggctgcagcct

SEQ ID NO: 2476540 - DNA, 15 bp, Homo sapiens
ggtggctgcagcctc

SEQ ID NO: 2476541 - DNA, 12 bp, Homo sapiens
ggtgggcctggt

SEQ ID NO: 2476542 - DNA, 16 bp, Homo sapiens
ggtgggctggtatctc

SEQ ID NO: 2476543 - DNA, 15 bp, Homo sapiens
ggtggggcagctcct

SEQ ID NO: 2476544 - DNA, 10 bp, Homo sapiens
ggtgggggta

SEQ ID NO: 2476545 - DNA, 20 bp, Homo sapiens
ggtgggggtagggggctgga

SEQ ID NO: 2476546 - DNA, 23 bp, Homo sapiens
ggtggggtcctggagcagaccac

SEQ ID NO: 2476547 - DNA, 20 bp, Homo sapiens
ggtgggtccatgggcagagc

SEQ ID NO: 2476548 - DNA, 13 bp, Homo sapiens
ggtggtattttca

SEQ ID NO: 2476549 - DNA, 21 bp, Homo sapiens
ggtggtctgttggcaggctgg

SEQ ID NO: 2476550 - DNA, 22 bp, Homo sapiens
ggtgtagctacagagaaaccag

SEQ ID NO: 2476551 - DNA, 18 bp, Homo sapiens
ggtgtcagaccctggagg

SEQ ID NO: 2476552 - DNA, 23 bp, Homo sapiens
ggtgtcagaccctggaggcccca

SEQ ID NO: 2476553 - DNA, 15 bp, Homo sapiens
ggtgtccccaacagc

SEQ ID NO: 2476554 - DNA, 12 bp, Homo sapiens
ggtgtcctacag

SEQ ID NO: 2476555 - DNA, 14 bp, Homo sapiens
ggtgtcctacagaa

SEQ ID NO: 2476556 - DNA, 15 bp, Homo sapiens
ggtgtcctacagaaa

SEQ ID NO: 2476557 - DNA, 17 bp, Homo sapiens
ggtgtctcaggctgcct

SEQ ID NO: 2476558 - DNA, 17 bp, Homo sapiens
ggtgtgcaccagggttg

SEQ ID NO: 2476559 - DNA, 19 bp, Homo sapiens
ggtgtgctgggagctccac

SEQ ID NO: 2476560 - DNA, 16 bp, Homo sapiens
ggtgtggtacagagaa

SEQ ID NO: 2476561 - DNA, 20 bp, Homo sapiens
ggtgtggtacagagaagcca

SEQ ID NO: 2476562 - DNA, 15 bp, Homo sapiens
ggtgttaacagaagg

SEQ ID NO: 2476563 - DNA, 12 bp, Homo sapiens
ggtgttatttgg

SEQ ID NO: 2476564 - DNA, 11 bp, Homo sapiens
ggtgttctaag

SEQ ID NO: 2476565 - DNA, 13 bp, Homo sapiens
ggtgttctaagat

SEQ ID NO: 2476566 - DNA, 22 bp, Homo sapiens
ggtgttgccaaatatgtcctgg

SEQ ID NO: 2476567 - DNA, 20 bp, Homo sapiens
ggtgttttgttcaccattat

SEQ ID NO: 2476568 - DNA, 13 bp, Homo sapiens
ggttagacctaca

SEQ ID NO: 2476569 - DNA, 15 bp, Homo sapiens
ggttagacctacagg

SEQ ID NO: 2476570 - DNA, 22 bp, Homo sapiens
ggttagacctacagggggtctg

SEQ ID NO: 2476571 - DNA, 19 bp, Homo sapiens
ggttcagaattaaactttt

SEQ ID NO: 2476572 - DNA, 22 bp, Homo sapiens
ggttctaaagttctaagattct

SEQ ID NO: 2476573 - DNA, 15 bp, Homo sapiens
ggttctaggtttcaa

SEQ ID NO: 2476574 - DNA, 21 bp, Homo sapiens
ggttctcaattccaacagttt

SEQ ID NO: 2476575 - DNA, 18 bp, Homo sapiens
ggttctcaggtgttgcca

SEQ ID NO: 2476576 - DNA, 20 bp, Homo sapiens
ggttctccgttagctcctgt

SEQ ID NO: 2476577 - DNA, 17 bp, Homo sapiens
ggttctgagatggctcc

SEQ ID NO: 2476578 - DNA, 19 bp, Homo sapiens
ggttctgcctgccagctgc

SEQ ID NO: 2476579 - DNA, 13 bp, Homo sapiens
ggttctggctgtt

SEQ ID NO: 2476580 - DNA, 20 bp, Homo sapiens
ggttcttgaggggaccagga

SEQ ID NO: 2476581 - DNA, 10 bp, Homo sapiens
ggttcttgtt

SEQ ID NO: 2476582 - DNA, 15 bp, Homo sapiens
ggttgaccccagagg

SEQ ID NO: 2476583 - DNA, 20 bp, Homo sapiens
ggttggctctgccagtcctg

SEQ ID NO: 2476584 - DNA, 19 bp, Homo sapiens
ggttgtttctgttccaaat

SEQ ID NO: 2476585 - DNA, 18 bp, Homo sapiens
ggtttaaagaaagtgtat

SEQ ID NO: 2476586 - DNA, 18 bp, Homo sapiens
ggtttactcactgctgca

SEQ ID NO: 2476587 - DNA, 18 bp, Homo sapiens
ggtttcaaagatgctgtg

SEQ ID NO: 2476588 - DNA, 20 bp, Homo sapiens
ggtttcaccatgttggccag

SEQ ID NO: 2476589 - DNA, 13 bp, Homo sapiens
ggtttcagcacta

SEQ ID NO: 2476590 - DNA, 16 bp, Homo sapiens
ggtttcatgttagtta

SEQ ID NO: 2476591 - DNA, 17 bp, Homo sapiens
ggtttctgccctgccca

SEQ ID NO: 2476592 - DNA, 18 bp, Homo sapiens
ggtttctgccctgcccac

SEQ ID NO: 2476593 - DNA, 15 bp, Homo sapiens
ggtttggtgtatggt

SEQ ID NO: 2476594 - DNA, 17 bp, Homo sapiens
ggttttaatttagtaaa

SEQ ID NO: 2476595 - DNA, 17 bp, Homo sapiens
ggttttataaggctgat

SEQ ID NO: 2476596 - DNA, 19 bp, Homo sapiens
ggttttgtattctctgagc

SEQ ID NO: 2476597 - DNA, 23 bp, Homo sapiens
gtaaaaaaaaaaaaaatgttctt

SEQ ID NO: 2476598 - DNA, 14 bp, Homo sapiens
gtctaagattctag

SEQ ID NO: 2476599 - DNA, 13 bp, Homo sapiens
gtctaccctggga

SEQ ID NO: 2476600 - DNA, 22 bp, Homo sapiens
gtctagatgtttattcttctag

SEQ ID NO: 2476601 - DNA, 12 bp, Homo sapiens
gtctagattctc

SEQ ID NO: 2476602 - DNA, 22 bp, Homo sapiens
gtctagtcacgcatgcagtgtt

SEQ ID NO: 2476603 - DNA, 13 bp, Homo sapiens
gtctataaagcat

SEQ ID NO: 2476604 - DNA, 22 bp, Homo sapiens
gtctcaaactcctgacctcagg

SEQ ID NO: 2476605 - DNA, 23 bp, Homo sapiens
gtctcacagtgttgcccaggctg

SEQ ID NO: 2476606 - DNA, 19 bp, Homo sapiens
gtctcagcccctttccctt

SEQ ID NO: 2476607 - DNA, 18 bp, Homo sapiens
gtctcaggctgcctgagt

SEQ ID NO: 2476608 - DNA, 19 bp, Homo sapiens
gtctcagtttgtgtgtctt

SEQ ID NO: 2476609 - DNA, 18 bp, Homo sapiens
gtctcatctcttcaggtt

SEQ ID NO: 2476610 - DNA, 22 bp, Homo sapiens
gtctcatctggggagcaggcag

SEQ ID NO: 2476611 - DNA, 15 bp, Homo sapiens
gtctccaggggctgc

SEQ ID NO: 2476612 - DNA, 20 bp, Homo sapiens
gtctccaggggctgcttcct

SEQ ID NO: 2476613 - DNA, 20 bp, Homo sapiens
gtctcccccaacagctggac

SEQ ID NO: 2476614 - DNA, 20 bp, Homo sapiens
gtctccctggatcagaacag

SEQ ID NO: 2476615 - DNA, 15 bp, Homo sapiens
gtctcgagcgccctg

SEQ ID NO: 2476616 - DNA, 23 bp, Homo sapiens
gtctcgagcgccctgcagaccct

SEQ ID NO: 2476617 - DNA, 16 bp, Homo sapiens
gtctcgctttgttgcc

SEQ ID NO: 2476618 - DNA, 12 bp, Homo sapiens
gtctctagagca

SEQ ID NO: 2476619 - DNA, 18 bp, Homo sapiens
gtctctctgggccttagg

SEQ ID NO: 2476620 - DNA, 16 bp, Homo sapiens
gtctctgctggcccag

SEQ ID NO: 2476621 - DNA, 22 bp, Homo sapiens
gtctcttatggatgtccccagc

SEQ ID NO: 2476622 - DNA, 21 bp, Homo sapiens
gtctcttccagtttgctttgc

SEQ ID NO: 2476623 - DNA, 14 bp, Homo sapiens
gtctcttgcctgcc

SEQ ID NO: 2476624 - DNA, 15 bp, Homo sapiens
gtctcttgcctgcca

SEQ ID NO: 2476625 - DNA, 16 bp, Homo sapiens
gtctcttgcctgccac

SEQ ID NO: 2476626 - DNA, 12 bp, Homo sapiens
gtctcttgcttg

SEQ ID NO: 2476627 - DNA, 18 bp, Homo sapiens
gtctcttttaccctggcc

SEQ ID NO: 2476628 - DNA, 22 bp, Homo sapiens
gtctcttttaccctggcccctc

SEQ ID NO: 2476629 - DNA, 23 bp, Homo sapiens
gtctcttttaccctggcccctct

SEQ ID NO: 2476630 - DNA, 14 bp, Homo sapiens
gtctcttttctctt

SEQ ID NO: 2476631 - DNA, 16 bp, Homo sapiens
gtctgaggtcctgagc

SEQ ID NO: 2476632 - DNA, 14 bp, Homo sapiens
gtctgccacccagg

SEQ ID NO: 2476633 - DNA, 17 bp, Homo sapiens
gtctgccccgccctcat

SEQ ID NO: 2476634 - DNA, 11 bp, Homo sapiens
gtctgcctctt

SEQ ID NO: 2476635 - DNA, 16 bp, Homo sapiens
gtctgctatcattatt

SEQ ID NO: 2476636 - DNA, 20 bp, Homo sapiens
gtctgctctttctctgccag

SEQ ID NO: 2476637 - DNA, 13 bp, Homo sapiens
gtctgctgtagaa

SEQ ID NO: 2476638 - DNA, 14 bp, Homo sapiens
gtctgctgtagaaa

SEQ ID NO: 2476639 - DNA, 23 bp, Homo sapiens
gtctggaagatggggaccagcag

SEQ ID NO: 2476640 - DNA, 14 bp, Homo sapiens
gtctggaagtccaa

SEQ ID NO: 2476641 - DNA, 17 bp, Homo sapiens
gtctggagaccaccagg

SEQ ID NO: 2476642 - DNA, 21 bp, Homo sapiens
gtctggagttgatctggaacc

SEQ ID NO: 2476643 - DNA, 18 bp, Homo sapiens
gtctggataacttccaca

SEQ ID NO: 2476644 - DNA, 23 bp, Homo sapiens
gtctggcaatgccacagccctgt

SEQ ID NO: 2476645 - DNA, 12 bp, Homo sapiens
gtctggcagcct

SEQ ID NO: 2476646 - DNA, 14 bp, Homo sapiens
gtctggctggtgtt

SEQ ID NO: 2476647 - DNA, 21 bp, Homo sapiens
gtctggctggtgttaacagaa

SEQ ID NO: 2476648 - DNA, 19 bp, Homo sapiens
gtctgggggcacaagactg

SEQ ID NO: 2476649 - DNA, 14 bp, Homo sapiens
gtctgggtggctca

SEQ ID NO: 2476650 - DNA, 20 bp, Homo sapiens
gtctgggtggggcccaggcc

SEQ ID NO: 2476651 - DNA, 14 bp, Homo sapiens
gtctggttctcaat

SEQ ID NO: 2476652 - DNA, 18 bp, Homo sapiens
gtctggttctcaattcca

SEQ ID NO: 2476653 - DNA, 19 bp, Homo sapiens
gtctgtaggttgcacactt

SEQ ID NO: 2476654 - DNA, 20 bp, Homo sapiens
gtctgtaggttgcacacttt

SEQ ID NO: 2476655 - DNA, 13 bp, Homo sapiens
gtctgtgcccctt

SEQ ID NO: 2476656 - DNA, 23 bp, Homo sapiens
gtctgtgccccttccgccactgg

SEQ ID NO: 2476657 - DNA, 13 bp, Homo sapiens
gtctgtggatttt

SEQ ID NO: 2476658 - DNA, 17 bp, Homo sapiens
gtctgtgttttgaaaga

SEQ ID NO: 2476659 - DNA, 18 bp, Homo sapiens
gtctgttctgtttcaagg

SEQ ID NO: 2476660 - DNA, 16 bp, Homo sapiens
gtctgttgattaaaga

SEQ ID NO: 2476661 - DNA, 14 bp, Homo sapiens
gtctgttggcaggc

SEQ ID NO: 2476662 - DNA, 19 bp, Homo sapiens
gtctgttggcaggctggcc

SEQ ID NO: 2476663 - DNA, 20 bp, Homo sapiens
gtctgttggcaggctggcca

SEQ ID NO: 2476664 - DNA, 12 bp, Homo sapiens
gtctgtttactg

SEQ ID NO: 2476665 - DNA, 17 bp, Homo sapiens
gtcttaaactaaatgtg

SEQ ID NO: 2476666 - DNA, 13 bp, Homo sapiens
gtcttaattatta

SEQ ID NO: 2476667 - DNA, 18 bp, Homo sapiens
gtcttaattattatttgt

SEQ ID NO: 2476668 - DNA, 19 bp, Homo sapiens
gtcttaattattatttgtg

SEQ ID NO: 2476669 - DNA, 21 bp, Homo sapiens
gtcttaattattatttgtgtt

SEQ ID NO: 2476670 - DNA, 20 bp, Homo sapiens
gtcttctccaacaccacctc

SEQ ID NO: 2476671 - DNA, 15 bp, Homo sapiens
gtcttctccctggaa

SEQ ID NO: 2476672 - DNA, 21 bp, Homo sapiens
gtcttgggcagagctggctct

SEQ ID NO: 2476673 - DNA, 15 bp, Homo sapiens
gtctttcacagctcc

SEQ ID NO: 2476674 - DNA, 19 bp, Homo sapiens
gtctttcccatggggaggg

SEQ ID NO: 2476675 - DNA, 21 bp, Homo sapiens
gtctttctctttccctggtcc

SEQ ID NO: 2476676 - DNA, 15 bp, Homo sapiens
gtctttggttctaag

SEQ ID NO: 2476677 - DNA, 17 bp, Homo sapiens
gtctttggttctaagga

SEQ ID NO: 2476678 - DNA, 14 bp, Homo sapiens
gtcttttgcttttg

SEQ ID NO: 2476679 - DNA, 22 bp, Homo sapiens
gtctttttttgtatagttaaca

SEQ ID NO: 2476680 - DNA, 12 bp, Homo sapiens
gtgaaaagaata

SEQ ID NO: 2476681 - DNA, 15 bp, Homo sapiens
gtgaaaatggtccag

SEQ ID NO: 2476682 - DNA, 14 bp, Homo sapiens
gtgaaactttcatt

SEQ ID NO: 2476683 - DNA, 20 bp, Homo sapiens
gtgaaatttacatcatttct

SEQ ID NO: 2476684 - DNA, 23 bp, Homo sapiens
gtgaagaatgcacaagaatggat

SEQ ID NO: 2476685 - DNA, 10 bp, Homo sapiens
gtgaagccaa

SEQ ID NO: 2476686 - DNA, 12 bp, Homo sapiens
gtgaagccttcc

SEQ ID NO: 2476687 - DNA, 13 bp, Homo sapiens
gtgaaggaccctt

SEQ ID NO: 2476688 - DNA, 14 bp, Homo sapiens
gtgaaggcttctct

SEQ ID NO: 2476689 - DNA, 23 bp, Homo sapiens
gtgaagttgctgcttctcccagg

SEQ ID NO: 2476690 - DNA, 13 bp, Homo sapiens
gtgaataaatgtc

SEQ ID NO: 2476691 - DNA, 15 bp, Homo sapiens
gtgaatacctgctca

SEQ ID NO: 2476692 - DNA, 19 bp, Homo sapiens
gtgaatactgctacagcaa

SEQ ID NO: 2476693 - DNA, 18 bp, Homo sapiens
gtgaatagccatatttgt

SEQ ID NO: 2476694 - DNA, 15 bp, Homo sapiens
gtgaatcaagggtca

SEQ ID NO: 2476695 - DNA, 20 bp, Homo sapiens
gtgaatgctgggactcagcc

SEQ ID NO: 2476696 - DNA, 21 bp, Homo sapiens
gtgaatgctgggactcagcct

SEQ ID NO: 2476697 - DNA, 21 bp, Homo sapiens
gtgaattaggctgtaactact

SEQ ID NO: 2476698 - DNA, 14 bp, Homo sapiens
gtgaattccctcac

SEQ ID NO: 2476699 - DNA, 21 bp, Homo sapiens
gtgacacaaacacacacaaaa

SEQ ID NO: 2476700 - DNA, 17 bp, Homo sapiens
gtgacagacaggctctt

SEQ ID NO: 2476701 - DNA, 19 bp, Homo sapiens
gtgacagggcgggggtggc

SEQ ID NO: 2476702 - DNA, 12 bp, Homo sapiens
gttcagccaagg

SEQ ID NO: 2476703 - DNA, 19 bp, Homo sapiens
gttcatatgtaccatgtac

SEQ ID NO: 2476704 - DNA, 22 bp, Homo sapiens
gttcatggcagatgtaggaggg

SEQ ID NO: 2476705 - DNA, 20 bp, Homo sapiens
gttcatgggggagggggcag

SEQ ID NO: 2476706 - DNA, 19 bp, Homo sapiens
gttcattagaaatatttta

SEQ ID NO: 2476707 - DNA, 13 bp, Homo sapiens
gttcatttgtgta

SEQ ID NO: 2476708 - DNA, 14 bp, Homo sapiens
gttccaaattcagt

SEQ ID NO: 2476709 - DNA, 14 bp, Homo sapiens
gttccactgagacc

SEQ ID NO: 2476710 - DNA, 17 bp, Homo sapiens
gttccagggtccctctg

SEQ ID NO: 2476711 - DNA, 19 bp, Homo sapiens
gttccagggtccctctgtg

SEQ ID NO: 2476712 - DNA, 17 bp, Homo sapiens
gttccattaaacgattt

SEQ ID NO: 2476713 - DNA, 18 bp, Homo sapiens
gttccccctgtttcagag

SEQ ID NO: 2476714 - DNA, 14 bp, Homo sapiens
gttcccgtttctcc

SEQ ID NO: 2476715 - DNA, 17 bp, Homo sapiens
gttccctctccctgttg

SEQ ID NO: 2476716 - DNA, 14 bp, Homo sapiens
gttcctagagaaga

SEQ ID NO: 2476717 - DNA, 23 bp, Homo sapiens
gttcctagtgatggcttatgata

SEQ ID NO: 2476718 - DNA, 23 bp, Homo sapiens
gttcctcccctccagctccctgt

SEQ ID NO: 2476719 - DNA, 14 bp, Homo sapiens
gttcctgctgctgt

SEQ ID NO: 2476720 - DNA, 16 bp, Homo sapiens
gttcctgtggctccct

SEQ ID NO: 2476721 - DNA, 13 bp, Homo sapiens
gttccttcccaat

SEQ ID NO: 2476722 - DNA, 14 bp, Homo sapiens
gttccttcccaatc

SEQ ID NO: 2476723 - DNA, 13 bp, Homo sapiens
gttcctttctttt

SEQ ID NO: 2476724 - DNA, 16 bp, Homo sapiens
gttcgcagccaccctg

SEQ ID NO: 2476725 - DNA, 19 bp, Homo sapiens
gttctaaaaattgtgatca

SEQ ID NO: 2476726 - DNA, 14 bp, Homo sapiens
gttctaaagctctg

SEQ ID NO: 2476727 - DNA, 12 bp, Homo sapiens
gttctaaagttc

SEQ ID NO: 2476728 - DNA, 20 bp, Homo sapiens
gttctaagactcaaatgttc

SEQ ID NO: 2476729 - DNA, 15 bp, Homo sapiens
gttctaagattctaa

SEQ ID NO: 2476730 - DNA, 20 bp, Homo sapiens
gttctaagattctaatgatg

SEQ ID NO: 2476731 - DNA, 13 bp, Homo sapiens
gttctaaggccta

SEQ ID NO: 2476732 - DNA, 20 bp, Homo sapiens
gttctaaggcctaggattct

SEQ ID NO: 2476733 - DNA, 13 bp, Homo sapiens
gttctaaggctct

SEQ ID NO: 2476734 - DNA, 17 bp, Homo sapiens
gttctaaggctctgaga

SEQ ID NO: 2476735 - DNA, 18 bp, Homo sapiens
gttctaagtttctaagat

SEQ ID NO: 2476736 - DNA, 19 bp, Homo sapiens
gttctaagtttctaagatt

SEQ ID NO: 2476737 - DNA, 12 bp, Homo sapiens
gttctagaaaaa

SEQ ID NO: 2476738 - DNA, 13 bp, Homo sapiens
gttctagaaaaac

SEQ ID NO: 2476739 - DNA, 22 bp, Homo sapiens
gttctagacatggaggttctaa

SEQ ID NO: 2476740 - DNA, 23 bp, Homo sapiens
gttctagacatggaggttctaag

SEQ ID NO: 2476741 - DNA, 17 bp, Homo sapiens
gttctagcgcagttttt

SEQ ID NO: 2476742 - DNA, 13 bp, Homo sapiens
gttctaggaaaat

SEQ ID NO: 2476743 - DNA, 15 bp, Homo sapiens
gttctatgcctttag

SEQ ID NO: 2476744 - DNA, 17 bp, Homo sapiens
gttctcaattccaacag

SEQ ID NO: 2476745 - DNA, 22 bp, Homo sapiens
gttctccaacatcacagcccag

SEQ ID NO: 2476746 - DNA, 22 bp, Homo sapiens
gttctccgttagctcctgtggc

SEQ ID NO: 2476747 - DNA, 22 bp, Homo sapiens
gttctcctgctgctccctcaga

SEQ ID NO: 2476748 - DNA, 22 bp, Homo sapiens
gttctccttttcctctctcccg

SEQ ID NO: 2476749 - DNA, 20 bp, Homo sapiens
gttctgctccagacagggaa

SEQ ID NO: 2476750 - DNA, 22 bp, Homo sapiens
gttctgctctggttgtttctgt

SEQ ID NO: 2476751 - DNA, 16 bp, Homo sapiens
gttctggctgtttgag

SEQ ID NO: 2476752 - DNA, 16 bp, Homo sapiens
gttctgtcccttgccc

SEQ ID NO: 2476753 - DNA, 21 bp, Homo sapiens
gttctgtggtttcatgttagt

SEQ ID NO: 2476754 - DNA, 13 bp, Homo sapiens
gttctgttaactg

SEQ ID NO: 2476755 - DNA, 14 bp, Homo sapiens
gttctgttaactga

SEQ ID NO: 2476756 - DNA, 12 bp, Homo sapiens
gttctgttttgt

SEQ ID NO: 2476757 - DNA, 16 bp, Homo sapiens
gttcttagctcaatga

SEQ ID NO: 2476758 - DNA, 13 bp, Homo sapiens
gttcttcctcagc

SEQ ID NO: 2476759 - DNA, 19 bp, Homo sapiens
gttcttcctcagccagcct

SEQ ID NO: 2476760 - DNA, 16 bp, Homo sapiens
gttcttgaggggacca

SEQ ID NO: 2476761 - DNA, 20 bp, Homo sapiens
gttcttgaggggaccaggag

SEQ ID NO: 2476762 - DNA, 21 bp, Homo sapiens
gttcttgaggggaccaggagt

SEQ ID NO: 2476763 - DNA, 22 bp, Homo sapiens
gttcttgaggggaccaggagtg

SEQ ID NO: 2476764 - DNA, 18 bp, Homo sapiens
gttcttgtaattttacac

SEQ ID NO: 2476765 - DNA, 14 bp, Homo sapiens
gttcttgttggtgc

SEQ ID NO: 2476766 - DNA, 20 bp, Homo sapiens
gttctttcatttgctttgga

SEQ ID NO: 2476767 - DNA, 15 bp, Homo sapiens
gttctttgggccaga

SEQ ID NO: 2476768 - DNA, 21 bp, Homo sapiens
gttgaaaggttttttttcagt

SEQ ID NO: 2476769 - DNA, 21 bp, Homo sapiens
gttgaattttttttaacattc

SEQ ID NO: 2476770 - DNA, 23 bp, Homo sapiens
gttgaattttttttaacattcct

SEQ ID NO: 2476771 - DNA, 14 bp, Homo sapiens
gttgaccccagagg

SEQ ID NO: 2476772 - DNA, 19 bp, Homo sapiens
gttgagaatcccaaatttg

SEQ ID NO: 2476773 - DNA, 14 bp, Homo sapiens
gttgaggccactgt

SEQ ID NO: 2476774 - DNA, 13 bp, Homo sapiens
gttgatactgttg

SEQ ID NO: 2476775 - DNA, 15 bp, Homo sapiens
gttgatactgttgca

SEQ ID NO: 2476776 - DNA, 16 bp, Homo sapiens
gttgatactgttgcac

SEQ ID NO: 2476777 - DNA, 18 bp, Homo sapiens
gttgatactgttgcacgt

SEQ ID NO: 2476778 - DNA, 15 bp, Homo sapiens
gttgatctggaaccc

SEQ ID NO: 2476779 - DNA, 16 bp, Homo sapiens
gttgatctggaaccca

SEQ ID NO: 2476780 - DNA, 22 bp, Homo sapiens
gttgatctggaacccagactca

SEQ ID NO: 2476781 - DNA, 16 bp, Homo sapiens
gttgattacagtgcag

SEQ ID NO: 2476782 - DNA, 22 bp, Homo sapiens
gttgatttttttttttttttcc

SEQ ID NO: 2476783 - DNA, 23 bp, Homo sapiens
gttgcacgtgtgtttttctatta

SEQ ID NO: 2476784 - DNA, 15 bp, Homo sapiens
gttgcagacaggaat

SEQ ID NO: 2476785 - DNA, 16 bp, Homo sapiens
gttgcagacaggaatc

SEQ ID NO: 2476786 - DNA, 16 bp, Homo sapiens
gttgcatgtagtaaca

SEQ ID NO: 2476787 - DNA, 16 bp, Homo sapiens
gttggagctcattctg

SEQ ID NO: 2476788 - DNA, 23 bp, Homo sapiens
gttggccatatttacctcagcct

SEQ ID NO: 2476789 - DNA, 19 bp, Homo sapiens
gttggcgtaggctacagag

SEQ ID NO: 2476790 - DNA, 22 bp, Homo sapiens
gttggcgtaggctacagagaag

SEQ ID NO: 2476791 - DNA, 24 bp, Homo sapiens
gttggcgtaggctacagagaagcc

SEQ ID NO: 2476792 - DNA, 19 bp, Homo sapiens
gttggctctgccagtcctg

SEQ ID NO: 2476793 - DNA, 14 bp, Homo sapiens
gttggcttacctgg

SEQ ID NO: 2476794 - DNA, 18 bp, Homo sapiens
gttgggactacaggcgtg

SEQ ID NO: 2476795 - DNA, 23 bp, Homo sapiens
gttgggagagggcgcaggccgtg

SEQ ID NO: 2476796 - DNA, 22 bp, Homo sapiens
gttgggatcaggggtaggaatg

SEQ ID NO: 2476797 - DNA, 22 bp, Homo sapiens
gttgggcagggtgaccctgaag

SEQ ID NO: 2476798 - DNA, 16 bp, Homo sapiens
gttggggtctggcagc

SEQ ID NO: 2476799 - DNA, 14 bp, Homo sapiens
gttgtaaattggca

SEQ ID NO: 2476800 - DNA, 17 bp, Homo sapiens
gttgtaacctgctgtga

SEQ ID NO: 2476801 - DNA, 18 bp, Homo sapiens
gttgtcaagaatagcatt

SEQ ID NO: 2476802 - DNA, 16 bp, Homo sapiens
gttgtcaccagatctg

SEQ ID NO: 2476803 - DNA, 14 bp, Homo sapiens
gttgtctaagaaat

SEQ ID NO: 2476804 - DNA, 14 bp, Homo sapiens
gttgtctctgatgc

SEQ ID NO: 2476805 - DNA, 15 bp, Homo sapiens
gttgtctctgatgca

SEQ ID NO: 2476806 - DNA, 19 bp, Homo sapiens
tacaaatcagaagtcatct

SEQ ID NO: 2476807 - DNA, 22 bp, Homo sapiens
tacaaatcagaagtcatcttgc

SEQ ID NO: 2476808 - DNA, 17 bp, Homo sapiens
tacaaatgttaaaatgt

SEQ ID NO: 2476809 - DNA, 23 bp, Homo sapiens
tacaaatgttaaaatgtgttgtt

SEQ ID NO: 2476810 - DNA, 17 bp, Homo sapiens
tacaactcatacactcg

SEQ ID NO: 2476811 - DNA, 23 bp, Homo sapiens
tacaactgcctcgaaacacagaa

SEQ ID NO: 2476812 - DNA, 24 bp, Homo sapiens
tacaagatgaaggagaggcaacat

SEQ ID NO: 2476813 - DNA, 17 bp, Homo sapiens
tacaagtatttttaatt

SEQ ID NO: 2476814 - DNA, 14 bp, Homo sapiens
tacaatgtaattat

SEQ ID NO: 2476815 - DNA, 19 bp, Homo sapiens
tacaattaattatcttttc

SEQ ID NO: 2476816 - DNA, 16 bp, Homo sapiens
tacaattcattgtgtt

SEQ ID NO: 2476817 - DNA, 13 bp, Homo sapiens
tacacaactcact

SEQ ID NO: 2476818 - DNA, 14 bp, Homo sapiens
tacacaactcactc

SEQ ID NO: 2476819 - DNA, 15 bp, Homo sapiens
tacacaactcactcc

SEQ ID NO: 2476820 - DNA, 16 bp, Homo sapiens
tacaccactctggcag

SEQ ID NO: 2476821 - DNA, 17 bp, Homo sapiens
tacaccactctggcagc

SEQ ID NO: 2476822 - DNA, 19 bp, Homo sapiens
tacaccactctggcagcca

SEQ ID NO: 2476823 - DNA, 18 bp, Homo sapiens
tacacctattatcccagc

SEQ ID NO: 2476824 - DNA, 17 bp, Homo sapiens
tacacgcttttgtgatg

SEQ ID NO: 2476825 - DNA, 13 bp, Homo sapiens
tacactctgctgt

SEQ ID NO: 2476826 - DNA, 17 bp, Homo sapiens
tacagaactctttcaaa

SEQ ID NO: 2476827 - DNA, 19 bp, Homo sapiens
tacagagaaaccagcttcc

SEQ ID NO: 2476828 - DNA, 20 bp, Homo sapiens
tacagagaaaccagcttcct

SEQ ID NO: 2476829 - DNA, 13 bp, Homo sapiens
tacagagaagcca

SEQ ID NO: 2476830 - DNA, 14 bp, Homo sapiens
tacagagaagccag

SEQ ID NO: 2476831 - DNA, 18 bp, Homo sapiens
tacagagaagccagcttg

SEQ ID NO: 2476832 - DNA, 19 bp, Homo sapiens
tacagagaagccagcttgt

SEQ ID NO: 2476833 - DNA, 18 bp, Homo sapiens
tacagagaagccatcacc

SEQ ID NO: 2476834 - DNA, 22 bp, Homo sapiens
tacagagaagccatcacctcag

SEQ ID NO: 2476835 - DNA, 17 bp, Homo sapiens
tacagagaagccttcaa

SEQ ID NO: 2476836 - DNA, 24 bp, Homo sapiens
tacagagaagccttcaagctctga

SEQ ID NO: 2476837 - DNA, 13 bp, Homo sapiens
tacagagaagtca

SEQ ID NO: 2476838 - DNA, 20 bp, Homo sapiens
tacagagaagtcacagggca

SEQ ID NO: 2476839 - DNA, 15 bp, Homo sapiens
tacagagcacatttg

SEQ ID NO: 2476840 - DNA, 15 bp, Homo sapiens
tacaggaaacagttg

SEQ ID NO: 2476841 - DNA, 14 bp, Homo sapiens
tacagggggtctgg

SEQ ID NO: 2476842 - DNA, 16 bp, Homo sapiens
tacagggggtctggct

SEQ ID NO: 2476843 - DNA, 19 bp, Homo sapiens
tacagggggtctggctggt

SEQ ID NO: 2476844 - DNA, 21 bp, Homo sapiens
tacagggggtctggctggtgt

SEQ ID NO: 2476845 - DNA, 22 bp, Homo sapiens
tacaggtgtgtgccaccacacc

SEQ ID NO: 2476846 - DNA, 20 bp, Homo sapiens
tacagtatgggggttgtaaa

SEQ ID NO: 2476847 - DNA, 22 bp, Homo sapiens
tacagtatgggggttgtaaatt

SEQ ID NO: 2476848 - DNA, 22 bp, Homo sapiens
tacagtcttccatttgcaaggg

SEQ ID NO: 2476849 - DNA, 19 bp, Homo sapiens
tacagtcttcttacttgga

SEQ ID NO: 2476850 - DNA, 13 bp, Homo sapiens
tacagtgtctttt

SEQ ID NO: 2476851 - DNA, 15 bp, Homo sapiens
tacagtgtttatcct

SEQ ID NO: 2476852 - DNA, 14 bp, Homo sapiens
tacagttctgtggt

SEQ ID NO: 2476853 - DNA, 19 bp, Homo sapiens
tacagttttaactgtggat

SEQ ID NO: 2476854 - DNA, 15 bp, Homo sapiens
tacataattcactct

SEQ ID NO: 2476855 - DNA, 12 bp, Homo sapiens
tacatacagaat

SEQ ID NO: 2476856 - DNA, 20 bp, Homo sapiens
tacataccacgctagggctg

SEQ ID NO: 2476857 - DNA, 23 bp, Homo sapiens
tacataccacgctagggctggct

SEQ ID NO: 2476858 - DNA, 22 bp, Homo sapiens
tacataccctggccgccccctg

SEQ ID NO: 2476859 - DNA, 17 bp, Homo sapiens
tacatagtgctgctgtg

SEQ ID NO: 2476860 - DNA, 23 bp, Homo sapiens
tacatccaaagcagacagctcca

SEQ ID NO: 2476861 - DNA, 13 bp, Homo sapiens
tacatgaagtatt

SEQ ID NO: 2476862 - DNA, 21 bp, Homo sapiens
tacatgaagtattttttcagt

SEQ ID NO: 2476863 - DNA, 17 bp, Homo sapiens
tacatgagaacaaacag

SEQ ID NO: 2476864 - DNA, 18 bp, Homo sapiens
tacatgagaacaaacaga

SEQ ID NO: 2476865 - DNA, 16 bp, Homo sapiens
tacatgagaaggaact

SEQ ID NO: 2476866 - DNA, 15 bp, Homo sapiens
tacatgtattgcaca

SEQ ID NO: 2476867 - DNA, 22 bp, Homo sapiens
tacatgtattgcacattgtaaa

SEQ ID NO: 2476868 - DNA, 13 bp, Homo sapiens
tacattcatttag

SEQ ID NO: 2476869 - DNA, 23 bp, Homo sapiens
tacattgtgggatgttcagcact

SEQ ID NO: 2476870 - DNA, 13 bp, Homo sapiens
tacattgttgagc

SEQ ID NO: 2476871 - DNA, 23 bp, Homo sapiens
tacattgttgagctattgctgtt

SEQ ID NO: 2476872 - DNA, 16 bp, Homo sapiens
tacatttaaaacatta

SEQ ID NO: 2476873 - DNA, 20 bp, Homo sapiens
tacatttaaaacattaaaat

SEQ ID NO: 2476874 - DNA, 15 bp, Homo sapiens
tacatttacaaactg

SEQ ID NO: 2476875 - DNA, 22 bp, Homo sapiens
tacatttctcaggctaggccag

SEQ ID NO: 2476876 - DNA, 19 bp, Homo sapiens
tacatttgggagtttttat

SEQ ID NO: 2476877 - DNA, 21 bp, Homo sapiens
tacatttgggagtttttatga

SEQ ID NO: 2476878 - DNA, 19 bp, Homo sapiens
tacattttctaagaaacat

SEQ ID NO: 2476879 - DNA, 15 bp, Homo sapiens
taccaatcattttaa

SEQ ID NO: 2476880 - DNA, 13 bp, Homo sapiens
taccaatgaaaaa

SEQ ID NO: 2476881 - DNA, 15 bp, Homo sapiens
taccacctttactgt

SEQ ID NO: 2476882 - DNA, 16 bp, Homo sapiens
taccactctgtaattg

SEQ ID NO: 2476883 - DNA, 15 bp, Homo sapiens
taccagcgaggaggc

SEQ ID NO: 2476884 - DNA, 18 bp, Homo sapiens
taccaggcaccaaaagaa

SEQ ID NO: 2476885 - DNA, 20 bp, Homo sapiens
taccagtatttagaagccaa

SEQ ID NO: 2476886 - DNA, 18 bp, Homo sapiens
taccagttaatttttcca

SEQ ID NO: 2476887 - DNA, 19 bp, Homo sapiens
taccagttaatttttccaa

SEQ ID NO: 2476888 - DNA, 15 bp, Homo sapiens
taccatgtaatggca

SEQ ID NO: 2476889 - DNA, 18 bp, Homo sapiens
taccatgtaatggcagtt

SEQ ID NO: 2476890 - DNA, 14 bp, Homo sapiens
taccatgtctttct

SEQ ID NO: 2476891 - DNA, 18 bp, Homo sapiens
taccattttaaagttagt

SEQ ID NO: 2476892 - DNA, 14 bp, Homo sapiens
tacccaaactgctt

SEQ ID NO: 2476893 - DNA, 22 bp, Homo sapiens
tacccaccgggccactccttcc

SEQ ID NO: 2476894 - DNA, 22 bp, Homo sapiens
tacccagtttctaaactggaga

SEQ ID NO: 2476895 - DNA, 23 bp, Homo sapiens
tacccagtttctaaactggagac

SEQ ID NO: 2476896 - DNA, 21 bp, Homo sapiens
tacccgtgtctagaggcaggt

SEQ ID NO: 2476897 - DNA, 12 bp, Homo sapiens
taccctcctggc

SEQ ID NO: 2476898 - DNA, 15 bp, Homo sapiens
taccctctcagctcc

SEQ ID NO: 2476899 - DNA, 16 bp, Homo sapiens
taccctctcagctcca

SEQ ID NO: 2476900 - DNA, 13 bp, Homo sapiens
taccctctgaaat

SEQ ID NO: 2476901 - DNA, 12 bp, Homo sapiens
taccctctggag

SEQ ID NO: 2476902 - DNA, 14 bp, Homo sapiens
taccctctggaggg

SEQ ID NO: 2476903 - DNA, 22 bp, Homo sapiens
taccctcttcatggatggggga

SEQ ID NO: 2476904 - DNA, 14 bp, Homo sapiens
taccctgacctggc

SEQ ID NO: 2476905 - DNA, 16 bp, Homo sapiens
taccctggcccctctc

SEQ ID NO: 2476906 - DNA, 19 bp, Homo sapiens
taccctggcccctctccct

SEQ ID NO: 2476907 - DNA, 17 bp, Homo sapiens
taccctttttctccagc

SEQ ID NO: 2476908 - DNA, 14 bp, Homo sapiens
taccgaatgtgtct

SEQ ID NO: 2476909 - DNA, 22 bp, Homo sapiens
tacctaaaaggaaatctcaccc

SEQ ID NO: 2476910 - DNA, 21 bp, Homo sapiens
tataaaatatgaagacataaa

SEQ ID NO: 2476911 - DNA, 19 bp, Homo sapiens
tataaacaagaaaaataaa

SEQ ID NO: 2476912 - DNA, 20 bp, Homo sapiens
tataaacaagaaaaataaag

SEQ ID NO: 2476913 - DNA, 14 bp, Homo sapiens
tataaagaattgtg

SEQ ID NO: 2476914 - DNA, 17 bp, Homo sapiens
tataaagacgttttata

SEQ ID NO: 2476915 - DNA, 12 bp, Homo sapiens
tataaagcagta

SEQ ID NO: 2476916 - DNA, 18 bp, Homo sapiens
tataaagttttatatatt

SEQ ID NO: 2476917 - DNA, 21 bp, Homo sapiens
tataaagttttatatattata

SEQ ID NO: 2476918 - DNA, 18 bp, Homo sapiens
tataaatactgcaaatca

SEQ ID NO: 2476919 - DNA, 15 bp, Homo sapiens
tataaatatatttaa

SEQ ID NO: 2476920 - DNA, 17 bp, Homo sapiens
tataaatgcaaataaca

SEQ ID NO: 2476921 - DNA, 17 bp, Homo sapiens
tataaatgtctttaatg

SEQ ID NO: 2476922 - DNA, 14 bp, Homo sapiens
tataactaacatgt

SEQ ID NO: 2476923 - DNA, 13 bp, Homo sapiens
tataagaagcctt

SEQ ID NO: 2476924 - DNA, 22 bp, Homo sapiens
tataagaagccttaatttgcac

SEQ ID NO: 2476925 - DNA, 18 bp, Homo sapiens
tataagatcctagatcct

SEQ ID NO: 2476926 - DNA, 15 bp, Homo sapiens
tataagcatcattat

SEQ ID NO: 2476927 - DNA, 21 bp, Homo sapiens
tataagcatcattatttatgt

SEQ ID NO: 2476928 - DNA, 17 bp, Homo sapiens
tataatcatcaagtaat

SEQ ID NO: 2476929 - DNA, 18 bp, Homo sapiens
tataattggatttcctaa

SEQ ID NO: 2476930 - DNA, 19 bp, Homo sapiens
tataattggatttcctaat

SEQ ID NO: 2476931 - DNA, 22 bp, Homo sapiens
tataattggatttcctaatact

SEQ ID NO: 2476932 - DNA, 20 bp, Homo sapiens
tatacagctgtattgtctga

SEQ ID NO: 2476933 - DNA, 12 bp, Homo sapiens
tatacctgtgtt

SEQ ID NO: 2476934 - DNA, 23 bp, Homo sapiens
tatacctgtgtttcttgcctcat

SEQ ID NO: 2476935 - DNA, 16 bp, Homo sapiens
tatactatatttatgg

SEQ ID NO: 2476936 - DNA, 18 bp, Homo sapiens
tatactctagatgaagtt

SEQ ID NO: 2476937 - DNA, 16 bp, Homo sapiens
tatactctttctgtat

SEQ ID NO: 2476938 - DNA, 22 bp, Homo sapiens
tatactctttctgtatatactt

SEQ ID NO: 2476939 - DNA, 23 bp, Homo sapiens
tatactgcttggagctgagcaaa

SEQ ID NO: 2476940 - DNA, 14 bp, Homo sapiens
tatacttgaatgaa

SEQ ID NO: 2476941 - DNA, 22 bp, Homo sapiens
tatacttgtaattatggagtca

SEQ ID NO: 2476942 - DNA, 22 bp, Homo sapiens
tatagatgggggaaagcaaagc

SEQ ID NO: 2476943 - DNA, 14 bp, Homo sapiens
tatagatgtctttt

SEQ ID NO: 2476944 - DNA, 14 bp, Homo sapiens
tatagattctaaag

SEQ ID NO: 2476945 - DNA, 15 bp, Homo sapiens
tatagattctaaaga

SEQ ID NO: 2476946 - DNA, 18 bp, Homo sapiens
tatagccaaaaatagcta

SEQ ID NO: 2476947 - DNA, 18 bp, Homo sapiens
tatagtgatgtaatcttg

SEQ ID NO: 2476948 - DNA, 15 bp, Homo sapiens
tatagttaacacact

SEQ ID NO: 2476949 - DNA, 13 bp, Homo sapiens
tatagttactgtg

SEQ ID NO: 2476950 - DNA, 15 bp, Homo sapiens
tatagttctagacat

SEQ ID NO: 2476951 - DNA, 12 bp, Homo sapiens
tatagttctagg

SEQ ID NO: 2476952 - DNA, 12 bp, Homo sapiens
tatataaagaaa

SEQ ID NO: 2476953 - DNA, 19 bp, Homo sapiens
tatataaatatattattac

SEQ ID NO: 2476954 - DNA, 23 bp, Homo sapiens
tatataagtgtacatatgtgctg

SEQ ID NO: 2476955 - DNA, 17 bp, Homo sapiens
tatatattatatggaaa

SEQ ID NO: 2476956 - DNA, 15 bp, Homo sapiens
tatatatttaaaagt

SEQ ID NO: 2476957 - DNA, 19 bp, Homo sapiens
tatatatttaaaagtgtca

SEQ ID NO: 2476958 - DNA, 19 bp, Homo sapiens
tatatcacatgttttctct

SEQ ID NO: 2476959 - DNA, 21 bp, Homo sapiens
tatatctaccccagactagat

SEQ ID NO: 2476960 - DNA, 13 bp, Homo sapiens
tatatctggcctc

SEQ ID NO: 2476961 - DNA, 22 bp, Homo sapiens
tatatggaaatatatattatac

SEQ ID NO: 2476962 - DNA, 18 bp, Homo sapiens
tatatgtaccctctgaaa

SEQ ID NO: 2476963 - DNA, 19 bp, Homo sapiens
tatattatatggaaatata

SEQ ID NO: 2476964 - DNA, 16 bp, Homo sapiens
tatattgataagatct

SEQ ID NO: 2476965 - DNA, 23 bp, Homo sapiens
tatatttctattttattatgaag

SEQ ID NO: 2476966 - DNA, 22 bp, Homo sapiens
tatatttgggcctgctccagac

SEQ ID NO: 2476967 - DNA, 15 bp, Homo sapiens
tatattttagcattt

SEQ ID NO: 2476968 - DNA, 14 bp, Homo sapiens
tatattttctgttt

SEQ ID NO: 2476969 - DNA, 15 bp, Homo sapiens
tatattttctttctc

SEQ ID NO: 2476970 - DNA, 19 bp, Homo sapiens
tatcaaacaccaacataaa

SEQ ID NO: 2476971 - DNA, 23 bp, Homo sapiens
tatcaaacaccaacataaaaatg

SEQ ID NO: 2476972 - DNA, 17 bp, Homo sapiens
tatcaaaccctagcctt

SEQ ID NO: 2476973 - DNA, 20 bp, Homo sapiens
tatcaaaccctagccttgct

SEQ ID NO: 2476974 - DNA, 21 bp, Homo sapiens
tatcaaaccctagccttgctt

SEQ ID NO: 2476975 - DNA, 23 bp, Homo sapiens
tatcaaaccctagccttgcttgt

SEQ ID NO: 2476976 - DNA, 23 bp, Homo sapiens
tatcaaatacatttaaaacatta

SEQ ID NO: 2476977 - DNA, 14 bp, Homo sapiens
tatcacacaaagca

SEQ ID NO: 2476978 - DNA, 16 bp, Homo sapiens
tatcacacaaagcaga

SEQ ID NO: 2476979 - DNA, 12 bp, Homo sapiens
tatcacatgttt

SEQ ID NO: 2476980 - DNA, 20 bp, Homo sapiens
tatcacccagacataaagga

SEQ ID NO: 2476981 - DNA, 16 bp, Homo sapiens
tatcacctagctgaat

SEQ ID NO: 2476982 - DNA, 18 bp, Homo sapiens
tatcactgaagcttttta

SEQ ID NO: 2476983 - DNA, 16 bp, Homo sapiens
tatcacttaaacttgc

SEQ ID NO: 2476984 - DNA, 22 bp, Homo sapiens
tatcacttaaacttgcatcact

SEQ ID NO: 2476985 - DNA, 21 bp, Homo sapiens
tatcaggacccagaggaaggg

SEQ ID NO: 2476986 - DNA, 22 bp, Homo sapiens
tatcagtcataactaaataaag

SEQ ID NO: 2476987 - DNA, 23 bp, Homo sapiens
tatcatcagtgtagaacctaatt

SEQ ID NO: 2476988 - DNA, 16 bp, Homo sapiens
tatcatctacctagat

SEQ ID NO: 2476989 - DNA, 16 bp, Homo sapiens
tatcatgagtgaataa

SEQ ID NO: 2476990 - DNA, 14 bp, Homo sapiens
tatcatgccctgtg

SEQ ID NO: 2476991 - DNA, 19 bp, Homo sapiens
tatcattgcttcctcctcc

SEQ ID NO: 2476992 - DNA, 18 bp, Homo sapiens
tatccaggtaatccaaga

SEQ ID NO: 2476993 - DNA, 15 bp, Homo sapiens
tatccccccatcttg

SEQ ID NO: 2476994 - DNA, 19 bp, Homo sapiens
tatccccccatcttgcttc

SEQ ID NO: 2476995 - DNA, 11 bp, Homo sapiens
tatcctccctg

SEQ ID NO: 2476996 - DNA, 15 bp, Homo sapiens
tatcctccctgtaac

SEQ ID NO: 2476997 - DNA, 12 bp, Homo sapiens
tatcctctgtaa

SEQ ID NO: 2476998 - DNA, 21 bp, Homo sapiens
tatcctgtttgaggaaagcaa

SEQ ID NO: 2476999 - DNA, 18 bp, Homo sapiens
tatcgttttcttaaagtg

SEQ ID NO: 2477000 - DNA, 13 bp, Homo sapiens
tatctataattta

SEQ ID NO: 2477001 - DNA, 14 bp, Homo sapiens
tatctataatttac

SEQ ID NO: 2477002 - DNA, 19 bp, Homo sapiens
tatctcagaaagtgcctga

SEQ ID NO: 2477003 - DNA, 18 bp, Homo sapiens
tatctccagcggccctgt

SEQ ID NO: 2477004 - DNA, 22 bp, Homo sapiens
tatctccctgcctcctgccggc

SEQ ID NO: 2477005 - DNA, 20 bp, Homo sapiens
tatctctactgaatgtcatt

SEQ ID NO: 2477006 - DNA, 12 bp, Homo sapiens
tatctctgtgtt

SEQ ID NO: 2477007 - DNA, 20 bp, Homo sapiens
tatctgaatttttaaacaag

SEQ ID NO: 2477008 - DNA, 20 bp, Homo sapiens
tatcttctcaagttctaaga

SEQ ID NO: 2477009 - DNA, 21 bp, Homo sapiens
tatcttctcaagttctaagat

SEQ ID NO: 2477010 - DNA, 21 bp, Homo sapiens
tatcttttcatacattttcta

SEQ ID NO: 2477011 - DNA, 18 bp, Homo sapiens
tatctttttacctttcat

SEQ ID NO: 2477012 - DNA, 14 bp, Homo sapiens
tatgaaaaagaaga

SEQ ID NO: 2477013 - DNA, 23 bp, Homo sapiens
tcactaggcccccacttgcctct

SEQ ID NO: 2477014 - DNA, 16 bp, Homo sapiens
tcactcgtctccccca

SEQ ID NO: 2477015 - DNA, 20 bp, Homo sapiens
tcactctgagtgttttatga

SEQ ID NO: 2477016 - DNA, 20 bp, Homo sapiens
tcactgcaacatgatgaggt

SEQ ID NO: 2477017 - DNA, 15 bp, Homo sapiens
tcactggagcacaat

SEQ ID NO: 2477018 - DNA, 16 bp, Homo sapiens
tcactggagcacaata

SEQ ID NO: 2477019 - DNA, 12 bp, Homo sapiens
tcactggctctc

SEQ ID NO: 2477020 - DNA, 17 bp, Homo sapiens
tcactggctctcctggc

SEQ ID NO: 2477021 - DNA, 18 bp, Homo sapiens
tcactggctctcctggcc

SEQ ID NO: 2477022 - DNA, 20 bp, Homo sapiens
tcactgtctttaattctgta

SEQ ID NO: 2477023 - DNA, 21 bp, Homo sapiens
tcacttcaggtatacctcact

SEQ ID NO: 2477024 - DNA, 19 bp, Homo sapiens
tcacttgtcaggagtgtgt

SEQ ID NO: 2477025 - DNA, 21 bp, Homo sapiens
tcacttgtcaggagtgtgtgt

SEQ ID NO: 2477026 - DNA, 21 bp, Homo sapiens
tcactttacacaatagaatta

SEQ ID NO: 2477027 - DNA, 14 bp, Homo sapiens
tcacttttcccact

SEQ ID NO: 2477028 - DNA, 15 bp, Homo sapiens
tcacttttcccactc

SEQ ID NO: 2477029 - DNA, 13 bp, Homo sapiens
tcactttttctga

SEQ ID NO: 2477030 - DNA, 14 bp, Homo sapiens
tcactttttctgat

SEQ ID NO: 2477031 - DNA, 16 bp, Homo sapiens
tcactttttctgataa

SEQ ID NO: 2477032 - DNA, 16 bp, Homo sapiens
tcactttttgaggcaa

SEQ ID NO: 2477033 - DNA, 22 bp, Homo sapiens
tcactttttgaggcaaaagaag

SEQ ID NO: 2477034 - DNA, 15 bp, Homo sapiens
tcagaaaatgttctg

SEQ ID NO: 2477035 - DNA, 17 bp, Homo sapiens
tcagaaaggaaaaacaa

SEQ ID NO: 2477036 - DNA, 23 bp, Homo sapiens
tcagaaagggagggctctgaggc

SEQ ID NO: 2477037 - DNA, 15 bp, Homo sapiens
tcagaactagaattt

SEQ ID NO: 2477038 - DNA, 17 bp, Homo sapiens
tcagaagaaaaagaagc

SEQ ID NO: 2477039 - DNA, 13 bp, Homo sapiens
tcagaagcctggg

SEQ ID NO: 2477040 - DNA, 19 bp, Homo sapiens
tcagaagcctgggggcctg

SEQ ID NO: 2477041 - DNA, 20 bp, Homo sapiens
tcagaagcctgggggcctgg

SEQ ID NO: 2477042 - DNA, 23 bp, Homo sapiens
tcagaagcctgggggcctggctg

SEQ ID NO: 2477043 - DNA, 18 bp, Homo sapiens
tcagaagtcatcttgcta

SEQ ID NO: 2477044 - DNA, 22 bp, Homo sapiens
tcagaagtcatcttgctaccag

SEQ ID NO: 2477045 - DNA, 23 bp, Homo sapiens
tcagaatagccacatttggaata

SEQ ID NO: 2477046 - DNA, 18 bp, Homo sapiens
tcagaatcccttaacagt

SEQ ID NO: 2477047 - DNA, 14 bp, Homo sapiens
tcagaatgtcattt

SEQ ID NO: 2477048 - DNA, 16 bp, Homo sapiens
tcagaattaaactttt

SEQ ID NO: 2477049 - DNA, 18 bp, Homo sapiens
tcagaattaaacttttaa

SEQ ID NO: 2477050 - DNA, 14 bp, Homo sapiens
tcagaatttagtgt

SEQ ID NO: 2477051 - DNA, 22 bp, Homo sapiens
tcagaattttatactttcccta

SEQ ID NO: 2477052 - DNA, 22 bp, Homo sapiens
tcagacagagaggactgtaggg

SEQ ID NO: 2477053 - DNA, 14 bp, Homo sapiens
tcagaccacggctc

SEQ ID NO: 2477054 - DNA, 15 bp, Homo sapiens
tcagaccataatgtt

SEQ ID NO: 2477055 - DNA, 14 bp, Homo sapiens
tcagaccctggagg

SEQ ID NO: 2477056 - DNA, 17 bp, Homo sapiens
tcagacgcctgaggaac

SEQ ID NO: 2477057 - DNA, 15 bp, Homo sapiens
tcagactaagccagc

SEQ ID NO: 2477058 - DNA, 21 bp, Homo sapiens
tcagactcccattcctgaaga

SEQ ID NO: 2477059 - DNA, 17 bp, Homo sapiens
tcagactctaagaaaga

SEQ ID NO: 2477060 - DNA, 18 bp, Homo sapiens
tcagactctaagaaagaa

SEQ ID NO: 2477061 - DNA, 14 bp, Homo sapiens
tcagactgtttagt

SEQ ID NO: 2477062 - DNA, 14 bp, Homo sapiens
tcagagaaggaaca

SEQ ID NO: 2477063 - DNA, 19 bp, Homo sapiens
tcagagacatcagcccttg

SEQ ID NO: 2477064 - DNA, 16 bp, Homo sapiens
tcagagaccagggctc

SEQ ID NO: 2477065 - DNA, 18 bp, Homo sapiens
tcagagagcagtgctttt

SEQ ID NO: 2477066 - DNA, 21 bp, Homo sapiens
tcagagatgcaccaccaagcc

SEQ ID NO: 2477067 - DNA, 21 bp, Homo sapiens
tcagaggccctcgctgccagc

SEQ ID NO: 2477068 - DNA, 18 bp, Homo sapiens
tcagagtccttaaaatgt

SEQ ID NO: 2477069 - DNA, 20 bp, Homo sapiens
tcagagtgactacacacagt

SEQ ID NO: 2477070 - DNA, 22 bp, Homo sapiens
tcagataaggtaaaatgccatg

SEQ ID NO: 2477071 - DNA, 23 bp, Homo sapiens
tcagataaggtaaaatgccatga

SEQ ID NO: 2477072 - DNA, 23 bp, Homo sapiens
tcagatcagtgtaccatttgcct

SEQ ID NO: 2477073 - DNA, 15 bp, Homo sapiens
tcagatccaggagct

SEQ ID NO: 2477074 - DNA, 18 bp, Homo sapiens
tcagatccaggagctcca

SEQ ID NO: 2477075 - DNA, 14 bp, Homo sapiens
tcagatccagggac

SEQ ID NO: 2477076 - DNA, 15 bp, Homo sapiens
tcagatcctcctcat

SEQ ID NO: 2477077 - DNA, 18 bp, Homo sapiens
tcagatcggccacagggc

SEQ ID NO: 2477078 - DNA, 19 bp, Homo sapiens
tcagatgctccaagattct

SEQ ID NO: 2477079 - DNA, 14 bp, Homo sapiens
tcagattttttcct

SEQ ID NO: 2477080 - DNA, 12 bp, Homo sapiens
tcagcactgtcc

SEQ ID NO: 2477081 - DNA, 13 bp, Homo sapiens
tcagcactgtccc

SEQ ID NO: 2477082 - DNA, 14 bp, Homo sapiens
tcagcactgtccct

SEQ ID NO: 2477083 - DNA, 17 bp, Homo sapiens
tcagcatgaatttgtaa

SEQ ID NO: 2477084 - DNA, 11 bp, Homo sapiens
tcagcatttga

SEQ ID NO: 2477085 - DNA, 22 bp, Homo sapiens
tcagccaaggttttataaggct

SEQ ID NO: 2477086 - DNA, 23 bp, Homo sapiens
tcagccaaggttttataaggctg

SEQ ID NO: 2477087 - DNA, 23 bp, Homo sapiens
tcagccagcacttgtccagctga

SEQ ID NO: 2477088 - DNA, 12 bp, Homo sapiens
tcagccagcctc

SEQ ID NO: 2477089 - DNA, 18 bp, Homo sapiens
tcagccccaccccagggc

SEQ ID NO: 2477090 - DNA, 23 bp, Homo sapiens
tcagccccaccccagggcagcca

SEQ ID NO: 2477091 - DNA, 18 bp, Homo sapiens
tcagccccaccctggcct

SEQ ID NO: 2477092 - DNA, 19 bp, Homo sapiens
tcagccctagggtggagag

SEQ ID NO: 2477093 - DNA, 23 bp, Homo sapiens
tcagccctagggtggagagccac

SEQ ID NO: 2477094 - DNA, 15 bp, Homo sapiens
tcagccctgcaccat

SEQ ID NO: 2477095 - DNA, 20 bp, Homo sapiens
tcagcctcctgagtagctgg

SEQ ID NO: 2477096 - DNA, 14 bp, Homo sapiens
tcagcctggccaga

SEQ ID NO: 2477097 - DNA, 16 bp, Homo sapiens
tcagcctggccagaca

SEQ ID NO: 2477098 - DNA, 17 bp, Homo sapiens
tcagcctggccagacac

SEQ ID NO: 2477099 - DNA, 19 bp, Homo sapiens
tcagcctggccagacacag

SEQ ID NO: 2477100 - DNA, 14 bp, Homo sapiens
tcagcctgtaccgg

SEQ ID NO: 2477101 - DNA, 17 bp, Homo sapiens
tcagccttaagaaccat

SEQ ID NO: 2477102 - DNA, 20 bp, Homo sapiens
tcagcgctgtcaggattgcg

SEQ ID NO: 2477103 - DNA, 21 bp, Homo sapiens
tcagcgctgtcaggattgcga

SEQ ID NO: 2477104 - DNA, 23 bp, Homo sapiens
tcagcgtggaggggtaggggctg

SEQ ID NO: 2477105 - DNA, 15 bp, Homo sapiens
tcagctaagctcacg

SEQ ID NO: 2477106 - DNA, 11 bp, Homo sapiens
tcagctcctga

SEQ ID NO: 2477107 - DNA, 15 bp, Homo sapiens
tcagctccttcctgg

SEQ ID NO: 2477108 - DNA, 17 bp, Homo sapiens
tcagctccttcctggag

SEQ ID NO: 2477109 - DNA, 18 bp, Homo sapiens
tcagctgcattccgcagc

SEQ ID NO: 2477110 - DNA, 21 bp, Homo sapiens
tcagctttctttaaagttctt

SEQ ID NO: 2477111 - DNA, 18 bp, Homo sapiens
tcaggaaaaggcctgggg

SEQ ID NO: 2477112 - DNA, 12 bp, Homo sapiens
tcaggaaaattg

SEQ ID NO: 2477113 - DNA, 18 bp, Homo sapiens
tcaggaatattttccaaa

SEQ ID NO: 2477114 - DNA, 16 bp, Homo sapiens
tcaggacacaggcctg

SEQ ID NO: 2477115 - DNA, 18 bp, Homo sapiens
tcaggacacaggcctgtg

SEQ ID NO: 2477116 - DNA, 23 bp, Homo sapiens
tcaggacacaggcctgtgtagct

SEQ ID NO: 2477117 - DNA, 23 bp, Homo sapiens
tcccttgggcacgtgtgctggga

SEQ ID NO: 2477118 - DNA, 17 bp, Homo sapiens
tcccttgggctctgatg

SEQ ID NO: 2477119 - DNA, 16 bp, Homo sapiens
tcccttgtagctcctc

SEQ ID NO: 2477120 - DNA, 14 bp, Homo sapiens
tcccttttctgttc

SEQ ID NO: 2477121 - DNA, 14 bp, Homo sapiens
tccgccactggggc

SEQ ID NO: 2477122 - DNA, 16 bp, Homo sapiens
tccgccctgccactca

SEQ ID NO: 2477123 - DNA, 22 bp, Homo sapiens
tccgcttggagctattttccag

SEQ ID NO: 2477124 - DNA, 15 bp, Homo sapiens
tccggagtagctggg

SEQ ID NO: 2477125 - DNA, 16 bp, Homo sapiens
tccggatcctaagcat

SEQ ID NO: 2477126 - DNA, 19 bp, Homo sapiens
tccggcatggacaatggac

SEQ ID NO: 2477127 - DNA, 14 bp, Homo sapiens
tccgtcccctgccc

SEQ ID NO: 2477128 - DNA, 15 bp, Homo sapiens
tccgttggccactcc

SEQ ID NO: 2477129 - DNA, 21 bp, Homo sapiens
tcctaaacatcattcattttt

SEQ ID NO: 2477130 - DNA, 14 bp, Homo sapiens
tcctaaatattatg

SEQ ID NO: 2477131 - DNA, 19 bp, Homo sapiens
tcctaaattttcctgtcct

SEQ ID NO: 2477132 - DNA, 20 bp, Homo sapiens
tcctaaattttcctgtcctc

SEQ ID NO: 2477133 - DNA, 14 bp, Homo sapiens
tcctaagcatctaa

SEQ ID NO: 2477134 - DNA, 16 bp, Homo sapiens
tcctaagggtcgaaag

SEQ ID NO: 2477135 - DNA, 14 bp, Homo sapiens
tcctacagaaaaac

SEQ ID NO: 2477136 - DNA, 15 bp, Homo sapiens
tcctacagaaaaacc

SEQ ID NO: 2477137 - DNA, 19 bp, Homo sapiens
tcctagagaagacaggctg

SEQ ID NO: 2477138 - DNA, 20 bp, Homo sapiens
tcctagagaagacaggctgg

SEQ ID NO: 2477139 - DNA, 16 bp, Homo sapiens
tcctagcacagatggc

SEQ ID NO: 2477140 - DNA, 15 bp, Homo sapiens
tcctagctgtccttt

SEQ ID NO: 2477141 - DNA, 19 bp, Homo sapiens
tcctaggcattctggacct

SEQ ID NO: 2477142 - DNA, 18 bp, Homo sapiens
tcctagttctagaaaaac

SEQ ID NO: 2477143 - DNA, 19 bp, Homo sapiens
tcctatcacctatttccat

SEQ ID NO: 2477144 - DNA, 13 bp, Homo sapiens
tcctatctgggct

SEQ ID NO: 2477145 - DNA, 20 bp, Homo sapiens
tcctatctgggcttcctgga

SEQ ID NO: 2477146 - DNA, 21 bp, Homo sapiens
tcctatgcatggtttcagcac

SEQ ID NO: 2477147 - DNA, 14 bp, Homo sapiens
tcctatgctttgaa

SEQ ID NO: 2477148 - DNA, 20 bp, Homo sapiens
tcctatgctttgaaacagaa

SEQ ID NO: 2477149 - DNA, 16 bp, Homo sapiens
tcctcaaagaaagtgt

SEQ ID NO: 2477150 - DNA, 12 bp, Homo sapiens
tcctcagccagc

SEQ ID NO: 2477151 - DNA, 14 bp, Homo sapiens
tcctcagcctgaac

SEQ ID NO: 2477152 - DNA, 20 bp, Homo sapiens
tcctcagccttgccagagat

SEQ ID NO: 2477153 - DNA, 15 bp, Homo sapiens
tcctcaggcacacag

SEQ ID NO: 2477154 - DNA, 14 bp, Homo sapiens
tcctcatccacccc

SEQ ID NO: 2477155 - DNA, 15 bp, Homo sapiens
tcctcatccacccca

SEQ ID NO: 2477156 - DNA, 21 bp, Homo sapiens
tcctcatgaatgtaaatttgt

SEQ ID NO: 2477157 - DNA, 22 bp, Homo sapiens
tcctccacgttctgctcatcat

SEQ ID NO: 2477158 - DNA, 13 bp, Homo sapiens
tcctccagcccct

SEQ ID NO: 2477159 - DNA, 14 bp, Homo sapiens
tcctcccctggagg

SEQ ID NO: 2477160 - DNA, 20 bp, Homo sapiens
tcctcccgagctcctcttcc

SEQ ID NO: 2477161 - DNA, 14 bp, Homo sapiens
tcctcccttcctcc

SEQ ID NO: 2477162 - DNA, 12 bp, Homo sapiens
tcctcctcaggc

SEQ ID NO: 2477163 - DNA, 12 bp, Homo sapiens
tcctcctccagg

SEQ ID NO: 2477164 - DNA, 17 bp, Homo sapiens
tcctcctccagggacag

SEQ ID NO: 2477165 - DNA, 11 bp, Homo sapiens
tcctcctctgt

SEQ ID NO: 2477166 - DNA, 12 bp, Homo sapiens
tcctcctctgtg

SEQ ID NO: 2477167 - DNA, 13 bp, Homo sapiens
tcctccttcttca

SEQ ID NO: 2477168 - DNA, 16 bp, Homo sapiens
tcctcctttctgaggg

SEQ ID NO: 2477169 - DNA, 15 bp, Homo sapiens
tcctcgcctgacaac

SEQ ID NO: 2477170 - DNA, 24 bp, Homo sapiens
tcctcgcctgacaaccactggtct

SEQ ID NO: 2477171 - DNA, 16 bp, Homo sapiens
tcctcgtttgtgttct

SEQ ID NO: 2477172 - DNA, 19 bp, Homo sapiens
tcctctactaacaatcagc

SEQ ID NO: 2477173 - DNA, 15 bp, Homo sapiens
tcctctccccagccc

SEQ ID NO: 2477174 - DNA, 16 bp, Homo sapiens
tcctctccccagccca

SEQ ID NO: 2477175 - DNA, 17 bp, Homo sapiens
tcctctcctagcccctg

SEQ ID NO: 2477176 - DNA, 15 bp, Homo sapiens
tcctctcgcggccct

SEQ ID NO: 2477177 - DNA, 17 bp, Homo sapiens
tcctctcgcggccctca

SEQ ID NO: 2477178 - DNA, 17 bp, Homo sapiens
tcctctcttcctcttcc

SEQ ID NO: 2477179 - DNA, 16 bp, Homo sapiens
tcctctgactcagggc

SEQ ID NO: 2477180 - DNA, 15 bp, Homo sapiens
tcctctggcttggcc

SEQ ID NO: 2477181 - DNA, 23 bp, Homo sapiens
tcctctggcttggccacagccag

SEQ ID NO: 2477182 - DNA, 19 bp, Homo sapiens
tcctctgtcagtcacagcc

SEQ ID NO: 2477183 - DNA, 21 bp, Homo sapiens
tcctctgtgaccaatgtcttg

SEQ ID NO: 2477184 - DNA, 13 bp, Homo sapiens
tcctcttccccag

SEQ ID NO: 2477185 - DNA, 18 bp, Homo sapiens
tcctcttccccagacgcc

SEQ ID NO: 2477186 - DNA, 23 bp, Homo sapiens
tcctcttctactcacttttccca

SEQ ID NO: 2477187 - DNA, 17 bp, Homo sapiens
tcctcttctgggcctga

SEQ ID NO: 2477188 - DNA, 12 bp, Homo sapiens
tcctctttcagc

SEQ ID NO: 2477189 - DNA, 16 bp, Homo sapiens
tcctctttcagctcct

SEQ ID NO: 2477190 - DNA, 21 bp, Homo sapiens
tcctgaaaaggtttatgaaaa

SEQ ID NO: 2477191 - DNA, 13 bp, Homo sapiens
tcctgaagaacca

SEQ ID NO: 2477192 - DNA, 17 bp, Homo sapiens
tcctgaaggcctgaggt

SEQ ID NO: 2477193 - DNA, 15 bp, Homo sapiens
tcctgacactgctgg

SEQ ID NO: 2477194 - DNA, 11 bp, Homo sapiens
tcctgaccagc

SEQ ID NO: 2477195 - DNA, 16 bp, Homo sapiens
tcctgacctcaggtga

SEQ ID NO: 2477196 - DNA, 18 bp, Homo sapiens
tcctgagaaagctcaaag

SEQ ID NO: 2477197 - DNA, 15 bp, Homo sapiens
tcctgagcactgcca

SEQ ID NO: 2477198 - DNA, 16 bp, Homo sapiens
tcctgagcactgccag

SEQ ID NO: 2477199 - DNA, 20 bp, Homo sapiens
tcctgagcactgccaggagg

SEQ ID NO: 2477200 - DNA, 23 bp, Homo sapiens
tcctgagcactgccaggagggac

SEQ ID NO: 2477201 - DNA, 13 bp, Homo sapiens
tcctgagctcagc

SEQ ID NO: 2477202 - DNA, 19 bp, Homo sapiens
tcctgagctcagcgtggag

SEQ ID NO: 2477203 - DNA, 18 bp, Homo sapiens
tcctgaggctttggattt

SEQ ID NO: 2477204 - DNA, 13 bp, Homo sapiens
tcctgagtagctg

SEQ ID NO: 2477205 - DNA, 15 bp, Homo sapiens
tcctgagtgcttgct

SEQ ID NO: 2477206 - DNA, 15 bp, Homo sapiens
tcctgatcagagccg

SEQ ID NO: 2477207 - DNA, 13 bp, Homo sapiens
tcctgcagcccca

SEQ ID NO: 2477208 - DNA, 21 bp, Homo sapiens
tcctgccccaactccttccag

SEQ ID NO: 2477209 - DNA, 14 bp, Homo sapiens
tcctgccggctcct

SEQ ID NO: 2477210 - DNA, 17 bp, Homo sapiens
tcctgcctcagcctccg

SEQ ID NO: 2477211 - DNA, 15 bp, Homo sapiens
tcctgcctctactgg

SEQ ID NO: 2477212 - DNA, 16 bp, Homo sapiens
tcctgccttcctcctg

SEQ ID NO: 2477213 - DNA, 17 bp, Homo sapiens
tcctgctaaaacaatga

SEQ ID NO: 2477214 - DNA, 20 bp, Homo sapiens
tcctgctgctccctcagact

SEQ ID NO: 2477215 - DNA, 13 bp, Homo sapiens
tcctgctgctgtc

SEQ ID NO: 2477216 - DNA, 17 bp, Homo sapiens
tcctgctgctgtctggg

SEQ ID NO: 2477217 - DNA, 19 bp, Homo sapiens
tcctgctgctgtctgggtg

SEQ ID NO: 2477218 - DNA, 20 bp, Homo sapiens
tcctgctgctgtctgggtgc

SEQ ID NO: 2477219 - DNA, 12 bp, Homo sapiens
tcctgcttgcca

SEQ ID NO: 2477220 - DNA, 16 bp, Homo sapiens
tcctgcttgccaaggc

SEQ ID NO: 2477221 - DNA, 19 bp, Homo sapiens
tcctggacactcagacctg

SEQ ID NO: 2477222 - DNA, 13 bp, Homo sapiens
tctctgggctgga

SEQ ID NO: 2477223 - DNA, 21 bp, Homo sapiens
tctctgggggctgaggagcag

SEQ ID NO: 2477224 - DNA, 21 bp, Homo sapiens
tctctgtctcatccatcatca

SEQ ID NO: 2477225 - DNA, 17 bp, Homo sapiens
tctctgtgtctaagatt

SEQ ID NO: 2477226 - DNA, 15 bp, Homo sapiens
tctcttattgcctca

SEQ ID NO: 2477227 - DNA, 9 bp, Homo sapiens
tctcttcat

SEQ ID NO: 2477228 - DNA, 12 bp, Homo sapiens
tctcttctctcc

SEQ ID NO: 2477229 - DNA, 15 bp, Homo sapiens
tctcttgagtttgtc

SEQ ID NO: 2477230 - DNA, 12 bp, Homo sapiens
tctcttgcctca

SEQ ID NO: 2477231 - DNA, 14 bp, Homo sapiens
tctcttgcctgcca

SEQ ID NO: 2477232 - DNA, 15 bp, Homo sapiens
tctcttgcctgccac

SEQ ID NO: 2477233 - DNA, 16 bp, Homo sapiens
tctcttgcctgccact

SEQ ID NO: 2477234 - DNA, 17 bp, Homo sapiens
tctcttgcctgccactg

SEQ ID NO: 2477235 - DNA, 19 bp, Homo sapiens
tctcttgcctgccactgtg

SEQ ID NO: 2477236 - DNA, 16 bp, Homo sapiens
tctcttgggaactgaa

SEQ ID NO: 2477237 - DNA, 23 bp, Homo sapiens
tctcttgggaactgaactcactt

SEQ ID NO: 2477238 - DNA, 12 bp, Homo sapiens
tctctttccatg

SEQ ID NO: 2477239 - DNA, 19 bp, Homo sapiens
tctctttccctggtccctt

SEQ ID NO: 2477240 - DNA, 14 bp, Homo sapiens
tctctttgcctcaa

SEQ ID NO: 2477241 - DNA, 18 bp, Homo sapiens
tctctttttgctttcgaa

SEQ ID NO: 2477242 - DNA, 18 bp, Homo sapiens
tctgaaaagtgaagacag

SEQ ID NO: 2477243 - DNA, 13 bp, Homo sapiens
tctgaaaatataa

SEQ ID NO: 2477244 - DNA, 20 bp, Homo sapiens
tctgaaaccagtgttaggga

SEQ ID NO: 2477245 - DNA, 18 bp, Homo sapiens
tctgaacttgcattgtga

SEQ ID NO: 2477246 - DNA, 17 bp, Homo sapiens
tctgaagccctcccagg

SEQ ID NO: 2477247 - DNA, 20 bp, Homo sapiens
tctgaaggagccccattcct

SEQ ID NO: 2477248 - DNA, 21 bp, Homo sapiens
tctgaaggagccccattcctg

SEQ ID NO: 2477249 - DNA, 13 bp, Homo sapiens
tctgaatgcttct

SEQ ID NO: 2477250 - DNA, 17 bp, Homo sapiens
tctgaatgcttctaagt

SEQ ID NO: 2477251 - DNA, 17 bp, Homo sapiens
tctgaatttttaaacaa

SEQ ID NO: 2477252 - DNA, 14 bp, Homo sapiens
tctgacagcagcat

SEQ ID NO: 2477253 - DNA, 13 bp, Homo sapiens
tctgacagcctca

SEQ ID NO: 2477254 - DNA, 19 bp, Homo sapiens
tctgacccagtgcccccac

SEQ ID NO: 2477255 - DNA, 18 bp, Homo sapiens
tctgacctgcactgggga

SEQ ID NO: 2477256 - DNA, 18 bp, Homo sapiens
tctgactcggtttctcca

SEQ ID NO: 2477257 - DNA, 16 bp, Homo sapiens
tctgacttctgcctgg

SEQ ID NO: 2477258 - DNA, 22 bp, Homo sapiens
tctgagaattgttgagatactt

SEQ ID NO: 2477259 - DNA, 14 bp, Homo sapiens
tctgagaggccctg

SEQ ID NO: 2477260 - DNA, 15 bp, Homo sapiens
tctgagagtctagat

SEQ ID NO: 2477261 - DNA, 19 bp, Homo sapiens
tctgagagtctagattctc

SEQ ID NO: 2477262 - DNA, 19 bp, Homo sapiens
tctgagatggctcccaggg

SEQ ID NO: 2477263 - DNA, 21 bp, Homo sapiens
tctgagcgcctccatccaagg

SEQ ID NO: 2477264 - DNA, 12 bp, Homo sapiens
tctgaggccagc

SEQ ID NO: 2477265 - DNA, 17 bp, Homo sapiens
tctgaggccagcctggc

SEQ ID NO: 2477266 - DNA, 19 bp, Homo sapiens
tctgaggccagcctggcct

SEQ ID NO: 2477267 - DNA, 14 bp, Homo sapiens
tctgaggtcctgag

SEQ ID NO: 2477268 - DNA, 16 bp, Homo sapiens
tctgaggtcctgagca

SEQ ID NO: 2477269 - DNA, 18 bp, Homo sapiens
tctgaggtcctgagcact

SEQ ID NO: 2477270 - DNA, 19 bp, Homo sapiens
tctgaggtcctgagcactg

SEQ ID NO: 2477271 - DNA, 20 bp, Homo sapiens
tctgaggtcctgagcactgc

SEQ ID NO: 2477272 - DNA, 23 bp, Homo sapiens
tctgaggtgcactgggaggctcc

SEQ ID NO: 2477273 - DNA, 21 bp, Homo sapiens
tctgaggtgcctgtcccaccc

SEQ ID NO: 2477274 - DNA, 15 bp, Homo sapiens
tctgaggttttattt

SEQ ID NO: 2477275 - DNA, 14 bp, Homo sapiens
tctgagttttgtgt

SEQ ID NO: 2477276 - DNA, 22 bp, Homo sapiens
tctgatagggtttgtgacaggg

SEQ ID NO: 2477277 - DNA, 15 bp, Homo sapiens
tctgatcaaggcctt

SEQ ID NO: 2477278 - DNA, 17 bp, Homo sapiens
tctgatgcagcttatac

SEQ ID NO: 2477279 - DNA, 22 bp, Homo sapiens
tctgatttgtaacccactgaga

SEQ ID NO: 2477280 - DNA, 20 bp, Homo sapiens
tctgcaagcacatctgcatt

SEQ ID NO: 2477281 - DNA, 23 bp, Homo sapiens
tctgcaagtatactagggagcca

SEQ ID NO: 2477282 - DNA, 23 bp, Homo sapiens
tctgcaattcaaaagttccaaga

SEQ ID NO: 2477283 - DNA, 20 bp, Homo sapiens
tctgcaattcccctctgctg

SEQ ID NO: 2477284 - DNA, 20 bp, Homo sapiens
tctgcactactgacatgtgg

SEQ ID NO: 2477285 - DNA, 18 bp, Homo sapiens
tctgcactcccacctgac

SEQ ID NO: 2477286 - DNA, 23 bp, Homo sapiens
tctgcacttgcggttccggcatg

SEQ ID NO: 2477287 - DNA, 16 bp, Homo sapiens
tctgcagacttcccag

SEQ ID NO: 2477288 - DNA, 13 bp, Homo sapiens
tctgcagcctcag

SEQ ID NO: 2477289 - DNA, 16 bp, Homo sapiens
tctgcagtaaatcttt

SEQ ID NO: 2477290 - DNA, 21 bp, Homo sapiens
tctgcatcctctggagccagc

SEQ ID NO: 2477291 - DNA, 21 bp, Homo sapiens
tctgcattttcaccccaccct

SEQ ID NO: 2477292 - DNA, 15 bp, Homo sapiens
tctgccacccaggat

SEQ ID NO: 2477293 - DNA, 20 bp, Homo sapiens
tctgccagggcccctctccc

SEQ ID NO: 2477294 - DNA, 22 bp, Homo sapiens
tctgccagggcccctctcccca

SEQ ID NO: 2477295 - DNA, 17 bp, Homo sapiens
tctgccagtcctgtcct

SEQ ID NO: 2477296 - DNA, 19 bp, Homo sapiens
tctgccagtgacagacagg

SEQ ID NO: 2477297 - DNA, 21 bp, Homo sapiens
tctgccagtgacagacaggct

SEQ ID NO: 2477298 - DNA, 12 bp, Homo sapiens
tctgcccaaccc

SEQ ID NO: 2477299 - DNA, 22 bp, Homo sapiens
tctgcccacctcagcctcccaa

SEQ ID NO: 2477300 - DNA, 13 bp, Homo sapiens
tctgcccaggcac

SEQ ID NO: 2477301 - DNA, 15 bp, Homo sapiens
tctgcctctctagga

SEQ ID NO: 2477302 - DNA, 17 bp, Homo sapiens
tctgcctcttctgggag

SEQ ID NO: 2477303 - DNA, 18 bp, Homo sapiens
tctgcctgccagctgcac

SEQ ID NO: 2477304 - DNA, 23 bp, Homo sapiens
tctgcctggagacttagggcacc

SEQ ID NO: 2477305 - DNA, 16 bp, Homo sapiens
tctgctactttgctgc

SEQ ID NO: 2477306 - DNA, 14 bp, Homo sapiens
tctgctccagacag

SEQ ID NO: 2477307 - DNA, 14 bp, Homo sapiens
tctgctctgatgca

SEQ ID NO: 2477308 - DNA, 17 bp, Homo sapiens
tctgctctttctctgcc

SEQ ID NO: 2477309 - DNA, 19 bp, Homo sapiens
tctgctctttctctgccag

SEQ ID NO: 2477310 - DNA, 19 bp, Homo sapiens
tctgctggagtttcatgta

SEQ ID NO: 2477311 - DNA, 14 bp, Homo sapiens
tctgctggcccagc

SEQ ID NO: 2477312 - DNA, 20 bp, Homo sapiens
tctgctggcccagccaaacc

SEQ ID NO: 2477313 - DNA, 16 bp, Homo sapiens
tctgctggcctctgcg

SEQ ID NO: 2477314 - DNA, 20 bp, Homo sapiens
tctgctttgctcttcaagaa

SEQ ID NO: 2477315 - DNA, 18 bp, Homo sapiens
tctggaacccagactcag

SEQ ID NO: 2477316 - DNA, 22 bp, Homo sapiens
tctggaacccagactcagacat

SEQ ID NO: 2477317 - DNA, 13 bp, Homo sapiens
tctggaagtccaa

SEQ ID NO: 2477318 - DNA, 19 bp, Homo sapiens
tctggacaggatgtgtttg

SEQ ID NO: 2477319 - DNA, 14 bp, Homo sapiens
tctggacctctggg

SEQ ID NO: 2477320 - DNA, 14 bp, Homo sapiens
tctggagccagccg

SEQ ID NO: 2477321 - DNA, 16 bp, Homo sapiens
tctggagttgatctgg

SEQ ID NO: 2477322 - DNA, 23 bp, Homo sapiens
tctggataacttccacagggtcc

SEQ ID NO: 2477323 - DNA, 16 bp, Homo sapiens
tctggcaatgccacag

SEQ ID NO: 2477324 - DNA, 11 bp, Homo sapiens
tctggcagcca

SEQ ID NO: 2477325 - DNA, 15 bp, Homo sapiens
tctggcagccacact

SEQ ID NO: 2477326 - DNA, 20 bp, Homo sapiens
tgacattctgaatgcttcta

SEQ ID NO: 2477327 - DNA, 15 bp, Homo sapiens
tgacattgcgtttga

SEQ ID NO: 2477328 - DNA, 19 bp, Homo sapiens
tgacattgcgtttgacctt

SEQ ID NO: 2477329 - DNA, 15 bp, Homo sapiens
tgacatttatatatt

SEQ ID NO: 2477330 - DNA, 16 bp, Homo sapiens
tgacatttatatattg

SEQ ID NO: 2477331 - DNA, 20 bp, Homo sapiens
tgacatttatatattgaatt

SEQ ID NO: 2477332 - DNA, 21 bp, Homo sapiens
tgacatttggagtgttcccct

SEQ ID NO: 2477333 - DNA, 22 bp, Homo sapiens
tgacatttgggagacatgtgac

SEQ ID NO: 2477334 - DNA, 24 bp, Homo sapiens
tgacatttgggagacatgtgacat

SEQ ID NO: 2477335 - DNA, 13 bp, Homo sapiens
tgaccaatgtctt

SEQ ID NO: 2477336 - DNA, 15 bp, Homo sapiens
tgaccaatgtcttga

SEQ ID NO: 2477337 - DNA, 16 bp, Homo sapiens
tgaccacagcacagcc

SEQ ID NO: 2477338 - DNA, 19 bp, Homo sapiens
tgaccacagcacagccaac

SEQ ID NO: 2477339 - DNA, 20 bp, Homo sapiens
tgaccactcagagacatgca

SEQ ID NO: 2477340 - DNA, 13 bp, Homo sapiens
tgaccagctcccc

SEQ ID NO: 2477341 - DNA, 17 bp, Homo sapiens
tgaccagctccccctcc

SEQ ID NO: 2477342 - DNA, 19 bp, Homo sapiens
tgaccagctccccctccct

SEQ ID NO: 2477343 - DNA, 18 bp, Homo sapiens
tgaccagttgcagtcact

SEQ ID NO: 2477344 - DNA, 15 bp, Homo sapiens
tgacccacatgccat

SEQ ID NO: 2477345 - DNA, 16 bp, Homo sapiens
tgacccagtgccccca

SEQ ID NO: 2477346 - DNA, 17 bp, Homo sapiens
tgacccagtgcccccac

SEQ ID NO: 2477347 - DNA, 21 bp, Homo sapiens
tgaccccaaacaccttccagc

SEQ ID NO: 2477348 - DNA, 22 bp, Homo sapiens
tgaccccaaacaccttccagct

SEQ ID NO: 2477349 - DNA, 19 bp, Homo sapiens
tgaccccagggcacaggag

SEQ ID NO: 2477350 - DNA, 22 bp, Homo sapiens
tgaccccagggcacaggagcta

SEQ ID NO: 2477351 - DNA, 14 bp, Homo sapiens
tgacccccagctcc

SEQ ID NO: 2477352 - DNA, 22 bp, Homo sapiens
tgacccggcaccccctgcagct

SEQ ID NO: 2477353 - DNA, 15 bp, Homo sapiens
tgaccctgaagtgag

SEQ ID NO: 2477354 - DNA, 14 bp, Homo sapiens
tgaccctgagctga

SEQ ID NO: 2477355 - DNA, 17 bp, Homo sapiens
tgaccctgagctgacca

SEQ ID NO: 2477356 - DNA, 22 bp, Homo sapiens
tgaccctgcctctcccaggcag

SEQ ID NO: 2477357 - DNA, 15 bp, Homo sapiens
tgacccttgctgtga

SEQ ID NO: 2477358 - DNA, 19 bp, Homo sapiens
tgaccggacttttctgcaa

SEQ ID NO: 2477359 - DNA, 17 bp, Homo sapiens
tgacctatacctgtgtt

SEQ ID NO: 2477360 - DNA, 20 bp, Homo sapiens
tgacctcaggcaatctgccc

SEQ ID NO: 2477361 - DNA, 13 bp, Homo sapiens
tgacctccagctt

SEQ ID NO: 2477362 - DNA, 17 bp, Homo sapiens
tgacctcgtactcagga

SEQ ID NO: 2477363 - DNA, 20 bp, Homo sapiens
tgacctcgtactcaggagcc

SEQ ID NO: 2477364 - DNA, 16 bp, Homo sapiens
tgacctgctaggccag

SEQ ID NO: 2477365 - DNA, 22 bp, Homo sapiens
tgacctgctaggccagagccca

SEQ ID NO: 2477366 - DNA, 15 bp, Homo sapiens
tgacctgctgagctc

SEQ ID NO: 2477367 - DNA, 19 bp, Homo sapiens
tgacctgctgagctctgag

SEQ ID NO: 2477368 - DNA, 16 bp, Homo sapiens
tgacctggatggggca

SEQ ID NO: 2477369 - DNA, 22 bp, Homo sapiens
tgacctggatggggcaggccac

SEQ ID NO: 2477370 - DNA, 16 bp, Homo sapiens
tgaccttaaatgcaac

SEQ ID NO: 2477371 - DNA, 17 bp, Homo sapiens
tgaccttttatgtagta

SEQ ID NO: 2477372 - DNA, 15 bp, Homo sapiens
tgacgacaagtgctg

SEQ ID NO: 2477373 - DNA, 20 bp, Homo sapiens
tgacgacaagtgctgaacag

SEQ ID NO: 2477374 - DNA, 23 bp, Homo sapiens
tgacgccagggtatgaagagtgt

SEQ ID NO: 2477375 - DNA, 19 bp, Homo sapiens
tgacggccagggagaagct

SEQ ID NO: 2477376 - DNA, 14 bp, Homo sapiens
tgacgtctgggtgg

SEQ ID NO: 2477377 - DNA, 15 bp, Homo sapiens
tgacgtctgggtggc

SEQ ID NO: 2477378 - DNA, 22 bp, Homo sapiens
tgacgtgaccggacttttctgc

SEQ ID NO: 2477379 - DNA, 18 bp, Homo sapiens
tgactaaactttttttct

SEQ ID NO: 2477380 - DNA, 21 bp, Homo sapiens
tgactaaactttttttctgta

SEQ ID NO: 2477381 - DNA, 16 bp, Homo sapiens
tgactaatggcatgag

SEQ ID NO: 2477382 - DNA, 23 bp, Homo sapiens
tgactagatgatggatgccaata

SEQ ID NO: 2477383 - DNA, 20 bp, Homo sapiens
tgactagggagccatgtttc

SEQ ID NO: 2477384 - DNA, 19 bp, Homo sapiens
tgactattcttgatgtaaa

SEQ ID NO: 2477385 - DNA, 22 bp, Homo sapiens
tgactattcttgatgtaaaatc

SEQ ID NO: 2477386 - DNA, 12 bp, Homo sapiens
tgactcaagaag

SEQ ID NO: 2477387 - DNA, 14 bp, Homo sapiens
tgactcacacctga

SEQ ID NO: 2477388 - DNA, 13 bp, Homo sapiens
tgactcagggctc

SEQ ID NO: 2477389 - DNA, 15 bp, Homo sapiens
tgactcagggctcct

SEQ ID NO: 2477390 - DNA, 20 bp, Homo sapiens
tgactcattctgaaggagcc

SEQ ID NO: 2477391 - DNA, 18 bp, Homo sapiens
tgactcggtttctccaaa

SEQ ID NO: 2477392 - DNA, 20 bp, Homo sapiens
tgactgagggtgagttggct

SEQ ID NO: 2477393 - DNA, 14 bp, Homo sapiens
tgactgcttgccct

SEQ ID NO: 2477394 - DNA, 16 bp, Homo sapiens
tgactgcttgccctaa

SEQ ID NO: 2477395 - DNA, 16 bp, Homo sapiens
tgactgggaccaggca

SEQ ID NO: 2477396 - DNA, 12 bp, Homo sapiens
tgactgtctggg

SEQ ID NO: 2477397 - DNA, 14 bp, Homo sapiens
tgactgtctgggga

SEQ ID NO: 2477398 - DNA, 22 bp, Homo sapiens
tgactgtctggggagcgggtct

SEQ ID NO: 2477399 - DNA, 21 bp, Homo sapiens
tgactgtggtagccagcatcg

SEQ ID NO: 2477400 - DNA, 12 bp, Homo sapiens
tgacttggctgg

SEQ ID NO: 2477401 - DNA, 16 bp, Homo sapiens
tgacttggctggtgtg

SEQ ID NO: 2477402 - DNA, 17 bp, Homo sapiens
tgacttgggcaccccca

SEQ ID NO: 2477403 - DNA, 12 bp, Homo sapiens
tgacttgtatat

SEQ ID NO: 2477404 - DNA, 17 bp, Homo sapiens
tgactttgacaattact

SEQ ID NO: 2477405 - DNA, 13 bp, Homo sapiens
tgactttgcttgc

SEQ ID NO: 2477406 - DNA, 20 bp, Homo sapiens
tgagaaacaacaatttctac

SEQ ID NO: 2477407 - DNA, 18 bp, Homo sapiens
tgagaaacttaaatgtta

SEQ ID NO: 2477408 - DNA, 19 bp, Homo sapiens
tgagaaacttaaatgttat

SEQ ID NO: 2477409 - DNA, 15 bp, Homo sapiens
tgagaaatatggaca

SEQ ID NO: 2477410 - DNA, 17 bp, Homo sapiens
tgagaaatatggacact

SEQ ID NO: 2477411 - DNA, 13 bp, Homo sapiens
tgagaaatttaaa

SEQ ID NO: 2477412 - DNA, 20 bp, Homo sapiens
tgagaaccgtagatgatttc

SEQ ID NO: 2477413 - DNA, 14 bp, Homo sapiens
tgagaacctggcct

SEQ ID NO: 2477414 - DNA, 22 bp, Homo sapiens
tgagaacctgggttgcagacag

SEQ ID NO: 2477415 - DNA, 18 bp, Homo sapiens
tgagaagtgaatgctggg

SEQ ID NO: 2477416 - DNA, 21 bp, Homo sapiens
tgagaagtgaatgctgggact

SEQ ID NO: 2477417 - DNA, 13 bp, Homo sapiens
tgagaatcccaaa

SEQ ID NO: 2477418 - DNA, 20 bp, Homo sapiens
tgagaatcccaaatttgatt

SEQ ID NO: 2477419 - DNA, 16 bp, Homo sapiens
tgagaatgtatcccca

SEQ ID NO: 2477420 - DNA, 20 bp, Homo sapiens
tgagacccagccctcatccc

SEQ ID NO: 2477421 - DNA, 14 bp, Homo sapiens
tgagaggccctgga

SEQ ID NO: 2477422 - DNA, 17 bp, Homo sapiens
tgagaggccctggatca

SEQ ID NO: 2477423 - DNA, 19 bp, Homo sapiens
tgagaggctgtctgttgta

SEQ ID NO: 2477424 - DNA, 22 bp, Homo sapiens
tgagagggctcgaggggtgggc

SEQ ID NO: 2477425 - DNA, 14 bp, Homo sapiens
tgagaggtttgact

SEQ ID NO: 2477426 - DNA, 14 bp, Homo sapiens
tgagagtctagatt

SEQ ID NO: 2477427 - DNA, 15 bp, Homo sapiens
tgagagtctagattc

SEQ ID NO: 2477428 - DNA, 15 bp, Homo sapiens
tgagatagttttcat

SEQ ID NO: 2477429 - DNA, 16 bp, Homo sapiens
tgagatagttttcatc

SEQ ID NO: 2477430 - DNA, 22 bp, Homo sapiens
tgcatggcagggggctgctgct

SEQ ID NO: 2477431 - DNA, 17 bp, Homo sapiens
tgcatggtgccccagga

SEQ ID NO: 2477432 - DNA, 22 bp, Homo sapiens
tgcatggtgccccaggaccagc

SEQ ID NO: 2477433 - DNA, 15 bp, Homo sapiens
tgcatggtttcagca

SEQ ID NO: 2477434 - DNA, 16 bp, Homo sapiens
tgcatggtttcagcac

SEQ ID NO: 2477435 - DNA, 17 bp, Homo sapiens
tgcatggtttcagcact

SEQ ID NO: 2477436 - DNA, 17 bp, Homo sapiens
tgcatgtagtaacacta

SEQ ID NO: 2477437 - DNA, 18 bp, Homo sapiens
tgcatgttgtctaagaaa

SEQ ID NO: 2477438 - DNA, 20 bp, Homo sapiens
tgcattaaattacagaaatt

SEQ ID NO: 2477439 - DNA, 17 bp, Homo sapiens
tgcattaaattcacaaa

SEQ ID NO: 2477440 - DNA, 19 bp, Homo sapiens
tgcattaaattcacaaact

SEQ ID NO: 2477441 - DNA, 20 bp, Homo sapiens
tgcattaaattcacaaactt

SEQ ID NO: 2477442 - DNA, 18 bp, Homo sapiens
tgcattatgcaattttta

SEQ ID NO: 2477443 - DNA, 15 bp, Homo sapiens
tgcattctgcctctc

SEQ ID NO: 2477444 - DNA, 17 bp, Homo sapiens
tgcattgaaaagagctg

SEQ ID NO: 2477445 - DNA, 18 bp, Homo sapiens
tgcattgaaaagagctga

SEQ ID NO: 2477446 - DNA, 20 bp, Homo sapiens
tgcattgaaaagagctgaag

SEQ ID NO: 2477447 - DNA, 19 bp, Homo sapiens
tgcattgaacacaaactgt

SEQ ID NO: 2477448 - DNA, 22 bp, Homo sapiens
tgcattgaccgcgactaatttc

SEQ ID NO: 2477449 - DNA, 17 bp, Homo sapiens
tgcattgactttcccca

SEQ ID NO: 2477450 - DNA, 22 bp, Homo sapiens
tgcattgactttccccaccaga

SEQ ID NO: 2477451 - DNA, 18 bp, Homo sapiens
tgcattggaactggaggc

SEQ ID NO: 2477452 - DNA, 17 bp, Homo sapiens
tgcattgtgattggcct

SEQ ID NO: 2477453 - DNA, 22 bp, Homo sapiens
tgcatttaaatacagtcttcca

SEQ ID NO: 2477454 - DNA, 24 bp, Homo sapiens
tgcatttaaatacagtcttccatt

SEQ ID NO: 2477455 - DNA, 16 bp, Homo sapiens
tgccaaaaagtgaaat

SEQ ID NO: 2477456 - DNA, 17 bp, Homo sapiens
tgccaaaaagtgaaata

SEQ ID NO: 2477457 - DNA, 22 bp, Homo sapiens
tgccaaaaagtgaaataatgtg

SEQ ID NO: 2477458 - DNA, 15 bp, Homo sapiens
tgccaaaggatgtga

SEQ ID NO: 2477459 - DNA, 17 bp, Homo sapiens
tgccaaattaaaaaaga

SEQ ID NO: 2477460 - DNA, 22 bp, Homo sapiens
tgccaaattaaaaaagataaac

SEQ ID NO: 2477461 - DNA, 22 bp, Homo sapiens
tgccaaattattctcctatgtt

SEQ ID NO: 2477462 - DNA, 17 bp, Homo sapiens
tgccaagactgctgtgg

SEQ ID NO: 2477463 - DNA, 23 bp, Homo sapiens
tgccaagactgctgtggccagga

SEQ ID NO: 2477464 - DNA, 21 bp, Homo sapiens
tgccaagtccaggtcctggtg

SEQ ID NO: 2477465 - DNA, 19 bp, Homo sapiens
tgccaatattaaatctgct

SEQ ID NO: 2477466 - DNA, 21 bp, Homo sapiens
tgccaatattaaatctgctgg

SEQ ID NO: 2477467 - DNA, 16 bp, Homo sapiens
tgccacaaggacttcc

SEQ ID NO: 2477468 - DNA, 14 bp, Homo sapiens
tgccacagccctgt

SEQ ID NO: 2477469 - DNA, 16 bp, Homo sapiens
tgccacagccctgtca

SEQ ID NO: 2477470 - DNA, 13 bp, Homo sapiens
tgccacagcctcc

SEQ ID NO: 2477471 - DNA, 17 bp, Homo sapiens
tgccacagcctcccctg

SEQ ID NO: 2477472 - DNA, 21 bp, Homo sapiens
tgccacagcctcccctgccag

SEQ ID NO: 2477473 - DNA, 22 bp, Homo sapiens
tgccacagcctcccctgccagg

SEQ ID NO: 2477474 - DNA, 20 bp, Homo sapiens
tgccacccagccccagccag

SEQ ID NO: 2477475 - DNA, 21 bp, Homo sapiens
tgccacccagccccagccagg

SEQ ID NO: 2477476 - DNA, 13 bp, Homo sapiens
tgccacccaggat

SEQ ID NO: 2477477 - DNA, 14 bp, Homo sapiens
tgccacctggaccc

SEQ ID NO: 2477478 - DNA, 15 bp, Homo sapiens
tgccacctggacccc

SEQ ID NO: 2477479 - DNA, 22 bp, Homo sapiens
tgccacgttggagaagcccgtg

SEQ ID NO: 2477480 - DNA, 13 bp, Homo sapiens
tgccactcactag

SEQ ID NO: 2477481 - DNA, 21 bp, Homo sapiens
tgccactcactaggcccccac

SEQ ID NO: 2477482 - DNA, 21 bp, Homo sapiens
tgccactgccttcgcttcttg

SEQ ID NO: 2477483 - DNA, 13 bp, Homo sapiens
tgccactggagtg

SEQ ID NO: 2477484 - DNA, 21 bp, Homo sapiens
tgccagagaacccagcccacc

SEQ ID NO: 2477485 - DNA, 12 bp, Homo sapiens
tgccagagcctg

SEQ ID NO: 2477486 - DNA, 13 bp, Homo sapiens
tgccagccaagct

SEQ ID NO: 2477487 - DNA, 19 bp, Homo sapiens
tgccagcccctgccattgt

SEQ ID NO: 2477488 - DNA, 22 bp, Homo sapiens
tgccagctctgtatcaggaccc

SEQ ID NO: 2477489 - DNA, 20 bp, Homo sapiens
tgccaggaccagtcaacctg

SEQ ID NO: 2477490 - DNA, 15 bp, Homo sapiens
tgccaggagcacggc

SEQ ID NO: 2477491 - DNA, 17 bp, Homo sapiens
tgccaggaggacccagg

SEQ ID NO: 2477492 - DNA, 20 bp, Homo sapiens
tgccaggaggacccagggct

SEQ ID NO: 2477493 - DNA, 21 bp, Homo sapiens
tgccaggaggacccagggctc

SEQ ID NO: 2477494 - DNA, 22 bp, Homo sapiens
tgccaggagggacaaaggagcc

SEQ ID NO: 2477495 - DNA, 16 bp, Homo sapiens
tgccaggctaattttt

SEQ ID NO: 2477496 - DNA, 12 bp, Homo sapiens
tgccaggctctc

SEQ ID NO: 2477497 - DNA, 14 bp, Homo sapiens
tgccaggctctctt

SEQ ID NO: 2477498 - DNA, 15 bp, Homo sapiens
tgccagggcagggcc

SEQ ID NO: 2477499 - DNA, 18 bp, Homo sapiens
tgccagggcccctctccc

SEQ ID NO: 2477500 - DNA, 21 bp, Homo sapiens
tgccagggcccctctccccag

SEQ ID NO: 2477501 - DNA, 17 bp, Homo sapiens
tgccagtaacaggctca

SEQ ID NO: 2477502 - DNA, 22 bp, Homo sapiens
tgccagtaacgcgtcttcctga

SEQ ID NO: 2477503 - DNA, 23 bp, Homo sapiens
tgccagtaacgcgtcttcctgag

SEQ ID NO: 2477504 - DNA, 16 bp, Homo sapiens
tgccagtgacagacag

SEQ ID NO: 2477505 - DNA, 22 bp, Homo sapiens
tgccagtgacagacaggctctt

SEQ ID NO: 2477506 - DNA, 16 bp, Homo sapiens
tgccagtgtcctgagc

SEQ ID NO: 2477507 - DNA, 23 bp, Homo sapiens
tgccagtgtcctgagccccaggg

SEQ ID NO: 2477508 - DNA, 20 bp, Homo sapiens
tgccatagtcttaactggtc

SEQ ID NO: 2477509 - DNA, 16 bp, Homo sapiens
tgccatattaaatttt

SEQ ID NO: 2477510 - DNA, 22 bp, Homo sapiens
tgccatctgcgtgacaataaaa

SEQ ID NO: 2477511 - DNA, 20 bp, Homo sapiens
tgccatgatgcctctgtctt

SEQ ID NO: 2477512 - DNA, 21 bp, Homo sapiens
tgccatgatgcctctgtcttc

SEQ ID NO: 2477513 - DNA, 11 bp, Homo sapiens
tgcccaagcca

SEQ ID NO: 2477514 - DNA, 13 bp, Homo sapiens
tgcccaagccaga

SEQ ID NO: 2477515 - DNA, 15 bp, Homo sapiens
tgcccaagccagagg

SEQ ID NO: 2477516 - DNA, 16 bp, Homo sapiens
tgcccaagccagaggc

SEQ ID NO: 2477517 - DNA, 23 bp, Homo sapiens
tgcccaagccagaggctgggttc

SEQ ID NO: 2477518 - DNA, 21 bp, Homo sapiens
tgcccacaggccgccctgcgg

SEQ ID NO: 2477519 - DNA, 18 bp, Homo sapiens
tgcccacagtgtcaggca

SEQ ID NO: 2477520 - DNA, 20 bp, Homo sapiens
tgcccacagtgtcaggcact

SEQ ID NO: 2477521 - DNA, 23 bp, Homo sapiens
tgcccacagtgtcaggcactggg

SEQ ID NO: 2477522 - DNA, 23 bp, Homo sapiens
tgcccacgtacccaggtctgggt

SEQ ID NO: 2477523 - DNA, 23 bp, Homo sapiens
tgcccagagacccagcggacaca

SEQ ID NO: 2477524 - DNA, 12 bp, Homo sapiens
tgcccaggcact

SEQ ID NO: 2477525 - DNA, 14 bp, Homo sapiens
tgcccagttaatct

SEQ ID NO: 2477526 - DNA, 24 bp, Homo sapiens
tgcccatggacaggctggctccag

SEQ ID NO: 2477527 - DNA, 20 bp, Homo sapiens
tgccccaactccttccagct

SEQ ID NO: 2477528 - DNA, 19 bp, Homo sapiens
tgccccacttgtccttagc

SEQ ID NO: 2477529 - DNA, 14 bp, Homo sapiens
tgccccaggaccag

SEQ ID NO: 2477530 - DNA, 20 bp, Homo sapiens
tgccccaggaccagctcagg

SEQ ID NO: 2477531 - DNA, 21 bp, Homo sapiens
tgcccccaaccatttcctcag

SEQ ID NO: 2477532 - DNA, 18 bp, Homo sapiens
tggagagggaatgtgaaa

SEQ ID NO: 2477533 - DNA, 19 bp, Homo sapiens
tggagagggaatgtgaaat

SEQ ID NO: 2477534 - DNA, 15 bp, Homo sapiens
tggagagtttcctga

SEQ ID NO: 2477535 - DNA, 18 bp, Homo sapiens
tggagatcctcctgcaga

SEQ ID NO: 2477536 - DNA, 19 bp, Homo sapiens
tggagcacaaagaccctgg

SEQ ID NO: 2477537 - DNA, 22 bp, Homo sapiens
tggagcacaataaatggctgta

SEQ ID NO: 2477538 - DNA, 13 bp, Homo sapiens
tggagcagaccac

SEQ ID NO: 2477539 - DNA, 15 bp, Homo sapiens
tggagctccagcctg

SEQ ID NO: 2477540 - DNA, 17 bp, Homo sapiens
tggagctccagcctgac

SEQ ID NO: 2477541 - DNA, 14 bp, Homo sapiens
tggaggacctgagc

SEQ ID NO: 2477542 - DNA, 15 bp, Homo sapiens
tggaggacctgagcc

SEQ ID NO: 2477543 - DNA, 16 bp, Homo sapiens
tggaggacctgagcct

SEQ ID NO: 2477544 - DNA, 17 bp, Homo sapiens
tggaggacctgagcctg

SEQ ID NO: 2477545 - DNA, 18 bp, Homo sapiens
tggaggacctgagcctgc

SEQ ID NO: 2477546 - DNA, 19 bp, Homo sapiens
tggaggacctgagcctgcc

SEQ ID NO: 2477547 - DNA, 23 bp, Homo sapiens
tggaggagcccaggccaggactc

SEQ ID NO: 2477548 - DNA, 17 bp, Homo sapiens
tggaggcaggggcttcc

SEQ ID NO: 2477549 - DNA, 12 bp, Homo sapiens
tggaggcccagt

SEQ ID NO: 2477550 - DNA, 15 bp, Homo sapiens
tggaggcccagttca

SEQ ID NO: 2477551 - DNA, 19 bp, Homo sapiens
tggagggggaatggcagca

SEQ ID NO: 2477552 - DNA, 20 bp, Homo sapiens
tggaggtcggtaggttcagc

SEQ ID NO: 2477553 - DNA, 23 bp, Homo sapiens
tggaggtggaaaagcaacattca

SEQ ID NO: 2477554 - DNA, 19 bp, Homo sapiens
tggagtcccctcacctcct

SEQ ID NO: 2477555 - DNA, 16 bp, Homo sapiens
tggagtgctgttttgt

SEQ ID NO: 2477556 - DNA, 13 bp, Homo sapiens
tggagtggcagcc

SEQ ID NO: 2477557 - DNA, 19 bp, Homo sapiens
tggagtggcagcccagcca

SEQ ID NO: 2477558 - DNA, 14 bp, Homo sapiens
tggagtgtatgact

SEQ ID NO: 2477559 - DNA, 19 bp, Homo sapiens
tggagtgtatgactgcaca

SEQ ID NO: 2477560 - DNA, 19 bp, Homo sapiens
tggagtgttccccttccac

SEQ ID NO: 2477561 - DNA, 19 bp, Homo sapiens
tggagttgatctggaaccc

SEQ ID NO: 2477562 - DNA, 22 bp, Homo sapiens
tggagttgatctggaacccaga

SEQ ID NO: 2477563 - DNA, 21 bp, Homo sapiens
tggagtttcatgtacaagatg

SEQ ID NO: 2477564 - DNA, 14 bp, Homo sapiens
tggagtttctaagg

SEQ ID NO: 2477565 - DNA, 17 bp, Homo sapiens
tggagtttctaaggtcc

SEQ ID NO: 2477566 - DNA, 15 bp, Homo sapiens
tggataacttccaca

SEQ ID NO: 2477567 - DNA, 15 bp, Homo sapiens
tggataccattatat

SEQ ID NO: 2477568 - DNA, 14 bp, Homo sapiens
tggatacttggatt

SEQ ID NO: 2477569 - DNA, 15 bp, Homo sapiens
tggatacttggattt

SEQ ID NO: 2477570 - DNA, 22 bp, Homo sapiens
tggatacttggatttagtttca

SEQ ID NO: 2477571 - DNA, 17 bp, Homo sapiens
tggatatgtaaaacatt

SEQ ID NO: 2477572 - DNA, 14 bp, Homo sapiens
tggatattgttacg

SEQ ID NO: 2477573 - DNA, 13 bp, Homo sapiens
tggatatttgtat

SEQ ID NO: 2477574 - DNA, 15 bp, Homo sapiens
tggatcacaaagtgg

SEQ ID NO: 2477575 - DNA, 14 bp, Homo sapiens
tggatctatttcat

SEQ ID NO: 2477576 - DNA, 18 bp, Homo sapiens
tggatctcattggaccct

SEQ ID NO: 2477577 - DNA, 14 bp, Homo sapiens
tggatgacattaaa

SEQ ID NO: 2477578 - DNA, 13 bp, Homo sapiens
tggatgagctccc

SEQ ID NO: 2477579 - DNA, 20 bp, Homo sapiens
tggatgatactaataaacta

SEQ ID NO: 2477580 - DNA, 19 bp, Homo sapiens
tggatgatataatgcgggt

SEQ ID NO: 2477581 - DNA, 20 bp, Homo sapiens
tggatgccaatattaaatct

SEQ ID NO: 2477582 - DNA, 21 bp, Homo sapiens
tggatgccaatattaaatctg

SEQ ID NO: 2477583 - DNA, 16 bp, Homo sapiens
tggatggccccagcac

SEQ ID NO: 2477584 - DNA, 21 bp, Homo sapiens
tggatggccccagcacagctt

SEQ ID NO: 2477585 - DNA, 18 bp, Homo sapiens
tggatgggggaactcaga

SEQ ID NO: 2477586 - DNA, 22 bp, Homo sapiens
tggatgggggaactcagatcca

SEQ ID NO: 2477587 - DNA, 19 bp, Homo sapiens
tggattccccatctcaggc

SEQ ID NO: 2477588 - DNA, 20 bp, Homo sapiens
tggatttaaaagcctgctca

SEQ ID NO: 2477589 - DNA, 21 bp, Homo sapiens
tggatttcctaatactgtcat

SEQ ID NO: 2477590 - DNA, 19 bp, Homo sapiens
tggatttctttgaaaaaaa

SEQ ID NO: 2477591 - DNA, 13 bp, Homo sapiens
tggcaacagatct

SEQ ID NO: 2477592 - DNA, 16 bp, Homo sapiens
tggcaacagatctgga

SEQ ID NO: 2477593 - DNA, 20 bp, Homo sapiens
tggcaacagatctggaacct

SEQ ID NO: 2477594 - DNA, 13 bp, Homo sapiens
tggcaaggacttt

SEQ ID NO: 2477595 - DNA, 19 bp, Homo sapiens
tggcaaggactttgtacat

SEQ ID NO: 2477596 - DNA, 13 bp, Homo sapiens
tggcaatgccaca

SEQ ID NO: 2477597 - DNA, 14 bp, Homo sapiens
tggcaatgccacag

SEQ ID NO: 2477598 - DNA, 15 bp, Homo sapiens
tggcaatgccacagc

SEQ ID NO: 2477599 - DNA, 19 bp, Homo sapiens
tggcaatgccacagccctg

SEQ ID NO: 2477600 - DNA, 20 bp, Homo sapiens
tggcaatgccacagccctgt

SEQ ID NO: 2477601 - DNA, 19 bp, Homo sapiens
tggcaatgccatcatctcc

SEQ ID NO: 2477602 - DNA, 14 bp, Homo sapiens
tggcacaggacatg

SEQ ID NO: 2477603 - DNA, 16 bp, Homo sapiens
tggcaccagacaccca

SEQ ID NO: 2477604 - DNA, 21 bp, Homo sapiens
tggcaccagacacccaggact

SEQ ID NO: 2477605 - DNA, 17 bp, Homo sapiens
tggcagagatgcctccc

SEQ ID NO: 2477606 - DNA, 18 bp, Homo sapiens
tggcagatgtaggaggga

SEQ ID NO: 2477607 - DNA, 19 bp, Homo sapiens
tggcagatgtaggagggac

SEQ ID NO: 2477608 - DNA, 13 bp, Homo sapiens
tggcagcccagcc

SEQ ID NO: 2477609 - DNA, 15 bp, Homo sapiens
tggcagcccagccag

SEQ ID NO: 2477610 - DNA, 15 bp, Homo sapiens
tggcagccttgtgat

SEQ ID NO: 2477611 - DNA, 11 bp, Homo sapiens
tggcagctctg

SEQ ID NO: 2477612 - DNA, 18 bp, Homo sapiens
tggcagcttttaaaagat

SEQ ID NO: 2477613 - DNA, 17 bp, Homo sapiens
tggcaggcagaggccca

SEQ ID NO: 2477614 - DNA, 21 bp, Homo sapiens
tggcaggcagaggcccaggct

SEQ ID NO: 2477615 - DNA, 23 bp, Homo sapiens
tggcaggcagaggcccaggctgc

SEQ ID NO: 2477616 - DNA, 20 bp, Homo sapiens
tggcaggcaggctcccaggg

SEQ ID NO: 2477617 - DNA, 15 bp, Homo sapiens
tggcaggccagctgt

SEQ ID NO: 2477618 - DNA, 12 bp, Homo sapiens
tggcaggctggc

SEQ ID NO: 2477619 - DNA, 18 bp, Homo sapiens
tggcaggggacaggagtc

SEQ ID NO: 2477620 - DNA, 13 bp, Homo sapiens
tggcagggggctg

SEQ ID NO: 2477621 - DNA, 16 bp, Homo sapiens
tggcagggggctgctg

SEQ ID NO: 2477622 - DNA, 16 bp, Homo sapiens
tggcagtttatattta

SEQ ID NO: 2477623 - DNA, 16 bp, Homo sapiens
tggcatccctgggcct

SEQ ID NO: 2477624 - DNA, 22 bp, Homo sapiens
tggcatcgcaccattctgactc

SEQ ID NO: 2477625 - DNA, 23 bp, Homo sapiens
tggcatcgcaccattctgactcg

SEQ ID NO: 2477626 - DNA, 21 bp, Homo sapiens
tggcatggaaatttaaagcag

SEQ ID NO: 2477627 - DNA, 17 bp, Homo sapiens
tggcattagaattattt

SEQ ID NO: 2477628 - DNA, 21 bp, Homo sapiens
tggccaagaagcagtggcctt

SEQ ID NO: 2477629 - DNA, 13 bp, Homo sapiens
tggccaagctgag

SEQ ID NO: 2477630 - DNA, 21 bp, Homo sapiens
tggccaagctgaggtgcccag

SEQ ID NO: 2477631 - DNA, 23 bp, Homo sapiens
tggccaagctgaggtgcccagga

SEQ ID NO: 2477632 - DNA, 17 bp, Homo sapiens
tggccacagtagtcttg

SEQ ID NO: 2477633 - DNA, 14 bp, Homo sapiens
tggccactccgaga

SEQ ID NO: 2477634 - DNA, 13 bp, Homo sapiens
tggccagacacag

SEQ ID NO: 2477635 - DNA, 21 bp, Homo sapiens
tggccagctggaggcaggggc

SEQ ID NO: 2477636 - DNA, 20 bp, Homo sapiens
tgtatatattattataatct

SEQ ID NO: 2477637 - DNA, 14 bp, Homo sapiens
tgtatattgtaatt

SEQ ID NO: 2477638 - DNA, 20 bp, Homo sapiens
tgtatattgtgtttgtgtat

SEQ ID NO: 2477639 - DNA, 22 bp, Homo sapiens
tgtatattttaagaaataacag

SEQ ID NO: 2477640 - DNA, 23 bp, Homo sapiens
tgtatcaaatacatttaaaacat

SEQ ID NO: 2477641 - DNA, 20 bp, Homo sapiens
tgtatgggtagggtaaatca

SEQ ID NO: 2477642 - DNA, 21 bp, Homo sapiens
tgtatggtttttgagatatta

SEQ ID NO: 2477643 - DNA, 16 bp, Homo sapiens
tgtattaagaaaggaa

SEQ ID NO: 2477644 - DNA, 14 bp, Homo sapiens
tgtattaagccact

SEQ ID NO: 2477645 - DNA, 18 bp, Homo sapiens
tgtattatttacatttaa

SEQ ID NO: 2477646 - DNA, 20 bp, Homo sapiens
tgtattgtgcaatgtgtata

SEQ ID NO: 2477647 - DNA, 23 bp, Homo sapiens
tgtattgttgaaaaagtttgttt

SEQ ID NO: 2477648 - DNA, 14 bp, Homo sapiens
tgtatttaacagaa

SEQ ID NO: 2477649 - DNA, 21 bp, Homo sapiens
tgtatttacgctttgattcat

SEQ ID NO: 2477650 - DNA, 22 bp, Homo sapiens
tgtatttattggttttgcagaa

SEQ ID NO: 2477651 - DNA, 17 bp, Homo sapiens
tgtatttgaaataagaa

SEQ ID NO: 2477652 - DNA, 17 bp, Homo sapiens
tgtatttgctaattttt

SEQ ID NO: 2477653 - DNA, 12 bp, Homo sapiens
tgtattttatgt

SEQ ID NO: 2477654 - DNA, 16 bp, Homo sapiens
tgtcaagtctctgctg

SEQ ID NO: 2477655 - DNA, 22 bp, Homo sapiens
tgtcaccaccctgctcatccac

SEQ ID NO: 2477656 - DNA, 14 bp, Homo sapiens
tgtcacctgtgctt

SEQ ID NO: 2477657 - DNA, 14 bp, Homo sapiens
tgtcacggccaggc

SEQ ID NO: 2477658 - DNA, 17 bp, Homo sapiens
tgtcactcaaggcggtg

SEQ ID NO: 2477659 - DNA, 17 bp, Homo sapiens
tgtcactttttgaggca

SEQ ID NO: 2477660 - DNA, 21 bp, Homo sapiens
tgtcagaactagaatttgatt

SEQ ID NO: 2477661 - DNA, 12 bp, Homo sapiens
tgtcagcatgaa

SEQ ID NO: 2477662 - DNA, 20 bp, Homo sapiens
tgtcagcatgaatttgtaat

SEQ ID NO: 2477663 - DNA, 21 bp, Homo sapiens
tgtcaggattgcgagagatgt

SEQ ID NO: 2477664 - DNA, 14 bp, Homo sapiens
tgtcaggcactggg

SEQ ID NO: 2477665 - DNA, 14 bp, Homo sapiens
tgtcagtcacagcc

SEQ ID NO: 2477666 - DNA, 19 bp, Homo sapiens
tgtcatcatcatggccagc

SEQ ID NO: 2477667 - DNA, 21 bp, Homo sapiens
tgtcatcctcaaagaaagtgt

SEQ ID NO: 2477668 - DNA, 23 bp, Homo sapiens
tgtcatcctcaaagaaagtgtat

SEQ ID NO: 2477669 - DNA, 13 bp, Homo sapiens
tgtcatgctgcct

SEQ ID NO: 2477670 - DNA, 16 bp, Homo sapiens
tgtcatgctgggattt

SEQ ID NO: 2477671 - DNA, 20 bp, Homo sapiens
tgtcatgctgggatttccaa

SEQ ID NO: 2477672 - DNA, 13 bp, Homo sapiens
tgtcatgtgtata

SEQ ID NO: 2477673 - DNA, 14 bp, Homo sapiens
tgtcatgtgtataa

SEQ ID NO: 2477674 - DNA, 14 bp, Homo sapiens
tgtcattgttatat

SEQ ID NO: 2477675 - DNA, 20 bp, Homo sapiens
tgtcatttagttcagcatcc

SEQ ID NO: 2477676 - DNA, 13 bp, Homo sapiens
tgtcattttggta

SEQ ID NO: 2477677 - DNA, 16 bp, Homo sapiens
tgtccaaaaccgccag

SEQ ID NO: 2477678 - DNA, 20 bp, Homo sapiens
tgtccaaaaccgccagctct

SEQ ID NO: 2477679 - DNA, 19 bp, Homo sapiens
tgtccaactggccctattt

SEQ ID NO: 2477680 - DNA, 21 bp, Homo sapiens
tgtccagacagagccctgtga

SEQ ID NO: 2477681 - DNA, 22 bp, Homo sapiens
tgtccagacagagccctgtgag

SEQ ID NO: 2477682 - DNA, 21 bp, Homo sapiens
tgtccagctgagcgccaggat

SEQ ID NO: 2477683 - DNA, 14 bp, Homo sapiens
tgtccattgtccaa

SEQ ID NO: 2477684 - DNA, 17 bp, Homo sapiens
tgtccattgtccaatcc

SEQ ID NO: 2477685 - DNA, 18 bp, Homo sapiens
tgtcccacccccaccccc

SEQ ID NO: 2477686 - DNA, 22 bp, Homo sapiens
tgtcccacccccacccccagct

SEQ ID NO: 2477687 - DNA, 14 bp, Homo sapiens
tgtcccagaagatg

SEQ ID NO: 2477688 - DNA, 13 bp, Homo sapiens
tgtccccaacagc

SEQ ID NO: 2477689 - DNA, 14 bp, Homo sapiens
tgtccccaacagcg

SEQ ID NO: 2477690 - DNA, 19 bp, Homo sapiens
tgtccccccactccctcac

SEQ ID NO: 2477691 - DNA, 12 bp, Homo sapiens
tgtccctccggg

SEQ ID NO: 2477692 - DNA, 22 bp, Homo sapiens
tgtcccttgcctcaatgccagt

SEQ ID NO: 2477693 - DNA, 23 bp, Homo sapiens
tgtccgctgggtggtaccctctg

SEQ ID NO: 2477694 - DNA, 13 bp, Homo sapiens
tgtcctacagaaa

SEQ ID NO: 2477695 - DNA, 18 bp, Homo sapiens
tgtcctagcacagatggc

SEQ ID NO: 2477696 - DNA, 17 bp, Homo sapiens
tgtcctcagccttgcca

SEQ ID NO: 2477697 - DNA, 16 bp, Homo sapiens
tgtcctcttccctctc

SEQ ID NO: 2477698 - DNA, 15 bp, Homo sapiens
tgtcctctttcagct

SEQ ID NO: 2477699 - DNA, 16 bp, Homo sapiens
tgtcctctttcagctc

SEQ ID NO: 2477700 - DNA, 19 bp, Homo sapiens
tgtcctctttcagctcctg

SEQ ID NO: 2477701 - DNA, 19 bp, Homo sapiens
tgtcctgagccccagggag

SEQ ID NO: 2477702 - DNA, 12 bp, Homo sapiens
tgtcctgagctc

SEQ ID NO: 2477703 - DNA, 15 bp, Homo sapiens
tgtcctgagctcagc

SEQ ID NO: 2477704 - DNA, 16 bp, Homo sapiens
tgtcctgtacattgtg

SEQ ID NO: 2477705 - DNA, 15 bp, Homo sapiens
tgtcctgtcatcatc

SEQ ID NO: 2477706 - DNA, 22 bp, Homo sapiens
tgtccttagcctggacctctga

SEQ ID NO: 2477707 - DNA, 20 bp, Homo sapiens
tgtccttgaaggactaatag

SEQ ID NO: 2477708 - DNA, 19 bp, Homo sapiens
tgtcctttaccaaagatga

SEQ ID NO: 2477709 - DNA, 14 bp, Homo sapiens
tgtcctttctagag

SEQ ID NO: 2477710 - DNA, 22 bp, Homo sapiens
tgtccttttcataggtctgaaa

SEQ ID NO: 2477711 - DNA, 15 bp, Homo sapiens
tgtccttttgcaaag

SEQ ID NO: 2477712 - DNA, 17 bp, Homo sapiens
tgtcgttaaaaacagat

SEQ ID NO: 2477713 - DNA, 18 bp, Homo sapiens
tgtctaagaaattgaata

SEQ ID NO: 2477714 - DNA, 20 bp, Homo sapiens
tgtctacatatgatctgtct

SEQ ID NO: 2477715 - DNA, 13 bp, Homo sapiens
tgtctataaagca

SEQ ID NO: 2477716 - DNA, 14 bp, Homo sapiens
tgtctcagcctccc

SEQ ID NO: 2477717 - DNA, 15 bp, Homo sapiens
tgtctcagcctccca

SEQ ID NO: 2477718 - DNA, 18 bp, Homo sapiens
tgtctcaggctgcctgag

SEQ ID NO: 2477719 - DNA, 17 bp, Homo sapiens
tgtctcatccatcatca

SEQ ID NO: 2477720 - DNA, 13 bp, Homo sapiens
tgtctcatgccag

SEQ ID NO: 2477721 - DNA, 21 bp, Homo sapiens
tgtctcatgccagtaacaggc

SEQ ID NO: 2477722 - DNA, 21 bp, Homo sapiens
tgtctcctaagcacctgtaat

SEQ ID NO: 2477723 - DNA, 19 bp, Homo sapiens
tgtctcgagcgccctgcag

SEQ ID NO: 2477724 - DNA, 18 bp, Homo sapiens
tgtctctcagggccaggc

SEQ ID NO: 2477725 - DNA, 13 bp, Homo sapiens
tgtctctgatgca

SEQ ID NO: 2477726 - DNA, 20 bp, Homo sapiens
tgtctctgatgcagcttata

SEQ ID NO: 2477727 - DNA, 20 bp, Homo sapiens
tgtctcttatggatgtcccc

SEQ ID NO: 2477728 - DNA, 22 bp, Homo sapiens
tgtctcttatggatgtccccag

SEQ ID NO: 2477729 - DNA, 17 bp, Homo sapiens
tgtctcttctttagaac

SEQ ID NO: 2477730 - DNA, 15 bp, Homo sapiens
tgtctcttgcctgcc

SEQ ID NO: 2477731 - DNA, 17 bp, Homo sapiens
tgtctcttgcctgccac

SEQ ID NO: 2477732 - DNA, 23 bp, Homo sapiens
tgtctctttggcgacctcctttc

SEQ ID NO: 2477733 - DNA, 22 bp, Homo sapiens
tgtctcttttctcttttgcttt

SEQ ID NO: 2477734 - DNA, 15 bp, Homo sapiens
tgtctgccaacctaa

SEQ ID NO: 2477735 - DNA, 18 bp, Homo sapiens
tgtctggagaccaccagg

SEQ ID NO: 2477736 - DNA, 20 bp, Homo sapiens
tgtctggagaccaccagggc

SEQ ID NO: 2477737 - DNA, 21 bp, Homo sapiens
tgtctggagaccaccagggca

SEQ ID NO: 2477738 - DNA, 21 bp, Homo sapiens
tgtctggggagcgggtctgct

SEQ ID NO: 2477739 - DNA, 14 bp, Homo sapiens
tgtctggtggcccc

SEQ ID NO: 2477740 - DNA, 14 bp, Homo sapiens
tgttgggagagggc

SEQ ID NO: 2477741 - DNA, 20 bp, Homo sapiens
tgttgggagagggcgcaggc

SEQ ID NO: 2477742 - DNA, 20 bp, Homo sapiens
tgttggggaagggcctgccc

SEQ ID NO: 2477743 - DNA, 14 bp, Homo sapiens
tgttggtgcacagc

SEQ ID NO: 2477744 - DNA, 18 bp, Homo sapiens
tgttggtgcacagcacaa

SEQ ID NO: 2477745 - DNA, 14 bp, Homo sapiens
tgttgtaacctgct

SEQ ID NO: 2477746 - DNA, 18 bp, Homo sapiens
tgttgtaacctgctgtga

SEQ ID NO: 2477747 - DNA, 17 bp, Homo sapiens
tgttgtaagcaacaggc

SEQ ID NO: 2477748 - DNA, 14 bp, Homo sapiens
tgttgtattcattg

SEQ ID NO: 2477749 - DNA, 11 bp, Homo sapiens
tgttgtcaaga

SEQ ID NO: 2477750 - DNA, 20 bp, Homo sapiens
tgttgtcaagaatagcattg

SEQ ID NO: 2477751 - DNA, 17 bp, Homo sapiens
tgttgtccttttcatag

SEQ ID NO: 2477752 - DNA, 20 bp, Homo sapiens
tgttgtcgtaaagatttggg

SEQ ID NO: 2477753 - DNA, 14 bp, Homo sapiens
tgttgtctaagaaa

SEQ ID NO: 2477754 - DNA, 17 bp, Homo sapiens
tgttgtctaagaaattg

SEQ ID NO: 2477755 - DNA, 13 bp, Homo sapiens
tgttgtgctttta

SEQ ID NO: 2477756 - DNA, 11 bp, Homo sapiens
tgttgttattt

SEQ ID NO: 2477757 - DNA, 23 bp, Homo sapiens
tgttgttccaaatactaatgaaa

SEQ ID NO: 2477758 - DNA, 18 bp, Homo sapiens
tgttgttctgttaactga

SEQ ID NO: 2477759 - DNA, 15 bp, Homo sapiens
tgtttaaaacatcat

SEQ ID NO: 2477760 - DNA, 18 bp, Homo sapiens
tgtttaaaacttcagttt

SEQ ID NO: 2477761 - DNA, 12 bp, Homo sapiens
tgtttaaagttc

SEQ ID NO: 2477762 - DNA, 13 bp, Homo sapiens
tgtttaaagttca

SEQ ID NO: 2477763 - DNA, 21 bp, Homo sapiens
tgtttaatttttatttcttcc

SEQ ID NO: 2477764 - DNA, 16 bp, Homo sapiens
tgtttacactctttgt

SEQ ID NO: 2477765 - DNA, 16 bp, Homo sapiens
tgtttacagataatta

SEQ ID NO: 2477766 - DNA, 19 bp, Homo sapiens
tgtttagactttaacataa

SEQ ID NO: 2477767 - DNA, 23 bp, Homo sapiens
tgtttagactttaacataagcta

SEQ ID NO: 2477768 - DNA, 16 bp, Homo sapiens
tgtttagtagcagtga

SEQ ID NO: 2477769 - DNA, 18 bp, Homo sapiens
tgtttatcctttcatata

SEQ ID NO: 2477770 - DNA, 21 bp, Homo sapiens
tgtttatcctttcatatagtt

SEQ ID NO: 2477771 - DNA, 15 bp, Homo sapiens
tgtttatgtaatttc

SEQ ID NO: 2477772 - DNA, 17 bp, Homo sapiens
tgtttatgtaatttcag

SEQ ID NO: 2477773 - DNA, 12 bp, Homo sapiens
tgtttatttttc

SEQ ID NO: 2477774 - DNA, 19 bp, Homo sapiens
tgtttcaaggcactctaga

SEQ ID NO: 2477775 - DNA, 14 bp, Homo sapiens
tgtttccagcattc

SEQ ID NO: 2477776 - DNA, 22 bp, Homo sapiens
tgtttcccaggcccactgtgcc

SEQ ID NO: 2477777 - DNA, 14 bp, Homo sapiens
tgtttcctctgttc

SEQ ID NO: 2477778 - DNA, 14 bp, Homo sapiens
tgtttcgctctttg

SEQ ID NO: 2477779 - DNA, 15 bp, Homo sapiens
tgtttcgtggggagg

SEQ ID NO: 2477780 - DNA, 21 bp, Homo sapiens
tgtttctcccccatgttctgt

SEQ ID NO: 2477781 - DNA, 23 bp, Homo sapiens
tgtttgcttcatgtgtcccagaa

SEQ ID NO: 2477782 - DNA, 13 bp, Homo sapiens
tgtttgctttctg

SEQ ID NO: 2477783 - DNA, 14 bp, Homo sapiens
tgtttggctttcag

SEQ ID NO: 2477784 - DNA, 14 bp, Homo sapiens
tgtttgtgtattta

SEQ ID NO: 2477785 - DNA, 15 bp, Homo sapiens
tgtttgttgtagatt

SEQ ID NO: 2477786 - DNA, 14 bp, Homo sapiens
tgtttgtttaattt

SEQ ID NO: 2477787 - DNA, 22 bp, Homo sapiens
tgttttaaacattaatagcagc

SEQ ID NO: 2477788 - DNA, 16 bp, Homo sapiens
tgttttatgagaaagc

SEQ ID NO: 2477789 - DNA, 19 bp, Homo sapiens
tgttttatgagaaagcctt

SEQ ID NO: 2477790 - DNA, 21 bp, Homo sapiens
tgttttattttcaaaaccagg

SEQ ID NO: 2477791 - DNA, 17 bp, Homo sapiens
tgttttgaaggcaaaat

SEQ ID NO: 2477792 - DNA, 19 bp, Homo sapiens
tgttttggacagtttacca

SEQ ID NO: 2477793 - DNA, 22 bp, Homo sapiens
tgttttgttcaccattataatg

SEQ ID NO: 2477794 - DNA, 20 bp, Homo sapiens
tgttttgttgacattctgaa

SEQ ID NO: 2477795 - DNA, 16 bp, Homo sapiens
tgttttgtttttacaa

SEQ ID NO: 2477796 - DNA, 14 bp, Homo sapiens
tgtttttaaactgt

SEQ ID NO: 2477797 - DNA, 19 bp, Homo sapiens
tgtttttaacatgtcaatc

SEQ ID NO: 2477798 - DNA, 18 bp, Homo sapiens
tgtttttacaaatgttaa

SEQ ID NO: 2477799 - DNA, 15 bp, Homo sapiens
tgtttttctattaaa

SEQ ID NO: 2477800 - DNA, 17 bp, Homo sapiens
tgtttttctattaaaag

SEQ ID NO: 2477801 - DNA, 19 bp, Homo sapiens
tgtttttctattaaaagac

SEQ ID NO: 2477802 - DNA, 20 bp, Homo sapiens
tgtttttctattaaaagact

SEQ ID NO: 2477803 - DNA, 23 bp, Homo sapiens
tgtttttgcgtgggagtgtgtgc

SEQ ID NO: 2477804 - DNA, 12 bp, Homo sapiens
ttaaaaaagata

SEQ ID NO: 2477805 - DNA, 15 bp, Homo sapiens
ttaaaacattaaaat

SEQ ID NO: 2477806 - DNA, 13 bp, Homo sapiens
ttaaaagattttt

SEQ ID NO: 2477807 - DNA, 21 bp, Homo sapiens
ttaaaagcaaatcatttgttt

SEQ ID NO: 2477808 - DNA, 16 bp, Homo sapiens
ttaaaagtgtcaagct

SEQ ID NO: 2477809 - DNA, 15 bp, Homo sapiens
ttaaaatacaagact

SEQ ID NO: 2477810 - DNA, 17 bp, Homo sapiens
ttaaaatacaagactgc

SEQ ID NO: 2477811 - DNA, 19 bp, Homo sapiens
ttaaaatagcaaaagaaga

SEQ ID NO: 2477812 - DNA, 20 bp, Homo sapiens
ttaaaatagcgttcttgtaa

SEQ ID NO: 2477813 - DNA, 21 bp, Homo sapiens
ttaaaatagcgttcttgtaat

SEQ ID NO: 2477814 - DNA, 12 bp, Homo sapiens
ttaaaatataat

SEQ ID NO: 2477815 - DNA, 17 bp, Homo sapiens
ttaaaatgtaaagccat

SEQ ID NO: 2477816 - DNA, 24 bp, Homo sapiens
ttaaaatgtaagattatagattct

SEQ ID NO: 2477817 - DNA, 23 bp, Homo sapiens
ttaaaattgatttttctcttcat

SEQ ID NO: 2477818 - DNA, 12 bp, Homo sapiens
ttaaaatttgtt

SEQ ID NO: 2477819 - DNA, 16 bp, Homo sapiens
ttaaacacctcctcat

SEQ ID NO: 2477820 - DNA, 13 bp, Homo sapiens
ttaaacagaggat

SEQ ID NO: 2477821 - DNA, 21 bp, Homo sapiens
ttaaaccatctccctggtgct

SEQ ID NO: 2477822 - DNA, 19 bp, Homo sapiens
ttaaaccgctaaaagaaac

SEQ ID NO: 2477823 - DNA, 22 bp, Homo sapiens
ttaaactctgttgcaagtgcaa

SEQ ID NO: 2477824 - DNA, 14 bp, Homo sapiens
ttaaactgtacagt

SEQ ID NO: 2477825 - DNA, 17 bp, Homo sapiens
ttaaactgtacagtgtc

SEQ ID NO: 2477826 - DNA, 18 bp, Homo sapiens
ttaaactgtacagtgtct

SEQ ID NO: 2477827 - DNA, 20 bp, Homo sapiens
ttaaactgtacagtgtcttt

SEQ ID NO: 2477828 - DNA, 21 bp, Homo sapiens
ttaaactgtacagtgtctttt

SEQ ID NO: 2477829 - DNA, 20 bp, Homo sapiens
ttaaagaaaaaaattgaaat

SEQ ID NO: 2477830 - DNA, 12 bp, Homo sapiens
ttaaagaaagtg

SEQ ID NO: 2477831 - DNA, 17 bp, Homo sapiens
ttaaagaaagtgtattt

SEQ ID NO: 2477832 - DNA, 14 bp, Homo sapiens
ttaaagagtctaga

SEQ ID NO: 2477833 - DNA, 16 bp, Homo sapiens
ttaaagagtctagatt

SEQ ID NO: 2477834 - DNA, 14 bp, Homo sapiens
ttaaagcctcctca

SEQ ID NO: 2477835 - DNA, 13 bp, Homo sapiens
ttaaataaatttg

SEQ ID NO: 2477836 - DNA, 16 bp, Homo sapiens
ttaaataaatttgact

SEQ ID NO: 2477837 - DNA, 16 bp, Homo sapiens
ttaaataagattctaa

SEQ ID NO: 2477838 - DNA, 14 bp, Homo sapiens
ttaaatacaggaaa

SEQ ID NO: 2477839 - DNA, 17 bp, Homo sapiens
ttaaatacaggaaacag

SEQ ID NO: 2477840 - DNA, 14 bp, Homo sapiens
ttaaatgaacaaga

SEQ ID NO: 2477841 - DNA, 22 bp, Homo sapiens
ttaaatgaacaagagaagcatt

SEQ ID NO: 2477842 - DNA, 21 bp, Homo sapiens
ttaaatgacactcatataatt

SEQ ID NO: 2477843 - DNA, 13 bp, Homo sapiens
ttaaatgttatta

SEQ ID NO: 2477844 - DNA, 21 bp, Homo sapiens
ttcatgtacaagatgaaggag

SEQ ID NO: 2477845 - DNA, 14 bp, Homo sapiens
ttcattaaataaat

SEQ ID NO: 2477846 - DNA, 9 bp, Homo sapiens
ttcattcag

SEQ ID NO: 2477847 - DNA, 18 bp, Homo sapiens
ttcattctgcaagtatac

SEQ ID NO: 2477848 - DNA, 21 bp, Homo sapiens
ttcatttagctaaacggattc

SEQ ID NO: 2477849 - DNA, 18 bp, Homo sapiens
ttcatttatctataattt

SEQ ID NO: 2477850 - DNA, 12 bp, Homo sapiens
ttcatttgcttt

SEQ ID NO: 2477851 - DNA, 16 bp, Homo sapiens
ttcatttgctttggaa

SEQ ID NO: 2477852 - DNA, 19 bp, Homo sapiens
ttccaaaatctcccatttt

SEQ ID NO: 2477853 - DNA, 20 bp, Homo sapiens
ttccaaactcttccctctct

SEQ ID NO: 2477854 - DNA, 21 bp, Homo sapiens
ttccaaagagtagaattgcat

SEQ ID NO: 2477855 - DNA, 16 bp, Homo sapiens
ttccaaagtctctaat

SEQ ID NO: 2477856 - DNA, 17 bp, Homo sapiens
ttccaaagtctctaatt

SEQ ID NO: 2477857 - DNA, 21 bp, Homo sapiens
ttccaaatgtaataaacttta

SEQ ID NO: 2477858 - DNA, 14 bp, Homo sapiens
ttccaaattcagtt

SEQ ID NO: 2477859 - DNA, 22 bp, Homo sapiens
ttccaactcgtatagcatgcat

SEQ ID NO: 2477860 - DNA, 15 bp, Homo sapiens
ttccaagactctaga

SEQ ID NO: 2477861 - DNA, 22 bp, Homo sapiens
ttccaagactctagagtccaag

SEQ ID NO: 2477862 - DNA, 13 bp, Homo sapiens
ttccaagagtcta

SEQ ID NO: 2477863 - DNA, 17 bp, Homo sapiens
ttccaagagtctaaaga

SEQ ID NO: 2477864 - DNA, 15 bp, Homo sapiens
ttccaagtctccacc

SEQ ID NO: 2477865 - DNA, 22 bp, Homo sapiens
ttccacaccttttattgacaca

SEQ ID NO: 2477866 - DNA, 10 bp, Homo sapiens
ttccacagac

SEQ ID NO: 2477867 - DNA, 21 bp, Homo sapiens
ttccacagcctgcaagtcagt

SEQ ID NO: 2477868 - DNA, 17 bp, Homo sapiens
ttccacagggtcccaca

SEQ ID NO: 2477869 - DNA, 18 bp, Homo sapiens
ttccacagggtcccacag

SEQ ID NO: 2477870 - DNA, 12 bp, Homo sapiens
ttccacccaggg

SEQ ID NO: 2477871 - DNA, 20 bp, Homo sapiens
ttccactcgatgatgcttct

SEQ ID NO: 2477872 - DNA, 16 bp, Homo sapiens
ttccactgagggcagt

SEQ ID NO: 2477873 - DNA, 22 bp, Homo sapiens
ttccactgtgcaggttcccact

SEQ ID NO: 2477874 - DNA, 14 bp, Homo sapiens
ttccagaatgctgt

SEQ ID NO: 2477875 - DNA, 18 bp, Homo sapiens
ttccagaatgctgtacat

SEQ ID NO: 2477876 - DNA, 17 bp, Homo sapiens
ttccagcattcccaggt

SEQ ID NO: 2477877 - DNA, 17 bp, Homo sapiens
ttccagcccctctggtc

SEQ ID NO: 2477878 - DNA, 17 bp, Homo sapiens
ttccagctgtcccccca

SEQ ID NO: 2477879 - DNA, 22 bp, Homo sapiens
ttccaggcttctgctggggcct

SEQ ID NO: 2477880 - DNA, 18 bp, Homo sapiens
ttccagggtccctctgtg

SEQ ID NO: 2477881 - DNA, 22 bp, Homo sapiens
ttccaggtagctgaaaggggaa

SEQ ID NO: 2477882 - DNA, 19 bp, Homo sapiens
ttccatccacctttcccaa

SEQ ID NO: 2477883 - DNA, 21 bp, Homo sapiens
ttccatgactgcttgccctaa

SEQ ID NO: 2477884 - DNA, 14 bp, Homo sapiens
ttccatgctgtgcg

SEQ ID NO: 2477885 - DNA, 17 bp, Homo sapiens
ttccatggcaggaaggc

SEQ ID NO: 2477886 - DNA, 19 bp, Homo sapiens
ttccatggcaggaaggctt

SEQ ID NO: 2477887 - DNA, 12 bp, Homo sapiens
ttccatgggaat

SEQ ID NO: 2477888 - DNA, 21 bp, Homo sapiens
ttccatggtgtgatcgtctga

SEQ ID NO: 2477889 - DNA, 13 bp, Homo sapiens
ttccattacaagt

SEQ ID NO: 2477890 - DNA, 22 bp, Homo sapiens
ttcccaaaatgttgaaatatga

SEQ ID NO: 2477891 - DNA, 22 bp, Homo sapiens
ttcccaccccaacctgctctcc

SEQ ID NO: 2477892 - DNA, 20 bp, Homo sapiens
ttcccaggaccctgaagggg

SEQ ID NO: 2477893 - DNA, 18 bp, Homo sapiens
ttcccagttggagctcca

SEQ ID NO: 2477894 - DNA, 15 bp, Homo sapiens
ttcccatccccagcg

SEQ ID NO: 2477895 - DNA, 14 bp, Homo sapiens
ttcccatcgctgtc

SEQ ID NO: 2477896 - DNA, 14 bp, Homo sapiens
ttcccatggggagg

SEQ ID NO: 2477897 - DNA, 23 bp, Homo sapiens
ttcccatggggagggattctggt

SEQ ID NO: 2477898 - DNA, 19 bp, Homo sapiens
ttccccacccaccaaccct

SEQ ID NO: 2477899 - DNA, 23 bp, Homo sapiens
ttccccacccaccaaccctcagg

SEQ ID NO: 2477900 - DNA, 11 bp, Homo sapiens
ttccccagaga

SEQ ID NO: 2477901 - DNA, 19 bp, Homo sapiens
ttccccatctcaggccaga

SEQ ID NO: 2477902 - DNA, 18 bp, Homo sapiens
ttccccatcttctaaacc

SEQ ID NO: 2477903 - DNA, 12 bp, Homo sapiens
ttcccccaccac

SEQ ID NO: 2477904 - DNA, 18 bp, Homo sapiens
ttcccctccttctccctt

SEQ ID NO: 2477905 - DNA, 14 bp, Homo sapiens
ttcccctctgctgc

SEQ ID NO: 2477906 - DNA, 15 bp, Homo sapiens
ttccccttccactga

SEQ ID NO: 2477907 - DNA, 15 bp, Homo sapiens
ttcccgtttctccac

SEQ ID NO: 2477908 - DNA, 16 bp, Homo sapiens
ttccctaatctatggt

SEQ ID NO: 2477909 - DNA, 17 bp, Homo sapiens
ttccctaccctctagag

SEQ ID NO: 2477910 - DNA, 17 bp, Homo sapiens
ttccctactgaagccct

SEQ ID NO: 2477911 - DNA, 14 bp, Homo sapiens
ttccctctcccagg

SEQ ID NO: 2477912 - DNA, 20 bp, Homo sapiens
ttccctctttggctcccctg

SEQ ID NO: 2477913 - DNA, 13 bp, Homo sapiens
ttccctgaagctc

SEQ ID NO: 2477914 - DNA, 15 bp, Homo sapiens
ttccctgtgcctcct

SEQ ID NO: 2477915 - DNA, 18 bp, Homo sapiens
ttccctgtgcctcctccc

SEQ ID NO: 2477916 - DNA, 19 bp, Homo sapiens
ttcccttcagtaccctctc

SEQ ID NO: 2477917 - DNA, 22 bp, Homo sapiens
ttcccttcagtaccctctcagc

SEQ ID NO: 2477918 - DNA, 19 bp, Homo sapiens
ttccgcttggagcagaggg

SEQ ID NO: 2477919 - DNA, 13 bp, Homo sapiens
ttccggcccctcc

SEQ ID NO: 2477920 - DNA, 12 bp, Homo sapiens
ttcctaaatttt

SEQ ID NO: 2477921 - DNA, 20 bp, Homo sapiens
ttcctaaattttcctgtcct

SEQ ID NO: 2477922 - DNA, 16 bp, Homo sapiens
ttcctaataaagttct

SEQ ID NO: 2477923 - DNA, 22 bp, Homo sapiens
ttcctaataaagttctgtactc

SEQ ID NO: 2477924 - DNA, 15 bp, Homo sapiens
ttcctactggtctct

SEQ ID NO: 2477925 - DNA, 15 bp, Homo sapiens
ttcctcagccagcct

SEQ ID NO: 2477926 - DNA, 16 bp, Homo sapiens
ttcctcagccagcctc

SEQ ID NO: 2477927 - DNA, 19 bp, Homo sapiens
ttcctcagccagcctcgcc

SEQ ID NO: 2477928 - DNA, 21 bp, Homo sapiens
ttcctcatgaatgtaaatttg

SEQ ID NO: 2477929 - DNA, 13 bp, Homo sapiens
ttcctcctcaggc

SEQ ID NO: 2477930 - DNA, 20 bp, Homo sapiens
ttcctcctcaggcacacagc

SEQ ID NO: 2477931 - DNA, 14 bp, Homo sapiens
ttcctcctggaaat

SEQ ID NO: 2477932 - DNA, 14 bp, Homo sapiens
ttcctcctgggccc

SEQ ID NO: 2477933 - DNA, 15 bp, Homo sapiens
ttcctcctgggccct

SEQ ID NO: 2477934 - DNA, 15 bp, Homo sapiens
ttcctctccacacag

SEQ ID NO: 2477935 - DNA, 20 bp, Homo sapiens
ttcctctcgcggccctcagt

SEQ ID NO: 2477936 - DNA, 15 bp, Homo sapiens
ttcctgaagaaccag

SEQ ID NO: 2477937 - DNA, 18 bp, Homo sapiens
ttcctgattgtttacagt

SEQ ID NO: 2477938 - DNA, 19 bp, Homo sapiens
ttcctgcaactcaaggact

SEQ ID NO: 2477939 - DNA, 23 bp, Homo sapiens
ttcctgccccaactccttccagc

SEQ ID NO: 2477940 - DNA, 16 bp, Homo sapiens
ttcctgccccaggcct

SEQ ID NO: 2477941 - DNA, 18 bp, Homo sapiens
ttcctgccccaggcctga

SEQ ID NO: 2477942 - DNA, 18 bp, Homo sapiens
ttcctgccgcaacagttt

SEQ ID NO: 2477943 - DNA, 11 bp, Homo sapiens
ttcctgctgct

SEQ ID NO: 2477944 - DNA, 15 bp, Homo sapiens
ttcctgctgctgtct

SEQ ID NO: 2477945 - DNA, 18 bp, Homo sapiens
ttcctgctgctgtctggg

SEQ ID NO: 2477946 - DNA, 20 bp, Homo sapiens
ttcctgctgctgtctgggtg

SEQ ID NO: 2477947 - DNA, 15 bp, Homo sapiens
ttcctgcttttcccc

SEQ ID NO: 2477948 - DNA, 16 bp, Homo sapiens
ttgctattctgtccct

SEQ ID NO: 2477949 - DNA, 19 bp, Homo sapiens
ttgctcacccagtgccctc

SEQ ID NO: 2477950 - DNA, 16 bp, Homo sapiens
ttgctgcatggcaggg

SEQ ID NO: 2477951 - DNA, 21 bp, Homo sapiens
ttgctgcttctcccaggcaag

SEQ ID NO: 2477952 - DNA, 15 bp, Homo sapiens
ttgctgctttagtcc

SEQ ID NO: 2477953 - DNA, 15 bp, Homo sapiens
ttgctgtgaggctgt

SEQ ID NO: 2477954 - DNA, 19 bp, Homo sapiens
ttgcttatcaacttcctaa

SEQ ID NO: 2477955 - DNA, 18 bp, Homo sapiens
ttgcttcatgtgtcccag

SEQ ID NO: 2477956 - DNA, 15 bp, Homo sapiens
ttgcttcctcctccc

SEQ ID NO: 2477957 - DNA, 16 bp, Homo sapiens
ttgctttaatataaat

SEQ ID NO: 2477958 - DNA, 15 bp, Homo sapiens
ttgctttattccaga

SEQ ID NO: 2477959 - DNA, 20 bp, Homo sapiens
ttgcttttggcaaaactcta

SEQ ID NO: 2477960 - DNA, 17 bp, Homo sapiens
ttgcttttttttccttc

SEQ ID NO: 2477961 - DNA, 15 bp, Homo sapiens
ttggaaatttagcat

SEQ ID NO: 2477962 - DNA, 14 bp, Homo sapiens
ttggaaccttgttt

SEQ ID NO: 2477963 - DNA, 14 bp, Homo sapiens
ttggaactggaggc

SEQ ID NO: 2477964 - DNA, 15 bp, Homo sapiens
ttggaagagcagcac

SEQ ID NO: 2477965 - DNA, 22 bp, Homo sapiens
ttggaagatggcataacctgtc

SEQ ID NO: 2477966 - DNA, 15 bp, Homo sapiens
ttggaaggagcagaa

SEQ ID NO: 2477967 - DNA, 20 bp, Homo sapiens
ttggaagtgaaaactttgta

SEQ ID NO: 2477968 - DNA, 15 bp, Homo sapiens
ttggaagttttaatc

SEQ ID NO: 2477969 - DNA, 17 bp, Homo sapiens
ttggaattcgctttcta

SEQ ID NO: 2477970 - DNA, 19 bp, Homo sapiens
ttggacaaatcacatattt

SEQ ID NO: 2477971 - DNA, 20 bp, Homo sapiens
ttggacaaatcacatatttt

SEQ ID NO: 2477972 - DNA, 15 bp, Homo sapiens
ttggacaagcttctg

SEQ ID NO: 2477973 - DNA, 19 bp, Homo sapiens
ttggacaagcttctgagac

SEQ ID NO: 2477974 - DNA, 19 bp, Homo sapiens
ttggacacctttaggttct

SEQ ID NO: 2477975 - DNA, 14 bp, Homo sapiens
ttggacacgctcag

SEQ ID NO: 2477976 - DNA, 13 bp, Homo sapiens
ttggacccttcca

SEQ ID NO: 2477977 - DNA, 16 bp, Homo sapiens
ttggacccttccatgg

SEQ ID NO: 2477978 - DNA, 21 bp, Homo sapiens
ttggacctaaatggcctcatg

SEQ ID NO: 2477979 - DNA, 20 bp, Homo sapiens
ttggagaagcccgtgtgaga

SEQ ID NO: 2477980 - DNA, 22 bp, Homo sapiens
ttggagagtttgcctgttctat

SEQ ID NO: 2477981 - DNA, 13 bp, Homo sapiens
ttggagtcactct

SEQ ID NO: 2477982 - DNA, 22 bp, Homo sapiens
ttggagtgttccccttccactg

SEQ ID NO: 2477983 - DNA, 16 bp, Homo sapiens
ttggatttagtttcag

SEQ ID NO: 2477984 - DNA, 22 bp, Homo sapiens
ttggatttgacattgcgtttga

SEQ ID NO: 2477985 - DNA, 20 bp, Homo sapiens
ttggattttgcaaggtgcat

SEQ ID NO: 2477986 - DNA, 13 bp, Homo sapiens
ttggcaccagaca

SEQ ID NO: 2477987 - DNA, 16 bp, Homo sapiens
ttggcagccttgtgat

SEQ ID NO: 2477988 - DNA, 13 bp, Homo sapiens
ttggcaggctggc

SEQ ID NO: 2477989 - DNA, 16 bp, Homo sapiens
ttggcatagctctggg

SEQ ID NO: 2477990 - DNA, 13 bp, Homo sapiens
ttggcatccctgg

SEQ ID NO: 2477991 - DNA, 21 bp, Homo sapiens
ttggcatggaaatttaaagca

SEQ ID NO: 2477992 - DNA, 17 bp, Homo sapiens
ttggccaaggaaaggca

SEQ ID NO: 2477993 - DNA, 23 bp, Homo sapiens
ttggccaatgcacctaaagaaaa

SEQ ID NO: 2477994 - DNA, 15 bp, Homo sapiens
ttggccacagccagg

SEQ ID NO: 2477995 - DNA, 14 bp, Homo sapiens
ttggctctgccagt

SEQ ID NO: 2477996 - DNA, 15 bp, Homo sapiens
ttggctggacccagc

SEQ ID NO: 2477997 - DNA, 20 bp, Homo sapiens
ttggctggtgtggtacagag

SEQ ID NO: 2477998 - DNA, 21 bp, Homo sapiens
ttggctggtgtggtacagaga

SEQ ID NO: 2477999 - DNA, 22 bp, Homo sapiens
ttggctggtgtggtacagagaa

SEQ ID NO: 2478000 - DNA, 17 bp, Homo sapiens
ttggcttataattcttt

SEQ ID NO: 2478001 - DNA, 15 bp, Homo sapiens
ttgggagagggcgca

SEQ ID NO: 2478002 - DNA, 16 bp, Homo sapiens
ttgggagagggcgcag

SEQ ID NO: 2478003 - DNA, 18 bp, Homo sapiens
ttgggcacccccagcctg

SEQ ID NO: 2478004 - DNA, 22 bp, Homo sapiens
ttgggcacccccagcctgggcc

SEQ ID NO: 2478005 - DNA, 17 bp, Homo sapiens
ttgggcagagctggctc

SEQ ID NO: 2478006 - DNA, 13 bp, Homo sapiens
ttgggccagacat

SEQ ID NO: 2478007 - DNA, 18 bp, Homo sapiens
ttgggccagcttttcaaa

SEQ ID NO: 2478008 - DNA, 16 bp, Homo sapiens
ttgggcctgctccaga

SEQ ID NO: 2478009 - DNA, 22 bp, Homo sapiens
ttggggaagagagcctgcagga

SEQ ID NO: 2478010 - DNA, 18 bp, Homo sapiens
ttggggaagggcctgccc

SEQ ID NO: 2478011 - DNA, 20 bp, Homo sapiens
ttggggagttaagacctggc

SEQ ID NO: 2478012 - DNA, 13 bp, Homo sapiens
ttgggggggtggc

SEQ ID NO: 2478013 - DNA, 20 bp, Homo sapiens
ttgggggggtggccgctgag

SEQ ID NO: 2478014 - DNA, 17 bp, Homo sapiens
ttggggtctggcagcct

SEQ ID NO: 2478015 - DNA, 13 bp, Homo sapiens
ttgggtccaggag

SEQ ID NO: 2478016 - DNA, 15 bp, Homo sapiens
ttgggttagacctac

SEQ ID NO: 2478017 - DNA, 19 bp, Homo sapiens
ttggtaaagactggctttt

SEQ ID NO: 2478018 - DNA, 15 bp, Homo sapiens
ttggtaacttttgtg

SEQ ID NO: 2478019 - DNA, 14 bp, Homo sapiens
ttggtgagaacctg

SEQ ID NO: 2478020 - DNA, 14 bp, Homo sapiens
ttggttcattaatt

SEQ ID NO: 2478021 - DNA, 13 bp, Homo sapiens
ttggttctaagga

SEQ ID NO: 2478022 - DNA, 18 bp, Homo sapiens
ttggttctagcgcagttt

SEQ ID NO: 2478023 - DNA, 23 bp, Homo sapiens
ttggttcttgaggggaccaggag

SEQ ID NO: 2478024 - DNA, 14 bp, Homo sapiens
ttggtttgccttcc

SEQ ID NO: 2478025 - DNA, 18 bp, Homo sapiens
ttggtttttaaaacccag

SEQ ID NO: 2478026 - DNA, 22 bp, Homo sapiens
ttggtttttactgctctgagaa

SEQ ID NO: 2478027 - DNA, 13 bp, Homo sapiens
ttgtaaaacaggt

SEQ ID NO: 2478028 - DNA, 19 bp, Homo sapiens
ttgtaaaagcattttgtaa

SEQ ID NO: 2478029 - DNA, 20 bp, Homo sapiens
ttgtaaaagcattttgtaat

SEQ ID NO: 2478030 - DNA, 13 bp, Homo sapiens
ttgtaaatataaa

SEQ ID NO: 2478031 - DNA, 18 bp, Homo sapiens
ttgtaaattggcatggaa

SEQ ID NO: 2478032 - DNA, 14 bp, Homo sapiens
ttgtaacccactga

SEQ ID NO: 2478033 - DNA, 18 bp, Homo sapiens
ttgtaactaaaataattt

SEQ ID NO: 2478034 - DNA, 23 bp, Homo sapiens
ttgtaactaaaataattttgtaa

SEQ ID NO: 2478035 - DNA, 15 bp, Homo sapiens
ttgtaataataaaga

SEQ ID NO: 2478036 - DNA, 14 bp, Homo sapiens
ttgtaatcactgtt

SEQ ID NO: 2478037 - DNA, 15 bp, Homo sapiens
ttgtaatctgaataa

SEQ ID NO: 2478038 - DNA, 15 bp, Homo sapiens
ttgtaattttacacg

SEQ ID NO: 2478039 - DNA, 23 bp, Homo sapiens
ttgtaatttttttaatttacaaa

SEQ ID NO: 2478040 - DNA, 20 bp, Homo sapiens
ttgtacatttgggagttttt

SEQ ID NO: 2478041 - DNA, 16 bp, Homo sapiens
ttgtactatttaactg

SEQ ID NO: 2478042 - DNA, 19 bp, Homo sapiens
ttgtactatttaactgact

SEQ ID NO: 2478043 - DNA, 12 bp, Homo sapiens
ttgtagctcctc

SEQ ID NO: 2478044 - DNA, 18 bp, Homo sapiens
ttgtagctggggctttga

SEQ ID NO: 2478045 - DNA, 13 bp, Homo sapiens
ttgtagggtttct

SEQ ID NO: 2478046 - DNA, 17 bp, Homo sapiens
ttgtagtgctttgagag

SEQ ID NO: 2478047 - DNA, 13 bp, Homo sapiens
ttgtagttccact

SEQ ID NO: 2478048 - DNA, 19 bp, Homo sapiens
ttgtagttccacttatagc

SEQ ID NO: 2478049 - DNA, 13 bp, Homo sapiens
ttgtatagttaac

SEQ ID NO: 2478050 - DNA, 19 bp, Homo sapiens
ttgtatatattattataat

SEQ ID NO: 2478051 - DNA, 13 bp, Homo sapiens
ttgtatattgtgt

SEQ ID NO: 2478052 - DNA, 9 bp, Homo sapiens
ttttatata

SEQ ID NO: 2478053 - DNA, 15 bp, Homo sapiens
ttttatatattatat

SEQ ID NO: 2478054 - DNA, 20 bp, Homo sapiens
ttttatattaaccagatata

SEQ ID NO: 2478055 - DNA, 15 bp, Homo sapiens
ttttatcccaaagtt

SEQ ID NO: 2478056 - DNA, 22 bp, Homo sapiens
ttttattagtattgttgtcctt

SEQ ID NO: 2478057 - DNA, 18 bp, Homo sapiens
ttttattgacacagaaaa

SEQ ID NO: 2478058 - DNA, 20 bp, Homo sapiens
ttttcaaacaaagatgccac

SEQ ID NO: 2478059 - DNA, 23 bp, Homo sapiens
ttttcaatcaactttactgtaat

SEQ ID NO: 2478060 - DNA, 11 bp, Homo sapiens
ttttcagatgt

SEQ ID NO: 2478061 - DNA, 17 bp, Homo sapiens
ttttcagatgtgaacca

SEQ ID NO: 2478062 - DNA, 13 bp, Homo sapiens
ttttcagttactt

SEQ ID NO: 2478063 - DNA, 12 bp, Homo sapiens
ttttcagttgtt

SEQ ID NO: 2478064 - DNA, 15 bp, Homo sapiens
ttttcataggtctga

SEQ ID NO: 2478065 - DNA, 16 bp, Homo sapiens
ttttcatcttcagttg

SEQ ID NO: 2478066 - DNA, 17 bp, Homo sapiens
ttttcatgcaaactctt

SEQ ID NO: 2478067 - DNA, 21 bp, Homo sapiens
ttttcatgcgatgacacttgt

SEQ ID NO: 2478068 - DNA, 22 bp, Homo sapiens
ttttcatgcgatgacacttgta

SEQ ID NO: 2478069 - DNA, 19 bp, Homo sapiens
ttttccaaagagtgatagt

SEQ ID NO: 2478070 - DNA, 21 bp, Homo sapiens
ttttccaacttggctgcagga

SEQ ID NO: 2478071 - DNA, 20 bp, Homo sapiens
ttttccagctggatgagaat

SEQ ID NO: 2478072 - DNA, 22 bp, Homo sapiens
ttttcccatttatctaaatatg

SEQ ID NO: 2478073 - DNA, 19 bp, Homo sapiens
ttttccttcccttttctgt

SEQ ID NO: 2478074 - DNA, 13 bp, Homo sapiens
ttttcctttgtgc

SEQ ID NO: 2478075 - DNA, 11 bp, Homo sapiens
ttttctattaa

SEQ ID NO: 2478076 - DNA, 21 bp, Homo sapiens
ttttctattaaaagactcatc

SEQ ID NO: 2478077 - DNA, 18 bp, Homo sapiens
ttttctatttcactggag

SEQ ID NO: 2478078 - DNA, 23 bp, Homo sapiens
ttttctatttcactggagcacaa

SEQ ID NO: 2478079 - DNA, 21 bp, Homo sapiens
ttttctcctcactgtatccag

SEQ ID NO: 2478080 - DNA, 21 bp, Homo sapiens
ttttctcgctgtcctttctag

SEQ ID NO: 2478081 - DNA, 15 bp, Homo sapiens
ttttctctcaacacc

SEQ ID NO: 2478082 - DNA, 18 bp, Homo sapiens
ttttctggaatgtaatca

SEQ ID NO: 2478083 - DNA, 14 bp, Homo sapiens
ttttctggttctaa

SEQ ID NO: 2478084 - DNA, 14 bp, Homo sapiens
ttttctgtaattca

SEQ ID NO: 2478085 - DNA, 13 bp, Homo sapiens
ttttcttaaagtg

SEQ ID NO: 2478086 - DNA, 18 bp, Homo sapiens
ttttctttaactgccgta

SEQ ID NO: 2478087 - DNA, 13 bp, Homo sapiens
ttttctttgaata

SEQ ID NO: 2478088 - DNA, 15 bp, Homo sapiens
ttttctttgaataaa

SEQ ID NO: 2478089 - DNA, 17 bp, Homo sapiens
ttttgaaagtctgtcct

SEQ ID NO: 2478090 - DNA, 17 bp, Homo sapiens
ttttgaaattaacctct

SEQ ID NO: 2478091 - DNA, 13 bp, Homo sapiens
ttttgaaggcaaa

SEQ ID NO: 2478092 - DNA, 12 bp, Homo sapiens
ttttgagatatt

SEQ ID NO: 2478093 - DNA, 19 bp, Homo sapiens
ttttgcaaagatttaatct

SEQ ID NO: 2478094 - DNA, 21 bp, Homo sapiens
ttttgcaacctcgctggactc

SEQ ID NO: 2478095 - DNA, 18 bp, Homo sapiens
ttttgcaatcccttaata

SEQ ID NO: 2478096 - DNA, 17 bp, Homo sapiens
ttttgcacagccaaatt

SEQ ID NO: 2478097 - DNA, 9 bp, Homo sapiens
ttttgcagt

SEQ ID NO: 2478098 - DNA, 23 bp, Homo sapiens
ttttgccggctggtgaattcaaa

SEQ ID NO: 2478099 - DNA, 22 bp, Homo sapiens
ttttgctgtaatgttaatattg

SEQ ID NO: 2478100 - DNA, 16 bp, Homo sapiens
ttttggattgtatatt

SEQ ID NO: 2478101 - DNA, 19 bp, Homo sapiens
ttttggtaaagactggctt

SEQ ID NO: 2478102 - DNA, 14 bp, Homo sapiens
ttttggtcattgta

SEQ ID NO: 2478103 - DNA, 17 bp, Homo sapiens
ttttgtattctctgagc

SEQ ID NO: 2478104 - DNA, 23 bp, Homo sapiens
ttttgtcaatgcagttgtctctg

SEQ ID NO: 2478105 - DNA, 18 bp, Homo sapiens
ttttgtcactttttctga

SEQ ID NO: 2478106 - DNA, 14 bp, Homo sapiens
ttttgtgaattagg

SEQ ID NO: 2478107 - DNA, 20 bp, Homo sapiens
ttttgtgtgtatttgctaat

SEQ ID NO: 2478108 - DNA, 18 bp, Homo sapiens
ttttgttatcagtcaata

SEQ ID NO: 2478109 - DNA, 23 bp, Homo sapiens
ttttgttcgcatggtcacacact

SEQ ID NO: 2478110 - DNA, 12 bp, Homo sapiens
ttttgttgacat

SEQ ID NO: 2478111 - DNA, 19 bp, Homo sapiens
ttttgttgacattctgaat

SEQ ID NO: 2478112 - DNA, 21 bp, Homo sapiens
ttttgttgtttcttaaataag

SEQ ID NO: 2478113 - DNA, 18 bp, Homo sapiens
ttttgtttcaatgaggtg

SEQ ID NO: 2478114 - DNA, 13 bp, Homo sapiens
ttttgtttccttt

SEQ ID NO: 2478115 - DNA, 15 bp, Homo sapiens
tttttaaaaaagctt

SEQ ID NO: 2478116 - DNA, 23 bp, Homo sapiens
tttttaaaaaagcttaaaacttt

SEQ ID NO: 2478117 - DNA, 16 bp, Homo sapiens
tttttaaactgtacag

SEQ ID NO: 2478118 - DNA, 19 bp, Homo sapiens
tttttaaactgtacagtgt

SEQ ID NO: 2478119 - DNA, 12 bp, Homo sapiens
tttttaagaaaa

SEQ ID NO: 2478120 - DNA, 20 bp, Homo sapiens
tttttaagtgaaaatatagc

SEQ ID NO: 2478121 - DNA, 19 bp, Homo sapiens
tttttaatccgccaatatt

SEQ ID NO: 2478122 - DNA, 15 bp, Homo sapiens
tttttacaaagccct

SEQ ID NO: 2478123 - DNA, 12 bp, Homo sapiens
tttttaggaaat

SEQ ID NO: 2478124 - DNA, 12 bp, Homo sapiens
tttttatttctg

SEQ ID NO: 2478125 - DNA, 18 bp, Homo sapiens
tttttcagtattatatgt

SEQ ID NO: 2478126 - DNA, 16 bp, Homo sapiens
tttttcagttgttctt

SEQ ID NO: 2478127 - DNA, 16 bp, Homo sapiens
tttttcatgataatga

SEQ ID NO: 2478128 - DNA, 22 bp, Homo sapiens
tttttcattaaataaatttgac

SEQ ID NO: 2478129 - DNA, 21 bp, Homo sapiens
tttttccaactactaatagaa

SEQ ID NO: 2478130 - DNA, 13 bp, Homo sapiens
tttttccatcttt

SEQ ID NO: 2478131 - DNA, 13 bp, Homo sapiens
tttttctaaagga

SEQ ID NO: 2478132 - DNA, 12 bp, Homo sapiens
tttttctcttca

SEQ ID NO: 2478133 - DNA, 17 bp, Homo sapiens
tttttctgataaaagat

SEQ ID NO: 2478134 - DNA, 13 bp, Homo sapiens
tttttctgtataa

SEQ ID NO: 2478135 - DNA, 16 bp, Homo sapiens
tttttcttcactgcaa

SEQ ID NO: 2478136 - DNA, 12 bp, Homo sapiens
tttttctttaca

SEQ ID NO: 2478137 - DNA, 19 bp, Homo sapiens
tttttctttataagaaagc

SEQ ID NO: 2478138 - DNA, 17 bp, Homo sapiens
tttttgaaaaagcgaaa

SEQ ID NO: 2478139 - DNA, 13 bp, Homo sapiens
tttttgaggcaaa

SEQ ID NO: 2478140 - DNA, 13 bp, Homo sapiens
tttttgatactaa

SEQ ID NO: 2478141 - DNA, 16 bp, Homo sapiens
tttttgcagtaactgt

SEQ ID NO: 2478142 - DNA, 15 bp, Homo sapiens
tttttggaagtgaaa

SEQ ID NO: 2478143 - DNA, 20 bp, Homo sapiens
tttttggcgtggctgactta

SEQ ID NO: 2478144 - DNA, 21 bp, Homo sapiens
tttttgtatagttaacacact

SEQ ID NO: 2478145 - DNA, 17 bp, Homo sapiens
tttttgtgtgtatttgc

SEQ ID NO: 2478146 - DNA, 18 bp, Homo sapiens
tttttgtgtgtatttgct

SEQ ID NO: 2478147 - DNA, 12 bp, Homo sapiens
ttttttaacatt

SEQ ID NO: 2478148 - DNA, 10 bp, Homo sapiens
ttttttaaga

SEQ ID NO: 2478149 - DNA, 17 bp, Homo sapiens
ttttttaagaatatctg

SEQ ID NO: 2478150 - DNA, 15 bp, Homo sapiens
ttttttaataaattt

SEQ ID NO: 2478151 - DNA, 14 bp, Homo sapiens
ttttttacttttgt

SEQ ID NO: 2478152 - DNA, 13 bp, Homo sapiens
ttttttatgctaa

SEQ ID NO: 2478153 - DNA, 12 bp, Homo sapiens
ttttttcagttg

SEQ ID NO: 2478154 - DNA, 14 bp, Homo sapiens
ttttttccaaaatc

SEQ ID NO: 2478155 - DNA, 12 bp, Homo sapiens
ttttttccccag

SEQ ID NO: 2478156 - DNA, 9 bp, Homo sapiens
ttttttgca

SEQ ID NO: 2478157 - DNA, 16 bp, Homo sapiens
tgcatttgggtccagg

SEQ ID NO: 2478158 - DNA, 18 bp, Homo sapiens
tgcatttgggtccaggag

SEQ ID NO: 2478159 - DNA, 18 bp, Homo sapiens
tgcatttgtttatgtaat

SEQ ID NO: 2478160 - DNA, 19 bp, Homo sapiens
tgcatttgtttatgtaatt

SEQ ID NO: 2478161 - DNA, 20 bp, Homo sapiens
tgcatttgtttatgtaattt

SEQ ID NO: 2478162 - DNA, 21 bp, Homo sapiens
tgcatttgttttgtttacaga

SEQ ID NO: 2478163 - DNA, 16 bp, Homo sapiens
tgccaaaaaaaaatac

SEQ ID NO: 2478164 - DNA, 17 bp, Homo sapiens
tgccaaatatgtcctgg

SEQ ID NO: 2478165 - DNA, 18 bp, Homo sapiens
tgccaaatatgtcctggg

SEQ ID NO: 2478166 - DNA, 19 bp, Homo sapiens
tgccaaattaaaaaagata

SEQ ID NO: 2478167 - DNA, 12 bp, Homo sapiens
tgccaacctaaa

SEQ ID NO: 2478168 - DNA, 16 bp, Homo sapiens
tgccaacctaaaactc

SEQ ID NO: 2478169 - DNA, 18 bp, Homo sapiens
tgccaacctaaaactctt

SEQ ID NO: 2478170 - DNA, 14 bp, Homo sapiens
tgccaagactgctg

SEQ ID NO: 2478171 - DNA, 21 bp, Homo sapiens
tgccaagactgctgtggccag

SEQ ID NO: 2478172 - DNA, 16 bp, Homo sapiens
tgccaagctccaagcc

SEQ ID NO: 2478173 - DNA, 17 bp, Homo sapiens
tgccaagggcataaatt

SEQ ID NO: 2478174 - DNA, 17 bp, Homo sapiens
tgccaagtccaggtcct

SEQ ID NO: 2478175 - DNA, 20 bp, Homo sapiens
tgccaagtccaggtcctggt

SEQ ID NO: 2478176 - DNA, 18 bp, Homo sapiens
tgccaatattaaatctgc

SEQ ID NO: 2478177 - DNA, 11 bp, Homo sapiens
tgccacagctt

SEQ ID NO: 2478178 - DNA, 14 bp, Homo sapiens
tgccaccaggccac

SEQ ID NO: 2478179 - DNA, 17 bp, Homo sapiens
tgccaccaggccacctc

SEQ ID NO: 2478180 - DNA, 18 bp, Homo sapiens
tgccaccaggccacctcc

SEQ ID NO: 2478181 - DNA, 17 bp, Homo sapiens
tgccacccagccccagc

SEQ ID NO: 2478182 - DNA, 22 bp, Homo sapiens
tgccacccagccccagccaggg

SEQ ID NO: 2478183 - DNA, 13 bp, Homo sapiens
tgccacctggacc

SEQ ID NO: 2478184 - DNA, 19 bp, Homo sapiens
tgccactcactaggccccc

SEQ ID NO: 2478185 - DNA, 22 bp, Homo sapiens
tgccactgaggggggatccagt

SEQ ID NO: 2478186 - DNA, 14 bp, Homo sapiens
tgccacttaatgta

SEQ ID NO: 2478187 - DNA, 17 bp, Homo sapiens
tgccacttaatgtatgt

SEQ ID NO: 2478188 - DNA, 23 bp, Homo sapiens
tgccacttaatgtatgttaccaa

SEQ ID NO: 2478189 - DNA, 13 bp, Homo sapiens
tgccagagcctgg

SEQ ID NO: 2478190 - DNA, 15 bp, Homo sapiens
tgccagagcctgggg

SEQ ID NO: 2478191 - DNA, 21 bp, Homo sapiens
tgccagccaagctctgcagtc

SEQ ID NO: 2478192 - DNA, 13 bp, Homo sapiens
tgccagcttcagg

SEQ ID NO: 2478193 - DNA, 19 bp, Homo sapiens
tgccaggagcacggctctg

SEQ ID NO: 2478194 - DNA, 22 bp, Homo sapiens
tgccaggaggacccagggctct

SEQ ID NO: 2478195 - DNA, 21 bp, Homo sapiens
tgccaggagggacaaaggagc

SEQ ID NO: 2478196 - DNA, 14 bp, Homo sapiens
tgccaggcgaggcc

SEQ ID NO: 2478197 - DNA, 17 bp, Homo sapiens
tgccagggcaatgatga

SEQ ID NO: 2478198 - DNA, 11 bp, Homo sapiens
tgccagggcag

SEQ ID NO: 2478199 - DNA, 12 bp, Homo sapiens
tgccagggcagg

SEQ ID NO: 2478200 - DNA, 23 bp, Homo sapiens
tgccagggcccctctccccaggg

SEQ ID NO: 2478201 - DNA, 17 bp, Homo sapiens
tgccaggtgaggtcagc

SEQ ID NO: 2478202 - DNA, 21 bp, Homo sapiens
tgccagtaacgcgtcttcctg

SEQ ID NO: 2478203 - DNA, 13 bp, Homo sapiens
tgccagtcctgtc

SEQ ID NO: 2478204 - DNA, 20 bp, Homo sapiens
tgccagtgacagacaggctc

SEQ ID NO: 2478205 - DNA, 14 bp, Homo sapiens
tgccatattaaatt

SEQ ID NO: 2478206 - DNA, 13 bp, Homo sapiens
tgccatattttca

SEQ ID NO: 2478207 - DNA, 23 bp, Homo sapiens
tgccatcatctcctgccttcctc

SEQ ID NO: 2478208 - DNA, 16 bp, Homo sapiens
tgccatgatgcctctg

SEQ ID NO: 2478209 - DNA, 17 bp, Homo sapiens
tgccatgatgcctctgt

SEQ ID NO: 2478210 - DNA, 20 bp, Homo sapiens
tgccattgtagcgtctttct

SEQ ID NO: 2478211 - DNA, 20 bp, Homo sapiens
tgcccaaatccttagatctg

SEQ ID NO: 2478212 - DNA, 19 bp, Homo sapiens
tgcccaacccttccctcac

SEQ ID NO: 2478213 - DNA, 20 bp, Homo sapiens
tgcccaacccttccctcacc

SEQ ID NO: 2478214 - DNA, 14 bp, Homo sapiens
tgcccaagccagag

SEQ ID NO: 2478215 - DNA, 18 bp, Homo sapiens
tgcccaagccagaggctg

SEQ ID NO: 2478216 - DNA, 20 bp, Homo sapiens
tgcccaagccagaggctggg

SEQ ID NO: 2478217 - DNA, 12 bp, Homo sapiens
tgcccacaggcc

SEQ ID NO: 2478218 - DNA, 21 bp, Homo sapiens
tgcccacagtgtcaggcactg

SEQ ID NO: 2478219 - DNA, 21 bp, Homo sapiens
tgcccagaataagttattgca

SEQ ID NO: 2478220 - DNA, 10 bp, Homo sapiens
tgcccagaca

SEQ ID NO: 2478221 - DNA, 15 bp, Homo sapiens
tgcccagagacccag

SEQ ID NO: 2478222 - DNA, 17 bp, Homo sapiens
tgcccaggctggtctca

SEQ ID NO: 2478223 - DNA, 13 bp, Homo sapiens
tgcccatgtttca

SEQ ID NO: 2478224 - DNA, 15 bp, Homo sapiens
tgcccatgtttcaaa

SEQ ID NO: 2478225 - DNA, 16 bp, Homo sapiens
tgccccaactccttcc

SEQ ID NO: 2478226 - DNA, 14 bp, Homo sapiens
tgccccaagtcctc

SEQ ID NO: 2478227 - DNA, 14 bp, Homo sapiens
tgccccacttgtcc

SEQ ID NO: 2478228 - DNA, 13 bp, Homo sapiens
tgccccaggacca

SEQ ID NO: 2478229 - DNA, 18 bp, Homo sapiens
tgccccaggaccagctca

SEQ ID NO: 2478230 - DNA, 16 bp, Homo sapiens
tgccccatcagtgctc

SEQ ID NO: 2478231 - DNA, 17 bp, Homo sapiens
tgccccatcccatgctg

SEQ ID NO: 2478232 - DNA, 18 bp, Homo sapiens
tgcccccagggtcctggg

SEQ ID NO: 2478233 - DNA, 14 bp, Homo sapiens
tgccccccagcctc

SEQ ID NO: 2478234 - DNA, 14 bp, Homo sapiens
tgccccctgcagga

SEQ ID NO: 2478235 - DNA, 17 bp, Homo sapiens
tgccccctgcaggaagg

SEQ ID NO: 2478236 - DNA, 18 bp, Homo sapiens
tgccccctgcaggaagga

SEQ ID NO: 2478237 - DNA, 23 bp, Homo sapiens
tgccccctgcaggaaggagctgc

SEQ ID NO: 2478238 - DNA, 13 bp, Homo sapiens
tgcccctggctgg

SEQ ID NO: 2478239 - DNA, 23 bp, Homo sapiens
tgccccttccgccactggggctc

SEQ ID NO: 2478240 - DNA, 19 bp, Homo sapiens
tgcccgagtctgtttttca

SEQ ID NO: 2478241 - DNA, 20 bp, Homo sapiens
tgcccgcctgggtctcctaa

SEQ ID NO: 2478242 - DNA, 12 bp, Homo sapiens
tgccctctccca

SEQ ID NO: 2478243 - DNA, 13 bp, Homo sapiens
tgccctctcccac

SEQ ID NO: 2478244 - DNA, 17 bp, Homo sapiens
tgccctctcccaccctc

SEQ ID NO: 2478245 - DNA, 16 bp, Homo sapiens
tgccctctcccctcag

SEQ ID NO: 2478246 - DNA, 14 bp, Homo sapiens
tgccctctgggctc

SEQ ID NO: 2478247 - DNA, 16 bp, Homo sapiens
tgccctctgggctctg

SEQ ID NO: 2478248 - DNA, 19 bp, Homo sapiens
tgccctctgggctctgagt

SEQ ID NO: 2478249 - DNA, 15 bp, Homo sapiens
tgcccttcactgtca

SEQ ID NO: 2478250 - DNA, 14 bp, Homo sapiens
tgcccttctttcta

SEQ ID NO: 2478251 - DNA, 20 bp, Homo sapiens
tgcccttgtttggggcagga

SEQ ID NO: 2478252 - DNA, 17 bp, Homo sapiens
tgccgagcaaccgtggc

SEQ ID NO: 2478253 - DNA, 17 bp, Homo sapiens
tgcctacagaacttcag

SEQ ID NO: 2478254 - DNA, 23 bp, Homo sapiens
tgcctacagaacttcagaaagac

SEQ ID NO: 2478255 - DNA, 13 bp, Homo sapiens
tgcctagaaacaa

SEQ ID NO: 2478256 - DNA, 23 bp, Homo sapiens
tgcctagaaacaacactgtagta

SEQ ID NO: 2478257 - DNA, 17 bp, Homo sapiens
tgcctagattcagggaa

SEQ ID NO: 2478258 - DNA, 18 bp, Homo sapiens
tgcctattgctagagctc

SEQ ID NO: 2478259 - DNA, 22 bp, Homo sapiens
tgcctcaaataaaaagtgcttt

SEQ ID NO: 2478260 - DNA, 13 bp, Homo sapiens
tgcctcaatgcca

SEQ ID NO: 2478261 - DNA, 22 bp, Homo sapiens
tgctcccaaggggcctgagcag

SEQ ID NO: 2478262 - DNA, 12 bp, Homo sapiens
tgctcccacctc

SEQ ID NO: 2478263 - DNA, 18 bp, Homo sapiens
tgctccgaggacccagga

SEQ ID NO: 2478264 - DNA, 14 bp, Homo sapiens
tgctccgcctggcc

SEQ ID NO: 2478265 - DNA, 18 bp, Homo sapiens
tgctccgcctggcctggc

SEQ ID NO: 2478266 - DNA, 19 bp, Homo sapiens
tgctcctcttccccagacg

SEQ ID NO: 2478267 - DNA, 15 bp, Homo sapiens
tgctccttgggccct

SEQ ID NO: 2478268 - DNA, 15 bp, Homo sapiens
tgctcggggtgcaca

SEQ ID NO: 2478269 - DNA, 16 bp, Homo sapiens
tgctcggggtgcacag

SEQ ID NO: 2478270 - DNA, 17 bp, Homo sapiens
tgctcggggtgcacagg

SEQ ID NO: 2478271 - DNA, 19 bp, Homo sapiens
tgctcggggtgcacaggag

SEQ ID NO: 2478272 - DNA, 15 bp, Homo sapiens
tgctctaacagccct

SEQ ID NO: 2478273 - DNA, 19 bp, Homo sapiens
tgctctccattctgctcct

SEQ ID NO: 2478274 - DNA, 12 bp, Homo sapiens
tgctctcctctt

SEQ ID NO: 2478275 - DNA, 15 bp, Homo sapiens
tgctctcctcttcta

SEQ ID NO: 2478276 - DNA, 13 bp, Homo sapiens
tgctctgatccct

SEQ ID NO: 2478277 - DNA, 16 bp, Homo sapiens
tgctctgatccctcta

SEQ ID NO: 2478278 - DNA, 19 bp, Homo sapiens
tgctctgatccctctacag

SEQ ID NO: 2478279 - DNA, 21 bp, Homo sapiens
tgctctggttgtttctgttcc

SEQ ID NO: 2478280 - DNA, 21 bp, Homo sapiens
tgctcttggctggacccagcc

SEQ ID NO: 2478281 - DNA, 16 bp, Homo sapiens
tgctctttctctgcca

SEQ ID NO: 2478282 - DNA, 14 bp, Homo sapiens
tgctctttgttttg

SEQ ID NO: 2478283 - DNA, 15 bp, Homo sapiens
tgctctttgttttgt

SEQ ID NO: 2478284 - DNA, 18 bp, Homo sapiens
tgctctttgttttgtgtc

SEQ ID NO: 2478285 - DNA, 15 bp, Homo sapiens
tgctcttttctcctc

SEQ ID NO: 2478286 - DNA, 23 bp, Homo sapiens
tgctcttttctcctcactgtatc

SEQ ID NO: 2478287 - DNA, 16 bp, Homo sapiens
tgctgaaaaatgggca

SEQ ID NO: 2478288 - DNA, 21 bp, Homo sapiens
tgctgaaaatgtccttgtgat

SEQ ID NO: 2478289 - DNA, 20 bp, Homo sapiens
tgctgaatgttgggactgct

SEQ ID NO: 2478290 - DNA, 13 bp, Homo sapiens
tgctgacctgctg

SEQ ID NO: 2478291 - DNA, 23 bp, Homo sapiens
tgctgacctgctgacctgtgcac

SEQ ID NO: 2478292 - DNA, 17 bp, Homo sapiens
tgctgacggccagggag

SEQ ID NO: 2478293 - DNA, 22 bp, Homo sapiens
tgctgacggccagggagaagct

SEQ ID NO: 2478294 - DNA, 14 bp, Homo sapiens
tgctgactgtagct

SEQ ID NO: 2478295 - DNA, 19 bp, Homo sapiens
tgctgagaacctggccttc

SEQ ID NO: 2478296 - DNA, 20 bp, Homo sapiens
tgctgagaacctggccttca

SEQ ID NO: 2478297 - DNA, 18 bp, Homo sapiens
tgctgagatacatacaga

SEQ ID NO: 2478298 - DNA, 19 bp, Homo sapiens
tgctgagatacatacagaa

SEQ ID NO: 2478299 - DNA, 23 bp, Homo sapiens
tgctgagctctgagaggccctgg

SEQ ID NO: 2478300 - DNA, 14 bp, Homo sapiens
tgctgaggcctggg

SEQ ID NO: 2478301 - DNA, 16 bp, Homo sapiens
tgctgaggcctgggcc

SEQ ID NO: 2478302 - DNA, 16 bp, Homo sapiens
tgctgcatggcagggg

SEQ ID NO: 2478303 - DNA, 23 bp, Homo sapiens
tgctgcatggcagggggctgctg

SEQ ID NO: 2478304 - DNA, 17 bp, Homo sapiens
tgctgcccatgtttcaa

SEQ ID NO: 2478305 - DNA, 13 bp, Homo sapiens
tgctgctccctca

SEQ ID NO: 2478306 - DNA, 23 bp, Homo sapiens
tgctgctcttggctggacccagc

SEQ ID NO: 2478307 - DNA, 11 bp, Homo sapiens
tgctgctgaga

SEQ ID NO: 2478308 - DNA, 16 bp, Homo sapiens
tgctgctgagaacctg

SEQ ID NO: 2478309 - DNA, 18 bp, Homo sapiens
tgctgctgagaacctggc

SEQ ID NO: 2478310 - DNA, 19 bp, Homo sapiens
tgctgctgagaacctggcc

SEQ ID NO: 2478311 - DNA, 21 bp, Homo sapiens
tgctgctgagaacctggcctt

SEQ ID NO: 2478312 - DNA, 14 bp, Homo sapiens
tgctgctggggaag

SEQ ID NO: 2478313 - DNA, 22 bp, Homo sapiens
tgctgctggggaagacagtggc

SEQ ID NO: 2478314 - DNA, 14 bp, Homo sapiens
tgctgctgtgtgct

SEQ ID NO: 2478315 - DNA, 16 bp, Homo sapiens
tgctggagggaggctg

SEQ ID NO: 2478316 - DNA, 20 bp, Homo sapiens
tgctggagtttcatgtacaa

SEQ ID NO: 2478317 - DNA, 14 bp, Homo sapiens
tgctggcccagggc

SEQ ID NO: 2478318 - DNA, 23 bp, Homo sapiens
tgctggccgcccccagccccctc

SEQ ID NO: 2478319 - DNA, 16 bp, Homo sapiens
tgctgggactcagcct

SEQ ID NO: 2478320 - DNA, 23 bp, Homo sapiens
tgctgggactcagccttcagaca

SEQ ID NO: 2478321 - DNA, 12 bp, Homo sapiens
tgctgggctcag

SEQ ID NO: 2478322 - DNA, 16 bp, Homo sapiens
tgctggggaagacagt

SEQ ID NO: 2478323 - DNA, 17 bp, Homo sapiens
tgctggggaagacagtg

SEQ ID NO: 2478324 - DNA, 22 bp, Homo sapiens
tgctggtttgtagttgaatatt

SEQ ID NO: 2478325 - DNA, 15 bp, Homo sapiens
tgctgtacatctatt

SEQ ID NO: 2478326 - DNA, 16 bp, Homo sapiens
tgctgtacatctattt

SEQ ID NO: 2478327 - DNA, 17 bp, Homo sapiens
tgctgtcaccttgctca

SEQ ID NO: 2478328 - DNA, 16 bp, Homo sapiens
tgctgtccctccccct

SEQ ID NO: 2478329 - DNA, 17 bp, Homo sapiens
tgctgtccctccccctt

SEQ ID NO: 2478330 - DNA, 15 bp, Homo sapiens
tgctgtctgggtgct

SEQ ID NO: 2478331 - DNA, 21 bp, Homo sapiens
tgctgtcttaaactaaatgtg

SEQ ID NO: 2478332 - DNA, 17 bp, Homo sapiens
tgctgtgaggctgtcct

SEQ ID NO: 2478333 - DNA, 19 bp, Homo sapiens
tgctgtgaggctgtcctgt

SEQ ID NO: 2478334 - DNA, 17 bp, Homo sapiens
tgctgtgcgcccagggc

SEQ ID NO: 2478335 - DNA, 15 bp, Homo sapiens
tgctgtgctgtgcta

SEQ ID NO: 2478336 - DNA, 17 bp, Homo sapiens
tgctgtggccaggaggt

SEQ ID NO: 2478337 - DNA, 23 bp, Homo sapiens
tgctgtggtgtgtccccctctgt

SEQ ID NO: 2478338 - DNA, 21 bp, Homo sapiens
tgctgtgtgctttttttgtgt

SEQ ID NO: 2478339 - DNA, 23 bp, Homo sapiens
tgctgtttattaatcttagtgta

SEQ ID NO: 2478340 - DNA, 13 bp, Homo sapiens
tgctgttttgtta

SEQ ID NO: 2478341 - DNA, 14 bp, Homo sapiens
tgcttacctctcag

SEQ ID NO: 2478342 - DNA, 18 bp, Homo sapiens
tgcttatgctcttaattg

SEQ ID NO: 2478343 - DNA, 19 bp, Homo sapiens
tgcttattccatgactgct

SEQ ID NO: 2478344 - DNA, 22 bp, Homo sapiens
tgcttattccatgactgcttgc

SEQ ID NO: 2478345 - DNA, 18 bp, Homo sapiens
tgcttatttattgtattc

SEQ ID NO: 2478346 - DNA, 21 bp, Homo sapiens
tgcttatttattgtattctgg

SEQ ID NO: 2478347 - DNA, 23 bp, Homo sapiens
tgcttatttgacaacgtttcagc

SEQ ID NO: 2478348 - DNA, 17 bp, Homo sapiens
tgcttcatgtgtcccag

SEQ ID NO: 2478349 - DNA, 12 bp, Homo sapiens
tgcttccagtgt

SEQ ID NO: 2478350 - DNA, 12 bp, Homo sapiens
tgcttcctcctg

SEQ ID NO: 2478351 - DNA, 18 bp, Homo sapiens
tgcttctaagtaaataca

SEQ ID NO: 2478352 - DNA, 21 bp, Homo sapiens
tgcttctataattttgccttt

SEQ ID NO: 2478353 - DNA, 13 bp, Homo sapiens
tgcttctcccagg

SEQ ID NO: 2478354 - DNA, 21 bp, Homo sapiens
tgcttctcccaggcaaggctg

SEQ ID NO: 2478355 - DNA, 14 bp, Homo sapiens
tgcttctctgactt

SEQ ID NO: 2478356 - DNA, 16 bp, Homo sapiens
tgcttgaggaaaacaa

SEQ ID NO: 2478357 - DNA, 18 bp, Homo sapiens
tgcttgatagaaatgcca

SEQ ID NO: 2478358 - DNA, 19 bp, Homo sapiens
tgcttgatgggattctgga

SEQ ID NO: 2478359 - DNA, 21 bp, Homo sapiens
tgcttgccaaggcagaggcct

SEQ ID NO: 2478360 - DNA, 23 bp, Homo sapiens
tgcttgccaaggcagaggcctgg

SEQ ID NO: 2478361 - DNA, 15 bp, Homo sapiens
tgcttgctttgaagt

SEQ ID NO: 2478362 - DNA, 23 bp, Homo sapiens
tgcttgcttttcatgcaaactct

SEQ ID NO: 2478363 - DNA, 21 bp, Homo sapiens
tgcttggggggtgatgagggc

SEQ ID NO: 2478364 - DNA, 14 bp, Homo sapiens
tgctttattccaga

SEQ ID NO: 2478365 - DNA, 15 bp, Homo sapiens
tggagtcccctcacc

SEQ ID NO: 2478366 - DNA, 15 bp, Homo sapiens
tggagtctgccaccc

SEQ ID NO: 2478367 - DNA, 16 bp, Homo sapiens
tggagtggcagcccag

SEQ ID NO: 2478368 - DNA, 20 bp, Homo sapiens
tggagtggcagcccagccag

SEQ ID NO: 2478369 - DNA, 17 bp, Homo sapiens
tggagtgtatgactgca

SEQ ID NO: 2478370 - DNA, 15 bp, Homo sapiens
tggagttgatctgga

SEQ ID NO: 2478371 - DNA, 17 bp, Homo sapiens
tggagttgatctggaac

SEQ ID NO: 2478372 - DNA, 17 bp, Homo sapiens
tggagttttttgtacca

SEQ ID NO: 2478373 - DNA, 18 bp, Homo sapiens
tggagttttttgtaccaa

SEQ ID NO: 2478374 - DNA, 16 bp, Homo sapiens
tggataacttccacag

SEQ ID NO: 2478375 - DNA, 16 bp, Homo sapiens
tggatatgtaaaacat

SEQ ID NO: 2478376 - DNA, 15 bp, Homo sapiens
tggatcactcaccat

SEQ ID NO: 2478377 - DNA, 16 bp, Homo sapiens
tggatcctgtgtggag

SEQ ID NO: 2478378 - DNA, 18 bp, Homo sapiens
tggatctatttcatgttt

SEQ ID NO: 2478379 - DNA, 20 bp, Homo sapiens
tggatctatttcatgttttt

SEQ ID NO: 2478380 - DNA, 21 bp, Homo sapiens
tggatcttgatgtaaggatgg

SEQ ID NO: 2478381 - DNA, 23 bp, Homo sapiens
tggatgagctcccacaagcctga

SEQ ID NO: 2478382 - DNA, 16 bp, Homo sapiens
tggatgatactaataa

SEQ ID NO: 2478383 - DNA, 14 bp, Homo sapiens
tggatggccccagc

SEQ ID NO: 2478384 - DNA, 17 bp, Homo sapiens
tggatggccccagcaca

SEQ ID NO: 2478385 - DNA, 18 bp, Homo sapiens
tggatggccccagcacag

SEQ ID NO: 2478386 - DNA, 20 bp, Homo sapiens
tggatggggcaggccacctg

SEQ ID NO: 2478387 - DNA, 23 bp, Homo sapiens
tggatgggggaactcagatccag

SEQ ID NO: 2478388 - DNA, 15 bp, Homo sapiens
tggatgtccccagca

SEQ ID NO: 2478389 - DNA, 18 bp, Homo sapiens
tggattccccatctcagg

SEQ ID NO: 2478390 - DNA, 17 bp, Homo sapiens
tggattgcacgtggcct

SEQ ID NO: 2478391 - DNA, 18 bp, Homo sapiens
tggatttaaaagcctgct

SEQ ID NO: 2478392 - DNA, 15 bp, Homo sapiens
tggatttcctaatac

SEQ ID NO: 2478393 - DNA, 13 bp, Homo sapiens
tggatttgacatt

SEQ ID NO: 2478394 - DNA, 14 bp, Homo sapiens
tggatttgacattg

SEQ ID NO: 2478395 - DNA, 18 bp, Homo sapiens
tggatttttctttaactg

SEQ ID NO: 2478396 - DNA, 18 bp, Homo sapiens
tggcaacagatctggaac

SEQ ID NO: 2478397 - DNA, 16 bp, Homo sapiens
tggcaaggaaaaacag

SEQ ID NO: 2478398 - DNA, 16 bp, Homo sapiens
tggcacaggccccctt

SEQ ID NO: 2478399 - DNA, 14 bp, Homo sapiens
tggcaccagacacc

SEQ ID NO: 2478400 - DNA, 23 bp, Homo sapiens
tggcaccagacacccaggactta

SEQ ID NO: 2478401 - DNA, 16 bp, Homo sapiens
tggcaccgaagcccag

SEQ ID NO: 2478402 - DNA, 17 bp, Homo sapiens
tggcaccgaagcccaga

SEQ ID NO: 2478403 - DNA, 18 bp, Homo sapiens
tggcaccgaagcccagag

SEQ ID NO: 2478404 - DNA, 22 bp, Homo sapiens
tggcactaacgttgagcccctg

SEQ ID NO: 2478405 - DNA, 17 bp, Homo sapiens
tggcagagttacagttc

SEQ ID NO: 2478406 - DNA, 19 bp, Homo sapiens
tggcagagttacagttctg

SEQ ID NO: 2478407 - DNA, 15 bp, Homo sapiens
tggcagatgtaggag

SEQ ID NO: 2478408 - DNA, 17 bp, Homo sapiens
tggcagatgtaggaggg

SEQ ID NO: 2478409 - DNA, 20 bp, Homo sapiens
tggcagatgtaggagggact

SEQ ID NO: 2478410 - DNA, 20 bp, Homo sapiens
tggcagcaacggcacagcta

SEQ ID NO: 2478411 - DNA, 14 bp, Homo sapiens
tggcagcccagcca

SEQ ID NO: 2478412 - DNA, 11 bp, Homo sapiens
tggcagctttt

SEQ ID NO: 2478413 - DNA, 12 bp, Homo sapiens
tggcaggaaggc

SEQ ID NO: 2478414 - DNA, 22 bp, Homo sapiens
tggcaggcagaggcccaggctg

SEQ ID NO: 2478415 - DNA, 15 bp, Homo sapiens
tggcagggggctgct

SEQ ID NO: 2478416 - DNA, 18 bp, Homo sapiens
tggcagggggctgctgct

SEQ ID NO: 2478417 - DNA, 21 bp, Homo sapiens
tggcagggggctgctgctggg

SEQ ID NO: 2478418 - DNA, 18 bp, Homo sapiens
tggcagtccgtgggacgg

SEQ ID NO: 2478419 - DNA, 13 bp, Homo sapiens
tggcagttatatt

SEQ ID NO: 2478420 - DNA, 20 bp, Homo sapiens
tggcatccctgggccttggg

SEQ ID NO: 2478421 - DNA, 21 bp, Homo sapiens
tggcatcgcaccattctgact

SEQ ID NO: 2478422 - DNA, 20 bp, Homo sapiens
tggcatgttagcccttcctc

SEQ ID NO: 2478423 - DNA, 13 bp, Homo sapiens
tggccaagaagca

SEQ ID NO: 2478424 - DNA, 22 bp, Homo sapiens
tggccaagaagcagtggcctta

SEQ ID NO: 2478425 - DNA, 16 bp, Homo sapiens
tggccaagttcctcta

SEQ ID NO: 2478426 - DNA, 12 bp, Homo sapiens
tggccacagcca

SEQ ID NO: 2478427 - DNA, 16 bp, Homo sapiens
tggccacagccagggg

SEQ ID NO: 2478428 - DNA, 20 bp, Homo sapiens
tggccactccgagaggtggg

SEQ ID NO: 2478429 - DNA, 20 bp, Homo sapiens
tggccagcagcacctgccct

SEQ ID NO: 2478430 - DNA, 21 bp, Homo sapiens
tggccagcagcacctgcccta

SEQ ID NO: 2478431 - DNA, 21 bp, Homo sapiens
tggccagccaacttttgcatg

SEQ ID NO: 2478432 - DNA, 12 bp, Homo sapiens
tggccagcccct

SEQ ID NO: 2478433 - DNA, 20 bp, Homo sapiens
tggccagccccttagacaga

SEQ ID NO: 2478434 - DNA, 23 bp, Homo sapiens
tggccagcgagcgcccagctcct

SEQ ID NO: 2478435 - DNA, 11 bp, Homo sapiens
tggccaggagg

SEQ ID NO: 2478436 - DNA, 15 bp, Homo sapiens
tggccaggccgggaa

SEQ ID NO: 2478437 - DNA, 20 bp, Homo sapiens
tggccagggccacgctccag

SEQ ID NO: 2478438 - DNA, 15 bp, Homo sapiens
tggccagtccaggct

SEQ ID NO: 2478439 - DNA, 18 bp, Homo sapiens
tggccagtgccctgatcc

SEQ ID NO: 2478440 - DNA, 21 bp, Homo sapiens
tggccagtgccctgatcccag

SEQ ID NO: 2478441 - DNA, 19 bp, Homo sapiens
tggccatatttacctcagc

SEQ ID NO: 2478442 - DNA, 22 bp, Homo sapiens
tggccatatttacctcagcctg

SEQ ID NO: 2478443 - DNA, 16 bp, Homo sapiens
tggccatgaccctgcc

SEQ ID NO: 2478444 - DNA, 23 bp, Homo sapiens
tggccatggagaaagctgacttg

SEQ ID NO: 2478445 - DNA, 22 bp, Homo sapiens
tggcccaccccacccacttctg

SEQ ID NO: 2478446 - DNA, 13 bp, Homo sapiens
tggcccagccttt

SEQ ID NO: 2478447 - DNA, 14 bp, Homo sapiens
tggcccagggccca

SEQ ID NO: 2478448 - DNA, 17 bp, Homo sapiens
tggcccagggcccagag

SEQ ID NO: 2478449 - DNA, 18 bp, Homo sapiens
tggcccagggcccagagc

SEQ ID NO: 2478450 - DNA, 13 bp, Homo sapiens
tggccccaccctg

SEQ ID NO: 2478451 - DNA, 18 bp, Homo sapiens
tggccccagcacagcttg

SEQ ID NO: 2478452 - DNA, 12 bp, Homo sapiens
tggccccaggac

SEQ ID NO: 2478453 - DNA, 20 bp, Homo sapiens
tggccccaggacctggctgc

SEQ ID NO: 2478454 - DNA, 15 bp, Homo sapiens
tggcccccctggtcc

SEQ ID NO: 2478455 - DNA, 21 bp, Homo sapiens
tggcccccctggtcccctcct

SEQ ID NO: 2478456 - DNA, 11 bp, Homo sapiens
tggccccctcc

SEQ ID NO: 2478457 - DNA, 16 bp, Homo sapiens
tggccccgtttctggt

SEQ ID NO: 2478458 - DNA, 18 bp, Homo sapiens
tggccctctcccctgccc

SEQ ID NO: 2478459 - DNA, 15 bp, Homo sapiens
tggccctgcaaaagg

SEQ ID NO: 2478460 - DNA, 22 bp, Homo sapiens
tggccctgggagaatcgctcct

SEQ ID NO: 2478461 - DNA, 21 bp, Homo sapiens
tggccctgggtcccaggaccc

SEQ ID NO: 2478462 - DNA, 16 bp, Homo sapiens
tggcccttcctggaca

SEQ ID NO: 2478463 - DNA, 17 bp, Homo sapiens
tggcccttcctggacag

SEQ ID NO: 2478464 - DNA, 18 bp, Homo sapiens
tggcccttcctggacagc

SEQ ID NO: 2478465 - DNA, 19 bp, Homo sapiens
tggcccttgcttacctctc

SEQ ID NO: 2478466 - DNA, 17 bp, Homo sapiens
tggccgagtccaagctg

SEQ ID NO: 2478467 - DNA, 21 bp, Homo sapiens
tggccgccccctgccccccag

SEQ ID NO: 2478468 - DNA, 18 bp, Homo sapiens
tggcctagaccagcagac

SEQ ID NO: 2478469 - DNA, 21 bp, Homo sapiens
tggcctagaccagcagacaga

SEQ ID NO: 2478470 - DNA, 22 bp, Homo sapiens
tggcctcacccacccctgcaca

SEQ ID NO: 2478471 - DNA, 20 bp, Homo sapiens
tggcctcatgctggagggag

SEQ ID NO: 2478472 - DNA, 13 bp, Homo sapiens
tggcctcatgtgg

SEQ ID NO: 2478473 - DNA, 15 bp, Homo sapiens
tggcctcatgtggct

SEQ ID NO: 2478474 - DNA, 17 bp, Homo sapiens
tggcctcatgtggctgg

SEQ ID NO: 2478475 - DNA, 19 bp, Homo sapiens
tggcctcatgtggctggaa

SEQ ID NO: 2478476 - DNA, 20 bp, Homo sapiens
tggcctcatgtggctggaag

SEQ ID NO: 2478477 - DNA, 19 bp, Homo sapiens
tggcctcccctgccaccag

SEQ ID NO: 2478478 - DNA, 21 bp, Homo sapiens
tggcctcccctgccaccaggc

SEQ ID NO: 2478479 - DNA, 16 bp, Homo sapiens
tggcctcctgcctcta

SEQ ID NO: 2478480 - DNA, 14 bp, Homo sapiens
tggcctctctatcc

SEQ ID NO: 2478481 - DNA, 17 bp, Homo sapiens
tggcctctctatcctct

SEQ ID NO: 2478482 - DNA, 15 bp, Homo sapiens
tggcctctctctagg

SEQ ID NO: 2478483 - DNA, 20 bp, Homo sapiens
tggcctcttgagcagtggct

SEQ ID NO: 2478484 - DNA, 22 bp, Homo sapiens
tggcctgatcagaccacggctc

SEQ ID NO: 2478485 - DNA, 15 bp, Homo sapiens
tggcctgcaaactgg

SEQ ID NO: 2478486 - DNA, 17 bp, Homo sapiens
tggcctgcaaactggga

SEQ ID NO: 2478487 - DNA, 13 bp, Homo sapiens
tggcctggactgt

SEQ ID NO: 2478488 - DNA, 14 bp, Homo sapiens
tggcctggccagtg

SEQ ID NO: 2478489 - DNA, 16 bp, Homo sapiens
tggcctttttcattta

SEQ ID NO: 2478490 - DNA, 19 bp, Homo sapiens
tggcctttttcatttatct

SEQ ID NO: 2478491 - DNA, 17 bp, Homo sapiens
tggcgccgtctccaggg

SEQ ID NO: 2478492 - DNA, 20 bp, Homo sapiens
tggcggctggggtcccagca

SEQ ID NO: 2478493 - DNA, 19 bp, Homo sapiens
tggcggggaggaggaaatc

SEQ ID NO: 2478494 - DNA, 15 bp, Homo sapiens
tggcgtaagtacaga

SEQ ID NO: 2478495 - DNA, 17 bp, Homo sapiens
tggcgtaagtacagaga

SEQ ID NO: 2478496 - DNA, 19 bp, Homo sapiens
tggcgtaagtacagagaag

SEQ ID NO: 2478497 - DNA, 16 bp, Homo sapiens
tggctactctgtgcca

SEQ ID NO: 2478498 - DNA, 19 bp, Homo sapiens
tggctactctgtgccagag

SEQ ID NO: 2478499 - DNA, 20 bp, Homo sapiens
tggctactctgtgccagagc

SEQ ID NO: 2478500 - DNA, 21 bp, Homo sapiens
tggctactctgtgccagagcc

SEQ ID NO: 2478501 - DNA, 17 bp, Homo sapiens
tggctatagatgtcttt

SEQ ID NO: 2478502 - DNA, 19 bp, Homo sapiens
tggctatagatgtcttttc

SEQ ID NO: 2478503 - DNA, 17 bp, Homo sapiens
tggctcactcagcactt

SEQ ID NO: 2478504 - DNA, 16 bp, Homo sapiens
tggctcagccagcact

SEQ ID NO: 2478505 - DNA, 20 bp, Homo sapiens
tggctccagatgcagggcag

SEQ ID NO: 2478506 - DNA, 23 bp, Homo sapiens
tggctccagatgcagggcagtca

SEQ ID NO: 2478507 - DNA, 21 bp, Homo sapiens
tggctcgaatctctgtgcctt

SEQ ID NO: 2478508 - DNA, 17 bp, Homo sapiens
tggctctcctggccctg

SEQ ID NO: 2478509 - DNA, 13 bp, Homo sapiens
tggctctgccagt

SEQ ID NO: 2478510 - DNA, 19 bp, Homo sapiens
tggctcttgatacccccct

SEQ ID NO: 2478511 - DNA, 20 bp, Homo sapiens
tggctcttgatacccccctc

SEQ ID NO: 2478512 - DNA, 18 bp, Homo sapiens
tggctgaaattctcctgg

SEQ ID NO: 2478513 - DNA, 20 bp, Homo sapiens
tggctgaaattctcctggag

SEQ ID NO: 2478514 - DNA, 17 bp, Homo sapiens
tggctgaggccacccag

SEQ ID NO: 2478515 - DNA, 14 bp, Homo sapiens
tggctgagggcagt

SEQ ID NO: 2478516 - DNA, 19 bp, Homo sapiens
tggctgataattttaaatt

SEQ ID NO: 2478517 - DNA, 19 bp, Homo sapiens
tggctgcacctttttgcat

SEQ ID NO: 2478518 - DNA, 12 bp, Homo sapiens
tggctgcagcct

SEQ ID NO: 2478519 - DNA, 13 bp, Homo sapiens
tggctgcagcctc

SEQ ID NO: 2478520 - DNA, 20 bp, Homo sapiens
tggctgcagcctcaggactg

SEQ ID NO: 2478521 - DNA, 20 bp, Homo sapiens
tggctgctgatcgccttccc

SEQ ID NO: 2478522 - DNA, 20 bp, Homo sapiens
tggctggaagatcctgcggg

SEQ ID NO: 2478523 - DNA, 14 bp, Homo sapiens
tggctggctgaggg

SEQ ID NO: 2478524 - DNA, 17 bp, Homo sapiens
tggctggctgagggcag

SEQ ID NO: 2478525 - DNA, 13 bp, Homo sapiens
tggctggtgtggt

SEQ ID NO: 2478526 - DNA, 18 bp, Homo sapiens
tggctggtgttaacagaa

SEQ ID NO: 2478527 - DNA, 21 bp, Homo sapiens
tggctggtgttaacagaaggg

SEQ ID NO: 2478528 - DNA, 15 bp, Homo sapiens
tggctgtaaggctct

SEQ ID NO: 2478529 - DNA, 16 bp, Homo sapiens
tggctgtaaggctcta

SEQ ID NO: 2478530 - DNA, 13 bp, Homo sapiens
tggcttacctggc

SEQ ID NO: 2478531 - DNA, 17 bp, Homo sapiens
tggcttacctggcccat

SEQ ID NO: 2478532 - DNA, 19 bp, Homo sapiens
tggcttataattctttcaa

SEQ ID NO: 2478533 - DNA, 18 bp, Homo sapiens
tggcttggccacagccag

SEQ ID NO: 2478534 - DNA, 19 bp, Homo sapiens
tggcttggccacagccagg

SEQ ID NO: 2478535 - DNA, 22 bp, Homo sapiens
tggcttggccacagccagggga

SEQ ID NO: 2478536 - DNA, 23 bp, Homo sapiens
tggcttggccacagccaggggag

SEQ ID NO: 2478537 - DNA, 15 bp, Homo sapiens
tggcttgtttgattt

SEQ ID NO: 2478538 - DNA, 11 bp, Homo sapiens
tggctttcagg

SEQ ID NO: 2478539 - DNA, 21 bp, Homo sapiens
tggctttcattttctctcagg

SEQ ID NO: 2478540 - DNA, 14 bp, Homo sapiens
tggctttggtctct

SEQ ID NO: 2478541 - DNA, 20 bp, Homo sapiens
tggcttttattaatgcactt

SEQ ID NO: 2478542 - DNA, 22 bp, Homo sapiens
tggcttttattaatgcactttc

SEQ ID NO: 2478543 - DNA, 20 bp, Homo sapiens
tgggaaccccttcatcctct

SEQ ID NO: 2478544 - DNA, 20 bp, Homo sapiens
tgggaagactcctagctgtc

SEQ ID NO: 2478545 - DNA, 23 bp, Homo sapiens
tgggaagactcctagctgtcctt

SEQ ID NO: 2478546 - DNA, 19 bp, Homo sapiens
tgggaagcccatcctgacc

SEQ ID NO: 2478547 - DNA, 17 bp, Homo sapiens
tgggacattccaaagaa

SEQ ID NO: 2478548 - DNA, 17 bp, Homo sapiens
tgggaccacaactattt

SEQ ID NO: 2478549 - DNA, 14 bp, Homo sapiens
tgggaccaggcacc

SEQ ID NO: 2478550 - DNA, 20 bp, Homo sapiens
tgggaccgctacaccactct

SEQ ID NO: 2478551 - DNA, 22 bp, Homo sapiens
tgggaccgctacaccactctgg

SEQ ID NO: 2478552 - DNA, 16 bp, Homo sapiens
tgggacctagggaggc

SEQ ID NO: 2478553 - DNA, 23 bp, Homo sapiens
tgggacgggatggttctggctgt

SEQ ID NO: 2478554 - DNA, 17 bp, Homo sapiens
tgggactgctaaataaa

SEQ ID NO: 2478555 - DNA, 23 bp, Homo sapiens
tgggagaccggcctgccaggagg

SEQ ID NO: 2478556 - DNA, 12 bp, Homo sapiens
tgggagagactt

SEQ ID NO: 2478557 - DNA, 12 bp, Homo sapiens
tgggagagggcg

SEQ ID NO: 2478558 - DNA, 15 bp, Homo sapiens
tgggagcccccagcc

SEQ ID NO: 2478559 - DNA, 16 bp, Homo sapiens
tgggagcccccagcct

SEQ ID NO: 2478560 - DNA, 18 bp, Homo sapiens
tgggagccgggtctgcct

SEQ ID NO: 2478561 - DNA, 22 bp, Homo sapiens
tgggagctccactctgcttctc

SEQ ID NO: 2478562 - DNA, 13 bp, Homo sapiens
tgggaggctcacc

SEQ ID NO: 2478563 - DNA, 22 bp, Homo sapiens
tgggaggctcacccccttctcc

SEQ ID NO: 2478564 - DNA, 17 bp, Homo sapiens
tgggagggaggctcagg

SEQ ID NO: 2478565 - DNA, 17 bp, Homo sapiens
tgggagggcagcagggc

SEQ ID NO: 2478566 - DNA, 19 bp, Homo sapiens
tgggagggcagcagggcta

SEQ ID NO: 2478567 - DNA, 15 bp, Homo sapiens
tgggagtcacacagt

SEQ ID NO: 2478568 - DNA, 20 bp, Homo sapiens
tgggatcaggggtaggaatg

SEQ ID NO: 2478569 - DNA, 22 bp, Homo sapiens
tgggatgttcagcactgtccct

SEQ ID NO: 2478570 - DNA, 19 bp, Homo sapiens
tgggattatgggtcacagg

SEQ ID NO: 2478571 - DNA, 14 bp, Homo sapiens
tgggatttgctgtg

SEQ ID NO: 2478572 - DNA, 12 bp, Homo sapiens
tggtcctttggg

SEQ ID NO: 2478573 - DNA, 12 bp, Homo sapiens
tggtctaaaact

SEQ ID NO: 2478574 - DNA, 18 bp, Homo sapiens
tggtctcaaactcctgac

SEQ ID NO: 2478575 - DNA, 15 bp, Homo sapiens
tggtctcaccctgga

SEQ ID NO: 2478576 - DNA, 17 bp, Homo sapiens
tggtctcaccctggagg

SEQ ID NO: 2478577 - DNA, 21 bp, Homo sapiens
tggtctctctatgcctctcta

SEQ ID NO: 2478578 - DNA, 11 bp, Homo sapiens
tggtctgctgt

SEQ ID NO: 2478579 - DNA, 18 bp, Homo sapiens
tggtctgttggcaggctg

SEQ ID NO: 2478580 - DNA, 20 bp, Homo sapiens
tggtcttacagcaggcagta

SEQ ID NO: 2478581 - DNA, 16 bp, Homo sapiens
tggtcttttataattc

SEQ ID NO: 2478582 - DNA, 18 bp, Homo sapiens
tggtgacatcaggttttt

SEQ ID NO: 2478583 - DNA, 22 bp, Homo sapiens
tggtgcaagttgaggacttctt

SEQ ID NO: 2478584 - DNA, 23 bp, Homo sapiens
tggtgcaagttgaggacttcttg

SEQ ID NO: 2478585 - DNA, 13 bp, Homo sapiens
tggtgccccagga

SEQ ID NO: 2478586 - DNA, 19 bp, Homo sapiens
tggtgccccaggaccagct

SEQ ID NO: 2478587 - DNA, 15 bp, Homo sapiens
tggtggcacaggccc

SEQ ID NO: 2478588 - DNA, 15 bp, Homo sapiens
tggtggcctggtccc

SEQ ID NO: 2478589 - DNA, 18 bp, Homo sapiens
tggtgggtccatgggcag

SEQ ID NO: 2478590 - DNA, 23 bp, Homo sapiens
tggtgggtgcctaggcctgggca

SEQ ID NO: 2478591 - DNA, 14 bp, Homo sapiens
tggtggtccctggg

SEQ ID NO: 2478592 - DNA, 17 bp, Homo sapiens
tggtgtagaacactaat

SEQ ID NO: 2478593 - DNA, 18 bp, Homo sapiens
tggtgtcagaccctggag

SEQ ID NO: 2478594 - DNA, 19 bp, Homo sapiens
tggtgtcagaccctggagg

SEQ ID NO: 2478595 - DNA, 23 bp, Homo sapiens
tggtgtctcttctttagaacagg

SEQ ID NO: 2478596 - DNA, 18 bp, Homo sapiens
tggtgtgatcgtctgact

SEQ ID NO: 2478597 - DNA, 14 bp, Homo sapiens
tggtgtggtacaga

SEQ ID NO: 2478598 - DNA, 17 bp, Homo sapiens
tggttatgaatactttg

SEQ ID NO: 2478599 - DNA, 22 bp, Homo sapiens
tggttccagggtccctctgtgt

SEQ ID NO: 2478600 - DNA, 16 bp, Homo sapiens
tggttccccagtagag

SEQ ID NO: 2478601 - DNA, 17 bp, Homo sapiens
tggttctaaggacctga

SEQ ID NO: 2478602 - DNA, 18 bp, Homo sapiens
tggttctgagatggctcc

SEQ ID NO: 2478603 - DNA, 17 bp, Homo sapiens
tggttctggctgtttga

SEQ ID NO: 2478604 - DNA, 21 bp, Homo sapiens
tggttcttgaggggaccagga

SEQ ID NO: 2478605 - DNA, 12 bp, Homo sapiens
tggttgaggaaa

SEQ ID NO: 2478606 - DNA, 23 bp, Homo sapiens
tggtttaaaagacacacttgtcc

SEQ ID NO: 2478607 - DNA, 21 bp, Homo sapiens
tggtttaaagaaagtgtattt

SEQ ID NO: 2478608 - DNA, 15 bp, Homo sapiens
tggtttcgaactcct

SEQ ID NO: 2478609 - DNA, 18 bp, Homo sapiens
tggtttgcagcgactggc

SEQ ID NO: 2478610 - DNA, 15 bp, Homo sapiens
tggtttgcaggtggc

SEQ ID NO: 2478611 - DNA, 12 bp, Homo sapiens
tgtaaaacaggt

SEQ ID NO: 2478612 - DNA, 13 bp, Homo sapiens
tgtaaaacaggta

SEQ ID NO: 2478613 - DNA, 14 bp, Homo sapiens
tgtaaaacaggtag

SEQ ID NO: 2478614 - DNA, 12 bp, Homo sapiens
tgtaaaataatt

SEQ ID NO: 2478615 - DNA, 19 bp, Homo sapiens
tgtaaaatattttgaatca

SEQ ID NO: 2478616 - DNA, 12 bp, Homo sapiens
tgtaaaatcttg

SEQ ID NO: 2478617 - DNA, 18 bp, Homo sapiens
tgtaaaatcttgtcatgt

SEQ ID NO: 2478618 - DNA, 20 bp, Homo sapiens
tgtaaaatcttgtcatgtgt

SEQ ID NO: 2478619 - DNA, 19 bp, Homo sapiens
tgtaaaatgacaatcatgt

SEQ ID NO: 2478620 - DNA, 21 bp, Homo sapiens
tgtaaacaaactgtgtaactg

SEQ ID NO: 2478621 - DNA, 15 bp, Homo sapiens
tgtaaactgtgcacc

SEQ ID NO: 2478622 - DNA, 13 bp, Homo sapiens
tgtaaactttttg

SEQ ID NO: 2478623 - DNA, 21 bp, Homo sapiens
tgtaaaggagtcaaaactaca

SEQ ID NO: 2478624 - DNA, 19 bp, Homo sapiens
tgtaaatatgtacatttct

SEQ ID NO: 2478625 - DNA, 20 bp, Homo sapiens
tgtaaatattttaaagaatt

SEQ ID NO: 2478626 - DNA, 13 bp, Homo sapiens
tgtaaatttgtac

SEQ ID NO: 2478627 - DNA, 20 bp, Homo sapiens
tgtaacaattgtgtagcctt

SEQ ID NO: 2478628 - DNA, 11 bp, Homo sapiens
tgtaacatgta

SEQ ID NO: 2478629 - DNA, 18 bp, Homo sapiens
tgtaactactttataact

SEQ ID NO: 2478630 - DNA, 18 bp, Homo sapiens
tgtaactgcccaaagcag

SEQ ID NO: 2478631 - DNA, 16 bp, Homo sapiens
tgtaactgcctagaaa

SEQ ID NO: 2478632 - DNA, 22 bp, Homo sapiens
tgtaacttgatccatttctaat

SEQ ID NO: 2478633 - DNA, 19 bp, Homo sapiens
tgtaagattatagattcta

SEQ ID NO: 2478634 - DNA, 22 bp, Homo sapiens
tgtaagattatagattctaaag

SEQ ID NO: 2478635 - DNA, 21 bp, Homo sapiens
tgtaagatttgtttttaaact

SEQ ID NO: 2478636 - DNA, 23 bp, Homo sapiens
tgtaagatttgtttttaaactgt

SEQ ID NO: 2478637 - DNA, 19 bp, Homo sapiens
tgtaaggatccggaaagaa

SEQ ID NO: 2478638 - DNA, 14 bp, Homo sapiens
tgtaaggctctaga

SEQ ID NO: 2478639 - DNA, 14 bp, Homo sapiens
tgtaaggctgtgta

SEQ ID NO: 2478640 - DNA, 21 bp, Homo sapiens
tgtaagggccagaaatatctt

SEQ ID NO: 2478641 - DNA, 14 bp, Homo sapiens
tgtaagttgggctt

SEQ ID NO: 2478642 - DNA, 13 bp, Homo sapiens
tgtaataaacttt

SEQ ID NO: 2478643 - DNA, 21 bp, Homo sapiens
tgtaatataaagtattcaaca

SEQ ID NO: 2478644 - DNA, 14 bp, Homo sapiens
tgtaatcaatgttt

SEQ ID NO: 2478645 - DNA, 16 bp, Homo sapiens
tgtaatccgaatctct

SEQ ID NO: 2478646 - DNA, 15 bp, Homo sapiens
tgtaatcttgaattg

SEQ ID NO: 2478647 - DNA, 21 bp, Homo sapiens
tgtaatcttgaattgtaactg

SEQ ID NO: 2478648 - DNA, 23 bp, Homo sapiens
tgtaatggcagttatattttgca

SEQ ID NO: 2478649 - DNA, 19 bp, Homo sapiens
tgtaatggtactgactttg

SEQ ID NO: 2478650 - DNA, 20 bp, Homo sapiens
tgtaatgtcttgagctctat

SEQ ID NO: 2478651 - DNA, 14 bp, Homo sapiens
tgtaatgttaatat

SEQ ID NO: 2478652 - DNA, 16 bp, Homo sapiens
tgtaattaaaagcaaa

SEQ ID NO: 2478653 - DNA, 21 bp, Homo sapiens
tgtaattagtgccacttaatg

SEQ ID NO: 2478654 - DNA, 23 bp, Homo sapiens
tgtaattagtgccacttaatgta

SEQ ID NO: 2478655 - DNA, 19 bp, Homo sapiens
tgtaattcaggtttttcct

SEQ ID NO: 2478656 - DNA, 16 bp, Homo sapiens
tgtaattctaaatgaa

SEQ ID NO: 2478657 - DNA, 16 bp, Homo sapiens
tgtaattgtgtggatt

SEQ ID NO: 2478658 - DNA, 15 bp, Homo sapiens
tgtacacaactcact

SEQ ID NO: 2478659 - DNA, 14 bp, Homo sapiens
tgtacagtagattt

SEQ ID NO: 2478660 - DNA, 13 bp, Homo sapiens
tgtacagtgttac

SEQ ID NO: 2478661 - DNA, 18 bp, Homo sapiens
tgtacatctattttggat

SEQ ID NO: 2478662 - DNA, 20 bp, Homo sapiens
tgtacatctattttggattg

SEQ ID NO: 2478663 - DNA, 22 bp, Homo sapiens
tgtacatgaagaagctaaatcc

SEQ ID NO: 2478664 - DNA, 16 bp, Homo sapiens
tgtacatgagaaggaa

SEQ ID NO: 2478665 - DNA, 17 bp, Homo sapiens
tgtacatttctcaggct

SEQ ID NO: 2478666 - DNA, 15 bp, Homo sapiens
tgtaccaagaatctt

SEQ ID NO: 2478667 - DNA, 12 bp, Homo sapiens
tgtaccagttaa

SEQ ID NO: 2478668 - DNA, 23 bp, Homo sapiens
tgtaccagttaatttttccaact

SEQ ID NO: 2478669 - DNA, 16 bp, Homo sapiens
tgtacccaccgggcca

SEQ ID NO: 2478670 - DNA, 21 bp, Homo sapiens
tgtacccaccgggccactcct

SEQ ID NO: 2478671 - DNA, 18 bp, Homo sapiens
tgtaccgcgtctaccctg

SEQ ID NO: 2478672 - DNA, 19 bp, Homo sapiens
tgtaccgcgtctaccctgg

SEQ ID NO: 2478673 - DNA, 20 bp, Homo sapiens
tgtaccgcgtctaccctggg

SEQ ID NO: 2478674 - DNA, 18 bp, Homo sapiens
tgtacctgcccccaatcc

SEQ ID NO: 2478675 - DNA, 21 bp, Homo sapiens
tgtaccttttgaggagcccca

SEQ ID NO: 2478676 - DNA, 23 bp, Homo sapiens
tgtcccacccccacccccagctc

SEQ ID NO: 2478677 - DNA, 21 bp, Homo sapiens
tgtcccagaagatgactgagg

SEQ ID NO: 2478678 - DNA, 21 bp, Homo sapiens
tgtcccatcggagtgcggacc

SEQ ID NO: 2478679 - DNA, 16 bp, Homo sapiens
tgtcccatgatccctg

SEQ ID NO: 2478680 - DNA, 18 bp, Homo sapiens
tgtcccatgatccctgtg

SEQ ID NO: 2478681 - DNA, 14 bp, Homo sapiens
tgtccccccactcc

SEQ ID NO: 2478682 - DNA, 22 bp, Homo sapiens
tgtccccctttagatctctgaa

SEQ ID NO: 2478683 - DNA, 13 bp, Homo sapiens
tgtcccctgagtt

SEQ ID NO: 2478684 - DNA, 16 bp, Homo sapiens
tgtcccgattgtaact

SEQ ID NO: 2478685 - DNA, 15 bp, Homo sapiens
tgtccgctgggtggt

SEQ ID NO: 2478686 - DNA, 22 bp, Homo sapiens
tgtccgctgggtggtaccctct

SEQ ID NO: 2478687 - DNA, 15 bp, Homo sapiens
tgtcctacagaaaaa

SEQ ID NO: 2478688 - DNA, 18 bp, Homo sapiens
tgtcctctttcagctcct

SEQ ID NO: 2478689 - DNA, 21 bp, Homo sapiens
tgtcctctttcagctcctgac

SEQ ID NO: 2478690 - DNA, 18 bp, Homo sapiens
tgtcctgaaggcctgagg

SEQ ID NO: 2478691 - DNA, 17 bp, Homo sapiens
tgtcctgagccccaggg

SEQ ID NO: 2478692 - DNA, 18 bp, Homo sapiens
tgtcctgagccccaggga

SEQ ID NO: 2478693 - DNA, 16 bp, Homo sapiens
tgtcctgagctcagcg

SEQ ID NO: 2478694 - DNA, 18 bp, Homo sapiens
tgtcctgccacccagccc

SEQ ID NO: 2478695 - DNA, 22 bp, Homo sapiens
tgtcctgccacccagccccagc

SEQ ID NO: 2478696 - DNA, 14 bp, Homo sapiens
tgtcctgggcctgc

SEQ ID NO: 2478697 - DNA, 15 bp, Homo sapiens
tgtcctgggcctgca

SEQ ID NO: 2478698 - DNA, 14 bp, Homo sapiens
tgtccttagcctgg

SEQ ID NO: 2478699 - DNA, 15 bp, Homo sapiens
tgtccttagcctgga

SEQ ID NO: 2478700 - DNA, 21 bp, Homo sapiens
tgtcctttaccaaagatgaat

SEQ ID NO: 2478701 - DNA, 14 bp, Homo sapiens
tgtcctttcccttc

SEQ ID NO: 2478702 - DNA, 13 bp, Homo sapiens
tgtcctttctaga

SEQ ID NO: 2478703 - DNA, 19 bp, Homo sapiens
tgtcctttctagagcactg

SEQ ID NO: 2478704 - DNA, 13 bp, Homo sapiens
tgtccttttcata

SEQ ID NO: 2478705 - DNA, 16 bp, Homo sapiens
tgtcctttttcctctc

SEQ ID NO: 2478706 - DNA, 15 bp, Homo sapiens
tgtcgctcatgtgtg

SEQ ID NO: 2478707 - DNA, 16 bp, Homo sapiens
tgtcgctcatgtgtgc

SEQ ID NO: 2478708 - DNA, 15 bp, Homo sapiens
tgtcgctgcttcgtg

SEQ ID NO: 2478709 - DNA, 16 bp, Homo sapiens
tgtcgtaaagatttgg

SEQ ID NO: 2478710 - DNA, 18 bp, Homo sapiens
tgtctaagattctagatc

SEQ ID NO: 2478711 - DNA, 15 bp, Homo sapiens
tgtctagaggcaggt

SEQ ID NO: 2478712 - DNA, 19 bp, Homo sapiens
tgtctcaagctcttcctta

SEQ ID NO: 2478713 - DNA, 13 bp, Homo sapiens
tgtctcaggctgc

SEQ ID NO: 2478714 - DNA, 20 bp, Homo sapiens
tgtctcaggctgcctgagtc

SEQ ID NO: 2478715 - DNA, 21 bp, Homo sapiens
tgtctcatccatcatcatgtg

SEQ ID NO: 2478716 - DNA, 15 bp, Homo sapiens
tgtctccatggccct

SEQ ID NO: 2478717 - DNA, 15 bp, Homo sapiens
tgtctcgagcgccct

SEQ ID NO: 2478718 - DNA, 18 bp, Homo sapiens
tgtctcgagcgccctgca

SEQ ID NO: 2478719 - DNA, 20 bp, Homo sapiens
tgtctcgagcgccctgcaga

SEQ ID NO: 2478720 - DNA, 13 bp, Homo sapiens
tgtctctcctgcc

SEQ ID NO: 2478721 - DNA, 17 bp, Homo sapiens
tgtctctcctgcccctt

SEQ ID NO: 2478722 - DNA, 14 bp, Homo sapiens
tgtctctgatgcag

SEQ ID NO: 2478723 - DNA, 19 bp, Homo sapiens
tgtctcttgcctgccactg

SEQ ID NO: 2478724 - DNA, 21 bp, Homo sapiens
tgtctcttttctcttttgctt

SEQ ID NO: 2478725 - DNA, 15 bp, Homo sapiens
tgtctggaagatggg

SEQ ID NO: 2478726 - DNA, 17 bp, Homo sapiens
tgtctggaagatgggga

SEQ ID NO: 2478727 - DNA, 11 bp, Homo sapiens
tgtctggagac

SEQ ID NO: 2478728 - DNA, 12 bp, Homo sapiens
tgtctggagacc

SEQ ID NO: 2478729 - DNA, 13 bp, Homo sapiens
tgtctggagacca

SEQ ID NO: 2478730 - DNA, 17 bp, Homo sapiens
tgtctggagaccaccag

SEQ ID NO: 2478731 - DNA, 20 bp, Homo sapiens
tgtctggcaaggactttgta

SEQ ID NO: 2478732 - DNA, 19 bp, Homo sapiens
tgtctggcaatgccacagc

SEQ ID NO: 2478733 - DNA, 20 bp, Homo sapiens
tgtctgggtgctactgggga

SEQ ID NO: 2478734 - DNA, 14 bp, Homo sapiens
tgtctgtcctttat

SEQ ID NO: 2478735 - DNA, 20 bp, Homo sapiens
tgtctgtgttttgaaagaat

SEQ ID NO: 2478736 - DNA, 16 bp, Homo sapiens
tgtctgttgtattcat

SEQ ID NO: 2478737 - DNA, 12 bp, Homo sapiens
tgtcttgggcag

SEQ ID NO: 2478738 - DNA, 14 bp, Homo sapiens
tgtctttaatgcaa

SEQ ID NO: 2478739 - DNA, 18 bp, Homo sapiens
tgtctttagatagccctg

SEQ ID NO: 2478740 - DNA, 20 bp, Homo sapiens
tgtcttttcccatttatcta

SEQ ID NO: 2478741 - DNA, 13 bp, Homo sapiens
tgtcttttggagg

SEQ ID NO: 2478742 - DNA, 18 bp, Homo sapiens
tgtgaaaatggtccagga

SEQ ID NO: 2478743 - DNA, 14 bp, Homo sapiens
tgtgaaactttcat

SEQ ID NO: 2478744 - DNA, 20 bp, Homo sapiens
tgtgaaagggagaagtgaca

SEQ ID NO: 2478745 - DNA, 14 bp, Homo sapiens
tgtgaaggaccctt

SEQ ID NO: 2478746 - DNA, 22 bp, Homo sapiens
tgtgaatagaactctgaaatga

SEQ ID NO: 2478747 - DNA, 17 bp, Homo sapiens
tgtgaatcaagggtcag

SEQ ID NO: 2478748 - DNA, 20 bp, Homo sapiens
tgtgaatcggcgacggagca

SEQ ID NO: 2478749 - DNA, 22 bp, Homo sapiens
tgtgaattaggctgtaactact

SEQ ID NO: 2478750 - DNA, 23 bp, Homo sapiens
tgtgaattaggctgtaactactt

SEQ ID NO: 2478751 - DNA, 24 bp, Homo sapiens
tgtgaattaggctgtaactacttt

SEQ ID NO: 2478752 - DNA, 16 bp, Homo sapiens
tgtgacataccccctc

SEQ ID NO: 2478753 - DNA, 15 bp, Homo sapiens
tgtgaccaatgtctt

SEQ ID NO: 2478754 - DNA, 20 bp, Homo sapiens
tgtgacccccagctccggcc

SEQ ID NO: 2478755 - DNA, 16 bp, Homo sapiens
tgtgacctgctgagct

SEQ ID NO: 2478756 - DNA, 17 bp, Homo sapiens
tgtgactggctaaagct

SEQ ID NO: 2478757 - DNA, 15 bp, Homo sapiens
tgtgagcccagctgg

SEQ ID NO: 2478758 - DNA, 13 bp, Homo sapiens
tgtgaggccaggg

SEQ ID NO: 2478759 - DNA, 16 bp, Homo sapiens
tgtgaggccagggcag

SEQ ID NO: 2478760 - DNA, 14 bp, Homo sapiens
tgtgaggctgtcct

SEQ ID NO: 2478761 - DNA, 19 bp, Homo sapiens
tgtgagtttaccttgtata

SEQ ID NO: 2478762 - DNA, 22 bp, Homo sapiens
tgtgagtttaccttgtatactg

SEQ ID NO: 2478763 - DNA, 15 bp, Homo sapiens
tgtgatatataagtg

SEQ ID NO: 2478764 - DNA, 16 bp, Homo sapiens
tgtgatatataagtgt

SEQ ID NO: 2478765 - DNA, 15 bp, Homo sapiens
tgtgatattctaaga

SEQ ID NO: 2478766 - DNA, 13 bp, Homo sapiens
tgtgatcgtctga

SEQ ID NO: 2478767 - DNA, 14 bp, Homo sapiens
tgtgatgaatactg

SEQ ID NO: 2478768 - DNA, 22 bp, Homo sapiens
tgtgatgtcatacagagaagtc

SEQ ID NO: 2478769 - DNA, 15 bp, Homo sapiens
tgtgatgtgaagcca

SEQ ID NO: 2478770 - DNA, 15 bp, Homo sapiens
tgtgatgttctaagg

SEQ ID NO: 2478771 - DNA, 20 bp, Homo sapiens
tgtgattcagaaaatgttct

SEQ ID NO: 2478772 - DNA, 18 bp, Homo sapiens
tgtgcaacagggtatgga

SEQ ID NO: 2478773 - DNA, 21 bp, Homo sapiens
tgtgcaaggcagccgtgggcc

SEQ ID NO: 2478774 - DNA, 16 bp, Homo sapiens
tgtgcaatgtgtataa

SEQ ID NO: 2478775 - DNA, 22 bp, Homo sapiens
tgtgcaatgtgtataaacaaga

SEQ ID NO: 2478776 - DNA, 19 bp, Homo sapiens
tgtgcagccgctgagcgag

SEQ ID NO: 2478777 - DNA, 16 bp, Homo sapiens
tgtgcaggtggggaga

SEQ ID NO: 2478778 - DNA, 20 bp, Homo sapiens
tgtgcagtcctgggtcctcc

SEQ ID NO: 2478779 - DNA, 15 bp, Homo sapiens
tgtgcattctggatt

SEQ ID NO: 2478780 - DNA, 16 bp, Homo sapiens
tgttccccactggagc

SEQ ID NO: 2478781 - DNA, 17 bp, Homo sapiens
tgttccccttccactga

SEQ ID NO: 2478782 - DNA, 12 bp, Homo sapiens
tgttcctgctgc

SEQ ID NO: 2478783 - DNA, 20 bp, Homo sapiens
tgttcgcatggtcacacact

SEQ ID NO: 2478784 - DNA, 19 bp, Homo sapiens
tgttcgggccaaggacctg

SEQ ID NO: 2478785 - DNA, 13 bp, Homo sapiens
tgttctaaagctc

SEQ ID NO: 2478786 - DNA, 14 bp, Homo sapiens
tgttctaaagctct

SEQ ID NO: 2478787 - DNA, 15 bp, Homo sapiens
tgttctaaggctctg

SEQ ID NO: 2478788 - DNA, 18 bp, Homo sapiens
tgttctaaggctctgaga

SEQ ID NO: 2478789 - DNA, 23 bp, Homo sapiens
tgttctaaggctctgagagtcta

SEQ ID NO: 2478790 - DNA, 17 bp, Homo sapiens
tgttctaagtttctaag

SEQ ID NO: 2478791 - DNA, 22 bp, Homo sapiens
tgttctcagaatcccttaacag

SEQ ID NO: 2478792 - DNA, 13 bp, Homo sapiens
tgttctgtgtctt

SEQ ID NO: 2478793 - DNA, 14 bp, Homo sapiens
tgttctgtgtcttt

SEQ ID NO: 2478794 - DNA, 22 bp, Homo sapiens
tgttctgttaactgaataccac

SEQ ID NO: 2478795 - DNA, 23 bp, Homo sapiens
tgttctgttaactgaataccact

SEQ ID NO: 2478796 - DNA, 16 bp, Homo sapiens
tgttctgttttgtttc

SEQ ID NO: 2478797 - DNA, 22 bp, Homo sapiens
tgttcttagctcaatgagcatg

SEQ ID NO: 2478798 - DNA, 20 bp, Homo sapiens
tgttcttcctcagccagcct

SEQ ID NO: 2478799 - DNA, 13 bp, Homo sapiens
tgttcttcctggc

SEQ ID NO: 2478800 - DNA, 15 bp, Homo sapiens
tgttcttcctggccg

SEQ ID NO: 2478801 - DNA, 10 bp, Homo sapiens
tgttcttgta

SEQ ID NO: 2478802 - DNA, 13 bp, Homo sapiens
tgttgaatacttt

SEQ ID NO: 2478803 - DNA, 17 bp, Homo sapiens
tgttgacagttcatatg

SEQ ID NO: 2478804 - DNA, 14 bp, Homo sapiens
tgttgacattagtc

SEQ ID NO: 2478805 - DNA, 14 bp, Homo sapiens
tgttgacattctga

SEQ ID NO: 2478806 - DNA, 15 bp, Homo sapiens
tgttgacattctgaa

SEQ ID NO: 2478807 - DNA, 16 bp, Homo sapiens
tgttgacattctgaat

SEQ ID NO: 2478808 - DNA, 18 bp, Homo sapiens
tgttgagccttttccctc

SEQ ID NO: 2478809 - DNA, 23 bp, Homo sapiens
tgttgatactgttgcacgtgtgt

SEQ ID NO: 2478810 - DNA, 15 bp, Homo sapiens
tgttgattaaagatg

SEQ ID NO: 2478811 - DNA, 19 bp, Homo sapiens
tgttgccaaatatgtcctg

SEQ ID NO: 2478812 - DNA, 20 bp, Homo sapiens
tgttgccaaatatgtcctgg

SEQ ID NO: 2478813 - DNA, 23 bp, Homo sapiens
tgttgccaaatatgtcctggggt

SEQ ID NO: 2478814 - DNA, 18 bp, Homo sapiens
tgttgccaagctccaagc

SEQ ID NO: 2478815 - DNA, 20 bp, Homo sapiens
tgttgccaagctccaagccc

SEQ ID NO: 2478816 - DNA, 12 bp, Homo sapiens
tgttggcaggct

SEQ ID NO: 2478817 - DNA, 17 bp, Homo sapiens
tgttggcatagctctgg

SEQ ID NO: 2478818 - DNA, 23 bp, Homo sapiens
tgttggcgtaggctacagagaag

SEQ ID NO: 2478819 - DNA, 19 bp, Homo sapiens
tgttgggaaacttggctcg

SEQ ID NO: 2478820 - DNA, 17 bp, Homo sapiens
tgttgggagagggcgca

SEQ ID NO: 2478821 - DNA, 19 bp, Homo sapiens
tgttgggagagggcgcagg

SEQ ID NO: 2478822 - DNA, 22 bp, Homo sapiens
tgttgtagattgattgtattgt

SEQ ID NO: 2478823 - DNA, 14 bp, Homo sapiens
tgttgtccttttca

SEQ ID NO: 2478824 - DNA, 16 bp, Homo sapiens
tgttgtccttttcata

SEQ ID NO: 2478825 - DNA, 22 bp, Homo sapiens
tgttgtctaagaaattgaatac

SEQ ID NO: 2478826 - DNA, 15 bp, Homo sapiens
tgttgtctcttgagt

SEQ ID NO: 2478827 - DNA, 22 bp, Homo sapiens
tgttgttctgttaactgaatac

SEQ ID NO: 2478828 - DNA, 15 bp, Homo sapiens
tgttgtttcttaaat

SEQ ID NO: 2478829 - DNA, 16 bp, Homo sapiens
tgttgtttcttaaata

SEQ ID NO: 2478830 - DNA, 18 bp, Homo sapiens
tgtttaaaaaaccacatg

SEQ ID NO: 2478831 - DNA, 12 bp, Homo sapiens
tgtttaaaacat

SEQ ID NO: 2478832 - DNA, 18 bp, Homo sapiens
tgtttaatttttatttct

SEQ ID NO: 2478833 - DNA, 21 bp, Homo sapiens
tgtttacaaaaatttctgtaa

SEQ ID NO: 2478834 - DNA, 22 bp, Homo sapiens
tgtttacatgcttattccatga

SEQ ID NO: 2478835 - DNA, 18 bp, Homo sapiens
tgtttagtagcagtgatt

SEQ ID NO: 2478836 - DNA, 17 bp, Homo sapiens
tgtttatcctttcatat

SEQ ID NO: 2478837 - DNA, 16 bp, Homo sapiens
tgtttatggtaaaaaa

SEQ ID NO: 2478838 - DNA, 14 bp, Homo sapiens
tgtttatgtaattt

SEQ ID NO: 2478839 - DNA, 14 bp, Homo sapiens
tgtttattaatctt

SEQ ID NO: 2478840 - DNA, 19 bp, Homo sapiens
tgtttatttttcttgtctt

SEQ ID NO: 2478841 - DNA, 23 bp, Homo sapiens
tgtttatttttcttgtctttatt

SEQ ID NO: 2478842 - DNA, 21 bp, Homo sapiens
tgtttcaaggcactctagatt

SEQ ID NO: 2478843 - DNA, 12 bp, Homo sapiens
tgtttcacagtt

SEQ ID NO: 2478844 - DNA, 17 bp, Homo sapiens
tgtttcacagtttgaaa

SEQ ID NO: 2478845 - DNA, 19 bp, Homo sapiens
tgtttcacagtttgaaata

SEQ ID NO: 2478846 - DNA, 21 bp, Homo sapiens
tgtttcagaggctcagattgt

SEQ ID NO: 2478847 - DNA, 16 bp, Homo sapiens
tgtttcctagctgtgt

SEQ ID NO: 2478848 - DNA, 14 bp, Homo sapiens
tgtttcctctagtt

SEQ ID NO: 2478849 - DNA, 18 bp, Homo sapiens
tgtttcctttttcagata

SEQ ID NO: 2478850 - DNA, 16 bp, Homo sapiens
tgtttctgtaagaaac

SEQ ID NO: 2478851 - DNA, 13 bp, Homo sapiens
tgtttctgttcca

SEQ ID NO: 2478852 - DNA, 14 bp, Homo sapiens
tgtttcttgcctca

SEQ ID NO: 2478853 - DNA, 15 bp, Homo sapiens
tgtttcttgcctcat

SEQ ID NO: 2478854 - DNA, 21 bp, Homo sapiens
tgtttctttctctgaggacaa

SEQ ID NO: 2478855 - DNA, 14 bp, Homo sapiens
tgtttgacacctct

SEQ ID NO: 2478856 - DNA, 18 bp, Homo sapiens
tgtttgagattctcaaag

SEQ ID NO: 2478857 - DNA, 20 bp, Homo sapiens
tgtttgccttctacttttaa

SEQ ID NO: 2478858 - DNA, 22 bp, Homo sapiens
tgtttgcttcatgtgtcccaga

SEQ ID NO: 2478859 - DNA, 13 bp, Homo sapiens
tgtttggctttca

SEQ ID NO: 2478860 - DNA, 23 bp, Homo sapiens
tgtttggggcaggagtagctgag

SEQ ID NO: 2478861 - DNA, 18 bp, Homo sapiens
tgtttgggtttttttcct

SEQ ID NO: 2478862 - DNA, 13 bp, Homo sapiens
tgtttgtttaatt

SEQ ID NO: 2478863 - DNA, 16 bp, Homo sapiens
tgttttaataacttat

SEQ ID NO: 2478864 - DNA, 13 bp, Homo sapiens
tgttttaattgta

SEQ ID NO: 2478865 - DNA, 23 bp, Homo sapiens
tgttttaatttaaacacctcctc

SEQ ID NO: 2478866 - DNA, 16 bp, Homo sapiens
tgttttcccacgagga

SEQ ID NO: 2478867 - DNA, 23 bp, Homo sapiens
tgttttggctgaaattctcctgg

SEQ ID NO: 2478868 - DNA, 14 bp, Homo sapiens
tgttttgttgacat

SEQ ID NO: 2478869 - DNA, 18 bp, Homo sapiens
tgtttttaaactgtacag

SEQ ID NO: 2478870 - DNA, 23 bp, Homo sapiens
tgtttttaaactgtacagtgtct

SEQ ID NO: 2478871 - DNA, 16 bp, Homo sapiens
tgtttttctattaaaa

SEQ ID NO: 2478872 - DNA, 18 bp, Homo sapiens
tgtttttctattaaaaga

SEQ ID NO: 2478873 - DNA, 16 bp, Homo sapiens
tgtttttggtctttta

SEQ ID NO: 2478874 - DNA, 13 bp, Homo sapiens
ttaaaaaaaaaga

SEQ ID NO: 2478875 - DNA, 13 bp, Homo sapiens
ttaaaaaactaaa

SEQ ID NO: 2478876 - DNA, 13 bp, Homo sapiens
ttaaaaaagataa

SEQ ID NO: 2478877 - DNA, 16 bp, Homo sapiens
ttaaaaaggtttacag

SEQ ID NO: 2478878 - DNA, 15 bp, Homo sapiens
ttaaaaataagtcaa

SEQ ID NO: 2478879 - DNA, 22 bp, Homo sapiens
ttaaaaataagtcaacagtaaa

SEQ ID NO: 2478880 - DNA, 15 bp, Homo sapiens
ttaaaactttgaagt

SEQ ID NO: 2478881 - DNA, 12 bp, Homo sapiens
ttaaaagaatat

SEQ ID NO: 2478882 - DNA, 12 bp, Homo sapiens
ttaaaagactca

SEQ ID NO: 2478883 - DNA, 14 bp, Homo sapiens
ttaaaagactcatc

SEQ ID NO: 2478884 - DNA, 19 bp, Homo sapiens
ttacctcctgagaaaaaag

SEQ ID NO: 2478885 - DNA, 16 bp, Homo sapiens
ttaccttgtatactgt

SEQ ID NO: 2478886 - DNA, 16 bp, Homo sapiens
ttacgctttgattcat

SEQ ID NO: 2478887 - DNA, 22 bp, Homo sapiens
ttacgtatgtctggttctcaat

SEQ ID NO: 2478888 - DNA, 23 bp, Homo sapiens
ttactagggatccctcatctgtc

SEQ ID NO: 2478889 - DNA, 15 bp, Homo sapiens
ttactataagaactt

SEQ ID NO: 2478890 - DNA, 12 bp, Homo sapiens
ttactcactgct

SEQ ID NO: 2478891 - DNA, 19 bp, Homo sapiens
ttactcctgtgggagcctc

SEQ ID NO: 2478892 - DNA, 12 bp, Homo sapiens
ttactctaagat

SEQ ID NO: 2478893 - DNA, 14 bp, Homo sapiens
ttactctaagatct

SEQ ID NO: 2478894 - DNA, 19 bp, Homo sapiens
ttactctaagatcttagat

SEQ ID NO: 2478895 - DNA, 21 bp, Homo sapiens
ttactctaagatcttagattc

SEQ ID NO: 2478896 - DNA, 14 bp, Homo sapiens
ttactctgcctaca

SEQ ID NO: 2478897 - DNA, 18 bp, Homo sapiens
ttactctgcctacagaac

SEQ ID NO: 2478898 - DNA, 15 bp, Homo sapiens
ttactgctctgagaa

SEQ ID NO: 2478899 - DNA, 16 bp, Homo sapiens
ttactggcctttttca

SEQ ID NO: 2478900 - DNA, 18 bp, Homo sapiens
ttactggcctttttcatt

SEQ ID NO: 2478901 - DNA, 15 bp, Homo sapiens
ttactgtaactgatt

SEQ ID NO: 2478902 - DNA, 16 bp, Homo sapiens
ttactgtgtaattagt

SEQ ID NO: 2478903 - DNA, 20 bp, Homo sapiens
ttactgtgtaattagtgcca

SEQ ID NO: 2478904 - DNA, 13 bp, Homo sapiens
ttacttgtaaata

SEQ ID NO: 2478905 - DNA, 17 bp, Homo sapiens
ttacttgtaaatataaa

SEQ ID NO: 2478906 - DNA, 18 bp, Homo sapiens
ttactttagaagcctgca

SEQ ID NO: 2478907 - DNA, 14 bp, Homo sapiens
ttacttttgctgta

SEQ ID NO: 2478908 - DNA, 14 bp, Homo sapiens
ttagaaaactttaa

SEQ ID NO: 2478909 - DNA, 17 bp, Homo sapiens
ttagaaataaagcatct

SEQ ID NO: 2478910 - DNA, 13 bp, Homo sapiens
ttagaaatatttt

SEQ ID NO: 2478911 - DNA, 22 bp, Homo sapiens
ttagaaatattttaaaatcagc

SEQ ID NO: 2478912 - DNA, 17 bp, Homo sapiens
ttagaagacaattgaca

SEQ ID NO: 2478913 - DNA, 18 bp, Homo sapiens
ttagaatcaaacattttg

SEQ ID NO: 2478914 - DNA, 12 bp, Homo sapiens
ttagaattattt

SEQ ID NO: 2478915 - DNA, 18 bp, Homo sapiens
ttagactaaggccattat

SEQ ID NO: 2478916 - DNA, 17 bp, Homo sapiens
ttagagtgtctttccac

SEQ ID NO: 2478917 - DNA, 16 bp, Homo sapiens
ttagatagccctgtcc

SEQ ID NO: 2478918 - DNA, 15 bp, Homo sapiens
ttagatctggcatgt

SEQ ID NO: 2478919 - DNA, 13 bp, Homo sapiens
ttagatgttctaa

SEQ ID NO: 2478920 - DNA, 19 bp, Homo sapiens
ttagattaagaaatagaca

SEQ ID NO: 2478921 - DNA, 10 bp, Homo sapiens
ttagatttca

SEQ ID NO: 2478922 - DNA, 22 bp, Homo sapiens
ttagatttcatagttcagaatt

SEQ ID NO: 2478923 - DNA, 13 bp, Homo sapiens
ttagatttgtgtg

SEQ ID NO: 2478924 - DNA, 12 bp, Homo sapiens
ttagattttaca

SEQ ID NO: 2478925 - DNA, 15 bp, Homo sapiens
ttagattttacatga

SEQ ID NO: 2478926 - DNA, 19 bp, Homo sapiens
ttagattttctggttctaa

SEQ ID NO: 2478927 - DNA, 17 bp, Homo sapiens
ttagctcaatgagcatg

SEQ ID NO: 2478928 - DNA, 12 bp, Homo sapiens
ttagctctgaga

SEQ ID NO: 2478929 - DNA, 18 bp, Homo sapiens
ttaggaagcaagcttaat

SEQ ID NO: 2478930 - DNA, 15 bp, Homo sapiens
ttaggacttgccctc

SEQ ID NO: 2478931 - DNA, 17 bp, Homo sapiens
ttaggagaagccaggaa

SEQ ID NO: 2478932 - DNA, 16 bp, Homo sapiens
ttaggagctaaggctc

SEQ ID NO: 2478933 - DNA, 19 bp, Homo sapiens
ttaggcccccatcatcctc

SEQ ID NO: 2478934 - DNA, 17 bp, Homo sapiens
ttaggctgtaactactt

SEQ ID NO: 2478935 - DNA, 22 bp, Homo sapiens
ttaggtgcaatttcaaggttct

SEQ ID NO: 2478936 - DNA, 13 bp, Homo sapiens
ttaggttctaaag

SEQ ID NO: 2478937 - DNA, 18 bp, Homo sapiens
ttaggttctaaagttcta

SEQ ID NO: 2478938 - DNA, 22 bp, Homo sapiens
ttaggttctaaagttctaagat

SEQ ID NO: 2478939 - DNA, 20 bp, Homo sapiens
ttagtattgttgtccttttc

SEQ ID NO: 2478940 - DNA, 14 bp, Homo sapiens
ttagtcatgtgacc

SEQ ID NO: 2478941 - DNA, 18 bp, Homo sapiens
ttagtgccacttaatgta

SEQ ID NO: 2478942 - DNA, 18 bp, Homo sapiens
ttagttaccttatagtta

SEQ ID NO: 2478943 - DNA, 16 bp, Homo sapiens
ttagttccactgagac

SEQ ID NO: 2478944 - DNA, 22 bp, Homo sapiens
ttagtttcagtagattgcagaa

SEQ ID NO: 2478945 - DNA, 15 bp, Homo sapiens
ttagtttgtgtgttg

SEQ ID NO: 2478946 - DNA, 17 bp, Homo sapiens
ttagtttttcattaaat

SEQ ID NO: 2478947 - DNA, 12 bp, Homo sapiens
ttataaaagtgt

SEQ ID NO: 2478948 - DNA, 16 bp, Homo sapiens
ttataaaagtgttcat

SEQ ID NO: 2478949 - DNA, 15 bp, Homo sapiens
ttataactaacatgt

SEQ ID NO: 2478950 - DNA, 12 bp, Homo sapiens
ttataagactct

SEQ ID NO: 2478951 - DNA, 17 bp, Homo sapiens
ttataagcatcattatt

SEQ ID NO: 2478952 - DNA, 19 bp, Homo sapiens
ttataagcatcattattta

SEQ ID NO: 2478953 - DNA, 22 bp, Homo sapiens
ttataagcatcattatttatgt

SEQ ID NO: 2478954 - DNA, 13 bp, Homo sapiens
ttataatatacta

SEQ ID NO: 2478955 - DNA, 18 bp, Homo sapiens
ttataatcttataattgt

SEQ ID NO: 2478956 - DNA, 14 bp, Homo sapiens
ttataattttccta

SEQ ID NO: 2478957 - DNA, 13 bp, Homo sapiens
ttatacagctgta

SEQ ID NO: 2478958 - DNA, 22 bp, Homo sapiens
ttataccaaaatgttgctgaaa

SEQ ID NO: 2478959 - DNA, 16 bp, Homo sapiens
ttatacgaaataattg

SEQ ID NO: 2478960 - DNA, 21 bp, Homo sapiens
ttatacgctggcaacacagag

SEQ ID NO: 2478961 - DNA, 22 bp, Homo sapiens
ttatacgctggcaacacagagg

SEQ ID NO: 2478962 - DNA, 18 bp, Homo sapiens
ttatactttccctaccct

SEQ ID NO: 2478963 - DNA, 16 bp, Homo sapiens
ttatagaagtttagat

SEQ ID NO: 2478964 - DNA, 13 bp, Homo sapiens
ttatagattctaa

SEQ ID NO: 2478965 - DNA, 14 bp, Homo sapiens
ttatagattctaaa

SEQ ID NO: 2478966 - DNA, 18 bp, Homo sapiens
ttataggatttatttaaa

SEQ ID NO: 2478967 - DNA, 21 bp, Homo sapiens
ttatagtgatgtaatcttgaa

SEQ ID NO: 2478968 - DNA, 14 bp, Homo sapiens
ttatagttactgtg

SEQ ID NO: 2478969 - DNA, 19 bp, Homo sapiens
ttatagttactgtgtaatt

SEQ ID NO: 2478970 - DNA, 22 bp, Homo sapiens
ttatataactgtatttgaaata

SEQ ID NO: 2478971 - DNA, 15 bp, Homo sapiens
ttatatataaatata

SEQ ID NO: 2478972 - DNA, 17 bp, Homo sapiens
ttatatatgtatttata

SEQ ID NO: 2478973 - DNA, 16 bp, Homo sapiens
ttatatattatatgga

SEQ ID NO: 2478974 - DNA, 19 bp, Homo sapiens
ttatatattatatggaaat

SEQ ID NO: 2478975 - DNA, 10 bp, Homo sapiens
ttatatggaa

SEQ ID NO: 2478976 - DNA, 18 bp, Homo sapiens
ttatatggaaatatatat

SEQ ID NO: 2478977 - DNA, 19 bp, Homo sapiens
ttatatggaaatatatatt

SEQ ID NO: 2478978 - DNA, 18 bp, Homo sapiens
ttatatgttgtaagcaac

SEQ ID NO: 2478979 - DNA, 16 bp, Homo sapiens
ttatcaaaactttctt

SEQ ID NO: 2478980 - DNA, 19 bp, Homo sapiens
ttatcaaaccctagccttg

SEQ ID NO: 2478981 - DNA, 15 bp, Homo sapiens
ttatcaacttcctaa

SEQ ID NO: 2478982 - DNA, 21 bp, Homo sapiens
ttatcaacttcctaaatatta

SEQ ID NO: 2478983 - DNA, 15 bp, Homo sapiens
ttatcagtcaatatt

SEQ ID NO: 2478984 - DNA, 23 bp, Homo sapiens
ttatcagtcataactaaataaag

SEQ ID NO: 2478985 - DNA, 19 bp, Homo sapiens
ttatccatattgagtcaaa

SEQ ID NO: 2478986 - DNA, 13 bp, Homo sapiens
ttatcccagctgc

SEQ ID NO: 2478987 - DNA, 16 bp, Homo sapiens
ttatcccagctgccta

SEQ ID NO: 2478988 - DNA, 13 bp, Homo sapiens
ttatcctccctgt

SEQ ID NO: 2478989 - DNA, 18 bp, Homo sapiens
ttcctaaattttcctgtc

SEQ ID NO: 2478990 - DNA, 21 bp, Homo sapiens
ttcctaaattttcctgtcctc

SEQ ID NO: 2478991 - DNA, 19 bp, Homo sapiens
ttcctaataaagttctgta

SEQ ID NO: 2478992 - DNA, 16 bp, Homo sapiens
ttcctatgctttgaaa

SEQ ID NO: 2478993 - DNA, 11 bp, Homo sapiens
ttcctcagcca

SEQ ID NO: 2478994 - DNA, 18 bp, Homo sapiens
ttcctcatccaccccatc

SEQ ID NO: 2478995 - DNA, 19 bp, Homo sapiens
ttcctcatccaccccatcc

SEQ ID NO: 2478996 - DNA, 14 bp, Homo sapiens
ttcctcatgaatgt

SEQ ID NO: 2478997 - DNA, 15 bp, Homo sapiens
ttcctcatgaatgta

SEQ ID NO: 2478998 - DNA, 16 bp, Homo sapiens
ttcctcatgaatgtaa

SEQ ID NO: 2478999 - DNA, 22 bp, Homo sapiens
ttcctcatgaatgtaaatttgt

SEQ ID NO: 2479000 - DNA, 14 bp, Homo sapiens
ttcctcctccccac

SEQ ID NO: 2479001 - DNA, 11 bp, Homo sapiens
ttcctcctgga

SEQ ID NO: 2479002 - DNA, 22 bp, Homo sapiens
ttcctctaacttggctcacact

SEQ ID NO: 2479003 - DNA, 18 bp, Homo sapiens
ttcctgaaacaacttgga

SEQ ID NO: 2479004 - DNA, 16 bp, Homo sapiens
ttcctgaagaaccagt

SEQ ID NO: 2479005 - DNA, 20 bp, Homo sapiens
ttcctgacctccgccatcca

SEQ ID NO: 2479006 - DNA, 20 bp, Homo sapiens
ttcctgcaactcaaggactt

SEQ ID NO: 2479007 - DNA, 15 bp, Homo sapiens
ttcctgccagcccct

SEQ ID NO: 2479008 - DNA, 18 bp, Homo sapiens
ttcctgccatgtttagtg

SEQ ID NO: 2479009 - DNA, 21 bp, Homo sapiens
ttcctgccttggcctcccaag

SEQ ID NO: 2479010 - DNA, 12 bp, Homo sapiens
ttcctgctgctg

SEQ ID NO: 2479011 - DNA, 17 bp, Homo sapiens
ttcctgctgctgtctgg

SEQ ID NO: 2479012 - DNA, 17 bp, Homo sapiens
ttcctggacagctgtgc

SEQ ID NO: 2479013 - DNA, 22 bp, Homo sapiens
ttcctggagcagaagcagcaac

SEQ ID NO: 2479014 - DNA, 21 bp, Homo sapiens
ttcctgggaaatattccctag

SEQ ID NO: 2479015 - DNA, 22 bp, Homo sapiens
ttcctgggtggctactctgtgc

SEQ ID NO: 2479016 - DNA, 17 bp, Homo sapiens
ttcctgtccagctccaa

SEQ ID NO: 2479017 - DNA, 22 bp, Homo sapiens
ttcctgtccagctccaacctgc

SEQ ID NO: 2479018 - DNA, 20 bp, Homo sapiens
ttcctgtcctctttcagctc

SEQ ID NO: 2479019 - DNA, 14 bp, Homo sapiens
ttccttcccatgga

SEQ ID NO: 2479020 - DNA, 16 bp, Homo sapiens
ttccttccctgtgcct

SEQ ID NO: 2479021 - DNA, 17 bp, Homo sapiens
ttcctttaacaacatgt

SEQ ID NO: 2479022 - DNA, 18 bp, Homo sapiens
ttcctttaacaacatgtt

SEQ ID NO: 2479023 - DNA, 21 bp, Homo sapiens
ttcctttaacaacatgtttcc

SEQ ID NO: 2479024 - DNA, 17 bp, Homo sapiens
ttccttttgccgacccc

SEQ ID NO: 2479025 - DNA, 20 bp, Homo sapiens
ttcctttttaatatgcttaa

SEQ ID NO: 2479026 - DNA, 21 bp, Homo sapiens
ttcgaagaaacccttgctgct

SEQ ID NO: 2479027 - DNA, 13 bp, Homo sapiens
ttcgcagccaccc

SEQ ID NO: 2479028 - DNA, 14 bp, Homo sapiens
ttcgcagccaccct

SEQ ID NO: 2479029 - DNA, 16 bp, Homo sapiens
ttcgcagccaccctga

SEQ ID NO: 2479030 - DNA, 16 bp, Homo sapiens
ttcgcatggtcacaca

SEQ ID NO: 2479031 - DNA, 17 bp, Homo sapiens
ttcgcatggtcacacac

SEQ ID NO: 2479032 - DNA, 23 bp, Homo sapiens
ttcgcatggtcacacactgatgc

SEQ ID NO: 2479033 - DNA, 18 bp, Homo sapiens
ttcggccccatgtatctc

SEQ ID NO: 2479034 - DNA, 18 bp, Homo sapiens
ttcgggccaaggacctga

SEQ ID NO: 2479035 - DNA, 14 bp, Homo sapiens
ttcgggctgtgccc

SEQ ID NO: 2479036 - DNA, 17 bp, Homo sapiens
ttcggggctgggaagtc

SEQ ID NO: 2479037 - DNA, 13 bp, Homo sapiens
ttcgtggggaggt

SEQ ID NO: 2479038 - DNA, 15 bp, Homo sapiens
ttctaaaatgtgatg

SEQ ID NO: 2479039 - DNA, 20 bp, Homo sapiens
ttctaaaatgtgatgttcta

SEQ ID NO: 2479040 - DNA, 23 bp, Homo sapiens
ttctaaacccaatccaaatggcg

SEQ ID NO: 2479041 - DNA, 18 bp, Homo sapiens
ttctaaactggagactgt

SEQ ID NO: 2479042 - DNA, 14 bp, Homo sapiens
ttctaaagattcta

SEQ ID NO: 2479043 - DNA, 16 bp, Homo sapiens
ttctaaagattctata

SEQ ID NO: 2479044 - DNA, 22 bp, Homo sapiens
ttctaaagattctatagttcta

SEQ ID NO: 2479045 - DNA, 16 bp, Homo sapiens
ttctaaaggtccacag

SEQ ID NO: 2479046 - DNA, 14 bp, Homo sapiens
ttctaaagttctaa

SEQ ID NO: 2479047 - DNA, 12 bp, Homo sapiens
ttctaaatgaat

SEQ ID NO: 2479048 - DNA, 21 bp, Homo sapiens
ttctaaatgaatgtttacact

SEQ ID NO: 2479049 - DNA, 14 bp, Homo sapiens
ttctaacaagtcat

SEQ ID NO: 2479050 - DNA, 16 bp, Homo sapiens
ttctaacctttacatg

SEQ ID NO: 2479051 - DNA, 22 bp, Homo sapiens
ttctaactacaaaggtttaaat

SEQ ID NO: 2479052 - DNA, 14 bp, Homo sapiens
ttctaagaaacatt

SEQ ID NO: 2479053 - DNA, 23 bp, Homo sapiens
ttctaagaaacatttatattgat

SEQ ID NO: 2479054 - DNA, 21 bp, Homo sapiens
ttctaagactcaaatgttcta

SEQ ID NO: 2479055 - DNA, 12 bp, Homo sapiens
ttctaagatgtg

SEQ ID NO: 2479056 - DNA, 20 bp, Homo sapiens
ttctaagatgtgatattcta

SEQ ID NO: 2479057 - DNA, 23 bp, Homo sapiens
ttctaagatgtgatattctaaga

SEQ ID NO: 2479058 - DNA, 14 bp, Homo sapiens
ttctaagattctaa

SEQ ID NO: 2479059 - DNA, 17 bp, Homo sapiens
ttctaagattctaatga

SEQ ID NO: 2479060 - DNA, 21 bp, Homo sapiens
ttctaaggacctgaaattcca

SEQ ID NO: 2479061 - DNA, 22 bp, Homo sapiens
ttctaaggacctgaaattccaa

SEQ ID NO: 2479062 - DNA, 17 bp, Homo sapiens
ttctaaggcctaggatt

SEQ ID NO: 2479063 - DNA, 22 bp, Homo sapiens
ttctaaggcctaggattctaaa

SEQ ID NO: 2479064 - DNA, 12 bp, Homo sapiens
ttctaaggctct

SEQ ID NO: 2479065 - DNA, 20 bp, Homo sapiens
ttctaaggctctgagagtct

SEQ ID NO: 2479066 - DNA, 21 bp, Homo sapiens
ttctaaggtccggtgttctaa

SEQ ID NO: 2479067 - DNA, 12 bp, Homo sapiens
ttctaagtttct

SEQ ID NO: 2479068 - DNA, 14 bp, Homo sapiens
ttctaagtttctaa

SEQ ID NO: 2479069 - DNA, 18 bp, Homo sapiens
ttctaataatttctaatg

SEQ ID NO: 2479070 - DNA, 21 bp, Homo sapiens
ttctacaactcatacactcgt

SEQ ID NO: 2479071 - DNA, 16 bp, Homo sapiens
ttctagagcactgcca

SEQ ID NO: 2479072 - DNA, 16 bp, Homo sapiens
ttctagatcagatgct

SEQ ID NO: 2479073 - DNA, 23 bp, Homo sapiens
ttctagatcagatgctccaagat

SEQ ID NO: 2479074 - DNA, 12 bp, Homo sapiens
ttctagatgatt

SEQ ID NO: 2479075 - DNA, 20 bp, Homo sapiens
ttctaggtttcaaagatgct

SEQ ID NO: 2479076 - DNA, 16 bp, Homo sapiens
ttctatagttattaag

SEQ ID NO: 2479077 - DNA, 16 bp, Homo sapiens
ttctatagttctagac

SEQ ID NO: 2479078 - DNA, 17 bp, Homo sapiens
ttctatagttctagaca

SEQ ID NO: 2479079 - DNA, 14 bp, Homo sapiens
ttctatcctctgta

SEQ ID NO: 2479080 - DNA, 15 bp, Homo sapiens
ttctatgggtgttat

SEQ ID NO: 2479081 - DNA, 16 bp, Homo sapiens
ttctattaaaagactc

SEQ ID NO: 2479082 - DNA, 21 bp, Homo sapiens
ttctattaaaagactcatccg

SEQ ID NO: 2479083 - DNA, 22 bp, Homo sapiens
ttctattaaaagactcatccgt

SEQ ID NO: 2479084 - DNA, 14 bp, Homo sapiens
ttctattaaaagtg

SEQ ID NO: 2479085 - DNA, 18 bp, Homo sapiens
ttctattaaaagtgggaa

SEQ ID NO: 2479086 - DNA, 18 bp, Homo sapiens
ttctatttatatgtacat

SEQ ID NO: 2479087 - DNA, 17 bp, Homo sapiens
ttctatttcactggagc

SEQ ID NO: 2479088 - DNA, 17 bp, Homo sapiens
ttctatttctcctccat

SEQ ID NO: 2479089 - DNA, 18 bp, Homo sapiens
ttctcaaaggagcgagca

SEQ ID NO: 2479090 - DNA, 18 bp, Homo sapiens
ttctcaagttctaagatt

SEQ ID NO: 2479091 - DNA, 17 bp, Homo sapiens
ttctcaattccaacagt

SEQ ID NO: 2479092 - DNA, 15 bp, Homo sapiens
ttctcactaaatctt

SEQ ID NO: 2479093 - DNA, 23 bp, Homo sapiens
ttgtaattctaaatgaatgttta

SEQ ID NO: 2479094 - DNA, 15 bp, Homo sapiens
ttgtaccaactttta

SEQ ID NO: 2479095 - DNA, 23 bp, Homo sapiens
ttgtactaaagccaaacatatat

SEQ ID NO: 2479096 - DNA, 15 bp, Homo sapiens
ttgtagattgattgt

SEQ ID NO: 2479097 - DNA, 19 bp, Homo sapiens
ttgtagctggggctttgat

SEQ ID NO: 2479098 - DNA, 13 bp, Homo sapiens
ttgtagttgaata

SEQ ID NO: 2479099 - DNA, 14 bp, Homo sapiens
ttgtataaaataga

SEQ ID NO: 2479100 - DNA, 11 bp, Homo sapiens
ttgtataattg

SEQ ID NO: 2479101 - DNA, 12 bp, Homo sapiens
ttgtataattgg

SEQ ID NO: 2479102 - DNA, 16 bp, Homo sapiens
ttgtatagttaacaca

SEQ ID NO: 2479103 - DNA, 15 bp, Homo sapiens
ttgtatcccctgcag

SEQ ID NO: 2479104 - DNA, 14 bp, Homo sapiens
ttgtattctctgag

SEQ ID NO: 2479105 - DNA, 18 bp, Homo sapiens
ttgtattgttgaaaaagt

SEQ ID NO: 2479106 - DNA, 15 bp, Homo sapiens
ttgtattgtttcaat

SEQ ID NO: 2479107 - DNA, 22 bp, Homo sapiens
ttgtcaagaatagcattgtaaa

SEQ ID NO: 2479108 - DNA, 16 bp, Homo sapiens
ttgtcaccagatctga

SEQ ID NO: 2479109 - DNA, 17 bp, Homo sapiens
ttgtcaccagatctgat

SEQ ID NO: 2479110 - DNA, 14 bp, Homo sapiens
ttgtcatgtgtata

SEQ ID NO: 2479111 - DNA, 19 bp, Homo sapiens
ttgtccagctgagcgccag

SEQ ID NO: 2479112 - DNA, 18 bp, Homo sapiens
ttgtcccgattgtaactc

SEQ ID NO: 2479113 - DNA, 15 bp, Homo sapiens
ttgtcctagcacaga

SEQ ID NO: 2479114 - DNA, 16 bp, Homo sapiens
ttgtccttagcctgga

SEQ ID NO: 2479115 - DNA, 14 bp, Homo sapiens
ttgtcgctcatgtg

SEQ ID NO: 2479116 - DNA, 18 bp, Homo sapiens
ttgtctacacaccctgca

SEQ ID NO: 2479117 - DNA, 13 bp, Homo sapiens
ttgtctctgatgc

SEQ ID NO: 2479118 - DNA, 14 bp, Homo sapiens
ttgtctctgatgca

SEQ ID NO: 2479119 - DNA, 17 bp, Homo sapiens
ttgtctctgatgcagct

SEQ ID NO: 2479120 - DNA, 23 bp, Homo sapiens
ttgtctctgttttacaagttgga

SEQ ID NO: 2479121 - DNA, 22 bp, Homo sapiens
ttgtctgaaaagtgaagacaga

SEQ ID NO: 2479122 - DNA, 21 bp, Homo sapiens
ttgtctggcaaggactttgta

SEQ ID NO: 2479123 - DNA, 13 bp, Homo sapiens
ttgtctttttaga

SEQ ID NO: 2479124 - DNA, 13 bp, Homo sapiens
ttgtgaaggcagg

SEQ ID NO: 2479125 - DNA, 20 bp, Homo sapiens
ttgtgaatcaagggtcaggc

SEQ ID NO: 2479126 - DNA, 18 bp, Homo sapiens
ttgtgagccaccacgtcc

SEQ ID NO: 2479127 - DNA, 16 bp, Homo sapiens
ttgtgatatgcacaat

SEQ ID NO: 2479128 - DNA, 21 bp, Homo sapiens
ttgtgatgtcatacagagaag

SEQ ID NO: 2479129 - DNA, 17 bp, Homo sapiens
ttgtgatgtgcacgtaa

SEQ ID NO: 2479130 - DNA, 19 bp, Homo sapiens
ttgtgattagacagaacac

SEQ ID NO: 2479131 - DNA, 17 bp, Homo sapiens
ttgtgcaatgtaaatat

SEQ ID NO: 2479132 - DNA, 22 bp, Homo sapiens
ttgtggaatggagattcagttt

SEQ ID NO: 2479133 - DNA, 15 bp, Homo sapiens
ttgtgggcctgggct

SEQ ID NO: 2479134 - DNA, 19 bp, Homo sapiens
ttgtgggcctgggctcctg

SEQ ID NO: 2479135 - DNA, 14 bp, Homo sapiens
ttgtggggcctggg

SEQ ID NO: 2479136 - DNA, 20 bp, Homo sapiens
ttgtgtatttacgctttgat

SEQ ID NO: 2479137 - DNA, 22 bp, Homo sapiens
ttgtgtatttacgctttgattc

SEQ ID NO: 2479138 - DNA, 18 bp, Homo sapiens
ttgtgtcccatgatccct

SEQ ID NO: 2479139 - DNA, 16 bp, Homo sapiens
ttgtgtccctaatgtg

SEQ ID NO: 2479140 - DNA, 14 bp, Homo sapiens
ttgtgtgctctcca

SEQ ID NO: 2479141 - DNA, 15 bp, Homo sapiens
ttgtgtgctctccat

SEQ ID NO: 2479142 - DNA, 14 bp, Homo sapiens
ttgtgtgtatgcac

SEQ ID NO: 2479143 - DNA, 13 bp, Homo sapiens
ttgtgtgtcttaa

SEQ ID NO: 2479144 - DNA, 19 bp, Homo sapiens
ttgtgtgtcttaattatta

SEQ ID NO: 2479145 - DNA, 15 bp, Homo sapiens
ttgttaaaaatgtca

SEQ ID NO: 2479146 - DNA, 19 bp, Homo sapiens
ttgttaatttagaaaactt

SEQ ID NO: 2479147 - DNA, 16 bp, Homo sapiens
ttgttatataatcatt

SEQ ID NO: 2479148 - DNA, 15 bp, Homo sapiens
ttgttatataattta

SEQ ID NO: 2479149 - DNA, 15 bp, Homo sapiens
ttgttattttgcaac

SEQ ID NO: 2479150 - DNA, 22 bp, Homo sapiens
ttgttattttgcaacctcgctg

SEQ ID NO: 2479151 - DNA, 19 bp, Homo sapiens
ttgttcaccattataatga

SEQ ID NO: 2479152 - DNA, 15 bp, Homo sapiens
ttgttcatagcccag

SEQ ID NO: 2479153 - DNA, 16 bp, Homo sapiens
ttgttccccactggag

SEQ ID NO: 2479154 - DNA, 16 bp, Homo sapiens
ttgttctcagaatccc

SEQ ID NO: 2479155 - DNA, 14 bp, Homo sapiens
ttgttctgttaact

SEQ ID NO: 2479156 - DNA, 16 bp, Homo sapiens
ttgttctgttaactga

SEQ ID NO: 2479157 - DNA, 18 bp, Homo sapiens
ttgttctgttaactgaat

SEQ ID NO: 2479158 - DNA, 12 bp, Homo sapiens
ttgttgacattc

SEQ ID NO: 2479159 - DNA, 16 bp, Homo sapiens
ttgttggcatagctct

SEQ ID NO: 2479160 - DNA, 21 bp, Homo sapiens
ttgttggcgtaggctacagag

SEQ ID NO: 2479161 - DNA, 16 bp, Homo sapiens
ttgttggttggttttc

SEQ ID NO: 2479162 - DNA, 16 bp, Homo sapiens
ttgttgtccttttcat

SEQ ID NO: 2479163 - DNA, 13 bp, Homo sapiens
ttgttgtgctttt

SEQ ID NO: 2479164 - DNA, 14 bp, Homo sapiens
ttgttgtgctttta

SEQ ID NO: 2479165 - DNA, 13 bp, Homo sapiens
ttgttgttctgtt

SEQ ID NO: 2479166 - DNA, 22 bp, Homo sapiens
ttgtttaatttttatttcttcc

SEQ ID NO: 2479167 - DNA, 22 bp, Homo sapiens
ttgtttacatgcttattccatg

SEQ ID NO: 2479168 - DNA, 21 bp, Homo sapiens
ttgtttagaaagaatattcat

SEQ ID NO: 2479169 - DNA, 15 bp, Homo sapiens
ttgtttatgtaattt

SEQ ID NO: 2479170 - DNA, 13 bp, Homo sapiens
ttgtttcgctctt

SEQ ID NO: 2479171 - DNA, 16 bp, Homo sapiens
ttgtttcgtggggagg

SEQ ID NO: 2479172 - DNA, 16 bp, Homo sapiens
ttgtttctgttccaaa

SEQ ID NO: 2479173 - DNA, 17 bp, Homo sapiens
ttgtttctgttccaaat

SEQ ID NO: 2479174 - DNA, 17 bp, Homo sapiens
ttgtttggggcaggagt

SEQ ID NO: 2479175 - DNA, 20 bp, Homo sapiens
ttgttttgcacactttgcca

SEQ ID NO: 2479176 - DNA, 16 bp, Homo sapiens
ttgtttttaaactgta

SEQ ID NO: 2479177 - DNA, 19 bp, Homo sapiens
ttgtttttcattcagtctt

SEQ ID NO: 2479178 - DNA, 23 bp, Homo sapiens
tttaaaaaaccacatggcacaga

SEQ ID NO: 2479179 - DNA, 20 bp, Homo sapiens
tttaaaaaagcttaaaactt

SEQ ID NO: 2479180 - DNA, 21 bp, Homo sapiens
tttaaaaaagcttaaaacttt

SEQ ID NO: 2479181 - DNA, 22 bp, Homo sapiens
tttaaaaataagtcaacagtaa

SEQ ID NO: 2479182 - DNA, 23 bp, Homo sapiens
tttaaaaataagtcaacagtaaa

SEQ ID NO: 2479183 - DNA, 18 bp, Homo sapiens
tttaaaatcagctatttt

SEQ ID NO: 2479184 - DNA, 15 bp, Homo sapiens
tttaaaatctgtcac

SEQ ID NO: 2479185 - DNA, 11 bp, Homo sapiens
tttaaaatgta

SEQ ID NO: 2479186 - DNA, 20 bp, Homo sapiens
tttaaaatgtaaagccatgc

SEQ ID NO: 2479187 - DNA, 12 bp, Homo sapiens
tttaaaatgtac

SEQ ID NO: 2479188 - DNA, 14 bp, Homo sapiens
tttaaacacctcct

SEQ ID NO: 2479189 - DNA, 19 bp, Homo sapiens
tttaaacattaatagcagc

SEQ ID NO: 2479190 - DNA, 18 bp, Homo sapiens
tttaaactgtacagtgtc

SEQ ID NO: 2479191 - DNA, 14 bp, Homo sapiens
tttaaagaaagtgt

SEQ ID NO: 2479192 - DNA, 16 bp, Homo sapiens
tttaaagaaagtgtat

SEQ ID NO: 2479193 - DNA, 12 bp, Homo sapiens
tttaaagaattg

SEQ ID NO: 2479194 - DNA, 13 bp, Homo sapiens
tttaaagaattgt

SEQ ID NO: 2479195 - DNA, 20 bp, Homo sapiens
tttaaatacagtcttccatt

SEQ ID NO: 2479196 - DNA, 12 bp, Homo sapiens
tttaaattgtgt

SEQ ID NO: 2479197 - DNA, 20 bp, Homo sapiens
tttaacaacatgtttccagc

SEQ ID NO: 2479198 - DNA, 20 bp, Homo sapiens
tttgatgtaaagatgttctg

SEQ ID NO: 2479199 - DNA, 12 bp, Homo sapiens
tttgatgtaata

SEQ ID NO: 2479200 - DNA, 15 bp, Homo sapiens
tttgatgttccttcc

SEQ ID NO: 2479201 - DNA, 14 bp, Homo sapiens
tttgatttaatgtt

SEQ ID NO: 2479202 - DNA, 12 bp, Homo sapiens
tttgatttcaac

SEQ ID NO: 2479203 - DNA, 20 bp, Homo sapiens
tttgcaaaaaatgtttttgg

SEQ ID NO: 2479204 - DNA, 23 bp, Homo sapiens
tttgcaaccaggaacagcaaatg

SEQ ID NO: 2479205 - DNA, 17 bp, Homo sapiens
tttgcaacttaatactc

SEQ ID NO: 2479206 - DNA, 18 bp, Homo sapiens
tttgcactgatatatcat

SEQ ID NO: 2479207 - DNA, 22 bp, Homo sapiens
tttgcagggtcctcttctgggc

SEQ ID NO: 2479208 - DNA, 14 bp, Homo sapiens
tttgcagtaactgt

SEQ ID NO: 2479209 - DNA, 17 bp, Homo sapiens
tttgcataacaattcct

SEQ ID NO: 2479210 - DNA, 14 bp, Homo sapiens
tttgcattaaatta

SEQ ID NO: 2479211 - DNA, 19 bp, Homo sapiens
tttgcattaaattacagaa

SEQ ID NO: 2479212 - DNA, 18 bp, Homo sapiens
tttgcattaaattcacaa

SEQ ID NO: 2479213 - DNA, 21 bp, Homo sapiens
tttgcattaaattcacaaact

SEQ ID NO: 2479214 - DNA, 23 bp, Homo sapiens
tttgccaagggcataaattattg

SEQ ID NO: 2479215 - DNA, 13 bp, Homo sapiens
tttgccacagctt

SEQ ID NO: 2479216 - DNA, 22 bp, Homo sapiens
tttgccatgacaacttctaatt

SEQ ID NO: 2479217 - DNA, 13 bp, Homo sapiens
tttgcccattttg

SEQ ID NO: 2479218 - DNA, 23 bp, Homo sapiens
tttgcctcaaataaaaagtgctt

SEQ ID NO: 2479219 - DNA, 19 bp, Homo sapiens
tttgcgtgggagtgtgtgc

SEQ ID NO: 2479220 - DNA, 14 bp, Homo sapiens
tttgctaaagacat

SEQ ID NO: 2479221 - DNA, 21 bp, Homo sapiens
tttgctaatttttattaattt

SEQ ID NO: 2479222 - DNA, 10 bp, Homo sapiens
tttgctgcca

SEQ ID NO: 2479223 - DNA, 22 bp, Homo sapiens
tttgctgtaatgttaatattga

SEQ ID NO: 2479224 - DNA, 20 bp, Homo sapiens
tttgcttcatgtgtcccaga

SEQ ID NO: 2479225 - DNA, 23 bp, Homo sapiens
tttgcttgctttgaagtagctct

SEQ ID NO: 2479226 - DNA, 23 bp, Homo sapiens
tttgctttaatataaatgcaaat

SEQ ID NO: 2479227 - DNA, 16 bp, Homo sapiens
tttggaaagactggac

SEQ ID NO: 2479228 - DNA, 12 bp, Homo sapiens
tttggaagaagg

SEQ ID NO: 2479229 - DNA, 11 bp, Homo sapiens
tttggaaggag

SEQ ID NO: 2479230 - DNA, 17 bp, Homo sapiens
tttggagtcccctcacc

SEQ ID NO: 2479231 - DNA, 15 bp, Homo sapiens
tttggatatgtaaaa

SEQ ID NO: 2479232 - DNA, 19 bp, Homo sapiens
tttggatatgtaaaacatt

SEQ ID NO: 2479233 - DNA, 14 bp, Homo sapiens
tttggatttgacat

SEQ ID NO: 2479234 - DNA, 17 bp, Homo sapiens
tttggcaatgccatcat

SEQ ID NO: 2479235 - DNA, 18 bp, Homo sapiens
tttggcatccctgggcct

SEQ ID NO: 2479236 - DNA, 20 bp, Homo sapiens
tttgggaagtgaagactgga

SEQ ID NO: 2479237 - DNA, 22 bp, Homo sapiens
tttgggaagtgaagactggaag

SEQ ID NO: 2479238 - DNA, 18 bp, Homo sapiens
tttgggagacatgtgaca

SEQ ID NO: 2479239 - DNA, 14 bp, Homo sapiens
tttgggagagactt

SEQ ID NO: 2479240 - DNA, 15 bp, Homo sapiens
tttgggcttgggcct

SEQ ID NO: 2479241 - DNA, 20 bp, Homo sapiens
tttggggggttttcttgcct

SEQ ID NO: 2479242 - DNA, 15 bp, Homo sapiens
tttgggtccaggagg

SEQ ID NO: 2479243 - DNA, 15 bp, Homo sapiens
tttgggttctgcctg

SEQ ID NO: 2479244 - DNA, 11 bp, Homo sapiens
tttgggtttct

SEQ ID NO: 2479245 - DNA, 16 bp, Homo sapiens
tttggtaccagataac

SEQ ID NO: 2479246 - DNA, 19 bp, Homo sapiens
tttggtcgaggagtaacaa

SEQ ID NO: 2479247 - DNA, 15 bp, Homo sapiens
tttggtctcttgctt

SEQ ID NO: 2479248 - DNA, 13 bp, Homo sapiens
tttggtgtatggt

SEQ ID NO: 2479249 - DNA, 20 bp, Homo sapiens
tttggttatgaatactttgc

SEQ ID NO: 2479250 - DNA, 13 bp, Homo sapiens
tttggttctaagg

SEQ ID NO: 2479251 - DNA, 19 bp, Homo sapiens
tttggtttcccaagagcta

SEQ ID NO: 2479252 - DNA, 21 bp, Homo sapiens
tttggtttcccaagagctacg

SEQ ID NO: 2479253 - DNA, 19 bp, Homo sapiens
tttgtaacccactgagagg

SEQ ID NO: 2479254 - DNA, 16 bp, Homo sapiens
tttgtaagttgaagca

SEQ ID NO: 2479255 - DNA, 22 bp, Homo sapiens
tttgtaattaaaagcaaatcat

SEQ ID NO: 2479256 - DNA, 20 bp, Homo sapiens
tttgtagctggggctttgat

SEQ ID NO: 2479257 - DNA, 13 bp, Homo sapiens
tttgtataattgg

SEQ ID NO: 2479258 - DNA, 21 bp, Homo sapiens
tttgtataattggatttccta

SEQ ID NO: 2479259 - DNA, 21 bp, Homo sapiens
tttgtattgtttcaattgcat

SEQ ID NO: 2479260 - DNA, 15 bp, Homo sapiens
tttgtcactttttct

SEQ ID NO: 2479261 - DNA, 20 bp, Homo sapiens
tttgtcagaactagaatttg

SEQ ID NO: 2479262 - DNA, 19 bp, Homo sapiens
tttgtcgctcatgtgtgca

SEQ ID NO: 2479263 - DNA, 22 bp, Homo sapiens
tttgtgaattaggctgtaacta

SEQ ID NO: 2479264 - DNA, 22 bp, Homo sapiens
tttgtgatatgcacaatgtaga

SEQ ID NO: 2479265 - DNA, 21 bp, Homo sapiens
tttgtgatggagtgctgtttt

SEQ ID NO: 2479266 - DNA, 20 bp, Homo sapiens
tttgtgggggactgtaagtt

SEQ ID NO: 2479267 - DNA, 16 bp, Homo sapiens
tttgtgtgctctccat

SEQ ID NO: 2479268 - DNA, 16 bp, Homo sapiens
tttgtgtgtatttgct

SEQ ID NO: 2479269 - DNA, 17 bp, Homo sapiens
tttgtgtgttgtctctt

SEQ ID NO: 2479270 - DNA, 17 bp, Homo sapiens
tttgtgttctgttttgt

SEQ ID NO: 2479271 - DNA, 21 bp, Homo sapiens
tttgttaatttagaaaacttt

SEQ ID NO: 2479272 - DNA, 23 bp, Homo sapiens
tttgttaatttagaaaactttaa

SEQ ID NO: 2479273 - DNA, 20 bp, Homo sapiens
tttgttcgcatggtcacaca

SEQ ID NO: 2479274 - DNA, 13 bp, Homo sapiens
tttgttgacatta

SEQ ID NO: 2479275 - DNA, 16 bp, Homo sapiens
tttgttgacattctga

SEQ ID NO: 2479276 - DNA, 19 bp, Homo sapiens
tttgttgacattctgaatg

SEQ ID NO: 2479277 - DNA, 14 bp, Homo sapiens
tttgtttaaaaagg

SEQ ID NO: 2479278 - DNA, 17 bp, Homo sapiens
tttgtttcaatgaggtg

SEQ ID NO: 2479279 - DNA, 12 bp, Homo sapiens
tttgtttcctct

SEQ ID NO: 2479280 - DNA, 17 bp, Homo sapiens
tttgtttcctctgttca

SEQ ID NO: 2479281 - DNA, 13 bp, Homo sapiens
tttgttttgtgtc

SEQ ID NO: 2479282 - DNA, 14 bp, Homo sapiens
tttgttttgtgtct

SEQ ID NO: 2479283 - DNA, 15 bp, Homo sapiens
tttgttttgtgtctc

SEQ ID NO: 2479284 - DNA, 19 bp, Homo sapiens
tttgtttttaaactgtaca

SEQ ID NO: 2479285 - DNA, 20 bp, Homo sapiens
ttttaaaaaagcttaaaact

SEQ ID NO: 2479286 - DNA, 21 bp, Homo sapiens
ttttaaaatagcgttcttgta

SEQ ID NO: 2479287 - DNA, 15 bp, Homo sapiens
ttttaaaattgattt

SEQ ID NO: 2479288 - DNA, 21 bp, Homo sapiens
ttttaaacatcaatctttaaa

SEQ ID NO: 2479289 - DNA, 23 bp, Homo sapiens
ttttaaacattaatagcagcctt

SEQ ID NO: 2479290 - DNA, 20 bp, Homo sapiens
ttttaaactgtacagtgtct

SEQ ID NO: 2479291 - DNA, 23 bp, Homo sapiens
ttttaaagaaaaaaattgaaatg

SEQ ID NO: 2479292 - DNA, 13 bp, Homo sapiens
ttttaaagaattg

SEQ ID NO: 2479293 - DNA, 17 bp, Homo sapiens
ttttaaagttagtatct

SEQ ID NO: 2479294 - DNA, 14 bp, Homo sapiens
ttttaacattcctc

SEQ ID NO: 2479295 - DNA, 13 bp, Homo sapiens
ttttaactttgtt

SEQ ID NO: 2479296 - DNA, 16 bp, Homo sapiens
ttttaagaatatctgt

SEQ ID NO: 2479297 - DNA, 18 bp, Homo sapiens
ttttaatccgccaatatt

SEQ ID NO: 2479298 - DNA, 19 bp, Homo sapiens
ttttaatccgccaatatta

SEQ ID NO: 2479299 - DNA, 21 bp, Homo sapiens
ttttaatctctaacagtggac

SEQ ID NO: 2479300 - DNA, 11 bp, Homo sapiens
ttttaattatt

SEQ ID NO: 2479301 - DNA, 16 bp, Homo sapiens
ttttaattattattct

SEQ ID NO: 2479302 - DNA, 12 bp, Homo sapiens
aaaaaaaacagt

SEQ ID NO: 2479303 - DNA, 13 bp, Homo sapiens
aaaaaaaattact

SEQ ID NO: 2479304 - DNA, 14 bp, Homo sapiens
aaaaaaagatctgt

SEQ ID NO: 2479305 - DNA, 13 bp, Homo sapiens
aaaaaaatgtatt

SEQ ID NO: 2479306 - DNA, 19 bp, Homo sapiens
aaaaaaattgaaatgtaag

SEQ ID NO: 2479307 - DNA, 16 bp, Homo sapiens
aaaaaatgtatatgca

SEQ ID NO: 2479308 - DNA, 19 bp, Homo sapiens
aaaaacaggtatatacttt

SEQ ID NO: 2479309 - DNA, 18 bp, Homo sapiens
aaaaacctgagatttatt

SEQ ID NO: 2479310 - DNA, 23 bp, Homo sapiens
aaaaacctgagatttattaaaga

SEQ ID NO: 2479311 - DNA, 12 bp, Homo sapiens
aaaaaccttggg

SEQ ID NO: 2479312 - DNA, 13 bp, Homo sapiens
aaaaaccttgggt

SEQ ID NO: 2479313 - DNA, 14 bp, Homo sapiens
aaaaactaaaaact

SEQ ID NO: 2479314 - DNA, 11 bp, Homo sapiens
aaaaactattt

SEQ ID NO: 2479315 - DNA, 19 bp, Homo sapiens
aaaaagaaaggctgttaaa

SEQ ID NO: 2479316 - DNA, 14 bp, Homo sapiens
aaaaagaagaatct

SEQ ID NO: 2479317 - DNA, 17 bp, Homo sapiens
aaaaagcccaccatttg

SEQ ID NO: 2479318 - DNA, 18 bp, Homo sapiens
aaaaagcgaaaaaatcag

SEQ ID NO: 2479319 - DNA, 13 bp, Homo sapiens
aaaaaggcagtta

SEQ ID NO: 2479320 - DNA, 18 bp, Homo sapiens
aaaaaggtttacagaatt

SEQ ID NO: 2479321 - DNA, 12 bp, Homo sapiens
aaaaagtgtcaa

SEQ ID NO: 2479322 - DNA, 20 bp, Homo sapiens
aaaaagttgcagctgttttg

SEQ ID NO: 2479323 - DNA, 23 bp, Homo sapiens
aaaaagttgcagctgttttgttg

SEQ ID NO: 2479324 - DNA, 24 bp, Homo sapiens
aaaaataaatatatctaccccaga

SEQ ID NO: 2479325 - DNA, 16 bp, Homo sapiens
aaaaataagaagaatg

SEQ ID NO: 2479326 - DNA, 22 bp, Homo sapiens
aaaaataagaagaatgcttaat

SEQ ID NO: 2479327 - DNA, 13 bp, Homo sapiens
aaaaatactcaga

SEQ ID NO: 2479328 - DNA, 21 bp, Homo sapiens
aaaaatagctaaatacctcaa

SEQ ID NO: 2479329 - DNA, 17 bp, Homo sapiens
aaaaatatatgtatata

SEQ ID NO: 2479330 - DNA, 14 bp, Homo sapiens
aaaaatgatctaaa

SEQ ID NO: 2479331 - DNA, 15 bp, Homo sapiens
aaaacaaaactgcat

SEQ ID NO: 2479332 - DNA, 14 bp, Homo sapiens
aaaacagaacactt

SEQ ID NO: 2479333 - DNA, 21 bp, Homo sapiens
aaaacagccaccgtttcttcc

SEQ ID NO: 2479334 - DNA, 17 bp, Homo sapiens
aaaacaggcactgccct

SEQ ID NO: 2479335 - DNA, 12 bp, Homo sapiens
aaaacaggtaga

SEQ ID NO: 2479336 - DNA, 24 bp, Homo sapiens
aaaacatctttgaaattatgtaaa

SEQ ID NO: 2479337 - DNA, 15 bp, Homo sapiens
aaaacatgtttattt

SEQ ID NO: 2479338 - DNA, 22 bp, Homo sapiens
aaaacatttattttgacataaa

SEQ ID NO: 2479339 - DNA, 17 bp, Homo sapiens
aaaaccatcaagttgtg

SEQ ID NO: 2479340 - DNA, 18 bp, Homo sapiens
aaaaccccccagatatca

SEQ ID NO: 2479341 - DNA, 16 bp, Homo sapiens
aaaacccttgggccag

SEQ ID NO: 2479342 - DNA, 18 bp, Homo sapiens
aaaacctgagatttatta

SEQ ID NO: 2479343 - DNA, 15 bp, Homo sapiens
aaaactctacttaat

SEQ ID NO: 2479344 - DNA, 14 bp, Homo sapiens
aaaactgcatttca

SEQ ID NO: 2479345 - DNA, 14 bp, Homo sapiens
aaaactttcctcgc

SEQ ID NO: 2479346 - DNA, 16 bp, Homo sapiens
aaaactttggaaccag

SEQ ID NO: 2479347 - DNA, 13 bp, Homo sapiens
aaaagaaaaagat

SEQ ID NO: 2479348 - DNA, 14 bp, Homo sapiens
aaaagaagaagttt

SEQ ID NO: 2479349 - DNA, 13 bp, Homo sapiens
aaaagaattgttg

SEQ ID NO: 2479350 - DNA, 20 bp, Homo sapiens
aaaagacacacttgtccaca

SEQ ID NO: 2479351 - DNA, 12 bp, Homo sapiens
aaaagactcatc

SEQ ID NO: 2479352 - DNA, 17 bp, Homo sapiens
aaaagataaacacaaga

SEQ ID NO: 2479353 - DNA, 18 bp, Homo sapiens
aaaagatgaaagagcagt

SEQ ID NO: 2479354 - DNA, 19 bp, Homo sapiens
aaaagatgcttttaacaga

SEQ ID NO: 2479355 - DNA, 16 bp, Homo sapiens
aaaagcattttgtaat

SEQ ID NO: 2479356 - DNA, 19 bp, Homo sapiens
aaaagcccaccatttggca

SEQ ID NO: 2479357 - DNA, 17 bp, Homo sapiens
aaaagcgtgagcttaaa

SEQ ID NO: 2479358 - DNA, 13 bp, Homo sapiens
aaaaggaaaaaaa

SEQ ID NO: 2479359 - DNA, 18 bp, Homo sapiens
aaaaggaagccaaagagt

SEQ ID NO: 2479360 - DNA, 13 bp, Homo sapiens
aaaaggcagttac

SEQ ID NO: 2479361 - DNA, 14 bp, Homo sapiens
aaaaggcctggggt

SEQ ID NO: 2479362 - DNA, 19 bp, Homo sapiens
aaaaggttcttactgcttg

SEQ ID NO: 2479363 - DNA, 13 bp, Homo sapiens
aaaaggtttacag

SEQ ID NO: 2479364 - DNA, 14 bp, Homo sapiens
aaaaggtttatgaa

SEQ ID NO: 2479365 - DNA, 13 bp, Homo sapiens
aaaagtgaaataa

SEQ ID NO: 2479366 - DNA, 15 bp, Homo sapiens
aaaagtgaagacaga

SEQ ID NO: 2479367 - DNA, 17 bp, Homo sapiens
aaaagtgggcttgattc

SEQ ID NO: 2479368 - DNA, 22 bp, Homo sapiens
aaaagttccaagagtctaaaga

SEQ ID NO: 2479369 - DNA, 23 bp, Homo sapiens
aaaagttccaagagtctaaagat

SEQ ID NO: 2479370 - DNA, 21 bp, Homo sapiens
aaaataaaaaagatcccaaat

SEQ ID NO: 2479371 - DNA, 23 bp, Homo sapiens
aaatattttaaagaattgtgtca

SEQ ID NO: 2479372 - DNA, 15 bp, Homo sapiens
aaatattttgaatca

SEQ ID NO: 2479373 - DNA, 18 bp, Homo sapiens
aaatcaacttgcttatca

SEQ ID NO: 2479374 - DNA, 17 bp, Homo sapiens
aaatcacgctttttgaa

SEQ ID NO: 2479375 - DNA, 21 bp, Homo sapiens
aaatcagaagtcatcttgcta

SEQ ID NO: 2479376 - DNA, 23 bp, Homo sapiens
aaatcaggcttttgtttcctttt

SEQ ID NO: 2479377 - DNA, 11 bp, Homo sapiens
aaatcagtaag

SEQ ID NO: 2479378 - DNA, 15 bp, Homo sapiens
aaatcagtaagaggt

SEQ ID NO: 2479379 - DNA, 15 bp, Homo sapiens
aaatcatcagaaagg

SEQ ID NO: 2479380 - DNA, 22 bp, Homo sapiens
aaatcatcagaaaggaaaaaca

SEQ ID NO: 2479381 - DNA, 12 bp, Homo sapiens
aaatcatttgtt

SEQ ID NO: 2479382 - DNA, 13 bp, Homo sapiens
aaatctaccactg

SEQ ID NO: 2479383 - DNA, 17 bp, Homo sapiens
aaatctctccactttca

SEQ ID NO: 2479384 - DNA, 19 bp, Homo sapiens
aaatctctccactttcagc

SEQ ID NO: 2479385 - DNA, 23 bp, Homo sapiens
aaatctctccactttcagctgtc

SEQ ID NO: 2479386 - DNA, 18 bp, Homo sapiens
aaatcttatagttctagg

SEQ ID NO: 2479387 - DNA, 19 bp, Homo sapiens
aaatcttatagttctaggc

SEQ ID NO: 2479388 - DNA, 20 bp, Homo sapiens
aaatcttggttgatgccaaa

SEQ ID NO: 2479389 - DNA, 22 bp, Homo sapiens
aaatcttggttgatgccaaaaa

SEQ ID NO: 2479390 - DNA, 20 bp, Homo sapiens
aaatcttgtcatgtgtataa

SEQ ID NO: 2479391 - DNA, 16 bp, Homo sapiens
aaatgaaaatgtcttg

SEQ ID NO: 2479392 - DNA, 20 bp, Homo sapiens
aaatgacactcatataatta

SEQ ID NO: 2479393 - DNA, 23 bp, Homo sapiens
aaatgacactcatataattatat

SEQ ID NO: 2479394 - DNA, 13 bp, Homo sapiens
aaatgagtaacat

SEQ ID NO: 2479395 - DNA, 14 bp, Homo sapiens
aaatgagtaacatt

SEQ ID NO: 2479396 - DNA, 15 bp, Homo sapiens
aaatgagtaacattt

SEQ ID NO: 2479397 - DNA, 13 bp, Homo sapiens
aaatgatctaaac

SEQ ID NO: 2479398 - DNA, 17 bp, Homo sapiens
aaatgccaaattaaaaa

SEQ ID NO: 2479399 - DNA, 22 bp, Homo sapiens
aaatgccaaattaaaaaagata

SEQ ID NO: 2479400 - DNA, 18 bp, Homo sapiens
aaatgctttttatttctg

SEQ ID NO: 2479401 - DNA, 21 bp, Homo sapiens
aaatggcctcatgtggctgga

SEQ ID NO: 2479402 - DNA, 15 bp, Homo sapiens
aaatgggcacttaaa

SEQ ID NO: 2479403 - DNA, 17 bp, Homo sapiens
aaatggggccagatcca

SEQ ID NO: 2479404 - DNA, 21 bp, Homo sapiens
aaatggggccagatccagcct

SEQ ID NO: 2479405 - DNA, 16 bp, Homo sapiens
aaatggtatcttttgg

SEQ ID NO: 2479406 - DNA, 14 bp, Homo sapiens
aaatggtccaggag

SEQ ID NO: 2479407 - DNA, 23 bp, Homo sapiens
aaatggttcagaattaaactttt

SEQ ID NO: 2479408 - DNA, 13 bp, Homo sapiens
aaatgtaaagcca

SEQ ID NO: 2479409 - DNA, 19 bp, Homo sapiens
aaatgtagagtttttaaac

SEQ ID NO: 2479410 - DNA, 22 bp, Homo sapiens
aaatgtagtatggcctgtgtca

SEQ ID NO: 2479411 - DNA, 13 bp, Homo sapiens
aaatgtatgcatg

SEQ ID NO: 2479412 - DNA, 15 bp, Homo sapiens
aaatgtatgcatgtt

SEQ ID NO: 2479413 - DNA, 16 bp, Homo sapiens
aaatgtatgcatgttg

SEQ ID NO: 2479414 - DNA, 19 bp, Homo sapiens
aaatgtatgcatgttgtct

SEQ ID NO: 2479415 - DNA, 15 bp, Homo sapiens
aaatgtcatgctgcc

SEQ ID NO: 2479416 - DNA, 22 bp, Homo sapiens
aaatgtccttgtgatgtgcacg

SEQ ID NO: 2479417 - DNA, 16 bp, Homo sapiens
aaatgtgagtgttttt

SEQ ID NO: 2479418 - DNA, 13 bp, Homo sapiens
aaatgtgatgaat

SEQ ID NO: 2479419 - DNA, 19 bp, Homo sapiens
aaatgtgggattatgggtc

SEQ ID NO: 2479420 - DNA, 12 bp, Homo sapiens
aaatgtgttgtt

SEQ ID NO: 2479421 - DNA, 13 bp, Homo sapiens
aaatgttaaaatg

SEQ ID NO: 2479422 - DNA, 17 bp, Homo sapiens
aaatgttatcttctcaa

SEQ ID NO: 2479423 - DNA, 23 bp, Homo sapiens
aaatgttatcttctcaagttcta

SEQ ID NO: 2479424 - DNA, 13 bp, Homo sapiens
aaatgttctaagt

SEQ ID NO: 2479425 - DNA, 14 bp, Homo sapiens
aaatgttctaagtt

SEQ ID NO: 2479426 - DNA, 11 bp, Homo sapiens
aaatgttcttt

SEQ ID NO: 2479427 - DNA, 19 bp, Homo sapiens
aaatgttgagaatcccaaa

SEQ ID NO: 2479428 - DNA, 19 bp, Homo sapiens
aaatgttgctgaaaaatgg

SEQ ID NO: 2479429 - DNA, 22 bp, Homo sapiens
aaatgtttttaataaaagaaaa

SEQ ID NO: 2479430 - DNA, 12 bp, Homo sapiens
aaattaaaaaag

SEQ ID NO: 2479431 - DNA, 14 bp, Homo sapiens
aaattaagaaggca

SEQ ID NO: 2479432 - DNA, 15 bp, Homo sapiens
aaattaagaaggcaa

SEQ ID NO: 2479433 - DNA, 13 bp, Homo sapiens
aaattaagacttt

SEQ ID NO: 2479434 - DNA, 17 bp, Homo sapiens
aaattactttgtgaata

SEQ ID NO: 2479435 - DNA, 14 bp, Homo sapiens
aaattagatgaact

SEQ ID NO: 2479436 - DNA, 13 bp, Homo sapiens
aaattatagaagt

SEQ ID NO: 2479437 - DNA, 23 bp, Homo sapiens
aaattatcaggcaaatttgcatt

SEQ ID NO: 2479438 - DNA, 15 bp, Homo sapiens
aaattatgtaaatta

SEQ ID NO: 2479439 - DNA, 22 bp, Homo sapiens
aaattatgtaaattatcaggca

SEQ ID NO: 2479440 - DNA, 14 bp, Homo sapiens
aaattattaatgaa

SEQ ID NO: 2479441 - DNA, 19 bp, Homo sapiens
aaattcacatgatgcactt

SEQ ID NO: 2479442 - DNA, 22 bp, Homo sapiens
aaattcaccccctttcctggac

SEQ ID NO: 2479443 - DNA, 13 bp, Homo sapiens
aaattcagcattt

SEQ ID NO: 2479444 - DNA, 15 bp, Homo sapiens
aaattcagcatttga

SEQ ID NO: 2479445 - DNA, 17 bp, Homo sapiens
aaattccaaagtctcta

SEQ ID NO: 2479446 - DNA, 18 bp, Homo sapiens
aaattccaaagtctctaa

SEQ ID NO: 2479447 - DNA, 13 bp, Homo sapiens
aaattctcctgga

SEQ ID NO: 2479448 - DNA, 16 bp, Homo sapiens
aaattctcctggaggt

SEQ ID NO: 2479449 - DNA, 22 bp, Homo sapiens
aaattgaacctttgtgccctat

SEQ ID NO: 2479450 - DNA, 21 bp, Homo sapiens
aaattgaatactttgaatgtg

SEQ ID NO: 2479451 - DNA, 16 bp, Homo sapiens
aaattggaaagcaggt

SEQ ID NO: 2479452 - DNA, 14 bp, Homo sapiens
aaattgtacagccg

SEQ ID NO: 2479453 - DNA, 19 bp, Homo sapiens
aaattgtatattgtaattt

SEQ ID NO: 2479454 - DNA, 23 bp, Homo sapiens
aaattgtgcagtactttgtgcat

SEQ ID NO: 2479455 - DNA, 19 bp, Homo sapiens
aaatttaaactataagcaa

SEQ ID NO: 2479456 - DNA, 17 bp, Homo sapiens
aaatttacatcatttct

SEQ ID NO: 2479457 - DNA, 20 bp, Homo sapiens
aacttgtaatttttttaatt

SEQ ID NO: 2479458 - DNA, 14 bp, Homo sapiens
aactttaatgtttt

SEQ ID NO: 2479459 - DNA, 12 bp, Homo sapiens
aactttactgta

SEQ ID NO: 2479460 - DNA, 14 bp, Homo sapiens
aactttatcactta

SEQ ID NO: 2479461 - DNA, 24 bp, Homo sapiens
aactttggaaccagactcttgcct

SEQ ID NO: 2479462 - DNA, 18 bp, Homo sapiens
aactttggagtcccctca

SEQ ID NO: 2479463 - DNA, 11 bp, Homo sapiens
aacttttaatt

SEQ ID NO: 2479464 - DNA, 23 bp, Homo sapiens
aacttttttatttaaaaaactaa

SEQ ID NO: 2479465 - DNA, 23 bp, Homo sapiens
aacttttttttttctttataaga

SEQ ID NO: 2479466 - DNA, 17 bp, Homo sapiens
aagaaaaaaatgtattt

SEQ ID NO: 2479467 - DNA, 17 bp, Homo sapiens
aagaaaaaaattgaaat

SEQ ID NO: 2479468 - DNA, 20 bp, Homo sapiens
aagaaaaaaattgaaatgta

SEQ ID NO: 2479469 - DNA, 21 bp, Homo sapiens
aagaaaaaaattgaaatgtaa

SEQ ID NO: 2479470 - DNA, 14 bp, Homo sapiens
aagaaaaataaaga

SEQ ID NO: 2479471 - DNA, 15 bp, Homo sapiens
aagaaaatctttata

SEQ ID NO: 2479472 - DNA, 15 bp, Homo sapiens
aagaaacaaagatgt

SEQ ID NO: 2479473 - DNA, 15 bp, Homo sapiens
aagaaacctactgcc

SEQ ID NO: 2479474 - DNA, 21 bp, Homo sapiens
aagaaacctactgcccaggca

SEQ ID NO: 2479475 - DNA, 14 bp, Homo sapiens
aagaaactttttta

SEQ ID NO: 2479476 - DNA, 23 bp, Homo sapiens
aagaaagaggtgaccccagggca

SEQ ID NO: 2479477 - DNA, 12 bp, Homo sapiens
aagaaagcctga

SEQ ID NO: 2479478 - DNA, 13 bp, Homo sapiens
aagaaagcctgag

SEQ ID NO: 2479479 - DNA, 23 bp, Homo sapiens
aagaaaggaagcattgtaaaata

SEQ ID NO: 2479480 - DNA, 22 bp, Homo sapiens
aagaaattgaatactttgaatg

SEQ ID NO: 2479481 - DNA, 19 bp, Homo sapiens
aagaacaccctatattttg

SEQ ID NO: 2479482 - DNA, 17 bp, Homo sapiens
aagaaccagtcccccca

SEQ ID NO: 2479483 - DNA, 17 bp, Homo sapiens
aagaactttaaattgtg

SEQ ID NO: 2479484 - DNA, 13 bp, Homo sapiens
aagaactttgagc

SEQ ID NO: 2479485 - DNA, 16 bp, Homo sapiens
aagaagacaaactttg

SEQ ID NO: 2479486 - DNA, 19 bp, Homo sapiens
aagaagacaaactttgcat

SEQ ID NO: 2479487 - DNA, 23 bp, Homo sapiens
aagaagagcgagagatcaaagat

SEQ ID NO: 2479488 - DNA, 21 bp, Homo sapiens
aagaagcaacctcagtaattt

SEQ ID NO: 2479489 - DNA, 24 bp, Homo sapiens
aagaagcccggctcctggtcacct

SEQ ID NO: 2479490 - DNA, 18 bp, Homo sapiens
aagaagccttaatttgca

SEQ ID NO: 2479491 - DNA, 19 bp, Homo sapiens
aagaagccttaatttgcac

SEQ ID NO: 2479492 - DNA, 20 bp, Homo sapiens
aagaagccttaatttgcaca

SEQ ID NO: 2479493 - DNA, 22 bp, Homo sapiens
aagaagccttaatttgcacagt

SEQ ID NO: 2479494 - DNA, 15 bp, Homo sapiens
aagaaggcaaaaata

SEQ ID NO: 2479495 - DNA, 22 bp, Homo sapiens
aagaagtaaaagcaaaaaagaa

SEQ ID NO: 2479496 - DNA, 18 bp, Homo sapiens
aagaagttttaaaaagcc

SEQ ID NO: 2479497 - DNA, 16 bp, Homo sapiens
aagaatacttctcatt

SEQ ID NO: 2479498 - DNA, 17 bp, Homo sapiens
aagaatagctttaatga

SEQ ID NO: 2479499 - DNA, 12 bp, Homo sapiens
aagaatcagaga

SEQ ID NO: 2479500 - DNA, 21 bp, Homo sapiens
aagaatccacatttctaaaat

SEQ ID NO: 2479501 - DNA, 12 bp, Homo sapiens
aagaatctcatc

SEQ ID NO: 2479502 - DNA, 22 bp, Homo sapiens
aagaatgcacaagaatggatca

SEQ ID NO: 2479503 - DNA, 14 bp, Homo sapiens
aagaattattttgt

SEQ ID NO: 2479504 - DNA, 12 bp, Homo sapiens
aagaattgttgg

SEQ ID NO: 2479505 - DNA, 22 bp, Homo sapiens
aagaattgttgggggttttttt

SEQ ID NO: 2479506 - DNA, 18 bp, Homo sapiens
aagacaaactttgcatct

SEQ ID NO: 2479507 - DNA, 20 bp, Homo sapiens
aagacagaaccacagggcta

SEQ ID NO: 2479508 - DNA, 14 bp, Homo sapiens
aagacagtggcccc

SEQ ID NO: 2479509 - DNA, 16 bp, Homo sapiens
aagacatgatttcctt

SEQ ID NO: 2479510 - DNA, 13 bp, Homo sapiens
aagacccccagca

SEQ ID NO: 2479511 - DNA, 15 bp, Homo sapiens
aagacccccagcact

SEQ ID NO: 2479512 - DNA, 21 bp, Homo sapiens
aagacctactgttctaaagct

SEQ ID NO: 2479513 - DNA, 15 bp, Homo sapiens
aagacctgagaatgt

SEQ ID NO: 2479514 - DNA, 17 bp, Homo sapiens
aagacgcctttctcctc

SEQ ID NO: 2479515 - DNA, 20 bp, Homo sapiens
aagacgtgatgccaggacca

SEQ ID NO: 2479516 - DNA, 18 bp, Homo sapiens
aagacgttttataagcat

SEQ ID NO: 2479517 - DNA, 14 bp, Homo sapiens
aagactcaaatgtt

SEQ ID NO: 2479518 - DNA, 18 bp, Homo sapiens
aagactcaaatgttctaa

SEQ ID NO: 2479519 - DNA, 12 bp, Homo sapiens
aagactctagag

SEQ ID NO: 2479520 - DNA, 13 bp, Homo sapiens
aagactctagagt

SEQ ID NO: 2479521 - DNA, 11 bp, Homo sapiens
aagactggctt

SEQ ID NO: 2479522 - DNA, 23 bp, Homo sapiens
aagacttggttggtagggtggga

SEQ ID NO: 2479523 - DNA, 17 bp, Homo sapiens
aagagcaggactccagg

SEQ ID NO: 2479524 - DNA, 17 bp, Homo sapiens
aagagcatcatgcctct

SEQ ID NO: 2479525 - DNA, 19 bp, Homo sapiens
aagagcatcatgcctctga

SEQ ID NO: 2479526 - DNA, 22 bp, Homo sapiens
aagagcatcatgcctctgaggc

SEQ ID NO: 2479527 - DNA, 23 bp, Homo sapiens
aagagcatcatgcctctgaggcc

SEQ ID NO: 2479528 - DNA, 24 bp, Homo sapiens
aagagcatcatgcctctgaggcca

SEQ ID NO: 2479529 - DNA, 16 bp, Homo sapiens
aagagccttccaccca

SEQ ID NO: 2479530 - DNA, 21 bp, Homo sapiens
aagagcgagagatcaaagatg

SEQ ID NO: 2479531 - DNA, 23 bp, Homo sapiens
aagagcgagagatcaaagatgaa

SEQ ID NO: 2479532 - DNA, 14 bp, Homo sapiens
aagagctacataat

SEQ ID NO: 2479533 - DNA, 16 bp, Homo sapiens
aagagctacataattt

SEQ ID NO: 2479534 - DNA, 18 bp, Homo sapiens
aagagctacgtatttaat

SEQ ID NO: 2479535 - DNA, 13 bp, Homo sapiens
aagagctcaggat

SEQ ID NO: 2479536 - DNA, 20 bp, Homo sapiens
aagaggaggggaagaggcct

SEQ ID NO: 2479537 - DNA, 15 bp, Homo sapiens
aagaggcaccaggaa

SEQ ID NO: 2479538 - DNA, 20 bp, Homo sapiens
aagaggctgaggcctggact

SEQ ID NO: 2479539 - DNA, 22 bp, Homo sapiens
aagaggctgcccctctcaccaa

SEQ ID NO: 2479540 - DNA, 16 bp, Homo sapiens
aagaggctgccctcct

SEQ ID NO: 2479541 - DNA, 17 bp, Homo sapiens
aagaggctgccctcctg

SEQ ID NO: 2479542 - DNA, 21 bp, Homo sapiens
aagaggtgaccccagggcaca

SEQ ID NO: 2479543 - DNA, 15 bp, Homo sapiens
aagaggtgttatttg

SEQ ID NO: 2479544 - DNA, 17 bp, Homo sapiens
aagaggtgttatttgga

SEQ ID NO: 2479545 - DNA, 13 bp, Homo sapiens
aagagtagaaact

SEQ ID NO: 2479546 - DNA, 13 bp, Homo sapiens
aagagtctaaaga

SEQ ID NO: 2479547 - DNA, 23 bp, Homo sapiens
aagagtctagattcaaaggttct

SEQ ID NO: 2479548 - DNA, 22 bp, Homo sapiens
aagataaacacaagattggtgt

SEQ ID NO: 2479549 - DNA, 12 bp, Homo sapiens
aagataattata

SEQ ID NO: 2479550 - DNA, 15 bp, Homo sapiens
aagataattcactgt

SEQ ID NO: 2479551 - DNA, 19 bp, Homo sapiens
aagatattttaaaatctgt

SEQ ID NO: 2479552 - DNA, 12 bp, Homo sapiens
aagatcaataaa

SEQ ID NO: 2479553 - DNA, 13 bp, Homo sapiens
aagatcttagatt

SEQ ID NO: 2479554 - DNA, 15 bp, Homo sapiens
aagatcttagattct

SEQ ID NO: 2479555 - DNA, 17 bp, Homo sapiens
aagatcttagattctct

SEQ ID NO: 2479556 - DNA, 11 bp, Homo sapiens
aagatctttta

SEQ ID NO: 2479557 - DNA, 16 bp, Homo sapiens
aagatgaaagagcagt

SEQ ID NO: 2479558 - DNA, 22 bp, Homo sapiens
aagatgaacccgaggctgagaa

SEQ ID NO: 2479559 - DNA, 23 bp, Homo sapiens
aagatgaacccgaggctgagaat

SEQ ID NO: 2479560 - DNA, 14 bp, Homo sapiens
aagatgactgaggg

SEQ ID NO: 2479561 - DNA, 22 bp, Homo sapiens
aagatgcttttaacagagtctg

SEQ ID NO: 2479562 - DNA, 13 bp, Homo sapiens
aagtaggaagtaa

SEQ ID NO: 2479563 - DNA, 14 bp, Homo sapiens
aagtagtcctgtga

SEQ ID NO: 2479564 - DNA, 15 bp, Homo sapiens
aagtatacataagtt

SEQ ID NO: 2479565 - DNA, 19 bp, Homo sapiens
aagtatcatcagtgtagaa

SEQ ID NO: 2479566 - DNA, 14 bp, Homo sapiens
aagtatgtattatt

SEQ ID NO: 2479567 - DNA, 13 bp, Homo sapiens
aagtattatcaga

SEQ ID NO: 2479568 - DNA, 20 bp, Homo sapiens
aagtatttgttaatttagaa

SEQ ID NO: 2479569 - DNA, 22 bp, Homo sapiens
aagtattttcataagtatttca

SEQ ID NO: 2479570 - DNA, 15 bp, Homo sapiens
aagtattttcctgtt

SEQ ID NO: 2479571 - DNA, 19 bp, Homo sapiens
aagtattttttcagtatta

SEQ ID NO: 2479572 - DNA, 15 bp, Homo sapiens
aagtcaaacttggat

SEQ ID NO: 2479573 - DNA, 15 bp, Homo sapiens
aagtcaacagtaaac

SEQ ID NO: 2479574 - DNA, 14 bp, Homo sapiens
aagtcacagggcag

SEQ ID NO: 2479575 - DNA, 23 bp, Homo sapiens
aagtcagtccaggatgctaacat

SEQ ID NO: 2479576 - DNA, 15 bp, Homo sapiens
aagtcataattgcat

SEQ ID NO: 2479577 - DNA, 13 bp, Homo sapiens
aagtcatcttgct

SEQ ID NO: 2479578 - DNA, 14 bp, Homo sapiens
aagtcatcttgcta

SEQ ID NO: 2479579 - DNA, 13 bp, Homo sapiens
aagtccaggtcct

SEQ ID NO: 2479580 - DNA, 18 bp, Homo sapiens
aagtccaggtcctggtgg

SEQ ID NO: 2479581 - DNA, 21 bp, Homo sapiens
aagtccaggtcctggtggggc

SEQ ID NO: 2479582 - DNA, 20 bp, Homo sapiens
aagtccagtccagtcctatc

SEQ ID NO: 2479583 - DNA, 24 bp, Homo sapiens
aagtcgtccttactcctgtgggag

SEQ ID NO: 2479584 - DNA, 11 bp, Homo sapiens
aagtctcagct

SEQ ID NO: 2479585 - DNA, 12 bp, Homo sapiens
aagtctcagcta

SEQ ID NO: 2479586 - DNA, 18 bp, Homo sapiens
aagtctttctctttccct

SEQ ID NO: 2479587 - DNA, 20 bp, Homo sapiens
aagtctttctctttccctgg

SEQ ID NO: 2479588 - DNA, 22 bp, Homo sapiens
aagtctttctctttccctggtc

SEQ ID NO: 2479589 - DNA, 14 bp, Homo sapiens
aagtgaaaatatag

SEQ ID NO: 2479590 - DNA, 16 bp, Homo sapiens
aagtgaagactggaag

SEQ ID NO: 2479591 - DNA, 20 bp, Homo sapiens
aagtgacctatacctgtgtt

SEQ ID NO: 2479592 - DNA, 19 bp, Homo sapiens
aagtgactaatggcatgag

SEQ ID NO: 2479593 - DNA, 17 bp, Homo sapiens
aagtgagggctcactca

SEQ ID NO: 2479594 - DNA, 22 bp, Homo sapiens
aagtgcaataaatctgacccag

SEQ ID NO: 2479595 - DNA, 23 bp, Homo sapiens
aagtgcaataaatctgacccagt

SEQ ID NO: 2479596 - DNA, 12 bp, Homo sapiens
aagtgccctcca

SEQ ID NO: 2479597 - DNA, 21 bp, Homo sapiens
aagtgcctttcaggatctatt

SEQ ID NO: 2479598 - DNA, 22 bp, Homo sapiens
aagtgcgtccacgagctgttta

SEQ ID NO: 2479599 - DNA, 19 bp, Homo sapiens
aagtgctaaggttctaagg

SEQ ID NO: 2479600 - DNA, 17 bp, Homo sapiens
aagtgctgtttattaat

SEQ ID NO: 2479601 - DNA, 20 bp, Homo sapiens
aagtggaacgaaaatgaaag

SEQ ID NO: 2479602 - DNA, 22 bp, Homo sapiens
aagtgggcttgattctgcagta

SEQ ID NO: 2479603 - DNA, 17 bp, Homo sapiens
aagtgtcaactctttgt

SEQ ID NO: 2479604 - DNA, 23 bp, Homo sapiens
aagtgttagccttttttccccag

SEQ ID NO: 2479605 - DNA, 16 bp, Homo sapiens
aagtgttgatcaacca

SEQ ID NO: 2479606 - DNA, 17 bp, Homo sapiens
aagttaaatgtagagtt

SEQ ID NO: 2479607 - DNA, 19 bp, Homo sapiens
aagttaatccactgtgact

SEQ ID NO: 2479608 - DNA, 16 bp, Homo sapiens
aagttagctttaactt

SEQ ID NO: 2479609 - DNA, 22 bp, Homo sapiens
aagttagtttgtatatattatt

SEQ ID NO: 2479610 - DNA, 15 bp, Homo sapiens
aagttatagtgaata

SEQ ID NO: 2479611 - DNA, 17 bp, Homo sapiens
aagttattaatttcttc

SEQ ID NO: 2479612 - DNA, 17 bp, Homo sapiens
aagttattgcagtttat

SEQ ID NO: 2479613 - DNA, 13 bp, Homo sapiens
aagttcccagttg

SEQ ID NO: 2479614 - DNA, 17 bp, Homo sapiens
aagttcccagttggagc

SEQ ID NO: 2479615 - DNA, 12 bp, Homo sapiens
aagttcgtctgt

SEQ ID NO: 2479616 - DNA, 15 bp, Homo sapiens
aagttctaagattct

SEQ ID NO: 2479617 - DNA, 18 bp, Homo sapiens
aagttctaagattctaat

SEQ ID NO: 2479618 - DNA, 21 bp, Homo sapiens
aagttctaagattctaatgat

SEQ ID NO: 2479619 - DNA, 16 bp, Homo sapiens
aagttctaagattctg

SEQ ID NO: 2479620 - DNA, 17 bp, Homo sapiens
aagttctaagattctga

SEQ ID NO: 2479621 - DNA, 18 bp, Homo sapiens
aagttctaataatttcta

SEQ ID NO: 2479622 - DNA, 19 bp, Homo sapiens
aagttctgtactcaaatgt

SEQ ID NO: 2479623 - DNA, 19 bp, Homo sapiens
aagttgagatagttttcat

SEQ ID NO: 2479624 - DNA, 14 bp, Homo sapiens
aagttgcagctgtt

SEQ ID NO: 2479625 - DNA, 12 bp, Homo sapiens
aagttgctgctt

SEQ ID NO: 2479626 - DNA, 14 bp, Homo sapiens
aagttgctgcttct

SEQ ID NO: 2479627 - DNA, 21 bp, Homo sapiens
aagttgggcttgctattctgt

SEQ ID NO: 2479628 - DNA, 14 bp, Homo sapiens
aagtttaataaatt

SEQ ID NO: 2479629 - DNA, 16 bp, Homo sapiens
aagtttaccagaaagc

SEQ ID NO: 2479630 - DNA, 13 bp, Homo sapiens
aagtttagctctg

SEQ ID NO: 2479631 - DNA, 14 bp, Homo sapiens
aagtttagctctga

SEQ ID NO: 2479632 - DNA, 15 bp, Homo sapiens
aagtttagctctgag

SEQ ID NO: 2479633 - DNA, 15 bp, Homo sapiens
aagtttcatcatttt

SEQ ID NO: 2479634 - DNA, 16 bp, Homo sapiens
aagtttctaagattct

SEQ ID NO: 2479635 - DNA, 21 bp, Homo sapiens
aagtttctaagattctaaagg

SEQ ID NO: 2479636 - DNA, 15 bp, Homo sapiens
aagtttctctgcaga

SEQ ID NO: 2479637 - DNA, 19 bp, Homo sapiens
aagtttgcactatctttca

SEQ ID NO: 2479638 - DNA, 21 bp, Homo sapiens
aagtttgcactatctttcagc

SEQ ID NO: 2479639 - DNA, 16 bp, Homo sapiens
aagtttgtttttgcgt

SEQ ID NO: 2479640 - DNA, 19 bp, Homo sapiens
aagttttaaaaagccagtt

SEQ ID NO: 2479641 - DNA, 14 bp, Homo sapiens
aagttttatatatt

SEQ ID NO: 2479642 - DNA, 21 bp, Homo sapiens
aagttttatatattatatgga

SEQ ID NO: 2479643 - DNA, 16 bp, Homo sapiens
aataaaagaaaattac

SEQ ID NO: 2479644 - DNA, 20 bp, Homo sapiens
aataaaaggaagccaaagag

SEQ ID NO: 2479645 - DNA, 16 bp, Homo sapiens
aataaaagtgaccttt

SEQ ID NO: 2479646 - DNA, 16 bp, Homo sapiens
aataaagaaaagatgc

SEQ ID NO: 2479647 - DNA, 16 bp, Homo sapiens
aataaaggcagttttc

SEQ ID NO: 2479648 - DNA, 15 bp, Homo sapiens
aataaagtgtaacaa

SEQ ID NO: 2479649 - DNA, 15 bp, Homo sapiens
aataaatatatctac

SEQ ID NO: 2479650 - DNA, 20 bp, Homo sapiens
aataaatatcctttaattga

SEQ ID NO: 2479651 - DNA, 15 bp, Homo sapiens
aataaatctgaccca

SEQ ID NO: 2479652 - DNA, 16 bp, Homo sapiens
aataaatctgacccag

SEQ ID NO: 2479653 - DNA, 21 bp, Homo sapiens
aataaatgtcaccaggtactt

SEQ ID NO: 2479654 - DNA, 12 bp, Homo sapiens
aataaatgtctt

SEQ ID NO: 2479655 - DNA, 13 bp, Homo sapiens
aataaatttgact

SEQ ID NO: 2479656 - DNA, 22 bp, Homo sapiens
aataacaaatgccaaattaaaa

SEQ ID NO: 2479657 - DNA, 13 bp, Homo sapiens
aataagaaacttt

SEQ ID NO: 2479658 - DNA, 18 bp, Homo sapiens
aataagcaggtggatcta

SEQ ID NO: 2479659 - DNA, 20 bp, Homo sapiens
aatccccttctcccctgcac

SEQ ID NO: 2479660 - DNA, 11 bp, Homo sapiens
aatcccttcat

SEQ ID NO: 2479661 - DNA, 15 bp, Homo sapiens
aatcctacctcaaaa

SEQ ID NO: 2479662 - DNA, 22 bp, Homo sapiens
aatcctatgcatggtttcagca

SEQ ID NO: 2479663 - DNA, 13 bp, Homo sapiens
aatcctttactgt

SEQ ID NO: 2479664 - DNA, 16 bp, Homo sapiens
aatctacacacggtgc

SEQ ID NO: 2479665 - DNA, 16 bp, Homo sapiens
aatctcagttgatttt

SEQ ID NO: 2479666 - DNA, 22 bp, Homo sapiens
aatctcagttgattttctggat

SEQ ID NO: 2479667 - DNA, 22 bp, Homo sapiens
aatctcccattttggaatttgc

SEQ ID NO: 2479668 - DNA, 22 bp, Homo sapiens
aatctctccactttcagctgtc

SEQ ID NO: 2479669 - DNA, 14 bp, Homo sapiens
aatctgacccagtg

SEQ ID NO: 2479670 - DNA, 15 bp, Homo sapiens
aatctgacccagtgc

SEQ ID NO: 2479671 - DNA, 20 bp, Homo sapiens
aatctgtgtgaaactttcat

SEQ ID NO: 2479672 - DNA, 19 bp, Homo sapiens
aatcttaaggtgtagccac

SEQ ID NO: 2479673 - DNA, 20 bp, Homo sapiens
aatcttaaggtgtagccaca

SEQ ID NO: 2479674 - DNA, 15 bp, Homo sapiens
aatcttataattgtt

SEQ ID NO: 2479675 - DNA, 17 bp, Homo sapiens
aatcttataattgttct

SEQ ID NO: 2479676 - DNA, 19 bp, Homo sapiens
aatcttggttgatgccaaa

SEQ ID NO: 2479677 - DNA, 18 bp, Homo sapiens
aatcttgtcatgtgtata

SEQ ID NO: 2479678 - DNA, 17 bp, Homo sapiens
aatctttaaaagatgct

SEQ ID NO: 2479679 - DNA, 23 bp, Homo sapiens
aatctttaaaccaattgctgcta

SEQ ID NO: 2479680 - DNA, 21 bp, Homo sapiens
aatctttagagaagtatacat

SEQ ID NO: 2479681 - DNA, 18 bp, Homo sapiens
aatgaaaacagaatgtct

SEQ ID NO: 2479682 - DNA, 14 bp, Homo sapiens
aatgaaaataagaa

SEQ ID NO: 2479683 - DNA, 15 bp, Homo sapiens
aatgaaaatgtcttg

SEQ ID NO: 2479684 - DNA, 16 bp, Homo sapiens
aatgaaacaaagagtt

SEQ ID NO: 2479685 - DNA, 17 bp, Homo sapiens
aatgaacaagagaagca

SEQ ID NO: 2479686 - DNA, 22 bp, Homo sapiens
aatgaacaagagaagcattctc

SEQ ID NO: 2479687 - DNA, 15 bp, Homo sapiens
aatgaacagaacata

SEQ ID NO: 2479688 - DNA, 11 bp, Homo sapiens
aatgaagaaag

SEQ ID NO: 2479689 - DNA, 24 bp, Homo sapiens
aatgaagatctaaataaaatgcta

SEQ ID NO: 2479690 - DNA, 19 bp, Homo sapiens
aatgacatgaattttagct

SEQ ID NO: 2479691 - DNA, 14 bp, Homo sapiens
aatgagaaccaaca

SEQ ID NO: 2479692 - DNA, 15 bp, Homo sapiens
aatgagattgaattt

SEQ ID NO: 2479693 - DNA, 14 bp, Homo sapiens
aatgagcatgttta

SEQ ID NO: 2479694 - DNA, 22 bp, Homo sapiens
aatgagcatgtttagactttaa

SEQ ID NO: 2479695 - DNA, 12 bp, Homo sapiens
aatgagctttct

SEQ ID NO: 2479696 - DNA, 14 bp, Homo sapiens
aatgagctttctga

SEQ ID NO: 2479697 - DNA, 15 bp, Homo sapiens
aatgagctttctgaa

SEQ ID NO: 2479698 - DNA, 16 bp, Homo sapiens
aatgagctttctgaac

SEQ ID NO: 2479699 - DNA, 22 bp, Homo sapiens
aatgagctttctgaacagctgg

SEQ ID NO: 2479700 - DNA, 16 bp, Homo sapiens
aatgaggccatggact

SEQ ID NO: 2479701 - DNA, 22 bp, Homo sapiens
aatgaggccatggactctgtcc

SEQ ID NO: 2479702 - DNA, 23 bp, Homo sapiens
aatgatgatcaattatagtttct

SEQ ID NO: 2479703 - DNA, 15 bp, Homo sapiens
aatgattgtagtaat

SEQ ID NO: 2479704 - DNA, 17 bp, Homo sapiens
aatgatttttctttaca

SEQ ID NO: 2479705 - DNA, 18 bp, Homo sapiens
aatgatttttctttacaa

SEQ ID NO: 2479706 - DNA, 17 bp, Homo sapiens
aatgcaaaaactctttg

SEQ ID NO: 2479707 - DNA, 13 bp, Homo sapiens
aatgcaaataaca

SEQ ID NO: 2479708 - DNA, 14 bp, Homo sapiens
aatgcaaataacaa

SEQ ID NO: 2479709 - DNA, 16 bp, Homo sapiens
aatgcaaataacaaat

SEQ ID NO: 2479710 - DNA, 13 bp, Homo sapiens
aatgcaaccattt

SEQ ID NO: 2479711 - DNA, 17 bp, Homo sapiens
aatgcaaccatttgaaa

SEQ ID NO: 2479712 - DNA, 19 bp, Homo sapiens
aatgcagttgtctctgttt

SEQ ID NO: 2479713 - DNA, 15 bp, Homo sapiens
aatgccatcatctcc

SEQ ID NO: 2479714 - DNA, 22 bp, Homo sapiens
aatgccatgatgcctctgtctt

SEQ ID NO: 2479715 - DNA, 13 bp, Homo sapiens
aatgcccttcact

SEQ ID NO: 2479716 - DNA, 22 bp, Homo sapiens
aatgcctgactagggagccatg

SEQ ID NO: 2479717 - DNA, 23 bp, Homo sapiens
aatgctggctatagatgtctttt

SEQ ID NO: 2479718 - DNA, 23 bp, Homo sapiens
aatgctgtacatctattttggat

SEQ ID NO: 2479719 - DNA, 22 bp, Homo sapiens
aatgcttaatcagatagatatt

SEQ ID NO: 2479720 - DNA, 15 bp, Homo sapiens
aatgcttagaaattc

SEQ ID NO: 2479721 - DNA, 21 bp, Homo sapiens
aatgcttctaagtaaatacaa

SEQ ID NO: 2479722 - DNA, 20 bp, Homo sapiens
aatgctttttatttctgcat

SEQ ID NO: 2479723 - DNA, 21 bp, Homo sapiens
aatggaccggagagtgggggt

SEQ ID NO: 2479724 - DNA, 17 bp, Homo sapiens
aatggactggaagggga

SEQ ID NO: 2479725 - DNA, 16 bp, Homo sapiens
aatggatcacaagatg

SEQ ID NO: 2479726 - DNA, 18 bp, Homo sapiens
aatggatttttctttaac

SEQ ID NO: 2479727 - DNA, 19 bp, Homo sapiens
aatggcagcaggggttggg

SEQ ID NO: 2479728 - DNA, 20 bp, Homo sapiens
aatggcagttatattttgca

SEQ ID NO: 2479729 - DNA, 19 bp, Homo sapiens
aatggctgataattttaaa

SEQ ID NO: 2479730 - DNA, 18 bp, Homo sapiens
aatggctttggtctcttg

SEQ ID NO: 2479731 - DNA, 21 bp, Homo sapiens
aatggctttggtctcttgctt

SEQ ID NO: 2479732 - DNA, 14 bp, Homo sapiens
aatgggctcaaact

SEQ ID NO: 2479733 - DNA, 13 bp, Homo sapiens
aatggggccagat

SEQ ID NO: 2479734 - DNA, 17 bp, Homo sapiens
aatggggccagatccag

SEQ ID NO: 2479735 - DNA, 22 bp, Homo sapiens
aatggggccagatccagcctgg

SEQ ID NO: 2479736 - DNA, 18 bp, Homo sapiens
aatggtactgactttgct

SEQ ID NO: 2479737 - DNA, 14 bp, Homo sapiens
aatggtgtgggaga

SEQ ID NO: 2479738 - DNA, 15 bp, Homo sapiens
aatgtaaagccatgc

SEQ ID NO: 2479739 - DNA, 22 bp, Homo sapiens
aatgtaaatattttaaagaatt

SEQ ID NO: 2479740 - DNA, 14 bp, Homo sapiens
aatgtaaatttgta

SEQ ID NO: 2479741 - DNA, 17 bp, Homo sapiens
aatgtaaatttgtacta

SEQ ID NO: 2479742 - DNA, 19 bp, Homo sapiens
aatgtaagattatagattc

SEQ ID NO: 2479743 - DNA, 22 bp, Homo sapiens
aatgtaagattatagattctaa

SEQ ID NO: 2479744 - DNA, 22 bp, Homo sapiens
aatgtaaggctgtgtaagattt

SEQ ID NO: 2479745 - DNA, 17 bp, Homo sapiens
aatgtacatctggcctt

SEQ ID NO: 2479746 - DNA, 15 bp, Homo sapiens
aatgtagataagtgt

SEQ ID NO: 2479747 - DNA, 23 bp, Homo sapiens
aatgtagttctgctccagacagg

SEQ ID NO: 2479748 - DNA, 13 bp, Homo sapiens
aatgtatagtaaa

SEQ ID NO: 2479749 - DNA, 18 bp, Homo sapiens
aatgtattttatgttata

SEQ ID NO: 2479750 - DNA, 20 bp, Homo sapiens
aatgtattttatgttatata

SEQ ID NO: 2479751 - DNA, 20 bp, Homo sapiens
aatgtcactttttgaggcaa

SEQ ID NO: 2479752 - DNA, 17 bp, Homo sapiens
aatgtcatgctgcctta

SEQ ID NO: 2479753 - DNA, 13 bp, Homo sapiens
aatgtctggagac

SEQ ID NO: 2479754 - DNA, 13 bp, Homo sapiens
aatgtcttgagct

SEQ ID NO: 2479755 - DNA, 20 bp, Homo sapiens
aatgtctttaatgcaatata

SEQ ID NO: 2479756 - DNA, 12 bp, Homo sapiens
aatgtgatgaat

SEQ ID NO: 2479757 - DNA, 16 bp, Homo sapiens
aatgtgatgaatactg

SEQ ID NO: 2479758 - DNA, 12 bp, Homo sapiens
aatgtggcttga

SEQ ID NO: 2479759 - DNA, 17 bp, Homo sapiens
aatgtgtgtatatggac

SEQ ID NO: 2479760 - DNA, 23 bp, Homo sapiens
aatgtgttgttccaaatactaat

SEQ ID NO: 2479761 - DNA, 23 bp, Homo sapiens
aatgtgtttcacagtttgaaata

SEQ ID NO: 2479762 - DNA, 13 bp, Homo sapiens
aatgttaaaatgt

SEQ ID NO: 2479763 - DNA, 15 bp, Homo sapiens
aatgttaaaatgtgt

SEQ ID NO: 2479764 - DNA, 22 bp, Homo sapiens
aatgttatcttctcaagttcta

SEQ ID NO: 2479765 - DNA, 23 bp, Homo sapiens
aatgttatcttctcaagttctaa

SEQ ID NO: 2479766 - DNA, 19 bp, Homo sapiens
aatgttattttttaattat

SEQ ID NO: 2479767 - DNA, 19 bp, Homo sapiens
aatgttctaagtttctaag

SEQ ID NO: 2479768 - DNA, 19 bp, Homo sapiens
aatgttgattacagtgcag

SEQ ID NO: 2479769 - DNA, 13 bp, Homo sapiens
aatgttgctgaaa

SEQ ID NO: 2479770 - DNA, 16 bp, Homo sapiens
aatgtttctggatttc

SEQ ID NO: 2479771 - DNA, 22 bp, Homo sapiens
aatgtttcttctaggttctaaa

SEQ ID NO: 2479772 - DNA, 22 bp, Homo sapiens
aatgtttttaataaaagaaaat

SEQ ID NO: 2479773 - DNA, 15 bp, Homo sapiens
aattaaaaaagataa

SEQ ID NO: 2479774 - DNA, 20 bp, Homo sapiens
aattaaaaaagataaacaca

SEQ ID NO: 2479775 - DNA, 24 bp, Homo sapiens
aattaaaaaagataaacacaagat

SEQ ID NO: 2479776 - DNA, 16 bp, Homo sapiens
aattaaagtactttaa

SEQ ID NO: 2479777 - DNA, 13 bp, Homo sapiens
aattaagaaggca

SEQ ID NO: 2479778 - DNA, 19 bp, Homo sapiens
aattaagaaggcaaaaatg

SEQ ID NO: 2479779 - DNA, 23 bp, Homo sapiens
aattaagaaggcaaaaatgtaaa

SEQ ID NO: 2479780 - DNA, 21 bp, Homo sapiens
aattaatatccctacatgtat

SEQ ID NO: 2479781 - DNA, 22 bp, Homo sapiens
aattaattatcttttcaaaggt

SEQ ID NO: 2479782 - DNA, 17 bp, Homo sapiens
aattacagaaatttaat

SEQ ID NO: 2479783 - DNA, 23 bp, Homo sapiens
aattactttggggctaatttaac

SEQ ID NO: 2479784 - DNA, 16 bp, Homo sapiens
aattagacactttgga

SEQ ID NO: 2479785 - DNA, 20 bp, Homo sapiens
aattagactgtgattcagaa

SEQ ID NO: 2479786 - DNA, 23 bp, Homo sapiens
aattagactgtgattcagaaaat

SEQ ID NO: 2479787 - DNA, 19 bp, Homo sapiens
aattaggctgtaactactt

SEQ ID NO: 2479788 - DNA, 20 bp, Homo sapiens
aattagtgccacttaatgta

SEQ ID NO: 2479789 - DNA, 14 bp, Homo sapiens
aattagtttccttt

SEQ ID NO: 2479790 - DNA, 15 bp, Homo sapiens
aattagtttcctttt

SEQ ID NO: 2479791 - DNA, 23 bp, Homo sapiens
aattagtttcctttttaatatgc

SEQ ID NO: 2479792 - DNA, 13 bp, Homo sapiens
aattataaatgac

SEQ ID NO: 2479793 - DNA, 16 bp, Homo sapiens
aattataatatactat

SEQ ID NO: 2479794 - DNA, 16 bp, Homo sapiens
aattatagtttctgag

SEQ ID NO: 2479795 - DNA, 14 bp, Homo sapiens
aattatataactgt

SEQ ID NO: 2479796 - DNA, 15 bp, Homo sapiens
aattatctaatttat

SEQ ID NO: 2479797 - DNA, 16 bp, Homo sapiens
aattatcttttcaaag

SEQ ID NO: 2479798 - DNA, 17 bp, Homo sapiens
aattatcttttcaaagg

SEQ ID NO: 2479799 - DNA, 12 bp, Homo sapiens
aattatgtagct

SEQ ID NO: 2479800 - DNA, 22 bp, Homo sapiens
aattatgtagctctttgtcagg

SEQ ID NO: 2479801 - DNA, 18 bp, Homo sapiens
aattattacagtgtttat

SEQ ID NO: 2479802 - DNA, 13 bp, Homo sapiens
aattattatttat

SEQ ID NO: 2479803 - DNA, 18 bp, Homo sapiens
aattattatttatatatg

SEQ ID NO: 2479804 - DNA, 14 bp, Homo sapiens
aattattcaattta

SEQ ID NO: 2479805 - DNA, 22 bp, Homo sapiens
aattatttcatgattagaaatt

SEQ ID NO: 2479806 - DNA, 12 bp, Homo sapiens
aattatttgcat

SEQ ID NO: 2479807 - DNA, 13 bp, Homo sapiens
aattattttcatc

SEQ ID NO: 2479808 - DNA, 16 bp, Homo sapiens
aattcaaaagttccaa

SEQ ID NO: 2479809 - DNA, 23 bp, Homo sapiens
aattcaaaagttccaagagtcta

SEQ ID NO: 2479810 - DNA, 22 bp, Homo sapiens
aattcaaagctgtgtgtttgga

SEQ ID NO: 2479811 - DNA, 17 bp, Homo sapiens
aattcaaataaaaatcc

SEQ ID NO: 2479812 - DNA, 13 bp, Homo sapiens
aattcaattcaaa

SEQ ID NO: 2479813 - DNA, 15 bp, Homo sapiens
aattcaattcaaagc

SEQ ID NO: 2479814 - DNA, 20 bp, Homo sapiens
aattcacagtgctcttttct

SEQ ID NO: 2479815 - DNA, 12 bp, Homo sapiens
aattcactctga

SEQ ID NO: 2479816 - DNA, 13 bp, Homo sapiens
aattcactgtact

SEQ ID NO: 2479817 - DNA, 15 bp, Homo sapiens
aattcaggtttttcc

SEQ ID NO: 2479818 - DNA, 13 bp, Homo sapiens
aattcagtttcat

SEQ ID NO: 2479819 - DNA, 12 bp, Homo sapiens
aattccaaagtc

SEQ ID NO: 2479820 - DNA, 13 bp, Homo sapiens
aattccaaagtct

SEQ ID NO: 2479821 - DNA, 16 bp, Homo sapiens
aattccacacctttta

SEQ ID NO: 2479822 - DNA, 20 bp, Homo sapiens
aattccctcactcgtctccc

SEQ ID NO: 2479823 - DNA, 15 bp, Homo sapiens
aattcggtgtgcacc

SEQ ID NO: 2479824 - DNA, 22 bp, Homo sapiens
aattcgtgtgtttttttatgaa

SEQ ID NO: 2479825 - DNA, 13 bp, Homo sapiens
aattctaaatgaa

SEQ ID NO: 2479826 - DNA, 22 bp, Homo sapiens
aattctataaggccataaaaca

SEQ ID NO: 2479827 - DNA, 15 bp, Homo sapiens
aattctattaaagtg

SEQ ID NO: 2479828 - DNA, 12 bp, Homo sapiens
aattctcctgga

SEQ ID NO: 2479829 - DNA, 15 bp, Homo sapiens
aattctcctggaggt

SEQ ID NO: 2479830 - DNA, 23 bp, Homo sapiens
aattctgagttttgtgtttgttg

SEQ ID NO: 2479831 - DNA, 19 bp, Homo sapiens
aattcttggttgaggaaac

SEQ ID NO: 2479832 - DNA, 17 bp, Homo sapiens
aattctttcaatacaga

SEQ ID NO: 2479833 - DNA, 12 bp, Homo sapiens
aattgaaatgta

SEQ ID NO: 2479834 - DNA, 13 bp, Homo sapiens
aattgaaatgtaa

SEQ ID NO: 2479835 - DNA, 24 bp, Homo sapiens
aattgaaatgtaaggctgtgtaag

SEQ ID NO: 2479836 - DNA, 12 bp, Homo sapiens
aattgaaccttt

SEQ ID NO: 2479837 - DNA, 13 bp, Homo sapiens
aattgaacctttg

SEQ ID NO: 2479838 - DNA, 17 bp, Homo sapiens
aattgaagtaaactttt

SEQ ID NO: 2479839 - DNA, 18 bp, Homo sapiens
aattgagtgtttaaagtt

SEQ ID NO: 2479840 - DNA, 17 bp, Homo sapiens
aattgagttttcagtgg

SEQ ID NO: 2479841 - DNA, 14 bp, Homo sapiens
aattgatttgcatt

SEQ ID NO: 2479842 - DNA, 23 bp, Homo sapiens
aattgatttgcattgaacacaaa

SEQ ID NO: 2479843 - DNA, 20 bp, Homo sapiens
aattgatttttataaatact

SEQ ID NO: 2479844 - DNA, 22 bp, Homo sapiens
aattgatttttctcttcatttt

SEQ ID NO: 2479845 - DNA, 14 bp, Homo sapiens
aattgcaaatcttg

SEQ ID NO: 2479846 - DNA, 18 bp, Homo sapiens
aattgcaaatcttgaaat

SEQ ID NO: 2479847 - DNA, 11 bp, Homo sapiens
aattgcattga

SEQ ID NO: 2479848 - DNA, 23 bp, Homo sapiens
aattgcattgactttccccacca

SEQ ID NO: 2479849 - DNA, 21 bp, Homo sapiens
aattgccaaaaagtgaaataa

SEQ ID NO: 2479850 - DNA, 19 bp, Homo sapiens
aattgctgactgtagcttt

SEQ ID NO: 2479851 - DNA, 16 bp, Homo sapiens
aattgtcccttaaaca

SEQ ID NO: 2479852 - DNA, 15 bp, Homo sapiens
aattgtgtggattct

SEQ ID NO: 2479853 - DNA, 19 bp, Homo sapiens
aatttaaaataattatata

SEQ ID NO: 2479854 - DNA, 10 bp, Homo sapiens
aatttaaaca

SEQ ID NO: 2479855 - DNA, 20 bp, Homo sapiens
aatttaaagcaggttcttgt

SEQ ID NO: 2479856 - DNA, 21 bp, Homo sapiens
aatttacaaaaatataaaata

SEQ ID NO: 2479857 - DNA, 14 bp, Homo sapiens
aatttacctaagat

SEQ ID NO: 2479858 - DNA, 16 bp, Homo sapiens
aatttacctaagatta

SEQ ID NO: 2479859 - DNA, 20 bp, Homo sapiens
aatttagaaatcattttgca

SEQ ID NO: 2479860 - DNA, 16 bp, Homo sapiens
aacccttgctgcttta

SEQ ID NO: 2479861 - DNA, 15 bp, Homo sapiens
aaccgccagctctgt

SEQ ID NO: 2479862 - DNA, 17 bp, Homo sapiens
aaccgccagctctgttc

SEQ ID NO: 2479863 - DNA, 16 bp, Homo sapiens
aaccgctaaaagaaac

SEQ ID NO: 2479864 - DNA, 17 bp, Homo sapiens
aaccgtggcccttcctg

SEQ ID NO: 2479865 - DNA, 18 bp, Homo sapiens
aaccgtggcccttcctgg

SEQ ID NO: 2479866 - DNA, 19 bp, Homo sapiens
aaccgtggcccttcctgga

SEQ ID NO: 2479867 - DNA, 17 bp, Homo sapiens
aaccgttttgaagctac

SEQ ID NO: 2479868 - DNA, 11 bp, Homo sapiens
aacctcagcct

SEQ ID NO: 2479869 - DNA, 20 bp, Homo sapiens
aacctcagcctggccagaca

SEQ ID NO: 2479870 - DNA, 18 bp, Homo sapiens
aacctcagtaatttagaa

SEQ ID NO: 2479871 - DNA, 16 bp, Homo sapiens
aacctcatcttcttca

SEQ ID NO: 2479872 - DNA, 14 bp, Homo sapiens
aacctcgctggact

SEQ ID NO: 2479873 - DNA, 21 bp, Homo sapiens
aacctgagatttattaaagaa

SEQ ID NO: 2479874 - DNA, 22 bp, Homo sapiens
aacctgagatttattaaagaaa

SEQ ID NO: 2479875 - DNA, 19 bp, Homo sapiens
aacctgcctgacatttgga

SEQ ID NO: 2479876 - DNA, 11 bp, Homo sapiens
aacctggcctt

SEQ ID NO: 2479877 - DNA, 12 bp, Homo sapiens
aacctggccttc

SEQ ID NO: 2479878 - DNA, 19 bp, Homo sapiens
aacctgggttgcagacagg

SEQ ID NO: 2479879 - DNA, 13 bp, Homo sapiens
aaccttaagacct

SEQ ID NO: 2479880 - DNA, 13 bp, Homo sapiens
aaccttaagatac

SEQ ID NO: 2479881 - DNA, 23 bp, Homo sapiens
aaccttagatgttctaagtcttt

SEQ ID NO: 2479882 - DNA, 17 bp, Homo sapiens
aaccttgaaaaaaaaca

SEQ ID NO: 2479883 - DNA, 20 bp, Homo sapiens
aaccttgaaaaaaaacagtg

SEQ ID NO: 2479884 - DNA, 13 bp, Homo sapiens
aaccttgcctggt

SEQ ID NO: 2479885 - DNA, 21 bp, Homo sapiens
aaccttgggttagacctacag

SEQ ID NO: 2479886 - DNA, 15 bp, Homo sapiens
aaccttgttttggac

SEQ ID NO: 2479887 - DNA, 23 bp, Homo sapiens
aaccttgttttggacagtttacc

SEQ ID NO: 2479888 - DNA, 12 bp, Homo sapiens
aacctttttaaa

SEQ ID NO: 2479889 - DNA, 16 bp, Homo sapiens
aacgaaaatgaaagct

SEQ ID NO: 2479890 - DNA, 16 bp, Homo sapiens
aacgagactttccatt

SEQ ID NO: 2479891 - DNA, 21 bp, Homo sapiens
aacgagactttccattacaag

SEQ ID NO: 2479892 - DNA, 15 bp, Homo sapiens
aacgatttttaaaat

SEQ ID NO: 2479893 - DNA, 18 bp, Homo sapiens
aacgatttttaaaatgta

SEQ ID NO: 2479894 - DNA, 11 bp, Homo sapiens
aacgcctgagc

SEQ ID NO: 2479895 - DNA, 13 bp, Homo sapiens
aacgcctgagccc

SEQ ID NO: 2479896 - DNA, 20 bp, Homo sapiens
aacgtttaagccaaaacaat

SEQ ID NO: 2479897 - DNA, 13 bp, Homo sapiens
aacgttttctaat

SEQ ID NO: 2479898 - DNA, 21 bp, Homo sapiens
aacgttttctaattgcttatt

SEQ ID NO: 2479899 - DNA, 23 bp, Homo sapiens
aactaaactcttaccatatgttt

SEQ ID NO: 2479900 - DNA, 20 bp, Homo sapiens
aactaaagtgctgcactcaa

SEQ ID NO: 2479901 - DNA, 15 bp, Homo sapiens
aactaacatgtcctg

SEQ ID NO: 2479902 - DNA, 14 bp, Homo sapiens
aactaataattgca

SEQ ID NO: 2479903 - DNA, 15 bp, Homo sapiens
aactaatttagtaat

SEQ ID NO: 2479904 - DNA, 18 bp, Homo sapiens
aactacaaaggtttaaat

SEQ ID NO: 2479905 - DNA, 21 bp, Homo sapiens
aactacaaaggtttaaatgaa

SEQ ID NO: 2479906 - DNA, 17 bp, Homo sapiens
aactactgtgttatgca

SEQ ID NO: 2479907 - DNA, 13 bp, Homo sapiens
aactactttataa

SEQ ID NO: 2479908 - DNA, 16 bp, Homo sapiens
aactactttgctgcta

SEQ ID NO: 2479909 - DNA, 16 bp, Homo sapiens
aactagaatttgatta

SEQ ID NO: 2479910 - DNA, 20 bp, Homo sapiens
aactagaggtgagaaattta

SEQ ID NO: 2479911 - DNA, 21 bp, Homo sapiens
aactagaggtgagaaatttaa

SEQ ID NO: 2479912 - DNA, 13 bp, Homo sapiens
aactagcccctgg

SEQ ID NO: 2479913 - DNA, 24 bp, Homo sapiens
aactatatataatcatcaagtaat

SEQ ID NO: 2479914 - DNA, 16 bp, Homo sapiens
aactatgattattaac

SEQ ID NO: 2479915 - DNA, 18 bp, Homo sapiens
aactattttcaaagactt

SEQ ID NO: 2479916 - DNA, 16 bp, Homo sapiens
aactattttcagatgt

SEQ ID NO: 2479917 - DNA, 20 bp, Homo sapiens
aactattttcagatgtgaac

SEQ ID NO: 2479918 - DNA, 18 bp, Homo sapiens
aactcaaatggggccaga

SEQ ID NO: 2479919 - DNA, 13 bp, Homo sapiens
aactcagatccag

SEQ ID NO: 2479920 - DNA, 15 bp, Homo sapiens
aactcagatccaggg

SEQ ID NO: 2479921 - DNA, 19 bp, Homo sapiens
aactcctagttctagaaaa

SEQ ID NO: 2479922 - DNA, 21 bp, Homo sapiens
aactcctagttctagaaaaac

SEQ ID NO: 2479923 - DNA, 11 bp, Homo sapiens
aactcctccca

SEQ ID NO: 2479924 - DNA, 18 bp, Homo sapiens
aactcctgacctcaggca

SEQ ID NO: 2479925 - DNA, 16 bp, Homo sapiens
aactcgaatctgtgtg

SEQ ID NO: 2479926 - DNA, 19 bp, Homo sapiens
aactcgtatagcatgcatc

SEQ ID NO: 2479927 - DNA, 23 bp, Homo sapiens
aactctatattgttcagcatgca

SEQ ID NO: 2479928 - DNA, 18 bp, Homo sapiens
aactctcttattgcctca

SEQ ID NO: 2479929 - DNA, 16 bp, Homo sapiens
aactctgcattctagt

SEQ ID NO: 2479930 - DNA, 23 bp, Homo sapiens
aactcttcactcttcaaatgcct

SEQ ID NO: 2479931 - DNA, 23 bp, Homo sapiens
aactcttccccctctcccagttg

SEQ ID NO: 2479932 - DNA, 13 bp, Homo sapiens
aactctttgctgc

SEQ ID NO: 2479933 - DNA, 13 bp, Homo sapiens
aactgaaaattat

SEQ ID NO: 2479934 - DNA, 21 bp, Homo sapiens
aactgaacaccattgaaggct

SEQ ID NO: 2479935 - DNA, 22 bp, Homo sapiens
aactgaacaccattgaaggctt

SEQ ID NO: 2479936 - DNA, 20 bp, Homo sapiens
aactgactattcttgatgta

SEQ ID NO: 2479937 - DNA, 16 bp, Homo sapiens
aactgcaggccctggc

SEQ ID NO: 2479938 - DNA, 17 bp, Homo sapiens
aactgcaggccctggcc

SEQ ID NO: 2479939 - DNA, 20 bp, Homo sapiens
aactgcaggccctggcctcc

SEQ ID NO: 2479940 - DNA, 17 bp, Homo sapiens
aactgcatgcccagaga

SEQ ID NO: 2479941 - DNA, 14 bp, Homo sapiens
aactgccaggctct

SEQ ID NO: 2479942 - DNA, 13 bp, Homo sapiens
aactgcctagaaa

SEQ ID NO: 2479943 - DNA, 20 bp, Homo sapiens
aactgcctcgaaacacagaa

SEQ ID NO: 2479944 - DNA, 17 bp, Homo sapiens
aactgctttctgttcca

SEQ ID NO: 2479945 - DNA, 13 bp, Homo sapiens
aactggaaagaag

SEQ ID NO: 2479946 - DNA, 16 bp, Homo sapiens
aactggccaagctgag

SEQ ID NO: 2479947 - DNA, 18 bp, Homo sapiens
aactgggaacccctttcc

SEQ ID NO: 2479948 - DNA, 13 bp, Homo sapiens
aactgtaatacaa

SEQ ID NO: 2479949 - DNA, 13 bp, Homo sapiens
aactgtggatatt

SEQ ID NO: 2479950 - DNA, 14 bp, Homo sapiens
aactgtggatattg

SEQ ID NO: 2479951 - DNA, 13 bp, Homo sapiens
aactgtgtaactg

SEQ ID NO: 2479952 - DNA, 22 bp, Homo sapiens
aactgtgtaactgcccaaagca

SEQ ID NO: 2479953 - DNA, 17 bp, Homo sapiens
aactgtttttgaacctg

SEQ ID NO: 2479954 - DNA, 13 bp, Homo sapiens
aactgttttttaa

SEQ ID NO: 2479955 - DNA, 15 bp, Homo sapiens
aacttaaatgttatt

SEQ ID NO: 2479956 - DNA, 21 bp, Homo sapiens
aacttaaatgttattatctgg

SEQ ID NO: 2479957 - DNA, 14 bp, Homo sapiens
aacttcagaaagac

SEQ ID NO: 2479958 - DNA, 19 bp, Homo sapiens
aacttcagtttcacagaaa

SEQ ID NO: 2479959 - DNA, 24 bp, Homo sapiens
aacttcttatggaattgatttgca

SEQ ID NO: 2479960 - DNA, 19 bp, Homo sapiens
aacttgaccctgagctgac

SEQ ID NO: 2479961 - DNA, 19 bp, Homo sapiens
aacttgatccatttctaat

SEQ ID NO: 2479962 - DNA, 17 bp, Homo sapiens
aacttggatacttggat

SEQ ID NO: 2479963 - DNA, 21 bp, Homo sapiens
aacttggctcgaatctctgtg

SEQ ID NO: 2479964 - DNA, 22 bp, Homo sapiens
aacttggctcgaatctctgtgc

SEQ ID NO: 2479965 - DNA, 20 bp, Homo sapiens
agtctgaggtcctgagcact

SEQ ID NO: 2479966 - DNA, 13 bp, Homo sapiens
agtctgtccttga

SEQ ID NO: 2479967 - DNA, 17 bp, Homo sapiens
agtctgtttactgcaag

SEQ ID NO: 2479968 - DNA, 16 bp, Homo sapiens
agtcttacgaatactt

SEQ ID NO: 2479969 - DNA, 18 bp, Homo sapiens
agtctttggttctaagga

SEQ ID NO: 2479970 - DNA, 14 bp, Homo sapiens
agtcttttgctttt

SEQ ID NO: 2479971 - DNA, 18 bp, Homo sapiens
agtcttttgcttttggca

SEQ ID NO: 2479972 - DNA, 19 bp, Homo sapiens
agtcttttgcttttggcaa

SEQ ID NO: 2479973 - DNA, 22 bp, Homo sapiens
agtgaagaatacttctcatttt

SEQ ID NO: 2479974 - DNA, 12 bp, Homo sapiens
agtgaagacaga

SEQ ID NO: 2479975 - DNA, 20 bp, Homo sapiens
agtgaagacagaaccacagg

SEQ ID NO: 2479976 - DNA, 19 bp, Homo sapiens
agtgaatgctgggactcag

SEQ ID NO: 2479977 - DNA, 16 bp, Homo sapiens
agtgaattccctcact

SEQ ID NO: 2479978 - DNA, 16 bp, Homo sapiens
agtgaccctggctcct

SEQ ID NO: 2479979 - DNA, 16 bp, Homo sapiens
agtgactaatggcatg

SEQ ID NO: 2479980 - DNA, 13 bp, Homo sapiens
agtgagacagact

SEQ ID NO: 2479981 - DNA, 13 bp, Homo sapiens
agtgaggcagccg

SEQ ID NO: 2479982 - DNA, 19 bp, Homo sapiens
agtgagggagggctgtcat

SEQ ID NO: 2479983 - DNA, 17 bp, Homo sapiens
agtgatagtcttttgct

SEQ ID NO: 2479984 - DNA, 14 bp, Homo sapiens
agtgatataaatca

SEQ ID NO: 2479985 - DNA, 15 bp, Homo sapiens
agtgatattggaact

SEQ ID NO: 2479986 - DNA, 13 bp, Homo sapiens
agtgcaacactgg

SEQ ID NO: 2479987 - DNA, 14 bp, Homo sapiens
agtgcatctggaga

SEQ ID NO: 2479988 - DNA, 16 bp, Homo sapiens
agtgccacttaatgta

SEQ ID NO: 2479989 - DNA, 16 bp, Homo sapiens
agtgcccccactgacc

SEQ ID NO: 2479990 - DNA, 19 bp, Homo sapiens
agtgccctctcccaccctc

SEQ ID NO: 2479991 - DNA, 23 bp, Homo sapiens
agtgccctctcccaccctcttcc

SEQ ID NO: 2479992 - DNA, 13 bp, Homo sapiens
agtgccctgagcc

SEQ ID NO: 2479993 - DNA, 20 bp, Homo sapiens
agtgccctgagccagggtct

SEQ ID NO: 2479994 - DNA, 21 bp, Homo sapiens
agtgccttcaacacagcttgt

SEQ ID NO: 2479995 - DNA, 15 bp, Homo sapiens
agtgcgtccacgagc

SEQ ID NO: 2479996 - DNA, 17 bp, Homo sapiens
agtgctaaggttctaag

SEQ ID NO: 2479997 - DNA, 18 bp, Homo sapiens
agtgctaaggttctaagg

SEQ ID NO: 2479998 - DNA, 11 bp, Homo sapiens
agtgctctgat

SEQ ID NO: 2479999 - DNA, 14 bp, Homo sapiens
agtgctcttttctc

SEQ ID NO: 2480000 - DNA, 15 bp, Homo sapiens
agtgctgagattaca

SEQ ID NO: 2480001 - DNA, 21 bp, Homo sapiens
aggtttatgaaaaagaagaat

SEQ ID NO: 2480002 - DNA, 17 bp, Homo sapiens
aggttttaatttagtaa

SEQ ID NO: 2480003 - DNA, 14 bp, Homo sapiens
aggttttaggttct

SEQ ID NO: 2480004 - DNA, 19 bp, Homo sapiens
aggttttaggttctaaagt

SEQ ID NO: 2480005 - DNA, 12 bp, Homo sapiens
aggtttttcctt

SEQ ID NO: 2480006 - DNA, 16 bp, Homo sapiens
agtaaagaattatttt

SEQ ID NO: 2480007 - DNA, 16 bp, Homo sapiens
agtaaagtcaaggaga

SEQ ID NO: 2480008 - DNA, 16 bp, Homo sapiens
agtaacactaatatat

SEQ ID NO: 2480009 - DNA, 17 bp, Homo sapiens
agtaacactaatatatt

SEQ ID NO: 2480010 - DNA, 17 bp, Homo sapiens
agtaacatttgctgttt

SEQ ID NO: 2480011 - DNA, 23 bp, Homo sapiens
agtaactgttttttaagtctctc

SEQ ID NO: 2480012 - DNA, 14 bp, Homo sapiens
agtaagaggtgtta

SEQ ID NO: 2480013 - DNA, 14 bp, Homo sapiens
agtaatagcctggg

SEQ ID NO: 2480014 - DNA, 22 bp, Homo sapiens
agtaatggtgtagaacactaat

SEQ ID NO: 2480015 - DNA, 23 bp, Homo sapiens
agtaatggtgtagaacactaatt

SEQ ID NO: 2480016 - DNA, 18 bp, Homo sapiens
agtaattgacatgtgcca

SEQ ID NO: 2480017 - DNA, 23 bp, Homo sapiens
agtaatttagaaatcattttgca

SEQ ID NO: 2480018 - DNA, 15 bp, Homo sapiens
agtacactctgctgt

SEQ ID NO: 2480019 - DNA, 12 bp, Homo sapiens
agtacagagaag

SEQ ID NO: 2480020 - DNA, 15 bp, Homo sapiens
agtaccaatcatttt

SEQ ID NO: 2480021 - DNA, 14 bp, Homo sapiens
agtaccagactaga

SEQ ID NO: 2480022 - DNA, 23 bp, Homo sapiens
agtacccactctggagcatttct

SEQ ID NO: 2480023 - DNA, 18 bp, Homo sapiens
agtaccctctcagctcca

SEQ ID NO: 2480024 - DNA, 13 bp, Homo sapiens
agtacctgagggt

SEQ ID NO: 2480025 - DNA, 21 bp, Homo sapiens
agtacctgagggtctgtaggt

SEQ ID NO: 2480026 - DNA, 14 bp, Homo sapiens
agtactccacactg

SEQ ID NO: 2480027 - DNA, 20 bp, Homo sapiens
agtactccacactgcacaat

SEQ ID NO: 2480028 - DNA, 16 bp, Homo sapiens
agtactgggattacag

SEQ ID NO: 2480029 - DNA, 23 bp, Homo sapiens
agtacttagctagttttattctt

SEQ ID NO: 2480030 - DNA, 23 bp, Homo sapiens
agtacttgggagacctgtaatca

SEQ ID NO: 2480031 - DNA, 19 bp, Homo sapiens
agtagaagtctcttccagt

SEQ ID NO: 2480032 - DNA, 14 bp, Homo sapiens
agtagaatctcagt

SEQ ID NO: 2480033 - DNA, 17 bp, Homo sapiens
agccagcgtcctcctct

SEQ ID NO: 2480034 - DNA, 18 bp, Homo sapiens
agccagcgtcctcctctg

SEQ ID NO: 2480035 - DNA, 23 bp, Homo sapiens
agccagcgtcctcctctgtgacc

SEQ ID NO: 2480036 - DNA, 20 bp, Homo sapiens
agccagcgtcggtctgtgcc

SEQ ID NO: 2480037 - DNA, 23 bp, Homo sapiens
agccagctaaggggtggggctgc

SEQ ID NO: 2480038 - DNA, 19 bp, Homo sapiens
agccagcttgtttacatgc

SEQ ID NO: 2480039 - DNA, 19 bp, Homo sapiens
agccaggaatttcccagga

SEQ ID NO: 2480040 - DNA, 22 bp, Homo sapiens
agccaggaatttcccaggaccc

SEQ ID NO: 2480041 - DNA, 13 bp, Homo sapiens
agccaggcccagc

SEQ ID NO: 2480042 - DNA, 17 bp, Homo sapiens
agccagggagagcccag

SEQ ID NO: 2480043 - DNA, 18 bp, Homo sapiens
agccagggagagcccagg

SEQ ID NO: 2480044 - DNA, 19 bp, Homo sapiens
agccagggagagcccagga

SEQ ID NO: 2480045 - DNA, 20 bp, Homo sapiens
agccagggagagcccaggag

SEQ ID NO: 2480046 - DNA, 18 bp, Homo sapiens
agccaggggagcagaggg

SEQ ID NO: 2480047 - DNA, 15 bp, Homo sapiens
agccaggtccctctc

SEQ ID NO: 2480048 - DNA, 15 bp, Homo sapiens
agccagtgccctgag

SEQ ID NO: 2480049 - DNA, 17 bp, Homo sapiens
agccagtgccctgagcc

SEQ ID NO: 2480050 - DNA, 18 bp, Homo sapiens
agccagtgccctgagcca

SEQ ID NO: 2480051 - DNA, 23 bp, Homo sapiens
agccagtgccctgagccagggtc

SEQ ID NO: 2480052 - DNA, 23 bp, Homo sapiens
agccagtttgggtaaaatacttt

SEQ ID NO: 2480053 - DNA, 10 bp, Homo sapiens
agccatagtg

SEQ ID NO: 2480054 - DNA, 16 bp, Homo sapiens
agccatatttgtaaaa

SEQ ID NO: 2480055 - DNA, 14 bp, Homo sapiens
agccatcaaaatgc

SEQ ID NO: 2480056 - DNA, 19 bp, Homo sapiens
agccatcacctcagatggc

SEQ ID NO: 2480057 - DNA, 21 bp, Homo sapiens
agccatgagatgatacatcca

SEQ ID NO: 2480058 - DNA, 15 bp, Homo sapiens
agccatgtcttctcc

SEQ ID NO: 2480059 - DNA, 16 bp, Homo sapiens
agccatgtcttctccc

SEQ ID NO: 2480060 - DNA, 17 bp, Homo sapiens
agccatgtcttctccct

SEQ ID NO: 2480061 - DNA, 14 bp, Homo sapiens
agcccactgtcctg

SEQ ID NO: 2480062 - DNA, 17 bp, Homo sapiens
agcccactgtcctgggc

SEQ ID NO: 2480063 - DNA, 18 bp, Homo sapiens
agcccactgtcctgggcc

SEQ ID NO: 2480064 - DNA, 23 bp, Homo sapiens
agcccactgtcctgggcctgcag

SEQ ID NO: 2480065 - DNA, 10 bp, Homo sapiens
agcccagaga

SEQ ID NO: 2480066 - DNA, 22 bp, Homo sapiens
agcccagagacatacttgaagg

SEQ ID NO: 2480067 - DNA, 12 bp, Homo sapiens
agcccagccagc

SEQ ID NO: 2480068 - DNA, 12 bp, Homo sapiens
agcccagctcca

SEQ ID NO: 2480069 - DNA, 13 bp, Homo sapiens
agcccagctgggt

SEQ ID NO: 2480070 - DNA, 15 bp, Homo sapiens
agcccagctgggtca

SEQ ID NO: 2480071 - DNA, 21 bp, Homo sapiens
agcccagctgggtcaggcagg

SEQ ID NO: 2480072 - DNA, 14 bp, Homo sapiens
agcccaggagctcc

SEQ ID NO: 2480073 - DNA, 13 bp, Homo sapiens
agcccaggccagg

SEQ ID NO: 2480074 - DNA, 19 bp, Homo sapiens
agcccaggccaggactctg

SEQ ID NO: 2480075 - DNA, 22 bp, Homo sapiens
agcccaggccaggactctgcag

SEQ ID NO: 2480076 - DNA, 23 bp, Homo sapiens
agcccaggccaggactctgcagc

SEQ ID NO: 2480077 - DNA, 14 bp, Homo sapiens
agcccagggctcct

SEQ ID NO: 2480078 - DNA, 15 bp, Homo sapiens
agcccagggctcctg

SEQ ID NO: 2480079 - DNA, 15 bp, Homo sapiens
agcccagtagacctt

SEQ ID NO: 2480080 - DNA, 17 bp, Homo sapiens
agcccatcctgaccagc

SEQ ID NO: 2480081 - DNA, 21 bp, Homo sapiens
agcccatggagattgacctgg

SEQ ID NO: 2480082 - DNA, 22 bp, Homo sapiens
agcccatggagattgacctgga

SEQ ID NO: 2480083 - DNA, 19 bp, Homo sapiens
agcccattgtggcctaaga

SEQ ID NO: 2480084 - DNA, 16 bp, Homo sapiens
agccccacccaggcca

SEQ ID NO: 2480085 - DNA, 23 bp, Homo sapiens
agccccaccccagggcagccagg

SEQ ID NO: 2480086 - DNA, 16 bp, Homo sapiens
agccccaccctggcct

SEQ ID NO: 2480087 - DNA, 13 bp, Homo sapiens
agccccactcctc

SEQ ID NO: 2480088 - DNA, 21 bp, Homo sapiens
agccccagcccagccccactc

SEQ ID NO: 2480089 - DNA, 13 bp, Homo sapiens
agccccattcctg

SEQ ID NO: 2480090 - DNA, 13 bp, Homo sapiens
agcccccaccctg

SEQ ID NO: 2480091 - DNA, 19 bp, Homo sapiens
agcccccaccctgttcctg

SEQ ID NO: 2480092 - DNA, 15 bp, Homo sapiens
agcccccagcctgtc

SEQ ID NO: 2480093 - DNA, 12 bp, Homo sapiens
agcccccagcta

SEQ ID NO: 2480094 - DNA, 19 bp, Homo sapiens
agcccccagctaagaacct

SEQ ID NO: 2480095 - DNA, 17 bp, Homo sapiens
agcccccagctcccacc

SEQ ID NO: 2480096 - DNA, 23 bp, Homo sapiens
agccccctcacagtattgctcac

SEQ ID NO: 2480097 - DNA, 21 bp, Homo sapiens
agccccctgaccactcagaga

SEQ ID NO: 2480098 - DNA, 22 bp, Homo sapiens
agcccctctggtcgctcctgcc

SEQ ID NO: 2480099 - DNA, 15 bp, Homo sapiens
agcccctcttggaga

SEQ ID NO: 2480100 - DNA, 20 bp, Homo sapiens
agcccctcttggagaagtct

SEQ ID NO: 2480101 - DNA, 21 bp, Homo sapiens
agcccctggggtggccaccag

SEQ ID NO: 2480102 - DNA, 16 bp, Homo sapiens
agccccttctgctcag

SEQ ID NO: 2480103 - DNA, 14 bp, Homo sapiens
agcccgaggaggtg

SEQ ID NO: 2480104 - DNA, 14 bp, Homo sapiens
agcccgtctcagtg

SEQ ID NO: 2480105 - DNA, 15 bp, Homo sapiens
agcccgtctcagtgt

SEQ ID NO: 2480106 - DNA, 15 bp, Homo sapiens
agccctaaacatcat

SEQ ID NO: 2480107 - DNA, 23 bp, Homo sapiens
agccctcacacaccctgtctgcc

SEQ ID NO: 2480108 - DNA, 17 bp, Homo sapiens
agccctcctctgcactc

SEQ ID NO: 2480109 - DNA, 20 bp, Homo sapiens
agccctgcaccatgctgctg

SEQ ID NO: 2480110 - DNA, 22 bp, Homo sapiens
agccctgcaccatgctgctggg

SEQ ID NO: 2480111 - DNA, 13 bp, Homo sapiens
agccctgcctgga

SEQ ID NO: 2480112 - DNA, 15 bp, Homo sapiens
agccctgcctggagg

SEQ ID NO: 2480113 - DNA, 20 bp, Homo sapiens
agccctgcctggaggacctg

SEQ ID NO: 2480114 - DNA, 21 bp, Homo sapiens
agccctgcctggaggacctga

SEQ ID NO: 2480115 - DNA, 23 bp, Homo sapiens
agctagtcttttgcttttgccca

SEQ ID NO: 2480116 - DNA, 17 bp, Homo sapiens
agctagtgacccacatg

SEQ ID NO: 2480117 - DNA, 22 bp, Homo sapiens
agctataaagcagtatttttct

SEQ ID NO: 2480118 - DNA, 15 bp, Homo sapiens
agctatttgatgtaa

SEQ ID NO: 2480119 - DNA, 20 bp, Homo sapiens
agctatttgatgtaatactt

SEQ ID NO: 2480120 - DNA, 14 bp, Homo sapiens
agctatttttctaa

SEQ ID NO: 2480121 - DNA, 23 bp, Homo sapiens
agctcaaaggtttggaaggagca

SEQ ID NO: 2480122 - DNA, 14 bp, Homo sapiens
agctcaactctctt

SEQ ID NO: 2480123 - DNA, 19 bp, Homo sapiens
agctcactccccaaccccc

SEQ ID NO: 2480124 - DNA, 21 bp, Homo sapiens
agctcatccatgcctcagaag

SEQ ID NO: 2480125 - DNA, 13 bp, Homo sapiens
agctccaacctgc

SEQ ID NO: 2480126 - DNA, 15 bp, Homo sapiens
agctccaagccccat

SEQ ID NO: 2480127 - DNA, 15 bp, Homo sapiens
agctccaccctggcc

SEQ ID NO: 2480128 - DNA, 22 bp, Homo sapiens
agctccactctgcttctctgac

SEQ ID NO: 2480129 - DNA, 15 bp, Homo sapiens
agctccagcctgaca

SEQ ID NO: 2480130 - DNA, 16 bp, Homo sapiens
agctccagcctgacat

SEQ ID NO: 2480131 - DNA, 18 bp, Homo sapiens
agctcccacaagcctctg

SEQ ID NO: 2480132 - DNA, 20 bp, Homo sapiens
agctcccacaagcctctgcc

SEQ ID NO: 2480133 - DNA, 17 bp, Homo sapiens
agctcccacaagcctga

SEQ ID NO: 2480134 - DNA, 23 bp, Homo sapiens
agctcccccagcaaagcccccag

SEQ ID NO: 2480135 - DNA, 16 bp, Homo sapiens
agctcccttcttccct

SEQ ID NO: 2480136 - DNA, 12 bp, Homo sapiens
agctcctcccac

SEQ ID NO: 2480137 - DNA, 14 bp, Homo sapiens
agctcctcccctgg

SEQ ID NO: 2480138 - DNA, 16 bp, Homo sapiens
agctcctctccccagc

SEQ ID NO: 2480139 - DNA, 19 bp, Homo sapiens
agctcctctccccagccca

SEQ ID NO: 2480140 - DNA, 20 bp, Homo sapiens
agctcctctccccagcccag

SEQ ID NO: 2480141 - DNA, 23 bp, Homo sapiens
agctcctctccccagcccagaga

SEQ ID NO: 2480142 - DNA, 24 bp, Homo sapiens
agctcctctccccagcccagagac

SEQ ID NO: 2480143 - DNA, 15 bp, Homo sapiens
agctcctcttccatg

SEQ ID NO: 2480144 - DNA, 18 bp, Homo sapiens
agctcctgacactgctgg

SEQ ID NO: 2480145 - DNA, 15 bp, Homo sapiens
agctcctgaccagtt

SEQ ID NO: 2480146 - DNA, 16 bp, Homo sapiens
agctcctgaccagttg

SEQ ID NO: 2480147 - DNA, 17 bp, Homo sapiens
agctcctgtcccctgct

SEQ ID NO: 2480148 - DNA, 18 bp, Homo sapiens
agctcctgtcccctgcta

SEQ ID NO: 2480149 - DNA, 13 bp, Homo sapiens
agctcctgtggcc

SEQ ID NO: 2480150 - DNA, 13 bp, Homo sapiens
agctccttcctgg

SEQ ID NO: 2480151 - DNA, 19 bp, Homo sapiens
agctccttcctggagactg

SEQ ID NO: 2480152 - DNA, 22 bp, Homo sapiens
agctcctttgggcttcagctgc

SEQ ID NO: 2480153 - DNA, 22 bp, Homo sapiens
agctcgatgtggtcacagctgt

SEQ ID NO: 2480154 - DNA, 17 bp, Homo sapiens
agctctactgcctcaac

SEQ ID NO: 2480155 - DNA, 15 bp, Homo sapiens
agctctagaatctgc

SEQ ID NO: 2480156 - DNA, 13 bp, Homo sapiens
agctctctgccct

SEQ ID NO: 2480157 - DNA, 15 bp, Homo sapiens
agctctgagaggccc

SEQ ID NO: 2480158 - DNA, 18 bp, Homo sapiens
agctctgagaggccctgg

SEQ ID NO: 2480159 - DNA, 13 bp, Homo sapiens
agctctgagctgt

SEQ ID NO: 2480160 - DNA, 23 bp, Homo sapiens
agctctgctattaggccagcaag

SEQ ID NO: 2480161 - DNA, 17 bp, Homo sapiens
agctctggaggggaggg

SEQ ID NO: 2480162 - DNA, 19 bp, Homo sapiens
agctctggaggggaggggg

SEQ ID NO: 2480163 - DNA, 20 bp, Homo sapiens
agctctggggtgggcagttt

SEQ ID NO: 2480164 - DNA, 22 bp, Homo sapiens
agctctgtatcaggacccagag

SEQ ID NO: 2480165 - DNA, 18 bp, Homo sapiens
agctctgttcttcctcag

SEQ ID NO: 2480166 - DNA, 21 bp, Homo sapiens
agctcttccttactcccaggc

SEQ ID NO: 2480167 - DNA, 23 bp, Homo sapiens
agctgaaggttgtggcctttgcg

SEQ ID NO: 2480168 - DNA, 15 bp, Homo sapiens
agctgaatgtttttc

SEQ ID NO: 2480169 - DNA, 18 bp, Homo sapiens
agctgaatgtttttctaa

SEQ ID NO: 2480170 - DNA, 22 bp, Homo sapiens
agctgaccagccgtgagcatgt

SEQ ID NO: 2480171 - DNA, 23 bp, Homo sapiens
agctgactaaactttttttctgt

SEQ ID NO: 2480172 - DNA, 17 bp, Homo sapiens
agctgacttggctggtg

SEQ ID NO: 2480173 - DNA, 19 bp, Homo sapiens
agctgacttggctggtgtg

SEQ ID NO: 2480174 - DNA, 14 bp, Homo sapiens
agctgagcgccagg

SEQ ID NO: 2480175 - DNA, 15 bp, Homo sapiens
agctgagcgccagga

SEQ ID NO: 2480176 - DNA, 21 bp, Homo sapiens
agctgagctcacaaggcagca

SEQ ID NO: 2480177 - DNA, 15 bp, Homo sapiens
agctgaggtgcccag

SEQ ID NO: 2480178 - DNA, 18 bp, Homo sapiens
agctgaggtgcccaggag

SEQ ID NO: 2480179 - DNA, 22 bp, Homo sapiens
agctgagtattaaaatgtatgc

SEQ ID NO: 2480180 - DNA, 14 bp, Homo sapiens
agctgagtttccta

SEQ ID NO: 2480181 - DNA, 11 bp, Homo sapiens
agctgcactga

SEQ ID NO: 2480182 - DNA, 20 bp, Homo sapiens
agctgcactgatgctgcccc

SEQ ID NO: 2480183 - DNA, 15 bp, Homo sapiens
agctgccagtgtcct

SEQ ID NO: 2480184 - DNA, 19 bp, Homo sapiens
agctgccccggcccctccc

SEQ ID NO: 2480185 - DNA, 16 bp, Homo sapiens
agctgccggtcgccct

SEQ ID NO: 2480186 - DNA, 23 bp, Homo sapiens
agctgcctcccctctccttcctg

SEQ ID NO: 2480187 - DNA, 18 bp, Homo sapiens
agctgctccgaggaccca

SEQ ID NO: 2480188 - DNA, 14 bp, Homo sapiens
agctgcttccagtg

SEQ ID NO: 2480189 - DNA, 13 bp, Homo sapiens
agctggaggcagg

SEQ ID NO: 2480190 - DNA, 22 bp, Homo sapiens
agctggaggcaggggcttcctg

SEQ ID NO: 2480191 - DNA, 23 bp, Homo sapiens
agctggcggctggggtcccagca

SEQ ID NO: 2480192 - DNA, 22 bp, Homo sapiens
agctggggatccctccccccca

SEQ ID NO: 2480193 - DNA, 15 bp, Homo sapiens
agctggggtgcaggg

SEQ ID NO: 2480194 - DNA, 23 bp, Homo sapiens
agctggggtgcagggatgtgggt

SEQ ID NO: 2480195 - DNA, 16 bp, Homo sapiens
agctgggtcaggcagg

SEQ ID NO: 2480196 - DNA, 19 bp, Homo sapiens
agacaacgtgctctttgtt

SEQ ID NO: 2480197 - DNA, 17 bp, Homo sapiens
agacaagcctggcctac

SEQ ID NO: 2480198 - DNA, 13 bp, Homo sapiens
agacacaggccct

SEQ ID NO: 2480199 - DNA, 13 bp, Homo sapiens
agacacatgaagg

SEQ ID NO: 2480200 - DNA, 12 bp, Homo sapiens
agacaccaaagt

SEQ ID NO: 2480201 - DNA, 14 bp, Homo sapiens
agacaccaaagttc

SEQ ID NO: 2480202 - DNA, 12 bp, Homo sapiens
agacacccagga

SEQ ID NO: 2480203 - DNA, 15 bp, Homo sapiens
agacacccaggactt

SEQ ID NO: 2480204 - DNA, 16 bp, Homo sapiens
agacacccaggactta

SEQ ID NO: 2480205 - DNA, 20 bp, Homo sapiens
agacactccccgaagtcttt

SEQ ID NO: 2480206 - DNA, 13 bp, Homo sapiens
agacactggcccc

SEQ ID NO: 2480207 - DNA, 14 bp, Homo sapiens
agacagaacaccta

SEQ ID NO: 2480208 - DNA, 18 bp, Homo sapiens
agacagaacacctatgca

SEQ ID NO: 2480209 - DNA, 15 bp, Homo sapiens
agacagagaggactg

SEQ ID NO: 2480210 - DNA, 14 bp, Homo sapiens
agacagagccagga

SEQ ID NO: 2480211 - DNA, 16 bp, Homo sapiens
agacagagccaggaga

SEQ ID NO: 2480212 - DNA, 19 bp, Homo sapiens
agacagagccaggagaagc

SEQ ID NO: 2480213 - DNA, 19 bp, Homo sapiens
agacagagccctgtgaggc

SEQ ID NO: 2480214 - DNA, 15 bp, Homo sapiens
agacagaggccctca

SEQ ID NO: 2480215 - DNA, 15 bp, Homo sapiens
agacaggctcttagc

SEQ ID NO: 2480216 - DNA, 16 bp, Homo sapiens
agacataaaggaaaag

SEQ ID NO: 2480217 - DNA, 18 bp, Homo sapiens
agacataaccactgcttc

SEQ ID NO: 2480218 - DNA, 17 bp, Homo sapiens
agacatacttgaagggc

SEQ ID NO: 2480219 - DNA, 14 bp, Homo sapiens
agacatcagccctt

SEQ ID NO: 2480220 - DNA, 15 bp, Homo sapiens
agacatgatttcctt

SEQ ID NO: 2480221 - DNA, 14 bp, Homo sapiens
agacatgcagagat

SEQ ID NO: 2480222 - DNA, 15 bp, Homo sapiens
agacatgcagagatt

SEQ ID NO: 2480223 - DNA, 15 bp, Homo sapiens
agacatggaggttct

SEQ ID NO: 2480224 - DNA, 16 bp, Homo sapiens
agacatggaggttcta

SEQ ID NO: 2480225 - DNA, 23 bp, Homo sapiens
agaccaccagggcatctctgggc

SEQ ID NO: 2480226 - DNA, 14 bp, Homo sapiens
agaccaccccgcct

SEQ ID NO: 2480227 - DNA, 21 bp, Homo sapiens
agaccacgcccgtcctgcctg

SEQ ID NO: 2480228 - DNA, 15 bp, Homo sapiens
agaccagcagacaga

SEQ ID NO: 2480229 - DNA, 21 bp, Homo sapiens
agaccagcagacagagccagg

SEQ ID NO: 2480230 - DNA, 12 bp, Homo sapiens
agaccagggctc

SEQ ID NO: 2480231 - DNA, 13 bp, Homo sapiens
agaccataatgtt

SEQ ID NO: 2480232 - DNA, 14 bp, Homo sapiens
agaccctggaggcc

SEQ ID NO: 2480233 - DNA, 15 bp, Homo sapiens
agaccggcctgccag

SEQ ID NO: 2480234 - DNA, 20 bp, Homo sapiens
agaccggcctgccaggagga

SEQ ID NO: 2480235 - DNA, 22 bp, Homo sapiens
agacctacagggggtctggctg

SEQ ID NO: 2480236 - DNA, 23 bp, Homo sapiens
agacctacagggggtctggctgg

SEQ ID NO: 2480237 - DNA, 16 bp, Homo sapiens
agacctactgttctaa

SEQ ID NO: 2480238 - DNA, 14 bp, Homo sapiens
agacctgatcctgg

SEQ ID NO: 2480239 - DNA, 15 bp, Homo sapiens
agacctgatcctgga

SEQ ID NO: 2480240 - DNA, 16 bp, Homo sapiens
agacctgatcctggag

SEQ ID NO: 2480241 - DNA, 21 bp, Homo sapiens
agacctgatcctggaggccca

SEQ ID NO: 2480242 - DNA, 18 bp, Homo sapiens
agacctgttagcagacag

SEQ ID NO: 2480243 - DNA, 21 bp, Homo sapiens
agaccttgttacttctgaggt

SEQ ID NO: 2480244 - DNA, 14 bp, Homo sapiens
agacgcctggctgc

SEQ ID NO: 2480245 - DNA, 15 bp, Homo sapiens
agacgcctggctgct

SEQ ID NO: 2480246 - DNA, 20 bp, Homo sapiens
agacggaagggtaaacaata

SEQ ID NO: 2480247 - DNA, 22 bp, Homo sapiens
agacggagccctggcatgtcaa

SEQ ID NO: 2480248 - DNA, 22 bp, Homo sapiens
agacgttttataagcatcatta

SEQ ID NO: 2480249 - DNA, 16 bp, Homo sapiens
agactagatgtagtat

SEQ ID NO: 2480250 - DNA, 23 bp, Homo sapiens
agactagatgtagtattttttgt

SEQ ID NO: 2480251 - DNA, 16 bp, Homo sapiens
agactcaaatgttcta

SEQ ID NO: 2480252 - DNA, 23 bp, Homo sapiens
agactcaggccaagaaacgtctt

SEQ ID NO: 2480253 - DNA, 14 bp, Homo sapiens
agactccagacctg

SEQ ID NO: 2480254 - DNA, 18 bp, Homo sapiens
agactccagacctgaggc

SEQ ID NO: 2480255 - DNA, 17 bp, Homo sapiens
agactcctagctgtcct

SEQ ID NO: 2480256 - DNA, 22 bp, Homo sapiens
agactcctagctgtcctttttc

SEQ ID NO: 2480257 - DNA, 17 bp, Homo sapiens
agactccttcaacaatt

SEQ ID NO: 2480258 - DNA, 17 bp, Homo sapiens
agactctaagaaagaac

SEQ ID NO: 2480259 - DNA, 19 bp, Homo sapiens
agactctacccatattaca

SEQ ID NO: 2480260 - DNA, 13 bp, Homo sapiens
agactctggtgtt

SEQ ID NO: 2480261 - DNA, 21 bp, Homo sapiens
agactgaatagatatgaaagc

SEQ ID NO: 2480262 - DNA, 20 bp, Homo sapiens
agactgccatattaaatttt

SEQ ID NO: 2480263 - DNA, 21 bp, Homo sapiens
agactgccatattaaattttt

SEQ ID NO: 2480264 - DNA, 19 bp, Homo sapiens
agactgctgtggccaggag

SEQ ID NO: 2480265 - DNA, 20 bp, Homo sapiens
agactgctgtggccaggagg

SEQ ID NO: 2480266 - DNA, 19 bp, Homo sapiens
agactggaagctaatttgc

SEQ ID NO: 2480267 - DNA, 11 bp, Homo sapiens
agactggcttt

SEQ ID NO: 2480268 - DNA, 21 bp, Homo sapiens
agactgggaaggcttgggatt

SEQ ID NO: 2480269 - DNA, 22 bp, Homo sapiens
agactgtgtgtgccctctgggc

SEQ ID NO: 2480270 - DNA, 17 bp, Homo sapiens
agacttagggcaccagg

SEQ ID NO: 2480271 - DNA, 18 bp, Homo sapiens
agacttctctttgcctca

SEQ ID NO: 2480272 - DNA, 21 bp, Homo sapiens
agacttggttggtagggtggg

SEQ ID NO: 2480273 - DNA, 20 bp, Homo sapiens
agagaaaaagcagaggccaa

SEQ ID NO: 2480274 - DNA, 20 bp, Homo sapiens
agagaaaatgcggttataaa

SEQ ID NO: 2480275 - DNA, 12 bp, Homo sapiens
agagaaaccagc

SEQ ID NO: 2480276 - DNA, 13 bp, Homo sapiens
agagaaaccagct

SEQ ID NO: 2480277 - DNA, 15 bp, Homo sapiens
agagaaaccagcttc

SEQ ID NO: 2480278 - DNA, 21 bp, Homo sapiens
agagaaaccagcttccttcag

SEQ ID NO: 2480279 - DNA, 18 bp, Homo sapiens
agagaacccagcccaccc

SEQ ID NO: 2480280 - DNA, 19 bp, Homo sapiens
agagaagtcacagggcagt

SEQ ID NO: 2480281 - DNA, 23 bp, Homo sapiens
agagaagtcacagggcagtacct

SEQ ID NO: 2480282 - DNA, 12 bp, Homo sapiens
agagaatcaaca

SEQ ID NO: 2480283 - DNA, 15 bp, Homo sapiens
agagaatcaacattt

SEQ ID NO: 2480284 - DNA, 15 bp, Homo sapiens
agagacactggtggg

SEQ ID NO: 2480285 - DNA, 16 bp, Homo sapiens
agagacactggtgggg

SEQ ID NO: 2480286 - DNA, 22 bp, Homo sapiens
agagacatacttgaagggccag

SEQ ID NO: 2480287 - DNA, 15 bp, Homo sapiens
agagacatgcagaga

SEQ ID NO: 2480288 - DNA, 22 bp, Homo sapiens
agagactgaatagatatgaaag

SEQ ID NO: 2480289 - DNA, 15 bp, Homo sapiens
agagagcagtgcttt

SEQ ID NO: 2480290 - DNA, 16 bp, Homo sapiens
agagagcagtgctttt

SEQ ID NO: 2480291 - DNA, 18 bp, Homo sapiens
agagagcccgaggaggtg

SEQ ID NO: 2480292 - DNA, 15 bp, Homo sapiens
agagatcaaagatga

SEQ ID NO: 2480293 - DNA, 21 bp, Homo sapiens
agagatcccaagtagaatctc

SEQ ID NO: 2480294 - DNA, 24 bp, Homo sapiens
agagatgtgtgttgatactgttgc

SEQ ID NO: 2480295 - DNA, 15 bp, Homo sapiens
agagcactgccacca

SEQ ID NO: 2480296 - DNA, 16 bp, Homo sapiens
agagcagcacctcctc

SEQ ID NO: 2480297 - DNA, 21 bp, Homo sapiens
agagcaggactccaggcccaa

SEQ ID NO: 2480298 - DNA, 22 bp, Homo sapiens
agagcaggactccaggcccaag

SEQ ID NO: 2480299 - DNA, 17 bp, Homo sapiens
agagcaggactgatgtc

SEQ ID NO: 2480300 - DNA, 18 bp, Homo sapiens
actaacactcagaagcct

SEQ ID NO: 2480301 - DNA, 19 bp, Homo sapiens
actaacactcagaagcctg

SEQ ID NO: 2480302 - DNA, 17 bp, Homo sapiens
actaacatataatgttg

SEQ ID NO: 2480303 - DNA, 21 bp, Homo sapiens
actaaccaagctgagtttcct

SEQ ID NO: 2480304 - DNA, 22 bp, Homo sapiens
actaaccaagctgagtttccta

SEQ ID NO: 2480305 - DNA, 23 bp, Homo sapiens
actaactatgcatggtgccccag

SEQ ID NO: 2480306 - DNA, 17 bp, Homo sapiens
actaagagaagttgtaa

SEQ ID NO: 2480307 - DNA, 14 bp, Homo sapiens
actaatagaaaagt

SEQ ID NO: 2480308 - DNA, 16 bp, Homo sapiens
actaatagaaaagtat

SEQ ID NO: 2480309 - DNA, 17 bp, Homo sapiens
actaatagaataaaggc

SEQ ID NO: 2480310 - DNA, 20 bp, Homo sapiens
actaatagaataaaggcagt

SEQ ID NO: 2480311 - DNA, 19 bp, Homo sapiens
actaatatatttaaaaata

SEQ ID NO: 2480312 - DNA, 20 bp, Homo sapiens
actaatatatttaaaaataa

SEQ ID NO: 2480313 - DNA, 18 bp, Homo sapiens
actaatgaaaacagaatg

SEQ ID NO: 2480314 - DNA, 13 bp, Homo sapiens
actaatggcatga

SEQ ID NO: 2480315 - DNA, 16 bp, Homo sapiens
actaatggcatgagaa

SEQ ID NO: 2480316 - DNA, 15 bp, Homo sapiens
actaattccacacct

SEQ ID NO: 2480317 - DNA, 19 bp, Homo sapiens
actacaaatcaagtatttg

SEQ ID NO: 2480318 - DNA, 16 bp, Homo sapiens
actacaaccaatggaa

SEQ ID NO: 2480319 - DNA, 13 bp, Homo sapiens
actacacacagta

SEQ ID NO: 2480320 - DNA, 22 bp, Homo sapiens
actacacactgtgtactgcagt

SEQ ID NO: 2480321 - DNA, 18 bp, Homo sapiens
actacagctggggtgcag

SEQ ID NO: 2480322 - DNA, 23 bp, Homo sapiens
actacagctggggtgcagggatg

SEQ ID NO: 2480323 - DNA, 17 bp, Homo sapiens
actacagcttcagtgat

SEQ ID NO: 2480324 - DNA, 17 bp, Homo sapiens
actacaggcgtgagcca

SEQ ID NO: 2480325 - DNA, 13 bp, Homo sapiens
actacattcattt

SEQ ID NO: 2480326 - DNA, 19 bp, Homo sapiens
actacccaggttaagaaaa

SEQ ID NO: 2480327 - DNA, 18 bp, Homo sapiens
actaccgaatgtgtcttt

SEQ ID NO: 2480328 - DNA, 22 bp, Homo sapiens
actacctgtaatgacaggcctg

SEQ ID NO: 2480329 - DNA, 21 bp, Homo sapiens
actagacaagccagaacttga

SEQ ID NO: 2480330 - DNA, 20 bp, Homo sapiens
actagacaccaaagttctaa

SEQ ID NO: 2480331 - DNA, 14 bp, Homo sapiens
actagaggtgagaa

SEQ ID NO: 2480332 - DNA, 21 bp, Homo sapiens
actagaggtgagaaatttaaa

SEQ ID NO: 2480333 - DNA, 18 bp, Homo sapiens
actagatggacctgcctg

SEQ ID NO: 2480334 - DNA, 16 bp, Homo sapiens
actagatgtagtattt

SEQ ID NO: 2480335 - DNA, 16 bp, Homo sapiens
actagccaaacctcac

SEQ ID NO: 2480336 - DNA, 19 bp, Homo sapiens
actagccaaacctcaccaa

SEQ ID NO: 2480337 - DNA, 22 bp, Homo sapiens
actaggagctttgactcaggag

SEQ ID NO: 2480338 - DNA, 20 bp, Homo sapiens
actaggcccccacttgcctc

SEQ ID NO: 2480339 - DNA, 19 bp, Homo sapiens
actagggagccatttgaga

SEQ ID NO: 2480340 - DNA, 18 bp, Homo sapiens
actagggatccctcatct

SEQ ID NO: 2480341 - DNA, 19 bp, Homo sapiens
actagggatccctcatctg

SEQ ID NO: 2480342 - DNA, 19 bp, Homo sapiens
actataagaactttgagct

SEQ ID NO: 2480343 - DNA, 20 bp, Homo sapiens
actataagcaagaaggcaaa

SEQ ID NO: 2480344 - DNA, 13 bp, Homo sapiens
actatatgtatgg

SEQ ID NO: 2480345 - DNA, 22 bp, Homo sapiens
actatatttgggcctgctccag

SEQ ID NO: 2480346 - DNA, 20 bp, Homo sapiens
actatgcatggtgccccagg

SEQ ID NO: 2480347 - DNA, 14 bp, Homo sapiens
actattgttacatt

SEQ ID NO: 2480348 - DNA, 16 bp, Homo sapiens
actcaaatgagtaaca

SEQ ID NO: 2480349 - DNA, 17 bp, Homo sapiens
actcaaatggggccaga

SEQ ID NO: 2480350 - DNA, 23 bp, Homo sapiens
actcaagaagtgaagaatgcaca

SEQ ID NO: 2480351 - DNA, 18 bp, Homo sapiens
actcaaggcggtgcttga

SEQ ID NO: 2480352 - DNA, 22 bp, Homo sapiens
actcacacaggcatttcctggg

SEQ ID NO: 2480353 - DNA, 21 bp, Homo sapiens
actcacacctgaactgaacac

SEQ ID NO: 2480354 - DNA, 20 bp, Homo sapiens
actcactaattcattaatct

SEQ ID NO: 2480355 - DNA, 21 bp, Homo sapiens
actcactaggcccccacttgc

SEQ ID NO: 2480356 - DNA, 19 bp, Homo sapiens
actcactccttttaaagaa

SEQ ID NO: 2480357 - DNA, 13 bp, Homo sapiens
actcagaaattca

SEQ ID NO: 2480358 - DNA, 12 bp, Homo sapiens
actcagacctga

SEQ ID NO: 2480359 - DNA, 11 bp, Homo sapiens
actcagatcca

SEQ ID NO: 2480360 - DNA, 17 bp, Homo sapiens
actcagatccagggaca

SEQ ID NO: 2480361 - DNA, 17 bp, Homo sapiens
actcagcacttggccct

SEQ ID NO: 2480362 - DNA, 18 bp, Homo sapiens
actcagccaccctgagtt

SEQ ID NO: 2480363 - DNA, 11 bp, Homo sapiens
actcagccttc

SEQ ID NO: 2480364 - DNA, 15 bp, Homo sapiens
actcaggtggcccta

SEQ ID NO: 2480365 - DNA, 19 bp, Homo sapiens
actcatataattatatgtt

SEQ ID NO: 2480366 - DNA, 16 bp, Homo sapiens
actcattcattagtca

SEQ ID NO: 2480367 - DNA, 14 bp, Homo sapiens
actccaactcttcc

SEQ ID NO: 2480368 - DNA, 13 bp, Homo sapiens
actccacactgca

SEQ ID NO: 2480369 - DNA, 21 bp, Homo sapiens
actccacactgcacaataact

SEQ ID NO: 2480370 - DNA, 13 bp, Homo sapiens
actccaggcccaa

SEQ ID NO: 2480371 - DNA, 19 bp, Homo sapiens
actccatctggtagaaggg

SEQ ID NO: 2480372 - DNA, 15 bp, Homo sapiens
actccccaaccccca

SEQ ID NO: 2480373 - DNA, 16 bp, Homo sapiens
actccccaacccccaa

SEQ ID NO: 2480374 - DNA, 17 bp, Homo sapiens
actccccgaagtctttt

SEQ ID NO: 2480375 - DNA, 15 bp, Homo sapiens
actccctcacaagtg

SEQ ID NO: 2480376 - DNA, 22 bp, Homo sapiens
actccgagaggtgggccagtct

SEQ ID NO: 2480377 - DNA, 17 bp, Homo sapiens
actccgttggccactcc

SEQ ID NO: 2480378 - DNA, 20 bp, Homo sapiens
actcctagttctagaaaaac

SEQ ID NO: 2480379 - DNA, 19 bp, Homo sapiens
actcctcattgtaaacaaa

SEQ ID NO: 2480380 - DNA, 13 bp, Homo sapiens
actcctcccaggg

SEQ ID NO: 2480381 - DNA, 16 bp, Homo sapiens
actcctcctttttcca

SEQ ID NO: 2480382 - DNA, 14 bp, Homo sapiens
actcctgaaaaaaa

SEQ ID NO: 2480383 - DNA, 16 bp, Homo sapiens
actcctgaaaaaaaac

SEQ ID NO: 2480384 - DNA, 17 bp, Homo sapiens
actcctgacctcaggca

SEQ ID NO: 2480385 - DNA, 15 bp, Homo sapiens
actcctgtgggagcc

SEQ ID NO: 2480386 - DNA, 17 bp, Homo sapiens
actcctgtgggagcctc

SEQ ID NO: 2480387 - DNA, 20 bp, Homo sapiens
actccttcaacaattctaaa

SEQ ID NO: 2480388 - DNA, 22 bp, Homo sapiens
actccttcaacaattctaaaat

SEQ ID NO: 2480389 - DNA, 14 bp, Homo sapiens
actccttttaaaga

SEQ ID NO: 2480390 - DNA, 23 bp, Homo sapiens
actccttttaaagaaaaaaattg

SEQ ID NO: 2480391 - DNA, 23 bp, Homo sapiens
actcgctagcagtggcaggcaga

SEQ ID NO: 2480392 - DNA, 14 bp, Homo sapiens
actcggtttctcca

SEQ ID NO: 2480393 - DNA, 14 bp, Homo sapiens
actcgttttttaca

SEQ ID NO: 2480394 - DNA, 21 bp, Homo sapiens
actctaaaattataaatgaca

SEQ ID NO: 2480395 - DNA, 13 bp, Homo sapiens
actctaaagcaaa

SEQ ID NO: 2480396 - DNA, 14 bp, Homo sapiens
actctaaagcaaat

SEQ ID NO: 2480397 - DNA, 19 bp, Homo sapiens
acttgtcaggagtgtgtgt

SEQ ID NO: 2480398 - DNA, 21 bp, Homo sapiens
acttgtcaggagtgtgtgtga

SEQ ID NO: 2480399 - DNA, 24 bp, Homo sapiens
acttgtcattgttatataatcatt

SEQ ID NO: 2480400 - DNA, 17 bp, Homo sapiens
acttgtcctagcacaga

SEQ ID NO: 2480401 - DNA, 20 bp, Homo sapiens
acttgtccttagcctggacc

SEQ ID NO: 2480402 - DNA, 16 bp, Homo sapiens
actttaacataagcta

SEQ ID NO: 2480403 - DNA, 18 bp, Homo sapiens
actttaacataagctatt

SEQ ID NO: 2480404 - DNA, 18 bp, Homo sapiens
acatcaacccgagtcatt

SEQ ID NO: 2480405 - DNA, 14 bp, Homo sapiens
acatcaatctttaa

SEQ ID NO: 2480406 - DNA, 16 bp, Homo sapiens
acatcaggtttttccc

SEQ ID NO: 2480407 - DNA, 15 bp, Homo sapiens
acatcattactataa

SEQ ID NO: 2480408 - DNA, 15 bp, Homo sapiens
acatcattcttgaga

SEQ ID NO: 2480409 - DNA, 12 bp, Homo sapiens
acatcatttctt

SEQ ID NO: 2480410 - DNA, 13 bp, Homo sapiens
acatcatttcttt

SEQ ID NO: 2480411 - DNA, 15 bp, Homo sapiens
acatccaaagcagac

SEQ ID NO: 2480412 - DNA, 19 bp, Homo sapiens
acatccaaagcagacagct

SEQ ID NO: 2480413 - DNA, 15 bp, Homo sapiens
acatcggaaaaataa

SEQ ID NO: 2480414 - DNA, 16 bp, Homo sapiens
acatctaacctcatct

SEQ ID NO: 2480415 - DNA, 18 bp, Homo sapiens
acatctattttggattgt

SEQ ID NO: 2480416 - DNA, 19 bp, Homo sapiens
acatctattttggattgta

SEQ ID NO: 2480417 - DNA, 22 bp, Homo sapiens
acatctcaacaggcctcagggc

SEQ ID NO: 2480418 - DNA, 19 bp, Homo sapiens
acatctgtaaatctacaca

SEQ ID NO: 2480419 - DNA, 17 bp, Homo sapiens
acatctttgaaattatg

SEQ ID NO: 2480420 - DNA, 19 bp, Homo sapiens
acatgaacttagattttac

SEQ ID NO: 2480421 - DNA, 13 bp, Homo sapiens
acatgaagaagct

SEQ ID NO: 2480422 - DNA, 13 bp, Homo sapiens
acatgaaggtaaa

SEQ ID NO: 2480423 - DNA, 15 bp, Homo sapiens
acatgaattttagct

SEQ ID NO: 2480424 - DNA, 18 bp, Homo sapiens
acatgaattttagctttt

SEQ ID NO: 2480425 - DNA, 15 bp, Homo sapiens
acatgagaacaaaca

SEQ ID NO: 2480426 - DNA, 20 bp, Homo sapiens
acatgaggactctattcttt

SEQ ID NO: 2480427 - DNA, 16 bp, Homo sapiens
acatgatttccttgaa

SEQ ID NO: 2480428 - DNA, 23 bp, Homo sapiens
acatgatttccttgaatgtggct

SEQ ID NO: 2480429 - DNA, 18 bp, Homo sapiens
acatgccatttgtactga

SEQ ID NO: 2480430 - DNA, 17 bp, Homo sapiens
acatgcggtagccagca

SEQ ID NO: 2480431 - DNA, 22 bp, Homo sapiens
acatgcggtagccagcacacag

SEQ ID NO: 2480432 - DNA, 17 bp, Homo sapiens
acatgctaagagaagta

SEQ ID NO: 2480433 - DNA, 24 bp, Homo sapiens
acatgctaagagaagtagaaatca

SEQ ID NO: 2480434 - DNA, 19 bp, Homo sapiens
acatgcttagcagtcccct

SEQ ID NO: 2480435 - DNA, 15 bp, Homo sapiens
acatggaggttctaa

SEQ ID NO: 2480436 - DNA, 13 bp, Homo sapiens
acatggcacagag

SEQ ID NO: 2480437 - DNA, 16 bp, Homo sapiens
acatggtgctgggaga

SEQ ID NO: 2480438 - DNA, 18 bp, Homo sapiens
acatggtgggtccatggg

SEQ ID NO: 2480439 - DNA, 19 bp, Homo sapiens
acatgtattgcacattgta

SEQ ID NO: 2480440 - DNA, 16 bp, Homo sapiens
acatgtgacatttata

SEQ ID NO: 2480441 - DNA, 21 bp, Homo sapiens
acatgtgacatttatatattg

SEQ ID NO: 2480442 - DNA, 18 bp, Homo sapiens
acatgtgctgccctacag

SEQ ID NO: 2480443 - DNA, 16 bp, Homo sapiens
acatgtggggccaggt

SEQ ID NO: 2480444 - DNA, 14 bp, Homo sapiens
acatgttatttgta

SEQ ID NO: 2480445 - DNA, 20 bp, Homo sapiens
acatgttgggaaacttggct

SEQ ID NO: 2480446 - DNA, 21 bp, Homo sapiens
acatgtttccagcattcccag

SEQ ID NO: 2480447 - DNA, 22 bp, Homo sapiens
acatgtttccagcattcccagg

SEQ ID NO: 2480448 - DNA, 11 bp, Homo sapiens
acatgtttcct

SEQ ID NO: 2480449 - DNA, 22 bp, Homo sapiens
acattaaagaagggttgagctg

SEQ ID NO: 2480450 - DNA, 21 bp, Homo sapiens
acattagaagacaattgacaa

SEQ ID NO: 2480451 - DNA, 19 bp, Homo sapiens
acattaggaaaagttgcta

SEQ ID NO: 2480452 - DNA, 14 bp, Homo sapiens
acattcacctgccc

SEQ ID NO: 2480453 - DNA, 19 bp, Homo sapiens
acattcaggaattcttgga

SEQ ID NO: 2480454 - DNA, 22 bp, Homo sapiens
acattcatagtctttggagaaa

SEQ ID NO: 2480455 - DNA, 15 bp, Homo sapiens
acattccaactcgta

SEQ ID NO: 2480456 - DNA, 16 bp, Homo sapiens
acattccaagactcta

SEQ ID NO: 2480457 - DNA, 21 bp, Homo sapiens
acattcctcatgaatgtaaat

SEQ ID NO: 2480458 - DNA, 15 bp, Homo sapiens
acattctgaatgctt

SEQ ID NO: 2480459 - DNA, 21 bp, Homo sapiens
acattctgaatgcttctaagt

SEQ ID NO: 2480460 - DNA, 17 bp, Homo sapiens
acattgcatcaaagcat

SEQ ID NO: 2480461 - DNA, 21 bp, Homo sapiens
acattggcacctaatccaggc

SEQ ID NO: 2480462 - DNA, 22 bp, Homo sapiens
acattggttctttcatttgctt

SEQ ID NO: 2480463 - DNA, 14 bp, Homo sapiens
acattgttgagcta

SEQ ID NO: 2480464 - DNA, 18 bp, Homo sapiens
acatttaaaacattaaaa

SEQ ID NO: 2480465 - DNA, 17 bp, Homo sapiens
acatttacaaactgaag

SEQ ID NO: 2480466 - DNA, 15 bp, Homo sapiens
acatttatttcctcc

SEQ ID NO: 2480467 - DNA, 16 bp, Homo sapiens
acatttattttgacat

SEQ ID NO: 2480468 - DNA, 13 bp, Homo sapiens
acatttctcaggc

SEQ ID NO: 2480469 - DNA, 15 bp, Homo sapiens
acatttggaatactt

SEQ ID NO: 2480470 - DNA, 16 bp, Homo sapiens
acatttggaatacttt

SEQ ID NO: 2480471 - DNA, 17 bp, Homo sapiens
acatttgggagacatgt

SEQ ID NO: 2480472 - DNA, 20 bp, Homo sapiens
acatttgggagacatgtgac

SEQ ID NO: 2480473 - DNA, 16 bp, Homo sapiens
acattttaaacacatt

SEQ ID NO: 2480474 - DNA, 21 bp, Homo sapiens
acattttgaaagtctgtcctt

SEQ ID NO: 2480475 - DNA, 16 bp, Homo sapiens
acattttttaggaaat

SEQ ID NO: 2480476 - DNA, 14 bp, Homo sapiens
accaaaagaagtaa

SEQ ID NO: 2480477 - DNA, 17 bp, Homo sapiens
accaaagggagtctgcc

SEQ ID NO: 2480478 - DNA, 19 bp, Homo sapiens
accaaagggagtctgccag

SEQ ID NO: 2480479 - DNA, 20 bp, Homo sapiens
accaaagggagtctgccagg

SEQ ID NO: 2480480 - DNA, 12 bp, Homo sapiens
accaaagttcta

SEQ ID NO: 2480481 - DNA, 15 bp, Homo sapiens
accaaagttctaata

SEQ ID NO: 2480482 - DNA, 23 bp, Homo sapiens
accaaagttctaataatttctaa

SEQ ID NO: 2480483 - DNA, 20 bp, Homo sapiens
accaaatcaaaatctctcca

SEQ ID NO: 2480484 - DNA, 20 bp, Homo sapiens
accaacaatcttcctgttta

SEQ ID NO: 2480485 - DNA, 15 bp, Homo sapiens
accaaccctcagggc

SEQ ID NO: 2480486 - DNA, 16 bp, Homo sapiens
accaaccctcagggca

SEQ ID NO: 2480487 - DNA, 17 bp, Homo sapiens
accaactcctagttcta

SEQ ID NO: 2480488 - DNA, 23 bp, Homo sapiens
accaactcctagttctagaaaaa

SEQ ID NO: 2480489 - DNA, 22 bp, Homo sapiens
accaacttttctattaaaagtg

SEQ ID NO: 2480490 - DNA, 15 bp, Homo sapiens
accaagatacttaag

SEQ ID NO: 2480491 - DNA, 14 bp, Homo sapiens
accaagcacagcag

SEQ ID NO: 2480492 - DNA, 14 bp, Homo sapiens
accaagctgagttt

SEQ ID NO: 2480493 - DNA, 13 bp, Homo sapiens
accaatcatttta

SEQ ID NO: 2480494 - DNA, 17 bp, Homo sapiens
accaatcctatgcatgg

SEQ ID NO: 2480495 - DNA, 13 bp, Homo sapiens
accaatgtcttga

SEQ ID NO: 2480496 - DNA, 22 bp, Homo sapiens
accaattgctgctacttatata

SEQ ID NO: 2480497 - DNA, 20 bp, Homo sapiens
accacaactattttcagatg

SEQ ID NO: 2480498 - DNA, 20 bp, Homo sapiens
accacagccagcacctggca

SEQ ID NO: 2480499 - DNA, 15 bp, Homo sapiens
accacaggctcaggc

SEQ ID NO: 2480500 - DNA, 16 bp, Homo sapiens
accacaggctcaggca

SEQ ID NO: 2480501 - DNA, 22 bp, Homo sapiens
accacaggttcatgccaccatg

SEQ ID NO: 2480502 - DNA, 22 bp, Homo sapiens
accacatgccccatcccatgct

SEQ ID NO: 2480503 - DNA, 16 bp, Homo sapiens
accaccaagccaaggg

SEQ ID NO: 2480504 - DNA, 13 bp, Homo sapiens
acatatggaattt

SEQ ID NO: 2480505 - DNA, 21 bp, Homo sapiens
acatatgtgctggaattctaa

SEQ ID NO: 2480506 - DNA, 12 bp, Homo sapiens
acatcaaagagg

SEQ ID NO: 2480507 - DNA, 20 bp, Homo sapiens
aatttagacttggattcttt

SEQ ID NO: 2480508 - DNA, 16 bp, Homo sapiens
aatttagtgtatccat

SEQ ID NO: 2480509 - DNA, 23 bp, Homo sapiens
aatttatttgaatgatttttctt

SEQ ID NO: 2480510 - DNA, 13 bp, Homo sapiens
aatttattttctt

SEQ ID NO: 2480511 - DNA, 13 bp, Homo sapiens
aggggctccctcc

SEQ ID NO: 2480512 - DNA, 14 bp, Homo sapiens
aggggctccctccg

SEQ ID NO: 2480513 - DNA, 21 bp, Homo sapiens
aggggctgcccgagtctgttt

SEQ ID NO: 2480514 - DNA, 14 bp, Homo sapiens
aggggctgggaaca

SEQ ID NO: 2480515 - DNA, 12 bp, Homo sapiens
aggggcttcagg

SEQ ID NO: 2480516 - DNA, 20 bp, Homo sapiens
agggggatccgactgctttg

SEQ ID NO: 2480517 - DNA, 12 bp, Homo sapiens
agggggcggcct

SEQ ID NO: 2480518 - DNA, 20 bp, Homo sapiens
agggggctgctgctgggctc

SEQ ID NO: 2480519 - DNA, 13 bp, Homo sapiens
aggggggagggaa

SEQ ID NO: 2480520 - DNA, 16 bp, Homo sapiens
agggggggctccctgg

SEQ ID NO: 2480521 - DNA, 15 bp, Homo sapiens
agggggtctggctgg

SEQ ID NO: 2480522 - DNA, 15 bp, Homo sapiens
aggggtaggggctgg

SEQ ID NO: 2480523 - DNA, 19 bp, Homo sapiens
aggggtaggggctgggaac

SEQ ID NO: 2480524 - DNA, 21 bp, Homo sapiens
aggggtcaagttattaatttc

SEQ ID NO: 2480525 - DNA, 22 bp, Homo sapiens
aggggtgtcttgggcagagctg

SEQ ID NO: 2480526 - DNA, 24 bp, Homo sapiens
aggggtgtcttgggcagagctggc

SEQ ID NO: 2480527 - DNA, 15 bp, Homo sapiens
aggggttagagcagg

SEQ ID NO: 2480528 - DNA, 13 bp, Homo sapiens
agggtaaacaata

SEQ ID NO: 2480529 - DNA, 11 bp, Homo sapiens
agggtaaatca

SEQ ID NO: 2480530 - DNA, 12 bp, Homo sapiens
agggtaagtatt

SEQ ID NO: 2480531 - DNA, 14 bp, Homo sapiens
agggtacatggtgc

SEQ ID NO: 2480532 - DNA, 23 bp, Homo sapiens
agggtagaattctggctggtaga

SEQ ID NO: 2480533 - DNA, 13 bp, Homo sapiens
agggtaggcagga

SEQ ID NO: 2480534 - DNA, 22 bp, Homo sapiens
agggtcaggcctttgagctcag

SEQ ID NO: 2480535 - DNA, 14 bp, Homo sapiens
agggtccctctgtg

SEQ ID NO: 2480536 - DNA, 22 bp, Homo sapiens
agggtccttttgacactgctct

SEQ ID NO: 2480537 - DNA, 15 bp, Homo sapiens
agggtcgaaagctct

SEQ ID NO: 2480538 - DNA, 16 bp, Homo sapiens
agggtcgaaagctcta

SEQ ID NO: 2480539 - DNA, 22 bp, Homo sapiens
agggtcgaaagctctagaatct

SEQ ID NO: 2480540 - DNA, 19 bp, Homo sapiens
caaactagggccaagccca

SEQ ID NO: 2480541 - DNA, 14 bp, Homo sapiens
caaactctttggtc

SEQ ID NO: 2480542 - DNA, 22 bp, Homo sapiens
caaactgggaacccctttccca

SEQ ID NO: 2480543 - DNA, 12 bp, Homo sapiens
caaactgtaaat

SEQ ID NO: 2480544 - DNA, 14 bp, Homo sapiens
caaactgtaaataa

SEQ ID NO: 2480545 - DNA, 18 bp, Homo sapiens
caaactgtgtaactgccc

SEQ ID NO: 2480546 - DNA, 20 bp, Homo sapiens
caaactgtgtaactgcccaa

SEQ ID NO: 2480547 - DNA, 12 bp, Homo sapiens
caaactttgcat

SEQ ID NO: 2480548 - DNA, 16 bp, Homo sapiens
caaagaaacaaagatg

SEQ ID NO: 2480549 - DNA, 13 bp, Homo sapiens
caaagaggctgcc

SEQ ID NO: 2480550 - DNA, 20 bp, Homo sapiens
caaagatctgtcctcagcct

SEQ ID NO: 2480551 - DNA, 21 bp, Homo sapiens
caaagatctgtcctcagcctt

SEQ ID NO: 2480552 - DNA, 12 bp, Homo sapiens
caaagatgaaaa

SEQ ID NO: 2480553 - DNA, 16 bp, Homo sapiens
caaagatgctgtgagt

SEQ ID NO: 2480554 - DNA, 13 bp, Homo sapiens
caaagatttaatc

SEQ ID NO: 2480555 - DNA, 14 bp, Homo sapiens
caaagcaagaccct

SEQ ID NO: 2480556 - DNA, 13 bp, Homo sapiens
caaagcagacagc

SEQ ID NO: 2480557 - DNA, 16 bp, Homo sapiens
caaagcagacagctcc

SEQ ID NO: 2480558 - DNA, 19 bp, Homo sapiens
caaagcagacagctccacc

SEQ ID NO: 2480559 - DNA, 21 bp, Homo sapiens
caaagccagcgtcctcctctg

SEQ ID NO: 2480560 - DNA, 22 bp, Homo sapiens
caaagccagcgtcctcctctgt

SEQ ID NO: 2480561 - DNA, 17 bp, Homo sapiens
caaagccaggtccctct

SEQ ID NO: 2480562 - DNA, 19 bp, Homo sapiens
caaagcccccagagcccag

SEQ ID NO: 2480563 - DNA, 22 bp, Homo sapiens
caaagcccccagagcccaggct

SEQ ID NO: 2480564 - DNA, 22 bp, Homo sapiens
caaagcctgttcatggcagatg

SEQ ID NO: 2480565 - DNA, 21 bp, Homo sapiens
caaagctgcctgtccctaccc

SEQ ID NO: 2480566 - DNA, 13 bp, Homo sapiens
caaagctttcctg

SEQ ID NO: 2480567 - DNA, 23 bp, Homo sapiens
caaagctttcctgccccaggcct

SEQ ID NO: 2480568 - DNA, 15 bp, Homo sapiens
caaaggcaagcactt

SEQ ID NO: 2480569 - DNA, 17 bp, Homo sapiens
caaagggagtctgccag

SEQ ID NO: 2480570 - DNA, 17 bp, Homo sapiens
caaaggggacctggaag

SEQ ID NO: 2480571 - DNA, 19 bp, Homo sapiens
caaaggttctaggtttcaa

SEQ ID NO: 2480572 - DNA, 13 bp, Homo sapiens
caaaggtttaaat

SEQ ID NO: 2480573 - DNA, 17 bp, Homo sapiens
caaaggtttggaaggag

SEQ ID NO: 2480574 - DNA, 14 bp, Homo sapiens
caaagtcctttttt

SEQ ID NO: 2480575 - DNA, 19 bp, Homo sapiens
caaagtcctttttttccat

SEQ ID NO: 2480576 - DNA, 12 bp, Homo sapiens
caaagtctctaa

SEQ ID NO: 2480577 - DNA, 15 bp, Homo sapiens
caaagtctctaattc

SEQ ID NO: 2480578 - DNA, 16 bp, Homo sapiens
caaagtgctgagatta

SEQ ID NO: 2480579 - DNA, 19 bp, Homo sapiens
caaagtgctgggattacag

SEQ ID NO: 2480580 - DNA, 11 bp, Homo sapiens
caaagtggaac

SEQ ID NO: 2480581 - DNA, 13 bp, Homo sapiens
caaagtttaataa

SEQ ID NO: 2480582 - DNA, 19 bp, Homo sapiens
caaagtttaccagaaagca

SEQ ID NO: 2480583 - DNA, 12 bp, Homo sapiens
caaataagactt

SEQ ID NO: 2480584 - DNA, 13 bp, Homo sapiens
caaataagacttc

SEQ ID NO: 2480585 - DNA, 16 bp, Homo sapiens
caaatagaaaatggtc

SEQ ID NO: 2480586 - DNA, 15 bp, Homo sapiens
caaatatgtcctggg

SEQ ID NO: 2480587 - DNA, 18 bp, Homo sapiens
caaatcaaaatctctcca

SEQ ID NO: 2480588 - DNA, 19 bp, Homo sapiens
caaatcaccacaaactgta

SEQ ID NO: 2480589 - DNA, 14 bp, Homo sapiens
caaatcagaagtca

SEQ ID NO: 2480590 - DNA, 22 bp, Homo sapiens
caaatcagaagtcatcttgcta

SEQ ID NO: 2480591 - DNA, 13 bp, Homo sapiens
caaatcaggcttt

SEQ ID NO: 2480592 - DNA, 13 bp, Homo sapiens
caaatcatttgtt

SEQ ID NO: 2480593 - DNA, 18 bp, Homo sapiens
caaatctaccactgtatg

SEQ ID NO: 2480594 - DNA, 12 bp, Homo sapiens
caaatcttgaaa

SEQ ID NO: 2480595 - DNA, 19 bp, Homo sapiens
caaatgcaaaaactctttg

SEQ ID NO: 2480596 - DNA, 17 bp, Homo sapiens
caagcacatctgcattt

SEQ ID NO: 2480597 - DNA, 19 bp, Homo sapiens
caagcacctccaaccaaat

SEQ ID NO: 2480598 - DNA, 21 bp, Homo sapiens
caagcagcctgagcaactctt

SEQ ID NO: 2480599 - DNA, 20 bp, Homo sapiens
caagcagcttagagttggcc

SEQ ID NO: 2480600 - DNA, 16 bp, Homo sapiens
caagcagtcgtgcctg

SEQ ID NO: 2480601 - DNA, 19 bp, Homo sapiens
caagcagtcgtgcctgtgt

SEQ ID NO: 2480602 - DNA, 21 bp, Homo sapiens
caagcatggctattttatatt

SEQ ID NO: 2480603 - DNA, 23 bp, Homo sapiens
caagcatggtcccacatccctgg

SEQ ID NO: 2480604 - DNA, 18 bp, Homo sapiens
caagccaagggaacctgt

SEQ ID NO: 2480605 - DNA, 13 bp, Homo sapiens
caagcctgaggga

SEQ ID NO: 2480606 - DNA, 22 bp, Homo sapiens
caagcctgagggaaaggccagc

SEQ ID NO: 2480607 - DNA, 21 bp, Homo sapiens
caagcgattctcttgcctcaa

SEQ ID NO: 2480608 - DNA, 22 bp, Homo sapiens
caagctaagcactgccactggg

SEQ ID NO: 2480609 - DNA, 19 bp, Homo sapiens
caagctccaagccccatct

SEQ ID NO: 2480610 - DNA, 23 bp, Homo sapiens
caagctgagtttcctatgggaac

SEQ ID NO: 2480611 - DNA, 15 bp, Homo sapiens
caagctgattaaatg

SEQ ID NO: 2480612 - DNA, 21 bp, Homo sapiens
caagcttctgtcctgccccca

SEQ ID NO: 2480613 - DNA, 13 bp, Homo sapiens
caaggaaaggcac

SEQ ID NO: 2480614 - DNA, 21 bp, Homo sapiens
caaggaatttcttaacttctt

SEQ ID NO: 2480615 - DNA, 19 bp, Homo sapiens
caaggacttcctgtccagc

SEQ ID NO: 2480616 - DNA, 21 bp, Homo sapiens
caaggacttcctgtccagctc

SEQ ID NO: 2480617 - DNA, 16 bp, Homo sapiens
caaggactttgcagcc

SEQ ID NO: 2480618 - DNA, 16 bp, Homo sapiens
caaggagtcagacatt

SEQ ID NO: 2480619 - DNA, 20 bp, Homo sapiens
caaggatagatgctggccca

SEQ ID NO: 2480620 - DNA, 22 bp, Homo sapiens
caaggatagatgctggcccagg

SEQ ID NO: 2480621 - DNA, 14 bp, Homo sapiens
caaggcactctaga

SEQ ID NO: 2480622 - DNA, 18 bp, Homo sapiens
caaggcacttgaggggga

SEQ ID NO: 2480623 - DNA, 20 bp, Homo sapiens
caaggcacttgagggggaag

SEQ ID NO: 2480624 - DNA, 19 bp, Homo sapiens
caaggcagaggcctgggct

SEQ ID NO: 2480625 - DNA, 16 bp, Homo sapiens
caaggcagcaaggccc

SEQ ID NO: 2480626 - DNA, 17 bp, Homo sapiens
caaggcagcaaggcccg

SEQ ID NO: 2480627 - DNA, 13 bp, Homo sapiens
caaggcagccgtg

SEQ ID NO: 2480628 - DNA, 17 bp, Homo sapiens
caaggccatctgggctc

SEQ ID NO: 2480629 - DNA, 13 bp, Homo sapiens
caaggcggtgctt

SEQ ID NO: 2480630 - DNA, 16 bp, Homo sapiens
caaggcggtgcttgat

SEQ ID NO: 2480631 - DNA, 20 bp, Homo sapiens
caaggctgtggaccatggag

SEQ ID NO: 2480632 - DNA, 16 bp, Homo sapiens
caagggaggctgctgc

SEQ ID NO: 2480633 - DNA, 18 bp, Homo sapiens
caaggggaatcagaactc

SEQ ID NO: 2480634 - DNA, 21 bp, Homo sapiens
caaggggatttttatgtctgg

SEQ ID NO: 2480635 - DNA, 16 bp, Homo sapiens
caaggggcctgagcag

SEQ ID NO: 2480636 - DNA, 21 bp, Homo sapiens
caaggggcctgagcagtcctt

SEQ ID NO: 2480637 - DNA, 20 bp, Homo sapiens
caaggtgtcctacagaaaaa

SEQ ID NO: 2480638 - DNA, 13 bp, Homo sapiens
caaggttctaacc

SEQ ID NO: 2480639 - DNA, 20 bp, Homo sapiens
caaggtttaaagagtctaga

SEQ ID NO: 2480640 - DNA, 22 bp, Homo sapiens
caaggtttaaagagtctagatt

SEQ ID NO: 2480641 - DNA, 19 bp, Homo sapiens
caagtacaaccacacccac

SEQ ID NO: 2480642 - DNA, 23 bp, Homo sapiens
caaccgtggcccttcctggacag

SEQ ID NO: 2480643 - DNA, 24 bp, Homo sapiens
caacctgaatacccttttctgacc

SEQ ID NO: 2480644 - DNA, 18 bp, Homo sapiens
caacctgtagagtggcca

SEQ ID NO: 2480645 - DNA, 18 bp, Homo sapiens
caaccttagatgttctaa

SEQ ID NO: 2480646 - DNA, 18 bp, Homo sapiens
caacgtgctctttgtttt

SEQ ID NO: 2480647 - DNA, 23 bp, Homo sapiens
caacgtggctttttttttttccc

SEQ ID NO: 2480648 - DNA, 15 bp, Homo sapiens
caactacagtctaaa

SEQ ID NO: 2480649 - DNA, 19 bp, Homo sapiens
caactacagtctaaagctg

SEQ ID NO: 2480650 - DNA, 19 bp, Homo sapiens
caactacccccagctgtgc

SEQ ID NO: 2480651 - DNA, 22 bp, Homo sapiens
caactcactccttttaaagaaa

SEQ ID NO: 2480652 - DNA, 17 bp, Homo sapiens
caactccttccagctag

SEQ ID NO: 2480653 - DNA, 19 bp, Homo sapiens
caactcgtatagcatgcat

SEQ ID NO: 2480654 - DNA, 22 bp, Homo sapiens
caactctcttattgcctcactt

SEQ ID NO: 2480655 - DNA, 16 bp, Homo sapiens
caactcttgattatcc

SEQ ID NO: 2480656 - DNA, 18 bp, Homo sapiens
caactctttgttatttga

SEQ ID NO: 2480657 - DNA, 21 bp, Homo sapiens
caactgcctcgaaacacagaa

SEQ ID NO: 2480658 - DNA, 11 bp, Homo sapiens
caactgctccc

SEQ ID NO: 2480659 - DNA, 14 bp, Homo sapiens
caactgctcccacc

SEQ ID NO: 2480660 - DNA, 17 bp, Homo sapiens
caactgctcccacctcc

SEQ ID NO: 2480661 - DNA, 18 bp, Homo sapiens
caactgctcccacctcct

SEQ ID NO: 2480662 - DNA, 21 bp, Homo sapiens
caactgtctcctacctctgct

SEQ ID NO: 2480663 - DNA, 20 bp, Homo sapiens
caacttgagcatgttactga

SEQ ID NO: 2480664 - DNA, 14 bp, Homo sapiens
caacttgcttatca

SEQ ID NO: 2480665 - DNA, 13 bp, Homo sapiens
caacttgtcctag

SEQ ID NO: 2480666 - DNA, 12 bp, Homo sapiens
caactttactgt

SEQ ID NO: 2480667 - DNA, 23 bp, Homo sapiens
caagaaaaataaagaaaagatgc

SEQ ID NO: 2480668 - DNA, 15 bp, Homo sapiens
caagaaaacaggcac

SEQ ID NO: 2480669 - DNA, 20 bp, Homo sapiens
caagaaaacaggcactgccc

SEQ ID NO: 2480670 - DNA, 21 bp, Homo sapiens
caagaaaacaggcactgccct

SEQ ID NO: 2480671 - DNA, 23 bp, Homo sapiens
caagaaaacaggcactgccctgg

SEQ ID NO: 2480672 - DNA, 19 bp, Homo sapiens
caagaaataaaaggaagcc

SEQ ID NO: 2480673 - DNA, 19 bp, Homo sapiens
caagaagaagggcacccta

SEQ ID NO: 2480674 - DNA, 14 bp, Homo sapiens
caagaagtgaagaa

SEQ ID NO: 2480675 - DNA, 21 bp, Homo sapiens
caagaatggatcacaagatgg

SEQ ID NO: 2480676 - DNA, 16 bp, Homo sapiens
caagacccccagcact

SEQ ID NO: 2480677 - DNA, 17 bp, Homo sapiens
caagactctagagtcca

SEQ ID NO: 2480678 - DNA, 12 bp, Homo sapiens
caagactgctgt

SEQ ID NO: 2480679 - DNA, 19 bp, Homo sapiens
caagactgctgtggccagg

SEQ ID NO: 2480680 - DNA, 22 bp, Homo sapiens
caagactgctgtggccaggagg

SEQ ID NO: 2480681 - DNA, 21 bp, Homo sapiens
caagacttctctttgcctcaa

SEQ ID NO: 2480682 - DNA, 19 bp, Homo sapiens
caagagcatcatgcctctg

SEQ ID NO: 2480683 - DNA, 19 bp, Homo sapiens
caagagctacataatttag

SEQ ID NO: 2480684 - DNA, 14 bp, Homo sapiens
caagaggagccccc

SEQ ID NO: 2480685 - DNA, 19 bp, Homo sapiens
caagaggccgtggctgctg

SEQ ID NO: 2480686 - DNA, 17 bp, Homo sapiens
caagagggacgcctggg

SEQ ID NO: 2480687 - DNA, 15 bp, Homo sapiens
caagatggcccatcc

SEQ ID NO: 2480688 - DNA, 16 bp, Homo sapiens
caagatgggcatcttt

SEQ ID NO: 2480689 - DNA, 17 bp, Homo sapiens
caagatgggcatctttt

SEQ ID NO: 2480690 - DNA, 21 bp, Homo sapiens
caagatgggcatcttttgtat

SEQ ID NO: 2480691 - DNA, 22 bp, Homo sapiens
caagattccggatcctaagcat

SEQ ID NO: 2480692 - DNA, 14 bp, Homo sapiens
caagattctagatg

SEQ ID NO: 2480693 - DNA, 16 bp, Homo sapiens
caagattgagctctct

SEQ ID NO: 2480694 - DNA, 20 bp, Homo sapiens
caagattgagctctctgccc

SEQ ID NO: 2480695 - DNA, 23 bp, Homo sapiens
caagattgagctctctgcccttg

SEQ ID NO: 2480696 - DNA, 21 bp, Homo sapiens
caagattggtgtttttttcta

SEQ ID NO: 2480697 - DNA, 22 bp, Homo sapiens
caagattgttcctgcttttccc

SEQ ID NO: 2480698 - DNA, 14 bp, Homo sapiens
caagcacagcagcc

SEQ ID NO: 2480699 - DNA, 14 bp, Homo sapiens
caagcacagccctt

SEQ ID NO: 2480700 - DNA, 19 bp, Homo sapiens
atttcccaggaccctgaag

SEQ ID NO: 2480701 - DNA, 15 bp, Homo sapiens
atttctaattatgta

SEQ ID NO: 2480702 - DNA, 21 bp, Homo sapiens
atttctaattatgtagctctt

SEQ ID NO: 2480703 - DNA, 17 bp, Homo sapiens
atttctatagccaaaaa

SEQ ID NO: 2480704 - DNA, 11 bp, Homo sapiens
atttctattaa

SEQ ID NO: 2480705 - DNA, 20 bp, Homo sapiens
atttctcaggctaggccagc

SEQ ID NO: 2480706 - DNA, 21 bp, Homo sapiens
atttctgaggtgcactgggag

SEQ ID NO: 2480707 - DNA, 23 bp, Homo sapiens
atttctgcatatgttgaatactt

SEQ ID NO: 2480708 - DNA, 14 bp, Homo sapiens
atttcttaaacact

SEQ ID NO: 2480709 - DNA, 19 bp, Homo sapiens
atttcttaacttcttgctt

SEQ ID NO: 2480710 - DNA, 20 bp, Homo sapiens
atttcttcctaccaagtcaa

SEQ ID NO: 2480711 - DNA, 23 bp, Homo sapiens
atttcttcctaccaagtcaaact

SEQ ID NO: 2480712 - DNA, 15 bp, Homo sapiens
atttctttgaaaaaa

SEQ ID NO: 2480713 - DNA, 17 bp, Homo sapiens
atttgaatgatttttct

SEQ ID NO: 2480714 - DNA, 15 bp, Homo sapiens
atttgacttttctgt

SEQ ID NO: 2480715 - DNA, 16 bp, Homo sapiens
atttgacttttctgta

SEQ ID NO: 2480716 - DNA, 14 bp, Homo sapiens
atttgagtgctctg

SEQ ID NO: 2480717 - DNA, 19 bp, Homo sapiens
atttgcattaaattcacaa

SEQ ID NO: 2480718 - DNA, 12 bp, Homo sapiens
atttgcatttgt

SEQ ID NO: 2480719 - DNA, 13 bp, Homo sapiens
atttgcatttgtt

SEQ ID NO: 2480720 - DNA, 22 bp, Homo sapiens
atttgcatttgtttatgtaatt

SEQ ID NO: 2480721 - DNA, 23 bp, Homo sapiens
atttgcatttgtttatgtaattt

SEQ ID NO: 2480722 - DNA, 14 bp, Homo sapiens
atttgctaattttt

SEQ ID NO: 2480723 - DNA, 14 bp, Homo sapiens
atttgctttggaag

SEQ ID NO: 2480724 - DNA, 15 bp, Homo sapiens
atttgctttggaagt

SEQ ID NO: 2480725 - DNA, 11 bp, Homo sapiens
atttgcttttt

SEQ ID NO: 2480726 - DNA, 17 bp, Homo sapiens
atttggaaataaagtca

SEQ ID NO: 2480727 - DNA, 14 bp, Homo sapiens
atttggaatacttt

SEQ ID NO: 2480728 - DNA, 19 bp, Homo sapiens
atttggagggaagctcttg

SEQ ID NO: 2480729 - DNA, 15 bp, Homo sapiens
atttggatcctgtgt

SEQ ID NO: 2480730 - DNA, 18 bp, Homo sapiens
atttggatttaaaagcct

SEQ ID NO: 2480731 - DNA, 16 bp, Homo sapiens
atttggcatccctggg

SEQ ID NO: 2480732 - DNA, 18 bp, Homo sapiens
atttgggaagtgaagact

SEQ ID NO: 2480733 - DNA, 19 bp, Homo sapiens
atttgggcctgctccagac

SEQ ID NO: 2480734 - DNA, 22 bp, Homo sapiens
atttgggcctgctccagacctg

SEQ ID NO: 2480735 - DNA, 16 bp, Homo sapiens
atttgggtccaggagg

SEQ ID NO: 2480736 - DNA, 22 bp, Homo sapiens
atttgtaaaatgacaatcatgt

SEQ ID NO: 2480737 - DNA, 17 bp, Homo sapiens
atttgtaaatctgccac

SEQ ID NO: 2480738 - DNA, 22 bp, Homo sapiens
atttgtaatagatgtttgatag

SEQ ID NO: 2480739 - DNA, 19 bp, Homo sapiens
atttgtaattaaaagcaaa

SEQ ID NO: 2480740 - DNA, 23 bp, Homo sapiens
atttgtaattaaaagcaaatcat

SEQ ID NO: 2480741 - DNA, 19 bp, Homo sapiens
atttgtgcccccaaccatt

SEQ ID NO: 2480742 - DNA, 20 bp, Homo sapiens
atttgtgttttaatttaaac

SEQ ID NO: 2480743 - DNA, 21 bp, Homo sapiens
atttgtgttttaatttaaaca

SEQ ID NO: 2480744 - DNA, 17 bp, Homo sapiens
atttgttattttgcaac

SEQ ID NO: 2480745 - DNA, 16 bp, Homo sapiens
atttgttcttgtattt

SEQ ID NO: 2480746 - DNA, 11 bp, Homo sapiens
atttgttgcat

SEQ ID NO: 2480747 - DNA, 20 bp, Homo sapiens
atttgtttatggtaaaaaat

SEQ ID NO: 2480748 - DNA, 13 bp, Homo sapiens
atttgtttatgta

SEQ ID NO: 2480749 - DNA, 17 bp, Homo sapiens
atttgtttatgtaattt

SEQ ID NO: 2480750 - DNA, 18 bp, Homo sapiens
atttgtttctttctctga

SEQ ID NO: 2480751 - DNA, 22 bp, Homo sapiens
atttgtttttaaactgtacagt

SEQ ID NO: 2480752 - DNA, 22 bp, Homo sapiens
attttaaaatagcgttcttgta

SEQ ID NO: 2480753 - DNA, 23 bp, Homo sapiens
attttaaaatagcgttcttgtaa

SEQ ID NO: 2480754 - DNA, 13 bp, Homo sapiens
attttaaaatttg

SEQ ID NO: 2480755 - DNA, 14 bp, Homo sapiens
attttaaaatttgt

SEQ ID NO: 2480756 - DNA, 17 bp, Homo sapiens
attttaaaatttgttct

SEQ ID NO: 2480757 - DNA, 14 bp, Homo sapiens
attttaaacacatt

SEQ ID NO: 2480758 - DNA, 15 bp, Homo sapiens
attttaaagacccct

SEQ ID NO: 2480759 - DNA, 13 bp, Homo sapiens
attttaaagttag

SEQ ID NO: 2480760 - DNA, 23 bp, Homo sapiens
attttaatgaagaaagtggaaaa

SEQ ID NO: 2480761 - DNA, 12 bp, Homo sapiens
attttaattctc

SEQ ID NO: 2480762 - DNA, 21 bp, Homo sapiens
attttacacgcttttgtgatg

SEQ ID NO: 2480763 - DNA, 18 bp, Homo sapiens
attttaggagctaaggct

SEQ ID NO: 2480764 - DNA, 19 bp, Homo sapiens
attttaggagctaaggctc

SEQ ID NO: 2480765 - DNA, 20 bp, Homo sapiens
attttagtttttcattaaat

SEQ ID NO: 2480766 - DNA, 16 bp, Homo sapiens
attttatggtgcatta

SEQ ID NO: 2480767 - DNA, 15 bp, Homo sapiens
attttatgttatata

SEQ ID NO: 2480768 - DNA, 23 bp, Homo sapiens
attttattatgaagaaggtgaat

SEQ ID NO: 2480769 - DNA, 22 bp, Homo sapiens
attttatttacccctcccctat

SEQ ID NO: 2480770 - DNA, 15 bp, Homo sapiens
attttcaaaaccagg

SEQ ID NO: 2480771 - DNA, 17 bp, Homo sapiens
attttcaaaaccaggtc

SEQ ID NO: 2480772 - DNA, 16 bp, Homo sapiens
attttcaaagacttaa

SEQ ID NO: 2480773 - DNA, 20 bp, Homo sapiens
attttcataagtatttcaaa

SEQ ID NO: 2480774 - DNA, 22 bp, Homo sapiens
attttcataagtatttcaaatt

SEQ ID NO: 2480775 - DNA, 14 bp, Homo sapiens
attttccaaagagt

SEQ ID NO: 2480776 - DNA, 15 bp, Homo sapiens
attttccaggcttct

SEQ ID NO: 2480777 - DNA, 17 bp, Homo sapiens
attttctaagaaacatt

SEQ ID NO: 2480778 - DNA, 18 bp, Homo sapiens
attttctggccagtgttt

SEQ ID NO: 2480779 - DNA, 15 bp, Homo sapiens
attttctggttctaa

SEQ ID NO: 2480780 - DNA, 20 bp, Homo sapiens
attttgaaagtctgtccttg

SEQ ID NO: 2480781 - DNA, 22 bp, Homo sapiens
attttgaagtgctgtttattaa

SEQ ID NO: 2480782 - DNA, 17 bp, Homo sapiens
attttgaatcaataata

SEQ ID NO: 2480783 - DNA, 18 bp, Homo sapiens
attttgatgtaaagatgt

SEQ ID NO: 2480784 - DNA, 19 bp, Homo sapiens
attttgccaagggcataaa

SEQ ID NO: 2480785 - DNA, 21 bp, Homo sapiens
attttggagagtttcctgaaa

SEQ ID NO: 2480786 - DNA, 17 bp, Homo sapiens
attttggattttgcaag

SEQ ID NO: 2480787 - DNA, 19 bp, Homo sapiens
attttgtaataataaagaa

SEQ ID NO: 2480788 - DNA, 16 bp, Homo sapiens
attttgtatcttgatg

SEQ ID NO: 2480789 - DNA, 19 bp, Homo sapiens
attttgtattgtttcaatt

SEQ ID NO: 2480790 - DNA, 23 bp, Homo sapiens
attttgtggttttcgagattatc

SEQ ID NO: 2480791 - DNA, 16 bp, Homo sapiens
attttgtgtaagaaat

SEQ ID NO: 2480792 - DNA, 17 bp, Homo sapiens
attttgtgtaagaaata

SEQ ID NO: 2480793 - DNA, 15 bp, Homo sapiens
attttgttggcatag

SEQ ID NO: 2480794 - DNA, 14 bp, Homo sapiens
atttttaaacaagt

SEQ ID NO: 2480795 - DNA, 22 bp, Homo sapiens
atttttaattaattgggccagc

SEQ ID NO: 2480796 - DNA, 21 bp, Homo sapiens
atttttagatagttagaacct

SEQ ID NO: 2480797 - DNA, 14 bp, Homo sapiens
atttttatatttaa

SEQ ID NO: 2480798 - DNA, 17 bp, Homo sapiens
atttttattaattttag

SEQ ID NO: 2480799 - DNA, 22 bp, Homo sapiens
atttttattaattttagttttt

SEQ ID NO: 2480800 - DNA, 13 bp, Homo sapiens
atttttccaacta

SEQ ID NO: 2480801 - DNA, 21 bp, Homo sapiens
atttttccaactactaataga

SEQ ID NO: 2480802 - DNA, 10 bp, Homo sapiens
atttttccta

SEQ ID NO: 2480803 - DNA, 12 bp, Homo sapiens
atttttctaact

SEQ ID NO: 2480804 - DNA, 13 bp, Homo sapiens
cagaccaccccgc

SEQ ID NO: 2480805 - DNA, 15 bp, Homo sapiens
cagaccaccccgcct

SEQ ID NO: 2480806 - DNA, 22 bp, Homo sapiens
cagaccaccccgcctgccctca

SEQ ID NO: 2480807 - DNA, 24 bp, Homo sapiens
cagaccacgcccgtcctgcctgtg

SEQ ID NO: 2480808 - DNA, 11 bp, Homo sapiens
cagaccctgga

SEQ ID NO: 2480809 - DNA, 18 bp, Homo sapiens
cagaccctggaggcccca

SEQ ID NO: 2480810 - DNA, 22 bp, Homo sapiens
cagacctgatcctggaggccca

SEQ ID NO: 2480811 - DNA, 16 bp, Homo sapiens
cagacgcctggctgct

SEQ ID NO: 2480812 - DNA, 17 bp, Homo sapiens
cagacgcctggctgctg

SEQ ID NO: 2480813 - DNA, 14 bp, Homo sapiens
cagactaagccagc

SEQ ID NO: 2480814 - DNA, 21 bp, Homo sapiens
cagactaagccagcaccggac

SEQ ID NO: 2480815 - DNA, 23 bp, Homo sapiens
cagactaagccagcaccggacca

SEQ ID NO: 2480816 - DNA, 14 bp, Homo sapiens
cagactagatgtag

SEQ ID NO: 2480817 - DNA, 15 bp, Homo sapiens
cagactagatgtagt

SEQ ID NO: 2480818 - DNA, 14 bp, Homo sapiens
cagactcagacatt

SEQ ID NO: 2480819 - DNA, 13 bp, Homo sapiens
cagactcttgcct

SEQ ID NO: 2480820 - DNA, 18 bp, Homo sapiens
cagactcttgcctgtttc

SEQ ID NO: 2480821 - DNA, 18 bp, Homo sapiens
cagactctttatgcttgc

SEQ ID NO: 2480822 - DNA, 15 bp, Homo sapiens
cagagaaaccagctt

SEQ ID NO: 2480823 - DNA, 16 bp, Homo sapiens
cagagaaaccagcttc

SEQ ID NO: 2480824 - DNA, 21 bp, Homo sapiens
cagagaaaccagcttccttca

SEQ ID NO: 2480825 - DNA, 23 bp, Homo sapiens
cagagaaaccagcttccttcaga

SEQ ID NO: 2480826 - DNA, 19 bp, Homo sapiens
cagagaaaggggagcccac

SEQ ID NO: 2480827 - DNA, 11 bp, Homo sapiens
cagagaaccca

SEQ ID NO: 2480828 - DNA, 22 bp, Homo sapiens
cagagaacccagcccacccccg

SEQ ID NO: 2480829 - DNA, 18 bp, Homo sapiens
cagagaagccatcacctc

SEQ ID NO: 2480830 - DNA, 19 bp, Homo sapiens
cagagaagccatcacctca

SEQ ID NO: 2480831 - DNA, 14 bp, Homo sapiens
cagagaagccttca

SEQ ID NO: 2480832 - DNA, 15 bp, Homo sapiens
cagagaagccttcaa

SEQ ID NO: 2480833 - DNA, 21 bp, Homo sapiens
cagagaagccttcaagctctg

SEQ ID NO: 2480834 - DNA, 16 bp, Homo sapiens
cagagacatgcagaga

SEQ ID NO: 2480835 - DNA, 18 bp, Homo sapiens
cagagacatgcagagatt

SEQ ID NO: 2480836 - DNA, 13 bp, Homo sapiens
cagagaccagggc

SEQ ID NO: 2480837 - DNA, 15 bp, Homo sapiens
cagagaccagggctc

SEQ ID NO: 2480838 - DNA, 11 bp, Homo sapiens
cagagagcagt

SEQ ID NO: 2480839 - DNA, 20 bp, Homo sapiens
cagagaggactgtagggagg

SEQ ID NO: 2480840 - DNA, 20 bp, Homo sapiens
cagagaggtttgcagtccca

SEQ ID NO: 2480841 - DNA, 18 bp, Homo sapiens
cagagcacctgctgtctg

SEQ ID NO: 2480842 - DNA, 21 bp, Homo sapiens
cagagcacctgctgtctgggt

SEQ ID NO: 2480843 - DNA, 20 bp, Homo sapiens
cagagccaaggggcttcagg

SEQ ID NO: 2480844 - DNA, 21 bp, Homo sapiens
cagagccaaggggcttcaggt

SEQ ID NO: 2480845 - DNA, 17 bp, Homo sapiens
cagagccaggagaagct

SEQ ID NO: 2480846 - DNA, 23 bp, Homo sapiens
cagagccaggagaagctcagctg

SEQ ID NO: 2480847 - DNA, 21 bp, Homo sapiens
cagagccatgtcttctccctg

SEQ ID NO: 2480848 - DNA, 13 bp, Homo sapiens
cagagcccagctc

SEQ ID NO: 2480849 - DNA, 17 bp, Homo sapiens
cagagcccaggctcggc

SEQ ID NO: 2480850 - DNA, 23 bp, Homo sapiens
cagagcccaggctcggcctgccc

SEQ ID NO: 2480851 - DNA, 22 bp, Homo sapiens
cagagccggggtggggtggctg

SEQ ID NO: 2480852 - DNA, 16 bp, Homo sapiens
cagagcctggggctct

SEQ ID NO: 2480853 - DNA, 19 bp, Homo sapiens
cagagctggtgcggctggc

SEQ ID NO: 2480854 - DNA, 19 bp, Homo sapiens
cagaggagccaccagttct

SEQ ID NO: 2480855 - DNA, 20 bp, Homo sapiens
cagaggagccaccagttctc

SEQ ID NO: 2480856 - DNA, 21 bp, Homo sapiens
cagaggattgctgccccatca

SEQ ID NO: 2480857 - DNA, 21 bp, Homo sapiens
cagaggcagcccgcacacctg

SEQ ID NO: 2480858 - DNA, 14 bp, Homo sapiens
cagaggccaaggag

SEQ ID NO: 2480859 - DNA, 20 bp, Homo sapiens
cagaggcccacattggaaga

SEQ ID NO: 2480860 - DNA, 14 bp, Homo sapiens
cagaggcccaggct

SEQ ID NO: 2480861 - DNA, 16 bp, Homo sapiens
cagaggcccaggctgc

SEQ ID NO: 2480862 - DNA, 14 bp, Homo sapiens
cagaggccccagcc

SEQ ID NO: 2480863 - DNA, 16 bp, Homo sapiens
cagaggccccagcctc

SEQ ID NO: 2480864 - DNA, 24 bp, Homo sapiens
cagaggcccccagcccagggctcc

SEQ ID NO: 2480865 - DNA, 21 bp, Homo sapiens
cagaggccctcaagtctttct

SEQ ID NO: 2480866 - DNA, 19 bp, Homo sapiens
cagaggccctcgctgccag

SEQ ID NO: 2480867 - DNA, 20 bp, Homo sapiens
cagaggccctcgctgccagc

SEQ ID NO: 2480868 - DNA, 16 bp, Homo sapiens
cagaggcctgcagggc

SEQ ID NO: 2480869 - DNA, 18 bp, Homo sapiens
cagaggcctgcagggcct

SEQ ID NO: 2480870 - DNA, 19 bp, Homo sapiens
cagaggcctgcagggcctc

SEQ ID NO: 2480871 - DNA, 20 bp, Homo sapiens
cagaggcctgcagggcctct

SEQ ID NO: 2480872 - DNA, 14 bp, Homo sapiens
cagaggcctgggct

SEQ ID NO: 2480873 - DNA, 17 bp, Homo sapiens
cagaggcgcactgtgac

SEQ ID NO: 2480874 - DNA, 12 bp, Homo sapiens
cagagggctgga

SEQ ID NO: 2480875 - DNA, 13 bp, Homo sapiens
cagagggctggag

SEQ ID NO: 2480876 - DNA, 14 bp, Homo sapiens
cagagggctggagg

SEQ ID NO: 2480877 - DNA, 20 bp, Homo sapiens
cagagggctggaggcccagg

SEQ ID NO: 2480878 - DNA, 21 bp, Homo sapiens
cagagggctggaggcccaggc

SEQ ID NO: 2480879 - DNA, 14 bp, Homo sapiens
cagaggggcctgcc

SEQ ID NO: 2480880 - DNA, 17 bp, Homo sapiens
cagaggggcctgccacc

SEQ ID NO: 2480881 - DNA, 20 bp, Homo sapiens
cagagtgacatccaggagga

SEQ ID NO: 2480882 - DNA, 17 bp, Homo sapiens
cagagttacagttctgt

SEQ ID NO: 2480883 - DNA, 23 bp, Homo sapiens
cagagttctttttgaagtattta

SEQ ID NO: 2480884 - DNA, 22 bp, Homo sapiens
cagataactgaaaattatttaa

SEQ ID NO: 2480885 - DNA, 20 bp, Homo sapiens
cagataaggtaaaatgccat

SEQ ID NO: 2480886 - DNA, 16 bp, Homo sapiens
cagataatgtgaaaat

SEQ ID NO: 2480887 - DNA, 21 bp, Homo sapiens
cagatacggacagagaccaag

SEQ ID NO: 2480888 - DNA, 18 bp, Homo sapiens
cagatatattttctttct

SEQ ID NO: 2480889 - DNA, 16 bp, Homo sapiens
cagatcagtaaagaac

SEQ ID NO: 2480890 - DNA, 12 bp, Homo sapiens
cagatccagcct

SEQ ID NO: 2480891 - DNA, 13 bp, Homo sapiens
cagatccagcctg

SEQ ID NO: 2480892 - DNA, 14 bp, Homo sapiens
cagatccagcctgg

SEQ ID NO: 2480893 - DNA, 15 bp, Homo sapiens
cagatccagcctggg

SEQ ID NO: 2480894 - DNA, 23 bp, Homo sapiens
cagatccagggacagaggcccca

SEQ ID NO: 2480895 - DNA, 14 bp, Homo sapiens
cagatcctcctcat

SEQ ID NO: 2480896 - DNA, 21 bp, Homo sapiens
cagatctagtcaatcaagtct

SEQ ID NO: 2480897 - DNA, 21 bp, Homo sapiens
cagatctggaacctcagcctg

SEQ ID NO: 2480898 - DNA, 21 bp, Homo sapiens
cagatgacctcgtactcagga

SEQ ID NO: 2480899 - DNA, 22 bp, Homo sapiens
cagatgacctcgtactcaggag

SEQ ID NO: 2480900 - DNA, 17 bp, Homo sapiens
cagatgcccctttctgg

SEQ ID NO: 2480901 - DNA, 12 bp, Homo sapiens
cagatgcctcct

SEQ ID NO: 2480902 - DNA, 20 bp, Homo sapiens
cagatgctccaagattctag

SEQ ID NO: 2480903 - DNA, 16 bp, Homo sapiens
cagatggcagctttta

SEQ ID NO: 2480904 - DNA, 18 bp, Homo sapiens
cagatgtaggagggactg

SEQ ID NO: 2480905 - DNA, 17 bp, Homo sapiens
cagattcagaaatgagg

SEQ ID NO: 2480906 - DNA, 18 bp, Homo sapiens
cagatttggcttgacaaa

SEQ ID NO: 2480907 - DNA, 14 bp, Homo sapiens
cagcaaaccggggc

SEQ ID NO: 2480908 - DNA, 20 bp, Homo sapiens
cactgggtggtggcctggtc

SEQ ID NO: 2480909 - DNA, 21 bp, Homo sapiens
cactggtctgctgttccagtg

SEQ ID NO: 2480910 - DNA, 21 bp, Homo sapiens
cactggtggggataggccagc

SEQ ID NO: 2480911 - DNA, 19 bp, Homo sapiens
cactgtagtaaataatgct

SEQ ID NO: 2480912 - DNA, 20 bp, Homo sapiens
cactgtagtaaataatgctt

SEQ ID NO: 2480913 - DNA, 21 bp, Homo sapiens
cactgtagtaaataatgcttt

SEQ ID NO: 2480914 - DNA, 23 bp, Homo sapiens
cactgtagtaaataatgctttga

SEQ ID NO: 2480915 - DNA, 16 bp, Homo sapiens
cactgtagttctaaga

SEQ ID NO: 2480916 - DNA, 17 bp, Homo sapiens
cactgtagttctaagac

SEQ ID NO: 2480917 - DNA, 20 bp, Homo sapiens
cactgtagttctaagactca

SEQ ID NO: 2480918 - DNA, 15 bp, Homo sapiens
cactgtcctgggcct

SEQ ID NO: 2480919 - DNA, 18 bp, Homo sapiens
cactgtctttaattctgt

SEQ ID NO: 2480920 - DNA, 13 bp, Homo sapiens
cactgtgaaggac

SEQ ID NO: 2480921 - DNA, 14 bp, Homo sapiens
cactgtgaaggacc

SEQ ID NO: 2480922 - DNA, 17 bp, Homo sapiens
cactgtgaaggaccctt

SEQ ID NO: 2480923 - DNA, 17 bp, Homo sapiens
cactgtgcctcagagac

SEQ ID NO: 2480924 - DNA, 20 bp, Homo sapiens
cactgtgcctcagagaccag

SEQ ID NO: 2480925 - DNA, 13 bp, Homo sapiens
cactgtgtgaatc

SEQ ID NO: 2480926 - DNA, 17 bp, Homo sapiens
cactgttccccctgtgc

SEQ ID NO: 2480927 - DNA, 19 bp, Homo sapiens
cactgttccccctgtgcag

SEQ ID NO: 2480928 - DNA, 23 bp, Homo sapiens
cactgttcttagctcaatgagca

SEQ ID NO: 2480929 - DNA, 17 bp, Homo sapiens
cactgttgaattttctc

SEQ ID NO: 2480930 - DNA, 21 bp, Homo sapiens
cactgtttatacactgtgtaa

SEQ ID NO: 2480931 - DNA, 22 bp, Homo sapiens
cactgtttgtttacaaaatcag

SEQ ID NO: 2480932 - DNA, 16 bp, Homo sapiens
cacttacttgcttatt

SEQ ID NO: 2480933 - DNA, 16 bp, Homo sapiens
cacttatagcctctgt

SEQ ID NO: 2480934 - DNA, 17 bp, Homo sapiens
cacttatctgatcagaa

SEQ ID NO: 2480935 - DNA, 11 bp, Homo sapiens
cacttcaaact

SEQ ID NO: 2480936 - DNA, 19 bp, Homo sapiens
cacttcaggtatacctcac

SEQ ID NO: 2480937 - DNA, 18 bp, Homo sapiens
cacttccctgcttaaatt

SEQ ID NO: 2480938 - DNA, 14 bp, Homo sapiens
cacttctcaggaca

SEQ ID NO: 2480939 - DNA, 15 bp, Homo sapiens
cacttctcaggacac

SEQ ID NO: 2480940 - DNA, 23 bp, Homo sapiens
cacttctcaggacacaggcctgt

SEQ ID NO: 2480941 - DNA, 11 bp, Homo sapiens
cacttctgcac

SEQ ID NO: 2480942 - DNA, 14 bp, Homo sapiens
cacttctgcacttg

SEQ ID NO: 2480943 - DNA, 18 bp, Homo sapiens
cacttcttgttccccact

SEQ ID NO: 2480944 - DNA, 12 bp, Homo sapiens
cacttgcaacct

SEQ ID NO: 2480945 - DNA, 20 bp, Homo sapiens
caatttctactttgaagtca

SEQ ID NO: 2480946 - DNA, 23 bp, Homo sapiens
caatttggatttaaaagcctgct

SEQ ID NO: 2480947 - DNA, 21 bp, Homo sapiens
caattttttaagtgaaaatat

SEQ ID NO: 2480948 - DNA, 17 bp, Homo sapiens
caattttttttattagt

SEQ ID NO: 2480949 - DNA, 13 bp, Homo sapiens
cacaaactgtaaa

SEQ ID NO: 2480950 - DNA, 17 bp, Homo sapiens
cacaaactgtaatacaa

SEQ ID NO: 2480951 - DNA, 19 bp, Homo sapiens
cacaaacttttatactctt

SEQ ID NO: 2480952 - DNA, 15 bp, Homo sapiens
cacaaagaccctggc

SEQ ID NO: 2480953 - DNA, 20 bp, Homo sapiens
cacaaagaccctggctttca

SEQ ID NO: 2480954 - DNA, 12 bp, Homo sapiens
cacaaggacttc

SEQ ID NO: 2480955 - DNA, 14 bp, Homo sapiens
cacaaggacttcct

SEQ ID NO: 2480956 - DNA, 22 bp, Homo sapiens
cacaaggacttcctgtccagct

SEQ ID NO: 2480957 - DNA, 22 bp, Homo sapiens
cacaaggatagatgctggccca

SEQ ID NO: 2480958 - DNA, 11 bp, Homo sapiens
cacaaggcagc

SEQ ID NO: 2480959 - DNA, 16 bp, Homo sapiens
cacaaggcagcaaggc

SEQ ID NO: 2480960 - DNA, 18 bp, Homo sapiens
cacaaggcagcaaggccc

SEQ ID NO: 2480961 - DNA, 22 bp, Homo sapiens
cacaaggcagcaaggcccgagc

SEQ ID NO: 2480962 - DNA, 19 bp, Homo sapiens
cacaagtgggtacccccag

SEQ ID NO: 2480963 - DNA, 22 bp, Homo sapiens
cacaagtgggtacccccaggac

SEQ ID NO: 2480964 - DNA, 20 bp, Homo sapiens
cacaataactcctcccaggg

SEQ ID NO: 2480965 - DNA, 14 bp, Homo sapiens
cacaatagaattat

SEQ ID NO: 2480966 - DNA, 23 bp, Homo sapiens
cacacaaaagggaacccagctct

SEQ ID NO: 2480967 - DNA, 15 bp, Homo sapiens
cacacagactatttt

SEQ ID NO: 2480968 - DNA, 13 bp, Homo sapiens
cacacagtatttt

SEQ ID NO: 2480969 - DNA, 18 bp, Homo sapiens
cacacagtgctcaaggcc

SEQ ID NO: 2480970 - DNA, 18 bp, Homo sapiens
cacacatacgtgcacagg

SEQ ID NO: 2480971 - DNA, 13 bp, Homo sapiens
cacacattgctgt

SEQ ID NO: 2480972 - DNA, 14 bp, Homo sapiens
cacaccactagcct

SEQ ID NO: 2480973 - DNA, 19 bp, Homo sapiens
cacaccactagcctcaggg

SEQ ID NO: 2480974 - DNA, 16 bp, Homo sapiens
cacactaccgaatgtg

SEQ ID NO: 2480975 - DNA, 20 bp, Homo sapiens
cacactcagatcctcctcat

SEQ ID NO: 2480976 - DNA, 14 bp, Homo sapiens
cacactgatgctta

SEQ ID NO: 2480977 - DNA, 22 bp, Homo sapiens
cacactgggtggtggcctggtc

SEQ ID NO: 2480978 - DNA, 14 bp, Homo sapiens
cacacttctcagga

SEQ ID NO: 2480979 - DNA, 17 bp, Homo sapiens
cacacttctcaggacac

SEQ ID NO: 2480980 - DNA, 23 bp, Homo sapiens
cacacttctcaggacacaggcct

SEQ ID NO: 2480981 - DNA, 23 bp, Homo sapiens
cacagacggaagggtaaacaata

SEQ ID NO: 2480982 - DNA, 13 bp, Homo sapiens
cacagactatttt

SEQ ID NO: 2480983 - DNA, 15 bp, Homo sapiens
cacagaggacacaga

SEQ ID NO: 2480984 - DNA, 19 bp, Homo sapiens
cacagaggacacagagaag

SEQ ID NO: 2480985 - DNA, 16 bp, Homo sapiens
cacagagggcgtgtgc

SEQ ID NO: 2480986 - DNA, 22 bp, Homo sapiens
cacagataactgaaaattattt

SEQ ID NO: 2480987 - DNA, 17 bp, Homo sapiens
cacagcaaccccaggct

SEQ ID NO: 2480988 - DNA, 18 bp, Homo sapiens
cacagcacaaattagtta

SEQ ID NO: 2480989 - DNA, 17 bp, Homo sapiens
cactaatatatttaaaa

SEQ ID NO: 2480990 - DNA, 21 bp, Homo sapiens
cactaatatatttaaaaataa

SEQ ID NO: 2480991 - DNA, 22 bp, Homo sapiens
cactaattcattaatctgcctc

SEQ ID NO: 2480992 - DNA, 19 bp, Homo sapiens
cactagacaagccagaact

SEQ ID NO: 2480993 - DNA, 22 bp, Homo sapiens
cactagccaaacctcaccaact

SEQ ID NO: 2480994 - DNA, 12 bp, Homo sapiens
cactagctcttg

SEQ ID NO: 2480995 - DNA, 22 bp, Homo sapiens
cactagctcttgttgagccgtg

SEQ ID NO: 2480996 - DNA, 17 bp, Homo sapiens
cactaggcccccacttg

SEQ ID NO: 2480997 - DNA, 22 bp, Homo sapiens
cactaggcccccacttgcctct

SEQ ID NO: 2480998 - DNA, 12 bp, Homo sapiens
cactcacctgca

SEQ ID NO: 2480999 - DNA, 17 bp, Homo sapiens
cactcagaagcctgggg

SEQ ID NO: 2481000 - DNA, 19 bp, Homo sapiens
cactcagaagcctgggggc

SEQ ID NO: 2481001 - DNA, 23 bp, Homo sapiens
cactcagaagcctgggggcctgg

SEQ ID NO: 2481002 - DNA, 20 bp, Homo sapiens
cactcagagacatgcagaga

SEQ ID NO: 2481003 - DNA, 12 bp, Homo sapiens
cactcagcacaa

SEQ ID NO: 2481004 - DNA, 15 bp, Homo sapiens
cactcagcacaaggc

SEQ ID NO: 2481005 - DNA, 22 bp, Homo sapiens
cactcagcacaaggccatctgg

SEQ ID NO: 2481006 - DNA, 17 bp, Homo sapiens
cactcagcacttggccc

SEQ ID NO: 2481007 - DNA, 16 bp, Homo sapiens
cactcagccaccctga

SEQ ID NO: 2481008 - DNA, 18 bp, Homo sapiens
cactcagccaccctgagt

SEQ ID NO: 2481009 - DNA, 17 bp, Homo sapiens
cactcccacctgacaca

SEQ ID NO: 2481010 - DNA, 13 bp, Homo sapiens
cactcccttgggc

SEQ ID NO: 2481011 - DNA, 16 bp, Homo sapiens
cactcccttgggctcc

SEQ ID NO: 2481012 - DNA, 13 bp, Homo sapiens
cactcctcatagc

SEQ ID NO: 2481013 - DNA, 13 bp, Homo sapiens
cactcctctgact

SEQ ID NO: 2481014 - DNA, 21 bp, Homo sapiens
cactcctctgactcagggctc

SEQ ID NO: 2481015 - DNA, 13 bp, Homo sapiens
cactccttcctgc

SEQ ID NO: 2481016 - DNA, 15 bp, Homo sapiens
cactccttcctgccc

SEQ ID NO: 2481017 - DNA, 17 bp, Homo sapiens
cactccttcctgcccca

SEQ ID NO: 2481018 - DNA, 16 bp, Homo sapiens
cactcgctagcagtgg

SEQ ID NO: 2481019 - DNA, 13 bp, Homo sapiens
cactcgtctcccc

SEQ ID NO: 2481020 - DNA, 12 bp, Homo sapiens
cactctgctctg

SEQ ID NO: 2481021 - DNA, 13 bp, Homo sapiens
cactctgctctga

SEQ ID NO: 2481022 - DNA, 15 bp, Homo sapiens
cactctgctctgatg

SEQ ID NO: 2481023 - DNA, 12 bp, Homo sapiens
cactctgctgtt

SEQ ID NO: 2481024 - DNA, 12 bp, Homo sapiens
cactctggcagc

SEQ ID NO: 2481025 - DNA, 15 bp, Homo sapiens
cactctttgtaagag

SEQ ID NO: 2481026 - DNA, 23 bp, Homo sapiens
cactcttttgctttattccagaa

SEQ ID NO: 2481027 - DNA, 17 bp, Homo sapiens
cactgaaaaaatatatg

SEQ ID NO: 2481028 - DNA, 23 bp, Homo sapiens
cactgaaaaatctaagtgatata

SEQ ID NO: 2481029 - DNA, 13 bp, Homo sapiens
cactgacagcctc

SEQ ID NO: 2481030 - DNA, 13 bp, Homo sapiens
cactgaccagaac

SEQ ID NO: 2481031 - DNA, 15 bp, Homo sapiens
cactgaccagaacta

SEQ ID NO: 2481032 - DNA, 17 bp, Homo sapiens
cactgatgctgcccctc

SEQ ID NO: 2481033 - DNA, 15 bp, Homo sapiens
cactgatgcttagat

SEQ ID NO: 2481034 - DNA, 20 bp, Homo sapiens
cactgcaaaccgccacctcc

SEQ ID NO: 2481035 - DNA, 20 bp, Homo sapiens
cactgcaattggcaccgaag

SEQ ID NO: 2481036 - DNA, 18 bp, Homo sapiens
cactgcacaataactcct

SEQ ID NO: 2481037 - DNA, 22 bp, Homo sapiens
cactgcacaataactcctccca

SEQ ID NO: 2481038 - DNA, 14 bp, Homo sapiens
cactgcacctgcct

SEQ ID NO: 2481039 - DNA, 17 bp, Homo sapiens
cactgcactcaacctta

SEQ ID NO: 2481040 - DNA, 12 bp, Homo sapiens
cactgccaggag

SEQ ID NO: 2481041 - DNA, 18 bp, Homo sapiens
cactgccatatgatttac

SEQ ID NO: 2481042 - DNA, 19 bp, Homo sapiens
cactgccccctgctgccat

SEQ ID NO: 2481043 - DNA, 19 bp, Homo sapiens
cactgccctggtggccctc

SEQ ID NO: 2481044 - DNA, 13 bp, Homo sapiens
cactgcctgctcc

SEQ ID NO: 2481045 - DNA, 17 bp, Homo sapiens
cactgctggagaggccc

SEQ ID NO: 2481046 - DNA, 14 bp, Homo sapiens
cactgcttgaggaa

SEQ ID NO: 2481047 - DNA, 13 bp, Homo sapiens
cactgcttttccc

SEQ ID NO: 2481048 - DNA, 12 bp, Homo sapiens
cactggagcaca

SEQ ID NO: 2481049 - DNA, 18 bp, Homo sapiens
cactgggaggctcccctt

SEQ ID NO: 2481050 - DNA, 20 bp, Homo sapiens
cactgggaggctccccttct

SEQ ID NO: 2481051 - DNA, 20 bp, Homo sapiens
cactggggacttggcctctc

SEQ ID NO: 2481052 - DNA, 22 bp, Homo sapiens
cactggggagcccgtctcagtg

SEQ ID NO: 2481053 - DNA, 22 bp, Homo sapiens
cactggggctcagagccggggt

SEQ ID NO: 2481054 - DNA, 22 bp, Homo sapiens
catactggcctggactgttttc

SEQ ID NO: 2481055 - DNA, 21 bp, Homo sapiens
catacttgaacgttttctaat

SEQ ID NO: 2481056 - DNA, 22 bp, Homo sapiens
catacttgaacgttttctaatt

SEQ ID NO: 2481057 - DNA, 18 bp, Homo sapiens
catacttgaagggccaga

SEQ ID NO: 2481058 - DNA, 22 bp, Homo sapiens
catacttgaagggccagagcca

SEQ ID NO: 2481059 - DNA, 19 bp, Homo sapiens
catagacagaagaaacaag

SEQ ID NO: 2481060 - DNA, 20 bp, Homo sapiens
catagacagaagaaacaagg

SEQ ID NO: 2481061 - DNA, 20 bp, Homo sapiens
catagagccgggtgtcccca

SEQ ID NO: 2481062 - DNA, 22 bp, Homo sapiens
catagagccgggtgtccccaac

SEQ ID NO: 2481063 - DNA, 23 bp, Homo sapiens
catagatcagcaaaccggggcct

SEQ ID NO: 2481064 - DNA, 13 bp, Homo sapiens
catagctctgggg

SEQ ID NO: 2481065 - DNA, 20 bp, Homo sapiens
catagctctggggtgggcag

SEQ ID NO: 2481066 - DNA, 18 bp, Homo sapiens
cataggacctttccacca

SEQ ID NO: 2481067 - DNA, 16 bp, Homo sapiens
cataggagtttggagg

SEQ ID NO: 2481068 - DNA, 17 bp, Homo sapiens
cataggagtttggagga

SEQ ID NO: 2481069 - DNA, 19 bp, Homo sapiens
cataggagtttggaggaag

SEQ ID NO: 2481070 - DNA, 20 bp, Homo sapiens
cataggtgatccatgtaact

SEQ ID NO: 2481071 - DNA, 23 bp, Homo sapiens
catagtaacttcttatggaattg

SEQ ID NO: 2481072 - DNA, 18 bp, Homo sapiens
catataatgttgttattt

SEQ ID NO: 2481073 - DNA, 16 bp, Homo sapiens
catataattatatgtt

SEQ ID NO: 2481074 - DNA, 13 bp, Homo sapiens
catattgtaaaac

SEQ ID NO: 2481075 - DNA, 19 bp, Homo sapiens
catattgttgcattgcttt

SEQ ID NO: 2481076 - DNA, 16 bp, Homo sapiens
catatttacctcagcc

SEQ ID NO: 2481077 - DNA, 18 bp, Homo sapiens
catatttacctcagcctg

SEQ ID NO: 2481078 - DNA, 14 bp, Homo sapiens
catatttgtaaaat

SEQ ID NO: 2481079 - DNA, 15 bp, Homo sapiens
catatttgtaaaatg

SEQ ID NO: 2481080 - DNA, 23 bp, Homo sapiens
catatttgtttatggtaaaaaat

SEQ ID NO: 2481081 - DNA, 19 bp, Homo sapiens
catattttaaaatttgttc

SEQ ID NO: 2481082 - DNA, 18 bp, Homo sapiens
catattttcaccatttga

SEQ ID NO: 2481083 - DNA, 18 bp, Homo sapiens
catcaaaaactttggagt

SEQ ID NO: 2481084 - DNA, 20 bp, Homo sapiens
catcaaggacacgggcctgt

SEQ ID NO: 2481085 - DNA, 13 bp, Homo sapiens
catcacagcccag

SEQ ID NO: 2481086 - DNA, 14 bp, Homo sapiens
catcacagcccagc

SEQ ID NO: 2481087 - DNA, 17 bp, Homo sapiens
catcacagcccagcccg

SEQ ID NO: 2481088 - DNA, 14 bp, Homo sapiens
catcacctactcac

SEQ ID NO: 2481089 - DNA, 21 bp, Homo sapiens
catcacctactcacacaggca

SEQ ID NO: 2481090 - DNA, 16 bp, Homo sapiens
catcacctcagatggc

SEQ ID NO: 2481091 - DNA, 19 bp, Homo sapiens
catcacgttagctgtccca

SEQ ID NO: 2481092 - DNA, 15 bp, Homo sapiens
catcactttgaccta

SEQ ID NO: 2481093 - DNA, 18 bp, Homo sapiens
catcagaaagggagggct

SEQ ID NO: 2481094 - DNA, 21 bp, Homo sapiens
catcagaaagggagggctctg

SEQ ID NO: 2481095 - DNA, 22 bp, Homo sapiens
catcagaaagggagggctctga

SEQ ID NO: 2481096 - DNA, 19 bp, Homo sapiens
catcagactgtgaacccca

SEQ ID NO: 2481097 - DNA, 15 bp, Homo sapiens
catcaggctttcttt

SEQ ID NO: 2481098 - DNA, 16 bp, Homo sapiens
catcagtgctccctca

SEQ ID NO: 2481099 - DNA, 15 bp, Homo sapiens
catcatcatggccag

SEQ ID NO: 2481100 - DNA, 13 bp, Homo sapiens
catcatcctctgg

SEQ ID NO: 2481101 - DNA, 14 bp, Homo sapiens
catcatgcctctga

SEQ ID NO: 2481102 - DNA, 21 bp, Homo sapiens
catcatggccagctggaggca

SEQ ID NO: 2481103 - DNA, 15 bp, Homo sapiens
catcattctctgtct

SEQ ID NO: 2481104 - DNA, 16 bp, Homo sapiens
catcattctctgtctc

SEQ ID NO: 2481105 - DNA, 17 bp, Homo sapiens
catcattctctgtctca

SEQ ID NO: 2481106 - DNA, 14 bp, Homo sapiens
catcattttttact

SEQ ID NO: 2481107 - DNA, 23 bp, Homo sapiens
catccaaaatagttaagacatga

SEQ ID NO: 2481108 - DNA, 23 bp, Homo sapiens
catccaaaatcttgatcagttaa

SEQ ID NO: 2481109 - DNA, 18 bp, Homo sapiens
catccaaagcagacagct

SEQ ID NO: 2481110 - DNA, 21 bp, Homo sapiens
catccaaggccaggttctccg

SEQ ID NO: 2481111 - DNA, 20 bp, Homo sapiens
catccacataccctgacctg

SEQ ID NO: 2481112 - DNA, 14 bp, Homo sapiens
catccatcatcatg

SEQ ID NO: 2481113 - DNA, 14 bp, Homo sapiens
catccatggccagc

SEQ ID NO: 2481114 - DNA, 18 bp, Homo sapiens
catccatggccagcagca

SEQ ID NO: 2481115 - DNA, 21 bp, Homo sapiens
catccatggccagcagcacct

SEQ ID NO: 2481116 - DNA, 22 bp, Homo sapiens
catccatggccagcagcacctg

SEQ ID NO: 2481117 - DNA, 17 bp, Homo sapiens
catcccgagcacctcca

SEQ ID NO: 2481118 - DNA, 16 bp, Homo sapiens
catcccgtcttctcca

SEQ ID NO: 2481119 - DNA, 21 bp, Homo sapiens
catcccgtgttctccttttcc

SEQ ID NO: 2481120 - DNA, 12 bp, Homo sapiens
catccctggccc

SEQ ID NO: 2481121 - DNA, 21 bp, Homo sapiens
catccctggccccctccctgg

SEQ ID NO: 2481122 - DNA, 15 bp, Homo sapiens
catccctgggcctgc

SEQ ID NO: 2481123 - DNA, 18 bp, Homo sapiens
catccctgggcctgctgc

SEQ ID NO: 2481124 - DNA, 22 bp, Homo sapiens
catccctgggcctgctgctgag

SEQ ID NO: 2481125 - DNA, 22 bp, Homo sapiens
catccctgggccttgggctccg

SEQ ID NO: 2481126 - DNA, 15 bp, Homo sapiens
catccctttttcaat

SEQ ID NO: 2481127 - DNA, 14 bp, Homo sapiens
catccgcaggtgct

SEQ ID NO: 2481128 - DNA, 15 bp, Homo sapiens
catcctaccgtcttt

SEQ ID NO: 2481129 - DNA, 17 bp, Homo sapiens
catcctaggctgacacc

SEQ ID NO: 2481130 - DNA, 22 bp, Homo sapiens
catcctcaaagaaagtgtattg

SEQ ID NO: 2481131 - DNA, 20 bp, Homo sapiens
catcctccacgttctgctca

SEQ ID NO: 2481132 - DNA, 13 bp, Homo sapiens
catcctccagccc

SEQ ID NO: 2481133 - DNA, 14 bp, Homo sapiens
catcctccagcccc

SEQ ID NO: 2481134 - DNA, 18 bp, Homo sapiens
catcctctggagccagcc

SEQ ID NO: 2481135 - DNA, 19 bp, Homo sapiens
catcctctggagccagccg

SEQ ID NO: 2481136 - DNA, 22 bp, Homo sapiens
catccttgtcttattcccttcc

SEQ ID NO: 2481137 - DNA, 21 bp, Homo sapiens
catcgaatctactaattccac

SEQ ID NO: 2481138 - DNA, 14 bp, Homo sapiens
catcggaaaaataa

SEQ ID NO: 2481139 - DNA, 18 bp, Homo sapiens
catctaacctcatcttct

SEQ ID NO: 2481140 - DNA, 16 bp, Homo sapiens
catctcaaaacagagg

SEQ ID NO: 2481141 - DNA, 18 bp, Homo sapiens
catctcaaaacagagggc

SEQ ID NO: 2481142 - DNA, 22 bp, Homo sapiens
catctcaaaacagagggctgca

SEQ ID NO: 2481143 - DNA, 22 bp, Homo sapiens
catctcaacaggcctcagggct

SEQ ID NO: 2481144 - DNA, 17 bp, Homo sapiens
catctcaggccagagcc

SEQ ID NO: 2481145 - DNA, 22 bp, Homo sapiens
catctcatgcccctggctggga

SEQ ID NO: 2481146 - DNA, 18 bp, Homo sapiens
catctctaccttctcccc

SEQ ID NO: 2481147 - DNA, 15 bp, Homo sapiens
catctctccctcccc

SEQ ID NO: 2481148 - DNA, 20 bp, Homo sapiens
catctctccctcccctgcca

SEQ ID NO: 2481149 - DNA, 14 bp, Homo sapiens
catctctgggctgg

SEQ ID NO: 2481150 - DNA, 23 bp, Homo sapiens
catctctgggctggatgagctcc

SEQ ID NO: 2481151 - DNA, 15 bp, Homo sapiens
catctcttcaggttc

SEQ ID NO: 2481152 - DNA, 20 bp, Homo sapiens
catctgcattttcaccccac

SEQ ID NO: 2481153 - DNA, 18 bp, Homo sapiens
catctgcgtgacaataaa

SEQ ID NO: 2481154 - DNA, 23 bp, Homo sapiens
catctgcgtgacaataaaacatt

SEQ ID NO: 2481155 - DNA, 18 bp, Homo sapiens
catctgggccttggcctg

SEQ ID NO: 2481156 - DNA, 20 bp, Homo sapiens
catctgggccttggcctgga

SEQ ID NO: 2481157 - DNA, 23 bp, Homo sapiens
catctggtagaagggaaagccca

SEQ ID NO: 2481158 - DNA, 23 bp, Homo sapiens
cagtataattgagttttcagtgg

SEQ ID NO: 2481159 - DNA, 13 bp, Homo sapiens
cagtatcatgccc

SEQ ID NO: 2481160 - DNA, 18 bp, Homo sapiens
cagtatgggggttgtaaa

SEQ ID NO: 2481161 - DNA, 20 bp, Homo sapiens
cagtatgggggttgtaaatt

SEQ ID NO: 2481162 - DNA, 21 bp, Homo sapiens
cagtatgggggttgtaaattg

SEQ ID NO: 2481163 - DNA, 15 bp, Homo sapiens
cagtattatatgtac

SEQ ID NO: 2481164 - DNA, 16 bp, Homo sapiens
cagtatttagaagcca

SEQ ID NO: 2481165 - DNA, 23 bp, Homo sapiens
cagtatttgtaattaaaagcaaa

SEQ ID NO: 2481166 - DNA, 13 bp, Homo sapiens
cagtatttttgcc

SEQ ID NO: 2481167 - DNA, 13 bp, Homo sapiens
cagtccacaaaat

SEQ ID NO: 2481168 - DNA, 18 bp, Homo sapiens
cagtccacttctgacagc

SEQ ID NO: 2481169 - DNA, 20 bp, Homo sapiens
cagtccacttctgacagcct

SEQ ID NO: 2481170 - DNA, 20 bp, Homo sapiens
cagtccagtcctatctgggc

SEQ ID NO: 2481171 - DNA, 21 bp, Homo sapiens
cagtccagtcctatctgggct

SEQ ID NO: 2481172 - DNA, 20 bp, Homo sapiens
cagtcccagcggtgggacct

SEQ ID NO: 2481173 - DNA, 13 bp, Homo sapiens
cagtccccttccc

SEQ ID NO: 2481174 - DNA, 19 bp, Homo sapiens
cagtccccttccctccaag

SEQ ID NO: 2481175 - DNA, 21 bp, Homo sapiens
cagtcctatctgggcttcctg

SEQ ID NO: 2481176 - DNA, 17 bp, Homo sapiens
cagtcctgcctcagcct

SEQ ID NO: 2481177 - DNA, 12 bp, Homo sapiens
cagtcctgtcct

SEQ ID NO: 2481178 - DNA, 19 bp, Homo sapiens
cagtccttggcctgctaag

SEQ ID NO: 2481179 - DNA, 15 bp, Homo sapiens
cagtcgatagagctg

SEQ ID NO: 2481180 - DNA, 14 bp, Homo sapiens
cagtcgtgcctgtg

SEQ ID NO: 2481181 - DNA, 17 bp, Homo sapiens
cagtctattcacagaag

SEQ ID NO: 2481182 - DNA, 13 bp, Homo sapiens
cagtctcgtctct

SEQ ID NO: 2481183 - DNA, 22 bp, Homo sapiens
cagtctctcttctctccagctg

SEQ ID NO: 2481184 - DNA, 15 bp, Homo sapiens
cagtctgtggatcag

SEQ ID NO: 2481185 - DNA, 23 bp, Homo sapiens
cagtgaagttgctgcttctccca

SEQ ID NO: 2481186 - DNA, 17 bp, Homo sapiens
cagtgaatgattcagtg

SEQ ID NO: 2481187 - DNA, 16 bp, Homo sapiens
cagtgacttctgagat

SEQ ID NO: 2481188 - DNA, 21 bp, Homo sapiens
cagtgagggagggctgtcatc

SEQ ID NO: 2481189 - DNA, 20 bp, Homo sapiens
cagtgcccccactgaccaga

SEQ ID NO: 2481190 - DNA, 14 bp, Homo sapiens
cagtgctcttttct

SEQ ID NO: 2481191 - DNA, 19 bp, Homo sapiens
cagtgctgatgtagcatgc

SEQ ID NO: 2481192 - DNA, 12 bp, Homo sapiens
cagtgcttttgg

SEQ ID NO: 2481193 - DNA, 20 bp, Homo sapiens
cagtggaggaagagggacag

SEQ ID NO: 2481194 - DNA, 17 bp, Homo sapiens
cagtggatcacaaagtg

SEQ ID NO: 2481195 - DNA, 14 bp, Homo sapiens
cagtggcaggcaga

SEQ ID NO: 2481196 - DNA, 18 bp, Homo sapiens
cagtggctggtccagggc

SEQ ID NO: 2481197 - DNA, 20 bp, Homo sapiens
cagtggctggtccagggcta

SEQ ID NO: 2481198 - DNA, 21 bp, Homo sapiens
cagtggggcagaggcagtacc

SEQ ID NO: 2481199 - DNA, 16 bp, Homo sapiens
cagtgtcatttctcat

SEQ ID NO: 2481200 - DNA, 22 bp, Homo sapiens
cagtgtcatttctcatccacat

SEQ ID NO: 2481201 - DNA, 15 bp, Homo sapiens
cagtgtcctgagctc

SEQ ID NO: 2481202 - DNA, 19 bp, Homo sapiens
cagtgtcctgagctcagcg

SEQ ID NO: 2481203 - DNA, 12 bp, Homo sapiens
cagtgtcttttt

SEQ ID NO: 2481204 - DNA, 14 bp, Homo sapiens
cagtgtgcaaggca

SEQ ID NO: 2481205 - DNA, 18 bp, Homo sapiens
cagtgtgcaaggcagccg

SEQ ID NO: 2481206 - DNA, 18 bp, Homo sapiens
cagtgtggaggccactgt

SEQ ID NO: 2481207 - DNA, 20 bp, Homo sapiens
cagtgtggaggccactgttt

SEQ ID NO: 2481208 - DNA, 14 bp, Homo sapiens
cagtgttaaatgtg

SEQ ID NO: 2481209 - DNA, 18 bp, Homo sapiens
cagtgttgagccttttcc

SEQ ID NO: 2481210 - DNA, 15 bp, Homo sapiens
cagttaagaaatttc

SEQ ID NO: 2481211 - DNA, 15 bp, Homo sapiens
cagttaatcttgctt

SEQ ID NO: 2481212 - DNA, 19 bp, Homo sapiens
cagttaatttttccaacta

SEQ ID NO: 2481213 - DNA, 22 bp, Homo sapiens
cagttacataattcactctgag

SEQ ID NO: 2481214 - DNA, 15 bp, Homo sapiens
cagttatattttgca

SEQ ID NO: 2481215 - DNA, 18 bp, Homo sapiens
cagttatattttgcagtt

SEQ ID NO: 2481216 - DNA, 20 bp, Homo sapiens
cagttcattagaaatatttt

SEQ ID NO: 2481217 - DNA, 15 bp, Homo sapiens
cagttcattgcactt

SEQ ID NO: 2481218 - DNA, 18 bp, Homo sapiens
cagttcccacattaaaga

SEQ ID NO: 2481219 - DNA, 21 bp, Homo sapiens
cagttcgactctgtgctggcc

SEQ ID NO: 2481220 - DNA, 13 bp, Homo sapiens
cagttcgcagcca

SEQ ID NO: 2481221 - DNA, 20 bp, Homo sapiens
cagttctgtggtttcatgtt

SEQ ID NO: 2481222 - DNA, 22 bp, Homo sapiens
cagttctttgggccagacatgc

SEQ ID NO: 2481223 - DNA, 19 bp, Homo sapiens
cagttgaagggaggggctg

SEQ ID NO: 2481224 - DNA, 16 bp, Homo sapiens
cagttgagacaagaaa

SEQ ID NO: 2481225 - DNA, 18 bp, Homo sapiens
cagttgagacaagaaaat

SEQ ID NO: 2481226 - DNA, 14 bp, Homo sapiens
cagttgcagtcact

SEQ ID NO: 2481227 - DNA, 21 bp, Homo sapiens
cagttggagctccagcctgac

SEQ ID NO: 2481228 - DNA, 15 bp, Homo sapiens
cagttgtctctgatg

SEQ ID NO: 2481229 - DNA, 17 bp, Homo sapiens
cagttgtctctgatgca

SEQ ID NO: 2481230 - DNA, 13 bp, Homo sapiens
cagttgttctttt

SEQ ID NO: 2481231 - DNA, 14 bp, Homo sapiens
cagtttaaaagcac

SEQ ID NO: 2481232 - DNA, 18 bp, Homo sapiens
cagtttaatgaagatcta

SEQ ID NO: 2481233 - DNA, 19 bp, Homo sapiens
cagtttatatttaactctc

SEQ ID NO: 2481234 - DNA, 19 bp, Homo sapiens
cagtttatcattcaagtgt

SEQ ID NO: 2481235 - DNA, 14 bp, Homo sapiens
cagtttcacagaaa

SEQ ID NO: 2481236 - DNA, 17 bp, Homo sapiens
cagtttctaaactggag

SEQ ID NO: 2481237 - DNA, 17 bp, Homo sapiens
cagtttgcaaaaaatgt

SEQ ID NO: 2481238 - DNA, 22 bp, Homo sapiens
cagtttgggtaaaatactttta

SEQ ID NO: 2481239 - DNA, 21 bp, Homo sapiens
cagtttgtgtgtcttaattat

SEQ ID NO: 2481240 - DNA, 13 bp, Homo sapiens
cagttttaactgt

SEQ ID NO: 2481241 - DNA, 16 bp, Homo sapiens
cagttttaactgtgga

SEQ ID NO: 2481242 - DNA, 18 bp, Homo sapiens
cagttttaactgtggata

SEQ ID NO: 2481243 - DNA, 20 bp, Homo sapiens
cagttttaactgtggatatt

SEQ ID NO: 2481244 - DNA, 15 bp, Homo sapiens
cagttttatcatttt

SEQ ID NO: 2481245 - DNA, 15 bp, Homo sapiens
cataaaggaaaagac

SEQ ID NO: 2481246 - DNA, 19 bp, Homo sapiens
cataaaggaaaagacacat

SEQ ID NO: 2481247 - DNA, 11 bp, Homo sapiens
cataaattatt

SEQ ID NO: 2481248 - DNA, 13 bp, Homo sapiens
cataaccactgct

SEQ ID NO: 2481249 - DNA, 17 bp, Homo sapiens
cataagctatttttcta

SEQ ID NO: 2481250 - DNA, 15 bp, Homo sapiens
cataatcactctaat

SEQ ID NO: 2481251 - DNA, 20 bp, Homo sapiens
cataatgcattcttctctgt

SEQ ID NO: 2481252 - DNA, 21 bp, Homo sapiens
cataattatccaggaagggaa

SEQ ID NO: 2481253 - DNA, 21 bp, Homo sapiens
cataattcactctgagtgttt

SEQ ID NO: 2481254 - DNA, 23 bp, Homo sapiens
cataattcactctgagtgtttta

SEQ ID NO: 2481255 - DNA, 15 bp, Homo sapiens
cataatttggaggga

SEQ ID NO: 2481256 - DNA, 12 bp, Homo sapiens
catacagagaag

SEQ ID NO: 2481257 - DNA, 16 bp, Homo sapiens
catacattttctaaga

SEQ ID NO: 2481258 - DNA, 14 bp, Homo sapiens
cataccctgacctg

SEQ ID NO: 2481259 - DNA, 16 bp, Homo sapiens
cataccctgacctggc

SEQ ID NO: 2481260 - DNA, 19 bp, Homo sapiens
cataccctgacctggcccc

SEQ ID NO: 2481261 - DNA, 21 bp, Homo sapiens
catacctcctatgggttgtca

SEQ ID NO: 2481262 - DNA, 18 bp, Homo sapiens
catactggcctggactgt

SEQ ID NO: 2481263 - DNA, 11 bp, Homo sapiens
cagcagggcta

SEQ ID NO: 2481264 - DNA, 20 bp, Homo sapiens
cagcagtgtgaggccagggc

SEQ ID NO: 2481265 - DNA, 22 bp, Homo sapiens
cagcagtgtgaggccagggcag

SEQ ID NO: 2481266 - DNA, 12 bp, Homo sapiens
cagcatccgcag

SEQ ID NO: 2481267 - DNA, 22 bp, Homo sapiens
cagcatcggacaagacccccag

SEQ ID NO: 2481268 - DNA, 17 bp, Homo sapiens
cagcatctctaccttct

SEQ ID NO: 2481269 - DNA, 21 bp, Homo sapiens
cagcatctctaccttctcccc

SEQ ID NO: 2481270 - DNA, 15 bp, Homo sapiens
cagcatggcatccaa

SEQ ID NO: 2481271 - DNA, 14 bp, Homo sapiens
cagcattcccaggt

SEQ ID NO: 2481272 - DNA, 20 bp, Homo sapiens
cagcattcccaggtaggcca

SEQ ID NO: 2481273 - DNA, 16 bp, Homo sapiens
cagcattgtatatgtg

SEQ ID NO: 2481274 - DNA, 17 bp, Homo sapiens
cagccaaaccctgtctg

SEQ ID NO: 2481275 - DNA, 19 bp, Homo sapiens
cagccaacacgcacctgcc

SEQ ID NO: 2481276 - DNA, 22 bp, Homo sapiens
cagccaacacgcacctgcctca

SEQ ID NO: 2481277 - DNA, 18 bp, Homo sapiens
cagccaactagcccctgg

SEQ ID NO: 2481278 - DNA, 15 bp, Homo sapiens
cagccaagcacctcc

SEQ ID NO: 2481279 - DNA, 14 bp, Homo sapiens
cagccacacttctc

SEQ ID NO: 2481280 - DNA, 17 bp, Homo sapiens
cagccacacttctcagg

SEQ ID NO: 2481281 - DNA, 20 bp, Homo sapiens
cagccacacttctcaggaca

SEQ ID NO: 2481282 - DNA, 21 bp, Homo sapiens
cagccacacttctcaggacac

SEQ ID NO: 2481283 - DNA, 14 bp, Homo sapiens
cagccaccctgagg

SEQ ID NO: 2481284 - DNA, 20 bp, Homo sapiens
cagccaccctgaggagtctg

SEQ ID NO: 2481285 - DNA, 16 bp, Homo sapiens
cagccaccctgagttg

SEQ ID NO: 2481286 - DNA, 16 bp, Homo sapiens
cagccaccgtttcttc

SEQ ID NO: 2481287 - DNA, 22 bp, Homo sapiens
cagccaccgtttcttcctgcca

SEQ ID NO: 2481288 - DNA, 13 bp, Homo sapiens
cagccagcacctg

SEQ ID NO: 2481289 - DNA, 16 bp, Homo sapiens
cagccagcacctggca

SEQ ID NO: 2481290 - DNA, 14 bp, Homo sapiens
cagccagcatctgg

SEQ ID NO: 2481291 - DNA, 15 bp, Homo sapiens
cagccagcatctggg

SEQ ID NO: 2481292 - DNA, 12 bp, Homo sapiens
cagccagccctg

SEQ ID NO: 2481293 - DNA, 17 bp, Homo sapiens
cagccagccctgcctgg

SEQ ID NO: 2481294 - DNA, 19 bp, Homo sapiens
cagccagccctgcctggag

SEQ ID NO: 2481295 - DNA, 21 bp, Homo sapiens
cagccagccctgcctggagga

SEQ ID NO: 2481296 - DNA, 17 bp, Homo sapiens
cagccaggcccagccga

SEQ ID NO: 2481297 - DNA, 24 bp, Homo sapiens
cagccagggagagcccaggagctc

SEQ ID NO: 2481298 - DNA, 15 bp, Homo sapiens
cagccaggggagcag

SEQ ID NO: 2481299 - DNA, 17 bp, Homo sapiens
cagccaggggagcagag

SEQ ID NO: 2481300 - DNA, 22 bp, Homo sapiens
cagccagtcccgtttcatttag

SEQ ID NO: 2481301 - DNA, 17 bp, Homo sapiens
cagccagtgccctgagc

SEQ ID NO: 2481302 - DNA, 22 bp, Homo sapiens
cagccattggctatttaaaact

SEQ ID NO: 2481303 - DNA, 23 bp, Homo sapiens
cagcccaagtgaggcagccgagg

SEQ ID NO: 2481304 - DNA, 12 bp, Homo sapiens
cagcccaccccc

SEQ ID NO: 2481305 - DNA, 17 bp, Homo sapiens
cagcccacccccggcag

SEQ ID NO: 2481306 - DNA, 22 bp, Homo sapiens
cagcccacccccggcagcagcc

SEQ ID NO: 2481307 - DNA, 12 bp, Homo sapiens
cagcccagagac

SEQ ID NO: 2481308 - DNA, 21 bp, Homo sapiens
cagcccagagacatacttgaa

SEQ ID NO: 2481309 - DNA, 12 bp, Homo sapiens
cagcccagccag

SEQ ID NO: 2481310 - DNA, 13 bp, Homo sapiens
cagcccagccagc

SEQ ID NO: 2481311 - DNA, 14 bp, Homo sapiens
cagcccagccagcg

SEQ ID NO: 2481312 - DNA, 16 bp, Homo sapiens
cagcccagccccactc

SEQ ID NO: 2481313 - DNA, 12 bp, Homo sapiens
cagcccaggaag

SEQ ID NO: 2481314 - DNA, 22 bp, Homo sapiens
cagcccaggaagtctcatctgg

SEQ ID NO: 2481315 - DNA, 16 bp, Homo sapiens
cagcccagggctcctg

SEQ ID NO: 2481316 - DNA, 17 bp, Homo sapiens
cagcccagggctcctgc

SEQ ID NO: 2481317 - DNA, 19 bp, Homo sapiens
cagcccagggctcctgcac

SEQ ID NO: 2481318 - DNA, 13 bp, Homo sapiens
cagcccatggaga

SEQ ID NO: 2481319 - DNA, 13 bp, Homo sapiens
cagccccacacca

SEQ ID NO: 2481320 - DNA, 18 bp, Homo sapiens
cagccccaccccagggca

SEQ ID NO: 2481321 - DNA, 15 bp, Homo sapiens
cagccccaccctggc

SEQ ID NO: 2481322 - DNA, 18 bp, Homo sapiens
cagcccccagctcccacc

SEQ ID NO: 2481323 - DNA, 19 bp, Homo sapiens
cagccccctaagagagcac

SEQ ID NO: 2481324 - DNA, 12 bp, Homo sapiens
cagccccctgac

SEQ ID NO: 2481325 - DNA, 13 bp, Homo sapiens
cagccccctgacc

SEQ ID NO: 2481326 - DNA, 14 bp, Homo sapiens
cagccccctgacca

SEQ ID NO: 2481327 - DNA, 20 bp, Homo sapiens
cagccccctgaccactcaga

SEQ ID NO: 2481328 - DNA, 22 bp, Homo sapiens
cagccccctgaccactcagaga

SEQ ID NO: 2481329 - DNA, 16 bp, Homo sapiens
cagcccctctggtcgc

SEQ ID NO: 2481330 - DNA, 20 bp, Homo sapiens
cagcccctcttggagaagtc

SEQ ID NO: 2481331 - DNA, 23 bp, Homo sapiens
cagcccctcttggagaagtctca

SEQ ID NO: 2481332 - DNA, 24 bp, Homo sapiens
cagcccctcttggagaagtctcag

SEQ ID NO: 2481333 - DNA, 13 bp, Homo sapiens
cagcccctggccc

SEQ ID NO: 2481334 - DNA, 21 bp, Homo sapiens
cagcccctggccccaggacct

SEQ ID NO: 2481335 - DNA, 18 bp, Homo sapiens
cagctgcactgatgctgc

SEQ ID NO: 2481336 - DNA, 17 bp, Homo sapiens
cagctgccccggcccct

SEQ ID NO: 2481337 - DNA, 19 bp, Homo sapiens
cagctgccccggcccctcc

SEQ ID NO: 2481338 - DNA, 23 bp, Homo sapiens
cagctgctccgaggacccaggaa

SEQ ID NO: 2481339 - DNA, 23 bp, Homo sapiens
cagctggaccctgaccagctccc

SEQ ID NO: 2481340 - DNA, 15 bp, Homo sapiens
cagctggaggcaggg

SEQ ID NO: 2481341 - DNA, 23 bp, Homo sapiens
cagctggatgagaatttgagtgc

SEQ ID NO: 2481342 - DNA, 12 bp, Homo sapiens
cagctggctcta

SEQ ID NO: 2481343 - DNA, 16 bp, Homo sapiens
cagctggctctacttc

SEQ ID NO: 2481344 - DNA, 22 bp, Homo sapiens
cagctggctctacttccccatg

SEQ ID NO: 2481345 - DNA, 15 bp, Homo sapiens
cagctgggctctgca

SEQ ID NO: 2481346 - DNA, 16 bp, Homo sapiens
cagctgggctctgcaa

SEQ ID NO: 2481347 - DNA, 16 bp, Homo sapiens
cagctggggtgcaggg

SEQ ID NO: 2481348 - DNA, 18 bp, Homo sapiens
cagctgggtcaggcaggg

SEQ ID NO: 2481349 - DNA, 20 bp, Homo sapiens
cagctgggtcaggcagggtg

SEQ ID NO: 2481350 - DNA, 22 bp, Homo sapiens
cagctggtgtagctacagagaa

SEQ ID NO: 2481351 - DNA, 14 bp, Homo sapiens
cagctgtatagctg

SEQ ID NO: 2481352 - DNA, 16 bp, Homo sapiens
cagctgtcaaggctca

SEQ ID NO: 2481353 - DNA, 16 bp, Homo sapiens
cagctgtccccccact

SEQ ID NO: 2481354 - DNA, 18 bp, Homo sapiens
cagctgtcttttggagga

SEQ ID NO: 2481355 - DNA, 11 bp, Homo sapiens
cagctgtgcct

SEQ ID NO: 2481356 - DNA, 11 bp, Homo sapiens
cagctgtgctt

SEQ ID NO: 2481357 - DNA, 16 bp, Homo sapiens
cagctgttttgttgac

SEQ ID NO: 2481358 - DNA, 17 bp, Homo sapiens
cagctgttttgttgaca

SEQ ID NO: 2481359 - DNA, 19 bp, Homo sapiens
cagctgttttgttgacatt

SEQ ID NO: 2481360 - DNA, 18 bp, Homo sapiens
cagcttagagttggccat

SEQ ID NO: 2481361 - DNA, 14 bp, Homo sapiens
cagcttagatttca

SEQ ID NO: 2481362 - DNA, 15 bp, Homo sapiens
cagcttagatttcat

SEQ ID NO: 2481363 - DNA, 14 bp, Homo sapiens
cagcttcaggtgac

SEQ ID NO: 2481364 - DNA, 20 bp, Homo sapiens
cagcttccttcagagagcag

SEQ ID NO: 2481365 - DNA, 21 bp, Homo sapiens
cagcttccttcagagagcagt

SEQ ID NO: 2481366 - DNA, 14 bp, Homo sapiens
cagcttctgccccc

SEQ ID NO: 2481367 - DNA, 17 bp, Homo sapiens
cagcttgacctgaggct

SEQ ID NO: 2481368 - DNA, 15 bp, Homo sapiens
cagcttgtagccagc

SEQ ID NO: 2481369 - DNA, 19 bp, Homo sapiens
cagcttgtagccagccggg

SEQ ID NO: 2481370 - DNA, 16 bp, Homo sapiens
cagcttgtctcttgcc

SEQ ID NO: 2481371 - DNA, 23 bp, Homo sapiens
cagcttgtctcttgcctgccact

SEQ ID NO: 2481372 - DNA, 15 bp, Homo sapiens
cagcttgtttacatg

SEQ ID NO: 2481373 - DNA, 14 bp, Homo sapiens
cagctttcctgtat

SEQ ID NO: 2481374 - DNA, 16 bp, Homo sapiens
caggaaaaggcctggg

SEQ ID NO: 2481375 - DNA, 18 bp, Homo sapiens
caggaaaaggcctggggt

SEQ ID NO: 2481376 - DNA, 13 bp, Homo sapiens
caggaaaattgaa

SEQ ID NO: 2481377 - DNA, 20 bp, Homo sapiens
caggaaatgaaaatgtcttg

SEQ ID NO: 2481378 - DNA, 16 bp, Homo sapiens
caggaaggagctgcct

SEQ ID NO: 2481379 - DNA, 21 bp, Homo sapiens
caggaaggagctgcctggacc

SEQ ID NO: 2481380 - DNA, 16 bp, Homo sapiens
caggaatcagtttaaa

SEQ ID NO: 2481381 - DNA, 14 bp, Homo sapiens
caggaatggctgca

SEQ ID NO: 2481382 - DNA, 16 bp, Homo sapiens
caggaatttcccagga

SEQ ID NO: 2481383 - DNA, 17 bp, Homo sapiens
caggaatttcccaggac

SEQ ID NO: 2481384 - DNA, 19 bp, Homo sapiens
caggaatttcccaggaccc

SEQ ID NO: 2481385 - DNA, 16 bp, Homo sapiens
caggacacaggcctgt

SEQ ID NO: 2481386 - DNA, 18 bp, Homo sapiens
caggacacaggcctgtgt

SEQ ID NO: 2481387 - DNA, 20 bp, Homo sapiens
caggacacaggcctgtgtag

SEQ ID NO: 2481388 - DNA, 22 bp, Homo sapiens
caggacacaggcctgtgtagct

SEQ ID NO: 2481389 - DNA, 18 bp, Homo sapiens
caggacatgcggtagcca

SEQ ID NO: 2481390 - DNA, 20 bp, Homo sapiens
caggacatgcggtagccagc

SEQ ID NO: 2481391 - DNA, 12 bp, Homo sapiens
caggaccacagg

SEQ ID NO: 2481392 - DNA, 16 bp, Homo sapiens
caggaccacaggctca

SEQ ID NO: 2481393 - DNA, 17 bp, Homo sapiens
caggaccacaggctcag

SEQ ID NO: 2481394 - DNA, 23 bp, Homo sapiens
caggaccacaggctcaggcaggg

SEQ ID NO: 2481395 - DNA, 12 bp, Homo sapiens
caggaccagctc

SEQ ID NO: 2481396 - DNA, 13 bp, Homo sapiens
caggaccagctca

SEQ ID NO: 2481397 - DNA, 17 bp, Homo sapiens
caggaccagctcaggac

SEQ ID NO: 2481398 - DNA, 19 bp, Homo sapiens
caggaccagtcccagagca

SEQ ID NO: 2481399 - DNA, 20 bp, Homo sapiens
caggaccagtcccagagcag

SEQ ID NO: 2481400 - DNA, 13 bp, Homo sapiens
caggacccagagg

SEQ ID NO: 2481401 - DNA, 15 bp, Homo sapiens
caggacccagaggaa

SEQ ID NO: 2481402 - DNA, 13 bp, Homo sapiens
caggaccctgaag

SEQ ID NO: 2481403 - DNA, 14 bp, Homo sapiens
caggaccctgaagg

SEQ ID NO: 2481404 - DNA, 15 bp, Homo sapiens
caggaccctgaaggg

SEQ ID NO: 2481405 - DNA, 14 bp, Homo sapiens
caggaccctggacc

SEQ ID NO: 2481406 - DNA, 17 bp, Homo sapiens
caggaccctggacccag

SEQ ID NO: 2481407 - DNA, 22 bp, Homo sapiens
caggaccctggacccagccaga

SEQ ID NO: 2481408 - DNA, 14 bp, Homo sapiens
caggacctggctgc

SEQ ID NO: 2481409 - DNA, 21 bp, Homo sapiens
caggaccttcgggctgtgccc

SEQ ID NO: 2481410 - DNA, 21 bp, Homo sapiens
caggactaacactcagaagcc

SEQ ID NO: 2481411 - DNA, 17 bp, Homo sapiens
caggactccaggcccaa

SEQ ID NO: 2481412 - DNA, 16 bp, Homo sapiens
caggactctgcagcct

SEQ ID NO: 2481413 - DNA, 19 bp, Homo sapiens
caggactctgcagcctcag

SEQ ID NO: 2481414 - DNA, 18 bp, Homo sapiens
caggactgatgtctccta

SEQ ID NO: 2481415 - DNA, 13 bp, Homo sapiens
caggactgggagc

SEQ ID NO: 2481416 - DNA, 18 bp, Homo sapiens
caggactgggagccccca

SEQ ID NO: 2481417 - DNA, 22 bp, Homo sapiens
caggactgggagcccccagcct

SEQ ID NO: 2481418 - DNA, 16 bp, Homo sapiens
caggagaagctcagct

SEQ ID NO: 2481419 - DNA, 19 bp, Homo sapiens
caggagaaggccaattcct

SEQ ID NO: 2481420 - DNA, 21 bp, Homo sapiens
caggagaaggccaattcctat

SEQ ID NO: 2481421 - DNA, 17 bp, Homo sapiens
caggagcacggctctgt

SEQ ID NO: 2481422 - DNA, 19 bp, Homo sapiens
caggagcacggctctgtcc

SEQ ID NO: 2481423 - DNA, 11 bp, Homo sapiens
caggagcctgt

SEQ ID NO: 2481424 - DNA, 22 bp, Homo sapiens
caggagctccagtgtcctgagc

SEQ ID NO: 2481425 - DNA, 13 bp, Homo sapiens
caggagctcccct

SEQ ID NO: 2481426 - DNA, 21 bp, Homo sapiens
caggagctcccctccccaact

SEQ ID NO: 2481427 - DNA, 19 bp, Homo sapiens
caggaggacccagggctct

SEQ ID NO: 2481428 - DNA, 15 bp, Homo sapiens
caggaggcaggacct

SEQ ID NO: 2481429 - DNA, 14 bp, Homo sapiens
caggaggcctagga

SEQ ID NO: 2481430 - DNA, 18 bp, Homo sapiens
caggagggacaaaggagc

SEQ ID NO: 2481431 - DNA, 24 bp, Homo sapiens
caggagggacaaaggagcctgtga

SEQ ID NO: 2481432 - DNA, 23 bp, Homo sapiens
caggaggggggagggaagggagc

SEQ ID NO: 2481433 - DNA, 23 bp, Homo sapiens
caggagggggtcgtggagagcta

SEQ ID NO: 2481434 - DNA, 14 bp, Homo sapiens
caggagtagctgag

SEQ ID NO: 2481435 - DNA, 20 bp, Homo sapiens
caggagtagctgagctcaca

SEQ ID NO: 2481436 - DNA, 14 bp, Homo sapiens
caggagtccacttt

SEQ ID NO: 2481437 - DNA, 21 bp, Homo sapiens
caggagtgtcctcttccctct

SEQ ID NO: 2481438 - DNA, 16 bp, Homo sapiens
caggatagagactgga

SEQ ID NO: 2481439 - DNA, 17 bp, Homo sapiens
caggatccaagctaagc

SEQ ID NO: 2481440 - DNA, 19 bp, Homo sapiens
caggatctatttttggagg

SEQ ID NO: 2481441 - DNA, 21 bp, Homo sapiens
caggatctatttttggaggtt

SEQ ID NO: 2481442 - DNA, 18 bp, Homo sapiens
caggatctcaccaggcag

SEQ ID NO: 2481443 - DNA, 19 bp, Homo sapiens
caggatctcaccaggcagc

SEQ ID NO: 2481444 - DNA, 22 bp, Homo sapiens
caggatgagggaaaagaaaaag

SEQ ID NO: 2481445 - DNA, 18 bp, Homo sapiens
caggattgcgagagatgt

SEQ ID NO: 2481446 - DNA, 19 bp, Homo sapiens
caggattgcgagagatgtg

SEQ ID NO: 2481447 - DNA, 20 bp, Homo sapiens
caggattgcgagagatgtgt

SEQ ID NO: 2481448 - DNA, 14 bp, Homo sapiens
caggattggggaag

SEQ ID NO: 2481449 - DNA, 13 bp, Homo sapiens
caggcaaggctgt

SEQ ID NO: 2481450 - DNA, 15 bp, Homo sapiens
caggcaccaaaagaa

SEQ ID NO: 2481451 - DNA, 14 bp, Homo sapiens
caggcactgcaaac

SEQ ID NO: 2481452 - DNA, 21 bp, Homo sapiens
caggcactgcaaaccgccacc

SEQ ID NO: 2481453 - DNA, 15 bp, Homo sapiens
caggcactgccctgg

SEQ ID NO: 2481454 - DNA, 18 bp, Homo sapiens
caggcactgggcatgagg

SEQ ID NO: 2481455 - DNA, 21 bp, Homo sapiens
caggcacttggcagccttgtg

SEQ ID NO: 2481456 - DNA, 15 bp, Homo sapiens
caggcagaggcccag

SEQ ID NO: 2481457 - DNA, 18 bp, Homo sapiens
caggcagaggcccaggct

SEQ ID NO: 2481458 - DNA, 15 bp, Homo sapiens
caggcagatccagga

SEQ ID NO: 2481459 - DNA, 15 bp, Homo sapiens
caggcagatgacctc

SEQ ID NO: 2481460 - DNA, 14 bp, Homo sapiens
caggcagccagcat

SEQ ID NO: 2481461 - DNA, 16 bp, Homo sapiens
caggcagccagcatct

SEQ ID NO: 2481462 - DNA, 12 bp, Homo sapiens
caggcagccagt

SEQ ID NO: 2481463 - DNA, 15 bp, Homo sapiens
caggcagccagtgcc

SEQ ID NO: 2481464 - DNA, 13 bp, Homo sapiens
caggcagcctctg

SEQ ID NO: 2481465 - DNA, 16 bp, Homo sapiens
caggcagcctctgggg

SEQ ID NO: 2481466 - DNA, 14 bp, Homo sapiens
caggcagggctctc

SEQ ID NO: 2481467 - DNA, 19 bp, Homo sapiens
caggcagggctctcctggc

SEQ ID NO: 2481468 - DNA, 20 bp, Homo sapiens
caggcagggctctcctggct

SEQ ID NO: 2481469 - DNA, 13 bp, Homo sapiens
caggcaggggcct

SEQ ID NO: 2481470 - DNA, 15 bp, Homo sapiens
caggcaggggcctcc

SEQ ID NO: 2481471 - DNA, 21 bp, Homo sapiens
caggcaggggcctccatgggc

SEQ ID NO: 2481472 - DNA, 12 bp, Homo sapiens
caggcatcctcc

SEQ ID NO: 2481473 - DNA, 16 bp, Homo sapiens
caggcatttcctgggt

SEQ ID NO: 2481474 - DNA, 21 bp, Homo sapiens
caggccaaaggggacctggaa

SEQ ID NO: 2481475 - DNA, 16 bp, Homo sapiens
caggccacacttcaaa

SEQ ID NO: 2481476 - DNA, 20 bp, Homo sapiens
caggccacctccccagcatt

SEQ ID NO: 2481477 - DNA, 13 bp, Homo sapiens
caggccagagcca

SEQ ID NO: 2481478 - DNA, 12 bp, Homo sapiens
caggccagctgt

SEQ ID NO: 2481479 - DNA, 13 bp, Homo sapiens
caggccaggactc

SEQ ID NO: 2481480 - DNA, 18 bp, Homo sapiens
caggccaggactctgcag

SEQ ID NO: 2481481 - DNA, 20 bp, Homo sapiens
caggccaggactctgcagcc

SEQ ID NO: 2481482 - DNA, 23 bp, Homo sapiens
caggccaggactctgcagcctca

SEQ ID NO: 2481483 - DNA, 12 bp, Homo sapiens
caggccaggcat

SEQ ID NO: 2481484 - DNA, 20 bp, Homo sapiens
caggcccagccgaccccctc

SEQ ID NO: 2481485 - DNA, 20 bp, Homo sapiens
caggccccactccttcctga

SEQ ID NO: 2481486 - DNA, 23 bp, Homo sapiens
caggccccactccttcctgattg

SEQ ID NO: 2481487 - DNA, 15 bp, Homo sapiens
caggccccaggaaag

SEQ ID NO: 2481488 - DNA, 14 bp, Homo sapiens
caggccccatgacc

SEQ ID NO: 2481489 - DNA, 19 bp, Homo sapiens
caggccccatgacctccag

SEQ ID NO: 2481490 - DNA, 22 bp, Homo sapiens
caggccccatgacctccagctt

SEQ ID NO: 2481491 - DNA, 21 bp, Homo sapiens
caggcccccgccttggcctgt

SEQ ID NO: 2481492 - DNA, 18 bp, Homo sapiens
caggcccggatgcagagg

SEQ ID NO: 2481493 - DNA, 22 bp, Homo sapiens
caggccctccctgttccccaga

SEQ ID NO: 2481494 - DNA, 23 bp, Homo sapiens
caggccctccctgttccccagag

SEQ ID NO: 2481495 - DNA, 22 bp, Homo sapiens
caggcctctccctcctccagga

SEQ ID NO: 2481496 - DNA, 22 bp, Homo sapiens
caggcctgaaagaggctgaggc

SEQ ID NO: 2481497 - DNA, 16 bp, Homo sapiens
caggcctgtgtagctg

SEQ ID NO: 2481498 - DNA, 19 bp, Homo sapiens
caggcctgtgtagctgtga

SEQ ID NO: 2481499 - DNA, 20 bp, Homo sapiens
caggcctgtgtagctgtgac

SEQ ID NO: 2481500 - DNA, 17 bp, Homo sapiens
caggcctttgagctcag

SEQ ID NO: 2481501 - DNA, 22 bp, Homo sapiens
caggcgaggcccttggcgggca

SEQ ID NO: 2481502 - DNA, 19 bp, Homo sapiens
caggcgatccacctgtctc

SEQ ID NO: 2481503 - DNA, 15 bp, Homo sapiens
caggcgctaattcaa

SEQ ID NO: 2481504 - DNA, 22 bp, Homo sapiens
caggctaatttttttgtatttt

SEQ ID NO: 2481505 - DNA, 15 bp, Homo sapiens
caggctaggccagca

SEQ ID NO: 2481506 - DNA, 22 bp, Homo sapiens
caggctaggccagcaggggctg

SEQ ID NO: 2481507 - DNA, 21 bp, Homo sapiens
caggctcaggcaggggcctcc

SEQ ID NO: 2481508 - DNA, 19 bp, Homo sapiens
caggctcccagggacacct

SEQ ID NO: 2481509 - DNA, 22 bp, Homo sapiens
caggctcccagggacacctggg

SEQ ID NO: 2481510 - DNA, 23 bp, Homo sapiens
caggctcggcctgcccccacccc

SEQ ID NO: 2481511 - DNA, 21 bp, Homo sapiens
caggctcgtggactgagtggg

SEQ ID NO: 2481512 - DNA, 17 bp, Homo sapiens
caggctgaccacagcac

SEQ ID NO: 2481513 - DNA, 22 bp, Homo sapiens
caggctgaccacagcacagcca

SEQ ID NO: 2481514 - DNA, 15 bp, Homo sapiens
caggctgcctgagtc

SEQ ID NO: 2481515 - DNA, 20 bp, Homo sapiens
caggctggaagatagctgtg

SEQ ID NO: 2481516 - DNA, 12 bp, Homo sapiens
caggctggccag

SEQ ID NO: 2481517 - DNA, 16 bp, Homo sapiens
caggctggccagtcca

SEQ ID NO: 2481518 - DNA, 20 bp, Homo sapiens
caggctggctccagatgcag

SEQ ID NO: 2481519 - DNA, 13 bp, Homo sapiens
caggctgggccat

SEQ ID NO: 2481520 - DNA, 23 bp, Homo sapiens
caggctgggccatgtccaaagag

SEQ ID NO: 2481521 - DNA, 21 bp, Homo sapiens
caggctgtaggaaatctagtt

SEQ ID NO: 2481522 - DNA, 16 bp, Homo sapiens
caggcttctgagcagc

SEQ ID NO: 2481523 - DNA, 21 bp, Homo sapiens
caggcttctgagcagcgagcc

SEQ ID NO: 2481524 - DNA, 15 bp, Homo sapiens
cagggaaaataggca

SEQ ID NO: 2481525 - DNA, 20 bp, Homo sapiens
cagggaaaattatttgcata

SEQ ID NO: 2481526 - DNA, 15 bp, Homo sapiens
cagggaaggaggagc

SEQ ID NO: 2481527 - DNA, 15 bp, Homo sapiens
cagggaaggcaggca

SEQ ID NO: 2481528 - DNA, 20 bp, Homo sapiens
cagggaaggcaggcagggct

SEQ ID NO: 2481529 - DNA, 18 bp, Homo sapiens
cagggaattaggccccca

SEQ ID NO: 2481530 - DNA, 16 bp, Homo sapiens
cagggacagaggcccc

SEQ ID NO: 2481531 - DNA, 21 bp, Homo sapiens
cagggacagaggccccagcct

SEQ ID NO: 2481532 - DNA, 23 bp, Homo sapiens
cagggacagaggccccagcctcc

SEQ ID NO: 2481533 - DNA, 13 bp, Homo sapiens
cagggagaagctc

SEQ ID NO: 2481534 - DNA, 16 bp, Homo sapiens
cagggagagcccagga

SEQ ID NO: 2481535 - DNA, 21 bp, Homo sapiens
cagggagcggccggccagccc

SEQ ID NO: 2481536 - DNA, 17 bp, Homo sapiens
cagggagctgggcttcc

SEQ ID NO: 2481537 - DNA, 15 bp, Homo sapiens
cagggaggccgaagc

SEQ ID NO: 2481538 - DNA, 16 bp, Homo sapiens
cagggaggctggtcct

SEQ ID NO: 2481539 - DNA, 20 bp, Homo sapiens
cagggatgtgggttccacag

SEQ ID NO: 2481540 - DNA, 22 bp, Homo sapiens
cagggatgtgggttccacagac

SEQ ID NO: 2481541 - DNA, 18 bp, Homo sapiens
cagggcaaagccaggtcc

SEQ ID NO: 2481542 - DNA, 20 bp, Homo sapiens
cagggcaaagccaggtccct

SEQ ID NO: 2481543 - DNA, 18 bp, Homo sapiens
cagggcaatgatgaatga

SEQ ID NO: 2481544 - DNA, 13 bp, Homo sapiens
cagggcacaggag

SEQ ID NO: 2481545 - DNA, 14 bp, Homo sapiens
cagggcacaggagc

SEQ ID NO: 2481546 - DNA, 15 bp, Homo sapiens
cagggcacaggagct

SEQ ID NO: 2481547 - DNA, 16 bp, Homo sapiens
cagggcagccagggag

SEQ ID NO: 2481548 - DNA, 15 bp, Homo sapiens
cagggcagcgccagg

SEQ ID NO: 2481549 - DNA, 16 bp, Homo sapiens
cagggcagcgccaggc

SEQ ID NO: 2481550 - DNA, 14 bp, Homo sapiens
cagggcagtacctg

SEQ ID NO: 2481551 - DNA, 19 bp, Homo sapiens
cagggcagtacctgagggt

SEQ ID NO: 2481552 - DNA, 16 bp, Homo sapiens
cagggcatctctgggc

SEQ ID NO: 2481553 - DNA, 15 bp, Homo sapiens
cagggcatgccacgt

SEQ ID NO: 2481554 - DNA, 18 bp, Homo sapiens
cagggccacgctccagct

SEQ ID NO: 2481555 - DNA, 14 bp, Homo sapiens
cagggccagcctct

SEQ ID NO: 2481556 - DNA, 17 bp, Homo sapiens
cagggccaggcctctcc

SEQ ID NO: 2481557 - DNA, 22 bp, Homo sapiens
cagggccatgctgaggcctggg

SEQ ID NO: 2481558 - DNA, 23 bp, Homo sapiens
cagggccatgctgaggcctgggc

SEQ ID NO: 2481559 - DNA, 12 bp, Homo sapiens
cagggcccagag

SEQ ID NO: 2481560 - DNA, 13 bp, Homo sapiens
cagggcccagagc

SEQ ID NO: 2481561 - DNA, 15 bp, Homo sapiens
cagggcccagagccc

SEQ ID NO: 2481562 - DNA, 18 bp, Homo sapiens
cagggcccagagcccagc

SEQ ID NO: 2481563 - DNA, 16 bp, Homo sapiens
cagggcccccatctca

SEQ ID NO: 2481564 - DNA, 18 bp, Homo sapiens
cagggcccctcaccctgc

SEQ ID NO: 2481565 - DNA, 22 bp, Homo sapiens
cagggccggggaactggccaag

SEQ ID NO: 2481566 - DNA, 23 bp, Homo sapiens
cagggcctctgtcaattgtacgc

SEQ ID NO: 2481567 - DNA, 14 bp, Homo sapiens
cagggcctgtctca

SEQ ID NO: 2481568 - DNA, 16 bp, Homo sapiens
cagggcgggcagaggg

SEQ ID NO: 2481569 - DNA, 15 bp, Homo sapiens
cagggcgggggtggc

SEQ ID NO: 2481570 - DNA, 16 bp, Homo sapiens
cagggctaccctgagc

SEQ ID NO: 2481571 - DNA, 22 bp, Homo sapiens
cagggctaccctgagctgaggc

SEQ ID NO: 2481572 - DNA, 14 bp, Homo sapiens
cagggctagtgact

SEQ ID NO: 2481573 - DNA, 15 bp, Homo sapiens
cagggctagtgactt

SEQ ID NO: 2481574 - DNA, 12 bp, Homo sapiens
cagggctcctgg

SEQ ID NO: 2481575 - DNA, 13 bp, Homo sapiens
cagggctcctggg

SEQ ID NO: 2481576 - DNA, 14 bp, Homo sapiens
cagggctccttgtg

SEQ ID NO: 2481577 - DNA, 23 bp, Homo sapiens
cagggctccttgtgggcctgggc

SEQ ID NO: 2481578 - DNA, 15 bp, Homo sapiens
cagggctctcctggc

SEQ ID NO: 2481579 - DNA, 16 bp, Homo sapiens
cagggctctcctggct

SEQ ID NO: 2481580 - DNA, 22 bp, Homo sapiens
cagggctttactccgtaacaga

SEQ ID NO: 2481581 - DNA, 17 bp, Homo sapiens
caggggaacactgggga

SEQ ID NO: 2481582 - DNA, 21 bp, Homo sapiens
caggggagcagaggggcagag

SEQ ID NO: 2481583 - DNA, 22 bp, Homo sapiens
caggggcctggagatcctcctg

SEQ ID NO: 2481584 - DNA, 16 bp, Homo sapiens
caggggcttcctggtg

SEQ ID NO: 2481585 - DNA, 19 bp, Homo sapiens
cagggggagctgggcctgg

SEQ ID NO: 2481586 - DNA, 12 bp, Homo sapiens
cagggggctgct

SEQ ID NO: 2481587 - DNA, 14 bp, Homo sapiens
cagggggctgctgc

SEQ ID NO: 2481588 - DNA, 16 bp, Homo sapiens
cagggggtctggctgg

SEQ ID NO: 2481589 - DNA, 20 bp, Homo sapiens
cagggggtctggctggtgtt

SEQ ID NO: 2481590 - DNA, 19 bp, Homo sapiens
caggggtctgagctccagc

SEQ ID NO: 2481591 - DNA, 15 bp, Homo sapiens
caggggttagagcag

SEQ ID NO: 2481592 - DNA, 13 bp, Homo sapiens
cagggtatgaaga

SEQ ID NO: 2481593 - DNA, 16 bp, Homo sapiens
cagggtccctctgtgt

SEQ ID NO: 2481594 - DNA, 23 bp, Homo sapiens
cagggtccttttgacactgctct

SEQ ID NO: 2481595 - DNA, 18 bp, Homo sapiens
cagggtctccagaaagcc

SEQ ID NO: 2481596 - DNA, 19 bp, Homo sapiens
cagggtctccagaaagccc

SEQ ID NO: 2481597 - DNA, 14 bp, Homo sapiens
cagggtctgctctt

SEQ ID NO: 2481598 - DNA, 13 bp, Homo sapiens
cagggtgtgtgct

SEQ ID NO: 2481599 - DNA, 19 bp, Homo sapiens
cagggttgaccccagagga

SEQ ID NO: 2481600 - DNA, 20 bp, Homo sapiens
cagggttgaccccagaggat

SEQ ID NO: 2481601 - DNA, 19 bp, Homo sapiens
cagggtttcaccatgttgc

SEQ ID NO: 2481602 - DNA, 16 bp, Homo sapiens
cagggttttaactttg

SEQ ID NO: 2481603 - DNA, 17 bp, Homo sapiens
cagggttttaactttgt

SEQ ID NO: 2481604 - DNA, 22 bp, Homo sapiens
caggtagaattatctaatttat

SEQ ID NO: 2481605 - DNA, 23 bp, Homo sapiens
caggtagaattatctaatttata

SEQ ID NO: 2481606 - DNA, 18 bp, Homo sapiens
caggtagctgaaagggga

SEQ ID NO: 2481607 - DNA, 14 bp, Homo sapiens
caggtaggccaagg

SEQ ID NO: 2481608 - DNA, 18 bp, Homo sapiens
caggtaggggcccctctc

SEQ ID NO: 2481609 - DNA, 19 bp, Homo sapiens
caggtaggggcccctctca

SEQ ID NO: 2481610 - DNA, 23 bp, Homo sapiens
caggtaggggcccctctcagccc

SEQ ID NO: 2481611 - DNA, 16 bp, Homo sapiens
caggtatacctcactt

SEQ ID NO: 2481612 - DNA, 15 bp, Homo sapiens
caggtatatactttg

SEQ ID NO: 2481613 - DNA, 16 bp, Homo sapiens
caggtcagccactgtt

SEQ ID NO: 2481614 - DNA, 21 bp, Homo sapiens
caggtccaatgagctttctga

SEQ ID NO: 2481615 - DNA, 13 bp, Homo sapiens
caggtccagctct

SEQ ID NO: 2481616 - DNA, 16 bp, Homo sapiens
caggtccctccccttc

SEQ ID NO: 2481617 - DNA, 23 bp, Homo sapiens
caggtctgggtggggcccaggcc

SEQ ID NO: 2481618 - DNA, 17 bp, Homo sapiens
caggtgaaaggaaatta

SEQ ID NO: 2481619 - DNA, 21 bp, Homo sapiens
caggtgctacacccttttcca

SEQ ID NO: 2481620 - DNA, 13 bp, Homo sapiens
caggtgctggggc

SEQ ID NO: 2481621 - DNA, 18 bp, Homo sapiens
caggtgctggggcctggt

SEQ ID NO: 2481622 - DNA, 15 bp, Homo sapiens
caggtgctggtcccg

SEQ ID NO: 2481623 - DNA, 22 bp, Homo sapiens
caggtggatctatttcatgttt

SEQ ID NO: 2481624 - DNA, 15 bp, Homo sapiens
caggtggccctactg

SEQ ID NO: 2481625 - DNA, 14 bp, Homo sapiens
caggttcccaagct

SEQ ID NO: 2481626 - DNA, 15 bp, Homo sapiens
caggttcccaagctc

SEQ ID NO: 2481627 - DNA, 14 bp, Homo sapiens
caggttcccactta

SEQ ID NO: 2481628 - DNA, 16 bp, Homo sapiens
caggttccctcccaga

SEQ ID NO: 2481629 - DNA, 24 bp, Homo sapiens
caggttctccgttagctcctgtgg

SEQ ID NO: 2481630 - DNA, 12 bp, Homo sapiens
caggttcttgtt

SEQ ID NO: 2481631 - DNA, 21 bp, Homo sapiens
caggttggctctgccagtcct

SEQ ID NO: 2481632 - DNA, 13 bp, Homo sapiens
caggtttttcctt

SEQ ID NO: 2481633 - DNA, 15 bp, Homo sapiens
caggtttttcctttt

SEQ ID NO: 2481634 - DNA, 18 bp, Homo sapiens
cagtaaaccactgaaaaa

SEQ ID NO: 2481635 - DNA, 16 bp, Homo sapiens
cagtaaataactggaa

SEQ ID NO: 2481636 - DNA, 18 bp, Homo sapiens
cagtaaataactggaaaa

SEQ ID NO: 2481637 - DNA, 22 bp, Homo sapiens
cagtaaataactggaaaacaga

SEQ ID NO: 2481638 - DNA, 19 bp, Homo sapiens
cagtaacgcgtcttcctga

SEQ ID NO: 2481639 - DNA, 20 bp, Homo sapiens
cagtaacgcgtcttcctgag

SEQ ID NO: 2481640 - DNA, 21 bp, Homo sapiens
cagtaacgcgtcttcctgagt

SEQ ID NO: 2481641 - DNA, 23 bp, Homo sapiens
cagtaccccatggagctgggcta

SEQ ID NO: 2481642 - DNA, 20 bp, Homo sapiens
cagtaccctctcagctccag

SEQ ID NO: 2481643 - DNA, 22 bp, Homo sapiens
cagtaccctctcagctccaggt

SEQ ID NO: 2481644 - DNA, 15 bp, Homo sapiens
cagtacctgagggtc

SEQ ID NO: 2481645 - DNA, 23 bp, Homo sapiens
cagtacctgagggtctgtaggtt

SEQ ID NO: 2481646 - DNA, 23 bp, Homo sapiens
cagtagaggctatggacagggca

SEQ ID NO: 2481647 - DNA, 15 bp, Homo sapiens
cagtaggagcccagc

SEQ ID NO: 2481648 - DNA, 14 bp, Homo sapiens
cagtagttcacata

SEQ ID NO: 2481649 - DNA, 17 bp, Homo sapiens
cccaggctcggcctgcc

SEQ ID NO: 2481650 - DNA, 17 bp, Homo sapiens
cccaggctcgtggactg

SEQ ID NO: 2481651 - DNA, 21 bp, Homo sapiens
cccaggctgggaactcatctg

SEQ ID NO: 2481652 - DNA, 16 bp, Homo sapiens
cccaggctggtctcaa

SEQ ID NO: 2481653 - DNA, 17 bp, Homo sapiens
cccagggaagcagcagc

SEQ ID NO: 2481654 - DNA, 23 bp, Homo sapiens
cccagggaagcagcagcctcgcc

SEQ ID NO: 2481655 - DNA, 18 bp, Homo sapiens
cccagggaggccgaagct

SEQ ID NO: 2481656 - DNA, 15 bp, Homo sapiens
cccagggcacaggag

SEQ ID NO: 2481657 - DNA, 18 bp, Homo sapiens
cccagggcacaggagcta

SEQ ID NO: 2481658 - DNA, 22 bp, Homo sapiens
cccagggcacaggagctacctg

SEQ ID NO: 2481659 - DNA, 13 bp, Homo sapiens
cccagggcagcca

SEQ ID NO: 2481660 - DNA, 15 bp, Homo sapiens
cccagggcagccagg

SEQ ID NO: 2481661 - DNA, 14 bp, Homo sapiens
cccagggcccagag

SEQ ID NO: 2481662 - DNA, 22 bp, Homo sapiens
cccagggcccagagcccagctc

SEQ ID NO: 2481663 - DNA, 16 bp, Homo sapiens
cccagggctctgtaag

SEQ ID NO: 2481664 - DNA, 21 bp, Homo sapiens
cccagggctgggaggaaggac

SEQ ID NO: 2481665 - DNA, 23 bp, Homo sapiens
cccagggctgtaactgccaggct

SEQ ID NO: 2481666 - DNA, 23 bp, Homo sapiens
cccaggtaggggcccctctcagc

SEQ ID NO: 2481667 - DNA, 14 bp, Homo sapiens
cccaggtctgggtg

SEQ ID NO: 2481668 - DNA, 22 bp, Homo sapiens
cccaggtctgggtggggcccag

SEQ ID NO: 2481669 - DNA, 14 bp, Homo sapiens
cccaggttggctct

SEQ ID NO: 2481670 - DNA, 21 bp, Homo sapiens
cccaggttggctctgccagtc

SEQ ID NO: 2481671 - DNA, 22 bp, Homo sapiens
cccagtacacaggggcttgact

SEQ ID NO: 2481672 - DNA, 20 bp, Homo sapiens
cccagtgcccccactgacca

SEQ ID NO: 2481673 - DNA, 22 bp, Homo sapiens
cccagtgcccccactgaccaga

SEQ ID NO: 2481674 - DNA, 14 bp, Homo sapiens
cccagtgccctctc

SEQ ID NO: 2481675 - DNA, 18 bp, Homo sapiens
cccagtgccctctcccct

SEQ ID NO: 2481676 - DNA, 12 bp, Homo sapiens
cccagtgtggct

SEQ ID NO: 2481677 - DNA, 14 bp, Homo sapiens
cccagttaatcttg

SEQ ID NO: 2481678 - DNA, 14 bp, Homo sapiens
cccagttcaccctg

SEQ ID NO: 2481679 - DNA, 18 bp, Homo sapiens
cccagttcctgtggctcc

SEQ ID NO: 2481680 - DNA, 20 bp, Homo sapiens
cccagttgcactcaggtgac

SEQ ID NO: 2481681 - DNA, 17 bp, Homo sapiens
cccagttgccatctgcg

SEQ ID NO: 2481682 - DNA, 21 bp, Homo sapiens
cccagtttctaaactggagac

SEQ ID NO: 2481683 - DNA, 22 bp, Homo sapiens
cccagtttctaaactggagact

SEQ ID NO: 2481684 - DNA, 22 bp, Homo sapiens
cccatcacctactcacacaggc

SEQ ID NO: 2481685 - DNA, 16 bp, Homo sapiens
cccatcatcctctggc

SEQ ID NO: 2481686 - DNA, 15 bp, Homo sapiens
cccatcccacaccct

SEQ ID NO: 2481687 - DNA, 18 bp, Homo sapiens
cccatccccagcgattcc

SEQ ID NO: 2481688 - DNA, 15 bp, Homo sapiens
cccatcctgaccagc

SEQ ID NO: 2481689 - DNA, 23 bp, Homo sapiens
cccatctcaggccagagccaagg

SEQ ID NO: 2481690 - DNA, 13 bp, Homo sapiens
cccatctctccct

SEQ ID NO: 2481691 - DNA, 18 bp, Homo sapiens
cccatctctccctcccct

SEQ ID NO: 2481692 - DNA, 23 bp, Homo sapiens
cccatctctccctcccctgccat

SEQ ID NO: 2481693 - DNA, 18 bp, Homo sapiens
cccatgaccccaaagcca

SEQ ID NO: 2481694 - DNA, 14 bp, Homo sapiens
cccatgacctccag

SEQ ID NO: 2481695 - DNA, 15 bp, Homo sapiens
cccatgacctccagc

SEQ ID NO: 2481696 - DNA, 16 bp, Homo sapiens
cccatgacctccagct

SEQ ID NO: 2481697 - DNA, 14 bp, Homo sapiens
cccatgcactgtga

SEQ ID NO: 2481698 - DNA, 18 bp, Homo sapiens
cccatgcactgtgaagga

SEQ ID NO: 2481699 - DNA, 19 bp, Homo sapiens
cccatgcactgtgaaggac

SEQ ID NO: 2481700 - DNA, 15 bp, Homo sapiens
cccatggacaggctg

SEQ ID NO: 2481701 - DNA, 21 bp, Homo sapiens
cccatggagattgacctggat

SEQ ID NO: 2481702 - DNA, 23 bp, Homo sapiens
cccatggagattgacctggatgg

SEQ ID NO: 2481703 - DNA, 15 bp, Homo sapiens
cccatggcattttat

SEQ ID NO: 2481704 - DNA, 12 bp, Homo sapiens
cccattcctgaa

SEQ ID NO: 2481705 - DNA, 13 bp, Homo sapiens
cccattcctgaag

SEQ ID NO: 2481706 - DNA, 19 bp, Homo sapiens
cccatttatagatggggga

SEQ ID NO: 2481707 - DNA, 17 bp, Homo sapiens
cccattttgaatcacat

SEQ ID NO: 2481708 - DNA, 12 bp, Homo sapiens
cccatttttcct

SEQ ID NO: 2481709 - DNA, 22 bp, Homo sapiens
ccccaaacaccttccagctcct

SEQ ID NO: 2481710 - DNA, 19 bp, Homo sapiens
ccccaaagctttcctgccc

SEQ ID NO: 2481711 - DNA, 17 bp, Homo sapiens
ccccaacagcgcccaaa

SEQ ID NO: 2481712 - DNA, 13 bp, Homo sapiens
ccccaacagctgg

SEQ ID NO: 2481713 - DNA, 21 bp, Homo sapiens
ccccaacagctggaccctgac

SEQ ID NO: 2481714 - DNA, 16 bp, Homo sapiens
ccccaacatgcactga

SEQ ID NO: 2481715 - DNA, 23 bp, Homo sapiens
ccccaacccgtggaggctgctcg

SEQ ID NO: 2481716 - DNA, 22 bp, Homo sapiens
ccccaactccttccagctagtg

SEQ ID NO: 2481717 - DNA, 13 bp, Homo sapiens
ccccaaggttctc

SEQ ID NO: 2481718 - DNA, 20 bp, Homo sapiens
ccccacaccagggccagcct

SEQ ID NO: 2481719 - DNA, 21 bp, Homo sapiens
ccccacccaccaaccctcagg

SEQ ID NO: 2481720 - DNA, 16 bp, Homo sapiens
ccccaccccagggcag

SEQ ID NO: 2481721 - DNA, 17 bp, Homo sapiens
ccccacccccagctcaa

SEQ ID NO: 2481722 - DNA, 17 bp, Homo sapiens
ccccaccctgttcctgc

SEQ ID NO: 2481723 - DNA, 20 bp, Homo sapiens
ccccaccctgttcctgctgc

SEQ ID NO: 2481724 - DNA, 21 bp, Homo sapiens
ccccaccctgttcctgctgct

SEQ ID NO: 2481725 - DNA, 22 bp, Homo sapiens
ccccaccgttgtctcatgccag

SEQ ID NO: 2481726 - DNA, 15 bp, Homo sapiens
ccccacgagggctgg

SEQ ID NO: 2481727 - DNA, 15 bp, Homo sapiens
ccccactccctcaca

SEQ ID NO: 2481728 - DNA, 12 bp, Homo sapiens
ccccactcctct

SEQ ID NO: 2481729 - DNA, 13 bp, Homo sapiens
ccccactctgctc

SEQ ID NO: 2481730 - DNA, 21 bp, Homo sapiens
ccccactgacagcctcccacc

SEQ ID NO: 2481731 - DNA, 14 bp, Homo sapiens
ccccactgaccaga

SEQ ID NO: 2481732 - DNA, 13 bp, Homo sapiens
ccccactggagca

SEQ ID NO: 2481733 - DNA, 14 bp, Homo sapiens
ccccactgtatcta

SEQ ID NO: 2481734 - DNA, 16 bp, Homo sapiens
ccccacttgcctcttc

SEQ ID NO: 2481735 - DNA, 19 bp, Homo sapiens
ccccacttgtccttagcct

SEQ ID NO: 2481736 - DNA, 16 bp, Homo sapiens
ccccagagcccaggct

SEQ ID NO: 2481737 - DNA, 16 bp, Homo sapiens
ccccagagcccccggg

SEQ ID NO: 2481738 - DNA, 22 bp, Homo sapiens
ccccagcaaagcccccagagcc

SEQ ID NO: 2481739 - DNA, 18 bp, Homo sapiens
ccccagcaggtgctgact

SEQ ID NO: 2481740 - DNA, 12 bp, Homo sapiens
ccccagcccaga

SEQ ID NO: 2481741 - DNA, 14 bp, Homo sapiens
ccccagcccagggc

SEQ ID NO: 2481742 - DNA, 21 bp, Homo sapiens
ccccagcccagggctcctgca

SEQ ID NO: 2481743 - DNA, 13 bp, Homo sapiens
ccccagcctccct

SEQ ID NO: 2481744 - DNA, 15 bp, Homo sapiens
ccccagcctccctga

SEQ ID NO: 2481745 - DNA, 14 bp, Homo sapiens
ccccagcctctggc

SEQ ID NO: 2481746 - DNA, 12 bp, Homo sapiens
ccccagcctggg

SEQ ID NO: 2481747 - DNA, 11 bp, Homo sapiens
ccccagcctgt

SEQ ID NO: 2481748 - DNA, 19 bp, Homo sapiens
ccccagctaagaacctgga

SEQ ID NO: 2481749 - DNA, 14 bp, Homo sapiens
ccccagctcaatgg

SEQ ID NO: 2481750 - DNA, 13 bp, Homo sapiens
ccccagctccggc

SEQ ID NO: 2481751 - DNA, 18 bp, Homo sapiens
ccccaggaccagaagctc

SEQ ID NO: 2481752 - DNA, 20 bp, Homo sapiens
ccccaggaccagaagctccc

SEQ ID NO: 2481753 - DNA, 17 bp, Homo sapiens
ccccaggacctggctgc

SEQ ID NO: 2481754 - DNA, 13 bp, Homo sapiens
ccctgtgttgtct

SEQ ID NO: 2481755 - DNA, 17 bp, Homo sapiens
ccctgtgttgtctctag

SEQ ID NO: 2481756 - DNA, 18 bp, Homo sapiens
ccctgtgttgtctctaga

SEQ ID NO: 2481757 - DNA, 14 bp, Homo sapiens
ccctgttcctgctg

SEQ ID NO: 2481758 - DNA, 16 bp, Homo sapiens
ccctgttcctgctgct

SEQ ID NO: 2481759 - DNA, 16 bp, Homo sapiens
ccctgttttcccccca

SEQ ID NO: 2481760 - DNA, 20 bp, Homo sapiens
ccctgttttccccccaaggg

SEQ ID NO: 2481761 - DNA, 14 bp, Homo sapiens
cccttaaaggggag

SEQ ID NO: 2481762 - DNA, 22 bp, Homo sapiens
cccttagacagaggccctcaag

SEQ ID NO: 2481763 - DNA, 19 bp, Homo sapiens
cccttatgcggttaatttt

SEQ ID NO: 2481764 - DNA, 16 bp, Homo sapiens
cccttccactgagggc

SEQ ID NO: 2481765 - DNA, 13 bp, Homo sapiens
cccttccctcacc

SEQ ID NO: 2481766 - DNA, 17 bp, Homo sapiens
cccttcctggacagctg

SEQ ID NO: 2481767 - DNA, 19 bp, Homo sapiens
cccttcctggacagctgtg

SEQ ID NO: 2481768 - DNA, 22 bp, Homo sapiens
cccttcctggacagctgtgcct

SEQ ID NO: 2481769 - DNA, 15 bp, Homo sapiens
cccttgaggtctcag

SEQ ID NO: 2481770 - DNA, 16 bp, Homo sapiens
cccttgagtccccatt

SEQ ID NO: 2481771 - DNA, 17 bp, Homo sapiens
cccttgcccccctggcc

SEQ ID NO: 2481772 - DNA, 18 bp, Homo sapiens
cccttgcccccctggcct

SEQ ID NO: 2481773 - DNA, 15 bp, Homo sapiens
cccttgcctgtgcca

SEQ ID NO: 2481774 - DNA, 19 bp, Homo sapiens
cccttgcctgtgccaggtg

SEQ ID NO: 2481775 - DNA, 20 bp, Homo sapiens
cccttgcctgtgccaggtga

SEQ ID NO: 2481776 - DNA, 14 bp, Homo sapiens
cccttggacacgct

SEQ ID NO: 2481777 - DNA, 14 bp, Homo sapiens
cccttgggcccaca

SEQ ID NO: 2481778 - DNA, 15 bp, Homo sapiens
cccttgggcccacac

SEQ ID NO: 2481779 - DNA, 21 bp, Homo sapiens
cccttgggggtcctcctccag

SEQ ID NO: 2481780 - DNA, 23 bp, Homo sapiens
cccttgggggtcctcctccaggg

SEQ ID NO: 2481781 - DNA, 15 bp, Homo sapiens
ccctttcacaggcag

SEQ ID NO: 2481782 - DNA, 17 bp, Homo sapiens
ccctttcccaccccaac

SEQ ID NO: 2481783 - DNA, 16 bp, Homo sapiens
ccctttctagaccaat

SEQ ID NO: 2481784 - DNA, 17 bp, Homo sapiens
ccctttctagaccaata

SEQ ID NO: 2481785 - DNA, 14 bp, Homo sapiens
ccctttgccttcat

SEQ ID NO: 2481786 - DNA, 21 bp, Homo sapiens
ccgaagctaacagggaaggca

SEQ ID NO: 2481787 - DNA, 23 bp, Homo sapiens
ccgaaggtgaggagcttgaaacc

SEQ ID NO: 2481788 - DNA, 23 bp, Homo sapiens
ccgaatctctttttgctttcgaa

SEQ ID NO: 2481789 - DNA, 14 bp, Homo sapiens
ccgactcacaccac

SEQ ID NO: 2481790 - DNA, 17 bp, Homo sapiens
ccgactgctttggacct

SEQ ID NO: 2481791 - DNA, 15 bp, Homo sapiens
ccgactggggcaggg

SEQ ID NO: 2481792 - DNA, 15 bp, Homo sapiens
ccgagaggtgggcca

SEQ ID NO: 2481793 - DNA, 18 bp, Homo sapiens
ccgagcaaccgtggccct

SEQ ID NO: 2481794 - DNA, 12 bp, Homo sapiens
ccgagcagctga

SEQ ID NO: 2481795 - DNA, 14 bp, Homo sapiens
ccgagcagctgagc

SEQ ID NO: 2481796 - DNA, 15 bp, Homo sapiens
ccgagcagctgagca

SEQ ID NO: 2481797 - DNA, 16 bp, Homo sapiens
ccgagcagctgagcag

SEQ ID NO: 2481798 - DNA, 17 bp, Homo sapiens
ccgagctcctcttccat

SEQ ID NO: 2481799 - DNA, 13 bp, Homo sapiens
ccgaggacccagg

SEQ ID NO: 2481800 - DNA, 21 bp, Homo sapiens
ccgaggaggtgtctcaggctg

SEQ ID NO: 2481801 - DNA, 15 bp, Homo sapiens
ccgagtccaagctgg

SEQ ID NO: 2481802 - DNA, 14 bp, Homo sapiens
ccgccactggggct

SEQ ID NO: 2481803 - DNA, 20 bp, Homo sapiens
ccgccactggggctcagagc

SEQ ID NO: 2481804 - DNA, 13 bp, Homo sapiens
ccgccagctctgt

SEQ ID NO: 2481805 - DNA, 15 bp, Homo sapiens
ccgccagctctgttc

SEQ ID NO: 2481806 - DNA, 23 bp, Homo sapiens
ccgcccacaggaagcctgcagtc

SEQ ID NO: 2481807 - DNA, 22 bp, Homo sapiens
ccgcccagagacccaagctgcc

SEQ ID NO: 2481808 - DNA, 12 bp, Homo sapiens
ccgccctgccac

SEQ ID NO: 2481809 - DNA, 15 bp, Homo sapiens
ccgccctgccactca

SEQ ID NO: 2481810 - DNA, 17 bp, Homo sapiens
ccgcgggacagccaagc

SEQ ID NO: 2481811 - DNA, 13 bp, Homo sapiens
ccgcgtctaccct

SEQ ID NO: 2481812 - DNA, 15 bp, Homo sapiens
ccgcgtctaccctgg

SEQ ID NO: 2481813 - DNA, 14 bp, Homo sapiens
ccgctaaaagaaac

SEQ ID NO: 2481814 - DNA, 18 bp, Homo sapiens
ccgctctacatcttctgc

SEQ ID NO: 2481815 - DNA, 15 bp, Homo sapiens
ccgcttggagcagag

SEQ ID NO: 2481816 - DNA, 20 bp, Homo sapiens
ccgcttggagctattttcca

SEQ ID NO: 2481817 - DNA, 11 bp, Homo sapiens
ccggaaagaag

SEQ ID NO: 2481818 - DNA, 13 bp, Homo sapiens
ccggaccagcctg

SEQ ID NO: 2481819 - DNA, 14 bp, Homo sapiens
ccggaccagcctgg

SEQ ID NO: 2481820 - DNA, 18 bp, Homo sapiens
ccggaccagcctggccca

SEQ ID NO: 2481821 - DNA, 23 bp, Homo sapiens
ccggacttagaaaaccagctcag

SEQ ID NO: 2481822 - DNA, 15 bp, Homo sapiens
ccggacttttctgca

SEQ ID NO: 2481823 - DNA, 14 bp, Homo sapiens
ccggagaggaccgg

SEQ ID NO: 2481824 - DNA, 14 bp, Homo sapiens
ccggatgcagaggc

SEQ ID NO: 2481825 - DNA, 17 bp, Homo sapiens
ccggcaccccctgcagc

SEQ ID NO: 2481826 - DNA, 19 bp, Homo sapiens
ccggcaccccctgcagctt

SEQ ID NO: 2481827 - DNA, 20 bp, Homo sapiens
ccggcaccccctgcagcttg

SEQ ID NO: 2481828 - DNA, 18 bp, Homo sapiens
ccggcagcttctgccccc

SEQ ID NO: 2481829 - DNA, 11 bp, Homo sapiens
ccggcagggcg

SEQ ID NO: 2481830 - DNA, 16 bp, Homo sapiens
ccggcagggcgggcag

SEQ ID NO: 2481831 - DNA, 14 bp, Homo sapiens
ccggcctgccagga

SEQ ID NO: 2481832 - DNA, 11 bp, Homo sapiens
ccggctggtga

SEQ ID NO: 2481833 - DNA, 20 bp, Homo sapiens
ccggctgtgcagtcctgggt

SEQ ID NO: 2481834 - DNA, 21 bp, Homo sapiens
ccgggaagtgagggctcactc

SEQ ID NO: 2481835 - DNA, 18 bp, Homo sapiens
ccgggccactccttcctg

SEQ ID NO: 2481836 - DNA, 19 bp, Homo sapiens
ccgggccactccttcctgc

SEQ ID NO: 2481837 - DNA, 15 bp, Homo sapiens
ccggggaaaggcaag

SEQ ID NO: 2481838 - DNA, 15 bp, Homo sapiens
ccggggaactggcca

SEQ ID NO: 2481839 - DNA, 14 bp, Homo sapiens
ccggggcagccccc

SEQ ID NO: 2481840 - DNA, 22 bp, Homo sapiens
ccgggtgtccccaacagcgccc

SEQ ID NO: 2481841 - DNA, 22 bp, Homo sapiens
ccggtcgccctttgctgcatgg

SEQ ID NO: 2481842 - DNA, 13 bp, Homo sapiens
ccgtaatttaact

SEQ ID NO: 2481843 - DNA, 14 bp, Homo sapiens
ccgtaatttaactt

SEQ ID NO: 2481844 - DNA, 12 bp, Homo sapiens
ccgtcagtgctg

SEQ ID NO: 2481845 - DNA, 13 bp, Homo sapiens
ccgtcctgcctgt

SEQ ID NO: 2481846 - DNA, 19 bp, Homo sapiens
ccgtctttcttttatactg

SEQ ID NO: 2481847 - DNA, 16 bp, Homo sapiens
ccgtcttttcctgttt

SEQ ID NO: 2481848 - DNA, 22 bp, Homo sapiens
ccgtgagccaatccctcacctt

SEQ ID NO: 2481849 - DNA, 14 bp, Homo sapiens
ccgtgccaagtcca

SEQ ID NO: 2481850 - DNA, 20 bp, Homo sapiens
ccgtgccaagtccaggtcct

SEQ ID NO: 2481851 - DNA, 16 bp, Homo sapiens
ccgtgctcgccccagc

SEQ ID NO: 2481852 - DNA, 17 bp, Homo sapiens
ccgtgctcgccccagca

SEQ ID NO: 2481853 - DNA, 16 bp, Homo sapiens
ccgtggaggctgctcg

SEQ ID NO: 2481854 - DNA, 19 bp, Homo sapiens
ccgtggattgcacgtggcc

SEQ ID NO: 2481855 - DNA, 20 bp, Homo sapiens
ccgtggattgcacgtggcct

SEQ ID NO: 2481856 - DNA, 20 bp, Homo sapiens
ccgtggcccttcctggacag

SEQ ID NO: 2481857 - DNA, 17 bp, Homo sapiens
ccgtggctgctgtggga

SEQ ID NO: 2481858 - DNA, 19 bp, Homo sapiens
ccgtgggccccaccctcgg

SEQ ID NO: 2481859 - DNA, 17 bp, Homo sapiens
ccgtggggccgccgcct

SEQ ID NO: 2481860 - DNA, 13 bp, Homo sapiens
cccaacccgtgga

SEQ ID NO: 2481861 - DNA, 19 bp, Homo sapiens
cccaacccgtggaggctgc

SEQ ID NO: 2481862 - DNA, 16 bp, Homo sapiens
cccaactccttccagc

SEQ ID NO: 2481863 - DNA, 23 bp, Homo sapiens
cccaactcttgcacagtcactgc

SEQ ID NO: 2481864 - DNA, 17 bp, Homo sapiens
cccaagattgagctctc

SEQ ID NO: 2481865 - DNA, 21 bp, Homo sapiens
cccaagattgagctctctgcc

SEQ ID NO: 2481866 - DNA, 16 bp, Homo sapiens
cccaagccagaggctg

SEQ ID NO: 2481867 - DNA, 12 bp, Homo sapiens
cccaagctcaga

SEQ ID NO: 2481868 - DNA, 14 bp, Homo sapiens
cccaaggaggcagc

SEQ ID NO: 2481869 - DNA, 19 bp, Homo sapiens
cccaaggctcccggaattc

SEQ ID NO: 2481870 - DNA, 17 bp, Homo sapiens
cccaaggtaccatccta

SEQ ID NO: 2481871 - DNA, 13 bp, Homo sapiens
cccaagtgagtct

SEQ ID NO: 2481872 - DNA, 14 bp, Homo sapiens
cccaatccagtgga

SEQ ID NO: 2481873 - DNA, 14 bp, Homo sapiens
cccaattgctggag

SEQ ID NO: 2481874 - DNA, 20 bp, Homo sapiens
cccacaagcctctgcccagg

SEQ ID NO: 2481875 - DNA, 21 bp, Homo sapiens
cccacaagtgccctccaggct

SEQ ID NO: 2481876 - DNA, 12 bp, Homo sapiens
cccacactcaga

SEQ ID NO: 2481877 - DNA, 22 bp, Homo sapiens
cccacaggaagcctgcagtcct

SEQ ID NO: 2481878 - DNA, 19 bp, Homo sapiens
cccacagtgtcaggcactg

SEQ ID NO: 2481879 - DNA, 17 bp, Homo sapiens
cccacatcccatcgtct

SEQ ID NO: 2481880 - DNA, 13 bp, Homo sapiens
cccacatccctgg

SEQ ID NO: 2481881 - DNA, 21 bp, Homo sapiens
cccacatccctgggcctgctg

SEQ ID NO: 2481882 - DNA, 22 bp, Homo sapiens
cccacatccctgggcctgctgc

SEQ ID NO: 2481883 - DNA, 22 bp, Homo sapiens
cccacattggaagagcagcacc

SEQ ID NO: 2481884 - DNA, 17 bp, Homo sapiens
cccacccaggccaggca

SEQ ID NO: 2481885 - DNA, 15 bp, Homo sapiens
cccaccccagggcag

SEQ ID NO: 2481886 - DNA, 12 bp, Homo sapiens
cccacccccatc

SEQ ID NO: 2481887 - DNA, 14 bp, Homo sapiens
cccacccccggcag

SEQ ID NO: 2481888 - DNA, 15 bp, Homo sapiens
cccaccctcttccta

SEQ ID NO: 2481889 - DNA, 13 bp, Homo sapiens
cccaccctgggcc

SEQ ID NO: 2481890 - DNA, 12 bp, Homo sapiens
cccaccctgttc

SEQ ID NO: 2481891 - DNA, 14 bp, Homo sapiens
cccaccctgttcct

SEQ ID NO: 2481892 - DNA, 17 bp, Homo sapiens
cccaccctgttcctgct

SEQ ID NO: 2481893 - DNA, 13 bp, Homo sapiens
cccacgagggctg

SEQ ID NO: 2481894 - DNA, 15 bp, Homo sapiens
cccacgagggctggc

SEQ ID NO: 2481895 - DNA, 22 bp, Homo sapiens
cccactagctcttgttgagccg

SEQ ID NO: 2481896 - DNA, 14 bp, Homo sapiens
cccactctcctagg

SEQ ID NO: 2481897 - DNA, 19 bp, Homo sapiens
cccactctgctctgatgca

SEQ ID NO: 2481898 - DNA, 15 bp, Homo sapiens
cccactgagaggaca

SEQ ID NO: 2481899 - DNA, 12 bp, Homo sapiens
cccactggagca

SEQ ID NO: 2481900 - DNA, 19 bp, Homo sapiens
cccactgtatctaggcaac

SEQ ID NO: 2481901 - DNA, 22 bp, Homo sapiens
cccactgtcctgggcctgcaga

SEQ ID NO: 2481902 - DNA, 14 bp, Homo sapiens
cccacttacattta

SEQ ID NO: 2481903 - DNA, 13 bp, Homo sapiens
cccacttgcctct

SEQ ID NO: 2481904 - DNA, 15 bp, Homo sapiens
cccacttgcctcttc

SEQ ID NO: 2481905 - DNA, 21 bp, Homo sapiens
cccacttgcctcttccttgaa

SEQ ID NO: 2481906 - DNA, 17 bp, Homo sapiens
cccagacataaaggaaa

SEQ ID NO: 2481907 - DNA, 21 bp, Homo sapiens
cccagacctgttagcagacag

SEQ ID NO: 2481908 - DNA, 15 bp, Homo sapiens
cccagacgcctggct

SEQ ID NO: 2481909 - DNA, 19 bp, Homo sapiens
cccagacgcctggctgctg

SEQ ID NO: 2481910 - DNA, 20 bp, Homo sapiens
cccagactagatgtagtatt

SEQ ID NO: 2481911 - DNA, 23 bp, Homo sapiens
cccagacttgttggcgtaggcta

SEQ ID NO: 2481912 - DNA, 22 bp, Homo sapiens
cccagagaaaggggagcccact

SEQ ID NO: 2481913 - DNA, 13 bp, Homo sapiens
cccagagacccag

SEQ ID NO: 2481914 - DNA, 14 bp, Homo sapiens
cccagagacccagc

SEQ ID NO: 2481915 - DNA, 15 bp, Homo sapiens
cccagagacccagcg

SEQ ID NO: 2481916 - DNA, 15 bp, Homo sapiens
cccagagagcccgag

SEQ ID NO: 2481917 - DNA, 13 bp, Homo sapiens
cccagagcccagc

SEQ ID NO: 2481918 - DNA, 14 bp, Homo sapiens
cccagagcccaggc

SEQ ID NO: 2481919 - DNA, 15 bp, Homo sapiens
cccagagcccaggct

SEQ ID NO: 2481920 - DNA, 23 bp, Homo sapiens
cccagaggaaggggccagaggct

SEQ ID NO: 2481921 - DNA, 15 bp, Homo sapiens
cccagaggggcctgc

SEQ ID NO: 2481922 - DNA, 20 bp, Homo sapiens
cccagaggggcctgccacct

SEQ ID NO: 2481923 - DNA, 17 bp, Homo sapiens
cccagccaaaccctgtc

SEQ ID NO: 2481924 - DNA, 13 bp, Homo sapiens
cccagccaggccc

SEQ ID NO: 2481925 - DNA, 17 bp, Homo sapiens
cccagccaggcccagcc

SEQ ID NO: 2481926 - DNA, 16 bp, Homo sapiens
cccagccagggctcaa

SEQ ID NO: 2481927 - DNA, 21 bp, Homo sapiens
cccagccagggctcaatctct

SEQ ID NO: 2481928 - DNA, 14 bp, Homo sapiens
cccagcccagagac

SEQ ID NO: 2481929 - DNA, 12 bp, Homo sapiens
cccagccccagc

SEQ ID NO: 2481930 - DNA, 18 bp, Homo sapiens
cccagccccctaagagag

SEQ ID NO: 2481931 - DNA, 16 bp, Homo sapiens
cccagcctccctgaag

SEQ ID NO: 2481932 - DNA, 18 bp, Homo sapiens
cccagcctgtcagatcca

SEQ ID NO: 2481933 - DNA, 22 bp, Homo sapiens
cccagcctgtcagatccaggag

SEQ ID NO: 2481934 - DNA, 21 bp, Homo sapiens
cccagcgattccctctcccag

SEQ ID NO: 2481935 - DNA, 23 bp, Homo sapiens
cccagcgattccctctcccaggc

SEQ ID NO: 2481936 - DNA, 16 bp, Homo sapiens
cccagcggcatcaggc

SEQ ID NO: 2481937 - DNA, 22 bp, Homo sapiens
cccagctaccctttttctccag

SEQ ID NO: 2481938 - DNA, 12 bp, Homo sapiens
cccagctcccac

SEQ ID NO: 2481939 - DNA, 13 bp, Homo sapiens
cccagctcccagg

SEQ ID NO: 2481940 - DNA, 14 bp, Homo sapiens
cccagctcccagga

SEQ ID NO: 2481941 - DNA, 17 bp, Homo sapiens
cccagctccggcctgtc

SEQ ID NO: 2481942 - DNA, 11 bp, Homo sapiens
cccagctcctg

SEQ ID NO: 2481943 - DNA, 12 bp, Homo sapiens
cccagctcctga

SEQ ID NO: 2481944 - DNA, 20 bp, Homo sapiens
cccagctcctgacactgctg

SEQ ID NO: 2481945 - DNA, 22 bp, Homo sapiens
cccagctcctgacactgctgga

SEQ ID NO: 2481946 - DNA, 22 bp, Homo sapiens
cccaggaagtctcatctgggga

SEQ ID NO: 2481947 - DNA, 21 bp, Homo sapiens
cccaggaccacaggctcaggc

SEQ ID NO: 2481948 - DNA, 12 bp, Homo sapiens
cccaggaccaga

SEQ ID NO: 2481949 - DNA, 23 bp, Homo sapiens
cccaggaccagaagctcccccag

SEQ ID NO: 2481950 - DNA, 14 bp, Homo sapiens
cccaggaccagctc

SEQ ID NO: 2481951 - DNA, 21 bp, Homo sapiens
cccaggaccagctcaggacag

SEQ ID NO: 2481952 - DNA, 13 bp, Homo sapiens
cccaggaccctga

SEQ ID NO: 2481953 - DNA, 19 bp, Homo sapiens
cccaggaccctggacccag

SEQ ID NO: 2481954 - DNA, 23 bp, Homo sapiens
cccaggaccctggacccagccag

SEQ ID NO: 2481955 - DNA, 20 bp, Homo sapiens
cccaggagctcccctcccca

SEQ ID NO: 2481956 - DNA, 19 bp, Homo sapiens
cccaggcaaggctgtggac

SEQ ID NO: 2481957 - DNA, 15 bp, Homo sapiens
cccaggccaggactc

SEQ ID NO: 2481958 - DNA, 19 bp, Homo sapiens
cccaggccaggactctgca

SEQ ID NO: 2481959 - DNA, 20 bp, Homo sapiens
cccaggccaggactctgcag

SEQ ID NO: 2481960 - DNA, 21 bp, Homo sapiens
cccaggccaggactctgcagc

SEQ ID NO: 2481961 - DNA, 11 bp, Homo sapiens
cccaggcccac

SEQ ID NO: 2481962 - DNA, 16 bp, Homo sapiens
cccaggccccatgacc

SEQ ID NO: 2481963 - DNA, 17 bp, Homo sapiens
cccaggccccatgacct

SEQ ID NO: 2481964 - DNA, 21 bp, Homo sapiens
cccaggccccatgacctccag

SEQ ID NO: 2481965 - DNA, 15 bp, Homo sapiens
ccccaggctcgtgga

SEQ ID NO: 2481966 - DNA, 18 bp, Homo sapiens
ccccagggaagcagcagc

SEQ ID NO: 2481967 - DNA, 20 bp, Homo sapiens
ccccagggaagcagcagcct

SEQ ID NO: 2481968 - DNA, 15 bp, Homo sapiens
ccccagggcacagga

SEQ ID NO: 2481969 - DNA, 16 bp, Homo sapiens
ccccagggcacaggag

SEQ ID NO: 2481970 - DNA, 17 bp, Homo sapiens
ccccagggcacaggagc

SEQ ID NO: 2481971 - DNA, 18 bp, Homo sapiens
ccccagggcacaggagct

SEQ ID NO: 2481972 - DNA, 22 bp, Homo sapiens
ccccagggcacaggagctacct

SEQ ID NO: 2481973 - DNA, 16 bp, Homo sapiens
ccccagggcagccagg

SEQ ID NO: 2481974 - DNA, 22 bp, Homo sapiens
ccccagggcagccagggagagc

SEQ ID NO: 2481975 - DNA, 17 bp, Homo sapiens
ccccagggtcctgggag

SEQ ID NO: 2481976 - DNA, 17 bp, Homo sapiens
ccccaggtccagctctg

SEQ ID NO: 2481977 - DNA, 14 bp, Homo sapiens
ccccagtacacagg

SEQ ID NO: 2481978 - DNA, 20 bp, Homo sapiens
ccccatcagtgctccctcac

SEQ ID NO: 2481979 - DNA, 14 bp, Homo sapiens
ccccatctcaggcc

SEQ ID NO: 2481980 - DNA, 21 bp, Homo sapiens
ccccatctcatgcccctggct

SEQ ID NO: 2481981 - DNA, 23 bp, Homo sapiens
ccccatctcatgcccctggctgg

SEQ ID NO: 2481982 - DNA, 13 bp, Homo sapiens
ccccatgacctcc

SEQ ID NO: 2481983 - DNA, 13 bp, Homo sapiens
ccccatgcactgt

SEQ ID NO: 2481984 - DNA, 23 bp, Homo sapiens
ccccatgcactgtgaaggaccct

SEQ ID NO: 2481985 - DNA, 17 bp, Homo sapiens
ccccatggccctgagcg

SEQ ID NO: 2481986 - DNA, 15 bp, Homo sapiens
ccccatgttctgtcc

SEQ ID NO: 2481987 - DNA, 18 bp, Homo sapiens
cccccaaggttctccaac

SEQ ID NO: 2481988 - DNA, 14 bp, Homo sapiens
cccccacccccagc

SEQ ID NO: 2481989 - DNA, 15 bp, Homo sapiens
cccccacccccagct

SEQ ID NO: 2481990 - DNA, 11 bp, Homo sapiens
cccccaccctg

SEQ ID NO: 2481991 - DNA, 16 bp, Homo sapiens
cccccagagcccaggc

SEQ ID NO: 2481992 - DNA, 12 bp, Homo sapiens
cccccagcactt

SEQ ID NO: 2481993 - DNA, 12 bp, Homo sapiens
cccccagcctgg

SEQ ID NO: 2481994 - DNA, 13 bp, Homo sapiens
cccccagcctggg

SEQ ID NO: 2481995 - DNA, 14 bp, Homo sapiens
cccccaggaccaga

SEQ ID NO: 2481996 - DNA, 14 bp, Homo sapiens
cccccatgcactgt

SEQ ID NO: 2481997 - DNA, 13 bp, Homo sapiens
ccccccagcctct

SEQ ID NO: 2481998 - DNA, 14 bp, Homo sapiens
ccccccatgcactg

SEQ ID NO: 2481999 - DNA, 14 bp, Homo sapiens
ccccctctcccagt

SEQ ID NO: 2482000 - DNA, 17 bp, Homo sapiens
ccccctctccctgcatg

SEQ ID NO: 2482001 - DNA, 16 bp, Homo sapiens
ccccctctgtcttgtg

SEQ ID NO: 2482002 - DNA, 17 bp, Homo sapiens
ccccctgaccactcaga

SEQ ID NO: 2482003 - DNA, 14 bp, Homo sapiens
ccccctgcaggaag

SEQ ID NO: 2482004 - DNA, 17 bp, Homo sapiens
ccccctggcctccccca

SEQ ID NO: 2482005 - DNA, 15 bp, Homo sapiens
ccccctggtcccctc

SEQ ID NO: 2482006 - DNA, 12 bp, Homo sapiens
ccccctgtgcag

SEQ ID NO: 2482007 - DNA, 16 bp, Homo sapiens
cccccttcaagcctgt

SEQ ID NO: 2482008 - DNA, 21 bp, Homo sapiens
ccccctttagatctctgaagc

SEQ ID NO: 2482009 - DNA, 22 bp, Homo sapiens
ccccctttcacaggcagccagt

SEQ ID NO: 2482010 - DNA, 20 bp, Homo sapiens
ccccctttcctggacactca

SEQ ID NO: 2482011 - DNA, 18 bp, Homo sapiens
ccccgcctgccctcatgg

SEQ ID NO: 2482012 - DNA, 22 bp, Homo sapiens
ccccggcacctcccttgggcac

SEQ ID NO: 2482013 - DNA, 13 bp, Homo sapiens
ccccggcagcagc

SEQ ID NO: 2482014 - DNA, 15 bp, Homo sapiens
ccccgtcaagagtga

SEQ ID NO: 2482015 - DNA, 14 bp, Homo sapiens
ccccgtttctggtg

SEQ ID NO: 2482016 - DNA, 19 bp, Homo sapiens
cccctaaagcctcaaaaca

SEQ ID NO: 2482017 - DNA, 23 bp, Homo sapiens
cccctaaccctttgtgtgctctc

SEQ ID NO: 2482018 - DNA, 13 bp, Homo sapiens
cccctcacccctc

SEQ ID NO: 2482019 - DNA, 20 bp, Homo sapiens
cccctcatctctctgcccaa

SEQ ID NO: 2482020 - DNA, 16 bp, Homo sapiens
cccctccgccctgcca

SEQ ID NO: 2482021 - DNA, 18 bp, Homo sapiens
cccctccgccctgccact

SEQ ID NO: 2482022 - DNA, 14 bp, Homo sapiens
cccctccttcccaa

SEQ ID NO: 2482023 - DNA, 12 bp, Homo sapiens
cccctctcacca

SEQ ID NO: 2482024 - DNA, 14 bp, Homo sapiens
cccctctccctgca

SEQ ID NO: 2482025 - DNA, 22 bp, Homo sapiens
cccctctcccttgggctctgat

SEQ ID NO: 2482026 - DNA, 14 bp, Homo sapiens
cccctctccttcct

SEQ ID NO: 2482027 - DNA, 16 bp, Homo sapiens
cccctctgctgctgtc

SEQ ID NO: 2482028 - DNA, 23 bp, Homo sapiens
cccctctggtcgctcctgcccac

SEQ ID NO: 2482029 - DNA, 14 bp, Homo sapiens
cccctctgtccagg

SEQ ID NO: 2482030 - DNA, 17 bp, Homo sapiens
cccctgaccactcagag

SEQ ID NO: 2482031 - DNA, 22 bp, Homo sapiens
cccctgaccactcagagacatg

SEQ ID NO: 2482032 - DNA, 15 bp, Homo sapiens
cccctgacctgtgag

SEQ ID NO: 2482033 - DNA, 16 bp, Homo sapiens
cccctgcactgtaaaa

SEQ ID NO: 2482034 - DNA, 23 bp, Homo sapiens
cccctgcaggaaggagctgcctg

SEQ ID NO: 2482035 - DNA, 22 bp, Homo sapiens
cccctgcattggaactggaggc

SEQ ID NO: 2482036 - DNA, 20 bp, Homo sapiens
cccctgccaccaggccacct

SEQ ID NO: 2482037 - DNA, 23 bp, Homo sapiens
cccctgccagggcagggccccag

SEQ ID NO: 2482038 - DNA, 17 bp, Homo sapiens
cccctgccccctgcagg

SEQ ID NO: 2482039 - DNA, 19 bp, Homo sapiens
cccctgcctgccctggtga

SEQ ID NO: 2482040 - DNA, 14 bp, Homo sapiens
cccctgctttgggc

SEQ ID NO: 2482041 - DNA, 22 bp, Homo sapiens
cccctggcagagatgcctccct

SEQ ID NO: 2482042 - DNA, 23 bp, Homo sapiens
cccctggctgggacgtggctcag

SEQ ID NO: 2482043 - DNA, 19 bp, Homo sapiens
cccctggggtggccaccag

SEQ ID NO: 2482044 - DNA, 15 bp, Homo sapiens
cccctgtaggcctca

SEQ ID NO: 2482045 - DNA, 22 bp, Homo sapiens
cccctgtctctcagggccaggc

SEQ ID NO: 2482046 - DNA, 18 bp, Homo sapiens
ccccttctatttggggct

SEQ ID NO: 2482047 - DNA, 16 bp, Homo sapiens
ccccttgcctgtgcca

SEQ ID NO: 2482048 - DNA, 16 bp, Homo sapiens
ccccttgggcccacac

SEQ ID NO: 2482049 - DNA, 18 bp, Homo sapiens
ccccttgtcctttccctt

SEQ ID NO: 2482050 - DNA, 16 bp, Homo sapiens
cccctttcacaggcag

SEQ ID NO: 2482051 - DNA, 21 bp, Homo sapiens
cccctttcacaggcagccagt

SEQ ID NO: 2482052 - DNA, 10 bp, Homo sapiens
cccctttcct

SEQ ID NO: 2482053 - DNA, 22 bp, Homo sapiens
cccctttcctggacactcagac

SEQ ID NO: 2482054 - DNA, 23 bp, Homo sapiens
cccctttcctggacactcagacc

SEQ ID NO: 2482055 - DNA, 22 bp, Homo sapiens
ccccttttcggccccatgtatc

SEQ ID NO: 2482056 - DNA, 14 bp, Homo sapiens
cccgagctcctctt

SEQ ID NO: 2482057 - DNA, 23 bp, Homo sapiens
cccgagtcattcgttctgtggag

SEQ ID NO: 2482058 - DNA, 15 bp, Homo sapiens
cccgcagacaccttg

SEQ ID NO: 2482059 - DNA, 23 bp, Homo sapiens
cccgcagtgggagcaaactgcat

SEQ ID NO: 2482060 - DNA, 12 bp, Homo sapiens
cccgcctgccct

SEQ ID NO: 2482061 - DNA, 17 bp, Homo sapiens
cccgcctgccctcatgg

SEQ ID NO: 2482062 - DNA, 14 bp, Homo sapiens
cccgccttggcctg

SEQ ID NO: 2482063 - DNA, 23 bp, Homo sapiens
cccggagaagtgtgccttctctc

SEQ ID NO: 2482064 - DNA, 16 bp, Homo sapiens
cccggcaccccctgca

SEQ ID NO: 2482065 - DNA, 14 bp, Homo sapiens
cccggcagggcggg

SEQ ID NO: 2482066 - DNA, 22 bp, Homo sapiens
cccggctcctggtcacctagga

SEQ ID NO: 2482067 - DNA, 21 bp, Homo sapiens
cccggctgcagaggccagagg

SEQ ID NO: 2482068 - DNA, 22 bp, Homo sapiens
cccggggaaaggcaaggtccgg

SEQ ID NO: 2482069 - DNA, 21 bp, Homo sapiens
cccggggtgcccacaggccgc

SEQ ID NO: 2482070 - DNA, 17 bp, Homo sapiens
cccgtcctgcctgtggc

SEQ ID NO: 2482071 - DNA, 12 bp, Homo sapiens
cccgtctcagtg

SEQ ID NO: 2482072 - DNA, 18 bp, Homo sapiens
cccgtgtaaatatgtaca

SEQ ID NO: 2482073 - DNA, 16 bp, Homo sapiens
cccgtttctccaccta

SEQ ID NO: 2482074 - DNA, 13 bp, Homo sapiens
cccgttttgtcac

SEQ ID NO: 2482075 - DNA, 14 bp, Homo sapiens
ccctacatgtattg

SEQ ID NO: 2482076 - DNA, 14 bp, Homo sapiens
ccctacctgcccca

SEQ ID NO: 2482077 - DNA, 12 bp, Homo sapiens
ccctaggtgttt

SEQ ID NO: 2482078 - DNA, 19 bp, Homo sapiens
ccctatactgtagtattct

SEQ ID NO: 2482079 - DNA, 18 bp, Homo sapiens
ccctatttattgactttg

SEQ ID NO: 2482080 - DNA, 16 bp, Homo sapiens
ccctcaccctgcctta

SEQ ID NO: 2482081 - DNA, 21 bp, Homo sapiens
ccctcacctgtagcagccagt

SEQ ID NO: 2482082 - DNA, 17 bp, Homo sapiens
ccctcactcgtctcccc

SEQ ID NO: 2482083 - DNA, 15 bp, Homo sapiens
ccctcagactggggc

SEQ ID NO: 2482084 - DNA, 20 bp, Homo sapiens
ccctcagcctgtaccggttt

SEQ ID NO: 2482085 - DNA, 19 bp, Homo sapiens
ccctcagggcaaagccagg

SEQ ID NO: 2482086 - DNA, 17 bp, Homo sapiens
ccctcatctctctgccc

SEQ ID NO: 2482087 - DNA, 14 bp, Homo sapiens
ccctcatctgtccc

SEQ ID NO: 2482088 - DNA, 16 bp, Homo sapiens
ccctcatggcccctct

SEQ ID NO: 2482089 - DNA, 17 bp, Homo sapiens
ccctcatggcccctctg

SEQ ID NO: 2482090 - DNA, 21 bp, Homo sapiens
ccctcatggcccctctgacct

SEQ ID NO: 2482091 - DNA, 22 bp, Homo sapiens
ccctccaagtggtccacaagct

SEQ ID NO: 2482092 - DNA, 13 bp, Homo sapiens
ccctccccctgag

SEQ ID NO: 2482093 - DNA, 12 bp, Homo sapiens
ccctcccccttg

SEQ ID NO: 2482094 - DNA, 15 bp, Homo sapiens
ccctccgccctgcca

SEQ ID NO: 2482095 - DNA, 19 bp, Homo sapiens
ccctcctctagctgtgggg

SEQ ID NO: 2482096 - DNA, 13 bp, Homo sapiens
ccctcctggctct

SEQ ID NO: 2482097 - DNA, 17 bp, Homo sapiens
ccctcctggtgccacct

SEQ ID NO: 2482098 - DNA, 20 bp, Homo sapiens
ccctcctgttgggagagggc

SEQ ID NO: 2482099 - DNA, 13 bp, Homo sapiens
ccctccttcccaa

SEQ ID NO: 2482100 - DNA, 13 bp, Homo sapiens
ccctctcaccaaa

SEQ ID NO: 2482101 - DNA, 17 bp, Homo sapiens
ccctctcagctccaggt

SEQ ID NO: 2482102 - DNA, 11 bp, Homo sapiens
ccctctcccac

SEQ ID NO: 2482103 - DNA, 12 bp, Homo sapiens
ccctctcccacc

SEQ ID NO: 2482104 - DNA, 13 bp, Homo sapiens
ccctctcccaccc

SEQ ID NO: 2482105 - DNA, 17 bp, Homo sapiens
ccctctcccaccctctt

SEQ ID NO: 2482106 - DNA, 13 bp, Homo sapiens
ccctctccctgca

SEQ ID NO: 2482107 - DNA, 15 bp, Homo sapiens
ccctctctgctctgc

SEQ ID NO: 2482108 - DNA, 14 bp, Homo sapiens
ccctctgacctgca

SEQ ID NO: 2482109 - DNA, 15 bp, Homo sapiens
ccctctgacctgcac

SEQ ID NO: 2482110 - DNA, 16 bp, Homo sapiens
ccctctgacctgcact

SEQ ID NO: 2482111 - DNA, 19 bp, Homo sapiens
ccctctgacctgcactggg

SEQ ID NO: 2482112 - DNA, 14 bp, Homo sapiens
ccctctgctgctgt

SEQ ID NO: 2482113 - DNA, 15 bp, Homo sapiens
ccctctgctgctgtc

SEQ ID NO: 2482114 - DNA, 12 bp, Homo sapiens
ccctctggaggg

SEQ ID NO: 2482115 - DNA, 10 bp, Homo sapiens
ccctctgggc

SEQ ID NO: 2482116 - DNA, 18 bp, Homo sapiens
ccctctggtcgctcctgc

SEQ ID NO: 2482117 - DNA, 20 bp, Homo sapiens
ccctctgtccaggcactgag

SEQ ID NO: 2482118 - DNA, 20 bp, Homo sapiens
ccctctgtgtatttgctttt

SEQ ID NO: 2482119 - DNA, 17 bp, Homo sapiens
ccctgaaggggccatga

SEQ ID NO: 2482120 - DNA, 22 bp, Homo sapiens
ccctgaccactcagagacatgc

SEQ ID NO: 2482121 - DNA, 16 bp, Homo sapiens
ccctgaccagctcccc

SEQ ID NO: 2482122 - DNA, 20 bp, Homo sapiens
ccctgacctgtgagcccagc

SEQ ID NO: 2482123 - DNA, 18 bp, Homo sapiens
ccctgagccagggtctcc

SEQ ID NO: 2482124 - DNA, 19 bp, Homo sapiens
ccctgagccagggtctcca

SEQ ID NO: 2482125 - DNA, 12 bp, Homo sapiens
ccctgagccggc

SEQ ID NO: 2482126 - DNA, 20 bp, Homo sapiens
ccctgagctagaaccctctg

SEQ ID NO: 2482127 - DNA, 14 bp, Homo sapiens
ccctgagctgacca

SEQ ID NO: 2482128 - DNA, 14 bp, Homo sapiens
ccctgaggagtctg

SEQ ID NO: 2482129 - DNA, 22 bp, Homo sapiens
ccctgaggagtctgaggtcctg

SEQ ID NO: 2482130 - DNA, 22 bp, Homo sapiens
ccctgcacagtgacttctgaga

SEQ ID NO: 2482131 - DNA, 17 bp, Homo sapiens
ccctgcactgtaaaatg

SEQ ID NO: 2482132 - DNA, 20 bp, Homo sapiens
ccctgcactgtaaaatgtgg

SEQ ID NO: 2482133 - DNA, 14 bp, Homo sapiens
ccctgcagaccctg

SEQ ID NO: 2482134 - DNA, 16 bp, Homo sapiens
ccctgcagaccctgcc

SEQ ID NO: 2482135 - DNA, 19 bp, Homo sapiens
ccctgcagaccctgccctt

SEQ ID NO: 2482136 - DNA, 19 bp, Homo sapiens
ccctgcagcttgtagccag

SEQ ID NO: 2482137 - DNA, 18 bp, Homo sapiens
ccctgcaggaaggagctg

SEQ ID NO: 2482138 - DNA, 19 bp, Homo sapiens
ccctgcaggaaggagctgc

SEQ ID NO: 2482139 - DNA, 21 bp, Homo sapiens
ccctgcaggaaggagctgcct

SEQ ID NO: 2482140 - DNA, 23 bp, Homo sapiens
ccctgcaggaaggagctgcctgg

SEQ ID NO: 2482141 - DNA, 22 bp, Homo sapiens
ccctgcattggaactggaggca

SEQ ID NO: 2482142 - DNA, 15 bp, Homo sapiens
ccctgccaccaggcc

SEQ ID NO: 2482143 - DNA, 18 bp, Homo sapiens
ccctgccactcactaggc

SEQ ID NO: 2482144 - DNA, 12 bp, Homo sapiens
ccctgcccccca

SEQ ID NO: 2482145 - DNA, 19 bp, Homo sapiens
ccctgccccccagcctctg

SEQ ID NO: 2482146 - DNA, 21 bp, Homo sapiens
ccctgccccccagcctctggc

SEQ ID NO: 2482147 - DNA, 17 bp, Homo sapiens
ccctgccccctgcagga

SEQ ID NO: 2482148 - DNA, 23 bp, Homo sapiens
ccctgcccttgtttggggcagga

SEQ ID NO: 2482149 - DNA, 19 bp, Homo sapiens
ccctgcctctcccaggcag

SEQ ID NO: 2482150 - DNA, 12 bp, Homo sapiens
ccctgcctggag

SEQ ID NO: 2482151 - DNA, 16 bp, Homo sapiens
ccctgcctggaggacc

SEQ ID NO: 2482152 - DNA, 22 bp, Homo sapiens
ccctgccttatcttgcacccca

SEQ ID NO: 2482153 - DNA, 22 bp, Homo sapiens
ccctgcgggtgaacaaagcagc

SEQ ID NO: 2482154 - DNA, 18 bp, Homo sapiens
ccctgctgccagcttcag

SEQ ID NO: 2482155 - DNA, 13 bp, Homo sapiens
ccctgctgccatg

SEQ ID NO: 2482156 - DNA, 10 bp, Homo sapiens
ccctgctttt

SEQ ID NO: 2482157 - DNA, 16 bp, Homo sapiens
ccctggacccagccag

SEQ ID NO: 2482158 - DNA, 21 bp, Homo sapiens
ccctggagggggaatggcagc

SEQ ID NO: 2482159 - DNA, 9 bp, Homo sapiens
ccctggccc

SEQ ID NO: 2482160 - DNA, 20 bp, Homo sapiens
ccctggccccctccctggat

SEQ ID NO: 2482161 - DNA, 20 bp, Homo sapiens
ccctggccgagtccaagctg

SEQ ID NO: 2482162 - DNA, 13 bp, Homo sapiens
ccctggcctcccc

SEQ ID NO: 2482163 - DNA, 24 bp, Homo sapiens
ccctggctttcattttctctcagg

SEQ ID NO: 2482164 - DNA, 22 bp, Homo sapiens
ccctgggagaatcgctcctgca

SEQ ID NO: 2482165 - DNA, 23 bp, Homo sapiens
ccctgggagggacatgcttagca

SEQ ID NO: 2482166 - DNA, 13 bp, Homo sapiens
ccctgggccttgg

SEQ ID NO: 2482167 - DNA, 13 bp, Homo sapiens
ccctgggctggaa

SEQ ID NO: 2482168 - DNA, 13 bp, Homo sapiens
ccctggggcctgt

SEQ ID NO: 2482169 - DNA, 14 bp, Homo sapiens
ccctggtcccctcc

SEQ ID NO: 2482170 - DNA, 23 bp, Homo sapiens
ccctggtgggccaacaaagaaca

SEQ ID NO: 2482171 - DNA, 11 bp, Homo sapiens
ccctgtaactt

SEQ ID NO: 2482172 - DNA, 18 bp, Homo sapiens
ccctgtacacaactcact

SEQ ID NO: 2482173 - DNA, 14 bp, Homo sapiens
ccctgtcctggtgg

SEQ ID NO: 2482174 - DNA, 17 bp, Homo sapiens
ccctgtccttagcctag

SEQ ID NO: 2482175 - DNA, 17 bp, Homo sapiens
ccctgtgcctcctccct

SEQ ID NO: 2482176 - DNA, 14 bp, Homo sapiens
ccaggaagtctcat

SEQ ID NO: 2482177 - DNA, 15 bp, Homo sapiens
ccaggaagtctcatc

SEQ ID NO: 2482178 - DNA, 12 bp, Homo sapiens
ccaggaccacag

SEQ ID NO: 2482179 - DNA, 21 bp, Homo sapiens
ccaggaccacaggctcaggca

SEQ ID NO: 2482180 - DNA, 20 bp, Homo sapiens
ccaggaccagctcaggacag

SEQ ID NO: 2482181 - DNA, 14 bp, Homo sapiens
ccaggaccctgaag

SEQ ID NO: 2482182 - DNA, 16 bp, Homo sapiens
ccaggaccctgaaggg

SEQ ID NO: 2482183 - DNA, 18 bp, Homo sapiens
ccaggaccctggacccag

SEQ ID NO: 2482184 - DNA, 19 bp, Homo sapiens
ccaggaccctggacccagc

SEQ ID NO: 2482185 - DNA, 17 bp, Homo sapiens
ccaggacctggctgcca

SEQ ID NO: 2482186 - DNA, 15 bp, Homo sapiens
ccaggagaagaaaga

SEQ ID NO: 2482187 - DNA, 11 bp, Homo sapiens
ccaggagaagc

SEQ ID NO: 2482188 - DNA, 19 bp, Homo sapiens
ccaggagcacggctctgtc

SEQ ID NO: 2482189 - DNA, 17 bp, Homo sapiens
ccaggagctccagtgtc

SEQ ID NO: 2482190 - DNA, 20 bp, Homo sapiens
ccaggagctccagtgtcctg

SEQ ID NO: 2482191 - DNA, 20 bp, Homo sapiens
ccaggagctcccctccccaa

SEQ ID NO: 2482192 - DNA, 15 bp, Homo sapiens
ccaggaggacccagg

SEQ ID NO: 2482193 - DNA, 22 bp, Homo sapiens
ccaggagggacaaaggagcctg

SEQ ID NO: 2482194 - DNA, 16 bp, Homo sapiens
ccaggatagagactgg

SEQ ID NO: 2482195 - DNA, 16 bp, Homo sapiens
ccaggcaaggctgtgg

SEQ ID NO: 2482196 - DNA, 17 bp, Homo sapiens
ccaggcaccaaaagaag

SEQ ID NO: 2482197 - DNA, 15 bp, Homo sapiens
ccaggcagatccagg

SEQ ID NO: 2482198 - DNA, 16 bp, Homo sapiens
ccaggcagatccagga

SEQ ID NO: 2482199 - DNA, 14 bp, Homo sapiens
ccaggcagcctctg

SEQ ID NO: 2482200 - DNA, 16 bp, Homo sapiens
ccaggcattgccaagg

SEQ ID NO: 2482201 - DNA, 13 bp, Homo sapiens
ccaggccacctcc

SEQ ID NO: 2482202 - DNA, 17 bp, Homo sapiens
ccaggccacctccccag

SEQ ID NO: 2482203 - DNA, 21 bp, Homo sapiens
ccaggccacctccccagcatt

SEQ ID NO: 2482204 - DNA, 13 bp, Homo sapiens
ccaggccaggact

SEQ ID NO: 2482205 - DNA, 17 bp, Homo sapiens
ccaggccaggactctgc

SEQ ID NO: 2482206 - DNA, 18 bp, Homo sapiens
ccaggccaggactctgca

SEQ ID NO: 2482207 - DNA, 20 bp, Homo sapiens
ccaggccaggactctgcagc

SEQ ID NO: 2482208 - DNA, 18 bp, Homo sapiens
ccaggccaggcatgtggc

SEQ ID NO: 2482209 - DNA, 18 bp, Homo sapiens
ccaggcccaaggctcccg

SEQ ID NO: 2482210 - DNA, 15 bp, Homo sapiens
ccaggccccatgacc

SEQ ID NO: 2482211 - DNA, 18 bp, Homo sapiens
ccaggccccatgacctcc

SEQ ID NO: 2482212 - DNA, 21 bp, Homo sapiens
ccaggccccatgacctccagc

SEQ ID NO: 2482213 - DNA, 22 bp, Homo sapiens
ccaggccccatgacctccagct

SEQ ID NO: 2482214 - DNA, 16 bp, Homo sapiens
ccaggcgctaattcaa

SEQ ID NO: 2482215 - DNA, 17 bp, Homo sapiens
ccaggctcggcctgccc

SEQ ID NO: 2482216 - DNA, 20 bp, Homo sapiens
ccaggctgaagcaggttccc

SEQ ID NO: 2482217 - DNA, 17 bp, Homo sapiens
ccaggctgaccacagca

SEQ ID NO: 2482218 - DNA, 14 bp, Homo sapiens
ccaggctgccgtcc

SEQ ID NO: 2482219 - DNA, 21 bp, Homo sapiens
ccaggctgccgtcccctagag

SEQ ID NO: 2482220 - DNA, 14 bp, Homo sapiens
ccaggctgccgtgg

SEQ ID NO: 2482221 - DNA, 18 bp, Homo sapiens
ccaggctgccgtggggcc

SEQ ID NO: 2482222 - DNA, 17 bp, Homo sapiens
ccaggctggtctaaaac

SEQ ID NO: 2482223 - DNA, 13 bp, Homo sapiens
ccaggcttctgct

SEQ ID NO: 2482224 - DNA, 15 bp, Homo sapiens
ccaggcttctgctgg

SEQ ID NO: 2482225 - DNA, 23 bp, Homo sapiens
ccaggcttctgctggggcctggg

SEQ ID NO: 2482226 - DNA, 20 bp, Homo sapiens
ccagggacacctgggagaaa

SEQ ID NO: 2482227 - DNA, 18 bp, Homo sapiens
ccagggacagaggcccca

SEQ ID NO: 2482228 - DNA, 20 bp, Homo sapiens
ccagggacagaggccccagc

SEQ ID NO: 2482229 - DNA, 15 bp, Homo sapiens
ccagggactctgccg

SEQ ID NO: 2482230 - DNA, 13 bp, Homo sapiens
ccagggagaagct

SEQ ID NO: 2482231 - DNA, 14 bp, Homo sapiens
ccagggagagccca

SEQ ID NO: 2482232 - DNA, 13 bp, Homo sapiens
ccagggagagggg

SEQ ID NO: 2482233 - DNA, 17 bp, Homo sapiens
ccagggcacaggagcta

SEQ ID NO: 2482234 - DNA, 20 bp, Homo sapiens
ccagggcatctctgggctgg

SEQ ID NO: 2482235 - DNA, 14 bp, Homo sapiens
ccagggccacgctc

SEQ ID NO: 2482236 - DNA, 13 bp, Homo sapiens
ccagggcccagag

SEQ ID NO: 2482237 - DNA, 16 bp, Homo sapiens
ccagggcccagagccc

SEQ ID NO: 2482238 - DNA, 17 bp, Homo sapiens
ccagggcccagagccca

SEQ ID NO: 2482239 - DNA, 22 bp, Homo sapiens
ccagggcccagagcccagctcc

SEQ ID NO: 2482240 - DNA, 22 bp, Homo sapiens
ccagggcccctcaccctgcctt

SEQ ID NO: 2482241 - DNA, 15 bp, Homo sapiens
ccagggcccctctcc

SEQ ID NO: 2482242 - DNA, 16 bp, Homo sapiens
ccagggctagtgactt

SEQ ID NO: 2482243 - DNA, 12 bp, Homo sapiens
ccagggctccag

SEQ ID NO: 2482244 - DNA, 14 bp, Homo sapiens
ccagggctccagcc

SEQ ID NO: 2482245 - DNA, 19 bp, Homo sapiens
ccagggctccagcccctct

SEQ ID NO: 2482246 - DNA, 15 bp, Homo sapiens
ccagggctgggagga

SEQ ID NO: 2482247 - DNA, 21 bp, Homo sapiens
ccagggctgggaggaaggact

SEQ ID NO: 2482248 - DNA, 19 bp, Homo sapiens
ccagggctgtaactgccag

SEQ ID NO: 2482249 - DNA, 19 bp, Homo sapiens
ccaggggaacactggggac

SEQ ID NO: 2482250 - DNA, 19 bp, Homo sapiens
ccaggggagcagaggggca

SEQ ID NO: 2482251 - DNA, 22 bp, Homo sapiens
ccaggggctgcttcctcctgga

SEQ ID NO: 2482252 - DNA, 16 bp, Homo sapiens
ccagggtccctctgtg

SEQ ID NO: 2482253 - DNA, 18 bp, Homo sapiens
ccagggtccctctgtgta

SEQ ID NO: 2482254 - DNA, 13 bp, Homo sapiens
ccagggtctccag

SEQ ID NO: 2482255 - DNA, 17 bp, Homo sapiens
ccagggtctccagaaag

SEQ ID NO: 2482256 - DNA, 21 bp, Homo sapiens
ccagggttgaccccagaggat

SEQ ID NO: 2482257 - DNA, 21 bp, Homo sapiens
ccagggttttgccccaagtcc

SEQ ID NO: 2482258 - DNA, 15 bp, Homo sapiens
ccaggtaggccaagg

SEQ ID NO: 2482259 - DNA, 21 bp, Homo sapiens
ccaggtaggccaaggtgtcct

SEQ ID NO: 2482260 - DNA, 20 bp, Homo sapiens
ccaggtcaccctttgctgtg

SEQ ID NO: 2482261 - DNA, 19 bp, Homo sapiens
ccaggtccaatgagctttc

SEQ ID NO: 2482262 - DNA, 20 bp, Homo sapiens
ccaggtccaatgagctttct

SEQ ID NO: 2482263 - DNA, 15 bp, Homo sapiens
ccaggtcctggtggg

SEQ ID NO: 2482264 - DNA, 20 bp, Homo sapiens
ccaggtctccctggatcaga

SEQ ID NO: 2482265 - DNA, 15 bp, Homo sapiens
ccaggtgaggtcagc

SEQ ID NO: 2482266 - DNA, 19 bp, Homo sapiens
ccaggtgaggtcagcacat

SEQ ID NO: 2482267 - DNA, 21 bp, Homo sapiens
ccaggttctccgttagctcct

SEQ ID NO: 2482268 - DNA, 24 bp, Homo sapiens
ccaggttctccgttagctcctgtg

SEQ ID NO: 2482269 - DNA, 14 bp, Homo sapiens
ccaggttggctctg

SEQ ID NO: 2482270 - DNA, 16 bp, Homo sapiens
ccaggttggctctgcc

SEQ ID NO: 2482271 - DNA, 17 bp, Homo sapiens
ccaggttggctctgcca

SEQ ID NO: 2482272 - DNA, 18 bp, Homo sapiens
ccaggttggctctgccag

SEQ ID NO: 2482273 - DNA, 24 bp, Homo sapiens
ccaggttggctctgccagtcctgt

SEQ ID NO: 2482274 - DNA, 21 bp, Homo sapiens
ccagtaacgcgtcttcctgag

SEQ ID NO: 2482275 - DNA, 14 bp, Homo sapiens
ccagtcaacctggg

SEQ ID NO: 2482276 - DNA, 13 bp, Homo sapiens
ccagtccaggctg

SEQ ID NO: 2482277 - DNA, 14 bp, Homo sapiens
ccagtccaggctgc

SEQ ID NO: 2482278 - DNA, 15 bp, Homo sapiens
ccagtccaggctgcc

SEQ ID NO: 2482279 - DNA, 19 bp, Homo sapiens
ccagtccaggctgccgtgg

SEQ ID NO: 2482280 - DNA, 15 bp, Homo sapiens
ccagtcccagagcag

SEQ ID NO: 2482281 - DNA, 22 bp, Homo sapiens
ccaacccgtctggcccaccagg

SEQ ID NO: 2482282 - DNA, 21 bp, Homo sapiens
ccaacccgtggaggctgctcg

SEQ ID NO: 2482283 - DNA, 17 bp, Homo sapiens
ccaacctgcaaagatct

SEQ ID NO: 2482284 - DNA, 18 bp, Homo sapiens
ccaacctgcaaagatctg

SEQ ID NO: 2482285 - DNA, 12 bp, Homo sapiens
ccaacctgctct

SEQ ID NO: 2482286 - DNA, 16 bp, Homo sapiens
ccaacctgctctcctc

SEQ ID NO: 2482287 - DNA, 18 bp, Homo sapiens
ccaacctgctctcctctt

SEQ ID NO: 2482288 - DNA, 22 bp, Homo sapiens
ccaactactaatagaataaagg

SEQ ID NO: 2482289 - DNA, 14 bp, Homo sapiens
ccaactatgattat

SEQ ID NO: 2482290 - DNA, 15 bp, Homo sapiens
ccaactcctagttct

SEQ ID NO: 2482291 - DNA, 15 bp, Homo sapiens
ccaactccttccagc

SEQ ID NO: 2482292 - DNA, 17 bp, Homo sapiens
ccaacttggctgcagga

SEQ ID NO: 2482293 - DNA, 18 bp, Homo sapiens
ccaagaatccacatttct

SEQ ID NO: 2482294 - DNA, 21 bp, Homo sapiens
ccaagactctagagtccaagg

SEQ ID NO: 2482295 - DNA, 22 bp, Homo sapiens
ccaagactgctgtggccaggag

SEQ ID NO: 2482296 - DNA, 18 bp, Homo sapiens
ccaagatgggcatctttt

SEQ ID NO: 2482297 - DNA, 13 bp, Homo sapiens
ccaagattccgga

SEQ ID NO: 2482298 - DNA, 20 bp, Homo sapiens
ccaagattccggatcctaag

SEQ ID NO: 2482299 - DNA, 14 bp, Homo sapiens
ccaagcacagcagc

SEQ ID NO: 2482300 - DNA, 18 bp, Homo sapiens
ccaagcacttctttttct

SEQ ID NO: 2482301 - DNA, 21 bp, Homo sapiens
ccaagcagttgggactacagg

SEQ ID NO: 2482302 - DNA, 22 bp, Homo sapiens
ccaagcatcttgggggggtggc

SEQ ID NO: 2482303 - DNA, 23 bp, Homo sapiens
ccaagcatcttgggggggtggcc

SEQ ID NO: 2482304 - DNA, 22 bp, Homo sapiens
ccaagccaagggaacctgtgtc

SEQ ID NO: 2482305 - DNA, 15 bp, Homo sapiens
ccaagcccagcccat

SEQ ID NO: 2482306 - DNA, 15 bp, Homo sapiens
ccaagctgaggtgcc

SEQ ID NO: 2482307 - DNA, 23 bp, Homo sapiens
ccaagctgaggtgcccaggagaa

SEQ ID NO: 2482308 - DNA, 17 bp, Homo sapiens
ccaagctgagtttccta

SEQ ID NO: 2482309 - DNA, 18 bp, Homo sapiens
ccaagctgagtttcctat

SEQ ID NO: 2482310 - DNA, 23 bp, Homo sapiens
ccaagctgcctcccctctccttc

SEQ ID NO: 2482311 - DNA, 14 bp, Homo sapiens
ccaaggaaaggcac

SEQ ID NO: 2482312 - DNA, 14 bp, Homo sapiens
ccaaggacctgaga

SEQ ID NO: 2482313 - DNA, 22 bp, Homo sapiens
ccaaggcagaggcctgggctgg

SEQ ID NO: 2482314 - DNA, 17 bp, Homo sapiens
ccaagggaacctgtgtc

SEQ ID NO: 2482315 - DNA, 18 bp, Homo sapiens
ccaagggatggacatctt

SEQ ID NO: 2482316 - DNA, 22 bp, Homo sapiens
ccaaggggatttttatgtctgg

SEQ ID NO: 2482317 - DNA, 15 bp, Homo sapiens
ccaaggggcctgagc

SEQ ID NO: 2482318 - DNA, 16 bp, Homo sapiens
ccaaggtgtcctacag

SEQ ID NO: 2482319 - DNA, 17 bp, Homo sapiens
ccaaggtgtcctacaga

SEQ ID NO: 2482320 - DNA, 18 bp, Homo sapiens
ccaaggtgtcctacagaa

SEQ ID NO: 2482321 - DNA, 19 bp, Homo sapiens
ccaaggtgtcctacagaaa

SEQ ID NO: 2482322 - DNA, 21 bp, Homo sapiens
ccaaggtgtcctacagaaaaa

SEQ ID NO: 2482323 - DNA, 22 bp, Homo sapiens
ccaagtagaatctcagttgatt

SEQ ID NO: 2482324 - DNA, 15 bp, Homo sapiens
ccaagtccaggtcct

SEQ ID NO: 2482325 - DNA, 18 bp, Homo sapiens
ccaagtccaggtcctggt

SEQ ID NO: 2482326 - DNA, 17 bp, Homo sapiens
ccaagtgaggcagccga

SEQ ID NO: 2482327 - DNA, 18 bp, Homo sapiens
ccaagtgaggcagccgag

SEQ ID NO: 2482328 - DNA, 14 bp, Homo sapiens
ccaatcctatgttt

SEQ ID NO: 2482329 - DNA, 20 bp, Homo sapiens
ccaatgagctttctgaacag

SEQ ID NO: 2482330 - DNA, 23 bp, Homo sapiens
ccaatgagctttctgaacagctg

SEQ ID NO: 2482331 - DNA, 20 bp, Homo sapiens
ccaatgggtttttccctgta

SEQ ID NO: 2482332 - DNA, 15 bp, Homo sapiens
ccaattagtttcctt

SEQ ID NO: 2482333 - DNA, 16 bp, Homo sapiens
ccaatttcagactccc

SEQ ID NO: 2482334 - DNA, 21 bp, Homo sapiens
ccaatttcggattttttccaa

SEQ ID NO: 2482335 - DNA, 12 bp, Homo sapiens
ccacaacatgag

SEQ ID NO: 2482336 - DNA, 16 bp, Homo sapiens
ccacaacatgaggcca

SEQ ID NO: 2482337 - DNA, 15 bp, Homo sapiens
ccacaactattttca

SEQ ID NO: 2482338 - DNA, 14 bp, Homo sapiens
ccacaagcctgagg

SEQ ID NO: 2482339 - DNA, 17 bp, Homo sapiens
ccacaaggacttcctgt

SEQ ID NO: 2482340 - DNA, 16 bp, Homo sapiens
ccacaagtgccctcca

SEQ ID NO: 2482341 - DNA, 20 bp, Homo sapiens
ccacaagtgccctccaggct

SEQ ID NO: 2482342 - DNA, 19 bp, Homo sapiens
ccacaccctgtactgttct

SEQ ID NO: 2482343 - DNA, 15 bp, Homo sapiens
ccacacctccttccc

SEQ ID NO: 2482344 - DNA, 19 bp, Homo sapiens
ccacactcagatcctcctc

SEQ ID NO: 2482345 - DNA, 14 bp, Homo sapiens
ccacactcagcaca

SEQ ID NO: 2482346 - DNA, 17 bp, Homo sapiens
ccacacttctcaggaca

SEQ ID NO: 2482347 - DNA, 24 bp, Homo sapiens
ccacacttctcaggacacaggcct

SEQ ID NO: 2482348 - DNA, 22 bp, Homo sapiens
ccacagacggaagggtaaacaa

SEQ ID NO: 2482349 - DNA, 23 bp, Homo sapiens
ccacagacggaagggtaaacaat

SEQ ID NO: 2482350 - DNA, 16 bp, Homo sapiens
ccacagataactgaaa

SEQ ID NO: 2482351 - DNA, 17 bp, Homo sapiens
ccacagccagcacctgg

SEQ ID NO: 2482352 - DNA, 19 bp, Homo sapiens
ccacagccagcacctggca

SEQ ID NO: 2482353 - DNA, 22 bp, Homo sapiens
ccacagccagcacctggcatcg

SEQ ID NO: 2482354 - DNA, 14 bp, Homo sapiens
ccacagccctgtca

SEQ ID NO: 2482355 - DNA, 16 bp, Homo sapiens
ccacagcctcccctgc

SEQ ID NO: 2482356 - DNA, 19 bp, Homo sapiens
ccacagcctcccctgccag

SEQ ID NO: 2482357 - DNA, 15 bp, Homo sapiens
ccacagcttttgcaa

SEQ ID NO: 2482358 - DNA, 23 bp, Homo sapiens
ccacaggaagcctgcagtcctgg

SEQ ID NO: 2482359 - DNA, 17 bp, Homo sapiens
ccacaggccgccctgcg

SEQ ID NO: 2482360 - DNA, 17 bp, Homo sapiens
ccacaggctcaggcagg

SEQ ID NO: 2482361 - DNA, 21 bp, Homo sapiens
ccacaggctcaggcaggggcc

SEQ ID NO: 2482362 - DNA, 19 bp, Homo sapiens
ccacagggtcccacagcca

SEQ ID NO: 2482363 - DNA, 21 bp, Homo sapiens
ccacagggtcccacagccacg

SEQ ID NO: 2482364 - DNA, 14 bp, Homo sapiens
ccacaggtctagac

SEQ ID NO: 2482365 - DNA, 22 bp, Homo sapiens
ccacaggttcatgccaccatgg

SEQ ID NO: 2482366 - DNA, 17 bp, Homo sapiens
ccacagtagtcttgatg

SEQ ID NO: 2482367 - DNA, 19 bp, Homo sapiens
ccacagtgtcaggcactgg

SEQ ID NO: 2482368 - DNA, 13 bp, Homo sapiens
ccacatccctggg

SEQ ID NO: 2482369 - DNA, 16 bp, Homo sapiens
ccacatccctgggcct

SEQ ID NO: 2482370 - DNA, 17 bp, Homo sapiens
ccacatccctgggcctg

SEQ ID NO: 2482371 - DNA, 19 bp, Homo sapiens
ccacatccctgggcctgct

SEQ ID NO: 2482372 - DNA, 15 bp, Homo sapiens
ccacatggcacagag

SEQ ID NO: 2482373 - DNA, 16 bp, Homo sapiens
ccacatgggaggctca

SEQ ID NO: 2482374 - DNA, 19 bp, Homo sapiens
ccacattggaagagcagca

SEQ ID NO: 2482375 - DNA, 19 bp, Homo sapiens
ccacatttggaatactttt

SEQ ID NO: 2482376 - DNA, 17 bp, Homo sapiens
ccaccaagacttgtttt

SEQ ID NO: 2482377 - DNA, 15 bp, Homo sapiens
ccaccacagccagca

SEQ ID NO: 2482378 - DNA, 12 bp, Homo sapiens
ccaccagatgct

SEQ ID NO: 2482379 - DNA, 14 bp, Homo sapiens
ccaccagctgtgtc

SEQ ID NO: 2482380 - DNA, 21 bp, Homo sapiens
ccaccaggccacctccccagc

SEQ ID NO: 2482381 - DNA, 16 bp, Homo sapiens
ccaccagggcatctct

SEQ ID NO: 2482382 - DNA, 19 bp, Homo sapiens
ccaccagggcatctctggg

SEQ ID NO: 2482383 - DNA, 21 bp, Homo sapiens
ccaccagggcatctctgggct

SEQ ID NO: 2482384 - DNA, 21 bp, Homo sapiens
ccaccatggccagccaacttt

SEQ ID NO: 2482385 - DNA, 21 bp, Homo sapiens
catctgtataccctctgtttc

SEQ ID NO: 2482386 - DNA, 12 bp, Homo sapiens
catctgtccccc

SEQ ID NO: 2482387 - DNA, 13 bp, Homo sapiens
catctgtccccct

SEQ ID NO: 2482388 - DNA, 23 bp, Homo sapiens
catctgtctgccaacctaaaact

SEQ ID NO: 2482389 - DNA, 17 bp, Homo sapiens
catctgtgcactgccca

SEQ ID NO: 2482390 - DNA, 21 bp, Homo sapiens
catctgtgcactgcccatgga

SEQ ID NO: 2482391 - DNA, 14 bp, Homo sapiens
catcttcagttgtc

SEQ ID NO: 2482392 - DNA, 23 bp, Homo sapiens
catcttcagttgtctctgatgca

SEQ ID NO: 2482393 - DNA, 16 bp, Homo sapiens
catcttgctaccagta

SEQ ID NO: 2482394 - DNA, 14 bp, Homo sapiens
catcttgcttccct

SEQ ID NO: 2482395 - DNA, 12 bp, Homo sapiens
catctttgaaat

SEQ ID NO: 2482396 - DNA, 18 bp, Homo sapiens
catctttgaaattatgta

SEQ ID NO: 2482397 - DNA, 22 bp, Homo sapiens
catcttttgtattaagaaagga

SEQ ID NO: 2482398 - DNA, 20 bp, Homo sapiens
catgaaaaatcatgggccag

SEQ ID NO: 2482399 - DNA, 17 bp, Homo sapiens
catgaaggtaaataaaa

SEQ ID NO: 2482400 - DNA, 20 bp, Homo sapiens
catgaaggtaaataaaaaga

SEQ ID NO: 2482401 - DNA, 21 bp, Homo sapiens
catgaaggtaaataaaaagaa

SEQ ID NO: 2482402 - DNA, 22 bp, Homo sapiens
catgaaggtaaataaaaagaaa

SEQ ID NO: 2482403 - DNA, 21 bp, Homo sapiens
catgaagtattttttcagtat

SEQ ID NO: 2482404 - DNA, 16 bp, Homo sapiens
catgaatgtaaatttg

SEQ ID NO: 2482405 - DNA, 17 bp, Homo sapiens
catgaatgtaaatttgt

SEQ ID NO: 2482406 - DNA, 18 bp, Homo sapiens
catgaattattacagtgt

SEQ ID NO: 2482407 - DNA, 18 bp, Homo sapiens
catgaatttgtaatgtct

SEQ ID NO: 2482408 - DNA, 15 bp, Homo sapiens
catgaattttagctt

SEQ ID NO: 2482409 - DNA, 16 bp, Homo sapiens
catgaattttagcttt

SEQ ID NO: 2482410 - DNA, 14 bp, Homo sapiens
catgacagcctcca

SEQ ID NO: 2482411 - DNA, 15 bp, Homo sapiens
catgaccctgcctct

SEQ ID NO: 2482412 - DNA, 13 bp, Homo sapiens
catgacctccagc

SEQ ID NO: 2482413 - DNA, 13 bp, Homo sapiens
catgagaaataca

SEQ ID NO: 2482414 - DNA, 22 bp, Homo sapiens
catgagaaatacaaaaatactc

SEQ ID NO: 2482415 - DNA, 16 bp, Homo sapiens
catgagaacaaacaga

SEQ ID NO: 2482416 - DNA, 19 bp, Homo sapiens
catgagaccactgttatca

SEQ ID NO: 2482417 - DNA, 20 bp, Homo sapiens
catgaggactctattcttta

SEQ ID NO: 2482418 - DNA, 19 bp, Homo sapiens
catgaggagattctgcctt

SEQ ID NO: 2482419 - DNA, 20 bp, Homo sapiens
catgaggagattctgccttt

SEQ ID NO: 2482420 - DNA, 21 bp, Homo sapiens
catgaggggttcctcccctcc

SEQ ID NO: 2482421 - DNA, 14 bp, Homo sapiens
catgagtgaataaa

SEQ ID NO: 2482422 - DNA, 20 bp, Homo sapiens
catgagttccagaaagtaaa

SEQ ID NO: 2482423 - DNA, 19 bp, Homo sapiens
catgataccacctttactg

SEQ ID NO: 2482424 - DNA, 21 bp, Homo sapiens
catgataccacctttactgtg

SEQ ID NO: 2482425 - DNA, 16 bp, Homo sapiens
catgatgcctctgtct

SEQ ID NO: 2482426 - DNA, 13 bp, Homo sapiens
catgattccttta

SEQ ID NO: 2482427 - DNA, 14 bp, Homo sapiens
catgatttccttga

SEQ ID NO: 2482428 - DNA, 16 bp, Homo sapiens
catgatttccttgaat

SEQ ID NO: 2482429 - DNA, 21 bp, Homo sapiens
catgattttaagtttctctgc

SEQ ID NO: 2482430 - DNA, 17 bp, Homo sapiens
catgcacagtatttgta

SEQ ID NO: 2482431 - DNA, 22 bp, Homo sapiens
catgcacagtatttgtaattaa

SEQ ID NO: 2482432 - DNA, 14 bp, Homo sapiens
catgcactgatgtt

SEQ ID NO: 2482433 - DNA, 10 bp, Homo sapiens
catgcactgt

SEQ ID NO: 2482434 - DNA, 16 bp, Homo sapiens
catgcactgtgaagga

SEQ ID NO: 2482435 - DNA, 20 bp, Homo sapiens
catgcactgtgaaggaccct

SEQ ID NO: 2482436 - DNA, 21 bp, Homo sapiens
catgccagctacttcctcctc

SEQ ID NO: 2482437 - DNA, 19 bp, Homo sapiens
catgccagtaacaggctca

SEQ ID NO: 2482438 - DNA, 17 bp, Homo sapiens
catgccatttgtactga

SEQ ID NO: 2482439 - DNA, 17 bp, Homo sapiens
catgcccagagacccag

SEQ ID NO: 2482440 - DNA, 14 bp, Homo sapiens
catgccctgtgcaa

SEQ ID NO: 2482441 - DNA, 18 bp, Homo sapiens
catgccctgtgcaacctc

SEQ ID NO: 2482442 - DNA, 18 bp, Homo sapiens
catgcctcagaagtgcat

SEQ ID NO: 2482443 - DNA, 13 bp, Homo sapiens
catgcctctgagg

SEQ ID NO: 2482444 - DNA, 17 bp, Homo sapiens
catgcctctgaggccag

SEQ ID NO: 2482445 - DNA, 21 bp, Homo sapiens
catgcctctgaggccagcctg

SEQ ID NO: 2482446 - DNA, 17 bp, Homo sapiens
catgcgatgacacttgt

SEQ ID NO: 2482447 - DNA, 15 bp, Homo sapiens
catgcgctcagggcc

SEQ ID NO: 2482448 - DNA, 13 bp, Homo sapiens
catgcggtagcca

SEQ ID NO: 2482449 - DNA, 19 bp, Homo sapiens
catgcggtagccagcacac

SEQ ID NO: 2482450 - DNA, 17 bp, Homo sapiens
catgctaagagaagtag

SEQ ID NO: 2482451 - DNA, 21 bp, Homo sapiens
catgctaagagaagtagaaat

SEQ ID NO: 2482452 - DNA, 18 bp, Homo sapiens
catgctcatctgctggtc

SEQ ID NO: 2482453 - DNA, 17 bp, Homo sapiens
catgctcctcttcccca

SEQ ID NO: 2482454 - DNA, 18 bp, Homo sapiens
catgctcctcttccccag

SEQ ID NO: 2482455 - DNA, 17 bp, Homo sapiens
catgctgaggcctgggc

SEQ ID NO: 2482456 - DNA, 16 bp, Homo sapiens
catgctgctggggaag

SEQ ID NO: 2482457 - DNA, 17 bp, Homo sapiens
catgctgctggggaaga

SEQ ID NO: 2482458 - DNA, 17 bp, Homo sapiens
catgcttattccatgac

SEQ ID NO: 2482459 - DNA, 15 bp, Homo sapiens
catggaaatttaaag

SEQ ID NO: 2482460 - DNA, 17 bp, Homo sapiens
catggaaatttaaagca

SEQ ID NO: 2482461 - DNA, 15 bp, Homo sapiens
catggaacacttcga

SEQ ID NO: 2482462 - DNA, 23 bp, Homo sapiens
catggacaatggaccggagagtg

SEQ ID NO: 2482463 - DNA, 16 bp, Homo sapiens
catggacaggctggct

SEQ ID NO: 2482464 - DNA, 14 bp, Homo sapiens
catggagaaagctg

SEQ ID NO: 2482465 - DNA, 15 bp, Homo sapiens
catggagaaagctga

SEQ ID NO: 2482466 - DNA, 20 bp, Homo sapiens
catggagaaagctgacttgg

SEQ ID NO: 2482467 - DNA, 19 bp, Homo sapiens
catggaggaggagggaggc

SEQ ID NO: 2482468 - DNA, 23 bp, Homo sapiens
catggaggaggagggaggcgctg

SEQ ID NO: 2482469 - DNA, 13 bp, Homo sapiens
catggagtggcag

SEQ ID NO: 2482470 - DNA, 23 bp, Homo sapiens
catggagtggcagcccagccagc

SEQ ID NO: 2482471 - DNA, 19 bp, Homo sapiens
catggatgggggaactcag

SEQ ID NO: 2482472 - DNA, 22 bp, Homo sapiens
catggcacagagattctgaact

SEQ ID NO: 2482473 - DNA, 19 bp, Homo sapiens
catggcagatgtaggaggg

SEQ ID NO: 2482474 - DNA, 20 bp, Homo sapiens
catggcagatgtaggaggga

SEQ ID NO: 2482475 - DNA, 13 bp, Homo sapiens
catggcagggggc

SEQ ID NO: 2482476 - DNA, 18 bp, Homo sapiens
catggcagggggctgctg

SEQ ID NO: 2482477 - DNA, 19 bp, Homo sapiens
catggcagggggctgctgc

SEQ ID NO: 2482478 - DNA, 16 bp, Homo sapiens
catggcatcctccagc

SEQ ID NO: 2482479 - DNA, 18 bp, Homo sapiens
catggcatcctccagccc

SEQ ID NO: 2482480 - DNA, 13 bp, Homo sapiens
catggccagcagc

SEQ ID NO: 2482481 - DNA, 23 bp, Homo sapiens
catggccagcagcacctgcccta

SEQ ID NO: 2482482 - DNA, 14 bp, Homo sapiens
catggccagctgga

SEQ ID NO: 2482483 - DNA, 15 bp, Homo sapiens
catggccctgagcga

SEQ ID NO: 2482484 - DNA, 16 bp, Homo sapiens
catggcctgcaaactg

SEQ ID NO: 2482485 - DNA, 20 bp, Homo sapiens
catggcgtggaggaggaggg

SEQ ID NO: 2482486 - DNA, 17 bp, Homo sapiens
catggctattttatatt

SEQ ID NO: 2482487 - DNA, 22 bp, Homo sapiens
catgggagccgggtctgcctct

SEQ ID NO: 2482488 - DNA, 14 bp, Homo sapiens
catgggaggctcac

SEQ ID NO: 2482489 - DNA, 22 bp, Homo sapiens
catgggccagagcctcggccct

SEQ ID NO: 2482490 - DNA, 11 bp, Homo sapiens
catggggaggg

SEQ ID NO: 2482491 - DNA, 20 bp, Homo sapiens
catggggagggattctggtt

SEQ ID NO: 2482492 - DNA, 14 bp, Homo sapiens
catggtcacacact

SEQ ID NO: 2482493 - DNA, 16 bp, Homo sapiens
catggtctgccctctg

SEQ ID NO: 2482494 - DNA, 18 bp, Homo sapiens
catggtgccccaggacca

SEQ ID NO: 2482495 - DNA, 20 bp, Homo sapiens
catggtgccccaggaccagc

SEQ ID NO: 2482496 - DNA, 21 bp, Homo sapiens
catggtgggtccatgggcaga

SEQ ID NO: 2482497 - DNA, 14 bp, Homo sapiens
catggtgttctcct

SEQ ID NO: 2482498 - DNA, 19 bp, Homo sapiens
catggttaagagtccaaga

SEQ ID NO: 2482499 - DNA, 15 bp, Homo sapiens
catggtttcagcact

SEQ ID NO: 2482500 - DNA, 16 bp, Homo sapiens
catggtttcagcacta

SEQ ID NO: 2482501 - DNA, 14 bp, Homo sapiens
catgtaaataatac

SEQ ID NO: 2482502 - DNA, 14 bp, Homo sapiens
catgtaactgccta

SEQ ID NO: 2482503 - DNA, 20 bp, Homo sapiens
catgtaactgcctagaaaca

SEQ ID NO: 2482504 - DNA, 22 bp, Homo sapiens
catgtactgagccttgtaattc

SEQ ID NO: 2482505 - DNA, 18 bp, Homo sapiens
catgtaggaagtaggaag

SEQ ID NO: 2482506 - DNA, 19 bp, Homo sapiens
catgtagtaacactaatat

SEQ ID NO: 2482507 - DNA, 21 bp, Homo sapiens
catgtagtaacactaatatat

SEQ ID NO: 2482508 - DNA, 21 bp, Homo sapiens
catgtattgcacattgtaaaa

SEQ ID NO: 2482509 - DNA, 15 bp, Homo sapiens
catgtatttggtgat

SEQ ID NO: 2482510 - DNA, 20 bp, Homo sapiens
catgtatttggtgattacat

SEQ ID NO: 2482511 - DNA, 18 bp, Homo sapiens
catgtcaagggttcaaga

SEQ ID NO: 2482512 - DNA, 13 bp, Homo sapiens
catgtccaaagag

SEQ ID NO: 2482513 - DNA, 14 bp, Homo sapiens
catgtccaaagagg

SEQ ID NO: 2482514 - DNA, 18 bp, Homo sapiens
catgtccaaagaggctgc

SEQ ID NO: 2482515 - DNA, 21 bp, Homo sapiens
catgtccaaagaggctgcccc

SEQ ID NO: 2482516 - DNA, 13 bp, Homo sapiens
catgtcctgccta

SEQ ID NO: 2482517 - DNA, 22 bp, Homo sapiens
catgtcctgcctattatctgtc

SEQ ID NO: 2482518 - DNA, 14 bp, Homo sapiens
catgtcttctccct

SEQ ID NO: 2482519 - DNA, 15 bp, Homo sapiens
catgtcttctccctg

SEQ ID NO: 2482520 - DNA, 12 bp, Homo sapiens
catgtgacattt

SEQ ID NO: 2482521 - DNA, 20 bp, Homo sapiens
catgtgagcatgtcacttcc

SEQ ID NO: 2482522 - DNA, 22 bp, Homo sapiens
catgtgccagggcaatgatgaa

SEQ ID NO: 2482523 - DNA, 18 bp, Homo sapiens
catgtgctgccctacagc

SEQ ID NO: 2482524 - DNA, 24 bp, Homo sapiens
catgtgctgccctacagcaccctg

SEQ ID NO: 2482525 - DNA, 14 bp, Homo sapiens
catgtggggccagg

SEQ ID NO: 2482526 - DNA, 14 bp, Homo sapiens
catgtgtataaaaa

SEQ ID NO: 2482527 - DNA, 18 bp, Homo sapiens
catgtgtgcaacagggta

SEQ ID NO: 2482528 - DNA, 23 bp, Homo sapiens
catgtgtgtccacgactgtctcc

SEQ ID NO: 2482529 - DNA, 23 bp, Homo sapiens
catgtgtgttaacccagtgcttt

SEQ ID NO: 2482530 - DNA, 15 bp, Homo sapiens
catgtgttatgtttt

SEQ ID NO: 2482531 - DNA, 16 bp, Homo sapiens
catgtgttatgttttc

SEQ ID NO: 2482532 - DNA, 22 bp, Homo sapiens
catgttagttaccttatagtta

SEQ ID NO: 2482533 - DNA, 24 bp, Homo sapiens
catgttagttaccttatagttact

SEQ ID NO: 2482534 - DNA, 14 bp, Homo sapiens
catgttctgtccct

SEQ ID NO: 2482535 - DNA, 19 bp, Homo sapiens
catgttgaagccactgcct

SEQ ID NO: 2482536 - DNA, 21 bp, Homo sapiens
catgttggccaggctggtcta

SEQ ID NO: 2482537 - DNA, 21 bp, Homo sapiens
catgttgggaaacttggctcg

SEQ ID NO: 2482538 - DNA, 15 bp, Homo sapiens
catgtttagacttta

SEQ ID NO: 2482539 - DNA, 21 bp, Homo sapiens
catgtttagtgaatgactttt

SEQ ID NO: 2482540 - DNA, 15 bp, Homo sapiens
catgtttatttttct

SEQ ID NO: 2482541 - DNA, 20 bp, Homo sapiens
catgtttatttttcttgtct

SEQ ID NO: 2482542 - DNA, 15 bp, Homo sapiens
catgtttccagcatt

SEQ ID NO: 2482543 - DNA, 16 bp, Homo sapiens
catgtttccagcattc

SEQ ID NO: 2482544 - DNA, 20 bp, Homo sapiens
catgtttccagcattcccag

SEQ ID NO: 2482545 - DNA, 22 bp, Homo sapiens
catgtttccagcattcccaggt

SEQ ID NO: 2482546 - DNA, 13 bp, Homo sapiens
catgtttcctcta

SEQ ID NO: 2482547 - DNA, 22 bp, Homo sapiens
cattaaacgatttttaaaatgt

SEQ ID NO: 2482548 - DNA, 15 bp, Homo sapiens
cattaaagaagacct

SEQ ID NO: 2482549 - DNA, 11 bp, Homo sapiens
cattaaataaa

SEQ ID NO: 2482550 - DNA, 18 bp, Homo sapiens
cattaatctgcctccctc

SEQ ID NO: 2482551 - DNA, 23 bp, Homo sapiens
cattactataagaactttgagct

SEQ ID NO: 2482552 - DNA, 23 bp, Homo sapiens
cattactgtacagggttatctgc

SEQ ID NO: 2482553 - DNA, 15 bp, Homo sapiens
cattagaaatatttt

SEQ ID NO: 2482554 - DNA, 19 bp, Homo sapiens
cattagaagacaattgaca

SEQ ID NO: 2482555 - DNA, 20 bp, Homo sapiens
cattagggatgcctcctttc

SEQ ID NO: 2482556 - DNA, 22 bp, Homo sapiens
cattagtcatgtttatctgctt

SEQ ID NO: 2482557 - DNA, 14 bp, Homo sapiens
cattataatgaatt

SEQ ID NO: 2482558 - DNA, 15 bp, Homo sapiens
cattataatgaattt

SEQ ID NO: 2482559 - DNA, 21 bp, Homo sapiens
cattatcgagcagcattttat

SEQ ID NO: 2482560 - DNA, 16 bp, Homo sapiens
cattattacttttgct

SEQ ID NO: 2482561 - DNA, 22 bp, Homo sapiens
cattattcgtagatattggaca

SEQ ID NO: 2482562 - DNA, 18 bp, Homo sapiens
cattattggaatataatt

SEQ ID NO: 2482563 - DNA, 22 bp, Homo sapiens
cattatttatgtattgtgcaat

SEQ ID NO: 2482564 - DNA, 13 bp, Homo sapiens
cattcaggaattc

SEQ ID NO: 2482565 - DNA, 17 bp, Homo sapiens
cattcatttttgttgtt

SEQ ID NO: 2482566 - DNA, 17 bp, Homo sapiens
cattccaagactctaga

SEQ ID NO: 2482567 - DNA, 13 bp, Homo sapiens
cattccagcccct

SEQ ID NO: 2482568 - DNA, 15 bp, Homo sapiens
cattccagcccctct

SEQ ID NO: 2482569 - DNA, 18 bp, Homo sapiens
cattccagcccctctggt

SEQ ID NO: 2482570 - DNA, 16 bp, Homo sapiens
cattccatgtgcccag

SEQ ID NO: 2482571 - DNA, 19 bp, Homo sapiens
cattcccgcagtgggagca

SEQ ID NO: 2482572 - DNA, 20 bp, Homo sapiens
cattcccgcagtgggagcaa

SEQ ID NO: 2482573 - DNA, 17 bp, Homo sapiens
cattcctgaagaaccag

SEQ ID NO: 2482574 - DNA, 20 bp, Homo sapiens
cattcctgaagaaccagtcc

SEQ ID NO: 2482575 - DNA, 22 bp, Homo sapiens
cattccttcccagaggggcctg

SEQ ID NO: 2482576 - DNA, 21 bp, Homo sapiens
cattcgacctataagaagcct

SEQ ID NO: 2482577 - DNA, 23 bp, Homo sapiens
cattcgacctataagaagcctta

SEQ ID NO: 2482578 - DNA, 22 bp, Homo sapiens
cattcgctactatgatttaatt

SEQ ID NO: 2482579 - DNA, 22 bp, Homo sapiens
cattctcattggaaatttagca

SEQ ID NO: 2482580 - DNA, 14 bp, Homo sapiens
cattctctgtctca

SEQ ID NO: 2482581 - DNA, 19 bp, Homo sapiens
cattctctgtctcatccat

SEQ ID NO: 2482582 - DNA, 11 bp, Homo sapiens
cattctgaatg

SEQ ID NO: 2482583 - DNA, 18 bp, Homo sapiens
cattctgaatgcttctaa

SEQ ID NO: 2482584 - DNA, 17 bp, Homo sapiens
cattctgcaagtatact

SEQ ID NO: 2482585 - DNA, 21 bp, Homo sapiens
cattcttctctgttgtcgtaa

SEQ ID NO: 2482586 - DNA, 14 bp, Homo sapiens
cattgaacacaaac

SEQ ID NO: 2482587 - DNA, 15 bp, Homo sapiens
cattgaacacaaact

SEQ ID NO: 2482588 - DNA, 16 bp, Homo sapiens
cattgagttggttact

SEQ ID NO: 2482589 - DNA, 18 bp, Homo sapiens
cattgagttggttacttc

SEQ ID NO: 2482590 - DNA, 16 bp, Homo sapiens
cattgcatcaaagcat

SEQ ID NO: 2482591 - DNA, 14 bp, Homo sapiens
cattgctgtgaaca

SEQ ID NO: 2482592 - DNA, 11 bp, Homo sapiens
cattgcttttc

SEQ ID NO: 2482593 - DNA, 19 bp, Homo sapiens
cattggaaatttagcattg

SEQ ID NO: 2482594 - DNA, 21 bp, Homo sapiens
cattggaaatttagcattgta

SEQ ID NO: 2482595 - DNA, 15 bp, Homo sapiens
cattggaactggagg

SEQ ID NO: 2482596 - DNA, 19 bp, Homo sapiens
cattggaactggaggcagg

SEQ ID NO: 2482597 - DNA, 18 bp, Homo sapiens
cattggaatgttctcaga

SEQ ID NO: 2482598 - DNA, 16 bp, Homo sapiens
cattggacccttccat

SEQ ID NO: 2482599 - DNA, 18 bp, Homo sapiens
cattggctatttaaaact

SEQ ID NO: 2482600 - DNA, 20 bp, Homo sapiens
cattgtaaaagcattttgta

SEQ ID NO: 2482601 - DNA, 23 bp, Homo sapiens
cattgtaaaagcattttgtaata

SEQ ID NO: 2482602 - DNA, 18 bp, Homo sapiens
cattgtagtgctttgaga

SEQ ID NO: 2482603 - DNA, 21 bp, Homo sapiens
cattgtccaatcctatgtttt

SEQ ID NO: 2482604 - DNA, 17 bp, Homo sapiens
cattgtttcgtaacaca

SEQ ID NO: 2482605 - DNA, 21 bp, Homo sapiens
catttaaaacattaaaatata

SEQ ID NO: 2482606 - DNA, 12 bp, Homo sapiens
catttaaaagca

SEQ ID NO: 2482607 - DNA, 20 bp, Homo sapiens
catttaacccccctgtacac

SEQ ID NO: 2482608 - DNA, 17 bp, Homo sapiens
catttagcctgtcctgt

SEQ ID NO: 2482609 - DNA, 22 bp, Homo sapiens
catttagctaaacggattccaa

SEQ ID NO: 2482610 - DNA, 12 bp, Homo sapiens
catttatatatt

SEQ ID NO: 2482611 - DNA, 14 bp, Homo sapiens
catttatctataat

SEQ ID NO: 2482612 - DNA, 21 bp, Homo sapiens
catttatctataatttaccta

SEQ ID NO: 2482613 - DNA, 22 bp, Homo sapiens
catttcagagttctttttgaag

SEQ ID NO: 2482614 - DNA, 23 bp, Homo sapiens
catttcctatcacctatttccat

SEQ ID NO: 2482615 - DNA, 12 bp, Homo sapiens
catttcctgggt

SEQ ID NO: 2482616 - DNA, 21 bp, Homo sapiens
catttcctgggtggctactct

SEQ ID NO: 2482617 - DNA, 23 bp, Homo sapiens
catttctaattatgtagctcttt

SEQ ID NO: 2482618 - DNA, 13 bp, Homo sapiens
catttctgaggtg

SEQ ID NO: 2482619 - DNA, 18 bp, Homo sapiens
catttctgaggtgcactg

SEQ ID NO: 2482620 - DNA, 22 bp, Homo sapiens
catttgcaagggaaaagtctct

SEQ ID NO: 2482621 - DNA, 13 bp, Homo sapiens
catttgcatttgt

SEQ ID NO: 2482622 - DNA, 16 bp, Homo sapiens
catttgctgttttaaa

SEQ ID NO: 2482623 - DNA, 15 bp, Homo sapiens
catttgctttttgtg

SEQ ID NO: 2482624 - DNA, 18 bp, Homo sapiens
catttggcatccctgggc

SEQ ID NO: 2482625 - DNA, 18 bp, Homo sapiens
catttgggagacatgtga

SEQ ID NO: 2482626 - DNA, 23 bp, Homo sapiens
catttgggagtttttatgagaaa

SEQ ID NO: 2482627 - DNA, 15 bp, Homo sapiens
catttgggtccagga

SEQ ID NO: 2482628 - DNA, 21 bp, Homo sapiens
catttgtcagtatttttgccg

SEQ ID NO: 2482629 - DNA, 17 bp, Homo sapiens
catttgtttatgtaatt

SEQ ID NO: 2482630 - DNA, 18 bp, Homo sapiens
catttgtttatgtaattt

SEQ ID NO: 2482631 - DNA, 23 bp, Homo sapiens
catttgtttctttctctgaggac

SEQ ID NO: 2482632 - DNA, 17 bp, Homo sapiens
catttgttttgtttaca

SEQ ID NO: 2482633 - DNA, 14 bp, Homo sapiens
cattttaattctct

SEQ ID NO: 2482634 - DNA, 17 bp, Homo sapiens
cattttcaccccaccct

SEQ ID NO: 2482635 - DNA, 14 bp, Homo sapiens
cattttctaagaaa

SEQ ID NO: 2482636 - DNA, 17 bp, Homo sapiens
cattttctaagaaacat

SEQ ID NO: 2482637 - DNA, 14 bp, Homo sapiens
cattttctctcagg

SEQ ID NO: 2482638 - DNA, 14 bp, Homo sapiens
cattttggtacttt

SEQ ID NO: 2482639 - DNA, 16 bp, Homo sapiens
catttttacaatgtaa

SEQ ID NO: 2482640 - DNA, 19 bp, Homo sapiens
catttttacaatgtaatta

SEQ ID NO: 2482641 - DNA, 20 bp, Homo sapiens
catttttactattgttacat

SEQ ID NO: 2482642 - DNA, 17 bp, Homo sapiens
catttttcaatagcaca

SEQ ID NO: 2482643 - DNA, 16 bp, Homo sapiens
catttttcatgataat

SEQ ID NO: 2482644 - DNA, 18 bp, Homo sapiens
catttttttccttgcaaa

SEQ ID NO: 2482645 - DNA, 15 bp, Homo sapiens
cattttttttctttg

SEQ ID NO: 2482646 - DNA, 17 bp, Homo sapiens
cattttttttctttgaa

SEQ ID NO: 2482647 - DNA, 15 bp, Homo sapiens
catttttttttcaat

SEQ ID NO: 2482648 - DNA, 13 bp, Homo sapiens
ccaaaaatagcta

SEQ ID NO: 2482649 - DNA, 15 bp, Homo sapiens
ccaaaaccgccagct

SEQ ID NO: 2482650 - DNA, 17 bp, Homo sapiens
ccaaaaccgccagctct

SEQ ID NO: 2482651 - DNA, 18 bp, Homo sapiens
ccaaaaccgccagctctg

SEQ ID NO: 2482652 - DNA, 21 bp, Homo sapiens
ccaaaaccgccagctctgttc

SEQ ID NO: 2482653 - DNA, 23 bp, Homo sapiens
ccaaaataaataaggaaaagctt

SEQ ID NO: 2482654 - DNA, 15 bp, Homo sapiens
ccaaaatgtgcctat

SEQ ID NO: 2482655 - DNA, 17 bp, Homo sapiens
ccaaaatgttgctgaaa

SEQ ID NO: 2482656 - DNA, 22 bp, Homo sapiens
ccaaacaccttccagctcctgt

SEQ ID NO: 2482657 - DNA, 14 bp, Homo sapiens
ccaaaccctgtctg

SEQ ID NO: 2482658 - DNA, 16 bp, Homo sapiens
ccaaacctcaccaact

SEQ ID NO: 2482659 - DNA, 21 bp, Homo sapiens
ccaaacgccctttcctcctca

SEQ ID NO: 2482660 - DNA, 17 bp, Homo sapiens
ccaaactgatccagtat

SEQ ID NO: 2482661 - DNA, 14 bp, Homo sapiens
ccaaagaggctgcc

SEQ ID NO: 2482662 - DNA, 17 bp, Homo sapiens
ccaaagaggctgcccct

SEQ ID NO: 2482663 - DNA, 20 bp, Homo sapiens
ccaaagaggctgcccctctc

SEQ ID NO: 2482664 - DNA, 16 bp, Homo sapiens
ccaaagcaagcaagag

SEQ ID NO: 2482665 - DNA, 13 bp, Homo sapiens
ccaaagctttcct

SEQ ID NO: 2482666 - DNA, 14 bp, Homo sapiens
ccaaagctttcctg

SEQ ID NO: 2482667 - DNA, 15 bp, Homo sapiens
ccaaagctttcctgc

SEQ ID NO: 2482668 - DNA, 17 bp, Homo sapiens
ccaaagctttcctgccc

SEQ ID NO: 2482669 - DNA, 19 bp, Homo sapiens
ccaaagctttcctgcccca

SEQ ID NO: 2482670 - DNA, 17 bp, Homo sapiens
ccaaaggacagccgcct

SEQ ID NO: 2482671 - DNA, 18 bp, Homo sapiens
ccaaagggagtctgccag

SEQ ID NO: 2482672 - DNA, 17 bp, Homo sapiens
ccaaagtcataattgca

SEQ ID NO: 2482673 - DNA, 15 bp, Homo sapiens
ccaaagtctctaatt

SEQ ID NO: 2482674 - DNA, 16 bp, Homo sapiens
ccaaagtctctaattc

SEQ ID NO: 2482675 - DNA, 18 bp, Homo sapiens
ccaaagtctctaattcta

SEQ ID NO: 2482676 - DNA, 12 bp, Homo sapiens
ccaaagttctaa

SEQ ID NO: 2482677 - DNA, 19 bp, Homo sapiens
ccaaagttctaataatttc

SEQ ID NO: 2482678 - DNA, 20 bp, Homo sapiens
ccaaagttctaataatttct

SEQ ID NO: 2482679 - DNA, 23 bp, Homo sapiens
ccaaagttgttgtaacctgctgt

SEQ ID NO: 2482680 - DNA, 13 bp, Homo sapiens
ccaaatatgtcct

SEQ ID NO: 2482681 - DNA, 15 bp, Homo sapiens
ccaaatcccctaagc

SEQ ID NO: 2482682 - DNA, 17 bp, Homo sapiens
ccaaattaaaaaagata

SEQ ID NO: 2482683 - DNA, 13 bp, Homo sapiens
ccaaattcagttt

SEQ ID NO: 2482684 - DNA, 15 bp, Homo sapiens
ccaaattcagtttca

SEQ ID NO: 2482685 - DNA, 19 bp, Homo sapiens
ccaaattcagtttcataaa

SEQ ID NO: 2482686 - DNA, 18 bp, Homo sapiens
ccaaatttaaaactgttg

SEQ ID NO: 2482687 - DNA, 19 bp, Homo sapiens
ccaacaaagaacactaact

SEQ ID NO: 2482688 - DNA, 13 bp, Homo sapiens
ccaacaccaagca

SEQ ID NO: 2482689 - DNA, 19 bp, Homo sapiens
ccaacaccaagcacagcag

SEQ ID NO: 2482690 - DNA, 22 bp, Homo sapiens
ccaacaccaagcacagcagcct

SEQ ID NO: 2482691 - DNA, 23 bp, Homo sapiens
ccaacaccaagcacagcagcctg

SEQ ID NO: 2482692 - DNA, 17 bp, Homo sapiens
ccaacacgcacctgcct

SEQ ID NO: 2482693 - DNA, 22 bp, Homo sapiens
ccaacagctggaccctgaccag

SEQ ID NO: 2482694 - DNA, 15 bp, Homo sapiens
ccaacataaaaatga

SEQ ID NO: 2482695 - DNA, 17 bp, Homo sapiens
ccaacatcacagcccag

SEQ ID NO: 2482696 - DNA, 15 bp, Homo sapiens
ccaaccaaataagac

SEQ ID NO: 2482697 - DNA, 13 bp, Homo sapiens
ccaaccatttcct

SEQ ID NO: 2482698 - DNA, 19 bp, Homo sapiens
ttgtttttaaactgtacag

SEQ ID NO: 2482699 - DNA, 13 bp, Homo sapiens
tttaaaaaagctt

SEQ ID NO: 2482700 - DNA, 20 bp, Homo sapiens
tttaaaaataagtcaacagt

SEQ ID NO: 2482701 - DNA, 21 bp, Homo sapiens
tttaaaaataagtcaacagta

SEQ ID NO: 2482702 - DNA, 15 bp, Homo sapiens
tttaaaactgttgga

SEQ ID NO: 2482703 - DNA, 11 bp, Homo sapiens
tttaaaacttg

SEQ ID NO: 2482704 - DNA, 17 bp, Homo sapiens
tttaaaagatgctttta

SEQ ID NO: 2482705 - DNA, 13 bp, Homo sapiens
tttaaaagcacga

SEQ ID NO: 2482706 - DNA, 14 bp, Homo sapiens
tttaaaagcctgct

SEQ ID NO: 2482707 - DNA, 18 bp, Homo sapiens
tttaaaagtgtcaagctg

SEQ ID NO: 2482708 - DNA, 17 bp, Homo sapiens
tttaaaatagcgttctt

SEQ ID NO: 2482709 - DNA, 23 bp, Homo sapiens
tttaaaatagcgttcttgtaatt

SEQ ID NO: 2482710 - DNA, 15 bp, Homo sapiens
tttaaacattaatag

SEQ ID NO: 2482711 - DNA, 17 bp, Homo sapiens
tttaaaccgctaaaaga

SEQ ID NO: 2482712 - DNA, 22 bp, Homo sapiens
tttaaaccgctaaaagaaactt

SEQ ID NO: 2482713 - DNA, 16 bp, Homo sapiens
tttaaactgtacagtg

SEQ ID NO: 2482714 - DNA, 21 bp, Homo sapiens
tttaaagaaaaaaattgaaat

SEQ ID NO: 2482715 - DNA, 13 bp, Homo sapiens
tttaaagagtcta

SEQ ID NO: 2482716 - DNA, 15 bp, Homo sapiens
tttaaagagtctaga

SEQ ID NO: 2482717 - DNA, 18 bp, Homo sapiens
tttaaagagtctagattc

SEQ ID NO: 2482718 - DNA, 22 bp, Homo sapiens
tttaaagttagtatcttttgat

SEQ ID NO: 2482719 - DNA, 14 bp, Homo sapiens
tttaacaacatgtt

SEQ ID NO: 2482720 - DNA, 12 bp, Homo sapiens
tttaacagaaat

SEQ ID NO: 2482721 - DNA, 14 bp, Homo sapiens
tttaacagaaattg

SEQ ID NO: 2482722 - DNA, 13 bp, Homo sapiens
tttaacataagct

SEQ ID NO: 2482723 - DNA, 22 bp, Homo sapiens
tttaacattcctcatgaatgta

SEQ ID NO: 2482724 - DNA, 23 bp, Homo sapiens
tttaacattcctcatgaatgtaa

SEQ ID NO: 2482725 - DNA, 16 bp, Homo sapiens
tttaacctttgataga

SEQ ID NO: 2482726 - DNA, 23 bp, Homo sapiens
tttaactgactattcttgatgta

SEQ ID NO: 2482727 - DNA, 13 bp, Homo sapiens
tttaactgtggat

SEQ ID NO: 2482728 - DNA, 18 bp, Homo sapiens
tttaactgtggatattgt

SEQ ID NO: 2482729 - DNA, 14 bp, Homo sapiens
tttaacttaaatag

SEQ ID NO: 2482730 - DNA, 12 bp, Homo sapiens
tttaactttgtt

SEQ ID NO: 2482731 - DNA, 21 bp, Homo sapiens
tttaagaatatctgtaatggt

SEQ ID NO: 2482732 - DNA, 15 bp, Homo sapiens
tttaagaattgagta

SEQ ID NO: 2482733 - DNA, 20 bp, Homo sapiens
tttaagaattgagtaatggt

SEQ ID NO: 2482734 - DNA, 14 bp, Homo sapiens
tttaagataattat

SEQ ID NO: 2482735 - DNA, 15 bp, Homo sapiens
tttaagtctctcgta

SEQ ID NO: 2482736 - DNA, 12 bp, Homo sapiens
tttaataaaaga

SEQ ID NO: 2482737 - DNA, 11 bp, Homo sapiens
tttaataattt

SEQ ID NO: 2482738 - DNA, 17 bp, Homo sapiens
tttaatagcaaagaatt

SEQ ID NO: 2482739 - DNA, 18 bp, Homo sapiens
tttaatagcaaagaattg

SEQ ID NO: 2482740 - DNA, 23 bp, Homo sapiens
tttaatataaagtagtcctgtga

SEQ ID NO: 2482741 - DNA, 17 bp, Homo sapiens
tttaatcaaatttgtag

SEQ ID NO: 2482742 - DNA, 23 bp, Homo sapiens
tttaattattattcttcataaca

SEQ ID NO: 2482743 - DNA, 18 bp, Homo sapiens
tttaatttagtaaaccaa

SEQ ID NO: 2482744 - DNA, 22 bp, Homo sapiens
tttaatttagtaaaccaatcct

SEQ ID NO: 2482745 - DNA, 15 bp, Homo sapiens
tttacaaaaatataa

SEQ ID NO: 2482746 - DNA, 18 bp, Homo sapiens
tttacaaaacaaactcat

SEQ ID NO: 2482747 - DNA, 19 bp, Homo sapiens
tttacaaaactacatgaga

SEQ ID NO: 2482748 - DNA, 13 bp, Homo sapiens
tttacaaactgaa

SEQ ID NO: 2482749 - DNA, 20 bp, Homo sapiens
tttacaaatgttaaaatgtg

SEQ ID NO: 2482750 - DNA, 21 bp, Homo sapiens
tttacaaatgttaaaatgtgt

SEQ ID NO: 2482751 - DNA, 15 bp, Homo sapiens
tttacaatgtaatta

SEQ ID NO: 2482752 - DNA, 16 bp, Homo sapiens
tttacaatgtaattat

SEQ ID NO: 2482753 - DNA, 13 bp, Homo sapiens
tttacagaatttt

SEQ ID NO: 2482754 - DNA, 14 bp, Homo sapiens
tttacaggaacttc

SEQ ID NO: 2482755 - DNA, 15 bp, Homo sapiens
tttacatgaagtatt

SEQ ID NO: 2482756 - DNA, 20 bp, Homo sapiens
tttaccctggcccctctccc

SEQ ID NO: 2482757 - DNA, 12 bp, Homo sapiens
tttacctcagcc

SEQ ID NO: 2482758 - DNA, 13 bp, Homo sapiens
tttaccttgtata

SEQ ID NO: 2482759 - DNA, 13 bp, Homo sapiens
tttacgctttgat

SEQ ID NO: 2482760 - DNA, 23 bp, Homo sapiens
tttactagggatccctcatctgt

SEQ ID NO: 2482761 - DNA, 17 bp, Homo sapiens
tttactccgtaacagat

SEQ ID NO: 2482762 - DNA, 13 bp, Homo sapiens
tttactctgccta

SEQ ID NO: 2482763 - DNA, 13 bp, Homo sapiens
tttacttttgttt

SEQ ID NO: 2482764 - DNA, 16 bp, Homo sapiens
tttagaaaactttaaa

SEQ ID NO: 2482765 - DNA, 15 bp, Homo sapiens
tttagaaagataatt

SEQ ID NO: 2482766 - DNA, 13 bp, Homo sapiens
tttagaaatcatt

SEQ ID NO: 2482767 - DNA, 16 bp, Homo sapiens
tttagaaatcattttg

SEQ ID NO: 2482768 - DNA, 22 bp, Homo sapiens
tttagacttggattctttccat

SEQ ID NO: 2482769 - DNA, 15 bp, Homo sapiens
tttagactttaacat

SEQ ID NO: 2482770 - DNA, 22 bp, Homo sapiens
tttagagataagagttggctgg

SEQ ID NO: 2482771 - DNA, 22 bp, Homo sapiens
tttagatagccctgtcctggtg

SEQ ID NO: 2482772 - DNA, 17 bp, Homo sapiens
tttagatgtaattttgt

SEQ ID NO: 2482773 - DNA, 19 bp, Homo sapiens
tttagattttcttttgcct

SEQ ID NO: 2482774 - DNA, 14 bp, Homo sapiens
tttagcatgttgtt

SEQ ID NO: 2482775 - DNA, 12 bp, Homo sapiens
tttagcattgta

SEQ ID NO: 2482776 - DNA, 14 bp, Homo sapiens
tttagcctgtcctg

SEQ ID NO: 2482777 - DNA, 13 bp, Homo sapiens
ttctaggtttcaa

SEQ ID NO: 2482778 - DNA, 14 bp, Homo sapiens
ttctatagccaaaa

SEQ ID NO: 2482779 - DNA, 15 bp, Homo sapiens
ttctatagccaaaaa

SEQ ID NO: 2482780 - DNA, 17 bp, Homo sapiens
ttctatagccaaaaata

SEQ ID NO: 2482781 - DNA, 13 bp, Homo sapiens
ttctattaaaaga

SEQ ID NO: 2482782 - DNA, 14 bp, Homo sapiens
ttctattaaaagac

SEQ ID NO: 2482783 - DNA, 15 bp, Homo sapiens
ttctattaaaagact

SEQ ID NO: 2482784 - DNA, 17 bp, Homo sapiens
ttctattaaaagactca

SEQ ID NO: 2482785 - DNA, 19 bp, Homo sapiens
ttctattaaaagactcatc

SEQ ID NO: 2482786 - DNA, 19 bp, Homo sapiens
tttatgataatagattctc

SEQ ID NO: 2482787 - DNA, 13 bp, Homo sapiens
tttatgcttgcaa

SEQ ID NO: 2482788 - DNA, 17 bp, Homo sapiens
tttatgttatatataaa

SEQ ID NO: 2482789 - DNA, 21 bp, Homo sapiens
tttatgttatatataaatata

SEQ ID NO: 2482790 - DNA, 22 bp, Homo sapiens
tttatgttatatataaatatat

SEQ ID NO: 2482791 - DNA, 12 bp, Homo sapiens
tttattaaagaa

SEQ ID NO: 2482792 - DNA, 12 bp, Homo sapiens
tttattaatgca

SEQ ID NO: 2482793 - DNA, 15 bp, Homo sapiens
tttattatgaagaag

SEQ ID NO: 2482794 - DNA, 17 bp, Homo sapiens
tttattatgcattatat

SEQ ID NO: 2482795 - DNA, 19 bp, Homo sapiens
tttattccagaatgctgta

SEQ ID NO: 2482796 - DNA, 15 bp, Homo sapiens
tttattcttctagag

SEQ ID NO: 2482797 - DNA, 18 bp, Homo sapiens
tttattcttctagagttc

SEQ ID NO: 2482798 - DNA, 17 bp, Homo sapiens
tttattggttttgcaga

SEQ ID NO: 2482799 - DNA, 13 bp, Homo sapiens
tttattgtattct

SEQ ID NO: 2482800 - DNA, 18 bp, Homo sapiens
tttattgtattctggggt

SEQ ID NO: 2482801 - DNA, 22 bp, Homo sapiens
tttatttaaaaaactaaaaact

SEQ ID NO: 2482802 - DNA, 12 bp, Homo sapiens
tttatttttcat

SEQ ID NO: 2482803 - DNA, 13 bp, Homo sapiens
tttcaaaaccagg

SEQ ID NO: 2482804 - DNA, 21 bp, Homo sapiens
tttcaaattggagcttcatgg

SEQ ID NO: 2482805 - DNA, 17 bp, Homo sapiens
tttcaacagtgaagaca

SEQ ID NO: 2482806 - DNA, 23 bp, Homo sapiens
tttcaacggaaagtgctgtctta

SEQ ID NO: 2482807 - DNA, 22 bp, Homo sapiens
tttcaagcagtcgtgcctgtgt

SEQ ID NO: 2482808 - DNA, 23 bp, Homo sapiens
tttcaagcagtcgtgcctgtgtc

SEQ ID NO: 2482809 - DNA, 19 bp, Homo sapiens
tttcaaggcactctagatt

SEQ ID NO: 2482810 - DNA, 21 bp, Homo sapiens
tttcaaggcactctagattcc

SEQ ID NO: 2482811 - DNA, 22 bp, Homo sapiens
tttcaaggcactctagattcca

SEQ ID NO: 2482812 - DNA, 22 bp, Homo sapiens
tttcaataaaagataaattatt

SEQ ID NO: 2482813 - DNA, 13 bp, Homo sapiens
tttcaatagccac

SEQ ID NO: 2482814 - DNA, 22 bp, Homo sapiens
tttcaattccacctgcaatcaa

SEQ ID NO: 2482815 - DNA, 17 bp, Homo sapiens
tttcacagaaaataagg

SEQ ID NO: 2482816 - DNA, 22 bp, Homo sapiens
tttcagagttctttttgaagta

SEQ ID NO: 2482817 - DNA, 23 bp, Homo sapiens
tttcagatatcttggacaaatca

SEQ ID NO: 2482818 - DNA, 18 bp, Homo sapiens
tttcagatgtgaaccatt

SEQ ID NO: 2482819 - DNA, 12 bp, Homo sapiens
tttcagcactag

SEQ ID NO: 2482820 - DNA, 21 bp, Homo sapiens
tttcagctcctgaccagttgc

SEQ ID NO: 2482821 - DNA, 19 bp, Homo sapiens
tttcaggaggaatactgaa

SEQ ID NO: 2482822 - DNA, 22 bp, Homo sapiens
tttcaggaggaatactgaacat

SEQ ID NO: 2482823 - DNA, 21 bp, Homo sapiens
tttcagtggggcagtcattat

SEQ ID NO: 2482824 - DNA, 15 bp, Homo sapiens
tttcagttctaggaa

SEQ ID NO: 2482825 - DNA, 14 bp, Homo sapiens
tttcatagttcaga

SEQ ID NO: 2482826 - DNA, 15 bp, Homo sapiens
tttcatagttcagaa

SEQ ID NO: 2482827 - DNA, 17 bp, Homo sapiens
tttcatattttaaacag

SEQ ID NO: 2482828 - DNA, 17 bp, Homo sapiens
tttcatccataactgaa

SEQ ID NO: 2482829 - DNA, 19 bp, Homo sapiens
tttcatccataactgaaca

SEQ ID NO: 2482830 - DNA, 17 bp, Homo sapiens
tttcatcttcagttgtc

SEQ ID NO: 2482831 - DNA, 23 bp, Homo sapiens
tttcatgcgatgacacttgtaca

SEQ ID NO: 2482832 - DNA, 19 bp, Homo sapiens
tttcatgtaaactgtgcac

SEQ ID NO: 2482833 - DNA, 18 bp, Homo sapiens
tttcatgtacaagatgaa

SEQ ID NO: 2482834 - DNA, 14 bp, Homo sapiens
tttcattaaataaa

SEQ ID NO: 2482835 - DNA, 15 bp, Homo sapiens
tttcattaaataaat

SEQ ID NO: 2482836 - DNA, 18 bp, Homo sapiens
tttcattaaataaatttg

SEQ ID NO: 2482837 - DNA, 21 bp, Homo sapiens
tttcattccttcagatttggc

SEQ ID NO: 2482838 - DNA, 19 bp, Homo sapiens
tttcatttagtcatgtgac

SEQ ID NO: 2482839 - DNA, 19 bp, Homo sapiens
tttcatttggttcattaat

SEQ ID NO: 2482840 - DNA, 18 bp, Homo sapiens
tttccaactactaataga

SEQ ID NO: 2482841 - DNA, 19 bp, Homo sapiens
tttccaccacagccagcac

SEQ ID NO: 2482842 - DNA, 20 bp, Homo sapiens
tttccagcattcccaggtag

SEQ ID NO: 2482843 - DNA, 12 bp, Homo sapiens
tttccatcttta

SEQ ID NO: 2482844 - DNA, 19 bp, Homo sapiens
tttccatgggaccacaact

SEQ ID NO: 2482845 - DNA, 21 bp, Homo sapiens
tttccatttgcatttgtttat

SEQ ID NO: 2482846 - DNA, 22 bp, Homo sapiens
tttcccaaagcatccctcttag

SEQ ID NO: 2482847 - DNA, 12 bp, Homo sapiens
tttcccaattca

SEQ ID NO: 2482848 - DNA, 23 bp, Homo sapiens
tttcccaccccaacctgctctcc

SEQ ID NO: 2482849 - DNA, 11 bp, Homo sapiens
tttcccaggac

SEQ ID NO: 2482850 - DNA, 16 bp, Homo sapiens
tttcccaggaccctga

SEQ ID NO: 2482851 - DNA, 22 bp, Homo sapiens
tttcccaggcccactgtgcctc

SEQ ID NO: 2482852 - DNA, 16 bp, Homo sapiens
tttccctaccctctag

SEQ ID NO: 2482853 - DNA, 12 bp, Homo sapiens
tttccctggtcc

SEQ ID NO: 2482854 - DNA, 16 bp, Homo sapiens
tttcccttcagtaccc

SEQ ID NO: 2482855 - DNA, 20 bp, Homo sapiens
tttcccttcagtaccctctc

SEQ ID NO: 2482856 - DNA, 20 bp, Homo sapiens
tttcccttgtagctcctccc

SEQ ID NO: 2482857 - DNA, 19 bp, Homo sapiens
tttcctcagactctaagaa

SEQ ID NO: 2482858 - DNA, 22 bp, Homo sapiens
tttcctcctgaggctttggatt

SEQ ID NO: 2482859 - DNA, 19 bp, Homo sapiens
ttttccaggcttctgctgg

SEQ ID NO: 2482860 - DNA, 20 bp, Homo sapiens
ttttccaggcttctgctggg

SEQ ID NO: 2482861 - DNA, 18 bp, Homo sapiens
ttttcccaaaatgttgaa

SEQ ID NO: 2482862 - DNA, 17 bp, Homo sapiens
ttttcccactccaagcc

SEQ ID NO: 2482863 - DNA, 14 bp, Homo sapiens
ttttccctttgcct

SEQ ID NO: 2482864 - DNA, 20 bp, Homo sapiens
ttttcctaataaagttctgt

SEQ ID NO: 2482865 - DNA, 16 bp, Homo sapiens
ttttcctcctgagtgc

SEQ ID NO: 2482866 - DNA, 16 bp, Homo sapiens
ttttcctctccacaca

SEQ ID NO: 2482867 - DNA, 22 bp, Homo sapiens
ttttcctgtcctctttcagctc

SEQ ID NO: 2482868 - DNA, 16 bp, Homo sapiens
ttttccttcaaagttt

SEQ ID NO: 2482869 - DNA, 15 bp, Homo sapiens
ttttcgaaaatcaaa

SEQ ID NO: 2482870 - DNA, 19 bp, Homo sapiens
ttttcggccccatgtatct

SEQ ID NO: 2482871 - DNA, 13 bp, Homo sapiens
ttttctattaaaa

SEQ ID NO: 2482872 - DNA, 14 bp, Homo sapiens
ttttctattaaaag

SEQ ID NO: 2482873 - DNA, 11 bp, Homo sapiens
ttttctttctc

SEQ ID NO: 2482874 - DNA, 14 bp, Homo sapiens
ttttgaaggcaaaa

SEQ ID NO: 2482875 - DNA, 14 bp, Homo sapiens
ttttgaagtattta

SEQ ID NO: 2482876 - DNA, 13 bp, Homo sapiens
ttttgagatatta

SEQ ID NO: 2482877 - DNA, 15 bp, Homo sapiens
ttttgaggagcccca

SEQ ID NO: 2482878 - DNA, 20 bp, Homo sapiens
ttttgatttaatgttttcag

SEQ ID NO: 2482879 - DNA, 20 bp, Homo sapiens
ttttgcacatgtttcctcta

SEQ ID NO: 2482880 - DNA, 14 bp, Homo sapiens
ttttgcagtaactg

SEQ ID NO: 2482881 - DNA, 15 bp, Homo sapiens
ttttgcagtaactgt

SEQ ID NO: 2482882 - DNA, 17 bp, Homo sapiens
ttttgcccattttgaat

SEQ ID NO: 2482883 - DNA, 19 bp, Homo sapiens
ttttgcccattttgaatca

SEQ ID NO: 2482884 - DNA, 21 bp, Homo sapiens
ttttgcggttcaggaaaattg

SEQ ID NO: 2482885 - DNA, 21 bp, Homo sapiens
ttttgcttttggcaaaactct

SEQ ID NO: 2482886 - DNA, 21 bp, Homo sapiens
ttttggtccaagttgtgctta

SEQ ID NO: 2482887 - DNA, 17 bp, Homo sapiens
ttttgtaataataaaga

SEQ ID NO: 2482888 - DNA, 24 bp, Homo sapiens
ttttgtataattggatttcctaat

SEQ ID NO: 2482889 - DNA, 13 bp, Homo sapiens
ttttgttgacatt

SEQ ID NO: 2482890 - DNA, 20 bp, Homo sapiens
ttttgttgacattctgaatg

SEQ ID NO: 2482891 - DNA, 21 bp, Homo sapiens
ttttgttggcatagctctggg

SEQ ID NO: 2482892 - DNA, 17 bp, Homo sapiens
ttttgtttttcattcag

SEQ ID NO: 2482893 - DNA, 17 bp, Homo sapiens
tttttaaaaaagcttaa

SEQ ID NO: 2482894 - DNA, 24 bp, Homo sapiens
tgtcctgccacccagccccagcca

SEQ ID NO: 2482895 - DNA, 24 bp, Homo sapiens
tgtcctgcctattatctgtcagct

SEQ ID NO: 2482896 - DNA, 16 bp, Homo sapiens
tgtcctgcctgtggcc

SEQ ID NO: 2482897 - DNA, 13 bp, Homo sapiens
tgtcctggtggta

SEQ ID NO: 2482898 - DNA, 19 bp, Homo sapiens
tgtcctggtggtattttca

SEQ ID NO: 2482899 - DNA, 15 bp, Homo sapiens
tgtcctggttcccgt

SEQ ID NO: 2482900 - DNA, 17 bp, Homo sapiens
tgtccttagcctggacc

SEQ ID NO: 2482901 - DNA, 12 bp, Homo sapiens
tgtcgctgcttc

SEQ ID NO: 2482902 - DNA, 20 bp, Homo sapiens
tgtcgtggacacacacagac

SEQ ID NO: 2482903 - DNA, 23 bp, Homo sapiens
tgtctaagaaattgaatactttg

SEQ ID NO: 2482904 - DNA, 14 bp, Homo sapiens
tgtctaagattcta

SEQ ID NO: 2482905 - DNA, 15 bp, Homo sapiens
tgtctaagattctag

SEQ ID NO: 2482906 - DNA, 17 bp, Homo sapiens
tgtctaagattctagat

SEQ ID NO: 2482907 - DNA, 14 bp, Homo sapiens
tgtctataaagcat

SEQ ID NO: 2482908 - DNA, 16 bp, Homo sapiens
tgtctcacctggactt

SEQ ID NO: 2482909 - DNA, 11 bp, Homo sapiens
tgtctcatcca

SEQ ID NO: 2482910 - DNA, 16 bp, Homo sapiens
tgtctcatccatcatc

SEQ ID NO: 2482911 - DNA, 16 bp, Homo sapiens
tgtctcctaagcacct

SEQ ID NO: 2482912 - DNA, 17 bp, Homo sapiens
tgtctcgagcgccctgc

SEQ ID NO: 2482913 - DNA, 16 bp, Homo sapiens
tgtctctcctgcccct

SEQ ID NO: 2482914 - DNA, 19 bp, Homo sapiens
tgtctctgatgcagcttat

SEQ ID NO: 2482915 - DNA, 22 bp, Homo sapiens
tgtctcttgcctgccactgtgt

SEQ ID NO: 2482916 - DNA, 16 bp, Homo sapiens
tgtctgaacttgcatt

SEQ ID NO: 2482917 - DNA, 18 bp, Homo sapiens
tgtctgaacttgcattgt

SEQ ID NO: 2482918 - DNA, 19 bp, Homo sapiens
tgtctgccaacctaaaact

SEQ ID NO: 2482919 - DNA, 15 bp, Homo sapiens
tgtctggcaatgcca

SEQ ID NO: 2482920 - DNA, 16 bp, Homo sapiens
tgtctgggtgctactg

SEQ ID NO: 2482921 - DNA, 16 bp, Homo sapiens
tgtctggtggccccgt

SEQ ID NO: 2482922 - DNA, 14 bp, Homo sapiens
tgtctggttctcaa

SEQ ID NO: 2482923 - DNA, 20 bp, Homo sapiens
tgtcttaaactaaatgtgca

SEQ ID NO: 2482924 - DNA, 15 bp, Homo sapiens
tgtcttaattattat

SEQ ID NO: 2482925 - DNA, 13 bp, Homo sapiens
tgtcttgggcaga

SEQ ID NO: 2482926 - DNA, 17 bp, Homo sapiens
tgtctttagatagccct

SEQ ID NO: 2482927 - DNA, 16 bp, Homo sapiens
tgtctttttttgtata

SEQ ID NO: 2482928 - DNA, 14 bp, Homo sapiens
tgtgaacccaggac

SEQ ID NO: 2482929 - DNA, 16 bp, Homo sapiens
tgtgaacccaggacaa

SEQ ID NO: 2482930 - DNA, 21 bp, Homo sapiens
tgtgaagccaattcagacagg

SEQ ID NO: 2482931 - DNA, 23 bp, Homo sapiens
tgtgaagccatgagttccagaaa

SEQ ID NO: 2482932 - DNA, 12 bp, Homo sapiens
tgtgaagccttc

SEQ ID NO: 2482933 - DNA, 23 bp, Homo sapiens
tgtgaaggtgatttaagggccca

SEQ ID NO: 2482934 - DNA, 22 bp, Homo sapiens
tgtgaatcaagggtcaggcctt

SEQ ID NO: 2482935 - DNA, 14 bp, Homo sapiens
tgtgaatgaacact

SEQ ID NO: 2482936 - DNA, 17 bp, Homo sapiens
tgtgaatgaacactctt

SEQ ID NO: 2482937 - DNA, 17 bp, Homo sapiens
tgtgaatgccactgcct

SEQ ID NO: 2482938 - DNA, 16 bp, Homo sapiens
tgtgaattaagcccaa

SEQ ID NO: 2482939 - DNA, 19 bp, Homo sapiens
tgtgaattaggctgtaact

SEQ ID NO: 2482940 - DNA, 12 bp, Homo sapiens
tgtgacagggcg

SEQ ID NO: 2482941 - DNA, 17 bp, Homo sapiens
tgtgacatttatatatt

SEQ ID NO: 2482942 - DNA, 15 bp, Homo sapiens
tgtgacccccagctc

SEQ ID NO: 2482943 - DNA, 17 bp, Homo sapiens
tgtgacctgctgagctc

SEQ ID NO: 2482944 - DNA, 20 bp, Homo sapiens
tgtgactggctaaagctcga

SEQ ID NO: 2482945 - DNA, 23 bp, Homo sapiens
tgtgacttctattttaaagacaa

SEQ ID NO: 2482946 - DNA, 18 bp, Homo sapiens
tgtgagcccagctgggtc

SEQ ID NO: 2482947 - DNA, 14 bp, Homo sapiens
tgtgaggccagggc

SEQ ID NO: 2482948 - DNA, 15 bp, Homo sapiens
tgtgaggccagggca

SEQ ID NO: 2482949 - DNA, 22 bp, Homo sapiens
tgtgaggccagggcagagtgag

SEQ ID NO: 2482950 - DNA, 16 bp, Homo sapiens
tgtgagtcaatacata

SEQ ID NO: 2482951 - DNA, 21 bp, Homo sapiens
tgtgagtctttggttctaagg

SEQ ID NO: 2482952 - DNA, 17 bp, Homo sapiens
tgtgagtgtttttatct

SEQ ID NO: 2482953 - DNA, 13 bp, Homo sapiens
tgtgatatataag

SEQ ID NO: 2482954 - DNA, 14 bp, Homo sapiens
tgtgatattctaag

SEQ ID NO: 2482955 - DNA, 18 bp, Homo sapiens
tgtgatgtaccagtttgt

SEQ ID NO: 2482956 - DNA, 22 bp, Homo sapiens
tgtgatgtaccagtttgtccat

SEQ ID NO: 2482957 - DNA, 18 bp, Homo sapiens
tgtgatgtcatacagaga

SEQ ID NO: 2482958 - DNA, 13 bp, Homo sapiens
tgtgatgttctaa

SEQ ID NO: 2482959 - DNA, 16 bp, Homo sapiens
tgtgatgttctaaggc

SEQ ID NO: 2482960 - DNA, 18 bp, Homo sapiens
tgtgatgttctaaggctc

SEQ ID NO: 2482961 - DNA, 14 bp, Homo sapiens
tgtgattggcctgt

SEQ ID NO: 2482962 - DNA, 15 bp, Homo sapiens
tgtgattggcctgta

SEQ ID NO: 2482963 - DNA, 17 bp, Homo sapiens
tgtgattgtggaatgga

SEQ ID NO: 2482964 - DNA, 15 bp, Homo sapiens
tgtgcaaggcagccg

SEQ ID NO: 2482965 - DNA, 13 bp, Homo sapiens
tgtgcaatagaag

SEQ ID NO: 2482966 - DNA, 17 bp, Homo sapiens
tgtgcaatgtaaatatt

SEQ ID NO: 2482967 - DNA, 11 bp, Homo sapiens
tgtgcaatgtg

SEQ ID NO: 2482968 - DNA, 14 bp, Homo sapiens
tgtgcaatgtgtat

SEQ ID NO: 2482969 - DNA, 21 bp, Homo sapiens
tgtgcacatctgtgtcttgtt

SEQ ID NO: 2482970 - DNA, 14 bp, Homo sapiens
tgtgcaccagggtt

SEQ ID NO: 2482971 - DNA, 20 bp, Homo sapiens
tgtgcacgtaaagtacttgt

SEQ ID NO: 2482972 - DNA, 21 bp, Homo sapiens
tgtgcactgcccatggacagg

SEQ ID NO: 2482973 - DNA, 20 bp, Homo sapiens
tgtgcactggcaccaagtgc

SEQ ID NO: 2482974 - DNA, 18 bp, Homo sapiens
tgtgcaggagcggcagat

SEQ ID NO: 2482975 - DNA, 14 bp, Homo sapiens
tgtgcaggttccca

SEQ ID NO: 2482976 - DNA, 17 bp, Homo sapiens
tgtgcagtcctgggtcc

SEQ ID NO: 2482977 - DNA, 12 bp, Homo sapiens
tgtgcagtgttg

SEQ ID NO: 2482978 - DNA, 13 bp, Homo sapiens
tgtgcatcaggct

SEQ ID NO: 2482979 - DNA, 14 bp, Homo sapiens
tgtgccagagcctg

SEQ ID NO: 2482980 - DNA, 17 bp, Homo sapiens
tgtgccagagcctgggg

SEQ ID NO: 2482981 - DNA, 21 bp, Homo sapiens
tgtgccagggcaatgatgaat

SEQ ID NO: 2482982 - DNA, 13 bp, Homo sapiens
tgtgccctccctg

SEQ ID NO: 2482983 - DNA, 13 bp, Homo sapiens
tgtgccctctggg

SEQ ID NO: 2482984 - DNA, 15 bp, Homo sapiens
tgtgccctctgggct

SEQ ID NO: 2482985 - DNA, 18 bp, Homo sapiens
tgtgccctctgggctctg

SEQ ID NO: 2482986 - DNA, 13 bp, Homo sapiens
tgtgcctcctccc

SEQ ID NO: 2482987 - DNA, 14 bp, Homo sapiens
tgtgccttcgtctt

SEQ ID NO: 2482988 - DNA, 23 bp, Homo sapiens
tgtgccttcgtctttcccatggg

SEQ ID NO: 2482989 - DNA, 17 bp, Homo sapiens
tgtgcggctgtgtgtgc

SEQ ID NO: 2482990 - DNA, 18 bp, Homo sapiens
tgtgctatggtgctctgt

SEQ ID NO: 2482991 - DNA, 12 bp, Homo sapiens
tgtgctcagccc

SEQ ID NO: 2482992 - DNA, 18 bp, Homo sapiens
tgtgctggaattctaaca

SEQ ID NO: 2482993 - DNA, 10 bp, Homo sapiens
tgtgctggga

SEQ ID NO: 2482994 - DNA, 21 bp, Homo sapiens
tgtgctgggagctccactctg

SEQ ID NO: 2482995 - DNA, 19 bp, Homo sapiens
tgtgctgtgctatggtgct

SEQ ID NO: 2482996 - DNA, 13 bp, Homo sapiens
tgtgcttattttt

SEQ ID NO: 2482997 - DNA, 19 bp, Homo sapiens
tgtgcttcgggcccttccc

SEQ ID NO: 2482998 - DNA, 16 bp, Homo sapiens
tgtgctttttttgtgt

SEQ ID NO: 2482999 - DNA, 15 bp, Homo sapiens
tgtggaactgctgcc

SEQ ID NO: 2483000 - DNA, 17 bp, Homo sapiens
tgtggatcagagatgca

SEQ ID NO: 2483001 - DNA, 20 bp, Homo sapiens
tgtggcagagttacagttct

SEQ ID NO: 2483002 - DNA, 21 bp, Homo sapiens
tgtggcagagttacagttctg

SEQ ID NO: 2483003 - DNA, 11 bp, Homo sapiens
tgtggccagga

SEQ ID NO: 2483004 - DNA, 23 bp, Homo sapiens
tgtggccatgaccctgcctctcc

SEQ ID NO: 2483005 - DNA, 13 bp, Homo sapiens
tgtggccccaccc

SEQ ID NO: 2483006 - DNA, 23 bp, Homo sapiens
tgtggccccaccctgggccctgg

SEQ ID NO: 2483007 - DNA, 19 bp, Homo sapiens
tgtggcctaagaggctgcc

SEQ ID NO: 2483008 - DNA, 19 bp, Homo sapiens
tgtggcgccgtctccaggg

SEQ ID NO: 2483009 - DNA, 12 bp, Homo sapiens
tgtgggagcctc

SEQ ID NO: 2483010 - DNA, 22 bp, Homo sapiens
tgtgggatgttcagcactgtcc

SEQ ID NO: 2483011 - DNA, 16 bp, Homo sapiens
tgtgggattatgggtc

SEQ ID NO: 2483012 - DNA, 18 bp, Homo sapiens
tgtgggattatgggtcac

SEQ ID NO: 2483013 - DNA, 23 bp, Homo sapiens
tgtgggattatgggtcacaggaa

SEQ ID NO: 2483014 - DNA, 19 bp, Homo sapiens
tgtgggcctgggctcctgg

SEQ ID NO: 2483015 - DNA, 15 bp, Homo sapiens
tgtgggttccacaga

SEQ ID NO: 2483016 - DNA, 20 bp, Homo sapiens
tgtggtaagcaacatggctt

SEQ ID NO: 2483017 - DNA, 15 bp, Homo sapiens
tgtggtacagagaag

SEQ ID NO: 2483018 - DNA, 18 bp, Homo sapiens
tgtggtacagagaagcca

SEQ ID NO: 2483019 - DNA, 16 bp, Homo sapiens
tgtggtacatggtgtt

SEQ ID NO: 2483020 - DNA, 15 bp, Homo sapiens
tgtggtcacagctgt

SEQ ID NO: 2483021 - DNA, 23 bp, Homo sapiens
tgtggtcacagctgtatagctgc

SEQ ID NO: 2483022 - DNA, 23 bp, Homo sapiens
tgtggtgtgtccccctctgtcca

SEQ ID NO: 2483023 - DNA, 15 bp, Homo sapiens
tgtggtttatatatt

SEQ ID NO: 2483024 - DNA, 17 bp, Homo sapiens
tgtggtttcatgttagt

SEQ ID NO: 2483025 - DNA, 19 bp, Homo sapiens
tgtggttttcttttgccat

SEQ ID NO: 2483026 - DNA, 21 bp, Homo sapiens
tgtgtaattagtgccacttaa

SEQ ID NO: 2483027 - DNA, 12 bp, Homo sapiens
tgtgtagccttt

SEQ ID NO: 2483028 - DNA, 14 bp, Homo sapiens
tgtgtagccttttt

SEQ ID NO: 2483029 - DNA, 21 bp, Homo sapiens
tgtgtataaaaataaaaaaga

SEQ ID NO: 2483030 - DNA, 14 bp, Homo sapiens
tgtgtataaacaag

SEQ ID NO: 2483031 - DNA, 13 bp, Homo sapiens
tgtgtatatggac

SEQ ID NO: 2483032 - DNA, 19 bp, Homo sapiens
tgtgtatgcacatgaactt

SEQ ID NO: 2483033 - DNA, 15 bp, Homo sapiens
tgtgtatttgctaat

SEQ ID NO: 2483034 - DNA, 23 bp, Homo sapiens
tgtgtccaaaaccgccagctctg

SEQ ID NO: 2483035 - DNA, 20 bp, Homo sapiens
tgtgtccatgcgctcagggc

SEQ ID NO: 2483036 - DNA, 23 bp, Homo sapiens
tgtgtcccagaagatgactgagg

SEQ ID NO: 2483037 - DNA, 20 bp, Homo sapiens
tgtgtcccatgatccctgtg

SEQ ID NO: 2483038 - DNA, 21 bp, Homo sapiens
tgtgtccccctctgtccaggc

SEQ ID NO: 2483039 - DNA, 14 bp, Homo sapiens
tgtgtcctgacact

SEQ ID NO: 2483040 - DNA, 17 bp, Homo sapiens
tgtgtctaagattctag

SEQ ID NO: 2483041 - DNA, 18 bp, Homo sapiens
tgtgtctaagattctaga

SEQ ID NO: 2483042 - DNA, 19 bp, Homo sapiens
tgtgtctaagattctagat

SEQ ID NO: 2483043 - DNA, 22 bp, Homo sapiens
tgtgtgaatgaacactcttttg

SEQ ID NO: 2483044 - DNA, 22 bp, Homo sapiens
tgtgtgcaacagggtatggact

SEQ ID NO: 2483045 - DNA, 15 bp, Homo sapiens
tgtgtgcatcaggct

SEQ ID NO: 2483046 - DNA, 22 bp, Homo sapiens
tgtgtgcatcaggctttctttt

SEQ ID NO: 2483047 - DNA, 22 bp, Homo sapiens
tgtgtggagagggaatgtgaaa

SEQ ID NO: 2483048 - DNA, 14 bp, Homo sapiens
tgtgtggattcttt

SEQ ID NO: 2483049 - DNA, 22 bp, Homo sapiens
tgtgtgtccacgactgtctcca

SEQ ID NO: 2483050 - DNA, 13 bp, Homo sapiens
tgtgtgtgtgaat

SEQ ID NO: 2483051 - DNA, 20 bp, Homo sapiens
tgtgtgttaagctctgctat

SEQ ID NO: 2483052 - DNA, 15 bp, Homo sapiens
tgtgttgatactgtt

SEQ ID NO: 2483053 - DNA, 16 bp, Homo sapiens
tgtgttgatactgttg

SEQ ID NO: 2483054 - DNA, 20 bp, Homo sapiens
tgtgttgatactgttgcacg

SEQ ID NO: 2483055 - DNA, 13 bp, Homo sapiens
tgtgttgccaagc

SEQ ID NO: 2483056 - DNA, 16 bp, Homo sapiens
tgtgttgccaagctcc

SEQ ID NO: 2483057 - DNA, 12 bp, Homo sapiens
tgtgttggctgt

SEQ ID NO: 2483058 - DNA, 13 bp, Homo sapiens
tgtgttgtctcta

SEQ ID NO: 2483059 - DNA, 19 bp, Homo sapiens
tgtgtttcacagtttgaaa

SEQ ID NO: 2483060 - DNA, 23 bp, Homo sapiens
tgtgtttcacagtttgaaataag

SEQ ID NO: 2483061 - DNA, 15 bp, Homo sapiens
tgtgtttgctttctg

SEQ ID NO: 2483062 - DNA, 17 bp, Homo sapiens
tgtgtttggaagactat

SEQ ID NO: 2483063 - DNA, 15 bp, Homo sapiens
tgtgtttttaacatg

SEQ ID NO: 2483064 - DNA, 15 bp, Homo sapiens
tgtgtttttctatta

SEQ ID NO: 2483065 - DNA, 16 bp, Homo sapiens
tgtgtttttctattaa

SEQ ID NO: 2483066 - DNA, 19 bp, Homo sapiens
tgttaaaaaaataagaaga

SEQ ID NO: 2483067 - DNA, 23 bp, Homo sapiens
tgttaaaaaaataagaagaatgc

SEQ ID NO: 2483068 - DNA, 13 bp, Homo sapiens
tgttaacagaagg

SEQ ID NO: 2483069 - DNA, 21 bp, Homo sapiens
tgttaacagaagggagggcag

SEQ ID NO: 2483070 - DNA, 15 bp, Homo sapiens
tgttaagtattttca

SEQ ID NO: 2483071 - DNA, 17 bp, Homo sapiens
tgttaagtattttcata

SEQ ID NO: 2483072 - DNA, 15 bp, Homo sapiens
tgttacctgaaaaca

SEQ ID NO: 2483073 - DNA, 20 bp, Homo sapiens
tgttactaaaaaaaagatga

SEQ ID NO: 2483074 - DNA, 12 bp, Homo sapiens
tgttactgtaat

SEQ ID NO: 2483075 - DNA, 14 bp, Homo sapiens
tgttactgtaattc

SEQ ID NO: 2483076 - DNA, 15 bp, Homo sapiens
tgttactgtaattcc

SEQ ID NO: 2483077 - DNA, 15 bp, Homo sapiens
tgttagtcatttgct

SEQ ID NO: 2483078 - DNA, 12 bp, Homo sapiens
tgttatataatt

SEQ ID NO: 2483079 - DNA, 15 bp, Homo sapiens
tgttatataatttag

SEQ ID NO: 2483080 - DNA, 16 bp, Homo sapiens
tgttatatataaatat

SEQ ID NO: 2483081 - DNA, 20 bp, Homo sapiens
tgttatcttctcaagttcta

SEQ ID NO: 2483082 - DNA, 23 bp, Homo sapiens
tgttatcttctcaagttctaaga

SEQ ID NO: 2483083 - DNA, 23 bp, Homo sapiens
tgttattagagattacctcctga

SEQ ID NO: 2483084 - DNA, 14 bp, Homo sapiens
tgttatttaaagaa

SEQ ID NO: 2483085 - DNA, 14 bp, Homo sapiens
tgttattttgcaac

SEQ ID NO: 2483086 - DNA, 22 bp, Homo sapiens
tgttcaaagccagcgtcctcct

SEQ ID NO: 2483087 - DNA, 14 bp, Homo sapiens
tgttcagcactgtc

SEQ ID NO: 2483088 - DNA, 17 bp, Homo sapiens
tgttcagcactgtccct

SEQ ID NO: 2483089 - DNA, 20 bp, Homo sapiens
tgttccaaattcagtttcat

SEQ ID NO: 2483090 - DNA, 22 bp, Homo sapiens
tgttccaaattcagtttcataa

SEQ ID NO: 2483091 - DNA, 18 bp, Homo sapiens
tgttccagtaatctaata

SEQ ID NO: 2483092 - DNA, 15 bp, Homo sapiens
tgttccattaaacga

SEQ ID NO: 2483093 - DNA, 22 bp, Homo sapiens
tgttccccactgacagcctccc

SEQ ID NO: 2483094 - DNA, 15 bp, Homo sapiens
tgttccccactggag

SEQ ID NO: 2483095 - DNA, 14 bp, Homo sapiens
tgttccccttccac

SEQ ID NO: 2483096 - DNA, 20 bp, Homo sapiens
tgttccccttccactgaggg

SEQ ID NO: 2483097 - DNA, 23 bp, Homo sapiens
tgttccccttccactgagggcag

SEQ ID NO: 2483098 - DNA, 16 bp, Homo sapiens
tgttctaacctttaca

SEQ ID NO: 2483099 - DNA, 13 bp, Homo sapiens
tgttctaagatgt

SEQ ID NO: 2483100 - DNA, 12 bp, Homo sapiens
tgttctaaggct

SEQ ID NO: 2483101 - DNA, 19 bp, Homo sapiens
tgttctaaggctctgagag

SEQ ID NO: 2483102 - DNA, 14 bp, Homo sapiens
tgttctaagtttct

SEQ ID NO: 2483103 - DNA, 18 bp, Homo sapiens
tgttctaagtttctaaga

SEQ ID NO: 2483104 - DNA, 23 bp, Homo sapiens
tgttctaagtttctaagattcta

SEQ ID NO: 2483105 - DNA, 14 bp, Homo sapiens
tgttctagtttttt

SEQ ID NO: 2483106 - DNA, 22 bp, Homo sapiens
tgttctcctgctgctccctcag

SEQ ID NO: 2483107 - DNA, 23 bp, Homo sapiens
tgttctcctgctgctccctcaga

SEQ ID NO: 2483108 - DNA, 21 bp, Homo sapiens
tgttctccttttcctctctcc

SEQ ID NO: 2483109 - DNA, 23 bp, Homo sapiens
tgttctcttgggaactgaactca

SEQ ID NO: 2483110 - DNA, 17 bp, Homo sapiens
tgttctgttaactgaat

SEQ ID NO: 2483111 - DNA, 19 bp, Homo sapiens
tgttctgttaactgaatac

SEQ ID NO: 2483112 - DNA, 13 bp, Homo sapiens
tgttctgttttgt

SEQ ID NO: 2483113 - DNA, 18 bp, Homo sapiens
tgttcttagctcaatgag

SEQ ID NO: 2483114 - DNA, 10 bp, Homo sapiens
tgttcttcct

SEQ ID NO: 2483115 - DNA, 12 bp, Homo sapiens
tgttgacattag

SEQ ID NO: 2483116 - DNA, 22 bp, Homo sapiens
tgttgagaatcccaaatttgat

SEQ ID NO: 2483117 - DNA, 13 bp, Homo sapiens
tgttgagacagag

SEQ ID NO: 2483118 - DNA, 15 bp, Homo sapiens
tgttgatactgttgc

SEQ ID NO: 2483119 - DNA, 16 bp, Homo sapiens
tgttgatactgttgca

SEQ ID NO: 2483120 - DNA, 17 bp, Homo sapiens
tgttgcaagtgcaataa

SEQ ID NO: 2483121 - DNA, 22 bp, Homo sapiens
tgttgccaaatatgtcctgggg

SEQ ID NO: 2483122 - DNA, 21 bp, Homo sapiens
tgttggacaagcttctgagac

SEQ ID NO: 2483123 - DNA, 22 bp, Homo sapiens
tgttggacaagcttctgagacg

SEQ ID NO: 2483124 - DNA, 14 bp, Homo sapiens
tgttgggactgcta

SEQ ID NO: 2483125 - DNA, 21 bp, Homo sapiens
tgttgtagattgattgtattg

SEQ ID NO: 2483126 - DNA, 16 bp, Homo sapiens
tgttgtcaagaatagc

SEQ ID NO: 2483127 - DNA, 13 bp, Homo sapiens
tgttgtcaccaga

SEQ ID NO: 2483128 - DNA, 22 bp, Homo sapiens
tgttgtccttttcataggtctg

SEQ ID NO: 2483129 - DNA, 18 bp, Homo sapiens
tgttgtcgtaaagatttg

SEQ ID NO: 2483130 - DNA, 13 bp, Homo sapiens
tgttgttatttaa

SEQ ID NO: 2483131 - DNA, 13 bp, Homo sapiens
tgttgttctgtta

SEQ ID NO: 2483132 - DNA, 12 bp, Homo sapiens
tgtttaaaactt

SEQ ID NO: 2483133 - DNA, 18 bp, Homo sapiens
tgtttacactctttgtaa

SEQ ID NO: 2483134 - DNA, 19 bp, Homo sapiens
tgtttacactctttgtaag

SEQ ID NO: 2483135 - DNA, 22 bp, Homo sapiens
tgtttacagataattacctact

SEQ ID NO: 2483136 - DNA, 13 bp, Homo sapiens
tgtttacatgctt

SEQ ID NO: 2483137 - DNA, 16 bp, Homo sapiens
tgtttacatgcttatt

SEQ ID NO: 2483138 - DNA, 21 bp, Homo sapiens
tgtttacatgcttattccatg

SEQ ID NO: 2483139 - DNA, 15 bp, Homo sapiens
tgtttactgcaaggt

SEQ ID NO: 2483140 - DNA, 13 bp, Homo sapiens
tgtttagacttta

SEQ ID NO: 2483141 - DNA, 16 bp, Homo sapiens
tgtttatcctttcata

SEQ ID NO: 2483142 - DNA, 16 bp, Homo sapiens
tgtttatgtaatttca

SEQ ID NO: 2483143 - DNA, 16 bp, Homo sapiens
tgtttattcttctaga

SEQ ID NO: 2483144 - DNA, 12 bp, Homo sapiens
tgtttcaagagg

SEQ ID NO: 2483145 - DNA, 22 bp, Homo sapiens
tgtttcaagaggagcccccacc

SEQ ID NO: 2483146 - DNA, 20 bp, Homo sapiens
tgtttcaaggcactctagat

SEQ ID NO: 2483147 - DNA, 16 bp, Homo sapiens
tgtttcaattgcatct

SEQ ID NO: 2483148 - DNA, 13 bp, Homo sapiens
tgtttcacaaggt

SEQ ID NO: 2483149 - DNA, 16 bp, Homo sapiens
tgtttcacaaggtctt

SEQ ID NO: 2483150 - DNA, 20 bp, Homo sapiens
tgtttcacagtttgaaataa

SEQ ID NO: 2483151 - DNA, 15 bp, Homo sapiens
tgtttccagcattcc

SEQ ID NO: 2483152 - DNA, 18 bp, Homo sapiens
tgtttccagcattcccag

SEQ ID NO: 2483153 - DNA, 20 bp, Homo sapiens
tgtttccctttcactggcat

SEQ ID NO: 2483154 - DNA, 16 bp, Homo sapiens
tgtttcctttttcaga

SEQ ID NO: 2483155 - DNA, 13 bp, Homo sapiens
tgtttctccccca

SEQ ID NO: 2483156 - DNA, 11 bp, Homo sapiens
tgtttctgtaa

SEQ ID NO: 2483157 - DNA, 15 bp, Homo sapiens
tgtttgaggaaagca

SEQ ID NO: 2483158 - DNA, 13 bp, Homo sapiens
tgtttgatagatt

SEQ ID NO: 2483159 - DNA, 15 bp, Homo sapiens
tgtttgcttcaactg

SEQ ID NO: 2483160 - DNA, 12 bp, Homo sapiens
tgtttggaaata

SEQ ID NO: 2483161 - DNA, 18 bp, Homo sapiens
tgtttggaatattgtcca

SEQ ID NO: 2483162 - DNA, 12 bp, Homo sapiens
tgtttggctggg

SEQ ID NO: 2483163 - DNA, 15 bp, Homo sapiens
tgtttggggcaggag

SEQ ID NO: 2483164 - DNA, 14 bp, Homo sapiens
tgtttgtgctgtgg

SEQ ID NO: 2483165 - DNA, 15 bp, Homo sapiens
tgtttgtgctgtggt

SEQ ID NO: 2483166 - DNA, 11 bp, Homo sapiens
tgtttgttggt

SEQ ID NO: 2483167 - DNA, 14 bp, Homo sapiens
tgttttatgagaaa

SEQ ID NO: 2483168 - DNA, 17 bp, Homo sapiens
tgttttcttttggtaaa

SEQ ID NO: 2483169 - DNA, 18 bp, Homo sapiens
tgttttgcacagccaaat

SEQ ID NO: 2483170 - DNA, 14 bp, Homo sapiens
tgttttgctaaagg

SEQ ID NO: 2483171 - DNA, 18 bp, Homo sapiens
tgttttggctgaaattct

SEQ ID NO: 2483172 - DNA, 12 bp, Homo sapiens
tgttttgttgac

SEQ ID NO: 2483173 - DNA, 13 bp, Homo sapiens
tgttttgttgaca

SEQ ID NO: 2483174 - DNA, 15 bp, Homo sapiens
tgttttgttgacatt

SEQ ID NO: 2483175 - DNA, 21 bp, Homo sapiens
tgttttgttgacattctgaat

SEQ ID NO: 2483176 - DNA, 15 bp, Homo sapiens
tgtttttaaactgta

SEQ ID NO: 2483177 - DNA, 19 bp, Homo sapiens
tgtttttaaactgtacagt

SEQ ID NO: 2483178 - DNA, 16 bp, Homo sapiens
tgtttttatcttttta

SEQ ID NO: 2483179 - DNA, 11 bp, Homo sapiens
tgtttttcatt

SEQ ID NO: 2483180 - DNA, 16 bp, Homo sapiens
tgtttttccttccaat

SEQ ID NO: 2483181 - DNA, 13 bp, Homo sapiens
tgtttttctaaag

SEQ ID NO: 2483182 - DNA, 16 bp, Homo sapiens
tgtttttgcacatgtt

SEQ ID NO: 2483183 - DNA, 15 bp, Homo sapiens
tgttttttgccacag

SEQ ID NO: 2483184 - DNA, 18 bp, Homo sapiens
tgttttttgccacagctt

SEQ ID NO: 2483185 - DNA, 15 bp, Homo sapiens
tgtttttttgtttgt

SEQ ID NO: 2483186 - DNA, 12 bp, Homo sapiens
ttaaaaaaataa

SEQ ID NO: 2483187 - DNA, 15 bp, Homo sapiens
ttaaaaaagataaac

SEQ ID NO: 2483188 - DNA, 12 bp, Homo sapiens
ttaaaaaagctt

SEQ ID NO: 2483189 - DNA, 19 bp, Homo sapiens
ttaaaaaagcttaaaactt

SEQ ID NO: 2483190 - DNA, 13 bp, Homo sapiens
ttaaaaagccagt

SEQ ID NO: 2483191 - DNA, 20 bp, Homo sapiens
ttaaaaaggcagtttgcaaa

SEQ ID NO: 2483192 - DNA, 22 bp, Homo sapiens
ttaaaaaggcagtttgcaaaaa

SEQ ID NO: 2483193 - DNA, 20 bp, Homo sapiens
ttaaaaagttataaccaact

SEQ ID NO: 2483194 - DNA, 21 bp, Homo sapiens
ttaaaaataagtcaacagtaa

SEQ ID NO: 2483195 - DNA, 17 bp, Homo sapiens
ttaaaaattcagcaaag

SEQ ID NO: 2483196 - DNA, 18 bp, Homo sapiens
ttaaaagcaaatcatttg

SEQ ID NO: 2483197 - DNA, 15 bp, Homo sapiens
ttaaaataattatat

SEQ ID NO: 2483198 - DNA, 22 bp, Homo sapiens
ttaaaatagcaaaagaagaagt

SEQ ID NO: 2483199 - DNA, 22 bp, Homo sapiens
ttaaaatagcgttcttgtaatt

SEQ ID NO: 2483200 - DNA, 23 bp, Homo sapiens
ttaaaatagcgttcttgtaattt

SEQ ID NO: 2483201 - DNA, 12 bp, Homo sapiens
ttaaaatcctca

SEQ ID NO: 2483202 - DNA, 13 bp, Homo sapiens
ttaaaatcctcaa

SEQ ID NO: 2483203 - DNA, 13 bp, Homo sapiens
ttaaaatgttcac

SEQ ID NO: 2483204 - DNA, 19 bp, Homo sapiens
ttaaaatttgttcttgtat

SEQ ID NO: 2483205 - DNA, 13 bp, Homo sapiens
ttaaacacctcct

SEQ ID NO: 2483206 - DNA, 23 bp, Homo sapiens
ttaaacattaatagcagcctttc

SEQ ID NO: 2483207 - DNA, 14 bp, Homo sapiens
ttaaaccatctccc

SEQ ID NO: 2483208 - DNA, 17 bp, Homo sapiens
ttaaaccatctccctgg

SEQ ID NO: 2483209 - DNA, 23 bp, Homo sapiens
ttaaacgctctaggtacgatgac

SEQ ID NO: 2483210 - DNA, 14 bp, Homo sapiens
ttaaactaaatgtg

SEQ ID NO: 2483211 - DNA, 22 bp, Homo sapiens
ttaaactaggagaaccaaatct

SEQ ID NO: 2483212 - DNA, 13 bp, Homo sapiens
ttaaactgtacag

SEQ ID NO: 2483213 - DNA, 15 bp, Homo sapiens
ttaaactgtacagtg

SEQ ID NO: 2483214 - DNA, 16 bp, Homo sapiens
ttaaactgtacagtgt

SEQ ID NO: 2483215 - DNA, 17 bp, Homo sapiens
ttaaacttttaattcat

SEQ ID NO: 2483216 - DNA, 18 bp, Homo sapiens
ttaaacttttaattcatt

SEQ ID NO: 2483217 - DNA, 18 bp, Homo sapiens
ttaaagaaaaaaatgtat

SEQ ID NO: 2483218 - DNA, 16 bp, Homo sapiens
ttaaagaatatgaaac

SEQ ID NO: 2483219 - DNA, 18 bp, Homo sapiens
ttaaagagtctagattca

SEQ ID NO: 2483220 - DNA, 20 bp, Homo sapiens
ttaaagcaggttcttgttgg

SEQ ID NO: 2483221 - DNA, 21 bp, Homo sapiens
ttaaaggggagacctcagaag

SEQ ID NO: 2483222 - DNA, 13 bp, Homo sapiens
ttaaagtattctt

SEQ ID NO: 2483223 - DNA, 20 bp, Homo sapiens
ttaaagtgactaatggcatg

SEQ ID NO: 2483224 - DNA, 21 bp, Homo sapiens
ttaaagtgactaatggcatga

SEQ ID NO: 2483225 - DNA, 17 bp, Homo sapiens
ttaaataaatttgactt

SEQ ID NO: 2483226 - DNA, 22 bp, Homo sapiens
ttaaataaatttgacttttctg

SEQ ID NO: 2483227 - DNA, 15 bp, Homo sapiens
ttaaataagaaactt

SEQ ID NO: 2483228 - DNA, 17 bp, Homo sapiens
ttaaataagaaactttt

SEQ ID NO: 2483229 - DNA, 14 bp, Homo sapiens
ttaaataagattct

SEQ ID NO: 2483230 - DNA, 17 bp, Homo sapiens
ttaaataagattctaac

SEQ ID NO: 2483231 - DNA, 18 bp, Homo sapiens
ttaaataagattctaacg

SEQ ID NO: 2483232 - DNA, 20 bp, Homo sapiens
ttaaatacaggaaacagttg

SEQ ID NO: 2483233 - DNA, 13 bp, Homo sapiens
ttaaatacagtct

SEQ ID NO: 2483234 - DNA, 16 bp, Homo sapiens
ttaaatctcattgctt

SEQ ID NO: 2483235 - DNA, 17 bp, Homo sapiens
ttaaatgaacaagagaa

SEQ ID NO: 2483236 - DNA, 20 bp, Homo sapiens
ttaaatgcaaccatttgaaa

SEQ ID NO: 2483237 - DNA, 13 bp, Homo sapiens
ttaaattacagaa

SEQ ID NO: 2483238 - DNA, 22 bp, Homo sapiens
ttaaattcccgttttgtcactt

SEQ ID NO: 2483239 - DNA, 22 bp, Homo sapiens
ttaacaacatgtttccagcatt

SEQ ID NO: 2483240 - DNA, 17 bp, Homo sapiens
ttaacaattaggcagac

SEQ ID NO: 2483241 - DNA, 17 bp, Homo sapiens
ttaacagaaactttcaa

SEQ ID NO: 2483242 - DNA, 15 bp, Homo sapiens
ttaacagaaattgta

SEQ ID NO: 2483243 - DNA, 20 bp, Homo sapiens
ttaacagaagggagggcaga

SEQ ID NO: 2483244 - DNA, 15 bp, Homo sapiens
ttaacagttgtattt

SEQ ID NO: 2483245 - DNA, 14 bp, Homo sapiens
ttaacataagctat

SEQ ID NO: 2483246 - DNA, 23 bp, Homo sapiens
ttaacattcctcatgaatgtaaa

SEQ ID NO: 2483247 - DNA, 18 bp, Homo sapiens
ttaacccccctgtacaca

SEQ ID NO: 2483248 - DNA, 21 bp, Homo sapiens
ttaactgaataccactctgta

SEQ ID NO: 2483249 - DNA, 14 bp, Homo sapiens
ttaacttcttgctt

SEQ ID NO: 2483250 - DNA, 21 bp, Homo sapiens
ttaacttcttgcttctttcta

SEQ ID NO: 2483251 - DNA, 22 bp, Homo sapiens
ttaagaaatagacagcatgaga

SEQ ID NO: 2483252 - DNA, 20 bp, Homo sapiens
ttaagacactgaaaaatcta

SEQ ID NO: 2483253 - DNA, 18 bp, Homo sapiens
ttaagacatgatttcctt

SEQ ID NO: 2483254 - DNA, 18 bp, Homo sapiens
ttaagacctactgttcta

SEQ ID NO: 2483255 - DNA, 20 bp, Homo sapiens
ttaagacctactgttctaaa

SEQ ID NO: 2483256 - DNA, 13 bp, Homo sapiens
ttaagagtccaag

SEQ ID NO: 2483257 - DNA, 18 bp, Homo sapiens
ttaagatcacagtgaact

SEQ ID NO: 2483258 - DNA, 22 bp, Homo sapiens
ttaagcatctggctctaattca

SEQ ID NO: 2483259 - DNA, 16 bp, Homo sapiens
ttaagccaaaacaatg

SEQ ID NO: 2483260 - DNA, 20 bp, Homo sapiens
ttaagcccagtgcactgaaa

SEQ ID NO: 2483261 - DNA, 14 bp, Homo sapiens
ttaaggtgtagcca

SEQ ID NO: 2483262 - DNA, 22 bp, Homo sapiens
ttaagttatagtgaatactgct

SEQ ID NO: 2483263 - DNA, 21 bp, Homo sapiens
ttaagttgagatagttttcat

SEQ ID NO: 2483264 - DNA, 22 bp, Homo sapiens
ttaagttgagatagttttcatc

SEQ ID NO: 2483265 - DNA, 18 bp, Homo sapiens
ttaagttgctgatgaact

SEQ ID NO: 2483266 - DNA, 14 bp, Homo sapiens
ttaataaaaataat

SEQ ID NO: 2483267 - DNA, 16 bp, Homo sapiens
ttaatagcaaagaatt

SEQ ID NO: 2483268 - DNA, 18 bp, Homo sapiens
ttaatagcaaagaattga

SEQ ID NO: 2483269 - DNA, 15 bp, Homo sapiens
ttaatagcagccttt

SEQ ID NO: 2483270 - DNA, 22 bp, Homo sapiens
ttaatagcagcctttctctctt

SEQ ID NO: 2483271 - DNA, 22 bp, Homo sapiens
ttaatataaagttttatatatt

SEQ ID NO: 2483272 - DNA, 17 bp, Homo sapiens
ttaatataaatgcaaat

SEQ ID NO: 2483273 - DNA, 19 bp, Homo sapiens
ttaatatccctacatgtat

SEQ ID NO: 2483274 - DNA, 17 bp, Homo sapiens
ttaatatcctaaacatc
